United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 144

SEQ ID NO: 6110584 - DNA, 12 bp, Homo sapiens
cctgtagctcag

SEQ ID NO: 6110585 - DNA, 14 bp, Homo sapiens
cctgtagctcagtc

SEQ ID NO: 6110586 - DNA, 14 bp, Homo sapiens
cctgtagctctgcc

SEQ ID NO: 6110587 - DNA, 17 bp, Homo sapiens
cctgtagctttcctggt

SEQ ID NO: 6110588 - DNA, 20 bp, Homo sapiens
cctgtagctttgggcagatt

SEQ ID NO: 6110589 - DNA, 20 bp, Homo sapiens
cctgtaggaaacagaaaaga

SEQ ID NO: 6110590 - DNA, 20 bp, Homo sapiens
cctgtagggtttggacagac

SEQ ID NO: 6110591 - DNA, 19 bp, Homo sapiens
cctgtaggtcaggaccatc

SEQ ID NO: 6110592 - DNA, 17 bp, Homo sapiens
cctgtagtcccagcact

SEQ ID NO: 6110593 - DNA, 18 bp, Homo sapiens
cctgtagtcccagcactt

SEQ ID NO: 6110594 - DNA, 18 bp, Homo sapiens
cctgtagtcccagccact

SEQ ID NO: 6110595 - DNA, 19 bp, Homo sapiens
cctgtagtcccagccactc

SEQ ID NO: 6110596 - DNA, 20 bp, Homo sapiens
cctgtagtgaatcctctgtt

SEQ ID NO: 6110597 - DNA, 14 bp, Homo sapiens
cctgtagtgagaaa

SEQ ID NO: 6110598 - DNA, 16 bp, Homo sapiens
cctgtagtgccccctc

SEQ ID NO: 6110599 - DNA, 23 bp, Homo sapiens
cctgtagtgccccctctaacccc

SEQ ID NO: 6110600 - DNA, 23 bp, Homo sapiens
cctgtagtgcccctcccatggcc

SEQ ID NO: 6110601 - DNA, 20 bp, Homo sapiens
cctgtagtggcaaaaaagaa

SEQ ID NO: 6110602 - DNA, 16 bp, Homo sapiens
cctgtagttaggaaat

SEQ ID NO: 6110603 - DNA, 23 bp, Homo sapiens
cctgtagttaggaaataaaacct

SEQ ID NO: 6110604 - DNA, 17 bp, Homo sapiens
cctgtagttaggcctgg

SEQ ID NO: 6110605 - DNA, 21 bp, Homo sapiens
ctaccagtcgccctctgtgcc

SEQ ID NO: 6110606 - DNA, 20 bp, Homo sapiens
ctaccagtgcaggctggcca

SEQ ID NO: 6110607 - DNA, 15 bp, Homo sapiens
ctaccagtgggcatg

SEQ ID NO: 6110608 - DNA, 14 bp, Homo sapiens
ctaccagttgccct

SEQ ID NO: 6110609 - DNA, 20 bp, Homo sapiens
ctaccagttggcagacagcc

SEQ ID NO: 6110610 - DNA, 14 bp, Homo sapiens
ctaccatacagaca

SEQ ID NO: 6110611 - DNA, 14 bp, Homo sapiens
ctaccatcagctct

SEQ ID NO: 6110612 - DNA, 15 bp, Homo sapiens
ctaccatcagctctg

SEQ ID NO: 6110613 - DNA, 16 bp, Homo sapiens
ctaccatcagctctgc

SEQ ID NO: 6110614 - DNA, 22 bp, Homo sapiens
ctaccatcagctctgccttgca

SEQ ID NO: 6110615 - DNA, 14 bp, Homo sapiens
ctaccatcagggac

SEQ ID NO: 6110616 - DNA, 15 bp, Homo sapiens
ctaccatcagggaca

SEQ ID NO: 6110617 - DNA, 16 bp, Homo sapiens
ctaccatcagggacag

SEQ ID NO: 6110618 - DNA, 11 bp, Homo sapiens
ctaccatctcc

SEQ ID NO: 6110619 - DNA, 13 bp, Homo sapiens
ctaccatctccct

SEQ ID NO: 6110620 - DNA, 19 bp, Homo sapiens
ctaccatgaacagaaaaca

SEQ ID NO: 6110621 - DNA, 17 bp, Homo sapiens
ctaccatgaagtgaaaa

SEQ ID NO: 6110622 - DNA, 19 bp, Homo sapiens
ctaccatggttctgcctcc

SEQ ID NO: 6110623 - DNA, 21 bp, Homo sapiens
ctaccatgtgaaactctaccc

SEQ ID NO: 6110624 - DNA, 22 bp, Homo sapiens
ctaccatgtgaaactctaccct

SEQ ID NO: 6110625 - DNA, 16 bp, Homo sapiens
ctaccattaaaatctt

SEQ ID NO: 6110626 - DNA, 13 bp, Homo sapiens
ctaccattcagtg

SEQ ID NO: 6110627 - DNA, 17 bp, Homo sapiens
ctacccaaaccctaggt

SEQ ID NO: 6110628 - DNA, 12 bp, Homo sapiens
ctacccaaagga

SEQ ID NO: 6110629 - DNA, 14 bp, Homo sapiens
ctacccaaccactc

SEQ ID NO: 6110630 - DNA, 14 bp, Homo sapiens
ctacccaaccctgc

SEQ ID NO: 6110631 - DNA, 16 bp, Homo sapiens
ctacccacacctctgc

SEQ ID NO: 6110632 - DNA, 18 bp, Homo sapiens
ctacccacacctctgcca

SEQ ID NO: 6110633 - DNA, 13 bp, Homo sapiens
ctacccacagggc

SEQ ID NO: 6110634 - DNA, 18 bp, Homo sapiens
ctacccacagggcctgac

SEQ ID NO: 6110635 - DNA, 21 bp, Homo sapiens
ctacccacagggcctgacttt

SEQ ID NO: 6110636 - DNA, 17 bp, Homo sapiens
ctacccaccgatggagc

SEQ ID NO: 6110637 - DNA, 19 bp, Homo sapiens
ctacccacctttcccagaa

SEQ ID NO: 6110638 - DNA, 15 bp, Homo sapiens
ctacccactatcctt

SEQ ID NO: 6110639 - DNA, 19 bp, Homo sapiens
ctacccactatccttcgtg

SEQ ID NO: 6110640 - DNA, 16 bp, Homo sapiens
ctacccactctttgct

SEQ ID NO: 6110641 - DNA, 21 bp, Homo sapiens
ctacccactctttgctacaat

SEQ ID NO: 6110642 - DNA, 22 bp, Homo sapiens
ctacccacttctaaatagcaat

SEQ ID NO: 6110643 - DNA, 19 bp, Homo sapiens
ctacccagatggaaaaata

SEQ ID NO: 6110644 - DNA, 15 bp, Homo sapiens
ctacccagcgagccc

SEQ ID NO: 6110645 - DNA, 17 bp, Homo sapiens
ctacccagcgagccctg

SEQ ID NO: 6110646 - DNA, 20 bp, Homo sapiens
ctacccagcgagccctggtg

SEQ ID NO: 6110647 - DNA, 16 bp, Homo sapiens
ctacccagctgatggg

SEQ ID NO: 6110648 - DNA, 19 bp, Homo sapiens
ctacccaggaggctgaggt

SEQ ID NO: 6110649 - DNA, 11 bp, Homo sapiens
ctacccagggc

SEQ ID NO: 6110650 - DNA, 14 bp, Homo sapiens
ctacccagggcctg

SEQ ID NO: 6110651 - DNA, 13 bp, Homo sapiens
ctacccaggtgct

SEQ ID NO: 6110652 - DNA, 13 bp, Homo sapiens
ctacccagttgcc

SEQ ID NO: 6110653 - DNA, 23 bp, Homo sapiens
ctacccatcggtgtccatttata

SEQ ID NO: 6110654 - DNA, 17 bp, Homo sapiens
ctacccatgagcctgcc

SEQ ID NO: 6110655 - DNA, 16 bp, Homo sapiens
ctaccccaaggccagt

SEQ ID NO: 6110656 - DNA, 17 bp, Homo sapiens
ctaccccacaccagcct

SEQ ID NO: 6110657 - DNA, 13 bp, Homo sapiens
ctaccccaccacg

SEQ ID NO: 6110658 - DNA, 14 bp, Homo sapiens
ctaccccaccacga

SEQ ID NO: 6110659 - DNA, 12 bp, Homo sapiens
ctaccccacctg

SEQ ID NO: 6110660 - DNA, 19 bp, Homo sapiens
ctaccccacctgacctctg

SEQ ID NO: 6110661 - DNA, 19 bp, Homo sapiens
ctaccccagccaggctcct

SEQ ID NO: 6110662 - DNA, 20 bp, Homo sapiens
ctaccccaggatgcatgcag

SEQ ID NO: 6110663 - DNA, 17 bp, Homo sapiens
ctaccccagtcccaggg

SEQ ID NO: 6110664 - DNA, 18 bp, Homo sapiens
ctaccccagtcccaggga

SEQ ID NO: 6110665 - DNA, 16 bp, Homo sapiens
ctaccccagttcctag

SEQ ID NO: 6110666 - DNA, 21 bp, Homo sapiens
ctaccccagttcctagcactg

SEQ ID NO: 6110667 - DNA, 19 bp, Homo sapiens
ctaccccatggtgctagga

SEQ ID NO: 6110668 - DNA, 14 bp, Homo sapiens
ctacccccaaccct

SEQ ID NO: 6110669 - DNA, 19 bp, Homo sapiens
ctacccccagggttgaggg

SEQ ID NO: 6110670 - DNA, 18 bp, Homo sapiens
ctaccccccgtctcctgc

SEQ ID NO: 6110671 - DNA, 17 bp, Homo sapiens
ctaccccctaagagcca

SEQ ID NO: 6110672 - DNA, 12 bp, Homo sapiens
ctaccccctcat

SEQ ID NO: 6110673 - DNA, 13 bp, Homo sapiens
ctaccccctcatc

SEQ ID NO: 6110674 - DNA, 21 bp, Homo sapiens
ctaccccctcatcccccagtt

SEQ ID NO: 6110675 - DNA, 15 bp, Homo sapiens
ctaccccctcctctc

SEQ ID NO: 6110676 - DNA, 17 bp, Homo sapiens
ctaccccctcctctctg

SEQ ID NO: 6110677 - DNA, 21 bp, Homo sapiens
ctaccccctcttcaaagcaga

SEQ ID NO: 6110678 - DNA, 13 bp, Homo sapiens
ctaccccctgaaa

SEQ ID NO: 6110679 - DNA, 20 bp, Homo sapiens
ctacccccttgtctgctgct

SEQ ID NO: 6110680 - DNA, 21 bp, Homo sapiens
ctacccccttgtctgctgctc

SEQ ID NO: 6110681 - DNA, 14 bp, Homo sapiens
ctacccccttttca

SEQ ID NO: 6110682 - DNA, 15 bp, Homo sapiens
ctaccccgactatcc

SEQ ID NO: 6110683 - DNA, 18 bp, Homo sapiens
ctacccctcccagctgac

SEQ ID NO: 6110684 - DNA, 14 bp, Homo sapiens
ctacccctcttcca

SEQ ID NO: 6110685 - DNA, 17 bp, Homo sapiens
ctacccctcttccagct

SEQ ID NO: 6110686 - DNA, 15 bp, Homo sapiens
ctaccccttcctgtc

SEQ ID NO: 6110687 - DNA, 17 bp, Homo sapiens
ctaccccttcctgtcct

SEQ ID NO: 6110688 - DNA, 16 bp, Homo sapiens
ctaccccttgattttc

SEQ ID NO: 6110689 - DNA, 21 bp, Homo sapiens
ctaccccttggaaatgtctgc

SEQ ID NO: 6110690 - DNA, 14 bp, Homo sapiens
ctaccccttgtggg

SEQ ID NO: 6110691 - DNA, 15 bp, Homo sapiens
ctaccccttgtgggc

SEQ ID NO: 6110692 - DNA, 19 bp, Homo sapiens
ctacccgagcccagctaca

SEQ ID NO: 6110693 - DNA, 20 bp, Homo sapiens
ctacccgagcccagctacat

SEQ ID NO: 6110694 - DNA, 15 bp, Homo sapiens
ctacccggcccagag

SEQ ID NO: 6110695 - DNA, 22 bp, Homo sapiens
ctacccggctcgttcccccagg

SEQ ID NO: 6110696 - DNA, 14 bp, Homo sapiens
ctacccgtgcctgg

SEQ ID NO: 6110697 - DNA, 18 bp, Homo sapiens
ctaccctacacctctggg

SEQ ID NO: 6110698 - DNA, 16 bp, Homo sapiens
ctaccctcagcctcca

SEQ ID NO: 6110699 - DNA, 15 bp, Homo sapiens
ctaccctccctgctg

SEQ ID NO: 6110700 - DNA, 16 bp, Homo sapiens
ctaccctccctgctgt

SEQ ID NO: 6110701 - DNA, 17 bp, Homo sapiens
ctaccctccgtttttct

SEQ ID NO: 6110702 - DNA, 12 bp, Homo sapiens
ctaccctcctgc

SEQ ID NO: 6110703 - DNA, 19 bp, Homo sapiens
ctaccctcctgctgagctg

SEQ ID NO: 6110704 - DNA, 21 bp, Homo sapiens
ctaccctcctgctgagctgcc

SEQ ID NO: 6110705 - DNA, 16 bp, Homo sapiens
ctaccctcgggcccac

SEQ ID NO: 6110706 - DNA, 20 bp, Homo sapiens
ctaccctcgggcccacctgg

SEQ ID NO: 6110707 - DNA, 17 bp, Homo sapiens
ctaccctcttagaaaaa

SEQ ID NO: 6110708 - DNA, 16 bp, Homo sapiens
ctaccctcttctcagc

SEQ ID NO: 6110709 - DNA, 22 bp, Homo sapiens
ctaccctgagatctgcacagtc

SEQ ID NO: 6110710 - DNA, 16 bp, Homo sapiens
ctaccctgagtgaaca

SEQ ID NO: 6110711 - DNA, 20 bp, Homo sapiens
ctaccctgatcacctcaggg

SEQ ID NO: 6110712 - DNA, 12 bp, Homo sapiens
ctaccctgcagc

SEQ ID NO: 6110713 - DNA, 15 bp, Homo sapiens
ctaccctgcagcttg

SEQ ID NO: 6110714 - DNA, 13 bp, Homo sapiens
ctaccctgcctcc

SEQ ID NO: 6110715 - DNA, 16 bp, Homo sapiens
ctaccctgctccctgc

SEQ ID NO: 6110716 - DNA, 12 bp, Homo sapiens
ctaccctggcag

SEQ ID NO: 6110717 - DNA, 19 bp, Homo sapiens
ctaccctggcagggacctg

SEQ ID NO: 6110718 - DNA, 18 bp, Homo sapiens
ctaccctgggctctggtc

SEQ ID NO: 6110719 - DNA, 12 bp, Homo sapiens
ctaccctgggtc

SEQ ID NO: 6110720 - DNA, 21 bp, Homo sapiens
ctaccctgggtcctcgggccc

SEQ ID NO: 6110721 - DNA, 19 bp, Homo sapiens
ctaccctgtctgtcccttt

SEQ ID NO: 6110722 - DNA, 23 bp, Homo sapiens
ctaccctgtctgtcccttttctt

SEQ ID NO: 6110723 - DNA, 14 bp, Homo sapiens
ctaccctgtgtata

SEQ ID NO: 6110724 - DNA, 18 bp, Homo sapiens
ctacccttctcctttcct

SEQ ID NO: 6110725 - DNA, 21 bp, Homo sapiens
ctacccttctcctttccttcc

SEQ ID NO: 6110726 - DNA, 17 bp, Homo sapiens
ctacccttgccaaggcc

SEQ ID NO: 6110727 - DNA, 17 bp, Homo sapiens
ctacccttggaaagaaa

SEQ ID NO: 6110728 - DNA, 20 bp, Homo sapiens
ctacccttggaaagaaatgt

SEQ ID NO: 6110729 - DNA, 14 bp, Homo sapiens
ctacccttgtaccc

SEQ ID NO: 6110730 - DNA, 22 bp, Homo sapiens
ctacccttgttagttattttag

SEQ ID NO: 6110731 - DNA, 19 bp, Homo sapiens
ctaccctttcccaaaccct

SEQ ID NO: 6110732 - DNA, 14 bp, Homo sapiens
ctacccttttcctt

SEQ ID NO: 6110733 - DNA, 19 bp, Homo sapiens
ctaccctttttctccagct

SEQ ID NO: 6110734 - DNA, 18 bp, Homo sapiens
ctaccgaatgtgtcttta

SEQ ID NO: 6110735 - DNA, 17 bp, Homo sapiens
ctaccgagtctcttctc

SEQ ID NO: 6110736 - DNA, 13 bp, Homo sapiens
ctaccgagttcaa

SEQ ID NO: 6110737 - DNA, 14 bp, Homo sapiens
ctaccgagttcaag

SEQ ID NO: 6110738 - DNA, 15 bp, Homo sapiens
ctaccgatggtccca

SEQ ID NO: 6110739 - DNA, 23 bp, Homo sapiens
ctaccgccccaaagtaaaagaaa

SEQ ID NO: 6110740 - DNA, 16 bp, Homo sapiens
ctaccgccctgggctg

SEQ ID NO: 6110741 - DNA, 20 bp, Homo sapiens
ctaccgccctgggctggact

SEQ ID NO: 6110742 - DNA, 21 bp, Homo sapiens
ctaccgctcccctctcctccg

SEQ ID NO: 6110743 - DNA, 22 bp, Homo sapiens
ctaccggacactcgtcacccca

SEQ ID NO: 6110744 - DNA, 19 bp, Homo sapiens
ctaccggggaccgggaccc

SEQ ID NO: 6110745 - DNA, 16 bp, Homo sapiens
ctaccgtaattgcttt

SEQ ID NO: 6110746 - DNA, 16 bp, Homo sapiens
ctaccgtactccctgc

SEQ ID NO: 6110747 - DNA, 20 bp, Homo sapiens
ctaccgtactccctgcaccg

SEQ ID NO: 6110748 - DNA, 13 bp, Homo sapiens
ctaccgtgccagc

SEQ ID NO: 6110749 - DNA, 15 bp, Homo sapiens
ctaccgtgccagcag

SEQ ID NO: 6110750 - DNA, 16 bp, Homo sapiens
ctaccgtgccagcagc

SEQ ID NO: 6110751 - DNA, 16 bp, Homo sapiens
ctaccgtggatctcct

SEQ ID NO: 6110752 - DNA, 17 bp, Homo sapiens
ctaccgtggatctcctt

SEQ ID NO: 6110753 - DNA, 22 bp, Homo sapiens
ctacctaaaataaataccaaag

SEQ ID NO: 6110754 - DNA, 17 bp, Homo sapiens
ctacctaagaatttcac

SEQ ID NO: 6110755 - DNA, 22 bp, Homo sapiens
ctacctaagaatttcactgtct

SEQ ID NO: 6110756 - DNA, 23 bp, Homo sapiens
ctacctaagaatttcactgtctt

SEQ ID NO: 6110757 - DNA, 16 bp, Homo sapiens
ctacctactggtgtaa

SEQ ID NO: 6110758 - DNA, 12 bp, Homo sapiens
ctacctagaagt

SEQ ID NO: 6110759 - DNA, 16 bp, Homo sapiens
ctacctagaagtaaga

SEQ ID NO: 6110760 - DNA, 16 bp, Homo sapiens
ctacctagtctccact

SEQ ID NO: 6110761 - DNA, 13 bp, Homo sapiens
ctacctataaatg

SEQ ID NO: 6110762 - DNA, 20 bp, Homo sapiens
ctacctcaaagggcagtttt

SEQ ID NO: 6110763 - DNA, 20 bp, Homo sapiens
ctacctcaagttcttggacc

SEQ ID NO: 6110764 - DNA, 21 bp, Homo sapiens
ctacctcaagttcttggacca

SEQ ID NO: 6110765 - DNA, 15 bp, Homo sapiens
ctacctcacctgggc

SEQ ID NO: 6110766 - DNA, 16 bp, Homo sapiens
ctacctcacctgggca

SEQ ID NO: 6110767 - DNA, 22 bp, Homo sapiens
ctacctcactattcaagtatta

SEQ ID NO: 6110768 - DNA, 13 bp, Homo sapiens
ctacctcagcctc

SEQ ID NO: 6110769 - DNA, 15 bp, Homo sapiens
ctacctcaggttgct

SEQ ID NO: 6110770 - DNA, 19 bp, Homo sapiens
ctacctcaggttgctggtt

SEQ ID NO: 6110771 - DNA, 22 bp, Homo sapiens
ctacctcaggttgctggttgct

SEQ ID NO: 6110772 - DNA, 15 bp, Homo sapiens
ctacctcagtcagta

SEQ ID NO: 6110773 - DNA, 18 bp, Homo sapiens
ctacctcagtgctcctgg

SEQ ID NO: 6110774 - DNA, 15 bp, Homo sapiens
ctacctcatctctga

SEQ ID NO: 6110775 - DNA, 14 bp, Homo sapiens
ctacctccaccctg

SEQ ID NO: 6110776 - DNA, 13 bp, Homo sapiens
ctacctccctccc

SEQ ID NO: 6110777 - DNA, 14 bp, Homo sapiens
ctacctccctcctc

SEQ ID NO: 6110778 - DNA, 14 bp, Homo sapiens
ctacctctaacacc

SEQ ID NO: 6110779 - DNA, 21 bp, Homo sapiens
ctacctctaacaccacactga

SEQ ID NO: 6110780 - DNA, 24 bp, Homo sapiens
ctacctctaacaccacactgacca

SEQ ID NO: 6110781 - DNA, 18 bp, Homo sapiens
ctacctctccagcctcag

SEQ ID NO: 6110782 - DNA, 11 bp, Homo sapiens
ctacctctctc

SEQ ID NO: 6110783 - DNA, 14 bp, Homo sapiens
ctacctctctcctc

SEQ ID NO: 6110784 - DNA, 13 bp, Homo sapiens
ctacctctctgtc

SEQ ID NO: 6110785 - DNA, 14 bp, Homo sapiens
ctacctctctgtcc

SEQ ID NO: 6110786 - DNA, 19 bp, Homo sapiens
cctgtagttaggcctggct

SEQ ID NO: 6110787 - DNA, 21 bp, Homo sapiens
cctgtagttgacaattctgca

SEQ ID NO: 6110788 - DNA, 19 bp, Homo sapiens
cctgtagttgcgtggactc

SEQ ID NO: 6110789 - DNA, 23 bp, Homo sapiens
cctgtagttgcgtggactctgca

SEQ ID NO: 6110790 - DNA, 19 bp, Homo sapiens
cctgtagttttattttatg

SEQ ID NO: 6110791 - DNA, 16 bp, Homo sapiens
cctgtataaccccacc

SEQ ID NO: 6110792 - DNA, 17 bp, Homo sapiens
cctgtataaccctgtta

SEQ ID NO: 6110793 - DNA, 21 bp, Homo sapiens
cctgtataagtagatctgctt

SEQ ID NO: 6110794 - DNA, 23 bp, Homo sapiens
cctgtataagtggaggcacttta

SEQ ID NO: 6110795 - DNA, 14 bp, Homo sapiens
cctgtatacagtgc

SEQ ID NO: 6110796 - DNA, 18 bp, Homo sapiens
cctgtatacagtgcagag

SEQ ID NO: 6110797 - DNA, 21 bp, Homo sapiens
cctgtatacagtgcagagcct

SEQ ID NO: 6110798 - DNA, 14 bp, Homo sapiens
cctgtatacctcct

SEQ ID NO: 6110799 - DNA, 15 bp, Homo sapiens
cctgtatactcttga

SEQ ID NO: 6110800 - DNA, 12 bp, Homo sapiens
cctgtatagtta

SEQ ID NO: 6110801 - DNA, 22 bp, Homo sapiens
cctgtatagttaggatagcatt

SEQ ID NO: 6110802 - DNA, 20 bp, Homo sapiens
cctgtatataatactaaagt

SEQ ID NO: 6110803 - DNA, 23 bp, Homo sapiens
cctgtatatagcccagccaggcc

SEQ ID NO: 6110804 - DNA, 20 bp, Homo sapiens
cctgtatatttgtaaagcta

SEQ ID NO: 6110805 - DNA, 17 bp, Homo sapiens
cctgtatccaattttaa

SEQ ID NO: 6110806 - DNA, 21 bp, Homo sapiens
cctgtatcctccctggcagac

SEQ ID NO: 6110807 - DNA, 14 bp, Homo sapiens
cctgtatcttgtct

SEQ ID NO: 6110808 - DNA, 14 bp, Homo sapiens
cctgtatctttcta

SEQ ID NO: 6110809 - DNA, 14 bp, Homo sapiens
cctgtatgagacag

SEQ ID NO: 6110810 - DNA, 19 bp, Homo sapiens
cctgtatggagctagagag

SEQ ID NO: 6110811 - DNA, 17 bp, Homo sapiens
cctgtatgtctccagta

SEQ ID NO: 6110812 - DNA, 14 bp, Homo sapiens
cctgtatgtctgtc

SEQ ID NO: 6110813 - DNA, 19 bp, Homo sapiens
cctgtatgtctgtcattgt

SEQ ID NO: 6110814 - DNA, 16 bp, Homo sapiens
cctgtattcccagcta

SEQ ID NO: 6110815 - DNA, 17 bp, Homo sapiens
cctgtattcccagctac

SEQ ID NO: 6110816 - DNA, 16 bp, Homo sapiens
cctgtattcttgtttg

SEQ ID NO: 6110817 - DNA, 14 bp, Homo sapiens
cctgtatttaagca

SEQ ID NO: 6110818 - DNA, 16 bp, Homo sapiens
cctgtatttaagcaaa

SEQ ID NO: 6110819 - DNA, 17 bp, Homo sapiens
cctgtatttaagcaaat

SEQ ID NO: 6110820 - DNA, 19 bp, Homo sapiens
cctgtatttaagcaaatac

SEQ ID NO: 6110821 - DNA, 20 bp, Homo sapiens
cctgtatttaagcaaatact

SEQ ID NO: 6110822 - DNA, 18 bp, Homo sapiens
cctgtatttgagagactg

SEQ ID NO: 6110823 - DNA, 16 bp, Homo sapiens
cctgtcaaacattagt

SEQ ID NO: 6110824 - DNA, 20 bp, Homo sapiens
cctgtcaacctgaattaaag

SEQ ID NO: 6110825 - DNA, 11 bp, Homo sapiens
cctgtcaataa

SEQ ID NO: 6110826 - DNA, 17 bp, Homo sapiens
cctgtcaataaatgttg

SEQ ID NO: 6110827 - DNA, 18 bp, Homo sapiens
cctgtcaataaatgttga

SEQ ID NO: 6110828 - DNA, 17 bp, Homo sapiens
cctgtcaatgtttgctt

SEQ ID NO: 6110829 - DNA, 13 bp, Homo sapiens
cctgtcacaataa

SEQ ID NO: 6110830 - DNA, 14 bp, Homo sapiens
cctgtcacacactg

SEQ ID NO: 6110831 - DNA, 18 bp, Homo sapiens
cctgtcacacactggacc

SEQ ID NO: 6110832 - DNA, 15 bp, Homo sapiens
cctgtcacattgcat

SEQ ID NO: 6110833 - DNA, 20 bp, Homo sapiens
cctgtcacattgcattctat

SEQ ID NO: 6110834 - DNA, 21 bp, Homo sapiens
cctgtcacattgcattctatt

SEQ ID NO: 6110835 - DNA, 17 bp, Homo sapiens
cctgtcacccccactcc

SEQ ID NO: 6110836 - DNA, 14 bp, Homo sapiens
cctgtcaccctggc

SEQ ID NO: 6110837 - DNA, 20 bp, Homo sapiens
cctgtcacctagaacgtgca

SEQ ID NO: 6110838 - DNA, 18 bp, Homo sapiens
cctgtcacctggcctgcc

SEQ ID NO: 6110839 - DNA, 16 bp, Homo sapiens
cctgtcacctgggagg

SEQ ID NO: 6110840 - DNA, 23 bp, Homo sapiens
cctgtcacgctcatgtcctgtcc

SEQ ID NO: 6110841 - DNA, 15 bp, Homo sapiens
cctgtcactcagctg

SEQ ID NO: 6110842 - DNA, 18 bp, Homo sapiens
cctgtcactgagcacagt

SEQ ID NO: 6110843 - DNA, 17 bp, Homo sapiens
cctgtcactgatggaag

SEQ ID NO: 6110844 - DNA, 16 bp, Homo sapiens
cctgtcactgtccaga

SEQ ID NO: 6110845 - DNA, 22 bp, Homo sapiens
cctgtcacttgctggctgtgaa

SEQ ID NO: 6110846 - DNA, 19 bp, Homo sapiens
cctgtcagaatcatgctgt

SEQ ID NO: 6110847 - DNA, 23 bp, Homo sapiens
cctgtcagacgttggtcccaagt

SEQ ID NO: 6110848 - DNA, 12 bp, Homo sapiens
cctgtcagaggc

SEQ ID NO: 6110849 - DNA, 17 bp, Homo sapiens
cctgtcagatccaggag

SEQ ID NO: 6110850 - DNA, 13 bp, Homo sapiens
cctgtcagcatga

SEQ ID NO: 6110851 - DNA, 22 bp, Homo sapiens
cctgtcagcatgaatttgtaat

SEQ ID NO: 6110852 - DNA, 14 bp, Homo sapiens
cctgtcagccaaca

SEQ ID NO: 6110853 - DNA, 20 bp, Homo sapiens
cctgtcagccaacattgcct

SEQ ID NO: 6110854 - DNA, 23 bp, Homo sapiens
cctgtcagccaacattgccttgc

SEQ ID NO: 6110855 - DNA, 21 bp, Homo sapiens
cctgtcaggaccattttagaa

SEQ ID NO: 6110856 - DNA, 17 bp, Homo sapiens
cctgtcaggctctggcc

SEQ ID NO: 6110857 - DNA, 16 bp, Homo sapiens
cctgtcagtgcagccc

SEQ ID NO: 6110858 - DNA, 19 bp, Homo sapiens
cctgtcagtgcagcccgtg

SEQ ID NO: 6110859 - DNA, 15 bp, Homo sapiens
cctgtcagtgccgcc

SEQ ID NO: 6110860 - DNA, 19 bp, Homo sapiens
cctgtcagtgtttttgaaa

SEQ ID NO: 6110861 - DNA, 17 bp, Homo sapiens
cctgtcagtttcccctc

SEQ ID NO: 6110862 - DNA, 23 bp, Homo sapiens
cctgtcataggttttaaatctgc

SEQ ID NO: 6110863 - DNA, 19 bp, Homo sapiens
cctgtcatcatcatggcca

SEQ ID NO: 6110864 - DNA, 15 bp, Homo sapiens
cctgtcatctgggcc

SEQ ID NO: 6110865 - DNA, 12 bp, Homo sapiens
cctgtcatgccc

SEQ ID NO: 6110866 - DNA, 14 bp, Homo sapiens
cctgtcatgccccc

SEQ ID NO: 6110867 - DNA, 15 bp, Homo sapiens
cctgtcatgcccccc

SEQ ID NO: 6110868 - DNA, 18 bp, Homo sapiens
cctgtcatgcccccctca

SEQ ID NO: 6110869 - DNA, 12 bp, Homo sapiens
cctgtccaacct

SEQ ID NO: 6110870 - DNA, 22 bp, Homo sapiens
cctgtccaagacagggctcatt

SEQ ID NO: 6110871 - DNA, 20 bp, Homo sapiens
cctgtccaatttctgctgta

SEQ ID NO: 6110872 - DNA, 22 bp, Homo sapiens
cctgtccacacccagctcagca

SEQ ID NO: 6110873 - DNA, 14 bp, Homo sapiens
cctgtccacagccc

SEQ ID NO: 6110874 - DNA, 21 bp, Homo sapiens
cctgtccacaggcttctgagc

SEQ ID NO: 6110875 - DNA, 13 bp, Homo sapiens
cctgtccaccctg

SEQ ID NO: 6110876 - DNA, 16 bp, Homo sapiens
cctgtccaccctgcca

SEQ ID NO: 6110877 - DNA, 17 bp, Homo sapiens
cctgtccacctgtgctg

SEQ ID NO: 6110878 - DNA, 20 bp, Homo sapiens
cctgtccactctgctcaggg

SEQ ID NO: 6110879 - DNA, 14 bp, Homo sapiens
cctgtccagcctgg

SEQ ID NO: 6110880 - DNA, 22 bp, Homo sapiens
cctgtccagcctgggcagccag

SEQ ID NO: 6110881 - DNA, 14 bp, Homo sapiens
cctgtccagctcca

SEQ ID NO: 6110882 - DNA, 14 bp, Homo sapiens
cctgtccaggtaga

SEQ ID NO: 6110883 - DNA, 18 bp, Homo sapiens
cctgtccatcagccagga

SEQ ID NO: 6110884 - DNA, 10 bp, Homo sapiens
cctgtcccaa

SEQ ID NO: 6110885 - DNA, 13 bp, Homo sapiens
cctgtcccacatg

SEQ ID NO: 6110886 - DNA, 19 bp, Homo sapiens
cctgtcccaccaactctgc

SEQ ID NO: 6110887 - DNA, 16 bp, Homo sapiens
cctgtcccaccccctt

SEQ ID NO: 6110888 - DNA, 13 bp, Homo sapiens
cctgtcccactgg

SEQ ID NO: 6110889 - DNA, 23 bp, Homo sapiens
cctgtcccagaggttatctgcct

SEQ ID NO: 6110890 - DNA, 15 bp, Homo sapiens
cctgtcccagcagaa

SEQ ID NO: 6110891 - DNA, 12 bp, Homo sapiens
cctgtcccaggc

SEQ ID NO: 6110892 - DNA, 16 bp, Homo sapiens
cctgtcccaggccggc

SEQ ID NO: 6110893 - DNA, 19 bp, Homo sapiens
cctgtcccatggacactcc

SEQ ID NO: 6110894 - DNA, 23 bp, Homo sapiens
cctgtcccatggacactccagtg

SEQ ID NO: 6110895 - DNA, 14 bp, Homo sapiens
cctgtcccatgggc

SEQ ID NO: 6110896 - DNA, 23 bp, Homo sapiens
cctgtcccatgggctctggcccc

SEQ ID NO: 6110897 - DNA, 14 bp, Homo sapiens
cctgtccccaagac

SEQ ID NO: 6110898 - DNA, 13 bp, Homo sapiens
cctgtccccaccc

SEQ ID NO: 6110899 - DNA, 20 bp, Homo sapiens
cctgtccccagaccaaccct

SEQ ID NO: 6110900 - DNA, 15 bp, Homo sapiens
cctgtccccagtccc

SEQ ID NO: 6110901 - DNA, 22 bp, Homo sapiens
cctgtccccagtccccagccct

SEQ ID NO: 6110902 - DNA, 18 bp, Homo sapiens
cctgtccccagttaatgt

SEQ ID NO: 6110903 - DNA, 15 bp, Homo sapiens
cctgtccccatctgt

SEQ ID NO: 6110904 - DNA, 13 bp, Homo sapiens
cctgtccccatgc

SEQ ID NO: 6110905 - DNA, 12 bp, Homo sapiens
cctgtcccccag

SEQ ID NO: 6110906 - DNA, 16 bp, Homo sapiens
cctgtcccccagcatc

SEQ ID NO: 6110907 - DNA, 22 bp, Homo sapiens
cctgtcccccagcatcgggggc

SEQ ID NO: 6110908 - DNA, 12 bp, Homo sapiens
cctgtccccctg

SEQ ID NO: 6110909 - DNA, 17 bp, Homo sapiens
cctgtcccctatgccac

SEQ ID NO: 6110910 - DNA, 22 bp, Homo sapiens
cctgtcccctatgccactaagc

SEQ ID NO: 6110911 - DNA, 15 bp, Homo sapiens
cctgtcccctcagct

SEQ ID NO: 6110912 - DNA, 16 bp, Homo sapiens
cctgtcccctcagctc

SEQ ID NO: 6110913 - DNA, 18 bp, Homo sapiens
cctgtcccctcagctcca

SEQ ID NO: 6110914 - DNA, 16 bp, Homo sapiens
cctgtcccctgaaaaa

SEQ ID NO: 6110915 - DNA, 15 bp, Homo sapiens
cctgtccctagctca

SEQ ID NO: 6110916 - DNA, 19 bp, Homo sapiens
cctgtccctagctcacact

SEQ ID NO: 6110917 - DNA, 22 bp, Homo sapiens
cctgtccctagctcacactcat

SEQ ID NO: 6110918 - DNA, 14 bp, Homo sapiens
cctgtccctccagg

SEQ ID NO: 6110919 - DNA, 15 bp, Homo sapiens
cctgtccctccaggc

SEQ ID NO: 6110920 - DNA, 17 bp, Homo sapiens
cctgtccctcccacctc

SEQ ID NO: 6110921 - DNA, 20 bp, Homo sapiens
cctgtccctcccacctctgt

SEQ ID NO: 6110922 - DNA, 13 bp, Homo sapiens
cctgtccctctcc

SEQ ID NO: 6110923 - DNA, 14 bp, Homo sapiens
cctgtccctgaggt

SEQ ID NO: 6110924 - DNA, 16 bp, Homo sapiens
cctgtccctgccccgc

SEQ ID NO: 6110925 - DNA, 13 bp, Homo sapiens
cctgtccctgcgc

SEQ ID NO: 6110926 - DNA, 14 bp, Homo sapiens
cctgtccctggcca

SEQ ID NO: 6110927 - DNA, 19 bp, Homo sapiens
cctgtccctgtagctcagt

SEQ ID NO: 6110928 - DNA, 21 bp, Homo sapiens
cctgtccctgtagctcagtca

SEQ ID NO: 6110929 - DNA, 16 bp, Homo sapiens
cctgtccctgtccccc

SEQ ID NO: 6110930 - DNA, 16 bp, Homo sapiens
cctgtcccttcctttc

SEQ ID NO: 6110931 - DNA, 17 bp, Homo sapiens
cctgtcccttcctttct

SEQ ID NO: 6110932 - DNA, 18 bp, Homo sapiens
cctgtcccttcctttctc

SEQ ID NO: 6110933 - DNA, 21 bp, Homo sapiens
cctgtcccttcgagtccagga

SEQ ID NO: 6110934 - DNA, 23 bp, Homo sapiens
cctgtcccttctcttaatttaat

SEQ ID NO: 6110935 - DNA, 16 bp, Homo sapiens
cctgtcccttcttggg

SEQ ID NO: 6110936 - DNA, 15 bp, Homo sapiens
cctgtcccttgcctc

SEQ ID NO: 6110937 - DNA, 17 bp, Homo sapiens
cctgtcccttgcctctg

SEQ ID NO: 6110938 - DNA, 18 bp, Homo sapiens
cctgtcccttgcctctgc

SEQ ID NO: 6110939 - DNA, 12 bp, Homo sapiens
cctgtccctttt

SEQ ID NO: 6110940 - DNA, 15 bp, Homo sapiens
cctgtccgccctctt

SEQ ID NO: 6110941 - DNA, 22 bp, Homo sapiens
cctgtccgccctcttcccctct

SEQ ID NO: 6110942 - DNA, 23 bp, Homo sapiens
cctgtccggcccagtgccagctc

SEQ ID NO: 6110943 - DNA, 18 bp, Homo sapiens
cctgtcctaaggaacctt

SEQ ID NO: 6110944 - DNA, 21 bp, Homo sapiens
cctgtcctaaggaaccttcct

SEQ ID NO: 6110945 - DNA, 17 bp, Homo sapiens
cctgtcctagagatcta

SEQ ID NO: 6110946 - DNA, 16 bp, Homo sapiens
cctgtcctagtctcct

SEQ ID NO: 6110947 - DNA, 9 bp, Homo sapiens
cctgtcctc

SEQ ID NO: 6110948 - DNA, 22 bp, Homo sapiens
cctgtcctcaaaataaggggca

SEQ ID NO: 6110949 - DNA, 12 bp, Homo sapiens
cctgtcctcacc

SEQ ID NO: 6110950 - DNA, 12 bp, Homo sapiens
cctgtcctcact

SEQ ID NO: 6110951 - DNA, 13 bp, Homo sapiens
cctgtcctcactg

SEQ ID NO: 6110952 - DNA, 14 bp, Homo sapiens
cctgtcctcactgc

SEQ ID NO: 6110953 - DNA, 18 bp, Homo sapiens
cctgtcctcatgacccct

SEQ ID NO: 6110954 - DNA, 21 bp, Homo sapiens
cctgtcctccaacaccaagca

SEQ ID NO: 6110955 - DNA, 22 bp, Homo sapiens
cctgtcctccaacaccaagcac

SEQ ID NO: 6110956 - DNA, 13 bp, Homo sapiens
cctgtcctcccag

SEQ ID NO: 6110957 - DNA, 15 bp, Homo sapiens
cctgtcctcctggaa

SEQ ID NO: 6110958 - DNA, 16 bp, Homo sapiens
cctgtcctcctggtgg

SEQ ID NO: 6110959 - DNA, 17 bp, Homo sapiens
cctgtcctcctggtggg

SEQ ID NO: 6110960 - DNA, 22 bp, Homo sapiens
cctgtcctcctggtgggtccag

SEQ ID NO: 6110961 - DNA, 19 bp, Homo sapiens
cctgtcctctttcagctcc

SEQ ID NO: 6110962 - DNA, 14 bp, Homo sapiens
cctgtcctgaaagc

SEQ ID NO: 6110963 - DNA, 12 bp, Homo sapiens
cctgtcctgcag

SEQ ID NO: 6110964 - DNA, 12 bp, Homo sapiens
cctgtcctgccc

SEQ ID NO: 6110965 - DNA, 19 bp, Homo sapiens
cctgtcctgcctaaggctg

SEQ ID NO: 6110966 - DNA, 13 bp, Homo sapiens
ctacctctctttc

SEQ ID NO: 6110967 - DNA, 13 bp, Homo sapiens
ctacctctgagaa

SEQ ID NO: 6110968 - DNA, 17 bp, Homo sapiens
ctacctctgagaagaca

SEQ ID NO: 6110969 - DNA, 16 bp, Homo sapiens
ctacctctgtctgaga

SEQ ID NO: 6110970 - DNA, 20 bp, Homo sapiens
ctacctctgtctgagacagg

SEQ ID NO: 6110971 - DNA, 14 bp, Homo sapiens
ctacctctgtgcct

SEQ ID NO: 6110972 - DNA, 23 bp, Homo sapiens
ctacctcttttgagactttgccc

SEQ ID NO: 6110973 - DNA, 18 bp, Homo sapiens
ctacctgaaaattcaaca

SEQ ID NO: 6110974 - DNA, 16 bp, Homo sapiens
ctacctgaaggcaggg

SEQ ID NO: 6110975 - DNA, 20 bp, Homo sapiens
ctacctgacactcccttggg

SEQ ID NO: 6110976 - DNA, 15 bp, Homo sapiens
ctacctgaggggcct

SEQ ID NO: 6110977 - DNA, 12 bp, Homo sapiens
ctacctgatttc

SEQ ID NO: 6110978 - DNA, 14 bp, Homo sapiens
ctacctgatttcag

SEQ ID NO: 6110979 - DNA, 17 bp, Homo sapiens
ctacctgcacctctgga

SEQ ID NO: 6110980 - DNA, 11 bp, Homo sapiens
ctacctgcagg

SEQ ID NO: 6110981 - DNA, 15 bp, Homo sapiens
ctacctgcaggcggg

SEQ ID NO: 6110982 - DNA, 18 bp, Homo sapiens
ctacctgcaggcggggct

SEQ ID NO: 6110983 - DNA, 19 bp, Homo sapiens
ctacctgcaggcggggctc

SEQ ID NO: 6110984 - DNA, 16 bp, Homo sapiens
ctacctgccctctctc

SEQ ID NO: 6110985 - DNA, 15 bp, Homo sapiens
ctacctgcctgttct

SEQ ID NO: 6110986 - DNA, 19 bp, Homo sapiens
ctacctgctcagccctgca

SEQ ID NO: 6110987 - DNA, 19 bp, Homo sapiens
ctacctgctctccaagtct

SEQ ID NO: 6110988 - DNA, 15 bp, Homo sapiens
ctacctgctggacag

SEQ ID NO: 6110989 - DNA, 20 bp, Homo sapiens
ctacctgctggacagcctcc

SEQ ID NO: 6110990 - DNA, 21 bp, Homo sapiens
ctacctgctggacagcctccg

SEQ ID NO: 6110991 - DNA, 16 bp, Homo sapiens
ctacctggaaacagct

SEQ ID NO: 6110992 - DNA, 18 bp, Homo sapiens
ctacctggaggaatgatt

SEQ ID NO: 6110993 - DNA, 12 bp, Homo sapiens
ctacctgggacc

SEQ ID NO: 6110994 - DNA, 23 bp, Homo sapiens
ctacctgggacctgatttattga

SEQ ID NO: 6110995 - DNA, 19 bp, Homo sapiens
ctacctggggaaagcctga

SEQ ID NO: 6110996 - DNA, 16 bp, Homo sapiens
ctacctggggactcct

SEQ ID NO: 6110997 - DNA, 21 bp, Homo sapiens
ctacctgggggcagaactcct

SEQ ID NO: 6110998 - DNA, 21 bp, Homo sapiens
ctacctggtcaacccgctgct

SEQ ID NO: 6110999 - DNA, 23 bp, Homo sapiens
ctacctggtcaacccgctgcttc

SEQ ID NO: 6111000 - DNA, 19 bp, Homo sapiens
ctacctggttttcattatt

SEQ ID NO: 6111001 - DNA, 14 bp, Homo sapiens
ctacctgtaacttt

SEQ ID NO: 6111002 - DNA, 19 bp, Homo sapiens
ctacctgtcccctatgcca

SEQ ID NO: 6111003 - DNA, 21 bp, Homo sapiens
ctacctgtcccctatgccact

SEQ ID NO: 6111004 - DNA, 16 bp, Homo sapiens
ctacctgtcctccgtg

SEQ ID NO: 6111005 - DNA, 17 bp, Homo sapiens
ctacctgtctgctgcca

SEQ ID NO: 6111006 - DNA, 18 bp, Homo sapiens
ctacctgtctgctgccag

SEQ ID NO: 6111007 - DNA, 20 bp, Homo sapiens
ctacctgtctgctgccagca

SEQ ID NO: 6111008 - DNA, 22 bp, Homo sapiens
ctacctgtgtttttttctaaaa

SEQ ID NO: 6111009 - DNA, 20 bp, Homo sapiens
ctacctgttcagtgtcccgg

SEQ ID NO: 6111010 - DNA, 21 bp, Homo sapiens
ctacctgttcagtgtcccggg

SEQ ID NO: 6111011 - DNA, 14 bp, Homo sapiens
ctacctgtttgaag

SEQ ID NO: 6111012 - DNA, 15 bp, Homo sapiens
ctacctgtttgaagg

SEQ ID NO: 6111013 - DNA, 19 bp, Homo sapiens
ctaccttccagtcaggatg

SEQ ID NO: 6111014 - DNA, 18 bp, Homo sapiens
ctaccttccagttcctca

SEQ ID NO: 6111015 - DNA, 18 bp, Homo sapiens
ctaccttccccagacttg

SEQ ID NO: 6111016 - DNA, 16 bp, Homo sapiens
ctaccttctccccagc

SEQ ID NO: 6111017 - DNA, 14 bp, Homo sapiens
ctaccttctgacct

SEQ ID NO: 6111018 - DNA, 15 bp, Homo sapiens
ctaccttctgacctc

SEQ ID NO: 6111019 - DNA, 14 bp, Homo sapiens
ctaccttgaaaata

SEQ ID NO: 6111020 - DNA, 14 bp, Homo sapiens
ctaccttgcctcct

SEQ ID NO: 6111021 - DNA, 20 bp, Homo sapiens
ctaccttgctagctagccag

SEQ ID NO: 6111022 - DNA, 22 bp, Homo sapiens
ctaccttgctagctagccagcc

SEQ ID NO: 6111023 - DNA, 16 bp, Homo sapiens
ctaccttgggggaacc

SEQ ID NO: 6111024 - DNA, 18 bp, Homo sapiens
ctaccttggtcctgcctc

SEQ ID NO: 6111025 - DNA, 16 bp, Homo sapiens
ctaccttggtgatttg

SEQ ID NO: 6111026 - DNA, 13 bp, Homo sapiens
ctaccttgtcata

SEQ ID NO: 6111027 - DNA, 19 bp, Homo sapiens
ctaccttgtgacccagcac

SEQ ID NO: 6111028 - DNA, 19 bp, Homo sapiens
ctaccttgtgagggagaga

SEQ ID NO: 6111029 - DNA, 14 bp, Homo sapiens
ctaccttgtgggaa

SEQ ID NO: 6111030 - DNA, 15 bp, Homo sapiens
ctaccttgtgggaat

SEQ ID NO: 6111031 - DNA, 20 bp, Homo sapiens
ctacctttggcttaattcca

SEQ ID NO: 6111032 - DNA, 22 bp, Homo sapiens
ctacctttgtctcacgattcca

SEQ ID NO: 6111033 - DNA, 16 bp, Homo sapiens
ctaccttttaaaattg

SEQ ID NO: 6111034 - DNA, 13 bp, Homo sapiens
ctaccttttctct

SEQ ID NO: 6111035 - DNA, 15 bp, Homo sapiens
ctacctttttatatt

SEQ ID NO: 6111036 - DNA, 14 bp, Homo sapiens
ctacctttttttct

SEQ ID NO: 6111037 - DNA, 21 bp, Homo sapiens
ctaccttttttttttgagttt

SEQ ID NO: 6111038 - DNA, 22 bp, Homo sapiens
ctaccttttttttttgagttta

SEQ ID NO: 6111039 - DNA, 15 bp, Homo sapiens
ctacgaagccacagg

SEQ ID NO: 6111040 - DNA, 23 bp, Homo sapiens
ctacgagtaattgcatttgcttt

SEQ ID NO: 6111041 - DNA, 16 bp, Homo sapiens
ctacgcactggacagc

SEQ ID NO: 6111042 - DNA, 15 bp, Homo sapiens
ctacgcagatgctgt

SEQ ID NO: 6111043 - DNA, 15 bp, Homo sapiens
ctacgccaatcaagg

SEQ ID NO: 6111044 - DNA, 21 bp, Homo sapiens
ctacgccaatgttatgccagc

SEQ ID NO: 6111045 - DNA, 13 bp, Homo sapiens
ctacgccaggaga

SEQ ID NO: 6111046 - DNA, 17 bp, Homo sapiens
ctacgcccttcctgtgc

SEQ ID NO: 6111047 - DNA, 19 bp, Homo sapiens
ctacgcgatagtctctgtt

SEQ ID NO: 6111048 - DNA, 20 bp, Homo sapiens
ctacgctcctgtctccaaga

SEQ ID NO: 6111049 - DNA, 14 bp, Homo sapiens
ctacgctctccttt

SEQ ID NO: 6111050 - DNA, 19 bp, Homo sapiens
ctacggagggtgggctctg

SEQ ID NO: 6111051 - DNA, 20 bp, Homo sapiens
ctacggagggtgggctctga

SEQ ID NO: 6111052 - DNA, 20 bp, Homo sapiens
ctacgggcgctgcagcctcc

SEQ ID NO: 6111053 - DNA, 17 bp, Homo sapiens
ctacggtagtgatgaaa

SEQ ID NO: 6111054 - DNA, 22 bp, Homo sapiens
ctacggttccctgcctaggagc

SEQ ID NO: 6111055 - DNA, 17 bp, Homo sapiens
ctacgtacatgtgaggc

SEQ ID NO: 6111056 - DNA, 13 bp, Homo sapiens
ctacgtataaata

SEQ ID NO: 6111057 - DNA, 16 bp, Homo sapiens
ctacgtataaatatga

SEQ ID NO: 6111058 - DNA, 21 bp, Homo sapiens
ctacgtataaatatgaaatga

SEQ ID NO: 6111059 - DNA, 12 bp, Homo sapiens
ctacgtgcctcc

SEQ ID NO: 6111060 - DNA, 16 bp, Homo sapiens
ctacgtgcctcccgag

SEQ ID NO: 6111061 - DNA, 20 bp, Homo sapiens
ctacgtgtgaaatctgtctt

SEQ ID NO: 6111062 - DNA, 21 bp, Homo sapiens
ctacgtgtgaaatctgtcttt

SEQ ID NO: 6111063 - DNA, 17 bp, Homo sapiens
ctacgttaccaggcagg

SEQ ID NO: 6111064 - DNA, 21 bp, Homo sapiens
ctacgttctccagcccacacc

SEQ ID NO: 6111065 - DNA, 21 bp, Homo sapiens
ctacgtttccccaataaagcc

SEQ ID NO: 6111066 - DNA, 23 bp, Homo sapiens
ctacgtttccccaataaagcctt

SEQ ID NO: 6111067 - DNA, 12 bp, Homo sapiens
ctacgtttcttt

SEQ ID NO: 6111068 - DNA, 20 bp, Homo sapiens
ctacgtttctttaaccttgt

SEQ ID NO: 6111069 - DNA, 16 bp, Homo sapiens
ctactaaaaatacaaa

SEQ ID NO: 6111070 - DNA, 18 bp, Homo sapiens
ctactaaaaatacaaaca

SEQ ID NO: 6111071 - DNA, 19 bp, Homo sapiens
ctactaaaaatacaaacaa

SEQ ID NO: 6111072 - DNA, 16 bp, Homo sapiens
ctactaaaagtttaga

SEQ ID NO: 6111073 - DNA, 21 bp, Homo sapiens
ctactaaaagtttagaacttg

SEQ ID NO: 6111074 - DNA, 12 bp, Homo sapiens
ctactaaagtgc

SEQ ID NO: 6111075 - DNA, 13 bp, Homo sapiens
ctactaaatccct

SEQ ID NO: 6111076 - DNA, 22 bp, Homo sapiens
ctactaaatggcctctctccac

SEQ ID NO: 6111077 - DNA, 18 bp, Homo sapiens
ctactaacaaatgtaaaa

SEQ ID NO: 6111078 - DNA, 12 bp, Homo sapiens
ctactaacagat

SEQ ID NO: 6111079 - DNA, 20 bp, Homo sapiens
ctactaacagattataataa

SEQ ID NO: 6111080 - DNA, 15 bp, Homo sapiens
ctactaacttttcaa

SEQ ID NO: 6111081 - DNA, 15 bp, Homo sapiens
ctactaagaagttta

SEQ ID NO: 6111082 - DNA, 13 bp, Homo sapiens
ctactaagaataa

SEQ ID NO: 6111083 - DNA, 14 bp, Homo sapiens
ctactaaggccttt

SEQ ID NO: 6111084 - DNA, 20 bp, Homo sapiens
ctactaaggctttcctacct

SEQ ID NO: 6111085 - DNA, 21 bp, Homo sapiens
ctactaaggggcttgtgttct

SEQ ID NO: 6111086 - DNA, 18 bp, Homo sapiens
ctactaataaaccagttc

SEQ ID NO: 6111087 - DNA, 14 bp, Homo sapiens
ctactaatagtttg

SEQ ID NO: 6111088 - DNA, 12 bp, Homo sapiens
ctactaattcca

SEQ ID NO: 6111089 - DNA, 20 bp, Homo sapiens
ctactaattgagccatttaa

SEQ ID NO: 6111090 - DNA, 14 bp, Homo sapiens
ctactaatttttag

SEQ ID NO: 6111091 - DNA, 21 bp, Homo sapiens
ctactaatttttagatattca

SEQ ID NO: 6111092 - DNA, 13 bp, Homo sapiens
ctactacagcact

SEQ ID NO: 6111093 - DNA, 19 bp, Homo sapiens
ctactacccattgttccct

SEQ ID NO: 6111094 - DNA, 18 bp, Homo sapiens
ctactacccccacagacc

SEQ ID NO: 6111095 - DNA, 17 bp, Homo sapiens
ctactacccgagcccag

SEQ ID NO: 6111096 - DNA, 10 bp, Homo sapiens
ctactacctc

SEQ ID NO: 6111097 - DNA, 12 bp, Homo sapiens
ctactactggtg

SEQ ID NO: 6111098 - DNA, 20 bp, Homo sapiens
ctactagagatattcttatt

SEQ ID NO: 6111099 - DNA, 15 bp, Homo sapiens
ctactagatgtcttt

SEQ ID NO: 6111100 - DNA, 14 bp, Homo sapiens
ctactagcaccatc

SEQ ID NO: 6111101 - DNA, 12 bp, Homo sapiens
ctactaggtctg

SEQ ID NO: 6111102 - DNA, 14 bp, Homo sapiens
ctactataaagaga

SEQ ID NO: 6111103 - DNA, 22 bp, Homo sapiens
ctactataatcaaatgatttca

SEQ ID NO: 6111104 - DNA, 14 bp, Homo sapiens
ctactatatatgtg

SEQ ID NO: 6111105 - DNA, 14 bp, Homo sapiens
ctactatgatcaga

SEQ ID NO: 6111106 - DNA, 16 bp, Homo sapiens
ctactatgcttcagga

SEQ ID NO: 6111107 - DNA, 18 bp, Homo sapiens
ctactatggctgagttct

SEQ ID NO: 6111108 - DNA, 17 bp, Homo sapiens
ctactatgtgcgagaca

SEQ ID NO: 6111109 - DNA, 13 bp, Homo sapiens
ctactatgtgctg

SEQ ID NO: 6111110 - DNA, 18 bp, Homo sapiens
ctactattcatgttttga

SEQ ID NO: 6111111 - DNA, 14 bp, Homo sapiens
ctactattctgtta

SEQ ID NO: 6111112 - DNA, 19 bp, Homo sapiens
ctactatttttctttccaa

SEQ ID NO: 6111113 - DNA, 16 bp, Homo sapiens
ctactcaaagcaaaag

SEQ ID NO: 6111114 - DNA, 22 bp, Homo sapiens
ctactcaagcgggtggctctgg

SEQ ID NO: 6111115 - DNA, 13 bp, Homo sapiens
ctactcacacagg

SEQ ID NO: 6111116 - DNA, 15 bp, Homo sapiens
ctactcacacaggca

SEQ ID NO: 6111117 - DNA, 23 bp, Homo sapiens
ctactcacacaggcatttcctgg

SEQ ID NO: 6111118 - DNA, 13 bp, Homo sapiens
ctactcactcaag

SEQ ID NO: 6111119 - DNA, 14 bp, Homo sapiens
ctactcactcaagt

SEQ ID NO: 6111120 - DNA, 22 bp, Homo sapiens
ctactcactcaagttcaaggac

SEQ ID NO: 6111121 - DNA, 22 bp, Homo sapiens
ctactcagaaatggacaaagaa

SEQ ID NO: 6111122 - DNA, 16 bp, Homo sapiens
ctactcagaagcctga

SEQ ID NO: 6111123 - DNA, 17 bp, Homo sapiens
ctactcagaagcctgag

SEQ ID NO: 6111124 - DNA, 19 bp, Homo sapiens
ctactcagaagcctgaggc

SEQ ID NO: 6111125 - DNA, 21 bp, Homo sapiens
ctactcagaagcctgaggctg

SEQ ID NO: 6111126 - DNA, 15 bp, Homo sapiens
ctactcagatctgca

SEQ ID NO: 6111127 - DNA, 22 bp, Homo sapiens
ctactcagatggctgaggcagg

SEQ ID NO: 6111128 - DNA, 15 bp, Homo sapiens
ctactcagcatttga

SEQ ID NO: 6111129 - DNA, 20 bp, Homo sapiens
ctactcaggaggctgagaca

SEQ ID NO: 6111130 - DNA, 20 bp, Homo sapiens
ctactcaggaggctgaggca

SEQ ID NO: 6111131 - DNA, 21 bp, Homo sapiens
ctactcatacttaagcaaaag

SEQ ID NO: 6111132 - DNA, 14 bp, Homo sapiens
ctactcatccagac

SEQ ID NO: 6111133 - DNA, 15 bp, Homo sapiens
ctactcatgactgaa

SEQ ID NO: 6111134 - DNA, 14 bp, Homo sapiens
ctactcatgccaga

SEQ ID NO: 6111135 - DNA, 16 bp, Homo sapiens
ctactcattgtctcag

SEQ ID NO: 6111136 - DNA, 12 bp, Homo sapiens
ctactccactgc

SEQ ID NO: 6111137 - DNA, 13 bp, Homo sapiens
ctactccactgcc

SEQ ID NO: 6111138 - DNA, 18 bp, Homo sapiens
ctactccactgccctggc

SEQ ID NO: 6111139 - DNA, 20 bp, Homo sapiens
ctactccactgccctggcag

SEQ ID NO: 6111140 - DNA, 11 bp, Homo sapiens
ctactccctct

SEQ ID NO: 6111141 - DNA, 17 bp, Homo sapiens
ctactccctcttccaaa

SEQ ID NO: 6111142 - DNA, 16 bp, Homo sapiens
ctactccctcttgtca

SEQ ID NO: 6111143 - DNA, 17 bp, Homo sapiens
ctactccctcttgtcag

SEQ ID NO: 6111144 - DNA, 14 bp, Homo sapiens
ctactccctgcaga

SEQ ID NO: 6111145 - DNA, 17 bp, Homo sapiens
ctactccctgcagatgc

SEQ ID NO: 6111146 - DNA, 13 bp, Homo sapiens
cctgtcctgcctc

SEQ ID NO: 6111147 - DNA, 18 bp, Homo sapiens
cctgtcctgcctcctcat

SEQ ID NO: 6111148 - DNA, 13 bp, Homo sapiens
cctgtcctgctca

SEQ ID NO: 6111149 - DNA, 16 bp, Homo sapiens
cctgtcctggctccca

SEQ ID NO: 6111150 - DNA, 15 bp, Homo sapiens
cctgtcctgggctgg

SEQ ID NO: 6111151 - DNA, 14 bp, Homo sapiens
cctgtcctggtcct

SEQ ID NO: 6111152 - DNA, 15 bp, Homo sapiens
cctgtcctggtggta

SEQ ID NO: 6111153 - DNA, 14 bp, Homo sapiens
cctgtcctgtgaat

SEQ ID NO: 6111154 - DNA, 17 bp, Homo sapiens
cctgtccttactcagag

SEQ ID NO: 6111155 - DNA, 21 bp, Homo sapiens
cctgtccttactcagagctgc

SEQ ID NO: 6111156 - DNA, 18 bp, Homo sapiens
cctgtccttcccacggcc

SEQ ID NO: 6111157 - DNA, 13 bp, Homo sapiens
cctgtccttccct

SEQ ID NO: 6111158 - DNA, 13 bp, Homo sapiens
cctgtccttctca

SEQ ID NO: 6111159 - DNA, 17 bp, Homo sapiens
cctgtccttctcaggct

SEQ ID NO: 6111160 - DNA, 18 bp, Homo sapiens
cctgtccttgaaaaacaa

SEQ ID NO: 6111161 - DNA, 19 bp, Homo sapiens
cctgtccttgaaaaacaaa

SEQ ID NO: 6111162 - DNA, 21 bp, Homo sapiens
cctgtcctttaccaaagatga

SEQ ID NO: 6111163 - DNA, 23 bp, Homo sapiens
cctgtcctttgttattatcctgc

SEQ ID NO: 6111164 - DNA, 23 bp, Homo sapiens
cctgtcgaaggggaggcacactt

SEQ ID NO: 6111165 - DNA, 23 bp, Homo sapiens
cctgtcgagttcggctctgggtg

SEQ ID NO: 6111166 - DNA, 21 bp, Homo sapiens
cctgtcgcctgcggactccat

SEQ ID NO: 6111167 - DNA, 17 bp, Homo sapiens
cctgtcggagccctgtc

SEQ ID NO: 6111168 - DNA, 18 bp, Homo sapiens
cctgtcggccacacccca

SEQ ID NO: 6111169 - DNA, 19 bp, Homo sapiens
cctgtcggccacaccccag

SEQ ID NO: 6111170 - DNA, 24 bp, Homo sapiens
cctgtcggccacaccccagactcc

SEQ ID NO: 6111171 - DNA, 14 bp, Homo sapiens
cctgtcgggcccgc

SEQ ID NO: 6111172 - DNA, 18 bp, Homo sapiens
cctgtcgtgccagtcctg

SEQ ID NO: 6111173 - DNA, 16 bp, Homo sapiens
cctgtcgtgtccagcc

SEQ ID NO: 6111174 - DNA, 17 bp, Homo sapiens
cctgtcgtgtccagcct

SEQ ID NO: 6111175 - DNA, 21 bp, Homo sapiens
cctgtctaacttggggaaggg

SEQ ID NO: 6111176 - DNA, 15 bp, Homo sapiens
cctgtctaatgaaac

SEQ ID NO: 6111177 - DNA, 14 bp, Homo sapiens
cctgtctagagagg

SEQ ID NO: 6111178 - DNA, 21 bp, Homo sapiens
cctgtctaggtcagtacccac

SEQ ID NO: 6111179 - DNA, 17 bp, Homo sapiens
cctgtctaggtctcctc

SEQ ID NO: 6111180 - DNA, 19 bp, Homo sapiens
cctgtctatactacagtag

SEQ ID NO: 6111181 - DNA, 23 bp, Homo sapiens
cctgtctcaaaaaaaaaaaaaac

SEQ ID NO: 6111182 - DNA, 21 bp, Homo sapiens
cctgtctcaaaaaaaaaaaga

SEQ ID NO: 6111183 - DNA, 12 bp, Homo sapiens
cctgtctcactc

SEQ ID NO: 6111184 - DNA, 16 bp, Homo sapiens
cctgtctcagcctccc

SEQ ID NO: 6111185 - DNA, 14 bp, Homo sapiens
cctgtctcagctgt

SEQ ID NO: 6111186 - DNA, 15 bp, Homo sapiens
cctgtctccactgtg

SEQ ID NO: 6111187 - DNA, 13 bp, Homo sapiens
cctgtctccagct

SEQ ID NO: 6111188 - DNA, 17 bp, Homo sapiens
cctgtctccagctgcct

SEQ ID NO: 6111189 - DNA, 21 bp, Homo sapiens
cctgtctccagctgcctgggc

SEQ ID NO: 6111190 - DNA, 23 bp, Homo sapiens
cctgtctccagctgcctgggccc

SEQ ID NO: 6111191 - DNA, 21 bp, Homo sapiens
cctgtctccagggcccccacc

SEQ ID NO: 6111192 - DNA, 13 bp, Homo sapiens
cctgtctcccagg

SEQ ID NO: 6111193 - DNA, 15 bp, Homo sapiens
cctgtctcccctctg

SEQ ID NO: 6111194 - DNA, 19 bp, Homo sapiens
cctgtctcccctctgctgg

SEQ ID NO: 6111195 - DNA, 14 bp, Homo sapiens
cctgtctccctggg

SEQ ID NO: 6111196 - DNA, 22 bp, Homo sapiens
cctgtctcctcccaggtttctt

SEQ ID NO: 6111197 - DNA, 16 bp, Homo sapiens
cctgtctcctggcggt

SEQ ID NO: 6111198 - DNA, 12 bp, Homo sapiens
cctgtctccttt

SEQ ID NO: 6111199 - DNA, 13 bp, Homo sapiens
cctgtctcctttc

SEQ ID NO: 6111200 - DNA, 21 bp, Homo sapiens
cctgtctcctttgcaggctca

SEQ ID NO: 6111201 - DNA, 12 bp, Homo sapiens
cctgtctctaaa

SEQ ID NO: 6111202 - DNA, 21 bp, Homo sapiens
cctgtctctacaaaaaaaatc

SEQ ID NO: 6111203 - DNA, 21 bp, Homo sapiens
cctgtctctagccactttggt

SEQ ID NO: 6111204 - DNA, 22 bp, Homo sapiens
cctgtctctattagctgggttc

SEQ ID NO: 6111205 - DNA, 20 bp, Homo sapiens
cctgtctctcagggccaggc

SEQ ID NO: 6111206 - DNA, 20 bp, Homo sapiens
cctgtctctccctaccctct

SEQ ID NO: 6111207 - DNA, 21 bp, Homo sapiens
cctgtctcttgggaagcagtt

SEQ ID NO: 6111208 - DNA, 13 bp, Homo sapiens
cctgtctctttcc

SEQ ID NO: 6111209 - DNA, 19 bp, Homo sapiens
cctgtctgaacctgccctt

SEQ ID NO: 6111210 - DNA, 16 bp, Homo sapiens
cctgtctgccagccag

SEQ ID NO: 6111211 - DNA, 12 bp, Homo sapiens
cctgtctgcccc

SEQ ID NO: 6111212 - DNA, 14 bp, Homo sapiens
cctgtctgccccag

SEQ ID NO: 6111213 - DNA, 15 bp, Homo sapiens
cctgtctgcgtgggt

SEQ ID NO: 6111214 - DNA, 14 bp, Homo sapiens
cctgtctgctccag

SEQ ID NO: 6111215 - DNA, 20 bp, Homo sapiens
cctgtctgctgccagcacag

SEQ ID NO: 6111216 - DNA, 21 bp, Homo sapiens
cctgtctgcttgcatctgcac

SEQ ID NO: 6111217 - DNA, 23 bp, Homo sapiens
cctgtctgcttgcatctgcacat

SEQ ID NO: 6111218 - DNA, 13 bp, Homo sapiens
cctgtctggaaga

SEQ ID NO: 6111219 - DNA, 16 bp, Homo sapiens
cctgtctggattgttt

SEQ ID NO: 6111220 - DNA, 18 bp, Homo sapiens
cctgtctggctcggaccc

SEQ ID NO: 6111221 - DNA, 21 bp, Homo sapiens
cctgtctggctcggacccacc

SEQ ID NO: 6111222 - DNA, 20 bp, Homo sapiens
cctgtctggcttctagagat

SEQ ID NO: 6111223 - DNA, 21 bp, Homo sapiens
cctgtctgtagagggccctgg

SEQ ID NO: 6111224 - DNA, 20 bp, Homo sapiens
cctgtctgtccaacccctcc

SEQ ID NO: 6111225 - DNA, 17 bp, Homo sapiens
cctgtctgtcccttttc

SEQ ID NO: 6111226 - DNA, 21 bp, Homo sapiens
cctgtctgtcccttttctttg

SEQ ID NO: 6111227 - DNA, 20 bp, Homo sapiens
cctgtctgtcgctgggctgt

SEQ ID NO: 6111228 - DNA, 18 bp, Homo sapiens
cctgtctgtctctccatc

SEQ ID NO: 6111229 - DNA, 21 bp, Homo sapiens
cctgtctgtctgtctgtccca

SEQ ID NO: 6111230 - DNA, 16 bp, Homo sapiens
cctgtctgtgtcccag

SEQ ID NO: 6111231 - DNA, 22 bp, Homo sapiens
cctgtctgttcccagcccctgc

SEQ ID NO: 6111232 - DNA, 15 bp, Homo sapiens
cctgtctgtttatat

SEQ ID NO: 6111233 - DNA, 19 bp, Homo sapiens
cctgtcttatggtccagaa

SEQ ID NO: 6111234 - DNA, 18 bp, Homo sapiens
cctgtcttattaagactg

SEQ ID NO: 6111235 - DNA, 20 bp, Homo sapiens
cctgtcttcacctgccacca

SEQ ID NO: 6111236 - DNA, 21 bp, Homo sapiens
cctgtcttcacctgccaccac

SEQ ID NO: 6111237 - DNA, 23 bp, Homo sapiens
cctgtcttcacctgccaccacac

SEQ ID NO: 6111238 - DNA, 22 bp, Homo sapiens
cctgtcttcagatcctgctgcc

SEQ ID NO: 6111239 - DNA, 15 bp, Homo sapiens
cctgtcttccaagga

SEQ ID NO: 6111240 - DNA, 16 bp, Homo sapiens
cctgtcttcccagggt

SEQ ID NO: 6111241 - DNA, 19 bp, Homo sapiens
cctgtcttcggccgagctg

SEQ ID NO: 6111242 - DNA, 22 bp, Homo sapiens
cctgtcttcggccgagctggtt

SEQ ID NO: 6111243 - DNA, 15 bp, Homo sapiens
cctgtcttctgcttt

SEQ ID NO: 6111244 - DNA, 16 bp, Homo sapiens
cctgtcttctgctttg

SEQ ID NO: 6111245 - DNA, 15 bp, Homo sapiens
cctgtcttctgggca

SEQ ID NO: 6111246 - DNA, 13 bp, Homo sapiens
cctgtcttcttaa

SEQ ID NO: 6111247 - DNA, 13 bp, Homo sapiens
cctgtcttctttc

SEQ ID NO: 6111248 - DNA, 18 bp, Homo sapiens
cctgtcttctttctccat

SEQ ID NO: 6111249 - DNA, 22 bp, Homo sapiens
cctgtcttgaataagagtgatt

SEQ ID NO: 6111250 - DNA, 15 bp, Homo sapiens
cctgtcttgagtaga

SEQ ID NO: 6111251 - DNA, 17 bp, Homo sapiens
cctgtcttgcctttttc

SEQ ID NO: 6111252 - DNA, 19 bp, Homo sapiens
cctgtcttgctcctgggga

SEQ ID NO: 6111253 - DNA, 16 bp, Homo sapiens
cctgtcttggcctccc

SEQ ID NO: 6111254 - DNA, 15 bp, Homo sapiens
cctgtctttaaaaat

SEQ ID NO: 6111255 - DNA, 17 bp, Homo sapiens
cctgtctttaaggaaaa

SEQ ID NO: 6111256 - DNA, 13 bp, Homo sapiens
cctgtctttccta

SEQ ID NO: 6111257 - DNA, 18 bp, Homo sapiens
cctgtgaacccaggacaa

SEQ ID NO: 6111258 - DNA, 21 bp, Homo sapiens
cctgtgaagaaaggacctgca

SEQ ID NO: 6111259 - DNA, 19 bp, Homo sapiens
cctgtgaagagatccttcc

SEQ ID NO: 6111260 - DNA, 16 bp, Homo sapiens
cctgtgaagcagtcag

SEQ ID NO: 6111261 - DNA, 20 bp, Homo sapiens
cctgtgaataaaaaccctgt

SEQ ID NO: 6111262 - DNA, 10 bp, Homo sapiens
cctgtgaatg

SEQ ID NO: 6111263 - DNA, 15 bp, Homo sapiens
cctgtgaatggaagc

SEQ ID NO: 6111264 - DNA, 15 bp, Homo sapiens
cctgtgaatggaggc

SEQ ID NO: 6111265 - DNA, 19 bp, Homo sapiens
cctgtgaatggcagcctga

SEQ ID NO: 6111266 - DNA, 17 bp, Homo sapiens
cctgtgacaaaggatga

SEQ ID NO: 6111267 - DNA, 17 bp, Homo sapiens
cctgtgacatggtgcct

SEQ ID NO: 6111268 - DNA, 15 bp, Homo sapiens
cctgtgaccacaaca

SEQ ID NO: 6111269 - DNA, 22 bp, Homo sapiens
cctgtgaccggggtcctgaggc

SEQ ID NO: 6111270 - DNA, 19 bp, Homo sapiens
cctgtgacctggtctggtc

SEQ ID NO: 6111271 - DNA, 17 bp, Homo sapiens
cctgtgaccttgggacc

SEQ ID NO: 6111272 - DNA, 22 bp, Homo sapiens
cctgtgactcctcccttcccca

SEQ ID NO: 6111273 - DNA, 22 bp, Homo sapiens
cctgtgactgctggtaaaataa

SEQ ID NO: 6111274 - DNA, 16 bp, Homo sapiens
cctgtgactgtctcac

SEQ ID NO: 6111275 - DNA, 18 bp, Homo sapiens
cctgtgacttcagctctg

SEQ ID NO: 6111276 - DNA, 16 bp, Homo sapiens
cctgtgagaaaggaaa

SEQ ID NO: 6111277 - DNA, 20 bp, Homo sapiens
cctgtgagaaaggaaaaatt

SEQ ID NO: 6111278 - DNA, 14 bp, Homo sapiens
cctgtgagagccac

SEQ ID NO: 6111279 - DNA, 23 bp, Homo sapiens
cctgtgagatgtgtatcagtgtt

SEQ ID NO: 6111280 - DNA, 20 bp, Homo sapiens
cctgtgagcaagagccaggg

SEQ ID NO: 6111281 - DNA, 21 bp, Homo sapiens
cctgtgagcaagagccagggg

SEQ ID NO: 6111282 - DNA, 20 bp, Homo sapiens
cctgtgagcccagctgggtc

SEQ ID NO: 6111283 - DNA, 16 bp, Homo sapiens
cctgtgagctgcacca

SEQ ID NO: 6111284 - DNA, 21 bp, Homo sapiens
cctgtgaggagccccatctgt

SEQ ID NO: 6111285 - DNA, 11 bp, Homo sapiens
cctgtgaggat

SEQ ID NO: 6111286 - DNA, 20 bp, Homo sapiens
cctgtgagggagtgcagaac

SEQ ID NO: 6111287 - DNA, 13 bp, Homo sapiens
cctgtgagggcga

SEQ ID NO: 6111288 - DNA, 18 bp, Homo sapiens
cctgtgaggggcccctgg

SEQ ID NO: 6111289 - DNA, 22 bp, Homo sapiens
cctgtgaggggcccctggccca

SEQ ID NO: 6111290 - DNA, 23 bp, Homo sapiens
cctgtgaggggcccctggcccag

SEQ ID NO: 6111291 - DNA, 15 bp, Homo sapiens
cctgtgagtaaatat

SEQ ID NO: 6111292 - DNA, 16 bp, Homo sapiens
cctgtgagtaaatatt

SEQ ID NO: 6111293 - DNA, 22 bp, Homo sapiens
cctgtgatatggcggcctgcag

SEQ ID NO: 6111294 - DNA, 17 bp, Homo sapiens
cctgtgatcgtgtgttg

SEQ ID NO: 6111295 - DNA, 20 bp, Homo sapiens
cctgtgatcgtgtgttgcca

SEQ ID NO: 6111296 - DNA, 17 bp, Homo sapiens
cctgtgatcttattttt

SEQ ID NO: 6111297 - DNA, 17 bp, Homo sapiens
cctgtgatgtcagcggt

SEQ ID NO: 6111298 - DNA, 12 bp, Homo sapiens
cctgtgatgtcc

SEQ ID NO: 6111299 - DNA, 15 bp, Homo sapiens
cctgtgatgttttat

SEQ ID NO: 6111300 - DNA, 12 bp, Homo sapiens
cctgtgatttct

SEQ ID NO: 6111301 - DNA, 17 bp, Homo sapiens
cctgtgcaaaaaaatta

SEQ ID NO: 6111302 - DNA, 23 bp, Homo sapiens
cctgtgcaaattttaaaaaggaa

SEQ ID NO: 6111303 - DNA, 18 bp, Homo sapiens
cctgtgcacaccccactc

SEQ ID NO: 6111304 - DNA, 16 bp, Homo sapiens
cctgtgcactgggcag

SEQ ID NO: 6111305 - DNA, 17 bp, Homo sapiens
cctgtgcactgggcagg

SEQ ID NO: 6111306 - DNA, 14 bp, Homo sapiens
cctgtgcagcagcc

SEQ ID NO: 6111307 - DNA, 17 bp, Homo sapiens
cctgtgcagcagcccag

SEQ ID NO: 6111308 - DNA, 22 bp, Homo sapiens
cctgtgcagcagcccagcttcc

SEQ ID NO: 6111309 - DNA, 18 bp, Homo sapiens
cctgtgcagccgctgagc

SEQ ID NO: 6111310 - DNA, 18 bp, Homo sapiens
cctgtgcagggccctctg

SEQ ID NO: 6111311 - DNA, 14 bp, Homo sapiens
cctgtgcatgtatg

SEQ ID NO: 6111312 - DNA, 17 bp, Homo sapiens
cctgtgcatgtatgtct

SEQ ID NO: 6111313 - DNA, 13 bp, Homo sapiens
cctgtgccaacct

SEQ ID NO: 6111314 - DNA, 20 bp, Homo sapiens
cctgtgccaacctgatgccc

SEQ ID NO: 6111315 - DNA, 17 bp, Homo sapiens
cctgtgccaccccttcc

SEQ ID NO: 6111316 - DNA, 12 bp, Homo sapiens
cctgtgccacct

SEQ ID NO: 6111317 - DNA, 13 bp, Homo sapiens
cctgtgccacctg

SEQ ID NO: 6111318 - DNA, 22 bp, Homo sapiens
cctgtgccacctgcaagtgccc

SEQ ID NO: 6111319 - DNA, 14 bp, Homo sapiens
cctgtgccactttg

SEQ ID NO: 6111320 - DNA, 14 bp, Homo sapiens
cctgtgccagcacc

SEQ ID NO: 6111321 - DNA, 17 bp, Homo sapiens
cctgtgccagcaccaca

SEQ ID NO: 6111322 - DNA, 22 bp, Homo sapiens
cctgtgccaggactctctttct

SEQ ID NO: 6111323 - DNA, 21 bp, Homo sapiens
cctgtgccatgcccaaggcct

SEQ ID NO: 6111324 - DNA, 15 bp, Homo sapiens
ctactccctggacca

SEQ ID NO: 6111325 - DNA, 17 bp, Homo sapiens
ctactccctggaccacg

SEQ ID NO: 6111326 - DNA, 16 bp, Homo sapiens
ctactccgttcctggc

SEQ ID NO: 6111327 - DNA, 16 bp, Homo sapiens
ctactcctacctcagc

SEQ ID NO: 6111328 - DNA, 18 bp, Homo sapiens
ctactcctacctcagcct

SEQ ID NO: 6111329 - DNA, 13 bp, Homo sapiens
ctactcctcacag

SEQ ID NO: 6111330 - DNA, 15 bp, Homo sapiens
ctactcctcacagca

SEQ ID NO: 6111331 - DNA, 17 bp, Homo sapiens
ctactcctccccctcct

SEQ ID NO: 6111332 - DNA, 18 bp, Homo sapiens
ctactcctccccctcctc

SEQ ID NO: 6111333 - DNA, 19 bp, Homo sapiens
ctactcctccccctcctcc

SEQ ID NO: 6111334 - DNA, 14 bp, Homo sapiens
ctactcctgggtca

SEQ ID NO: 6111335 - DNA, 13 bp, Homo sapiens
ctactcctgtctt

SEQ ID NO: 6111336 - DNA, 13 bp, Homo sapiens
ctactcctgtgct

SEQ ID NO: 6111337 - DNA, 14 bp, Homo sapiens
ctactcctgtgctc

SEQ ID NO: 6111338 - DNA, 14 bp, Homo sapiens
ctactcctttggaa

SEQ ID NO: 6111339 - DNA, 14 bp, Homo sapiens
ctactccttttcct

SEQ ID NO: 6111340 - DNA, 13 bp, Homo sapiens
ctactcgagccca

SEQ ID NO: 6111341 - DNA, 15 bp, Homo sapiens
ctactcgagttacag

SEQ ID NO: 6111342 - DNA, 16 bp, Homo sapiens
ctactcgagttacaga

SEQ ID NO: 6111343 - DNA, 20 bp, Homo sapiens
ctactcgcttgctagaagta

SEQ ID NO: 6111344 - DNA, 16 bp, Homo sapiens
ctactcggatggggca

SEQ ID NO: 6111345 - DNA, 16 bp, Homo sapiens
ctactcgggaagctga

SEQ ID NO: 6111346 - DNA, 17 bp, Homo sapiens
ctactctaaagaaaaat

SEQ ID NO: 6111347 - DNA, 18 bp, Homo sapiens
ctactctaaagaaaaatg

SEQ ID NO: 6111348 - DNA, 21 bp, Homo sapiens
ctactctaaagaaaaatgcct

SEQ ID NO: 6111349 - DNA, 22 bp, Homo sapiens
ctactctaccatggttctgcct

SEQ ID NO: 6111350 - DNA, 12 bp, Homo sapiens
ctactctagaag

SEQ ID NO: 6111351 - DNA, 18 bp, Homo sapiens
ctactctaggactgggcc

SEQ ID NO: 6111352 - DNA, 21 bp, Homo sapiens
ctactctatatacttttgctt

SEQ ID NO: 6111353 - DNA, 22 bp, Homo sapiens
ctactctcaggtttttgaggaa

SEQ ID NO: 6111354 - DNA, 18 bp, Homo sapiens
ctactctcccatggctta

SEQ ID NO: 6111355 - DNA, 17 bp, Homo sapiens
ctactctcctcggcccc

SEQ ID NO: 6111356 - DNA, 15 bp, Homo sapiens
ctactctcttgccag

SEQ ID NO: 6111357 - DNA, 20 bp, Homo sapiens
ctactctgagacaaaagaaa

SEQ ID NO: 6111358 - DNA, 22 bp, Homo sapiens
ctactctgccaatcggctaccc

SEQ ID NO: 6111359 - DNA, 23 bp, Homo sapiens
ctactctggaagtccccgggagc

SEQ ID NO: 6111360 - DNA, 13 bp, Homo sapiens
ctactctggaatg

SEQ ID NO: 6111361 - DNA, 13 bp, Homo sapiens
ctactctgtccag

SEQ ID NO: 6111362 - DNA, 13 bp, Homo sapiens
ctactctgtgcca

SEQ ID NO: 6111363 - DNA, 22 bp, Homo sapiens
ctactctgtgccagagcctggg

SEQ ID NO: 6111364 - DNA, 13 bp, Homo sapiens
ctactctgtgtaa

SEQ ID NO: 6111365 - DNA, 16 bp, Homo sapiens
ctactctgtgtcaggt

SEQ ID NO: 6111366 - DNA, 16 bp, Homo sapiens
ctactctgttccttca

SEQ ID NO: 6111367 - DNA, 19 bp, Homo sapiens
ctactctgttccttcacat

SEQ ID NO: 6111368 - DNA, 22 bp, Homo sapiens
ctactcttaagccatcttggta

SEQ ID NO: 6111369 - DNA, 24 bp, Homo sapiens
ctactcttccaggactctctgctt

SEQ ID NO: 6111370 - DNA, 18 bp, Homo sapiens
ctactcttctctctgctc

SEQ ID NO: 6111371 - DNA, 18 bp, Homo sapiens
ctactcttgagagctcag

SEQ ID NO: 6111372 - DNA, 22 bp, Homo sapiens
ctactcttggatgggacatttt

SEQ ID NO: 6111373 - DNA, 14 bp, Homo sapiens
ctactctttgattt

SEQ ID NO: 6111374 - DNA, 21 bp, Homo sapiens
ctactctttgttttctttcct

SEQ ID NO: 6111375 - DNA, 19 bp, Homo sapiens
ctactcttttgaagtgttt

SEQ ID NO: 6111376 - DNA, 18 bp, Homo sapiens
ctactgaaaaaaatggag

SEQ ID NO: 6111377 - DNA, 17 bp, Homo sapiens
ctactgaaacttacctg

SEQ ID NO: 6111378 - DNA, 12 bp, Homo sapiens
ctactgaaattt

SEQ ID NO: 6111379 - DNA, 20 bp, Homo sapiens
ctactgaacacatgtgtatg

SEQ ID NO: 6111380 - DNA, 19 bp, Homo sapiens
ctactgaaccctgcctctt

SEQ ID NO: 6111381 - DNA, 17 bp, Homo sapiens
ctactgaactgttacct

SEQ ID NO: 6111382 - DNA, 24 bp, Homo sapiens
ctactgaactgttacctaggttaa

SEQ ID NO: 6111383 - DNA, 21 bp, Homo sapiens
ctactgaagggaacagcctga

SEQ ID NO: 6111384 - DNA, 12 bp, Homo sapiens
ctactgaataaa

SEQ ID NO: 6111385 - DNA, 14 bp, Homo sapiens
ctactgaataaatc

SEQ ID NO: 6111386 - DNA, 21 bp, Homo sapiens
ctactgaatgacctctctact

SEQ ID NO: 6111387 - DNA, 12 bp, Homo sapiens
ctactgaattta

SEQ ID NO: 6111388 - DNA, 16 bp, Homo sapiens
ctactgaatttattgc

SEQ ID NO: 6111389 - DNA, 19 bp, Homo sapiens
ctactgacatatctacact

SEQ ID NO: 6111390 - DNA, 14 bp, Homo sapiens
ctactgacccagag

SEQ ID NO: 6111391 - DNA, 14 bp, Homo sapiens
ctactgagaacata

SEQ ID NO: 6111392 - DNA, 20 bp, Homo sapiens
ctactgagctgagaccactg

SEQ ID NO: 6111393 - DNA, 19 bp, Homo sapiens
ctactgattttaaaatgaa

SEQ ID NO: 6111394 - DNA, 20 bp, Homo sapiens
ctactgattttaaaatgaat

SEQ ID NO: 6111395 - DNA, 16 bp, Homo sapiens
ctactgatttttgtga

SEQ ID NO: 6111396 - DNA, 16 bp, Homo sapiens
ctactgcaagagccaa

SEQ ID NO: 6111397 - DNA, 18 bp, Homo sapiens
ctactgcaagagccaagt

SEQ ID NO: 6111398 - DNA, 23 bp, Homo sapiens
ctactgcactttcccccttcccg

SEQ ID NO: 6111399 - DNA, 21 bp, Homo sapiens
ctactgcagcacctccaggcc

SEQ ID NO: 6111400 - DNA, 16 bp, Homo sapiens
ctactgcagtctttat

SEQ ID NO: 6111401 - DNA, 17 bp, Homo sapiens
ctactgcatttagggag

SEQ ID NO: 6111402 - DNA, 20 bp, Homo sapiens
ctactgcatttataggacct

SEQ ID NO: 6111403 - DNA, 14 bp, Homo sapiens
ctactgccaacctc

SEQ ID NO: 6111404 - DNA, 22 bp, Homo sapiens
ctactgccaacctcgctccaac

SEQ ID NO: 6111405 - DNA, 23 bp, Homo sapiens
ctactgccaacctcgctccaact

SEQ ID NO: 6111406 - DNA, 14 bp, Homo sapiens
ctactgccatcctg

SEQ ID NO: 6111407 - DNA, 23 bp, Homo sapiens
ctactgccatcctggcccagggc

SEQ ID NO: 6111408 - DNA, 14 bp, Homo sapiens
ctactgcccacatt

SEQ ID NO: 6111409 - DNA, 15 bp, Homo sapiens
ctactgccccagctc

SEQ ID NO: 6111410 - DNA, 16 bp, Homo sapiens
ctactgccccagctcc

SEQ ID NO: 6111411 - DNA, 18 bp, Homo sapiens
ctactgcccctgccctga

SEQ ID NO: 6111412 - DNA, 19 bp, Homo sapiens
ctactgcccctgccctgag

SEQ ID NO: 6111413 - DNA, 21 bp, Homo sapiens
ctactgccgtcagtgctgtgc

SEQ ID NO: 6111414 - DNA, 15 bp, Homo sapiens
ctactgcctttagaa

SEQ ID NO: 6111415 - DNA, 13 bp, Homo sapiens
ctactgcctttca

SEQ ID NO: 6111416 - DNA, 12 bp, Homo sapiens
ctactgctattt

SEQ ID NO: 6111417 - DNA, 16 bp, Homo sapiens
ctactgctcagcttct

SEQ ID NO: 6111418 - DNA, 15 bp, Homo sapiens
ctactgctcctgtgg

SEQ ID NO: 6111419 - DNA, 16 bp, Homo sapiens
ctactgctcctgtggc

SEQ ID NO: 6111420 - DNA, 21 bp, Homo sapiens
ctactgctcctgtggcaggag

SEQ ID NO: 6111421 - DNA, 19 bp, Homo sapiens
ctactgctgcaaagtgcaa

SEQ ID NO: 6111422 - DNA, 11 bp, Homo sapiens
ctactgctgtg

SEQ ID NO: 6111423 - DNA, 12 bp, Homo sapiens
ctactgcttcta

SEQ ID NO: 6111424 - DNA, 21 bp, Homo sapiens
ctactggaaatgtagcactta

SEQ ID NO: 6111425 - DNA, 22 bp, Homo sapiens
ctactggaatggtgttttgtca

SEQ ID NO: 6111426 - DNA, 22 bp, Homo sapiens
ctactggatgcttacagtgact

SEQ ID NO: 6111427 - DNA, 14 bp, Homo sapiens
ctactggattctta

SEQ ID NO: 6111428 - DNA, 15 bp, Homo sapiens
ctactggattcttat

SEQ ID NO: 6111429 - DNA, 11 bp, Homo sapiens
ctactggcagc

SEQ ID NO: 6111430 - DNA, 14 bp, Homo sapiens
ctactggcagctcc

SEQ ID NO: 6111431 - DNA, 15 bp, Homo sapiens
ctactggcagctcct

SEQ ID NO: 6111432 - DNA, 19 bp, Homo sapiens
ctactggcattaattatta

SEQ ID NO: 6111433 - DNA, 11 bp, Homo sapiens
ctactggctgt

SEQ ID NO: 6111434 - DNA, 16 bp, Homo sapiens
ctactgggaaattact

SEQ ID NO: 6111435 - DNA, 21 bp, Homo sapiens
ctactgggagactgggacacc

SEQ ID NO: 6111436 - DNA, 14 bp, Homo sapiens
ctactgggagccta

SEQ ID NO: 6111437 - DNA, 15 bp, Homo sapiens
ctactgggagcctac

SEQ ID NO: 6111438 - DNA, 15 bp, Homo sapiens
ctactggggaaactg

SEQ ID NO: 6111439 - DNA, 16 bp, Homo sapiens
ctactggggaaactgg

SEQ ID NO: 6111440 - DNA, 18 bp, Homo sapiens
ctactggggaaacttcct

SEQ ID NO: 6111441 - DNA, 20 bp, Homo sapiens
ctactggggaggctgaggca

SEQ ID NO: 6111442 - DNA, 21 bp, Homo sapiens
ctactggggaggctgaggcag

SEQ ID NO: 6111443 - DNA, 14 bp, Homo sapiens
ctactggtctgtac

SEQ ID NO: 6111444 - DNA, 19 bp, Homo sapiens
ctactggtctgtactcctt

SEQ ID NO: 6111445 - DNA, 23 bp, Homo sapiens
ctactggtgatgcctaattatga

SEQ ID NO: 6111446 - DNA, 23 bp, Homo sapiens
ctactggtgtaatctcaatgcaa

SEQ ID NO: 6111447 - DNA, 16 bp, Homo sapiens
ctactggttacctgga

SEQ ID NO: 6111448 - DNA, 23 bp, Homo sapiens
ctactggttacctggagaagtag

SEQ ID NO: 6111449 - DNA, 18 bp, Homo sapiens
ctactgtaacttttttaa

SEQ ID NO: 6111450 - DNA, 12 bp, Homo sapiens
ctactgtaagag

SEQ ID NO: 6111451 - DNA, 22 bp, Homo sapiens
ctactgtaataaagatgattgt

SEQ ID NO: 6111452 - DNA, 18 bp, Homo sapiens
ctactgtaatgctgcctc

SEQ ID NO: 6111453 - DNA, 12 bp, Homo sapiens
ctactgtaatta

SEQ ID NO: 6111454 - DNA, 15 bp, Homo sapiens
ctactgtaattaagt

SEQ ID NO: 6111455 - DNA, 18 bp, Homo sapiens
ctactgtaattaagtgca

SEQ ID NO: 6111456 - DNA, 16 bp, Homo sapiens
ctactgtaatttgtga

SEQ ID NO: 6111457 - DNA, 13 bp, Homo sapiens
ctactgtacataa

SEQ ID NO: 6111458 - DNA, 20 bp, Homo sapiens
ctactgtacataaacaatga

SEQ ID NO: 6111459 - DNA, 12 bp, Homo sapiens
ctactgtacatt

SEQ ID NO: 6111460 - DNA, 14 bp, Homo sapiens
ctactgtagaaaca

SEQ ID NO: 6111461 - DNA, 15 bp, Homo sapiens
ctactgtagaaagga

SEQ ID NO: 6111462 - DNA, 17 bp, Homo sapiens
ctactgtagaaaggaaa

SEQ ID NO: 6111463 - DNA, 19 bp, Homo sapiens
ctactgtagaactgatttt

SEQ ID NO: 6111464 - DNA, 20 bp, Homo sapiens
ctactgtagaactgatttta

SEQ ID NO: 6111465 - DNA, 21 bp, Homo sapiens
ctactgtagaactgattttac

SEQ ID NO: 6111466 - DNA, 21 bp, Homo sapiens
ctactgtagaactgcaatttc

SEQ ID NO: 6111467 - DNA, 23 bp, Homo sapiens
ctactgtagaagaagtgaacact

SEQ ID NO: 6111468 - DNA, 20 bp, Homo sapiens
ctactgtagatttgtatcct

SEQ ID NO: 6111469 - DNA, 23 bp, Homo sapiens
ctactgtatcaataaaattctgt

SEQ ID NO: 6111470 - DNA, 19 bp, Homo sapiens
ctactgtattcccacaagg

SEQ ID NO: 6111471 - DNA, 17 bp, Homo sapiens
ctactgtatttcattat

SEQ ID NO: 6111472 - DNA, 17 bp, Homo sapiens
ctactgtcaaatgatgt

SEQ ID NO: 6111473 - DNA, 18 bp, Homo sapiens
ctactgtcaaatgatgtg

SEQ ID NO: 6111474 - DNA, 20 bp, Homo sapiens
ctactgtcaaatgatgtgca

SEQ ID NO: 6111475 - DNA, 19 bp, Homo sapiens
ctactgtccctctcagtgc

SEQ ID NO: 6111476 - DNA, 19 bp, Homo sapiens
ctactgtcctacccaccct

SEQ ID NO: 6111477 - DNA, 20 bp, Homo sapiens
ctactgtctcactgaaacat

SEQ ID NO: 6111478 - DNA, 24 bp, Homo sapiens
ctactgtctcctccctgggctaag

SEQ ID NO: 6111479 - DNA, 15 bp, Homo sapiens
ctactgtctccttcc

SEQ ID NO: 6111480 - DNA, 17 bp, Homo sapiens
ctactgtctccttccca

SEQ ID NO: 6111481 - DNA, 15 bp, Homo sapiens
ctactgtggaaagac

SEQ ID NO: 6111482 - DNA, 16 bp, Homo sapiens
ctactgtgggcaaagt

SEQ ID NO: 6111483 - DNA, 14 bp, Homo sapiens
ctactgtggggaga

SEQ ID NO: 6111484 - DNA, 21 bp, Homo sapiens
ctactgtggggagagatggca

SEQ ID NO: 6111485 - DNA, 19 bp, Homo sapiens
ctactgtgttcctggcaat

SEQ ID NO: 6111486 - DNA, 20 bp, Homo sapiens
ctactgtgttcctggcaata

SEQ ID NO: 6111487 - DNA, 19 bp, Homo sapiens
ctactgttactctaaatag

SEQ ID NO: 6111488 - DNA, 21 bp, Homo sapiens
ctactgttaggaacagcagtg

SEQ ID NO: 6111489 - DNA, 20 bp, Homo sapiens
ctactgttataattattcct

SEQ ID NO: 6111490 - DNA, 20 bp, Homo sapiens
ctactgttatcagtaatgct

SEQ ID NO: 6111491 - DNA, 17 bp, Homo sapiens
ctactgttatgtgagaa

SEQ ID NO: 6111492 - DNA, 22 bp, Homo sapiens
ctactgttcagcttttattcct

SEQ ID NO: 6111493 - DNA, 18 bp, Homo sapiens
ctactgttcctttcagat

SEQ ID NO: 6111494 - DNA, 15 bp, Homo sapiens
ctactgttctaaagc

SEQ ID NO: 6111495 - DNA, 20 bp, Homo sapiens
ctactgttgcacagccagaa

SEQ ID NO: 6111496 - DNA, 15 bp, Homo sapiens
ctactgtttgatttg

SEQ ID NO: 6111497 - DNA, 23 bp, Homo sapiens
ctactgttttaatttatactggc

SEQ ID NO: 6111498 - DNA, 23 bp, Homo sapiens
ctacttaaaatgattctctacca

SEQ ID NO: 6111499 - DNA, 23 bp, Homo sapiens
ctacttaaacaaaaactttccat

SEQ ID NO: 6111500 - DNA, 16 bp, Homo sapiens
ctacttaatgcacagt

SEQ ID NO: 6111501 - DNA, 15 bp, Homo sapiens
ctacttaattccttt

SEQ ID NO: 6111502 - DNA, 14 bp, Homo sapiens
cctgtgcccaccca

SEQ ID NO: 6111503 - DNA, 20 bp, Homo sapiens
cctgtgcccacccagggccc

SEQ ID NO: 6111504 - DNA, 14 bp, Homo sapiens
cctgtgcccacgtg

SEQ ID NO: 6111505 - DNA, 21 bp, Homo sapiens
cctgtgcccatcatctctgcc

SEQ ID NO: 6111506 - DNA, 14 bp, Homo sapiens
cctgtgccccagct

SEQ ID NO: 6111507 - DNA, 14 bp, Homo sapiens
cctgtgccccagtt

SEQ ID NO: 6111508 - DNA, 16 bp, Homo sapiens
cctgtgcccccagcct

SEQ ID NO: 6111509 - DNA, 14 bp, Homo sapiens
cctgtgcccctcag

SEQ ID NO: 6111510 - DNA, 22 bp, Homo sapiens
cctgtgcccctcagagaggcat

SEQ ID NO: 6111511 - DNA, 20 bp, Homo sapiens
cctgtgcccgactgactgga

SEQ ID NO: 6111512 - DNA, 21 bp, Homo sapiens
cctgtgcccgctgcgctgccc

SEQ ID NO: 6111513 - DNA, 14 bp, Homo sapiens
cctgtgccctcacc

SEQ ID NO: 6111514 - DNA, 17 bp, Homo sapiens
cctgtgccctccttccc

SEQ ID NO: 6111515 - DNA, 19 bp, Homo sapiens
cctgtgccctccttcccaa

SEQ ID NO: 6111516 - DNA, 20 bp, Homo sapiens
cctgtgccctgcacgtatac

SEQ ID NO: 6111517 - DNA, 14 bp, Homo sapiens
cctgtgccgcactc

SEQ ID NO: 6111518 - DNA, 15 bp, Homo sapiens
cctgtgccgcactct

SEQ ID NO: 6111519 - DNA, 19 bp, Homo sapiens
cctgtgccgcactctggcg

SEQ ID NO: 6111520 - DNA, 18 bp, Homo sapiens
cctgtgcctaacaccagc

SEQ ID NO: 6111521 - DNA, 11 bp, Homo sapiens
cctgtgcctcc

SEQ ID NO: 6111522 - DNA, 16 bp, Homo sapiens
cctgtgcctccatcag

SEQ ID NO: 6111523 - DNA, 17 bp, Homo sapiens
cctgtgcctcccagctt

SEQ ID NO: 6111524 - DNA, 13 bp, Homo sapiens
cctgtgcctccct

SEQ ID NO: 6111525 - DNA, 20 bp, Homo sapiens
cctgtgcctcctcaccccca

SEQ ID NO: 6111526 - DNA, 15 bp, Homo sapiens
cctgtgcctctggga

SEQ ID NO: 6111527 - DNA, 20 bp, Homo sapiens
cctgtgcctctgggactgga

SEQ ID NO: 6111528 - DNA, 14 bp, Homo sapiens
cctgtgcctctgtc

SEQ ID NO: 6111529 - DNA, 13 bp, Homo sapiens
cctgtgcctgcca

SEQ ID NO: 6111530 - DNA, 15 bp, Homo sapiens
cctgtgcctgccatg

SEQ ID NO: 6111531 - DNA, 17 bp, Homo sapiens
cctgtgcctgccatggg

SEQ ID NO: 6111532 - DNA, 22 bp, Homo sapiens
cctgtgcctgccatgggccagc

SEQ ID NO: 6111533 - DNA, 16 bp, Homo sapiens
cctgtgcctgctgggc

SEQ ID NO: 6111534 - DNA, 20 bp, Homo sapiens
cctgtgcctggccccagcct

SEQ ID NO: 6111535 - DNA, 18 bp, Homo sapiens
cctgtgcctgggccctgg

SEQ ID NO: 6111536 - DNA, 23 bp, Homo sapiens
cctgtgcctgggccctgggctga

SEQ ID NO: 6111537 - DNA, 11 bp, Homo sapiens
cctgtgcctgt

SEQ ID NO: 6111538 - DNA, 21 bp, Homo sapiens
cctgtgcctgtcaggctctgg

SEQ ID NO: 6111539 - DNA, 13 bp, Homo sapiens
cctgtgcctgtgt

SEQ ID NO: 6111540 - DNA, 19 bp, Homo sapiens
cctgtgcgttcccttcagt

SEQ ID NO: 6111541 - DNA, 13 bp, Homo sapiens
cctgtgctacaga

SEQ ID NO: 6111542 - DNA, 13 bp, Homo sapiens
cctgtgctacctc

SEQ ID NO: 6111543 - DNA, 23 bp, Homo sapiens
cctgtgctactttgccttttgca

SEQ ID NO: 6111544 - DNA, 16 bp, Homo sapiens
cctgtgctagaagctc

SEQ ID NO: 6111545 - DNA, 14 bp, Homo sapiens
cctgtgctatttgt

SEQ ID NO: 6111546 - DNA, 19 bp, Homo sapiens
cctgtgctatttgtacaaa

SEQ ID NO: 6111547 - DNA, 22 bp, Homo sapiens
cctgtgctatttgtacaaataa

SEQ ID NO: 6111548 - DNA, 14 bp, Homo sapiens
cctgtgctcagccc

SEQ ID NO: 6111549 - DNA, 17 bp, Homo sapiens
cctgtgctcagccctga

SEQ ID NO: 6111550 - DNA, 18 bp, Homo sapiens
cctgtgctcccctgccac

SEQ ID NO: 6111551 - DNA, 19 bp, Homo sapiens
cctgtgctcccctgccaca

SEQ ID NO: 6111552 - DNA, 17 bp, Homo sapiens
cctgtgctccgtgcctc

SEQ ID NO: 6111553 - DNA, 21 bp, Homo sapiens
cctgtgctccgtgcctccacc

SEQ ID NO: 6111554 - DNA, 13 bp, Homo sapiens
cctgtgctcctgc

SEQ ID NO: 6111555 - DNA, 17 bp, Homo sapiens
cctgtgctcctgcccag

SEQ ID NO: 6111556 - DNA, 20 bp, Homo sapiens
cctgtgctctgggggtccct

SEQ ID NO: 6111557 - DNA, 23 bp, Homo sapiens
cctgtgctgaacataacttctca

SEQ ID NO: 6111558 - DNA, 16 bp, Homo sapiens
cctgtgctgaggactc

SEQ ID NO: 6111559 - DNA, 19 bp, Homo sapiens
cctgtgctgcatgcgacag

SEQ ID NO: 6111560 - DNA, 21 bp, Homo sapiens
cctgtgctgcccgtcttcagc

SEQ ID NO: 6111561 - DNA, 15 bp, Homo sapiens
cctgtgctgggccag

SEQ ID NO: 6111562 - DNA, 17 bp, Homo sapiens
cctgtgctgggccagtg

SEQ ID NO: 6111563 - DNA, 14 bp, Homo sapiens
cctgtgctggggga

SEQ ID NO: 6111564 - DNA, 23 bp, Homo sapiens
cctgtgctggtgtcctgaccacc

SEQ ID NO: 6111565 - DNA, 13 bp, Homo sapiens
cctgtgctgtgag

SEQ ID NO: 6111566 - DNA, 17 bp, Homo sapiens
cctgtgcttggaaccag

SEQ ID NO: 6111567 - DNA, 14 bp, Homo sapiens
cctgtgcttggagg

SEQ ID NO: 6111568 - DNA, 18 bp, Homo sapiens
cctgtgctttctgcatgc

SEQ ID NO: 6111569 - DNA, 17 bp, Homo sapiens
cctgtggaaatatgcaa

SEQ ID NO: 6111570 - DNA, 21 bp, Homo sapiens
cctgtggaaatatgcaacctg

SEQ ID NO: 6111571 - DNA, 23 bp, Homo sapiens
cctgtggaacataaaaaggacat

SEQ ID NO: 6111572 - DNA, 15 bp, Homo sapiens
cctgtggaacccagc

SEQ ID NO: 6111573 - DNA, 17 bp, Homo sapiens
cctgtggaacccagcag

SEQ ID NO: 6111574 - DNA, 11 bp, Homo sapiens
cctgtggaagc

SEQ ID NO: 6111575 - DNA, 19 bp, Homo sapiens
cctgtggaagggactagga

SEQ ID NO: 6111576 - DNA, 20 bp, Homo sapiens
cctgtggaagggactaggag

SEQ ID NO: 6111577 - DNA, 13 bp, Homo sapiens
cctgtggaataaa

SEQ ID NO: 6111578 - DNA, 22 bp, Homo sapiens
cctgtggaataaagatggtcca

SEQ ID NO: 6111579 - DNA, 23 bp, Homo sapiens
cctgtggaatgagtgtgcatgga

SEQ ID NO: 6111580 - DNA, 22 bp, Homo sapiens
cctgtggacaggatgaggacag

SEQ ID NO: 6111581 - DNA, 11 bp, Homo sapiens
cctgtggagac

SEQ ID NO: 6111582 - DNA, 22 bp, Homo sapiens
cctgtggagacagccctgccta

SEQ ID NO: 6111583 - DNA, 14 bp, Homo sapiens
cctgtggagactgg

SEQ ID NO: 6111584 - DNA, 19 bp, Homo sapiens
cctgtggagctcagccccg

SEQ ID NO: 6111585 - DNA, 17 bp, Homo sapiens
cctgtggaggggcttgg

SEQ ID NO: 6111586 - DNA, 18 bp, Homo sapiens
cctgtggagtccagctct

SEQ ID NO: 6111587 - DNA, 20 bp, Homo sapiens
cctgtggagtccagctctac

SEQ ID NO: 6111588 - DNA, 17 bp, Homo sapiens
cctgtggatgctgctgc

SEQ ID NO: 6111589 - DNA, 19 bp, Homo sapiens
cctgtggatgctgctgccc

SEQ ID NO: 6111590 - DNA, 20 bp, Homo sapiens
cctgtggatgggatcctctc

SEQ ID NO: 6111591 - DNA, 18 bp, Homo sapiens
cctgtggatgtaaagtga

SEQ ID NO: 6111592 - DNA, 17 bp, Homo sapiens
cctgtggattagaatag

SEQ ID NO: 6111593 - DNA, 18 bp, Homo sapiens
cctgtggattccagcatt

SEQ ID NO: 6111594 - DNA, 21 bp, Homo sapiens
cctgtggcagaaaagaggaga

SEQ ID NO: 6111595 - DNA, 21 bp, Homo sapiens
cctgtggcagaccgggggcca

SEQ ID NO: 6111596 - DNA, 22 bp, Homo sapiens
cctgtggcagctgcccctggca

SEQ ID NO: 6111597 - DNA, 13 bp, Homo sapiens
cctgtggcaggag

SEQ ID NO: 6111598 - DNA, 14 bp, Homo sapiens
cctgtggcaggagg

SEQ ID NO: 6111599 - DNA, 15 bp, Homo sapiens
cctgtggcaggcagc

SEQ ID NO: 6111600 - DNA, 16 bp, Homo sapiens
cctgtggcaggcctag

SEQ ID NO: 6111601 - DNA, 20 bp, Homo sapiens
cctgtggcaggcctaggacc

SEQ ID NO: 6111602 - DNA, 22 bp, Homo sapiens
cctgtggcaggcctaggacctc

SEQ ID NO: 6111603 - DNA, 23 bp, Homo sapiens
cctgtggcagtaaagagaaactt

SEQ ID NO: 6111604 - DNA, 18 bp, Homo sapiens
cctgtggcatctttgcct

SEQ ID NO: 6111605 - DNA, 17 bp, Homo sapiens
cctgtggccaactgcaa

SEQ ID NO: 6111606 - DNA, 22 bp, Homo sapiens
cctgtggccatgaccctgcctc

SEQ ID NO: 6111607 - DNA, 14 bp, Homo sapiens
cctgtggccctggc

SEQ ID NO: 6111608 - DNA, 17 bp, Homo sapiens
cctgtggccctggccac

SEQ ID NO: 6111609 - DNA, 13 bp, Homo sapiens
cctgtggccctgt

SEQ ID NO: 6111610 - DNA, 22 bp, Homo sapiens
cctgtggccctgtcctgccatg

SEQ ID NO: 6111611 - DNA, 16 bp, Homo sapiens
cctgtggccgccacct

SEQ ID NO: 6111612 - DNA, 11 bp, Homo sapiens
cctgtggcctc

SEQ ID NO: 6111613 - DNA, 14 bp, Homo sapiens
cctgtggcctcagc

SEQ ID NO: 6111614 - DNA, 17 bp, Homo sapiens
cctgtggcctcagcatc

SEQ ID NO: 6111615 - DNA, 12 bp, Homo sapiens
cctgtggcctga

SEQ ID NO: 6111616 - DNA, 15 bp, Homo sapiens
cctgtggcctgccag

SEQ ID NO: 6111617 - DNA, 13 bp, Homo sapiens
cctgtggcctgtg

SEQ ID NO: 6111618 - DNA, 18 bp, Homo sapiens
cctgtggcctgtgtccca

SEQ ID NO: 6111619 - DNA, 13 bp, Homo sapiens
cctgtggccttgc

SEQ ID NO: 6111620 - DNA, 14 bp, Homo sapiens
cctgtggccttgcc

SEQ ID NO: 6111621 - DNA, 17 bp, Homo sapiens
cctgtggccttgcccgc

SEQ ID NO: 6111622 - DNA, 22 bp, Homo sapiens
cctgtggccttgcccgccagcc

SEQ ID NO: 6111623 - DNA, 21 bp, Homo sapiens
cctgtggcgccgtctccaggg

SEQ ID NO: 6111624 - DNA, 17 bp, Homo sapiens
cctgtggcggccttccg

SEQ ID NO: 6111625 - DNA, 22 bp, Homo sapiens
cctgtggcgggtaggcaggaag

SEQ ID NO: 6111626 - DNA, 15 bp, Homo sapiens
cctgtggcggtgcct

SEQ ID NO: 6111627 - DNA, 16 bp, Homo sapiens
cctgtggcggtgcctg

SEQ ID NO: 6111628 - DNA, 18 bp, Homo sapiens
cctgtggcggtgcctggg

SEQ ID NO: 6111629 - DNA, 18 bp, Homo sapiens
cctgtggctccctctctc

SEQ ID NO: 6111630 - DNA, 21 bp, Homo sapiens
cctgtggctccctctctcctg

SEQ ID NO: 6111631 - DNA, 13 bp, Homo sapiens
cctgtggctgtcg

SEQ ID NO: 6111632 - DNA, 22 bp, Homo sapiens
cctgtggctgtgtgtctgcttg

SEQ ID NO: 6111633 - DNA, 21 bp, Homo sapiens
cctgtgggaagagaagggaag

SEQ ID NO: 6111634 - DNA, 22 bp, Homo sapiens
cctgtgggaagagaagggaagc

SEQ ID NO: 6111635 - DNA, 14 bp, Homo sapiens
cctgtgggaccgcc

SEQ ID NO: 6111636 - DNA, 17 bp, Homo sapiens
cctgtgggaccgcctgg

SEQ ID NO: 6111637 - DNA, 19 bp, Homo sapiens
cctgtgggaccgcctggcc

SEQ ID NO: 6111638 - DNA, 21 bp, Homo sapiens
cctgtgggagccgcagagcct

SEQ ID NO: 6111639 - DNA, 18 bp, Homo sapiens
cctgtgggagggggagga

SEQ ID NO: 6111640 - DNA, 13 bp, Homo sapiens
cctgtgggagtcc

SEQ ID NO: 6111641 - DNA, 14 bp, Homo sapiens
cctgtgggagtcca

SEQ ID NO: 6111642 - DNA, 19 bp, Homo sapiens
cctgtgggagtccactttc

SEQ ID NO: 6111643 - DNA, 23 bp, Homo sapiens
cctgtgggagtccactttcctct

SEQ ID NO: 6111644 - DNA, 18 bp, Homo sapiens
cctgtgggcagcatgccc

SEQ ID NO: 6111645 - DNA, 21 bp, Homo sapiens
cctgtgggcctcacctgcccc

SEQ ID NO: 6111646 - DNA, 14 bp, Homo sapiens
cctgtgggctcaca

SEQ ID NO: 6111647 - DNA, 18 bp, Homo sapiens
cctgtgggctcacaccgg

SEQ ID NO: 6111648 - DNA, 20 bp, Homo sapiens
cctgtgggcttatgtctctg

SEQ ID NO: 6111649 - DNA, 22 bp, Homo sapiens
cctgtgggcttatgtctctgcc

SEQ ID NO: 6111650 - DNA, 23 bp, Homo sapiens
cctgtgggcttatgtctctgcct

SEQ ID NO: 6111651 - DNA, 13 bp, Homo sapiens
cctgtggggcagg

SEQ ID NO: 6111652 - DNA, 20 bp, Homo sapiens
cctgtgggggaagagcacag

SEQ ID NO: 6111653 - DNA, 21 bp, Homo sapiens
cctgtgggggaagagcacagc

SEQ ID NO: 6111654 - DNA, 17 bp, Homo sapiens
cctgtgggggtggccat

SEQ ID NO: 6111655 - DNA, 22 bp, Homo sapiens
cctgtgggggtggccatccctg

SEQ ID NO: 6111656 - DNA, 23 bp, Homo sapiens
cctgtggggtcaacccttctgga

SEQ ID NO: 6111657 - DNA, 17 bp, Homo sapiens
cctgtggggtctgatgt

SEQ ID NO: 6111658 - DNA, 20 bp, Homo sapiens
cctgtgggtggggcttctct

SEQ ID NO: 6111659 - DNA, 17 bp, Homo sapiens
cctgtgggtgtagccag

SEQ ID NO: 6111660 - DNA, 17 bp, Homo sapiens
cctgtgggtgtctccct

SEQ ID NO: 6111661 - DNA, 19 bp, Homo sapiens
cctgtgggtgtctccctcg

SEQ ID NO: 6111662 - DNA, 21 bp, Homo sapiens
cctgtgggtgtctccctcggg

SEQ ID NO: 6111663 - DNA, 12 bp, Homo sapiens
cctgtgggtgtg

SEQ ID NO: 6111664 - DNA, 20 bp, Homo sapiens
cctgtgggtgttctttcctg

SEQ ID NO: 6111665 - DNA, 23 bp, Homo sapiens
cctgtgggtgttctttcctgccc

SEQ ID NO: 6111666 - DNA, 18 bp, Homo sapiens
cctgtgggtttgggtgcc

SEQ ID NO: 6111667 - DNA, 15 bp, Homo sapiens
cctgtggtaccctgg

SEQ ID NO: 6111668 - DNA, 18 bp, Homo sapiens
cctgtggtaccctggcag

SEQ ID NO: 6111669 - DNA, 20 bp, Homo sapiens
cctgtggtaccctggcagag

SEQ ID NO: 6111670 - DNA, 23 bp, Homo sapiens
cctgtggtagtcctcccaagctg

SEQ ID NO: 6111671 - DNA, 17 bp, Homo sapiens
cctgtggtgaagtgtgg

SEQ ID NO: 6111672 - DNA, 18 bp, Homo sapiens
cctgtggtgaagtgtggc

SEQ ID NO: 6111673 - DNA, 19 bp, Homo sapiens
cctgtggtgaagtgtggct

SEQ ID NO: 6111674 - DNA, 19 bp, Homo sapiens
cctgtggtgacaggcccag

SEQ ID NO: 6111675 - DNA, 18 bp, Homo sapiens
cctgtggtgaggtcctgt

SEQ ID NO: 6111676 - DNA, 16 bp, Homo sapiens
cctgtggtgatgtgcc

SEQ ID NO: 6111677 - DNA, 19 bp, Homo sapiens
cctgtggtgatgtgcctgt

SEQ ID NO: 6111678 - DNA, 20 bp, Homo sapiens
cctgtggtgatgtgcctgta

SEQ ID NO: 6111679 - DNA, 22 bp, Homo sapiens
ctacttaattcctttctcatcc

SEQ ID NO: 6111680 - DNA, 20 bp, Homo sapiens
ctacttacccaggtgggtcc

SEQ ID NO: 6111681 - DNA, 19 bp, Homo sapiens
ctacttagatatttcatgt

SEQ ID NO: 6111682 - DNA, 17 bp, Homo sapiens
ctacttagcatgtccct

SEQ ID NO: 6111683 - DNA, 14 bp, Homo sapiens
ctacttagctggcc

SEQ ID NO: 6111684 - DNA, 21 bp, Homo sapiens
ctacttaggaaatactcagca

SEQ ID NO: 6111685 - DNA, 15 bp, Homo sapiens
ctacttagggaagaa

SEQ ID NO: 6111686 - DNA, 16 bp, Homo sapiens
ctacttagggaagaaa

SEQ ID NO: 6111687 - DNA, 17 bp, Homo sapiens
ctacttatcatttttgt

SEQ ID NO: 6111688 - DNA, 20 bp, Homo sapiens
ctacttatcatttttgtata

SEQ ID NO: 6111689 - DNA, 22 bp, Homo sapiens
ctacttattgtagcatcctgga

SEQ ID NO: 6111690 - DNA, 16 bp, Homo sapiens
ctacttcatagctcct

SEQ ID NO: 6111691 - DNA, 16 bp, Homo sapiens
ctacttccaaactaat

SEQ ID NO: 6111692 - DNA, 19 bp, Homo sapiens
ctacttccaaactaatttt

SEQ ID NO: 6111693 - DNA, 17 bp, Homo sapiens
ctacttccaagaaaaat

SEQ ID NO: 6111694 - DNA, 13 bp, Homo sapiens
ctacttccaggat

SEQ ID NO: 6111695 - DNA, 16 bp, Homo sapiens
ctacttcccactgtat

SEQ ID NO: 6111696 - DNA, 21 bp, Homo sapiens
ctacttccccagctctcagta

SEQ ID NO: 6111697 - DNA, 11 bp, Homo sapiens
ctacttcccct

SEQ ID NO: 6111698 - DNA, 15 bp, Homo sapiens
ctacttccccttcct

SEQ ID NO: 6111699 - DNA, 16 bp, Homo sapiens
ctacttccccttcttg

SEQ ID NO: 6111700 - DNA, 13 bp, Homo sapiens
ctacttcccttcc

SEQ ID NO: 6111701 - DNA, 14 bp, Homo sapiens
ctacttcccttcct

SEQ ID NO: 6111702 - DNA, 19 bp, Homo sapiens
ctacttcctcctccccact

SEQ ID NO: 6111703 - DNA, 20 bp, Homo sapiens
ctacttcctcctccccactt

SEQ ID NO: 6111704 - DNA, 15 bp, Homo sapiens
ctacttcctcctcct

SEQ ID NO: 6111705 - DNA, 15 bp, Homo sapiens
ctacttcctgcactg

SEQ ID NO: 6111706 - DNA, 15 bp, Homo sapiens
ctacttctaattatt

SEQ ID NO: 6111707 - DNA, 19 bp, Homo sapiens
ctacttctcacctgggcct

SEQ ID NO: 6111708 - DNA, 19 bp, Homo sapiens
ctacttctcagtccccttc

SEQ ID NO: 6111709 - DNA, 21 bp, Homo sapiens
ctacttctcagtccccttcaa

SEQ ID NO: 6111710 - DNA, 20 bp, Homo sapiens
ctacttctctgagtcagctg

SEQ ID NO: 6111711 - DNA, 12 bp, Homo sapiens
ctacttctctgt

SEQ ID NO: 6111712 - DNA, 20 bp, Homo sapiens
ctacttctggaagtcatctc

SEQ ID NO: 6111713 - DNA, 17 bp, Homo sapiens
ctacttctgtaattgtg

SEQ ID NO: 6111714 - DNA, 18 bp, Homo sapiens
ctacttctgtgtctgtca

SEQ ID NO: 6111715 - DNA, 14 bp, Homo sapiens
ctacttctttttct

SEQ ID NO: 6111716 - DNA, 20 bp, Homo sapiens
ctacttgaaggtacacccca

SEQ ID NO: 6111717 - DNA, 16 bp, Homo sapiens
ctacttgaccattctc

SEQ ID NO: 6111718 - DNA, 15 bp, Homo sapiens
ctacttgagaggctg

SEQ ID NO: 6111719 - DNA, 14 bp, Homo sapiens
ctacttgagataat

SEQ ID NO: 6111720 - DNA, 19 bp, Homo sapiens
ctacttgatatttccttca

SEQ ID NO: 6111721 - DNA, 22 bp, Homo sapiens
ctacttgatgtaactgagaatt

SEQ ID NO: 6111722 - DNA, 16 bp, Homo sapiens
ctacttgctctgctct

SEQ ID NO: 6111723 - DNA, 16 bp, Homo sapiens
ctacttgctctggacc

SEQ ID NO: 6111724 - DNA, 19 bp, Homo sapiens
ctacttgctctggacctgc

SEQ ID NO: 6111725 - DNA, 22 bp, Homo sapiens
ctacttgcttattacatttaaa

SEQ ID NO: 6111726 - DNA, 23 bp, Homo sapiens
ctacttggcaaggtcatagacaa

SEQ ID NO: 6111727 - DNA, 16 bp, Homo sapiens
ctacttgggagcctga

SEQ ID NO: 6111728 - DNA, 18 bp, Homo sapiens
ctacttgggagcctgagg

SEQ ID NO: 6111729 - DNA, 20 bp, Homo sapiens
ctacttggggacataatttc

SEQ ID NO: 6111730 - DNA, 22 bp, Homo sapiens
ctacttggggacataatttcag

SEQ ID NO: 6111731 - DNA, 13 bp, Homo sapiens
ctacttggtttgt

SEQ ID NO: 6111732 - DNA, 17 bp, Homo sapiens
ctacttggtttgtgttc

SEQ ID NO: 6111733 - DNA, 13 bp, Homo sapiens
ctacttgtaaact

SEQ ID NO: 6111734 - DNA, 18 bp, Homo sapiens
ctacttgtaaacttgaaa

SEQ ID NO: 6111735 - DNA, 18 bp, Homo sapiens
ctacttgtgactgaaggg

SEQ ID NO: 6111736 - DNA, 15 bp, Homo sapiens
ctacttgtttaacat

SEQ ID NO: 6111737 - DNA, 12 bp, Homo sapiens
ctactttaaatc

SEQ ID NO: 6111738 - DNA, 13 bp, Homo sapiens
ctactttaaatcc

SEQ ID NO: 6111739 - DNA, 14 bp, Homo sapiens
ctactttaaatcct

SEQ ID NO: 6111740 - DNA, 19 bp, Homo sapiens
ctactttaaattgtggatg

SEQ ID NO: 6111741 - DNA, 18 bp, Homo sapiens
ctactttaaattttttaa

SEQ ID NO: 6111742 - DNA, 17 bp, Homo sapiens
ctactttccatttggta

SEQ ID NO: 6111743 - DNA, 18 bp, Homo sapiens
ctactttcctgatgttga

SEQ ID NO: 6111744 - DNA, 14 bp, Homo sapiens
ctactttctctctc

SEQ ID NO: 6111745 - DNA, 12 bp, Homo sapiens
ctactttctctt

SEQ ID NO: 6111746 - DNA, 22 bp, Homo sapiens
ctactttctgtgtctatggatt

SEQ ID NO: 6111747 - DNA, 14 bp, Homo sapiens
ctactttgaaaaca

SEQ ID NO: 6111748 - DNA, 21 bp, Homo sapiens
ctactttgaaaacaattcagt

SEQ ID NO: 6111749 - DNA, 22 bp, Homo sapiens
ctactttgaaaacaattcagtg

SEQ ID NO: 6111750 - DNA, 20 bp, Homo sapiens
ctactttgaaatatttaatt

SEQ ID NO: 6111751 - DNA, 19 bp, Homo sapiens
ctactttgactttttgcat

SEQ ID NO: 6111752 - DNA, 21 bp, Homo sapiens
ctactttgactttttgcattt

SEQ ID NO: 6111753 - DNA, 19 bp, Homo sapiens
ctactttgataaagtaaaa

SEQ ID NO: 6111754 - DNA, 15 bp, Homo sapiens
ctactttgattctga

SEQ ID NO: 6111755 - DNA, 16 bp, Homo sapiens
ctactttgattctgat

SEQ ID NO: 6111756 - DNA, 21 bp, Homo sapiens
ctactttgcccctttcagtat

SEQ ID NO: 6111757 - DNA, 16 bp, Homo sapiens
ctactttgcttccgcc

SEQ ID NO: 6111758 - DNA, 20 bp, Homo sapiens
ctactttggtttctgtctgt

SEQ ID NO: 6111759 - DNA, 22 bp, Homo sapiens
ctactttgtcccctcacctcca

SEQ ID NO: 6111760 - DNA, 20 bp, Homo sapiens
ctactttgttaggattttca

SEQ ID NO: 6111761 - DNA, 13 bp, Homo sapiens
ctactttgtttat

SEQ ID NO: 6111762 - DNA, 21 bp, Homo sapiens
ctacttttccttccctcaaag

SEQ ID NO: 6111763 - DNA, 14 bp, Homo sapiens
ctacttttctaaaa

SEQ ID NO: 6111764 - DNA, 20 bp, Homo sapiens
ctacttttctttattagctt

SEQ ID NO: 6111765 - DNA, 22 bp, Homo sapiens
ctacttttctttattagctttc

SEQ ID NO: 6111766 - DNA, 17 bp, Homo sapiens
ctacttttgaaaatcaa

SEQ ID NO: 6111767 - DNA, 18 bp, Homo sapiens
ctacttttgcatgaaaat

SEQ ID NO: 6111768 - DNA, 15 bp, Homo sapiens
ctactttttaacaga

SEQ ID NO: 6111769 - DNA, 15 bp, Homo sapiens
ctactttttatactc

SEQ ID NO: 6111770 - DNA, 12 bp, Homo sapiens
ctactttttcct

SEQ ID NO: 6111771 - DNA, 14 bp, Homo sapiens
ctactttttccttc

SEQ ID NO: 6111772 - DNA, 22 bp, Homo sapiens
ctactttttccttcctgccctg

SEQ ID NO: 6111773 - DNA, 23 bp, Homo sapiens
ctactttttccttcctgccctgt

SEQ ID NO: 6111774 - DNA, 18 bp, Homo sapiens
ctacttttttatccacct

SEQ ID NO: 6111775 - DNA, 19 bp, Homo sapiens
ctacttttttatccacctc

SEQ ID NO: 6111776 - DNA, 13 bp, Homo sapiens
ctagaaaaaaaga

SEQ ID NO: 6111777 - DNA, 14 bp, Homo sapiens
ctagaaaaaacata

SEQ ID NO: 6111778 - DNA, 17 bp, Homo sapiens
ctagaaaaacaggcact

SEQ ID NO: 6111779 - DNA, 14 bp, Homo sapiens
ctagaaaaataaaa

SEQ ID NO: 6111780 - DNA, 20 bp, Homo sapiens
ctagaaaaataaaatgtttc

SEQ ID NO: 6111781 - DNA, 16 bp, Homo sapiens
ctagaaaacatttttt

SEQ ID NO: 6111782 - DNA, 23 bp, Homo sapiens
ctagaaaacattttttttttaaa

SEQ ID NO: 6111783 - DNA, 16 bp, Homo sapiens
ctagaaaacccttccc

SEQ ID NO: 6111784 - DNA, 16 bp, Homo sapiens
ctagaaaagcttccta

SEQ ID NO: 6111785 - DNA, 15 bp, Homo sapiens
ctagaaaatctgagt

SEQ ID NO: 6111786 - DNA, 14 bp, Homo sapiens
ctagaaacaacact

SEQ ID NO: 6111787 - DNA, 16 bp, Homo sapiens
ctagaaacagatcttg

SEQ ID NO: 6111788 - DNA, 17 bp, Homo sapiens
ctagaaacccaagctcc

SEQ ID NO: 6111789 - DNA, 18 bp, Homo sapiens
ctagaaacccaagctcct

SEQ ID NO: 6111790 - DNA, 23 bp, Homo sapiens
ctagaaacccaagctcctcctcg

SEQ ID NO: 6111791 - DNA, 21 bp, Homo sapiens
ctagaaacgagttggtgtctt

SEQ ID NO: 6111792 - DNA, 13 bp, Homo sapiens
ctagaaactctgg

SEQ ID NO: 6111793 - DNA, 14 bp, Homo sapiens
ctagaaagaaaaga

SEQ ID NO: 6111794 - DNA, 23 bp, Homo sapiens
ctagaaagaagctcgccccacct

SEQ ID NO: 6111795 - DNA, 21 bp, Homo sapiens
ctagaaagagaaaaagccctc

SEQ ID NO: 6111796 - DNA, 18 bp, Homo sapiens
ctagaaagcagagatttt

SEQ ID NO: 6111797 - DNA, 21 bp, Homo sapiens
ctagaaagcatccattaatta

SEQ ID NO: 6111798 - DNA, 22 bp, Homo sapiens
ctagaaagcatccattaattaa

SEQ ID NO: 6111799 - DNA, 21 bp, Homo sapiens
ctagaaagccatattccagca

SEQ ID NO: 6111800 - DNA, 22 bp, Homo sapiens
ctagaaagcctgttcccctcac

SEQ ID NO: 6111801 - DNA, 13 bp, Homo sapiens
ctagaaaggagag

SEQ ID NO: 6111802 - DNA, 19 bp, Homo sapiens
ctagaaagtggcagagcca

SEQ ID NO: 6111803 - DNA, 22 bp, Homo sapiens
ctagaaataaaatcaccctgac

SEQ ID NO: 6111804 - DNA, 23 bp, Homo sapiens
ctagaaataaaatcaccctgact

SEQ ID NO: 6111805 - DNA, 15 bp, Homo sapiens
ctagaaataaatgtt

SEQ ID NO: 6111806 - DNA, 21 bp, Homo sapiens
ctagaaatagatttaaagaat

SEQ ID NO: 6111807 - DNA, 19 bp, Homo sapiens
ctagaaatatctttctctt

SEQ ID NO: 6111808 - DNA, 23 bp, Homo sapiens
ctagaaatgatccccagctgttt

SEQ ID NO: 6111809 - DNA, 23 bp, Homo sapiens
ctagaaatgcccttcactttctc

SEQ ID NO: 6111810 - DNA, 19 bp, Homo sapiens
ctagaaattccccaccctg

SEQ ID NO: 6111811 - DNA, 16 bp, Homo sapiens
ctagaacaagccagag

SEQ ID NO: 6111812 - DNA, 17 bp, Homo sapiens
ctagaacacccactggc

SEQ ID NO: 6111813 - DNA, 19 bp, Homo sapiens
ctagaacacccactggcca

SEQ ID NO: 6111814 - DNA, 21 bp, Homo sapiens
ctagaacacccactggccagt

SEQ ID NO: 6111815 - DNA, 16 bp, Homo sapiens
ctagaacactaactca

SEQ ID NO: 6111816 - DNA, 19 bp, Homo sapiens
ctagaacactaactcacca

SEQ ID NO: 6111817 - DNA, 21 bp, Homo sapiens
ctagaacatccttaaatgtct

SEQ ID NO: 6111818 - DNA, 22 bp, Homo sapiens
ctagaacatgcacatttatata

SEQ ID NO: 6111819 - DNA, 21 bp, Homo sapiens
ctagaacattccatttgcttg

SEQ ID NO: 6111820 - DNA, 19 bp, Homo sapiens
ctagaaccaagcttcagag

SEQ ID NO: 6111821 - DNA, 20 bp, Homo sapiens
ctagaaccaagcttcagagc

SEQ ID NO: 6111822 - DNA, 18 bp, Homo sapiens
ctagaacctggaagggct

SEQ ID NO: 6111823 - DNA, 15 bp, Homo sapiens
ctagaacctggagag

SEQ ID NO: 6111824 - DNA, 16 bp, Homo sapiens
ctagaacctggagggc

SEQ ID NO: 6111825 - DNA, 16 bp, Homo sapiens
ctagaacctgggctgt

SEQ ID NO: 6111826 - DNA, 16 bp, Homo sapiens
ctagaactccctttca

SEQ ID NO: 6111827 - DNA, 18 bp, Homo sapiens
ctagaactcctgtcttct

SEQ ID NO: 6111828 - DNA, 23 bp, Homo sapiens
ctagaactcctgtcttctttctc

SEQ ID NO: 6111829 - DNA, 23 bp, Homo sapiens
ctagaactggtgatataaagaat

SEQ ID NO: 6111830 - DNA, 13 bp, Homo sapiens
ctagaacttcaaa

SEQ ID NO: 6111831 - DNA, 23 bp, Homo sapiens
ctagaacttttttaaataaactt

SEQ ID NO: 6111832 - DNA, 17 bp, Homo sapiens
ctagaagaaaagcccat

SEQ ID NO: 6111833 - DNA, 18 bp, Homo sapiens
ctagaagaaaagcccatt

SEQ ID NO: 6111834 - DNA, 21 bp, Homo sapiens
ctagaagaaagtaaaaagaac

SEQ ID NO: 6111835 - DNA, 23 bp, Homo sapiens
ctagaagaaagtaaaaagaacaa

SEQ ID NO: 6111836 - DNA, 14 bp, Homo sapiens
ctagaagaaatgaa

SEQ ID NO: 6111837 - DNA, 20 bp, Homo sapiens
ctagaagaaatgaaatttta

SEQ ID NO: 6111838 - DNA, 22 bp, Homo sapiens
ctagaagaaccaaatacctcaa

SEQ ID NO: 6111839 - DNA, 13 bp, Homo sapiens
ctagaagaagcta

SEQ ID NO: 6111840 - DNA, 21 bp, Homo sapiens
ctagaagagcacagagccctg

SEQ ID NO: 6111841 - DNA, 20 bp, Homo sapiens
ctagaagataacattttcaa

SEQ ID NO: 6111842 - DNA, 15 bp, Homo sapiens
ctagaagatgaatac

SEQ ID NO: 6111843 - DNA, 17 bp, Homo sapiens
ctagaagatgtgtaaac

SEQ ID NO: 6111844 - DNA, 18 bp, Homo sapiens
ctagaagattagaaacta

SEQ ID NO: 6111845 - DNA, 22 bp, Homo sapiens
ctagaagattttgaaattttta

SEQ ID NO: 6111846 - DNA, 13 bp, Homo sapiens
ctagaagcagaag

SEQ ID NO: 6111847 - DNA, 12 bp, Homo sapiens
ctagaagccaag

SEQ ID NO: 6111848 - DNA, 21 bp, Homo sapiens
ctagaagccaagggaaagggg

SEQ ID NO: 6111849 - DNA, 18 bp, Homo sapiens
ctagaagctgatctgatt

SEQ ID NO: 6111850 - DNA, 22 bp, Homo sapiens
ctagaaggatgaacagttctcc

SEQ ID NO: 6111851 - DNA, 23 bp, Homo sapiens
ctagaaggctgagtaccatgggc

SEQ ID NO: 6111852 - DNA, 20 bp, Homo sapiens
ctagaagggccagtcctgcc

SEQ ID NO: 6111853 - DNA, 16 bp, Homo sapiens
ctagaaggggtggctg

SEQ ID NO: 6111854 - DNA, 17 bp, Homo sapiens
ctagaagtaagaagagg

SEQ ID NO: 6111855 - DNA, 15 bp, Homo sapiens
cctgtggtgctggga

SEQ ID NO: 6111856 - DNA, 16 bp, Homo sapiens
cctgtggtggctcccc

SEQ ID NO: 6111857 - DNA, 22 bp, Homo sapiens
cctgtggtgtgcggagtctcct

SEQ ID NO: 6111858 - DNA, 21 bp, Homo sapiens
cctgtggttacagtgcagaca

SEQ ID NO: 6111859 - DNA, 15 bp, Homo sapiens
cctgtggttctgaga

SEQ ID NO: 6111860 - DNA, 17 bp, Homo sapiens
cctgtgtaaaaacaaca

SEQ ID NO: 6111861 - DNA, 18 bp, Homo sapiens
cctgtgtaacagctcctt

SEQ ID NO: 6111862 - DNA, 12 bp, Homo sapiens
cctgtgtacagg

SEQ ID NO: 6111863 - DNA, 15 bp, Homo sapiens
cctgtgtacctcact

SEQ ID NO: 6111864 - DNA, 15 bp, Homo sapiens
cctgtgtagccagtg

SEQ ID NO: 6111865 - DNA, 13 bp, Homo sapiens
cctgtgtagctgg

SEQ ID NO: 6111866 - DNA, 13 bp, Homo sapiens
cctgtgtagctgt

SEQ ID NO: 6111867 - DNA, 24 bp, Homo sapiens
cctgtgtagtctctctagtagtta

SEQ ID NO: 6111868 - DNA, 17 bp, Homo sapiens
cctgtgtatacagccct

SEQ ID NO: 6111869 - DNA, 21 bp, Homo sapiens
cctgtgtatggtgacctctcc

SEQ ID NO: 6111870 - DNA, 17 bp, Homo sapiens
cctgtgtattaaacctt

SEQ ID NO: 6111871 - DNA, 18 bp, Homo sapiens
cctgtgtattcaccacca

SEQ ID NO: 6111872 - DNA, 13 bp, Homo sapiens
cctgtgtcatctg

SEQ ID NO: 6111873 - DNA, 16 bp, Homo sapiens
cctgtgtcatctgtca

SEQ ID NO: 6111874 - DNA, 19 bp, Homo sapiens
cctgtgtccaagaactcta

SEQ ID NO: 6111875 - DNA, 12 bp, Homo sapiens
cctgtgtccaca

SEQ ID NO: 6111876 - DNA, 17 bp, Homo sapiens
cctgtgtccacctgtgg

SEQ ID NO: 6111877 - DNA, 19 bp, Homo sapiens
cctgtgtccacctgtgggt

SEQ ID NO: 6111878 - DNA, 16 bp, Homo sapiens
cctgtgtccagcagct

SEQ ID NO: 6111879 - DNA, 14 bp, Homo sapiens
cctgtgtccatctg

SEQ ID NO: 6111880 - DNA, 11 bp, Homo sapiens
cctgtgtccca

SEQ ID NO: 6111881 - DNA, 14 bp, Homo sapiens
cctgtgtcccatga

SEQ ID NO: 6111882 - DNA, 20 bp, Homo sapiens
cctgtgtcccatgacccacc

SEQ ID NO: 6111883 - DNA, 22 bp, Homo sapiens
cctgtgtcccatgacccacccc

SEQ ID NO: 6111884 - DNA, 13 bp, Homo sapiens
cctgtgtcccctg

SEQ ID NO: 6111885 - DNA, 18 bp, Homo sapiens
cctgtgtcccctgacctg

SEQ ID NO: 6111886 - DNA, 21 bp, Homo sapiens
cctgtgtcccctgacctgtcc

SEQ ID NO: 6111887 - DNA, 23 bp, Homo sapiens
cctgtgtcccctgacctgtccag

SEQ ID NO: 6111888 - DNA, 16 bp, Homo sapiens
cctgtgtcctccacca

SEQ ID NO: 6111889 - DNA, 24 bp, Homo sapiens
cctgtgtctccaagcctctgtctt

SEQ ID NO: 6111890 - DNA, 12 bp, Homo sapiens
cctgtgtctggc

SEQ ID NO: 6111891 - DNA, 21 bp, Homo sapiens
cctgtgtctgtcacaggctgg

SEQ ID NO: 6111892 - DNA, 11 bp, Homo sapiens
cctgtgtctta

SEQ ID NO: 6111893 - DNA, 17 bp, Homo sapiens
cctgtgtcttgcaatgg

SEQ ID NO: 6111894 - DNA, 22 bp, Homo sapiens
cctgtgtctttaaatgctgctt

SEQ ID NO: 6111895 - DNA, 15 bp, Homo sapiens
cctgtgtgaccctgg

SEQ ID NO: 6111896 - DNA, 21 bp, Homo sapiens
cctgtgtgagcatctctgtgt

SEQ ID NO: 6111897 - DNA, 22 bp, Homo sapiens
cctgtgtgagcatctctgtgta

SEQ ID NO: 6111898 - DNA, 14 bp, Homo sapiens
cctgtgtgattgac

SEQ ID NO: 6111899 - DNA, 12 bp, Homo sapiens
cctgtgtgcagg

SEQ ID NO: 6111900 - DNA, 13 bp, Homo sapiens
cctgtgtgcaggt

SEQ ID NO: 6111901 - DNA, 16 bp, Homo sapiens
cctgtgtgcaggttcc

SEQ ID NO: 6111902 - DNA, 18 bp, Homo sapiens
cctgtgtgcgagtctgag

SEQ ID NO: 6111903 - DNA, 19 bp, Homo sapiens
cctgtgtgcgagtctgagt

SEQ ID NO: 6111904 - DNA, 13 bp, Homo sapiens
cctgtgtgcttgt

SEQ ID NO: 6111905 - DNA, 21 bp, Homo sapiens
cctgtgtggaagaaggaaaca

SEQ ID NO: 6111906 - DNA, 13 bp, Homo sapiens
cctgtgtggagag

SEQ ID NO: 6111907 - DNA, 14 bp, Homo sapiens
cctgtgtggagagg

SEQ ID NO: 6111908 - DNA, 19 bp, Homo sapiens
cctgtgtggagagggaatg

SEQ ID NO: 6111909 - DNA, 21 bp, Homo sapiens
cctgtgtggagagggaatgtg

SEQ ID NO: 6111910 - DNA, 23 bp, Homo sapiens
cctgtgtggagagggaatgtgaa

SEQ ID NO: 6111911 - DNA, 21 bp, Homo sapiens
cctgtgtggatgctgagctgt

SEQ ID NO: 6111912 - DNA, 23 bp, Homo sapiens
cctgtgtggatgctgagctgtga

SEQ ID NO: 6111913 - DNA, 20 bp, Homo sapiens
cctgtgtggccacttctgtc

SEQ ID NO: 6111914 - DNA, 23 bp, Homo sapiens
cctgtgtggccacttctgtccat

SEQ ID NO: 6111915 - DNA, 17 bp, Homo sapiens
cctgtgtggccctggac

SEQ ID NO: 6111916 - DNA, 13 bp, Homo sapiens
cctgtgtggggag

SEQ ID NO: 6111917 - DNA, 20 bp, Homo sapiens
cctgtgtggggaggcagctc

SEQ ID NO: 6111918 - DNA, 19 bp, Homo sapiens
cctgtgtggtttagtgtaa

SEQ ID NO: 6111919 - DNA, 22 bp, Homo sapiens
cctgtgtggtttagtgtaaaaa

SEQ ID NO: 6111920 - DNA, 16 bp, Homo sapiens
cctgtgtgtaggctgg

SEQ ID NO: 6111921 - DNA, 17 bp, Homo sapiens
cctgtgtgtaggctggg

SEQ ID NO: 6111922 - DNA, 22 bp, Homo sapiens
cctgtgtgtcgttcccttgtgt

SEQ ID NO: 6111923 - DNA, 20 bp, Homo sapiens
cctgtgtgtgcgcctacagg

SEQ ID NO: 6111924 - DNA, 16 bp, Homo sapiens
cctgtgtgtggaaggc

SEQ ID NO: 6111925 - DNA, 20 bp, Homo sapiens
cctgtgtgtgggtggggtta

SEQ ID NO: 6111926 - DNA, 17 bp, Homo sapiens
cctgtgtgttaagctct

SEQ ID NO: 6111927 - DNA, 20 bp, Homo sapiens
cctgtgtgttaagctctgct

SEQ ID NO: 6111928 - DNA, 18 bp, Homo sapiens
cctgtgtgttcttttgat

SEQ ID NO: 6111929 - DNA, 22 bp, Homo sapiens
cctgtgtgttcttttgatacat

SEQ ID NO: 6111930 - DNA, 23 bp, Homo sapiens
cctgtgtgttcttttgatacatt

SEQ ID NO: 6111931 - DNA, 17 bp, Homo sapiens
cctgtgttaatttaagt

SEQ ID NO: 6111932 - DNA, 21 bp, Homo sapiens
cctgtgttagtgtctgtccat

SEQ ID NO: 6111933 - DNA, 15 bp, Homo sapiens
cctgtgttccagccc

SEQ ID NO: 6111934 - DNA, 18 bp, Homo sapiens
cctgtgttctgggctggg

SEQ ID NO: 6111935 - DNA, 21 bp, Homo sapiens
cctgtgttctgggctggggcc

SEQ ID NO: 6111936 - DNA, 14 bp, Homo sapiens
cctgtgttctttcc

SEQ ID NO: 6111937 - DNA, 17 bp, Homo sapiens
cctgtgttggggggcaa

SEQ ID NO: 6111938 - DNA, 22 bp, Homo sapiens
cctgtgttgtcccatctgccct

SEQ ID NO: 6111939 - DNA, 16 bp, Homo sapiens
cctgtgttgtctctag

SEQ ID NO: 6111940 - DNA, 22 bp, Homo sapiens
cctgtgttgtctctagagcagg

SEQ ID NO: 6111941 - DNA, 21 bp, Homo sapiens
cctgtgtttcatgttctgtgt

SEQ ID NO: 6111942 - DNA, 13 bp, Homo sapiens
cctgtgtttctag

SEQ ID NO: 6111943 - DNA, 16 bp, Homo sapiens
cctgtgtttgtcctgg

SEQ ID NO: 6111944 - DNA, 19 bp, Homo sapiens
cctgtgtttgtcctgggtt

SEQ ID NO: 6111945 - DNA, 19 bp, Homo sapiens
cctgtgttttcacgcaggt

SEQ ID NO: 6111946 - DNA, 14 bp, Homo sapiens
cctgttaaaacaac

SEQ ID NO: 6111947 - DNA, 12 bp, Homo sapiens
cctgttaaacag

SEQ ID NO: 6111948 - DNA, 15 bp, Homo sapiens
cctgttaaattttct

SEQ ID NO: 6111949 - DNA, 17 bp, Homo sapiens
cctgttaaattttctct

SEQ ID NO: 6111950 - DNA, 21 bp, Homo sapiens
cctgttaacgtcatctcaggg

SEQ ID NO: 6111951 - DNA, 23 bp, Homo sapiens
cctgttacctaattagagcagat

SEQ ID NO: 6111952 - DNA, 19 bp, Homo sapiens
cctgttacctactttgact

SEQ ID NO: 6111953 - DNA, 24 bp, Homo sapiens
cctgttacttaaatagcatctgct

SEQ ID NO: 6111954 - DNA, 14 bp, Homo sapiens
cctgttacttacct

SEQ ID NO: 6111955 - DNA, 15 bp, Homo sapiens
cctgttacttgcttc

SEQ ID NO: 6111956 - DNA, 18 bp, Homo sapiens
cctgttacttgcttcagt

SEQ ID NO: 6111957 - DNA, 20 bp, Homo sapiens
cctgttacttgcttcagtgg

SEQ ID NO: 6111958 - DNA, 21 bp, Homo sapiens
cctgttagaaatgttagtgcc

SEQ ID NO: 6111959 - DNA, 23 bp, Homo sapiens
cctgttagacgtcctccgtccat

SEQ ID NO: 6111960 - DNA, 22 bp, Homo sapiens
cctgttagctttccaaggaagc

SEQ ID NO: 6111961 - DNA, 19 bp, Homo sapiens
cctgttaggccaactgcct

SEQ ID NO: 6111962 - DNA, 21 bp, Homo sapiens
cctgttaggtctcatgcccac

SEQ ID NO: 6111963 - DNA, 19 bp, Homo sapiens
cctgttatttttctgccct

SEQ ID NO: 6111964 - DNA, 16 bp, Homo sapiens
cctgttcaaaatgtta

SEQ ID NO: 6111965 - DNA, 15 bp, Homo sapiens
cctgttcaaggcccc

SEQ ID NO: 6111966 - DNA, 14 bp, Homo sapiens
cctgttcacaccag

SEQ ID NO: 6111967 - DNA, 20 bp, Homo sapiens
cctgttcacggtgacacagg

SEQ ID NO: 6111968 - DNA, 20 bp, Homo sapiens
cctgttcacgtgactcctca

SEQ ID NO: 6111969 - DNA, 15 bp, Homo sapiens
cctgttcagctccag

SEQ ID NO: 6111970 - DNA, 20 bp, Homo sapiens
cctgttcagctccagctcac

SEQ ID NO: 6111971 - DNA, 19 bp, Homo sapiens
cctgttcagttacagaaag

SEQ ID NO: 6111972 - DNA, 21 bp, Homo sapiens
cctgttcataaaacggtgctt

SEQ ID NO: 6111973 - DNA, 23 bp, Homo sapiens
cctgttcataaaacggtgctttc

SEQ ID NO: 6111974 - DNA, 18 bp, Homo sapiens
cctgttcatgtgcctctg

SEQ ID NO: 6111975 - DNA, 21 bp, Homo sapiens
cctgttcatgtttttgtttta

SEQ ID NO: 6111976 - DNA, 18 bp, Homo sapiens
cctgttcccatgagatga

SEQ ID NO: 6111977 - DNA, 12 bp, Homo sapiens
cctgttcccatt

SEQ ID NO: 6111978 - DNA, 17 bp, Homo sapiens
cctgttccccacaggtc

SEQ ID NO: 6111979 - DNA, 19 bp, Homo sapiens
cctgttccccacaggtcct

SEQ ID NO: 6111980 - DNA, 22 bp, Homo sapiens
cctgttcccccgccgcttttct

SEQ ID NO: 6111981 - DNA, 18 bp, Homo sapiens
cctgttcccctcactgga

SEQ ID NO: 6111982 - DNA, 14 bp, Homo sapiens
cctgttcccctctc

SEQ ID NO: 6111983 - DNA, 15 bp, Homo sapiens
cctgttcccctctcc

SEQ ID NO: 6111984 - DNA, 18 bp, Homo sapiens
cctgttcccctctccctt

SEQ ID NO: 6111985 - DNA, 14 bp, Homo sapiens
cctgttccctagag

SEQ ID NO: 6111986 - DNA, 23 bp, Homo sapiens
cctgttccctagagagaataaat

SEQ ID NO: 6111987 - DNA, 20 bp, Homo sapiens
cctgttccctcctggtcctg

SEQ ID NO: 6111988 - DNA, 17 bp, Homo sapiens
cctgttccctgaggacc

SEQ ID NO: 6111989 - DNA, 13 bp, Homo sapiens
cctgttccgcctc

SEQ ID NO: 6111990 - DNA, 17 bp, Homo sapiens
cctgttccgcctcactg

SEQ ID NO: 6111991 - DNA, 21 bp, Homo sapiens
cctgttcctcccaagaggcca

SEQ ID NO: 6111992 - DNA, 12 bp, Homo sapiens
cctgttcctgac

SEQ ID NO: 6111993 - DNA, 14 bp, Homo sapiens
cctgttcctgcctt

SEQ ID NO: 6111994 - DNA, 17 bp, Homo sapiens
cctgttcctgccttctc

SEQ ID NO: 6111995 - DNA, 18 bp, Homo sapiens
cctgttccttcctgcaga

SEQ ID NO: 6111996 - DNA, 19 bp, Homo sapiens
cctgttccttcctgcagac

SEQ ID NO: 6111997 - DNA, 21 bp, Homo sapiens
cctgttccttgaatctgaaag

SEQ ID NO: 6111998 - DNA, 18 bp, Homo sapiens
cctgttcggttccagaca

SEQ ID NO: 6111999 - DNA, 20 bp, Homo sapiens
cctgttcggttccagacact

SEQ ID NO: 6112000 - DNA, 21 bp, Homo sapiens
cctgttctaagggggagggga

SEQ ID NO: 6112001 - DNA, 17 bp, Homo sapiens
cctgttctatgccttta

SEQ ID NO: 6112002 - DNA, 13 bp, Homo sapiens
cctgttctcagag

SEQ ID NO: 6112003 - DNA, 15 bp, Homo sapiens
cctgttctcagagct

SEQ ID NO: 6112004 - DNA, 16 bp, Homo sapiens
cctgttctcagagctc

SEQ ID NO: 6112005 - DNA, 22 bp, Homo sapiens
cctgttctcagagctccacaga

SEQ ID NO: 6112006 - DNA, 14 bp, Homo sapiens
cctgttctccagat

SEQ ID NO: 6112007 - DNA, 12 bp, Homo sapiens
cctgttctccct

SEQ ID NO: 6112008 - DNA, 13 bp, Homo sapiens
cctgttctccctt

SEQ ID NO: 6112009 - DNA, 22 bp, Homo sapiens
cctgttctccctttctctctcc

SEQ ID NO: 6112010 - DNA, 13 bp, Homo sapiens
cctgttctcttca

SEQ ID NO: 6112011 - DNA, 16 bp, Homo sapiens
cctgttctgaaacctt

SEQ ID NO: 6112012 - DNA, 14 bp, Homo sapiens
cctgttctgaactg

SEQ ID NO: 6112013 - DNA, 14 bp, Homo sapiens
cctgttctgcccac

SEQ ID NO: 6112014 - DNA, 12 bp, Homo sapiens
cctgttctgcgc

SEQ ID NO: 6112015 - DNA, 18 bp, Homo sapiens
cctgttctggtagctcca

SEQ ID NO: 6112016 - DNA, 22 bp, Homo sapiens
cctgttctggtatttcccctgt

SEQ ID NO: 6112017 - DNA, 21 bp, Homo sapiens
cctgttctgtagctttctgga

SEQ ID NO: 6112018 - DNA, 15 bp, Homo sapiens
cctgttctgtaggag

SEQ ID NO: 6112019 - DNA, 16 bp, Homo sapiens
cctgttctgtaggaga

SEQ ID NO: 6112020 - DNA, 13 bp, Homo sapiens
cctgttctgtgac

SEQ ID NO: 6112021 - DNA, 14 bp, Homo sapiens
cctgttctgtgtct

SEQ ID NO: 6112022 - DNA, 20 bp, Homo sapiens
cctgttctgtgtctgctgta

SEQ ID NO: 6112023 - DNA, 21 bp, Homo sapiens
cctgttcttagagtgtagctg

SEQ ID NO: 6112024 - DNA, 13 bp, Homo sapiens
cctgttcttccta

SEQ ID NO: 6112025 - DNA, 12 bp, Homo sapiens
cctgttgaagac

SEQ ID NO: 6112026 - DNA, 15 bp, Homo sapiens
cctgttgaagacttc

SEQ ID NO: 6112027 - DNA, 20 bp, Homo sapiens
cctgttgaagacttcctctc

SEQ ID NO: 6112028 - DNA, 21 bp, Homo sapiens
cctgttgaagattatttcatt

SEQ ID NO: 6112029 - DNA, 21 bp, Homo sapiens
cctgttgaattggtgaataaa

SEQ ID NO: 6112030 - DNA, 22 bp, Homo sapiens
cctgttgaattggtgaataaaa

SEQ ID NO: 6112031 - DNA, 23 bp, Homo sapiens
cctgttgacgaagtctcttttct

SEQ ID NO: 6112032 - DNA, 18 bp, Homo sapiens
ctagaagtaagaagagga

SEQ ID NO: 6112033 - DNA, 22 bp, Homo sapiens
ctagaagtaagaagaggagcct

SEQ ID NO: 6112034 - DNA, 17 bp, Homo sapiens
ctagaagtctccctgca

SEQ ID NO: 6112035 - DNA, 22 bp, Homo sapiens
ctagaagtctccctgcacagcc

SEQ ID NO: 6112036 - DNA, 23 bp, Homo sapiens
ctagaagtctccctgcacagcct

SEQ ID NO: 6112037 - DNA, 18 bp, Homo sapiens
ctagaagtctgtccaaat

SEQ ID NO: 6112038 - DNA, 21 bp, Homo sapiens
ctagaagtcttcatggtctct

SEQ ID NO: 6112039 - DNA, 19 bp, Homo sapiens
ctagaagtgggccaggaca

SEQ ID NO: 6112040 - DNA, 21 bp, Homo sapiens
ctagaagtgggccaggacagg

SEQ ID NO: 6112041 - DNA, 17 bp, Homo sapiens
ctagaagttactgaatg

SEQ ID NO: 6112042 - DNA, 21 bp, Homo sapiens
ctagaataatctcatcccccc

SEQ ID NO: 6112043 - DNA, 20 bp, Homo sapiens
ctagaatactaataaaatac

SEQ ID NO: 6112044 - DNA, 12 bp, Homo sapiens
ctagaatacttt

SEQ ID NO: 6112045 - DNA, 16 bp, Homo sapiens
ctagaatagccatgta

SEQ ID NO: 6112046 - DNA, 22 bp, Homo sapiens
ctagaatagccatgtactataa

SEQ ID NO: 6112047 - DNA, 19 bp, Homo sapiens
ctagaataggagaaaatga

SEQ ID NO: 6112048 - DNA, 20 bp, Homo sapiens
ctagaatatcctacttctcc

SEQ ID NO: 6112049 - DNA, 13 bp, Homo sapiens
ctagaatcacagc

SEQ ID NO: 6112050 - DNA, 16 bp, Homo sapiens
ctagaatcagggtgga

SEQ ID NO: 6112051 - DNA, 17 bp, Homo sapiens
ctagaatcatgtatttt

SEQ ID NO: 6112052 - DNA, 16 bp, Homo sapiens
ctagaatcccagcagc

SEQ ID NO: 6112053 - DNA, 17 bp, Homo sapiens
ctagaatcccagcagca

SEQ ID NO: 6112054 - DNA, 14 bp, Homo sapiens
ctagaatctttatt

SEQ ID NO: 6112055 - DNA, 17 bp, Homo sapiens
ctagaatgagaaatcat

SEQ ID NO: 6112056 - DNA, 20 bp, Homo sapiens
ctagaatgagaaatcatgtt

SEQ ID NO: 6112057 - DNA, 13 bp, Homo sapiens
ctagaatggaagc

SEQ ID NO: 6112058 - DNA, 23 bp, Homo sapiens
ctagaatggaagcctccacctgc

SEQ ID NO: 6112059 - DNA, 16 bp, Homo sapiens
ctagaatggatttttc

SEQ ID NO: 6112060 - DNA, 18 bp, Homo sapiens
ctagaatggatttttccc

SEQ ID NO: 6112061 - DNA, 21 bp, Homo sapiens
ctagaatgtcagatttctggt

SEQ ID NO: 6112062 - DNA, 15 bp, Homo sapiens
ctagaatgtggattt

SEQ ID NO: 6112063 - DNA, 20 bp, Homo sapiens
ctagaatgttattgtgtata

SEQ ID NO: 6112064 - DNA, 20 bp, Homo sapiens
ctagaattataagtcacaaa

SEQ ID NO: 6112065 - DNA, 20 bp, Homo sapiens
ctagaattcactccacttgg

SEQ ID NO: 6112066 - DNA, 15 bp, Homo sapiens
ctagaattctagtgc

SEQ ID NO: 6112067 - DNA, 19 bp, Homo sapiens
ctagaattgagtgtttaaa

SEQ ID NO: 6112068 - DNA, 13 bp, Homo sapiens
ctagaatttattc

SEQ ID NO: 6112069 - DNA, 14 bp, Homo sapiens
ctagaatttcttta

SEQ ID NO: 6112070 - DNA, 23 bp, Homo sapiens
ctagaatttgatatgtgaacagt

SEQ ID NO: 6112071 - DNA, 17 bp, Homo sapiens
ctagaatttgtattttg

SEQ ID NO: 6112072 - DNA, 16 bp, Homo sapiens
ctagacaaaggcccag

SEQ ID NO: 6112073 - DNA, 17 bp, Homo sapiens
ctagacaaaggcccaga

SEQ ID NO: 6112074 - DNA, 15 bp, Homo sapiens
ctagacaaccctgca

SEQ ID NO: 6112075 - DNA, 19 bp, Homo sapiens
ctagacaacctttctgtag

SEQ ID NO: 6112076 - DNA, 21 bp, Homo sapiens
ctagacaacctttctgtagcc

SEQ ID NO: 6112077 - DNA, 16 bp, Homo sapiens
ctagacaagccagaac

SEQ ID NO: 6112078 - DNA, 17 bp, Homo sapiens
ctagacaagccagaact

SEQ ID NO: 6112079 - DNA, 18 bp, Homo sapiens
ctagacaaggttgctgtt

SEQ ID NO: 6112080 - DNA, 16 bp, Homo sapiens
ctagacacaatttcat

SEQ ID NO: 6112081 - DNA, 14 bp, Homo sapiens
ctagacacacaaag

SEQ ID NO: 6112082 - DNA, 14 bp, Homo sapiens
ctagacacatgaag

SEQ ID NO: 6112083 - DNA, 15 bp, Homo sapiens
ctagacaccaaagtt

SEQ ID NO: 6112084 - DNA, 18 bp, Homo sapiens
ctagacaccaaagttcta

SEQ ID NO: 6112085 - DNA, 19 bp, Homo sapiens
ctagacaccaaagttctaa

SEQ ID NO: 6112086 - DNA, 11 bp, Homo sapiens
ctagacactga

SEQ ID NO: 6112087 - DNA, 16 bp, Homo sapiens
ctagacagtattgcca

SEQ ID NO: 6112088 - DNA, 21 bp, Homo sapiens
ctagacatggaggttctaagg

SEQ ID NO: 6112089 - DNA, 17 bp, Homo sapiens
ctagacatggcctctgg

SEQ ID NO: 6112090 - DNA, 18 bp, Homo sapiens
ctagacattattttgtat

SEQ ID NO: 6112091 - DNA, 18 bp, Homo sapiens
ctagaccagcagacagag

SEQ ID NO: 6112092 - DNA, 21 bp, Homo sapiens
ctagaccagggctgctctttc

SEQ ID NO: 6112093 - DNA, 16 bp, Homo sapiens
ctagaccagtttgcat

SEQ ID NO: 6112094 - DNA, 12 bp, Homo sapiens
ctagaccctccc

SEQ ID NO: 6112095 - DNA, 15 bp, Homo sapiens
ctagaccctccccca

SEQ ID NO: 6112096 - DNA, 16 bp, Homo sapiens
ctagaccctcccccac

SEQ ID NO: 6112097 - DNA, 16 bp, Homo sapiens
ctagacccttcatctc

SEQ ID NO: 6112098 - DNA, 16 bp, Homo sapiens
ctagacctccccctca

SEQ ID NO: 6112099 - DNA, 17 bp, Homo sapiens
ctagacctccccctcac

SEQ ID NO: 6112100 - DNA, 19 bp, Homo sapiens
ctagacctccccctcactt

SEQ ID NO: 6112101 - DNA, 13 bp, Homo sapiens
ctagacctgggcc

SEQ ID NO: 6112102 - DNA, 21 bp, Homo sapiens
ctagacgagcaggcttcttcc

SEQ ID NO: 6112103 - DNA, 20 bp, Homo sapiens
ctagactaattaaaatctgg

SEQ ID NO: 6112104 - DNA, 22 bp, Homo sapiens
ctagactactcaatattaaagg

SEQ ID NO: 6112105 - DNA, 22 bp, Homo sapiens
ctagactagtgctttaccttta

SEQ ID NO: 6112106 - DNA, 14 bp, Homo sapiens
ctagactataaatg

SEQ ID NO: 6112107 - DNA, 17 bp, Homo sapiens
ctagactcaaaacctgg

SEQ ID NO: 6112108 - DNA, 22 bp, Homo sapiens
ctagactcaaggttcccagaga

SEQ ID NO: 6112109 - DNA, 17 bp, Homo sapiens
ctagactcaagtgatcc

SEQ ID NO: 6112110 - DNA, 21 bp, Homo sapiens
ctagactcccggggtccccgc

SEQ ID NO: 6112111 - DNA, 16 bp, Homo sapiens
ctagactcctcaggag

SEQ ID NO: 6112112 - DNA, 20 bp, Homo sapiens
ctagactcctcaggagagac

SEQ ID NO: 6112113 - DNA, 15 bp, Homo sapiens
ctagactctagacaa

SEQ ID NO: 6112114 - DNA, 16 bp, Homo sapiens
ctagactgcaagaact

SEQ ID NO: 6112115 - DNA, 18 bp, Homo sapiens
ctagactgctcctgggca

SEQ ID NO: 6112116 - DNA, 19 bp, Homo sapiens
ctagactggagtgaggctt

SEQ ID NO: 6112117 - DNA, 23 bp, Homo sapiens
ctagactggagtgaggcttccag

SEQ ID NO: 6112118 - DNA, 14 bp, Homo sapiens
ctagactggcctag

SEQ ID NO: 6112119 - DNA, 15 bp, Homo sapiens
ctagactggcctagg

SEQ ID NO: 6112120 - DNA, 19 bp, Homo sapiens
ctagactggtgactgattc

SEQ ID NO: 6112121 - DNA, 13 bp, Homo sapiens
ctagactgtgaag

SEQ ID NO: 6112122 - DNA, 15 bp, Homo sapiens
ctagactgttacttt

SEQ ID NO: 6112123 - DNA, 16 bp, Homo sapiens
ctagactgttactttg

SEQ ID NO: 6112124 - DNA, 22 bp, Homo sapiens
ctagactgtttgctgatcccca

SEQ ID NO: 6112125 - DNA, 18 bp, Homo sapiens
ctagacttagattcatta

SEQ ID NO: 6112126 - DNA, 21 bp, Homo sapiens
ctagacttagattcattaact

SEQ ID NO: 6112127 - DNA, 22 bp, Homo sapiens
ctagacttcagaacatgctgga

SEQ ID NO: 6112128 - DNA, 14 bp, Homo sapiens
ctagacttccccat

SEQ ID NO: 6112129 - DNA, 17 bp, Homo sapiens
ctagacttccccatccc

SEQ ID NO: 6112130 - DNA, 14 bp, Homo sapiens
ctagacttgaaagt

SEQ ID NO: 6112131 - DNA, 23 bp, Homo sapiens
ctagacttgaaagttttccagta

SEQ ID NO: 6112132 - DNA, 20 bp, Homo sapiens
ctagactttaaatttaaagt

SEQ ID NO: 6112133 - DNA, 18 bp, Homo sapiens
ctagactttaggctttca

SEQ ID NO: 6112134 - DNA, 12 bp, Homo sapiens
ctagactttctc

SEQ ID NO: 6112135 - DNA, 23 bp, Homo sapiens
ctagactttgggatcaaataact

SEQ ID NO: 6112136 - DNA, 16 bp, Homo sapiens
ctagagaaaataaatt

SEQ ID NO: 6112137 - DNA, 16 bp, Homo sapiens
ctagagaaagacaaaa

SEQ ID NO: 6112138 - DNA, 17 bp, Homo sapiens
ctagagaaagacaaaat

SEQ ID NO: 6112139 - DNA, 19 bp, Homo sapiens
ctagagaaataagatcttt

SEQ ID NO: 6112140 - DNA, 16 bp, Homo sapiens
ctagagaaattcttgt

SEQ ID NO: 6112141 - DNA, 22 bp, Homo sapiens
ctagagaacagtattgggcagg

SEQ ID NO: 6112142 - DNA, 15 bp, Homo sapiens
ctagagaagacaggc

SEQ ID NO: 6112143 - DNA, 18 bp, Homo sapiens
ctagagaagacaggctgg

SEQ ID NO: 6112144 - DNA, 17 bp, Homo sapiens
ctagagaagaggctggt

SEQ ID NO: 6112145 - DNA, 16 bp, Homo sapiens
ctagagaagataattg

SEQ ID NO: 6112146 - DNA, 17 bp, Homo sapiens
ctagagaagataattgt

SEQ ID NO: 6112147 - DNA, 21 bp, Homo sapiens
ctagagaagggagacattgtt

SEQ ID NO: 6112148 - DNA, 16 bp, Homo sapiens
ctagagaatgcacaga

SEQ ID NO: 6112149 - DNA, 21 bp, Homo sapiens
ctagagaatgcacagatatac

SEQ ID NO: 6112150 - DNA, 15 bp, Homo sapiens
ctagagacaaatctt

SEQ ID NO: 6112151 - DNA, 13 bp, Homo sapiens
ctagagacaacaa

SEQ ID NO: 6112152 - DNA, 12 bp, Homo sapiens
ctagagacacat

SEQ ID NO: 6112153 - DNA, 17 bp, Homo sapiens
ctagagacacattggac

SEQ ID NO: 6112154 - DNA, 15 bp, Homo sapiens
ctagagacagatgct

SEQ ID NO: 6112155 - DNA, 19 bp, Homo sapiens
ctagagacagatgctggtg

SEQ ID NO: 6112156 - DNA, 15 bp, Homo sapiens
ctagagactctgtga

SEQ ID NO: 6112157 - DNA, 23 bp, Homo sapiens
ctagagactctgtgatctaagca

SEQ ID NO: 6112158 - DNA, 15 bp, Homo sapiens
ctagagagaaaaaga

SEQ ID NO: 6112159 - DNA, 20 bp, Homo sapiens
ctagagagaaaaagaaagaa

SEQ ID NO: 6112160 - DNA, 13 bp, Homo sapiens
ctagagagaataa

SEQ ID NO: 6112161 - DNA, 15 bp, Homo sapiens
ctagagagaataaat

SEQ ID NO: 6112162 - DNA, 11 bp, Homo sapiens
ctagagagagg

SEQ ID NO: 6112163 - DNA, 16 bp, Homo sapiens
ctagagagagggagaa

SEQ ID NO: 6112164 - DNA, 17 bp, Homo sapiens
ctagagagcagaaataa

SEQ ID NO: 6112165 - DNA, 14 bp, Homo sapiens
ctagagaggagaaa

SEQ ID NO: 6112166 - DNA, 19 bp, Homo sapiens
ctagagagggaattctctt

SEQ ID NO: 6112167 - DNA, 13 bp, Homo sapiens
ctagagaggggcc

SEQ ID NO: 6112168 - DNA, 20 bp, Homo sapiens
ctagagaggggcctctggct

SEQ ID NO: 6112169 - DNA, 22 bp, Homo sapiens
ctagagaggggcctctggctgc

SEQ ID NO: 6112170 - DNA, 15 bp, Homo sapiens
ctagagatattttgt

SEQ ID NO: 6112171 - DNA, 17 bp, Homo sapiens
ctagagatattttgtaa

SEQ ID NO: 6112172 - DNA, 23 bp, Homo sapiens
ctagagcaacccctgtacccagc

SEQ ID NO: 6112173 - DNA, 18 bp, Homo sapiens
ctagagcacaacataatt

SEQ ID NO: 6112174 - DNA, 19 bp, Homo sapiens
ctagagcacaacataattt

SEQ ID NO: 6112175 - DNA, 14 bp, Homo sapiens
ctagagcagacagg

SEQ ID NO: 6112176 - DNA, 16 bp, Homo sapiens
ctagagcatctgtccc

SEQ ID NO: 6112177 - DNA, 17 bp, Homo sapiens
ctagagcatctgtccca

SEQ ID NO: 6112178 - DNA, 15 bp, Homo sapiens
ctagagccagaccaa

SEQ ID NO: 6112179 - DNA, 13 bp, Homo sapiens
ctagagccctctc

SEQ ID NO: 6112180 - DNA, 20 bp, Homo sapiens
ctagagccctctcctccctc

SEQ ID NO: 6112181 - DNA, 23 bp, Homo sapiens
ctagagccctctcctccctctgt

SEQ ID NO: 6112182 - DNA, 14 bp, Homo sapiens
ctagagccgagggg

SEQ ID NO: 6112183 - DNA, 17 bp, Homo sapiens
ctagagccgggcacagc

SEQ ID NO: 6112184 - DNA, 13 bp, Homo sapiens
ctagagcctcgac

SEQ ID NO: 6112185 - DNA, 13 bp, Homo sapiens
ctagagcctctgc

SEQ ID NO: 6112186 - DNA, 21 bp, Homo sapiens
ctagagcctcttggggaaggg

SEQ ID NO: 6112187 - DNA, 10 bp, Homo sapiens
ctagagcctg

SEQ ID NO: 6112188 - DNA, 13 bp, Homo sapiens
ctagagcctgcct

SEQ ID NO: 6112189 - DNA, 19 bp, Homo sapiens
ctagagcgcggctggctct

SEQ ID NO: 6112190 - DNA, 16 bp, Homo sapiens
ctagagctaacagaca

SEQ ID NO: 6112191 - DNA, 16 bp, Homo sapiens
ctagagctcctgtccc

SEQ ID NO: 6112192 - DNA, 19 bp, Homo sapiens
ctagagctcctgtccctac

SEQ ID NO: 6112193 - DNA, 24 bp, Homo sapiens
ctagagctcctgtccctacccact

SEQ ID NO: 6112194 - DNA, 19 bp, Homo sapiens
ctagagctgggaaacaggg

SEQ ID NO: 6112195 - DNA, 22 bp, Homo sapiens
ctagagctgggaaacagggagc

SEQ ID NO: 6112196 - DNA, 19 bp, Homo sapiens
ctagagcttctgtattttc

SEQ ID NO: 6112197 - DNA, 22 bp, Homo sapiens
ctagagctttctttcacaaaaa

SEQ ID NO: 6112198 - DNA, 13 bp, Homo sapiens
ctagagctttttt

SEQ ID NO: 6112199 - DNA, 19 bp, Homo sapiens
ctagagcttttttataaca

SEQ ID NO: 6112200 - DNA, 23 bp, Homo sapiens
ctagaggaataaagctgtgagca

SEQ ID NO: 6112201 - DNA, 18 bp, Homo sapiens
ctagaggacactaggaga

SEQ ID NO: 6112202 - DNA, 22 bp, Homo sapiens
ctagaggagacagcctgtctct

SEQ ID NO: 6112203 - DNA, 17 bp, Homo sapiens
ctagaggaggaaaaagg

SEQ ID NO: 6112204 - DNA, 16 bp, Homo sapiens
ctagaggagggggcag

SEQ ID NO: 6112205 - DNA, 20 bp, Homo sapiens
ctagaggagggggcaggctg

SEQ ID NO: 6112206 - DNA, 23 bp, Homo sapiens
ctagaggattgtccaccttctgc

SEQ ID NO: 6112207 - DNA, 21 bp, Homo sapiens
ctagaggcaacagtgttctga

SEQ ID NO: 6112208 - DNA, 15 bp, Homo sapiens
ctagaggcagggagg

SEQ ID NO: 6112209 - DNA, 12 bp, Homo sapiens
ctagaggccacc

SEQ ID NO: 6112210 - DNA, 18 bp, Homo sapiens
cctgttgattatcttcag

SEQ ID NO: 6112211 - DNA, 19 bp, Homo sapiens
cctgttgcaggcaaatgta

SEQ ID NO: 6112212 - DNA, 18 bp, Homo sapiens
cctgttgccgagcccagc

SEQ ID NO: 6112213 - DNA, 12 bp, Homo sapiens
cctgttgctaag

SEQ ID NO: 6112214 - DNA, 14 bp, Homo sapiens
cctgttgctctgtt

SEQ ID NO: 6112215 - DNA, 22 bp, Homo sapiens
cctgttgctgtgtttaatttga

SEQ ID NO: 6112216 - DNA, 16 bp, Homo sapiens
cctgttgcttacaatt

SEQ ID NO: 6112217 - DNA, 20 bp, Homo sapiens
cctgttgctttcttcctgca

SEQ ID NO: 6112218 - DNA, 20 bp, Homo sapiens
cctgttggacccgctctgga

SEQ ID NO: 6112219 - DNA, 23 bp, Homo sapiens
cctgttggacccgctctggacca

SEQ ID NO: 6112220 - DNA, 18 bp, Homo sapiens
cctgttggcagctctagc

SEQ ID NO: 6112221 - DNA, 16 bp, Homo sapiens
cctgttggcctgtggg

SEQ ID NO: 6112222 - DNA, 20 bp, Homo sapiens
cctgttggcctgtgggcctc

SEQ ID NO: 6112223 - DNA, 22 bp, Homo sapiens
cctgttggctacacagacccct

SEQ ID NO: 6112224 - DNA, 17 bp, Homo sapiens
cctgttggctgctgcca

SEQ ID NO: 6112225 - DNA, 16 bp, Homo sapiens
cctgttggctgctgcg

SEQ ID NO: 6112226 - DNA, 12 bp, Homo sapiens
cctgttgggaga

SEQ ID NO: 6112227 - DNA, 19 bp, Homo sapiens
cctgttgggcagagctgga

SEQ ID NO: 6112228 - DNA, 22 bp, Homo sapiens
cctgttgggcagagctggacaa

SEQ ID NO: 6112229 - DNA, 16 bp, Homo sapiens
cctgttgggccaggag

SEQ ID NO: 6112230 - DNA, 19 bp, Homo sapiens
cctgttgggccaggagcct

SEQ ID NO: 6112231 - DNA, 16 bp, Homo sapiens
cctgttgggctgaacc

SEQ ID NO: 6112232 - DNA, 16 bp, Homo sapiens
cctgttgggggcttca

SEQ ID NO: 6112233 - DNA, 23 bp, Homo sapiens
cctgttgggggcttcaggtctct

SEQ ID NO: 6112234 - DNA, 21 bp, Homo sapiens
cctgttggttccaagccctgg

SEQ ID NO: 6112235 - DNA, 16 bp, Homo sapiens
cctgttggtttgaagt

SEQ ID NO: 6112236 - DNA, 13 bp, Homo sapiens
cctgttgtcctga

SEQ ID NO: 6112237 - DNA, 13 bp, Homo sapiens
cctgttgtgccac

SEQ ID NO: 6112238 - DNA, 18 bp, Homo sapiens
cctgttgttcccatctgc

SEQ ID NO: 6112239 - DNA, 19 bp, Homo sapiens
cctgttgttttggctcaat

SEQ ID NO: 6112240 - DNA, 17 bp, Homo sapiens
cctgtttaaaaaaagta

SEQ ID NO: 6112241 - DNA, 14 bp, Homo sapiens
cctgtttaatattt

SEQ ID NO: 6112242 - DNA, 16 bp, Homo sapiens
cctgtttaatatttaa

SEQ ID NO: 6112243 - DNA, 18 bp, Homo sapiens
cctgtttataatctgaag

SEQ ID NO: 6112244 - DNA, 21 bp, Homo sapiens
cctgtttataatctgaagata

SEQ ID NO: 6112245 - DNA, 12 bp, Homo sapiens
cctgtttatata

SEQ ID NO: 6112246 - DNA, 14 bp, Homo sapiens
cctgtttattgcca

SEQ ID NO: 6112247 - DNA, 20 bp, Homo sapiens
cctgtttatttttaaatttt

SEQ ID NO: 6112248 - DNA, 22 bp, Homo sapiens
cctgtttatttttaaattttct

SEQ ID NO: 6112249 - DNA, 23 bp, Homo sapiens
cctgtttcaagttcacacctgca

SEQ ID NO: 6112250 - DNA, 17 bp, Homo sapiens
cctgtttcaatcactgt

SEQ ID NO: 6112251 - DNA, 18 bp, Homo sapiens
cctgtttcagaccccccc

SEQ ID NO: 6112252 - DNA, 17 bp, Homo sapiens
cctgtttcccaggccca

SEQ ID NO: 6112253 - DNA, 12 bp, Homo sapiens
cctgtttcctga

SEQ ID NO: 6112254 - DNA, 20 bp, Homo sapiens
cctgtttctacctatatgca

SEQ ID NO: 6112255 - DNA, 13 bp, Homo sapiens
cctgtttctgaaa

SEQ ID NO: 6112256 - DNA, 15 bp, Homo sapiens
cctgtttctgaaaag

SEQ ID NO: 6112257 - DNA, 21 bp, Homo sapiens
cctgtttctggaagactgctc

SEQ ID NO: 6112258 - DNA, 14 bp, Homo sapiens
cctgtttctgtaga

SEQ ID NO: 6112259 - DNA, 12 bp, Homo sapiens
cctgtttcttcc

SEQ ID NO: 6112260 - DNA, 14 bp, Homo sapiens
cctgtttgaaatat

SEQ ID NO: 6112261 - DNA, 23 bp, Homo sapiens
cctgtttgaaggggagagaggga

SEQ ID NO: 6112262 - DNA, 13 bp, Homo sapiens
cctgtttgatgta

SEQ ID NO: 6112263 - DNA, 17 bp, Homo sapiens
cctgtttgcatgagaaa

SEQ ID NO: 6112264 - DNA, 15 bp, Homo sapiens
cctgtttggcctctc

SEQ ID NO: 6112265 - DNA, 16 bp, Homo sapiens
cctgtttggcctctct

SEQ ID NO: 6112266 - DNA, 21 bp, Homo sapiens
cctgtttggcctctctatcct

SEQ ID NO: 6112267 - DNA, 15 bp, Homo sapiens
cctgtttggtgagga

SEQ ID NO: 6112268 - DNA, 16 bp, Homo sapiens
cctgtttgtctgatgt

SEQ ID NO: 6112269 - DNA, 17 bp, Homo sapiens
cctgtttgttgagtgca

SEQ ID NO: 6112270 - DNA, 18 bp, Homo sapiens
cctgtttgtttctgaaag

SEQ ID NO: 6112271 - DNA, 15 bp, Homo sapiens
cctgttttaaattat

SEQ ID NO: 6112272 - DNA, 18 bp, Homo sapiens
cctgttttaagcagctct

SEQ ID NO: 6112273 - DNA, 19 bp, Homo sapiens
cctgttttatactgtactt

SEQ ID NO: 6112274 - DNA, 22 bp, Homo sapiens
cctgttttatatattatgtgaa

SEQ ID NO: 6112275 - DNA, 23 bp, Homo sapiens
cctgttttatatattatgtgaag

SEQ ID NO: 6112276 - DNA, 13 bp, Homo sapiens
cctgttttcactc

SEQ ID NO: 6112277 - DNA, 18 bp, Homo sapiens
cctgttttccacaccatc

SEQ ID NO: 6112278 - DNA, 23 bp, Homo sapiens
cctgttttcccacgaggaatctg

SEQ ID NO: 6112279 - DNA, 15 bp, Homo sapiens
cctgttttctccctc

SEQ ID NO: 6112280 - DNA, 16 bp, Homo sapiens
cctgttttctccctct

SEQ ID NO: 6112281 - DNA, 20 bp, Homo sapiens
cctgttttctccctctcatg

SEQ ID NO: 6112282 - DNA, 12 bp, Homo sapiens
cctgttttctga

SEQ ID NO: 6112283 - DNA, 13 bp, Homo sapiens
cctgttttctgaa

SEQ ID NO: 6112284 - DNA, 14 bp, Homo sapiens
cctgttttctgaaa

SEQ ID NO: 6112285 - DNA, 15 bp, Homo sapiens
cctgttttctgagcc

SEQ ID NO: 6112286 - DNA, 16 bp, Homo sapiens
cctgttttgagaccag

SEQ ID NO: 6112287 - DNA, 17 bp, Homo sapiens
cctgttttgagaccaga

SEQ ID NO: 6112288 - DNA, 16 bp, Homo sapiens
cctgttttgagccctg

SEQ ID NO: 6112289 - DNA, 21 bp, Homo sapiens
cctgttttggggctttcccag

SEQ ID NO: 6112290 - DNA, 18 bp, Homo sapiens
cctgtttttaagctgttt

SEQ ID NO: 6112291 - DNA, 23 bp, Homo sapiens
cctgtttttagagcttccaaatg

SEQ ID NO: 6112292 - DNA, 20 bp, Homo sapiens
cctgtttttcacattttcct

SEQ ID NO: 6112293 - DNA, 17 bp, Homo sapiens
cctgtttttctgggtgg

SEQ ID NO: 6112294 - DNA, 14 bp, Homo sapiens
cctgttttttttct

SEQ ID NO: 6112295 - DNA, 16 bp, Homo sapiens
cctgtttttttttcat

SEQ ID NO: 6112296 - DNA, 16 bp, Homo sapiens
ccttaaaaaatgtttc

SEQ ID NO: 6112297 - DNA, 14 bp, Homo sapiens
ccttaaaaaggact

SEQ ID NO: 6112298 - DNA, 13 bp, Homo sapiens
ccttaaaaataac

SEQ ID NO: 6112299 - DNA, 20 bp, Homo sapiens
ccttaaaaattagaacttga

SEQ ID NO: 6112300 - DNA, 13 bp, Homo sapiens
ccttaaaactagg

SEQ ID NO: 6112301 - DNA, 14 bp, Homo sapiens
ccttaaaagccatc

SEQ ID NO: 6112302 - DNA, 17 bp, Homo sapiens
ccttaaaaggagagaag

SEQ ID NO: 6112303 - DNA, 20 bp, Homo sapiens
ccttaaaagtaataaagaga

SEQ ID NO: 6112304 - DNA, 21 bp, Homo sapiens
ccttaaaagtaataaagagaa

SEQ ID NO: 6112305 - DNA, 16 bp, Homo sapiens
ccttaaaataatgatt

SEQ ID NO: 6112306 - DNA, 11 bp, Homo sapiens
ccttaaaatgc

SEQ ID NO: 6112307 - DNA, 23 bp, Homo sapiens
ccttaaaatgcattgaaagaatt

SEQ ID NO: 6112308 - DNA, 12 bp, Homo sapiens
ccttaaaatgga

SEQ ID NO: 6112309 - DNA, 10 bp, Homo sapiens
ccttaaaatt

SEQ ID NO: 6112310 - DNA, 16 bp, Homo sapiens
ccttaaaatttgaaac

SEQ ID NO: 6112311 - DNA, 22 bp, Homo sapiens
ccttaaacaattcttgtaactt

SEQ ID NO: 6112312 - DNA, 22 bp, Homo sapiens
ccttaaacacaggctgtcctta

SEQ ID NO: 6112313 - DNA, 23 bp, Homo sapiens
ccttaaacctgaagatgtctcct

SEQ ID NO: 6112314 - DNA, 18 bp, Homo sapiens
ccttaaagaaaattgcat

SEQ ID NO: 6112315 - DNA, 23 bp, Homo sapiens
ccttaaagaaagtcgaattaata

SEQ ID NO: 6112316 - DNA, 12 bp, Homo sapiens
ccttaaattatt

SEQ ID NO: 6112317 - DNA, 23 bp, Homo sapiens
ccttaaatttctgccctgagccc

SEQ ID NO: 6112318 - DNA, 12 bp, Homo sapiens
ccttaaattttt

SEQ ID NO: 6112319 - DNA, 17 bp, Homo sapiens
ccttaacacactggcca

SEQ ID NO: 6112320 - DNA, 19 bp, Homo sapiens
ccttaacacctgatctggc

SEQ ID NO: 6112321 - DNA, 17 bp, Homo sapiens
ccttaacagttgtattt

SEQ ID NO: 6112322 - DNA, 22 bp, Homo sapiens
ccttaaccaccgcatatgcatg

SEQ ID NO: 6112323 - DNA, 15 bp, Homo sapiens
ccttaacccaaggag

SEQ ID NO: 6112324 - DNA, 20 bp, Homo sapiens
ccttaacccaaggagcacag

SEQ ID NO: 6112325 - DNA, 17 bp, Homo sapiens
ccttaacccacctctcc

SEQ ID NO: 6112326 - DNA, 13 bp, Homo sapiens
ccttaacctggga

SEQ ID NO: 6112327 - DNA, 16 bp, Homo sapiens
ccttaacctgggacca

SEQ ID NO: 6112328 - DNA, 14 bp, Homo sapiens
ccttaactcagcca

SEQ ID NO: 6112329 - DNA, 20 bp, Homo sapiens
ccttaactctaaccctgtgg

SEQ ID NO: 6112330 - DNA, 13 bp, Homo sapiens
ccttaactggccc

SEQ ID NO: 6112331 - DNA, 18 bp, Homo sapiens
ccttaactggccctcggg

SEQ ID NO: 6112332 - DNA, 21 bp, Homo sapiens
ccttaactgtccagtccagtg

SEQ ID NO: 6112333 - DNA, 16 bp, Homo sapiens
ccttaactgtgctcag

SEQ ID NO: 6112334 - DNA, 16 bp, Homo sapiens
ccttaagaaagctata

SEQ ID NO: 6112335 - DNA, 15 bp, Homo sapiens
ccttaagaactgtgt

SEQ ID NO: 6112336 - DNA, 15 bp, Homo sapiens
ccttaagaatgccaa

SEQ ID NO: 6112337 - DNA, 23 bp, Homo sapiens
ccttaagacctactgttctaaag

SEQ ID NO: 6112338 - DNA, 16 bp, Homo sapiens
ccttaagatattgaag

SEQ ID NO: 6112339 - DNA, 19 bp, Homo sapiens
ccttaagccaaactcaggc

SEQ ID NO: 6112340 - DNA, 14 bp, Homo sapiens
ccttaagccctggc

SEQ ID NO: 6112341 - DNA, 21 bp, Homo sapiens
ccttaaggaggtagctcccag

SEQ ID NO: 6112342 - DNA, 22 bp, Homo sapiens
ccttaaggatcaccccagcccc

SEQ ID NO: 6112343 - DNA, 23 bp, Homo sapiens
ccttaaggatcaccccagccccc

SEQ ID NO: 6112344 - DNA, 20 bp, Homo sapiens
ccttaaggcacagtgggagc

SEQ ID NO: 6112345 - DNA, 18 bp, Homo sapiens
ccttaaggctcttttgta

SEQ ID NO: 6112346 - DNA, 14 bp, Homo sapiens
ccttaaggtctcca

SEQ ID NO: 6112347 - DNA, 23 bp, Homo sapiens
ccttaagtcttactgttttgtgc

SEQ ID NO: 6112348 - DNA, 18 bp, Homo sapiens
ccttaagtctttttgaag

SEQ ID NO: 6112349 - DNA, 19 bp, Homo sapiens
ccttaagtgaggaaatcaa

SEQ ID NO: 6112350 - DNA, 22 bp, Homo sapiens
ccttaagtgaggaaatcaaagt

SEQ ID NO: 6112351 - DNA, 20 bp, Homo sapiens
ccttaagtgatttgcctgta

SEQ ID NO: 6112352 - DNA, 12 bp, Homo sapiens
ccttaagtttcc

SEQ ID NO: 6112353 - DNA, 22 bp, Homo sapiens
ccttaagttttagtctttagaa

SEQ ID NO: 6112354 - DNA, 14 bp, Homo sapiens
ccttaataaatatg

SEQ ID NO: 6112355 - DNA, 15 bp, Homo sapiens
ccttaataaatatgt

SEQ ID NO: 6112356 - DNA, 16 bp, Homo sapiens
ccttaataaatatgta

SEQ ID NO: 6112357 - DNA, 23 bp, Homo sapiens
ccttaataaatatgtaatataaa

SEQ ID NO: 6112358 - DNA, 12 bp, Homo sapiens
ccttaataataa

SEQ ID NO: 6112359 - DNA, 22 bp, Homo sapiens
ccttaatatacctaaatctcca

SEQ ID NO: 6112360 - DNA, 20 bp, Homo sapiens
ccttaatattgaggctgcag

SEQ ID NO: 6112361 - DNA, 21 bp, Homo sapiens
ccttaatattgaggctgcagc

SEQ ID NO: 6112362 - DNA, 23 bp, Homo sapiens
ccttaatcaggtcctcagagaat

SEQ ID NO: 6112363 - DNA, 23 bp, Homo sapiens
ccttaatctaatctaaaagctct

SEQ ID NO: 6112364 - DNA, 18 bp, Homo sapiens
ccttaatcttgctttctt

SEQ ID NO: 6112365 - DNA, 18 bp, Homo sapiens
ccttaatgacaacactta

SEQ ID NO: 6112366 - DNA, 15 bp, Homo sapiens
ccttaatggatgctc

SEQ ID NO: 6112367 - DNA, 19 bp, Homo sapiens
ccttaatgtcaccatgctt

SEQ ID NO: 6112368 - DNA, 15 bp, Homo sapiens
ccttaattaaagaat

SEQ ID NO: 6112369 - DNA, 12 bp, Homo sapiens
ccttaatttaat

SEQ ID NO: 6112370 - DNA, 23 bp, Homo sapiens
ccttaatttagaaactgaaaaat

SEQ ID NO: 6112371 - DNA, 16 bp, Homo sapiens
ccttaatttattatta

SEQ ID NO: 6112372 - DNA, 15 bp, Homo sapiens
ccttaatttcctttt

SEQ ID NO: 6112373 - DNA, 16 bp, Homo sapiens
ccttaatttgcacagt

SEQ ID NO: 6112374 - DNA, 20 bp, Homo sapiens
ccttaatttttgaaaagctg

SEQ ID NO: 6112375 - DNA, 16 bp, Homo sapiens
ccttacaaagccagct

SEQ ID NO: 6112376 - DNA, 22 bp, Homo sapiens
ccttacaaagccagctctgagc

SEQ ID NO: 6112377 - DNA, 21 bp, Homo sapiens
ccttacaaatgattgctttta

SEQ ID NO: 6112378 - DNA, 19 bp, Homo sapiens
ccttacaaccacatttctg

SEQ ID NO: 6112379 - DNA, 20 bp, Homo sapiens
ccttacaaccacatttctgg

SEQ ID NO: 6112380 - DNA, 22 bp, Homo sapiens
ccttacaacgccgagtgcactg

SEQ ID NO: 6112381 - DNA, 16 bp, Homo sapiens
ccttacaatgtgaata

SEQ ID NO: 6112382 - DNA, 21 bp, Homo sapiens
ccttacaatgtgaataatggc

SEQ ID NO: 6112383 - DNA, 12 bp, Homo sapiens
ccttacacactc

SEQ ID NO: 6112384 - DNA, 18 bp, Homo sapiens
ccttacacactcaggcct

SEQ ID NO: 6112385 - DNA, 20 bp, Homo sapiens
ccttacacgtgcgtgtgagt

SEQ ID NO: 6112386 - DNA, 15 bp, Homo sapiens
ccttacactccccca

SEQ ID NO: 6112387 - DNA, 13 bp, Homo sapiens
ccttacacttact

SEQ ID NO: 6112388 - DNA, 14 bp, Homo sapiens
ctagaggccaccta

SEQ ID NO: 6112389 - DNA, 17 bp, Homo sapiens
ctagaggccagccccac

SEQ ID NO: 6112390 - DNA, 18 bp, Homo sapiens
ctagaggccagccccacc

SEQ ID NO: 6112391 - DNA, 19 bp, Homo sapiens
ctagaggccagccccaccc

SEQ ID NO: 6112392 - DNA, 20 bp, Homo sapiens
ctagaggccagccccaccca

SEQ ID NO: 6112393 - DNA, 22 bp, Homo sapiens
ctagaggccagccccacccagg

SEQ ID NO: 6112394 - DNA, 13 bp, Homo sapiens
ctagaggccatgt

SEQ ID NO: 6112395 - DNA, 12 bp, Homo sapiens
ctagaggcctca

SEQ ID NO: 6112396 - DNA, 15 bp, Homo sapiens
ctagaggcctcagtt

SEQ ID NO: 6112397 - DNA, 13 bp, Homo sapiens
ctagaggcctgag

SEQ ID NO: 6112398 - DNA, 15 bp, Homo sapiens
ctagaggcctgagga

SEQ ID NO: 6112399 - DNA, 18 bp, Homo sapiens
ctagaggcctgaggatga

SEQ ID NO: 6112400 - DNA, 22 bp, Homo sapiens
ctagaggcctgaggatgagctg

SEQ ID NO: 6112401 - DNA, 16 bp, Homo sapiens
ctagaggcgagccagg

SEQ ID NO: 6112402 - DNA, 14 bp, Homo sapiens
ctagaggctcatgg

SEQ ID NO: 6112403 - DNA, 15 bp, Homo sapiens
ctagaggctcatggc

SEQ ID NO: 6112404 - DNA, 17 bp, Homo sapiens
ctagaggctcatggccc

SEQ ID NO: 6112405 - DNA, 18 bp, Homo sapiens
ctagaggctcatggccct

SEQ ID NO: 6112406 - DNA, 21 bp, Homo sapiens
ctagaggcttccttcatttcc

SEQ ID NO: 6112407 - DNA, 22 bp, Homo sapiens
ctagaggcttgcataataagct

SEQ ID NO: 6112408 - DNA, 18 bp, Homo sapiens
ctagaggctttgagaagc

SEQ ID NO: 6112409 - DNA, 16 bp, Homo sapiens
ctagagggacctctcc

SEQ ID NO: 6112410 - DNA, 18 bp, Homo sapiens
ctagagggacctctccca

SEQ ID NO: 6112411 - DNA, 21 bp, Homo sapiens
ctagagggacctctcccaggg

SEQ ID NO: 6112412 - DNA, 21 bp, Homo sapiens
ctagagggaggggcctaggcc

SEQ ID NO: 6112413 - DNA, 22 bp, Homo sapiens
ctagagggaggggcctaggcct

SEQ ID NO: 6112414 - DNA, 22 bp, Homo sapiens
ctagagggatacactgaagtta

SEQ ID NO: 6112415 - DNA, 17 bp, Homo sapiens
ctagagggtcggggagg

SEQ ID NO: 6112416 - DNA, 16 bp, Homo sapiens
ctagaggtagagaaac

SEQ ID NO: 6112417 - DNA, 15 bp, Homo sapiens
ctagaggtgagaaat

SEQ ID NO: 6112418 - DNA, 17 bp, Homo sapiens
ctagaggtgagaaattt

SEQ ID NO: 6112419 - DNA, 12 bp, Homo sapiens
ctagaggtggca

SEQ ID NO: 6112420 - DNA, 14 bp, Homo sapiens
ctagaggtgggcag

SEQ ID NO: 6112421 - DNA, 19 bp, Homo sapiens
ctagaggtgggcagctggg

SEQ ID NO: 6112422 - DNA, 22 bp, Homo sapiens
ctagaggtgggcagctgggccc

SEQ ID NO: 6112423 - DNA, 17 bp, Homo sapiens
ctagaggttcaaagata

SEQ ID NO: 6112424 - DNA, 21 bp, Homo sapiens
ctagaggttcaaagatatttt

SEQ ID NO: 6112425 - DNA, 20 bp, Homo sapiens
ctagaggttttatgatattt

SEQ ID NO: 6112426 - DNA, 22 bp, Homo sapiens
ctagagtaaaagtcccagttaa

SEQ ID NO: 6112427 - DNA, 16 bp, Homo sapiens
ctagagtatacctgtg

SEQ ID NO: 6112428 - DNA, 23 bp, Homo sapiens
ctagagtatattcctctgctgaa

SEQ ID NO: 6112429 - DNA, 13 bp, Homo sapiens
ctagagtatgtgt

SEQ ID NO: 6112430 - DNA, 16 bp, Homo sapiens
ctagagtatgtgtatg

SEQ ID NO: 6112431 - DNA, 18 bp, Homo sapiens
ctagagtatgtgtatgta

SEQ ID NO: 6112432 - DNA, 22 bp, Homo sapiens
ctagagtcacccccccaggcct

SEQ ID NO: 6112433 - DNA, 18 bp, Homo sapiens
ctagagtcatgtgagcct

SEQ ID NO: 6112434 - DNA, 15 bp, Homo sapiens
ctagagtcctcactc

SEQ ID NO: 6112435 - DNA, 19 bp, Homo sapiens
ctagagtcctcactcccag

SEQ ID NO: 6112436 - DNA, 16 bp, Homo sapiens
ctagagtctgaacagc

SEQ ID NO: 6112437 - DNA, 17 bp, Homo sapiens
ctagagtgaacttgggc

SEQ ID NO: 6112438 - DNA, 24 bp, Homo sapiens
ctagagtgactcactaattcatta

SEQ ID NO: 6112439 - DNA, 15 bp, Homo sapiens
ctagagtgcagtggc

SEQ ID NO: 6112440 - DNA, 22 bp, Homo sapiens
ctagagtgctctgaccctgggc

SEQ ID NO: 6112441 - DNA, 22 bp, Homo sapiens
ctagagtgtagcctaaagggca

SEQ ID NO: 6112442 - DNA, 12 bp, Homo sapiens
ctagagttaaaa

SEQ ID NO: 6112443 - DNA, 13 bp, Homo sapiens
ctagagttatctt

SEQ ID NO: 6112444 - DNA, 15 bp, Homo sapiens
ctagagttatcttct

SEQ ID NO: 6112445 - DNA, 19 bp, Homo sapiens
ctagagtttagctggaaaa

SEQ ID NO: 6112446 - DNA, 20 bp, Homo sapiens
ctagagtttagtccttactg

SEQ ID NO: 6112447 - DNA, 22 bp, Homo sapiens
ctagagtttatacagtgtacat

SEQ ID NO: 6112448 - DNA, 23 bp, Homo sapiens
ctagagtttatacagtgtacatg

SEQ ID NO: 6112449 - DNA, 16 bp, Homo sapiens
ctagagttttatcaac

SEQ ID NO: 6112450 - DNA, 16 bp, Homo sapiens
ctagataaaaagatgg

SEQ ID NO: 6112451 - DNA, 23 bp, Homo sapiens
ctagataaaaagatggcctttgc

SEQ ID NO: 6112452 - DNA, 22 bp, Homo sapiens
ctagataaaaggagagaaagca

SEQ ID NO: 6112453 - DNA, 21 bp, Homo sapiens
ctagataacgaagtgcactta

SEQ ID NO: 6112454 - DNA, 16 bp, Homo sapiens
ctagataacttaaata

SEQ ID NO: 6112455 - DNA, 19 bp, Homo sapiens
ctagataacttaaataatt

SEQ ID NO: 6112456 - DNA, 23 bp, Homo sapiens
ctagataacttaaataatttaag

SEQ ID NO: 6112457 - DNA, 16 bp, Homo sapiens
ctagatacaataaatt

SEQ ID NO: 6112458 - DNA, 20 bp, Homo sapiens
ctagatacaggactggttcc

SEQ ID NO: 6112459 - DNA, 22 bp, Homo sapiens
ctagatacaggactggttcctt

SEQ ID NO: 6112460 - DNA, 18 bp, Homo sapiens
ctagatacgaaatcagtt

SEQ ID NO: 6112461 - DNA, 17 bp, Homo sapiens
ctagatactactttctc

SEQ ID NO: 6112462 - DNA, 22 bp, Homo sapiens
ctagatactactttctcttttt

SEQ ID NO: 6112463 - DNA, 16 bp, Homo sapiens
ctagatactgtatcat

SEQ ID NO: 6112464 - DNA, 18 bp, Homo sapiens
ctagatactgttgatctt

SEQ ID NO: 6112465 - DNA, 18 bp, Homo sapiens
ctagataggtgcttttaa

SEQ ID NO: 6112466 - DNA, 22 bp, Homo sapiens
ctagatatagcttttggtgttt

SEQ ID NO: 6112467 - DNA, 14 bp, Homo sapiens
ctagatatgcctta

SEQ ID NO: 6112468 - DNA, 19 bp, Homo sapiens
ctagatcaaggagcccaga

SEQ ID NO: 6112469 - DNA, 17 bp, Homo sapiens
ctagatcactgtgctta

SEQ ID NO: 6112470 - DNA, 20 bp, Homo sapiens
ctagatcacttgtcctcttg

SEQ ID NO: 6112471 - DNA, 18 bp, Homo sapiens
ctagatcagagagcaaga

SEQ ID NO: 6112472 - DNA, 20 bp, Homo sapiens
ctagatcagatgctccaaga

SEQ ID NO: 6112473 - DNA, 17 bp, Homo sapiens
ctagatcataaggcttc

SEQ ID NO: 6112474 - DNA, 17 bp, Homo sapiens
ctagatcatatttaaag

SEQ ID NO: 6112475 - DNA, 18 bp, Homo sapiens
ctagatcatgaagaacct

SEQ ID NO: 6112476 - DNA, 21 bp, Homo sapiens
ctagatcatttgttctgggag

SEQ ID NO: 6112477 - DNA, 17 bp, Homo sapiens
ctagatccacacacaga

SEQ ID NO: 6112478 - DNA, 22 bp, Homo sapiens
ctagatccaggcttctcccgga

SEQ ID NO: 6112479 - DNA, 19 bp, Homo sapiens
ctagatcctgggtttccat

SEQ ID NO: 6112480 - DNA, 21 bp, Homo sapiens
ctagatctagaatcagagctg

SEQ ID NO: 6112481 - DNA, 13 bp, Homo sapiens
ctagatctgcagg

SEQ ID NO: 6112482 - DNA, 14 bp, Homo sapiens
ctagatctgcaggc

SEQ ID NO: 6112483 - DNA, 18 bp, Homo sapiens
ctagatctgcaggctgca

SEQ ID NO: 6112484 - DNA, 19 bp, Homo sapiens
ctagatctgcaggctgcac

SEQ ID NO: 6112485 - DNA, 16 bp, Homo sapiens
ctagatgaagaaagag

SEQ ID NO: 6112486 - DNA, 23 bp, Homo sapiens
ctagatgagcccagccctgttct

SEQ ID NO: 6112487 - DNA, 14 bp, Homo sapiens
ctagatgatttttt

SEQ ID NO: 6112488 - DNA, 18 bp, Homo sapiens
ctagatgcatcactgggt

SEQ ID NO: 6112489 - DNA, 19 bp, Homo sapiens
ctagatggatattagatgc

SEQ ID NO: 6112490 - DNA, 14 bp, Homo sapiens
ctagatggctcctc

SEQ ID NO: 6112491 - DNA, 18 bp, Homo sapiens
ctagatggctcctctcag

SEQ ID NO: 6112492 - DNA, 20 bp, Homo sapiens
ctagatgggcatggggtggg

SEQ ID NO: 6112493 - DNA, 15 bp, Homo sapiens
ctagatggtgctgag

SEQ ID NO: 6112494 - DNA, 17 bp, Homo sapiens
ctagatggtgctgagaa

SEQ ID NO: 6112495 - DNA, 16 bp, Homo sapiens
ctagatgtagtatttt

SEQ ID NO: 6112496 - DNA, 20 bp, Homo sapiens
ctagatgtagtattttttgt

SEQ ID NO: 6112497 - DNA, 23 bp, Homo sapiens
ctagatgtagtattttttgtata

SEQ ID NO: 6112498 - DNA, 13 bp, Homo sapiens
ctagatgtcttta

SEQ ID NO: 6112499 - DNA, 12 bp, Homo sapiens
ctagatgtgttc

SEQ ID NO: 6112500 - DNA, 16 bp, Homo sapiens
ctagatgtttaacaaa

SEQ ID NO: 6112501 - DNA, 20 bp, Homo sapiens
ctagattacatctgccttaa

SEQ ID NO: 6112502 - DNA, 19 bp, Homo sapiens
ctagattaggtagactttg

SEQ ID NO: 6112503 - DNA, 21 bp, Homo sapiens
ctagattaggtagactttgct

SEQ ID NO: 6112504 - DNA, 22 bp, Homo sapiens
ctagattaggtagactttgctt

SEQ ID NO: 6112505 - DNA, 15 bp, Homo sapiens
ctagattatatcaaa

SEQ ID NO: 6112506 - DNA, 13 bp, Homo sapiens
ctagattcataaa

SEQ ID NO: 6112507 - DNA, 18 bp, Homo sapiens
ctagattcataaatacaa

SEQ ID NO: 6112508 - DNA, 12 bp, Homo sapiens
ctagattgacta

SEQ ID NO: 6112509 - DNA, 13 bp, Homo sapiens
ctagatttatgaa

SEQ ID NO: 6112510 - DNA, 19 bp, Homo sapiens
ctagatttctagaaaagct

SEQ ID NO: 6112511 - DNA, 22 bp, Homo sapiens
ctagatttctagaaaagcttcc

SEQ ID NO: 6112512 - DNA, 17 bp, Homo sapiens
ctagatttggagacttt

SEQ ID NO: 6112513 - DNA, 23 bp, Homo sapiens
ctagatttggagactttgttcct

SEQ ID NO: 6112514 - DNA, 12 bp, Homo sapiens
ctagatttgtcc

SEQ ID NO: 6112515 - DNA, 14 bp, Homo sapiens
ctagatttgtcctt

SEQ ID NO: 6112516 - DNA, 18 bp, Homo sapiens
ctagattttaatttattt

SEQ ID NO: 6112517 - DNA, 19 bp, Homo sapiens
ctagattttaatttatttg

SEQ ID NO: 6112518 - DNA, 19 bp, Homo sapiens
ctagattttcacttatgaa

SEQ ID NO: 6112519 - DNA, 13 bp, Homo sapiens
ctagattttgaaa

SEQ ID NO: 6112520 - DNA, 15 bp, Homo sapiens
ctagattttgaaaaa

SEQ ID NO: 6112521 - DNA, 13 bp, Homo sapiens
ctagattttgttt

SEQ ID NO: 6112522 - DNA, 18 bp, Homo sapiens
ctagattttgttttgctt

SEQ ID NO: 6112523 - DNA, 16 bp, Homo sapiens
ctagcaaaactcacag

SEQ ID NO: 6112524 - DNA, 13 bp, Homo sapiens
ctagcaaaaggat

SEQ ID NO: 6112525 - DNA, 19 bp, Homo sapiens
ctagcaaaataaaacatag

SEQ ID NO: 6112526 - DNA, 13 bp, Homo sapiens
ctagcaaaatgct

SEQ ID NO: 6112527 - DNA, 17 bp, Homo sapiens
ctagcaaacaaaaatag

SEQ ID NO: 6112528 - DNA, 23 bp, Homo sapiens
ctagcaaacaaaaatagaatata

SEQ ID NO: 6112529 - DNA, 21 bp, Homo sapiens
ctagcaacacccaaaggtggc

SEQ ID NO: 6112530 - DNA, 21 bp, Homo sapiens
ctagcaagctgccgaaccaaa

SEQ ID NO: 6112531 - DNA, 16 bp, Homo sapiens
ctagcaagctggcctc

SEQ ID NO: 6112532 - DNA, 20 bp, Homo sapiens
ctagcaataagttgaatgat

SEQ ID NO: 6112533 - DNA, 17 bp, Homo sapiens
ctagcaatacagggagg

SEQ ID NO: 6112534 - DNA, 22 bp, Homo sapiens
ctagcaatcacaacactggctg

SEQ ID NO: 6112535 - DNA, 19 bp, Homo sapiens
ctagcaatctcttcattat

SEQ ID NO: 6112536 - DNA, 14 bp, Homo sapiens
ctagcaattttctt

SEQ ID NO: 6112537 - DNA, 22 bp, Homo sapiens
ctagcaattttctttgtttctt

SEQ ID NO: 6112538 - DNA, 20 bp, Homo sapiens
ctagcacaaggagtgcccgc

SEQ ID NO: 6112539 - DNA, 17 bp, Homo sapiens
ctagcacaatttgcact

SEQ ID NO: 6112540 - DNA, 23 bp, Homo sapiens
ctagcacactcttctcttgagca

SEQ ID NO: 6112541 - DNA, 13 bp, Homo sapiens
ctagcacagaggc

SEQ ID NO: 6112542 - DNA, 16 bp, Homo sapiens
ctagcacagaggcctg

SEQ ID NO: 6112543 - DNA, 17 bp, Homo sapiens
ctagcacagaggcctga

SEQ ID NO: 6112544 - DNA, 14 bp, Homo sapiens
ctagcacagctccc

SEQ ID NO: 6112545 - DNA, 18 bp, Homo sapiens
ctagcacagctgtgagga

SEQ ID NO: 6112546 - DNA, 18 bp, Homo sapiens
ctagcacagttccttgca

SEQ ID NO: 6112547 - DNA, 17 bp, Homo sapiens
ctagcacatcatggcag

SEQ ID NO: 6112548 - DNA, 14 bp, Homo sapiens
ctagcacatgcttc

SEQ ID NO: 6112549 - DNA, 18 bp, Homo sapiens
ctagcacatgcttcaata

SEQ ID NO: 6112550 - DNA, 20 bp, Homo sapiens
ctagcacatgttgatttcct

SEQ ID NO: 6112551 - DNA, 21 bp, Homo sapiens
ctagcacatgttgatttccta

SEQ ID NO: 6112552 - DNA, 17 bp, Homo sapiens
ctagcaccctggagagt

SEQ ID NO: 6112553 - DNA, 16 bp, Homo sapiens
ctagcacctccccaga

SEQ ID NO: 6112554 - DNA, 20 bp, Homo sapiens
ctagcacctccccagacagg

SEQ ID NO: 6112555 - DNA, 15 bp, Homo sapiens
ctagcactcacatgc

SEQ ID NO: 6112556 - DNA, 14 bp, Homo sapiens
ctagcactcctcaa

SEQ ID NO: 6112557 - DNA, 20 bp, Homo sapiens
ctagcactgcacactcagtt

SEQ ID NO: 6112558 - DNA, 15 bp, Homo sapiens
ctagcactgccccac

SEQ ID NO: 6112559 - DNA, 16 bp, Homo sapiens
ctagcacttgtctcag

SEQ ID NO: 6112560 - DNA, 17 bp, Homo sapiens
ctagcacttgtctcagg

SEQ ID NO: 6112561 - DNA, 21 bp, Homo sapiens
ctagcagaagacaaggcatgt

SEQ ID NO: 6112562 - DNA, 18 bp, Homo sapiens
ctagcagacactgccttg

SEQ ID NO: 6112563 - DNA, 12 bp, Homo sapiens
ctagcagagtgc

SEQ ID NO: 6112564 - DNA, 19 bp, Homo sapiens
ctagcagcaccgttctgtg

SEQ ID NO: 6112565 - DNA, 13 bp, Homo sapiens
ccttacagagcat

SEQ ID NO: 6112566 - DNA, 21 bp, Homo sapiens
ccttacagagcatacaacaga

SEQ ID NO: 6112567 - DNA, 18 bp, Homo sapiens
ccttacagtgaagatgtt

SEQ ID NO: 6112568 - DNA, 19 bp, Homo sapiens
ccttacagttatcctgcaa

SEQ ID NO: 6112569 - DNA, 15 bp, Homo sapiens
ccttacatcttttct

SEQ ID NO: 6112570 - DNA, 12 bp, Homo sapiens
ccttacattaaa

SEQ ID NO: 6112571 - DNA, 16 bp, Homo sapiens
ccttacattaaaaagc

SEQ ID NO: 6112572 - DNA, 18 bp, Homo sapiens
ccttaccaactttctgta

SEQ ID NO: 6112573 - DNA, 20 bp, Homo sapiens
ccttaccactgctctgatga

SEQ ID NO: 6112574 - DNA, 19 bp, Homo sapiens
ccttaccagagacgcccag

SEQ ID NO: 6112575 - DNA, 20 bp, Homo sapiens
ccttaccagagacgcccagc

SEQ ID NO: 6112576 - DNA, 15 bp, Homo sapiens
ccttaccagcagagc

SEQ ID NO: 6112577 - DNA, 16 bp, Homo sapiens
ccttacccatctctct

SEQ ID NO: 6112578 - DNA, 18 bp, Homo sapiens
ccttaccctactggctgt

SEQ ID NO: 6112579 - DNA, 16 bp, Homo sapiens
ccttacctcccctgcc

SEQ ID NO: 6112580 - DNA, 17 bp, Homo sapiens
ccttacctcccctgcca

SEQ ID NO: 6112581 - DNA, 16 bp, Homo sapiens
ccttacctcctgccca

SEQ ID NO: 6112582 - DNA, 13 bp, Homo sapiens
ccttacctctgga

SEQ ID NO: 6112583 - DNA, 14 bp, Homo sapiens
ccttacctctggaa

SEQ ID NO: 6112584 - DNA, 13 bp, Homo sapiens
ccttacctgtctc

SEQ ID NO: 6112585 - DNA, 20 bp, Homo sapiens
ccttacctgtctctctcttc

SEQ ID NO: 6112586 - DNA, 17 bp, Homo sapiens
ccttaccttcacttaaa

SEQ ID NO: 6112587 - DNA, 17 bp, Homo sapiens
ccttacgatcaggcaca

SEQ ID NO: 6112588 - DNA, 16 bp, Homo sapiens
ccttacggtcatgatg

SEQ ID NO: 6112589 - DNA, 14 bp, Homo sapiens
ccttactaattata

SEQ ID NO: 6112590 - DNA, 17 bp, Homo sapiens
ccttactacttcttgga

SEQ ID NO: 6112591 - DNA, 15 bp, Homo sapiens
ccttactagaaatat

SEQ ID NO: 6112592 - DNA, 23 bp, Homo sapiens
ccttactagattcataatgcaat

SEQ ID NO: 6112593 - DNA, 18 bp, Homo sapiens
ccttactatgatctcagg

SEQ ID NO: 6112594 - DNA, 18 bp, Homo sapiens
ccttactattgtattata

SEQ ID NO: 6112595 - DNA, 16 bp, Homo sapiens
ccttactcagagctgc

SEQ ID NO: 6112596 - DNA, 17 bp, Homo sapiens
ccttactcagagctgcg

SEQ ID NO: 6112597 - DNA, 20 bp, Homo sapiens
ccttactcaggggatgttta

SEQ ID NO: 6112598 - DNA, 17 bp, Homo sapiens
ccttactcctctttcct

SEQ ID NO: 6112599 - DNA, 12 bp, Homo sapiens
ccttactcctgt

SEQ ID NO: 6112600 - DNA, 15 bp, Homo sapiens
ccttactcctgtggg

SEQ ID NO: 6112601 - DNA, 13 bp, Homo sapiens
ccttactctgagc

SEQ ID NO: 6112602 - DNA, 16 bp, Homo sapiens
ccttactctgagccca

SEQ ID NO: 6112603 - DNA, 18 bp, Homo sapiens
ccttactctgagcccagg

SEQ ID NO: 6112604 - DNA, 22 bp, Homo sapiens
ccttactctgagcccaggccgt

SEQ ID NO: 6112605 - DNA, 14 bp, Homo sapiens
ccttactctgagga

SEQ ID NO: 6112606 - DNA, 15 bp, Homo sapiens
ccttactctgaggaa

SEQ ID NO: 6112607 - DNA, 22 bp, Homo sapiens
ccttactcttcttgaaatttta

SEQ ID NO: 6112608 - DNA, 23 bp, Homo sapiens
ccttactgagcgcaagccacagc

SEQ ID NO: 6112609 - DNA, 16 bp, Homo sapiens
ccttactgatatttat

SEQ ID NO: 6112610 - DNA, 18 bp, Homo sapiens
ccttactggcactgtggc

SEQ ID NO: 6112611 - DNA, 19 bp, Homo sapiens
ccttactggcactgtggca

SEQ ID NO: 6112612 - DNA, 17 bp, Homo sapiens
ccttactggtttcccca

SEQ ID NO: 6112613 - DNA, 14 bp, Homo sapiens
ccttactgtctcac

SEQ ID NO: 6112614 - DNA, 16 bp, Homo sapiens
ccttactgtctctctt

SEQ ID NO: 6112615 - DNA, 18 bp, Homo sapiens
ccttactgtttacagttt

SEQ ID NO: 6112616 - DNA, 18 bp, Homo sapiens
ccttacttcaaagtgcct

SEQ ID NO: 6112617 - DNA, 21 bp, Homo sapiens
ccttacttcaaagtgcctggg

SEQ ID NO: 6112618 - DNA, 23 bp, Homo sapiens
ccttacttcaaagtgcctgggct

SEQ ID NO: 6112619 - DNA, 18 bp, Homo sapiens
ccttacttccagcaaaat

SEQ ID NO: 6112620 - DNA, 22 bp, Homo sapiens
ccttacttcctggcctcttctg

SEQ ID NO: 6112621 - DNA, 13 bp, Homo sapiens
ccttacttcttgc

SEQ ID NO: 6112622 - DNA, 16 bp, Homo sapiens
ccttacttcttgccct

SEQ ID NO: 6112623 - DNA, 17 bp, Homo sapiens
ccttacttgcactgtta

SEQ ID NO: 6112624 - DNA, 22 bp, Homo sapiens
ccttactttactgcctgaataa

SEQ ID NO: 6112625 - DNA, 18 bp, Homo sapiens
ccttagaaatgtaaactg

SEQ ID NO: 6112626 - DNA, 19 bp, Homo sapiens
ccttagaaatgtaaactgc

SEQ ID NO: 6112627 - DNA, 22 bp, Homo sapiens
ccttagaaatgtaaactgccat

SEQ ID NO: 6112628 - DNA, 17 bp, Homo sapiens
ccttagaagagagccag

SEQ ID NO: 6112629 - DNA, 18 bp, Homo sapiens
ccttagaagtcacacagt

SEQ ID NO: 6112630 - DNA, 14 bp, Homo sapiens
ccttagaagtggaa

SEQ ID NO: 6112631 - DNA, 16 bp, Homo sapiens
ccttagaatgagggaa

SEQ ID NO: 6112632 - DNA, 20 bp, Homo sapiens
ccttagacagaggccctcaa

SEQ ID NO: 6112633 - DNA, 14 bp, Homo sapiens
ccttagacagtccc

SEQ ID NO: 6112634 - DNA, 18 bp, Homo sapiens
ccttagacagtccctgcc

SEQ ID NO: 6112635 - DNA, 14 bp, Homo sapiens
ccttagacctgagg

SEQ ID NO: 6112636 - DNA, 15 bp, Homo sapiens
ccttagagccaggca

SEQ ID NO: 6112637 - DNA, 19 bp, Homo sapiens
ccttagaggtcctctggag

SEQ ID NO: 6112638 - DNA, 18 bp, Homo sapiens
ccttagagtgctgtgaga

SEQ ID NO: 6112639 - DNA, 14 bp, Homo sapiens
ccttagatctggca

SEQ ID NO: 6112640 - DNA, 16 bp, Homo sapiens
ccttagattagctctg

SEQ ID NO: 6112641 - DNA, 16 bp, Homo sapiens
ccttagcaaattctgt

SEQ ID NO: 6112642 - DNA, 21 bp, Homo sapiens
ccttagcaatgggggcctccg

SEQ ID NO: 6112643 - DNA, 22 bp, Homo sapiens
ccttagcacaggggggccgccg

SEQ ID NO: 6112644 - DNA, 22 bp, Homo sapiens
ccttagcaccttcagggctgag

SEQ ID NO: 6112645 - DNA, 14 bp, Homo sapiens
ccttagcacttctt

SEQ ID NO: 6112646 - DNA, 12 bp, Homo sapiens
ccttagcagccc

SEQ ID NO: 6112647 - DNA, 16 bp, Homo sapiens
ccttagcagcccagca

SEQ ID NO: 6112648 - DNA, 19 bp, Homo sapiens
ccttagcagccctggatgg

SEQ ID NO: 6112649 - DNA, 13 bp, Homo sapiens
ccttagcagctca

SEQ ID NO: 6112650 - DNA, 23 bp, Homo sapiens
ccttagcagctcaggcgcagccc

SEQ ID NO: 6112651 - DNA, 19 bp, Homo sapiens
ccttagcagggaaggctgg

SEQ ID NO: 6112652 - DNA, 18 bp, Homo sapiens
ccttagcatgtgttgcag

SEQ ID NO: 6112653 - DNA, 21 bp, Homo sapiens
ccttagcatgtgttgcagctg

SEQ ID NO: 6112654 - DNA, 10 bp, Homo sapiens
ccttagccag

SEQ ID NO: 6112655 - DNA, 23 bp, Homo sapiens
ccttagcccggatgcccacccct

SEQ ID NO: 6112656 - DNA, 15 bp, Homo sapiens
ccttagccctgtctg

SEQ ID NO: 6112657 - DNA, 16 bp, Homo sapiens
ccttagcctccctgaa

SEQ ID NO: 6112658 - DNA, 17 bp, Homo sapiens
ccttagcctctcccacc

SEQ ID NO: 6112659 - DNA, 18 bp, Homo sapiens
ccttagcctcttggaaat

SEQ ID NO: 6112660 - DNA, 12 bp, Homo sapiens
ccttagcctggg

SEQ ID NO: 6112661 - DNA, 14 bp, Homo sapiens
ccttagcctgggcc

SEQ ID NO: 6112662 - DNA, 21 bp, Homo sapiens
ccttagcctgggcctcctcct

SEQ ID NO: 6112663 - DNA, 15 bp, Homo sapiens
ccttagccttgctgt

SEQ ID NO: 6112664 - DNA, 22 bp, Homo sapiens
ccttagctacaatcctaccttt

SEQ ID NO: 6112665 - DNA, 22 bp, Homo sapiens
ccttagctattcccagggaacc

SEQ ID NO: 6112666 - DNA, 11 bp, Homo sapiens
ccttagctgcc

SEQ ID NO: 6112667 - DNA, 21 bp, Homo sapiens
ccttagcttcactcagctgga

SEQ ID NO: 6112668 - DNA, 19 bp, Homo sapiens
ccttagcttcaggaacctc

SEQ ID NO: 6112669 - DNA, 14 bp, Homo sapiens
ccttagctttccct

SEQ ID NO: 6112670 - DNA, 19 bp, Homo sapiens
ccttagcttttagcctggc

SEQ ID NO: 6112671 - DNA, 15 bp, Homo sapiens
ccttaggaagagcct

SEQ ID NO: 6112672 - DNA, 17 bp, Homo sapiens
ccttaggaagtgacttg

SEQ ID NO: 6112673 - DNA, 16 bp, Homo sapiens
ccttaggaatactgtt

SEQ ID NO: 6112674 - DNA, 20 bp, Homo sapiens
ccttaggaatactgttttat

SEQ ID NO: 6112675 - DNA, 15 bp, Homo sapiens
ccttaggatggggct

SEQ ID NO: 6112676 - DNA, 18 bp, Homo sapiens
ccttaggatggggctccc

SEQ ID NO: 6112677 - DNA, 19 bp, Homo sapiens
ccttaggcattatttaatg

SEQ ID NO: 6112678 - DNA, 12 bp, Homo sapiens
ccttaggccccg

SEQ ID NO: 6112679 - DNA, 20 bp, Homo sapiens
ccttaggccccgtggtgaca

SEQ ID NO: 6112680 - DNA, 13 bp, Homo sapiens
ccttaggccttcc

SEQ ID NO: 6112681 - DNA, 15 bp, Homo sapiens
ccttaggccttcctc

SEQ ID NO: 6112682 - DNA, 18 bp, Homo sapiens
ccttaggctgctgggaga

SEQ ID NO: 6112683 - DNA, 20 bp, Homo sapiens
ccttagggaagctggcctga

SEQ ID NO: 6112684 - DNA, 14 bp, Homo sapiens
ccttagggaagttg

SEQ ID NO: 6112685 - DNA, 16 bp, Homo sapiens
ccttaggtttgacatg

SEQ ID NO: 6112686 - DNA, 17 bp, Homo sapiens
ccttaggttttctttgg

SEQ ID NO: 6112687 - DNA, 20 bp, Homo sapiens
ccttagtacatgctctgtcc

SEQ ID NO: 6112688 - DNA, 17 bp, Homo sapiens
ccttagtacctttttaa

SEQ ID NO: 6112689 - DNA, 17 bp, Homo sapiens
ccttagtacggctgctg

SEQ ID NO: 6112690 - DNA, 19 bp, Homo sapiens
ccttagtacggctgctgca

SEQ ID NO: 6112691 - DNA, 14 bp, Homo sapiens
ccttagtcacaaag

SEQ ID NO: 6112692 - DNA, 22 bp, Homo sapiens
ccttagtcccccaactctgagc

SEQ ID NO: 6112693 - DNA, 14 bp, Homo sapiens
ccttagtctcagtt

SEQ ID NO: 6112694 - DNA, 16 bp, Homo sapiens
ccttagtggctttttt

SEQ ID NO: 6112695 - DNA, 15 bp, Homo sapiens
ccttagtgggccagg

SEQ ID NO: 6112696 - DNA, 16 bp, Homo sapiens
ccttagtgtttctgtg

SEQ ID NO: 6112697 - DNA, 19 bp, Homo sapiens
ccttagtgtttctgtgcat

SEQ ID NO: 6112698 - DNA, 15 bp, Homo sapiens
ccttagttggctgga

SEQ ID NO: 6112699 - DNA, 14 bp, Homo sapiens
ccttagttgttatc

SEQ ID NO: 6112700 - DNA, 15 bp, Homo sapiens
ccttagtttcagctg

SEQ ID NO: 6112701 - DNA, 21 bp, Homo sapiens
ccttagtttgaaacagattct

SEQ ID NO: 6112702 - DNA, 16 bp, Homo sapiens
ccttataaaccaatct

SEQ ID NO: 6112703 - DNA, 14 bp, Homo sapiens
ccttataagcccag

SEQ ID NO: 6112704 - DNA, 15 bp, Homo sapiens
ccttataagcccagc

SEQ ID NO: 6112705 - DNA, 13 bp, Homo sapiens
ccttatactgtat

SEQ ID NO: 6112706 - DNA, 18 bp, Homo sapiens
ccttatagggaaaaatgc

SEQ ID NO: 6112707 - DNA, 17 bp, Homo sapiens
ccttatagtctaagact

SEQ ID NO: 6112708 - DNA, 18 bp, Homo sapiens
ccttatcaaaggacacca

SEQ ID NO: 6112709 - DNA, 15 bp, Homo sapiens
ccttatcaaataata

SEQ ID NO: 6112710 - DNA, 13 bp, Homo sapiens
ccttatcaaggat

SEQ ID NO: 6112711 - DNA, 14 bp, Homo sapiens
ccttatcaagtgtc

SEQ ID NO: 6112712 - DNA, 15 bp, Homo sapiens
ccttatcaagtgtct

SEQ ID NO: 6112713 - DNA, 16 bp, Homo sapiens
ccttatcaagtgtctt

SEQ ID NO: 6112714 - DNA, 13 bp, Homo sapiens
ccttatcaccagc

SEQ ID NO: 6112715 - DNA, 21 bp, Homo sapiens
ccttatcacccccttgttgta

SEQ ID NO: 6112716 - DNA, 13 bp, Homo sapiens
ccttatcagagct

SEQ ID NO: 6112717 - DNA, 14 bp, Homo sapiens
ccttatcagaggcc

SEQ ID NO: 6112718 - DNA, 16 bp, Homo sapiens
ccttatcagcttcctg

SEQ ID NO: 6112719 - DNA, 16 bp, Homo sapiens
ccttatcataaattca

SEQ ID NO: 6112720 - DNA, 15 bp, Homo sapiens
ccttatcattcattc

SEQ ID NO: 6112721 - DNA, 13 bp, Homo sapiens
ccttatccaaaat

SEQ ID NO: 6112722 - DNA, 15 bp, Homo sapiens
ccttatccaggactc

SEQ ID NO: 6112723 - DNA, 14 bp, Homo sapiens
ccttatccccactt

SEQ ID NO: 6112724 - DNA, 13 bp, Homo sapiens
ccttatccctctc

SEQ ID NO: 6112725 - DNA, 17 bp, Homo sapiens
ccttatccctctcttcc

SEQ ID NO: 6112726 - DNA, 16 bp, Homo sapiens
ccttatcctagccttt

SEQ ID NO: 6112727 - DNA, 13 bp, Homo sapiens
ccttatcctccct

SEQ ID NO: 6112728 - DNA, 16 bp, Homo sapiens
ccttatcctccctgta

SEQ ID NO: 6112729 - DNA, 19 bp, Homo sapiens
ccttatcctccctgtaact

SEQ ID NO: 6112730 - DNA, 15 bp, Homo sapiens
ccttatcctctgatc

SEQ ID NO: 6112731 - DNA, 15 bp, Homo sapiens
ccttatctagctgca

SEQ ID NO: 6112732 - DNA, 19 bp, Homo sapiens
ccttatctagtgtttgatt

SEQ ID NO: 6112733 - DNA, 16 bp, Homo sapiens
ccttatctataaaagg

SEQ ID NO: 6112734 - DNA, 19 bp, Homo sapiens
ccttatctgaaaggccagc

SEQ ID NO: 6112735 - DNA, 15 bp, Homo sapiens
ccttatctgtgctca

SEQ ID NO: 6112736 - DNA, 14 bp, Homo sapiens
ccttatcttttact

SEQ ID NO: 6112737 - DNA, 18 bp, Homo sapiens
ccttatgagcgtcactgc

SEQ ID NO: 6112738 - DNA, 22 bp, Homo sapiens
ccttatgagctcagcctcgctt

SEQ ID NO: 6112739 - DNA, 19 bp, Homo sapiens
ccttatgcatgaaatgaat

SEQ ID NO: 6112740 - DNA, 22 bp, Homo sapiens
ccttatgcccggcgccgggcac

SEQ ID NO: 6112741 - DNA, 16 bp, Homo sapiens
ccttatggaacactct

SEQ ID NO: 6112742 - DNA, 17 bp, Homo sapiens
ccttatggaacactctg

SEQ ID NO: 6112743 - DNA, 20 bp, Homo sapiens
ccttatggaacactctgaga

SEQ ID NO: 6112744 - DNA, 22 bp, Homo sapiens
ccttatggaacactctgagact

SEQ ID NO: 6112745 - DNA, 17 bp, Homo sapiens
ccttatgggatcatttt

SEQ ID NO: 6112746 - DNA, 19 bp, Homo sapiens
ctagcagcccaccctgctg

SEQ ID NO: 6112747 - DNA, 13 bp, Homo sapiens
ctagcagccctaa

SEQ ID NO: 6112748 - DNA, 20 bp, Homo sapiens
ctagcagcccttgtgtgtgc

SEQ ID NO: 6112749 - DNA, 13 bp, Homo sapiens
ctagcagctgcag

SEQ ID NO: 6112750 - DNA, 15 bp, Homo sapiens
ctagcaggcacagga

SEQ ID NO: 6112751 - DNA, 18 bp, Homo sapiens
ctagcaggcacaggacac

SEQ ID NO: 6112752 - DNA, 23 bp, Homo sapiens
ctagcaggcacaggacacctggc

SEQ ID NO: 6112753 - DNA, 12 bp, Homo sapiens
ctagcaggcagg

SEQ ID NO: 6112754 - DNA, 15 bp, Homo sapiens
ctagcaggcaggaag

SEQ ID NO: 6112755 - DNA, 15 bp, Homo sapiens
ctagcaggcatgccg

SEQ ID NO: 6112756 - DNA, 19 bp, Homo sapiens
ctagcaggctgttccatgt

SEQ ID NO: 6112757 - DNA, 17 bp, Homo sapiens
ctagcagggaacactaa

SEQ ID NO: 6112758 - DNA, 21 bp, Homo sapiens
ctagcagggaaggtgaagatg

SEQ ID NO: 6112759 - DNA, 17 bp, Homo sapiens
ctagcagtaaaagatga

SEQ ID NO: 6112760 - DNA, 21 bp, Homo sapiens
ctagcagtatgtgtgctctta

SEQ ID NO: 6112761 - DNA, 15 bp, Homo sapiens
ctagcagtgagtact

SEQ ID NO: 6112762 - DNA, 13 bp, Homo sapiens
ctagcagtggcag

SEQ ID NO: 6112763 - DNA, 15 bp, Homo sapiens
ctagcagtggcaggc

SEQ ID NO: 6112764 - DNA, 18 bp, Homo sapiens
ctagcagtggcaggcaga

SEQ ID NO: 6112765 - DNA, 21 bp, Homo sapiens
ctagcagtggcaggcagaggc

SEQ ID NO: 6112766 - DNA, 17 bp, Homo sapiens
ctagcagtttgcctctg

SEQ ID NO: 6112767 - DNA, 19 bp, Homo sapiens
ctagcagtttgcctctgca

SEQ ID NO: 6112768 - DNA, 20 bp, Homo sapiens
ctagcagtttgcctctgcac

SEQ ID NO: 6112769 - DNA, 19 bp, Homo sapiens
ctagcatacgtacacattt

SEQ ID NO: 6112770 - DNA, 23 bp, Homo sapiens
ctagcatacgtacacattttatt

SEQ ID NO: 6112771 - DNA, 14 bp, Homo sapiens
ctagcatagtaaac

SEQ ID NO: 6112772 - DNA, 15 bp, Homo sapiens
ctagcatatatgtgt

SEQ ID NO: 6112773 - DNA, 14 bp, Homo sapiens
ctagcatatctgcc

SEQ ID NO: 6112774 - DNA, 13 bp, Homo sapiens
ctagcatccctga

SEQ ID NO: 6112775 - DNA, 16 bp, Homo sapiens
ctagcatgaagacaga

SEQ ID NO: 6112776 - DNA, 21 bp, Homo sapiens
ctagcatgccaacaagaatgc

SEQ ID NO: 6112777 - DNA, 18 bp, Homo sapiens
ctagcatggcccgggcct

SEQ ID NO: 6112778 - DNA, 19 bp, Homo sapiens
ctagcatggcccgggcctt

SEQ ID NO: 6112779 - DNA, 17 bp, Homo sapiens
ctagcatggctgccaat

SEQ ID NO: 6112780 - DNA, 18 bp, Homo sapiens
ctagcatggggtcagccc

SEQ ID NO: 6112781 - DNA, 17 bp, Homo sapiens
ctagcatgggtattttt

SEQ ID NO: 6112782 - DNA, 22 bp, Homo sapiens
ctagcattgtaaaattatttca

SEQ ID NO: 6112783 - DNA, 18 bp, Homo sapiens
ctagcatttatttctctg

SEQ ID NO: 6112784 - DNA, 19 bp, Homo sapiens
ctagcatttcccaacacaa

SEQ ID NO: 6112785 - DNA, 15 bp, Homo sapiens
ctagcattttcttga

SEQ ID NO: 6112786 - DNA, 18 bp, Homo sapiens
ctagcattttcttgaacc

SEQ ID NO: 6112787 - DNA, 23 bp, Homo sapiens
ctagccaaatggtttaacttctg

SEQ ID NO: 6112788 - DNA, 14 bp, Homo sapiens
ctagccaaggctag

SEQ ID NO: 6112789 - DNA, 16 bp, Homo sapiens
ctagccaccagtgtcc

SEQ ID NO: 6112790 - DNA, 15 bp, Homo sapiens
ctagccactccctcc

SEQ ID NO: 6112791 - DNA, 15 bp, Homo sapiens
ctagccagacactct

SEQ ID NO: 6112792 - DNA, 22 bp, Homo sapiens
ctagccagacactctgctctgc

SEQ ID NO: 6112793 - DNA, 13 bp, Homo sapiens
ctagccagagaat

SEQ ID NO: 6112794 - DNA, 20 bp, Homo sapiens
ctagccagagaatagatcag

SEQ ID NO: 6112795 - DNA, 12 bp, Homo sapiens
ctagccagagga

SEQ ID NO: 6112796 - DNA, 15 bp, Homo sapiens
ctagccagaggagag

SEQ ID NO: 6112797 - DNA, 14 bp, Homo sapiens
ctagccagaggctg

SEQ ID NO: 6112798 - DNA, 16 bp, Homo sapiens
ctagccagaggctgga

SEQ ID NO: 6112799 - DNA, 19 bp, Homo sapiens
ctagccagcacaaaaggca

SEQ ID NO: 6112800 - DNA, 20 bp, Homo sapiens
ctagccagcacttgtatata

SEQ ID NO: 6112801 - DNA, 22 bp, Homo sapiens
ctagccaggaagtacttccacc

SEQ ID NO: 6112802 - DNA, 13 bp, Homo sapiens
ctagccaggagtc

SEQ ID NO: 6112803 - DNA, 17 bp, Homo sapiens
ctagccaggagtctgtg

SEQ ID NO: 6112804 - DNA, 19 bp, Homo sapiens
ctagccaggagtctgtgct

SEQ ID NO: 6112805 - DNA, 23 bp, Homo sapiens
ctagccaggcctcccgcatgctg

SEQ ID NO: 6112806 - DNA, 18 bp, Homo sapiens
ctagccaggtctcctggg

SEQ ID NO: 6112807 - DNA, 21 bp, Homo sapiens
ctagccaggtctcctgggaaa

SEQ ID NO: 6112808 - DNA, 21 bp, Homo sapiens
ctagccagtcactaggaattt

SEQ ID NO: 6112809 - DNA, 13 bp, Homo sapiens
ctagccataataa

SEQ ID NO: 6112810 - DNA, 13 bp, Homo sapiens
ctagccatatatt

SEQ ID NO: 6112811 - DNA, 21 bp, Homo sapiens
ctagccatcccttggggaagg

SEQ ID NO: 6112812 - DNA, 21 bp, Homo sapiens
ctagccatctcaagcaagttt

SEQ ID NO: 6112813 - DNA, 12 bp, Homo sapiens
ctagcccaacct

SEQ ID NO: 6112814 - DNA, 18 bp, Homo sapiens
ctagcccaatgaaatgaa

SEQ ID NO: 6112815 - DNA, 18 bp, Homo sapiens
ctagcccaccctgctgcc

SEQ ID NO: 6112816 - DNA, 21 bp, Homo sapiens
ctagcccaccctgctgccttc

SEQ ID NO: 6112817 - DNA, 17 bp, Homo sapiens
ctagcccactccctgcc

SEQ ID NO: 6112818 - DNA, 13 bp, Homo sapiens
ctagcccagactc

SEQ ID NO: 6112819 - DNA, 15 bp, Homo sapiens
ctagcccagactctg

SEQ ID NO: 6112820 - DNA, 16 bp, Homo sapiens
ctagcccagactctga

SEQ ID NO: 6112821 - DNA, 15 bp, Homo sapiens
ctagcccagcagaga

SEQ ID NO: 6112822 - DNA, 16 bp, Homo sapiens
ctagcccaggagagag

SEQ ID NO: 6112823 - DNA, 20 bp, Homo sapiens
ctagcccaggagagagaaag

SEQ ID NO: 6112824 - DNA, 22 bp, Homo sapiens
ctagcccagtccctggagctgt

SEQ ID NO: 6112825 - DNA, 15 bp, Homo sapiens
ctagcccagtgcttc

SEQ ID NO: 6112826 - DNA, 20 bp, Homo sapiens
ctagccccaaaccagcccag

SEQ ID NO: 6112827 - DNA, 18 bp, Homo sapiens
ctagccccacccagaggt

SEQ ID NO: 6112828 - DNA, 21 bp, Homo sapiens
ctagccccacccagaggtggc

SEQ ID NO: 6112829 - DNA, 14 bp, Homo sapiens
ctagccccagcgcc

SEQ ID NO: 6112830 - DNA, 20 bp, Homo sapiens
ctagccccaggtcttttctt

SEQ ID NO: 6112831 - DNA, 18 bp, Homo sapiens
ctagccccgagacaccat

SEQ ID NO: 6112832 - DNA, 14 bp, Homo sapiens
ctagcccctgtgga

SEQ ID NO: 6112833 - DNA, 20 bp, Homo sapiens
ctagcccctgtggagactgg

SEQ ID NO: 6112834 - DNA, 21 bp, Homo sapiens
ctagcccctgtggagactggg

SEQ ID NO: 6112835 - DNA, 20 bp, Homo sapiens
ctagccctccccccagctcc

SEQ ID NO: 6112836 - DNA, 21 bp, Homo sapiens
ctagccctccccccagctccc

SEQ ID NO: 6112837 - DNA, 14 bp, Homo sapiens
ctagccctcctgag

SEQ ID NO: 6112838 - DNA, 15 bp, Homo sapiens
ctagccctctccctc

SEQ ID NO: 6112839 - DNA, 21 bp, Homo sapiens
ctagccctctccctctaggct

SEQ ID NO: 6112840 - DNA, 19 bp, Homo sapiens
ctagccctctttctctctg

SEQ ID NO: 6112841 - DNA, 10 bp, Homo sapiens
ctagccctga

SEQ ID NO: 6112842 - DNA, 16 bp, Homo sapiens
ctagccctgctccaac

SEQ ID NO: 6112843 - DNA, 22 bp, Homo sapiens
ctagccctggggtggcgtctgc

SEQ ID NO: 6112844 - DNA, 13 bp, Homo sapiens
ctagccctggtta

SEQ ID NO: 6112845 - DNA, 20 bp, Homo sapiens
ctagccctggttagctgaca

SEQ ID NO: 6112846 - DNA, 14 bp, Homo sapiens
ctagcccttccagc

SEQ ID NO: 6112847 - DNA, 19 bp, Homo sapiens
ctagcccttccctgagtgc

SEQ ID NO: 6112848 - DNA, 18 bp, Homo sapiens
ctagcccttctaccccac

SEQ ID NO: 6112849 - DNA, 12 bp, Homo sapiens
ctagcccttgtc

SEQ ID NO: 6112850 - DNA, 12 bp, Homo sapiens
ctagccgctgcc

SEQ ID NO: 6112851 - DNA, 15 bp, Homo sapiens
ctagccgctgccctg

SEQ ID NO: 6112852 - DNA, 21 bp, Homo sapiens
ctagccgctgccctgggtcct

SEQ ID NO: 6112853 - DNA, 18 bp, Homo sapiens
ctagccggaaggccgagg

SEQ ID NO: 6112854 - DNA, 18 bp, Homo sapiens
ctagccggccactttgga

SEQ ID NO: 6112855 - DNA, 16 bp, Homo sapiens
ctagccgggccatgct

SEQ ID NO: 6112856 - DNA, 22 bp, Homo sapiens
ctagcctagaacaagccagagc

SEQ ID NO: 6112857 - DNA, 20 bp, Homo sapiens
ctagcctaggtcataaagag

SEQ ID NO: 6112858 - DNA, 22 bp, Homo sapiens
ctagcctcacgctcctttctga

SEQ ID NO: 6112859 - DNA, 16 bp, Homo sapiens
ctagcctcattttgtt

SEQ ID NO: 6112860 - DNA, 13 bp, Homo sapiens
ctagcctctccag

SEQ ID NO: 6112861 - DNA, 12 bp, Homo sapiens
ctagcctctccg

SEQ ID NO: 6112862 - DNA, 17 bp, Homo sapiens
ctagcctctgagatgct

SEQ ID NO: 6112863 - DNA, 13 bp, Homo sapiens
ctagcctctggac

SEQ ID NO: 6112864 - DNA, 15 bp, Homo sapiens
ctagcctctggactg

SEQ ID NO: 6112865 - DNA, 21 bp, Homo sapiens
ctagcctctggactggaaagc

SEQ ID NO: 6112866 - DNA, 15 bp, Homo sapiens
ctagcctctttctcc

SEQ ID NO: 6112867 - DNA, 19 bp, Homo sapiens
ctagcctgcactttgatgt

SEQ ID NO: 6112868 - DNA, 13 bp, Homo sapiens
ctagcctgctctg

SEQ ID NO: 6112869 - DNA, 14 bp, Homo sapiens
ctagcctgctctgc

SEQ ID NO: 6112870 - DNA, 17 bp, Homo sapiens
ctagcctgctctgccac

SEQ ID NO: 6112871 - DNA, 18 bp, Homo sapiens
ctagcctgctctgccact

SEQ ID NO: 6112872 - DNA, 18 bp, Homo sapiens
ctagcctggatggcccct

SEQ ID NO: 6112873 - DNA, 19 bp, Homo sapiens
ctagcctggcaacagagca

SEQ ID NO: 6112874 - DNA, 15 bp, Homo sapiens
ctagcctgggccaga

SEQ ID NO: 6112875 - DNA, 21 bp, Homo sapiens
ctagcctgtgattaacttgct

SEQ ID NO: 6112876 - DNA, 19 bp, Homo sapiens
ctagcctgtgcctctggga

SEQ ID NO: 6112877 - DNA, 21 bp, Homo sapiens
ctagcctgtgcctctgggact

SEQ ID NO: 6112878 - DNA, 22 bp, Homo sapiens
ctagccttagaagtcacacagt

SEQ ID NO: 6112879 - DNA, 22 bp, Homo sapiens
ctagccttagacaaatgatcac

SEQ ID NO: 6112880 - DNA, 18 bp, Homo sapiens
ctagccttatcctctgat

SEQ ID NO: 6112881 - DNA, 15 bp, Homo sapiens
ctagccttcccagct

SEQ ID NO: 6112882 - DNA, 13 bp, Homo sapiens
ctagccttgcttg

SEQ ID NO: 6112883 - DNA, 15 bp, Homo sapiens
ctagcctttggctct

SEQ ID NO: 6112884 - DNA, 16 bp, Homo sapiens
ctagcctttggctctg

SEQ ID NO: 6112885 - DNA, 17 bp, Homo sapiens
ctagcctttggctctgg

SEQ ID NO: 6112886 - DNA, 18 bp, Homo sapiens
ctagcctttggctctgga

SEQ ID NO: 6112887 - DNA, 21 bp, Homo sapiens
ctagcctttggctctggagac

SEQ ID NO: 6112888 - DNA, 16 bp, Homo sapiens
ctagcctttgggcaca

SEQ ID NO: 6112889 - DNA, 18 bp, Homo sapiens
ctagcgatctctcctggc

SEQ ID NO: 6112890 - DNA, 22 bp, Homo sapiens
ctagcgcagttttttttttctt

SEQ ID NO: 6112891 - DNA, 17 bp, Homo sapiens
ctagcgctatctccctg

SEQ ID NO: 6112892 - DNA, 20 bp, Homo sapiens
ctagcgctatctccctgcct

SEQ ID NO: 6112893 - DNA, 16 bp, Homo sapiens
ctagcgctctcttcca

SEQ ID NO: 6112894 - DNA, 22 bp, Homo sapiens
ctagcgctgccgcaccccagag

SEQ ID NO: 6112895 - DNA, 14 bp, Homo sapiens
ctagcggagcccag

SEQ ID NO: 6112896 - DNA, 15 bp, Homo sapiens
ctagcggagcccagc

SEQ ID NO: 6112897 - DNA, 17 bp, Homo sapiens
ctagcggagcccagcct

SEQ ID NO: 6112898 - DNA, 14 bp, Homo sapiens
ctagcggctgctcc

SEQ ID NO: 6112899 - DNA, 16 bp, Homo sapiens
ctagcgggatggggct

SEQ ID NO: 6112900 - DNA, 15 bp, Homo sapiens
ctagctaaaccagaa

SEQ ID NO: 6112901 - DNA, 15 bp, Homo sapiens
ctagctaaataaatg

SEQ ID NO: 6112902 - DNA, 15 bp, Homo sapiens
ctagctaagcaagcc

SEQ ID NO: 6112903 - DNA, 18 bp, Homo sapiens
ctagctaagcaagccagg

SEQ ID NO: 6112904 - DNA, 19 bp, Homo sapiens
ctagctaagcaagccagga

SEQ ID NO: 6112905 - DNA, 15 bp, Homo sapiens
ctagctaattattta

SEQ ID NO: 6112906 - DNA, 19 bp, Homo sapiens
ctagctacaaaaaatattt

SEQ ID NO: 6112907 - DNA, 20 bp, Homo sapiens
ctagctaccttctctaccca

SEQ ID NO: 6112908 - DNA, 16 bp, Homo sapiens
ctagctagaaatatga

SEQ ID NO: 6112909 - DNA, 23 bp, Homo sapiens
ctagctagaagtgggccaggaca

SEQ ID NO: 6112910 - DNA, 13 bp, Homo sapiens
ctagctagagaag

SEQ ID NO: 6112911 - DNA, 15 bp, Homo sapiens
ctagctagccagcca

SEQ ID NO: 6112912 - DNA, 17 bp, Homo sapiens
ctagctagccagccaag

SEQ ID NO: 6112913 - DNA, 14 bp, Homo sapiens
ctagctaggagcag

SEQ ID NO: 6112914 - DNA, 18 bp, Homo sapiens
ctagctaggagcaggctt

SEQ ID NO: 6112915 - DNA, 19 bp, Homo sapiens
ctagctaggagcaggcttg

SEQ ID NO: 6112916 - DNA, 17 bp, Homo sapiens
ctagctataacaactct

SEQ ID NO: 6112917 - DNA, 21 bp, Homo sapiens
ctagctataacaactctattt

SEQ ID NO: 6112918 - DNA, 14 bp, Homo sapiens
ctagctatatatgg

SEQ ID NO: 6112919 - DNA, 16 bp, Homo sapiens
ctagctatcaagaggc

SEQ ID NO: 6112920 - DNA, 18 bp, Homo sapiens
ctagctatgctgtatctg

SEQ ID NO: 6112921 - DNA, 21 bp, Homo sapiens
ctagctatttctatgtatgtg

SEQ ID NO: 6112922 - DNA, 14 bp, Homo sapiens
ctagctcacactca

SEQ ID NO: 6112923 - DNA, 20 bp, Homo sapiens
ctagctcaccaggcctggcc

SEQ ID NO: 6112924 - DNA, 23 bp, Homo sapiens
ctagctcaccaggcctggcctct

SEQ ID NO: 6112925 - DNA, 21 bp, Homo sapiens
ccttatgggatcatttttcca

SEQ ID NO: 6112926 - DNA, 19 bp, Homo sapiens
ccttatgggctgaagtgtt

SEQ ID NO: 6112927 - DNA, 16 bp, Homo sapiens
ccttatgtaattattt

SEQ ID NO: 6112928 - DNA, 16 bp, Homo sapiens
ccttatgtccaccact

SEQ ID NO: 6112929 - DNA, 13 bp, Homo sapiens
ccttatgtggggt

SEQ ID NO: 6112930 - DNA, 17 bp, Homo sapiens
ccttatgtgttacatta

SEQ ID NO: 6112931 - DNA, 18 bp, Homo sapiens
ccttatgtgttacattat

SEQ ID NO: 6112932 - DNA, 19 bp, Homo sapiens
ccttatgtgttacattatt

SEQ ID NO: 6112933 - DNA, 13 bp, Homo sapiens
ccttattaaaata

SEQ ID NO: 6112934 - DNA, 22 bp, Homo sapiens
ccttattacacggaaaacggtg

SEQ ID NO: 6112935 - DNA, 14 bp, Homo sapiens
ccttattactgctt

SEQ ID NO: 6112936 - DNA, 18 bp, Homo sapiens
ccttattcacctttttaa

SEQ ID NO: 6112937 - DNA, 14 bp, Homo sapiens
ccttattgcctccc

SEQ ID NO: 6112938 - DNA, 15 bp, Homo sapiens
ccttattgtacctct

SEQ ID NO: 6112939 - DNA, 15 bp, Homo sapiens
ccttatttaaaagat

SEQ ID NO: 6112940 - DNA, 14 bp, Homo sapiens
ccttatttccctat

SEQ ID NO: 6112941 - DNA, 18 bp, Homo sapiens
ccttatttctctctcctg

SEQ ID NO: 6112942 - DNA, 14 bp, Homo sapiens
ccttattttcaaga

SEQ ID NO: 6112943 - DNA, 14 bp, Homo sapiens
ccttattttgagta

SEQ ID NO: 6112944 - DNA, 20 bp, Homo sapiens
ccttattttgagtaaatatt

SEQ ID NO: 6112945 - DNA, 21 bp, Homo sapiens
ccttatttttacttgtatgta

SEQ ID NO: 6112946 - DNA, 22 bp, Homo sapiens
ccttatttttagccataatttt

SEQ ID NO: 6112947 - DNA, 16 bp, Homo sapiens
ccttatttttgaattc

SEQ ID NO: 6112948 - DNA, 15 bp, Homo sapiens
ccttattttttccca

SEQ ID NO: 6112949 - DNA, 18 bp, Homo sapiens
ccttcaaaatgctgcttc

SEQ ID NO: 6112950 - DNA, 13 bp, Homo sapiens
ccttcaaacctaa

SEQ ID NO: 6112951 - DNA, 17 bp, Homo sapiens
ccttcaaagaagggcca

SEQ ID NO: 6112952 - DNA, 22 bp, Homo sapiens
ccttcaaagtctcaatgaaata

SEQ ID NO: 6112953 - DNA, 15 bp, Homo sapiens
ccttcaaatagtata

SEQ ID NO: 6112954 - DNA, 17 bp, Homo sapiens
ccttcaaatcctgccac

SEQ ID NO: 6112955 - DNA, 21 bp, Homo sapiens
ccttcaacacagcttgtctct

SEQ ID NO: 6112956 - DNA, 22 bp, Homo sapiens
ccttcaaccccacttcctactg

SEQ ID NO: 6112957 - DNA, 13 bp, Homo sapiens
ccttcaactcctg

SEQ ID NO: 6112958 - DNA, 14 bp, Homo sapiens
ccttcaactcctgg

SEQ ID NO: 6112959 - DNA, 13 bp, Homo sapiens
ccttcaactctgt

SEQ ID NO: 6112960 - DNA, 14 bp, Homo sapiens
ccttcaactctgtg

SEQ ID NO: 6112961 - DNA, 17 bp, Homo sapiens
ccttcaacttcagaagg

SEQ ID NO: 6112962 - DNA, 13 bp, Homo sapiens
ccttcaagacctt

SEQ ID NO: 6112963 - DNA, 22 bp, Homo sapiens
ccttcaagaccttcaccaaaca

SEQ ID NO: 6112964 - DNA, 18 bp, Homo sapiens
ccttcaagacgaggggca

SEQ ID NO: 6112965 - DNA, 23 bp, Homo sapiens
ccttcaagatcatgtaccccaat

SEQ ID NO: 6112966 - DNA, 23 bp, Homo sapiens
ccttcaagcaccctgttccctct

SEQ ID NO: 6112967 - DNA, 23 bp, Homo sapiens
ccttcaagccagcaacacagagc

SEQ ID NO: 6112968 - DNA, 16 bp, Homo sapiens
ccttcaagcgctccag

SEQ ID NO: 6112969 - DNA, 18 bp, Homo sapiens
ccttcaagcgctccaggg

SEQ ID NO: 6112970 - DNA, 13 bp, Homo sapiens
ccttcaagctctg

SEQ ID NO: 6112971 - DNA, 14 bp, Homo sapiens
ccttcaaggcctcc

SEQ ID NO: 6112972 - DNA, 20 bp, Homo sapiens
ccttcaaggctcttcttcct

SEQ ID NO: 6112973 - DNA, 13 bp, Homo sapiens
ccttcaagtgcca

SEQ ID NO: 6112974 - DNA, 16 bp, Homo sapiens
ccttcaagtgccaaac

SEQ ID NO: 6112975 - DNA, 17 bp, Homo sapiens
ccttcaagttagctcag

SEQ ID NO: 6112976 - DNA, 16 bp, Homo sapiens
ccttcaataaagtatc

SEQ ID NO: 6112977 - DNA, 10 bp, Homo sapiens
ccttcaatct

SEQ ID NO: 6112978 - DNA, 13 bp, Homo sapiens
ccttcaatgctgc

SEQ ID NO: 6112979 - DNA, 16 bp, Homo sapiens
ccttcaatgctgcagg

SEQ ID NO: 6112980 - DNA, 15 bp, Homo sapiens
ccttcaattcctggg

SEQ ID NO: 6112981 - DNA, 11 bp, Homo sapiens
ccttcacaaat

SEQ ID NO: 6112982 - DNA, 12 bp, Homo sapiens
ccttcacaacca

SEQ ID NO: 6112983 - DNA, 22 bp, Homo sapiens
ccttcacaaccagccacacaga

SEQ ID NO: 6112984 - DNA, 17 bp, Homo sapiens
ccttcacaccccaggcc

SEQ ID NO: 6112985 - DNA, 22 bp, Homo sapiens
ccttcacagatgcctacttttg

SEQ ID NO: 6112986 - DNA, 15 bp, Homo sapiens
ccttcacatctccca

SEQ ID NO: 6112987 - DNA, 16 bp, Homo sapiens
ccttcacattttttat

SEQ ID NO: 6112988 - DNA, 18 bp, Homo sapiens
ccttcacattttttatgg

SEQ ID NO: 6112989 - DNA, 17 bp, Homo sapiens
ccttcaccccagtggcc

SEQ ID NO: 6112990 - DNA, 16 bp, Homo sapiens
ccttcaccccttcagc

SEQ ID NO: 6112991 - DNA, 18 bp, Homo sapiens
ccttcaccgctccccaca

SEQ ID NO: 6112992 - DNA, 17 bp, Homo sapiens
ccttcacctcggaggga

SEQ ID NO: 6112993 - DNA, 19 bp, Homo sapiens
ccttcacctttgtccccac

SEQ ID NO: 6112994 - DNA, 14 bp, Homo sapiens
ccttcacgctggct

SEQ ID NO: 6112995 - DNA, 16 bp, Homo sapiens
ccttcacgctggcttc

SEQ ID NO: 6112996 - DNA, 22 bp, Homo sapiens
ccttcacgctggcttccagcgg

SEQ ID NO: 6112997 - DNA, 14 bp, Homo sapiens
ccttcactcatttt

SEQ ID NO: 6112998 - DNA, 15 bp, Homo sapiens
ccttcactccctccc

SEQ ID NO: 6112999 - DNA, 20 bp, Homo sapiens
ccttcactccggtgtgcctg

SEQ ID NO: 6113000 - DNA, 16 bp, Homo sapiens
ccttcactgaacatgc

SEQ ID NO: 6113001 - DNA, 12 bp, Homo sapiens
ccttcactgcca

SEQ ID NO: 6113002 - DNA, 13 bp, Homo sapiens
ccttcactggaga

SEQ ID NO: 6113003 - DNA, 18 bp, Homo sapiens
ccttcactggcgccttct

SEQ ID NO: 6113004 - DNA, 20 bp, Homo sapiens
ccttcactggcgccttctcg

SEQ ID NO: 6113005 - DNA, 14 bp, Homo sapiens
ccttcactgggcca

SEQ ID NO: 6113006 - DNA, 13 bp, Homo sapiens
ccttcactgtgct

SEQ ID NO: 6113007 - DNA, 17 bp, Homo sapiens
ccttcactgttccctct

SEQ ID NO: 6113008 - DNA, 20 bp, Homo sapiens
ccttcactgttccctctggc

SEQ ID NO: 6113009 - DNA, 16 bp, Homo sapiens
ccttcactttctcctg

SEQ ID NO: 6113010 - DNA, 21 bp, Homo sapiens
ccttcactttctcctggtgtt

SEQ ID NO: 6113011 - DNA, 18 bp, Homo sapiens
ccttcacttttctgagtt

SEQ ID NO: 6113012 - DNA, 18 bp, Homo sapiens
ccttcagaacagaggcat

SEQ ID NO: 6113013 - DNA, 17 bp, Homo sapiens
ccttcagacaccctcaa

SEQ ID NO: 6113014 - DNA, 14 bp, Homo sapiens
ccttcagaccttgc

SEQ ID NO: 6113015 - DNA, 16 bp, Homo sapiens
ccttcagactggccct

SEQ ID NO: 6113016 - DNA, 18 bp, Homo sapiens
ccttcagactttgcttcc

SEQ ID NO: 6113017 - DNA, 15 bp, Homo sapiens
ccttcagagagcagt

SEQ ID NO: 6113018 - DNA, 23 bp, Homo sapiens
ccttcagagtacgtcctgcctgg

SEQ ID NO: 6113019 - DNA, 20 bp, Homo sapiens
ccttcagatcagccacacct

SEQ ID NO: 6113020 - DNA, 14 bp, Homo sapiens
ccttcagatcctac

SEQ ID NO: 6113021 - DNA, 16 bp, Homo sapiens
ccttcagatggaaact

SEQ ID NO: 6113022 - DNA, 16 bp, Homo sapiens
ccttcagcagcagctc

SEQ ID NO: 6113023 - DNA, 17 bp, Homo sapiens
ccttcagcagcagctca

SEQ ID NO: 6113024 - DNA, 18 bp, Homo sapiens
ccttcagcagcagctcac

SEQ ID NO: 6113025 - DNA, 15 bp, Homo sapiens
ccttcagcagctaga

SEQ ID NO: 6113026 - DNA, 16 bp, Homo sapiens
ccttcagcatctcact

SEQ ID NO: 6113027 - DNA, 13 bp, Homo sapiens
ccttcagcccacc

SEQ ID NO: 6113028 - DNA, 15 bp, Homo sapiens
ccttcagcccaccac

SEQ ID NO: 6113029 - DNA, 19 bp, Homo sapiens
ccttcagcccccagcccct

SEQ ID NO: 6113030 - DNA, 13 bp, Homo sapiens
ccttcagccctca

SEQ ID NO: 6113031 - DNA, 18 bp, Homo sapiens
ccttcagccctcacccct

SEQ ID NO: 6113032 - DNA, 12 bp, Homo sapiens
ccttcagccctg

SEQ ID NO: 6113033 - DNA, 13 bp, Homo sapiens
ccttcagccctgg

SEQ ID NO: 6113034 - DNA, 16 bp, Homo sapiens
ccttcagccctggcca

SEQ ID NO: 6113035 - DNA, 19 bp, Homo sapiens
ccttcagccctggccaagc

SEQ ID NO: 6113036 - DNA, 20 bp, Homo sapiens
ccttcagccctggccaagct

SEQ ID NO: 6113037 - DNA, 21 bp, Homo sapiens
ccttcagccctggccaagctt

SEQ ID NO: 6113038 - DNA, 18 bp, Homo sapiens
ccttcagctcacgcttca

SEQ ID NO: 6113039 - DNA, 12 bp, Homo sapiens
ccttcagctcca

SEQ ID NO: 6113040 - DNA, 22 bp, Homo sapiens
ccttcagctcctgagtagctgg

SEQ ID NO: 6113041 - DNA, 17 bp, Homo sapiens
ccttcaggaagcaggtg

SEQ ID NO: 6113042 - DNA, 13 bp, Homo sapiens
ccttcaggactct

SEQ ID NO: 6113043 - DNA, 14 bp, Homo sapiens
ccttcaggactctg

SEQ ID NO: 6113044 - DNA, 15 bp, Homo sapiens
ccttcaggactctgc

SEQ ID NO: 6113045 - DNA, 18 bp, Homo sapiens
ccttcaggactctgcggg

SEQ ID NO: 6113046 - DNA, 16 bp, Homo sapiens
ccttcaggagcctggc

SEQ ID NO: 6113047 - DNA, 17 bp, Homo sapiens
ccttcaggccagctggg

SEQ ID NO: 6113048 - DNA, 17 bp, Homo sapiens
ccttcagggagagctgg

SEQ ID NO: 6113049 - DNA, 13 bp, Homo sapiens
ccttcagggccag

SEQ ID NO: 6113050 - DNA, 22 bp, Homo sapiens
ccttcagggccagaaggagggc

SEQ ID NO: 6113051 - DNA, 16 bp, Homo sapiens
ccttcaggttcctcct

SEQ ID NO: 6113052 - DNA, 18 bp, Homo sapiens
ccttcaggttcctcctag

SEQ ID NO: 6113053 - DNA, 19 bp, Homo sapiens
ccttcaggttcctcctagg

SEQ ID NO: 6113054 - DNA, 19 bp, Homo sapiens
ccttcagtaccctctcagc

SEQ ID NO: 6113055 - DNA, 20 bp, Homo sapiens
ccttcagtaccctctcagct

SEQ ID NO: 6113056 - DNA, 21 bp, Homo sapiens
ccttcagtaggaacaagctgg

SEQ ID NO: 6113057 - DNA, 22 bp, Homo sapiens
ccttcagtaggaacaagctggc

SEQ ID NO: 6113058 - DNA, 24 bp, Homo sapiens
ccttcagtatcaaggctgcctgga

SEQ ID NO: 6113059 - DNA, 12 bp, Homo sapiens
ccttcagtctgc

SEQ ID NO: 6113060 - DNA, 18 bp, Homo sapiens
ccttcagtctgctccacc

SEQ ID NO: 6113061 - DNA, 20 bp, Homo sapiens
ccttcagtgaactaagtccc

SEQ ID NO: 6113062 - DNA, 20 bp, Homo sapiens
ccttcagtgacaagtagggc

SEQ ID NO: 6113063 - DNA, 23 bp, Homo sapiens
ccttcagtgagcccctccccagc

SEQ ID NO: 6113064 - DNA, 10 bp, Homo sapiens
ccttcagtgc

SEQ ID NO: 6113065 - DNA, 14 bp, Homo sapiens
ccttcagtgccaaa

SEQ ID NO: 6113066 - DNA, 16 bp, Homo sapiens
ccttcagtgcccacca

SEQ ID NO: 6113067 - DNA, 18 bp, Homo sapiens
ccttcagtgcccaccaac

SEQ ID NO: 6113068 - DNA, 19 bp, Homo sapiens
ccttcagtgctacattttg

SEQ ID NO: 6113069 - DNA, 16 bp, Homo sapiens
ccttcagtttgtaaag

SEQ ID NO: 6113070 - DNA, 16 bp, Homo sapiens
ccttcagttttagcta

SEQ ID NO: 6113071 - DNA, 11 bp, Homo sapiens
ccttcataatt

SEQ ID NO: 6113072 - DNA, 20 bp, Homo sapiens
ccttcataccgcctcgtgcc

SEQ ID NO: 6113073 - DNA, 21 bp, Homo sapiens
ccttcataccgcctcgtgcca

SEQ ID NO: 6113074 - DNA, 22 bp, Homo sapiens
ccttcataccgcctcgtgccag

SEQ ID NO: 6113075 - DNA, 20 bp, Homo sapiens
ccttcatacttgaacgtttt

SEQ ID NO: 6113076 - DNA, 21 bp, Homo sapiens
ccttcataggcggtcatgtgt

SEQ ID NO: 6113077 - DNA, 23 bp, Homo sapiens
ccttcatatgaaaggtgccatgg

SEQ ID NO: 6113078 - DNA, 19 bp, Homo sapiens
ccttcatccatcctgagcc

SEQ ID NO: 6113079 - DNA, 18 bp, Homo sapiens
ccttcatccgcctgtggg

SEQ ID NO: 6113080 - DNA, 13 bp, Homo sapiens
ccttcatctggaa

SEQ ID NO: 6113081 - DNA, 14 bp, Homo sapiens
ccttcatctggaac

SEQ ID NO: 6113082 - DNA, 20 bp, Homo sapiens
ccttcatctggattccagag

SEQ ID NO: 6113083 - DNA, 17 bp, Homo sapiens
ccttcatctgggacaaa

SEQ ID NO: 6113084 - DNA, 16 bp, Homo sapiens
ccttcatcttcctgtg

SEQ ID NO: 6113085 - DNA, 17 bp, Homo sapiens
ccttcatcttcctgtgt

SEQ ID NO: 6113086 - DNA, 18 bp, Homo sapiens
ccttcatcttcctgtgtc

SEQ ID NO: 6113087 - DNA, 19 bp, Homo sapiens
ccttcatcttcctgtgtcc

SEQ ID NO: 6113088 - DNA, 19 bp, Homo sapiens
ccttcatgaatctttcata

SEQ ID NO: 6113089 - DNA, 17 bp, Homo sapiens
ccttcatgacagcctcc

SEQ ID NO: 6113090 - DNA, 18 bp, Homo sapiens
ccttcatgacagcctcca

SEQ ID NO: 6113091 - DNA, 18 bp, Homo sapiens
ccttcatgcttttctcat

SEQ ID NO: 6113092 - DNA, 21 bp, Homo sapiens
ccttcatgcttttctcatggt

SEQ ID NO: 6113093 - DNA, 18 bp, Homo sapiens
ccttcatgtgccatctct

SEQ ID NO: 6113094 - DNA, 13 bp, Homo sapiens
ccttcatgtttta

SEQ ID NO: 6113095 - DNA, 15 bp, Homo sapiens
ccttcattaaatgtt

SEQ ID NO: 6113096 - DNA, 17 bp, Homo sapiens
ccttcattaaatgtttg

SEQ ID NO: 6113097 - DNA, 20 bp, Homo sapiens
ccttcattgatttcctgtgt

SEQ ID NO: 6113098 - DNA, 22 bp, Homo sapiens
ccttcattgatttcctgtgtca

SEQ ID NO: 6113099 - DNA, 23 bp, Homo sapiens
ccttcattgccttaactggagcc

SEQ ID NO: 6113100 - DNA, 19 bp, Homo sapiens
ccttcatttcaggagggat

SEQ ID NO: 6113101 - DNA, 14 bp, Homo sapiens
ccttcatttcctcc

SEQ ID NO: 6113102 - DNA, 15 bp, Homo sapiens
ccttcatttctgata

SEQ ID NO: 6113103 - DNA, 18 bp, Homo sapiens
ccttccaaaaattattat

SEQ ID NO: 6113104 - DNA, 22 bp, Homo sapiens
ccttccaaaacctgcttccttc

SEQ ID NO: 6113105 - DNA, 19 bp, Homo sapiens
ctagctccccaatccctga

SEQ ID NO: 6113106 - DNA, 19 bp, Homo sapiens
ctagctcccctcctctccc

SEQ ID NO: 6113107 - DNA, 23 bp, Homo sapiens
ctagctccgggggtacagccctt

SEQ ID NO: 6113108 - DNA, 15 bp, Homo sapiens
ctagctcctcccctt

SEQ ID NO: 6113109 - DNA, 17 bp, Homo sapiens
ctagctcctcctcctgg

SEQ ID NO: 6113110 - DNA, 18 bp, Homo sapiens
ctagctcctcctcctggg

SEQ ID NO: 6113111 - DNA, 17 bp, Homo sapiens
ctagctcctgccacatg

SEQ ID NO: 6113112 - DNA, 19 bp, Homo sapiens
ctagctctatgtttacaaa

SEQ ID NO: 6113113 - DNA, 20 bp, Homo sapiens
ctagctctatttacttctaa

SEQ ID NO: 6113114 - DNA, 20 bp, Homo sapiens
ctagctctccatctattgat

SEQ ID NO: 6113115 - DNA, 21 bp, Homo sapiens
ctagctctctaggcctctcca

SEQ ID NO: 6113116 - DNA, 21 bp, Homo sapiens
ctagctctgaaatcaactctc

SEQ ID NO: 6113117 - DNA, 20 bp, Homo sapiens
ctagctctgagccagttcag

SEQ ID NO: 6113118 - DNA, 10 bp, Homo sapiens
ctagctctgg

SEQ ID NO: 6113119 - DNA, 23 bp, Homo sapiens
ctagctctggaggtgctgctcta

SEQ ID NO: 6113120 - DNA, 22 bp, Homo sapiens
ctagctcttccccatctcactc

SEQ ID NO: 6113121 - DNA, 12 bp, Homo sapiens
ctagctctttga

SEQ ID NO: 6113122 - DNA, 14 bp, Homo sapiens
ctagctctttgggc

SEQ ID NO: 6113123 - DNA, 21 bp, Homo sapiens
ctagctctttggtctattttc

SEQ ID NO: 6113124 - DNA, 20 bp, Homo sapiens
ctagctgaatgtttttctaa

SEQ ID NO: 6113125 - DNA, 22 bp, Homo sapiens
ctagctgaccccgagaagtgct

SEQ ID NO: 6113126 - DNA, 16 bp, Homo sapiens
ctagctgcacagggca

SEQ ID NO: 6113127 - DNA, 12 bp, Homo sapiens
ctagctgccact

SEQ ID NO: 6113128 - DNA, 22 bp, Homo sapiens
ctagctgcctagcaagctggcc

SEQ ID NO: 6113129 - DNA, 15 bp, Homo sapiens
ctagctgctacaaag

SEQ ID NO: 6113130 - DNA, 16 bp, Homo sapiens
ctagctgctacaaaga

SEQ ID NO: 6113131 - DNA, 21 bp, Homo sapiens
ctagctgctacaaagaagaca

SEQ ID NO: 6113132 - DNA, 15 bp, Homo sapiens
ctagctgcttttctg

SEQ ID NO: 6113133 - DNA, 23 bp, Homo sapiens
ctagctggaattttttattcttg

SEQ ID NO: 6113134 - DNA, 18 bp, Homo sapiens
ctagctggagaggagccc

SEQ ID NO: 6113135 - DNA, 19 bp, Homo sapiens
ctagctggagaggagccct

SEQ ID NO: 6113136 - DNA, 23 bp, Homo sapiens
ctagctggagaggagccctgcct

SEQ ID NO: 6113137 - DNA, 15 bp, Homo sapiens
ctagctggagccccg

SEQ ID NO: 6113138 - DNA, 20 bp, Homo sapiens
ctagctggagtgccatggct

SEQ ID NO: 6113139 - DNA, 14 bp, Homo sapiens
ctagctggatttgt

SEQ ID NO: 6113140 - DNA, 12 bp, Homo sapiens
ctagctggcagg

SEQ ID NO: 6113141 - DNA, 13 bp, Homo sapiens
ctagctggcagga

SEQ ID NO: 6113142 - DNA, 21 bp, Homo sapiens
ctagctgggcaaacccttctc

SEQ ID NO: 6113143 - DNA, 23 bp, Homo sapiens
ctagctgggcaaacccttctctt

SEQ ID NO: 6113144 - DNA, 17 bp, Homo sapiens
ctagctggtagcataaa

SEQ ID NO: 6113145 - DNA, 24 bp, Homo sapiens
ctagctgtattttttgtatgctta

SEQ ID NO: 6113146 - DNA, 15 bp, Homo sapiens
ctagctgtctgtgaa

SEQ ID NO: 6113147 - DNA, 16 bp, Homo sapiens
ctagctgtctgtgaat

SEQ ID NO: 6113148 - DNA, 14 bp, Homo sapiens
ctagctgtgcaaga

SEQ ID NO: 6113149 - DNA, 17 bp, Homo sapiens
ctagctgttctggacta

SEQ ID NO: 6113150 - DNA, 19 bp, Homo sapiens
ctagctgttctggactaca

SEQ ID NO: 6113151 - DNA, 14 bp, Homo sapiens
ctagcttactgata

SEQ ID NO: 6113152 - DNA, 17 bp, Homo sapiens
ctagcttactgataaac

SEQ ID NO: 6113153 - DNA, 15 bp, Homo sapiens
ctagcttagagcctc

SEQ ID NO: 6113154 - DNA, 20 bp, Homo sapiens
ctagcttagagcctccctca

SEQ ID NO: 6113155 - DNA, 16 bp, Homo sapiens
ctagcttagtttcaga

SEQ ID NO: 6113156 - DNA, 20 bp, Homo sapiens
ctagcttatctccctgcttc

SEQ ID NO: 6113157 - DNA, 18 bp, Homo sapiens
ctagcttcatgcctcagt

SEQ ID NO: 6113158 - DNA, 20 bp, Homo sapiens
ctagcttcatgcctcagttt

SEQ ID NO: 6113159 - DNA, 23 bp, Homo sapiens
ctagcttcatgcctcagtttccc

SEQ ID NO: 6113160 - DNA, 21 bp, Homo sapiens
ctagcttctgcttttctgccc

SEQ ID NO: 6113161 - DNA, 14 bp, Homo sapiens
ctagcttgaaaact

SEQ ID NO: 6113162 - DNA, 14 bp, Homo sapiens
ctagcttgaggcaa

SEQ ID NO: 6113163 - DNA, 22 bp, Homo sapiens
ctagcttgaggcaattttaatc

SEQ ID NO: 6113164 - DNA, 23 bp, Homo sapiens
ctagctttacgctcatcacctaa

SEQ ID NO: 6113165 - DNA, 15 bp, Homo sapiens
ctagctttctaaagc

SEQ ID NO: 6113166 - DNA, 15 bp, Homo sapiens
ctagctttgttgtcc

SEQ ID NO: 6113167 - DNA, 22 bp, Homo sapiens
ctagctttgttgtcctcccagg

SEQ ID NO: 6113168 - DNA, 18 bp, Homo sapiens
ctagcttttaaaaaatat

SEQ ID NO: 6113169 - DNA, 14 bp, Homo sapiens
ctagctttttaatt

SEQ ID NO: 6113170 - DNA, 14 bp, Homo sapiens
ctaggaaaagaaat

SEQ ID NO: 6113171 - DNA, 19 bp, Homo sapiens
ctaggaaaagaaatctata

SEQ ID NO: 6113172 - DNA, 14 bp, Homo sapiens
ctaggaaactcaca

SEQ ID NO: 6113173 - DNA, 22 bp, Homo sapiens
ctaggaaagagttgagcacagg

SEQ ID NO: 6113174 - DNA, 14 bp, Homo sapiens
ctaggaaattcttg

SEQ ID NO: 6113175 - DNA, 20 bp, Homo sapiens
ctaggaacattttttaagga

SEQ ID NO: 6113176 - DNA, 15 bp, Homo sapiens
ctaggaactcagtgc

SEQ ID NO: 6113177 - DNA, 15 bp, Homo sapiens
ctaggaagaatttta

SEQ ID NO: 6113178 - DNA, 21 bp, Homo sapiens
ctaggaagaattttaaaaatg

SEQ ID NO: 6113179 - DNA, 21 bp, Homo sapiens
ctaggaagactttggaaagag

SEQ ID NO: 6113180 - DNA, 16 bp, Homo sapiens
ctaggaagcctcagat

SEQ ID NO: 6113181 - DNA, 17 bp, Homo sapiens
ctaggaagtacgagccc

SEQ ID NO: 6113182 - DNA, 14 bp, Homo sapiens
ctaggaatatagat

SEQ ID NO: 6113183 - DNA, 17 bp, Homo sapiens
ctaggaatatagattaa

SEQ ID NO: 6113184 - DNA, 16 bp, Homo sapiens
ctaggaatcccagagg

SEQ ID NO: 6113185 - DNA, 19 bp, Homo sapiens
ctaggaatggaggagccag

SEQ ID NO: 6113186 - DNA, 21 bp, Homo sapiens
ctaggaatggaggagccaggc

SEQ ID NO: 6113187 - DNA, 19 bp, Homo sapiens
ctaggacacagttcctggg

SEQ ID NO: 6113188 - DNA, 20 bp, Homo sapiens
ctaggacagttgattcaaca

SEQ ID NO: 6113189 - DNA, 22 bp, Homo sapiens
ctaggacatctctgtaaaaagc

SEQ ID NO: 6113190 - DNA, 16 bp, Homo sapiens
ctaggaccactcagcc

SEQ ID NO: 6113191 - DNA, 19 bp, Homo sapiens
ctaggaccactcagcccct

SEQ ID NO: 6113192 - DNA, 22 bp, Homo sapiens
ctaggaccactcagcccctagg

SEQ ID NO: 6113193 - DNA, 13 bp, Homo sapiens
ctaggacccccag

SEQ ID NO: 6113194 - DNA, 21 bp, Homo sapiens
ctaggacccgtctccagctgc

SEQ ID NO: 6113195 - DNA, 23 bp, Homo sapiens
ctaggacccgtctccagctgctg

SEQ ID NO: 6113196 - DNA, 13 bp, Homo sapiens
ctaggacctcagg

SEQ ID NO: 6113197 - DNA, 15 bp, Homo sapiens
ctaggacctcaggcg

SEQ ID NO: 6113198 - DNA, 23 bp, Homo sapiens
ctaggacctcaggcggggaggag

SEQ ID NO: 6113199 - DNA, 12 bp, Homo sapiens
ctaggacctcat

SEQ ID NO: 6113200 - DNA, 12 bp, Homo sapiens
ctaggactctga

SEQ ID NO: 6113201 - DNA, 12 bp, Homo sapiens
ctaggactgagg

SEQ ID NO: 6113202 - DNA, 18 bp, Homo sapiens
ctaggactgtggagggga

SEQ ID NO: 6113203 - DNA, 20 bp, Homo sapiens
ctaggactgtggaggggagc

SEQ ID NO: 6113204 - DNA, 22 bp, Homo sapiens
ctaggacttaaccttgaaatgg

SEQ ID NO: 6113205 - DNA, 17 bp, Homo sapiens
ctaggacttcaaattgg

SEQ ID NO: 6113206 - DNA, 18 bp, Homo sapiens
ctaggacttgagcctcca

SEQ ID NO: 6113207 - DNA, 20 bp, Homo sapiens
ctaggactttagggatctgg

SEQ ID NO: 6113208 - DNA, 20 bp, Homo sapiens
ctaggagaagagttgaggaa

SEQ ID NO: 6113209 - DNA, 23 bp, Homo sapiens
ctaggagaaggaggggaaccaga

SEQ ID NO: 6113210 - DNA, 15 bp, Homo sapiens
ctaggagaagggctg

SEQ ID NO: 6113211 - DNA, 17 bp, Homo sapiens
ctaggagaccagaagtg

SEQ ID NO: 6113212 - DNA, 20 bp, Homo sapiens
ctaggagagactgaaagcag

SEQ ID NO: 6113213 - DNA, 17 bp, Homo sapiens
ctaggagagccaacctc

SEQ ID NO: 6113214 - DNA, 18 bp, Homo sapiens
ctaggagatatctgaggg

SEQ ID NO: 6113215 - DNA, 18 bp, Homo sapiens
ctaggagatgttgggaac

SEQ ID NO: 6113216 - DNA, 13 bp, Homo sapiens
ctaggagcaaagc

SEQ ID NO: 6113217 - DNA, 16 bp, Homo sapiens
ctaggagcaaagcctg

SEQ ID NO: 6113218 - DNA, 17 bp, Homo sapiens
ctaggagcaaagcctgt

SEQ ID NO: 6113219 - DNA, 14 bp, Homo sapiens
ctaggagcaggctt

SEQ ID NO: 6113220 - DNA, 21 bp, Homo sapiens
ctaggagcaggcttgtggcag

SEQ ID NO: 6113221 - DNA, 23 bp, Homo sapiens
ctaggagcagtgggccctggctc

SEQ ID NO: 6113222 - DNA, 20 bp, Homo sapiens
ctaggagcccagccttgcgc

SEQ ID NO: 6113223 - DNA, 14 bp, Homo sapiens
ctaggagccccagc

SEQ ID NO: 6113224 - DNA, 15 bp, Homo sapiens
ctaggagccccagct

SEQ ID NO: 6113225 - DNA, 21 bp, Homo sapiens
ctaggagccccagcttcctgt

SEQ ID NO: 6113226 - DNA, 16 bp, Homo sapiens
ctaggagctggctggc

SEQ ID NO: 6113227 - DNA, 19 bp, Homo sapiens
ctaggagctggctggcagg

SEQ ID NO: 6113228 - DNA, 17 bp, Homo sapiens
ctaggagctttgactca

SEQ ID NO: 6113229 - DNA, 20 bp, Homo sapiens
ctaggagctttgactcagga

SEQ ID NO: 6113230 - DNA, 21 bp, Homo sapiens
ctaggagctttgactcaggag

SEQ ID NO: 6113231 - DNA, 22 bp, Homo sapiens
ctaggagctttgactcaggagc

SEQ ID NO: 6113232 - DNA, 20 bp, Homo sapiens
ctaggaggaaaagacagagc

SEQ ID NO: 6113233 - DNA, 21 bp, Homo sapiens
ctaggaggaaaagacagagcc

SEQ ID NO: 6113234 - DNA, 17 bp, Homo sapiens
ctaggaggatgctgtgc

SEQ ID NO: 6113235 - DNA, 15 bp, Homo sapiens
ctaggaggccttctc

SEQ ID NO: 6113236 - DNA, 13 bp, Homo sapiens
ctaggaggctggc

SEQ ID NO: 6113237 - DNA, 16 bp, Homo sapiens
ctaggaggctggccaa

SEQ ID NO: 6113238 - DNA, 18 bp, Homo sapiens
ctaggagggaaggagctg

SEQ ID NO: 6113239 - DNA, 19 bp, Homo sapiens
ctaggagggagccttgtga

SEQ ID NO: 6113240 - DNA, 22 bp, Homo sapiens
ctaggagttgagtacagtgagg

SEQ ID NO: 6113241 - DNA, 19 bp, Homo sapiens
ctaggataaaaagccaggg

SEQ ID NO: 6113242 - DNA, 21 bp, Homo sapiens
ctaggataaaaagccagggct

SEQ ID NO: 6113243 - DNA, 23 bp, Homo sapiens
ctaggataatttttaaaagagga

SEQ ID NO: 6113244 - DNA, 13 bp, Homo sapiens
ctaggatacagaa

SEQ ID NO: 6113245 - DNA, 19 bp, Homo sapiens
ctaggatagcgctcccctt

SEQ ID NO: 6113246 - DNA, 22 bp, Homo sapiens
ctaggatatgtatattttaata

SEQ ID NO: 6113247 - DNA, 14 bp, Homo sapiens
ctaggatcccactg

SEQ ID NO: 6113248 - DNA, 20 bp, Homo sapiens
ctaggatgaacaatgtatac

SEQ ID NO: 6113249 - DNA, 23 bp, Homo sapiens
ctaggatgaattatcttggatga

SEQ ID NO: 6113250 - DNA, 16 bp, Homo sapiens
ctaggatgctgcagca

SEQ ID NO: 6113251 - DNA, 16 bp, Homo sapiens
ctaggatggggcacgg

SEQ ID NO: 6113252 - DNA, 21 bp, Homo sapiens
ctaggatggggcacggctctg

SEQ ID NO: 6113253 - DNA, 22 bp, Homo sapiens
ctaggatggggcacggctctgg

SEQ ID NO: 6113254 - DNA, 16 bp, Homo sapiens
ctaggatggttctgtg

SEQ ID NO: 6113255 - DNA, 22 bp, Homo sapiens
ctaggatgtcatgtctgcttgt

SEQ ID NO: 6113256 - DNA, 20 bp, Homo sapiens
ctaggattcacaccccacct

SEQ ID NO: 6113257 - DNA, 20 bp, Homo sapiens
ctaggattccccctgccctg

SEQ ID NO: 6113258 - DNA, 14 bp, Homo sapiens
ctaggattcctccc

SEQ ID NO: 6113259 - DNA, 17 bp, Homo sapiens
ctaggattcctccccca

SEQ ID NO: 6113260 - DNA, 22 bp, Homo sapiens
ctaggattggagtatgatttac

SEQ ID NO: 6113261 - DNA, 15 bp, Homo sapiens
ctaggatttcagcca

SEQ ID NO: 6113262 - DNA, 16 bp, Homo sapiens
ctaggatttcagccat

SEQ ID NO: 6113263 - DNA, 16 bp, Homo sapiens
ctaggatttgaacact

SEQ ID NO: 6113264 - DNA, 17 bp, Homo sapiens
ctaggatttgaacactt

SEQ ID NO: 6113265 - DNA, 13 bp, Homo sapiens
ctaggcaacatag

SEQ ID NO: 6113266 - DNA, 19 bp, Homo sapiens
ctaggcaagcaggacctgg

SEQ ID NO: 6113267 - DNA, 21 bp, Homo sapiens
ctaggcaagcaggacctggca

SEQ ID NO: 6113268 - DNA, 18 bp, Homo sapiens
ctaggcaagtgtatattt

SEQ ID NO: 6113269 - DNA, 15 bp, Homo sapiens
ctaggcacaaggttg

SEQ ID NO: 6113270 - DNA, 23 bp, Homo sapiens
ctaggcacctccccgctctccct

SEQ ID NO: 6113271 - DNA, 18 bp, Homo sapiens
ctaggcagaagaagctgg

SEQ ID NO: 6113272 - DNA, 19 bp, Homo sapiens
ctaggcagaagaagctggg

SEQ ID NO: 6113273 - DNA, 22 bp, Homo sapiens
ctaggcagaagaagctgggagg

SEQ ID NO: 6113274 - DNA, 20 bp, Homo sapiens
ctaggcagccagctacaggc

SEQ ID NO: 6113275 - DNA, 13 bp, Homo sapiens
ctaggcagggagg

SEQ ID NO: 6113276 - DNA, 17 bp, Homo sapiens
ctaggcagggagggggc

SEQ ID NO: 6113277 - DNA, 19 bp, Homo sapiens
ctaggcagggagggggctg

SEQ ID NO: 6113278 - DNA, 16 bp, Homo sapiens
ctaggcatactctcca

SEQ ID NO: 6113279 - DNA, 21 bp, Homo sapiens
ctaggcataggtctctttgct

SEQ ID NO: 6113280 - DNA, 17 bp, Homo sapiens
ctaggcatcatgtccta

SEQ ID NO: 6113281 - DNA, 21 bp, Homo sapiens
ccttccaaactctctagtgca

SEQ ID NO: 6113282 - DNA, 19 bp, Homo sapiens
ccttccaaatcaggctggg

SEQ ID NO: 6113283 - DNA, 22 bp, Homo sapiens
ccttccaacttcctgtggcctg

SEQ ID NO: 6113284 - DNA, 14 bp, Homo sapiens
ccttccaagactga

SEQ ID NO: 6113285 - DNA, 15 bp, Homo sapiens
ccttccaagagcctg

SEQ ID NO: 6113286 - DNA, 16 bp, Homo sapiens
ccttccaagagcctga

SEQ ID NO: 6113287 - DNA, 18 bp, Homo sapiens
ccttccaagtttgacttg

SEQ ID NO: 6113288 - DNA, 16 bp, Homo sapiens
ccttccaatgcttctg

SEQ ID NO: 6113289 - DNA, 15 bp, Homo sapiens
ccttccacaccccca

SEQ ID NO: 6113290 - DNA, 15 bp, Homo sapiens
ccttccacagctggc

SEQ ID NO: 6113291 - DNA, 17 bp, Homo sapiens
ccttccacagttatctt

SEQ ID NO: 6113292 - DNA, 18 bp, Homo sapiens
ccttccacagttatctta

SEQ ID NO: 6113293 - DNA, 13 bp, Homo sapiens
ccttccaccctgc

SEQ ID NO: 6113294 - DNA, 14 bp, Homo sapiens
ccttccaccctgcc

SEQ ID NO: 6113295 - DNA, 15 bp, Homo sapiens
ccttccaccctgccc

SEQ ID NO: 6113296 - DNA, 22 bp, Homo sapiens
ccttccaccctgccctggccta

SEQ ID NO: 6113297 - DNA, 21 bp, Homo sapiens
ccttccaccggcactcatgac

SEQ ID NO: 6113298 - DNA, 22 bp, Homo sapiens
ccttccaccggcactcatgacg

SEQ ID NO: 6113299 - DNA, 13 bp, Homo sapiens
ccttccacctcag

SEQ ID NO: 6113300 - DNA, 12 bp, Homo sapiens
ccttccacctcc

SEQ ID NO: 6113301 - DNA, 16 bp, Homo sapiens
ccttccacctgctctg

SEQ ID NO: 6113302 - DNA, 19 bp, Homo sapiens
ccttccacgctgtctccag

SEQ ID NO: 6113303 - DNA, 15 bp, Homo sapiens
ccttccactctggaa

SEQ ID NO: 6113304 - DNA, 17 bp, Homo sapiens
ccttccactgagggcag

SEQ ID NO: 6113305 - DNA, 13 bp, Homo sapiens
ccttccactgcct

SEQ ID NO: 6113306 - DNA, 18 bp, Homo sapiens
ccttccactgcctctgcc

SEQ ID NO: 6113307 - DNA, 11 bp, Homo sapiens
ccttccactgt

SEQ ID NO: 6113308 - DNA, 15 bp, Homo sapiens
ccttccactgtagct

SEQ ID NO: 6113309 - DNA, 21 bp, Homo sapiens
ccttccacttcagggttctaa

SEQ ID NO: 6113310 - DNA, 21 bp, Homo sapiens
ccttccacttctaactccact

SEQ ID NO: 6113311 - DNA, 13 bp, Homo sapiens
ccttccagacata

SEQ ID NO: 6113312 - DNA, 22 bp, Homo sapiens
ccttccagacatacgaaacaca

SEQ ID NO: 6113313 - DNA, 10 bp, Homo sapiens
ccttccagat

SEQ ID NO: 6113314 - DNA, 15 bp, Homo sapiens
ccttccagatggtca

SEQ ID NO: 6113315 - DNA, 17 bp, Homo sapiens
ccttccagcaccctgca

SEQ ID NO: 6113316 - DNA, 11 bp, Homo sapiens
ccttccagcct

SEQ ID NO: 6113317 - DNA, 23 bp, Homo sapiens
ccttccagcctgggacacacaca

SEQ ID NO: 6113318 - DNA, 14 bp, Homo sapiens
ccttccagctccct

SEQ ID NO: 6113319 - DNA, 14 bp, Homo sapiens
ccttccagctgctg

SEQ ID NO: 6113320 - DNA, 13 bp, Homo sapiens
ccttccaggccat

SEQ ID NO: 6113321 - DNA, 15 bp, Homo sapiens
ccttccaggccatca

SEQ ID NO: 6113322 - DNA, 12 bp, Homo sapiens
ccttccaggccc

SEQ ID NO: 6113323 - DNA, 13 bp, Homo sapiens
ccttccaggcccc

SEQ ID NO: 6113324 - DNA, 17 bp, Homo sapiens
ccttccaggccccaggc

SEQ ID NO: 6113325 - DNA, 22 bp, Homo sapiens
ccttccaggccccaggctggat

SEQ ID NO: 6113326 - DNA, 24 bp, Homo sapiens
ccttccaggcgtagggccagggct

SEQ ID NO: 6113327 - DNA, 18 bp, Homo sapiens
ccttccagggcctgagca

SEQ ID NO: 6113328 - DNA, 23 bp, Homo sapiens
ccttccagggcctgagcagctgg

SEQ ID NO: 6113329 - DNA, 22 bp, Homo sapiens
ccttccaggggtgggacaccct

SEQ ID NO: 6113330 - DNA, 16 bp, Homo sapiens
ccttccagtcaggatg

SEQ ID NO: 6113331 - DNA, 15 bp, Homo sapiens
ccttccagtggctcg

SEQ ID NO: 6113332 - DNA, 21 bp, Homo sapiens
ccttccagtggtaccagctca

SEQ ID NO: 6113333 - DNA, 24 bp, Homo sapiens
ccttccagtggtaccagctcactc

SEQ ID NO: 6113334 - DNA, 22 bp, Homo sapiens
ccttccagtgtccttagaacat

SEQ ID NO: 6113335 - DNA, 19 bp, Homo sapiens
ccttccatacacagaggag

SEQ ID NO: 6113336 - DNA, 19 bp, Homo sapiens
ccttccatcagcgggtctc

SEQ ID NO: 6113337 - DNA, 22 bp, Homo sapiens
ccttccatcagcgggtctcctc

SEQ ID NO: 6113338 - DNA, 23 bp, Homo sapiens
ccttccatccatctttccatcca

SEQ ID NO: 6113339 - DNA, 12 bp, Homo sapiens
ccttccatccct

SEQ ID NO: 6113340 - DNA, 17 bp, Homo sapiens
ccttccatctcttcctt

SEQ ID NO: 6113341 - DNA, 18 bp, Homo sapiens
ccttccatcttcacactg

SEQ ID NO: 6113342 - DNA, 20 bp, Homo sapiens
ccttccatcttgtggggcca

SEQ ID NO: 6113343 - DNA, 18 bp, Homo sapiens
ccttccatgccccaggat

SEQ ID NO: 6113344 - DNA, 15 bp, Homo sapiens
ccttccatgctccca

SEQ ID NO: 6113345 - DNA, 16 bp, Homo sapiens
ccttccatgctcccaa

SEQ ID NO: 6113346 - DNA, 22 bp, Homo sapiens
ccttccatgtcaggccagcctg

SEQ ID NO: 6113347 - DNA, 20 bp, Homo sapiens
ccttccatgtcgcctctgca

SEQ ID NO: 6113348 - DNA, 19 bp, Homo sapiens
ccttccatgtcggcctcta

SEQ ID NO: 6113349 - DNA, 16 bp, Homo sapiens
ccttccatgtgccttt

SEQ ID NO: 6113350 - DNA, 17 bp, Homo sapiens
ccttccatgtgcctttc

SEQ ID NO: 6113351 - DNA, 19 bp, Homo sapiens
ccttccatgtgcctttctt

SEQ ID NO: 6113352 - DNA, 16 bp, Homo sapiens
ccttccattcacacca

SEQ ID NO: 6113353 - DNA, 17 bp, Homo sapiens
ccttccatttctgcctt

SEQ ID NO: 6113354 - DNA, 10 bp, Homo sapiens
ccttcccaaa

SEQ ID NO: 6113355 - DNA, 18 bp, Homo sapiens
ccttcccaaaggactcca

SEQ ID NO: 6113356 - DNA, 21 bp, Homo sapiens
ccttcccaaaggactccaccc

SEQ ID NO: 6113357 - DNA, 11 bp, Homo sapiens
ccttcccaagg

SEQ ID NO: 6113358 - DNA, 21 bp, Homo sapiens
ccttcccaaggttactcagca

SEQ ID NO: 6113359 - DNA, 21 bp, Homo sapiens
ccttcccaagtaagaggctgg

SEQ ID NO: 6113360 - DNA, 22 bp, Homo sapiens
ccttcccaagtaagaggctgga

SEQ ID NO: 6113361 - DNA, 23 bp, Homo sapiens
ccttcccaagtgagtctctctgg

SEQ ID NO: 6113362 - DNA, 18 bp, Homo sapiens
ccttcccaatcagcactg

SEQ ID NO: 6113363 - DNA, 21 bp, Homo sapiens
ccttcccaatcagcactgaaa

SEQ ID NO: 6113364 - DNA, 15 bp, Homo sapiens
ccttcccacaaaaga

SEQ ID NO: 6113365 - DNA, 13 bp, Homo sapiens
ccttcccacatat

SEQ ID NO: 6113366 - DNA, 16 bp, Homo sapiens
ccttcccacatgcctg

SEQ ID NO: 6113367 - DNA, 22 bp, Homo sapiens
ccttcccacccatcgctgtgtg

SEQ ID NO: 6113368 - DNA, 13 bp, Homo sapiens
ccttcccacccct

SEQ ID NO: 6113369 - DNA, 14 bp, Homo sapiens
ccttcccaccccta

SEQ ID NO: 6113370 - DNA, 18 bp, Homo sapiens
ccttcccacccctacaca

SEQ ID NO: 6113371 - DNA, 20 bp, Homo sapiens
ccttcccacccctacacaca

SEQ ID NO: 6113372 - DNA, 21 bp, Homo sapiens
ccttcccacccctacacacac

SEQ ID NO: 6113373 - DNA, 20 bp, Homo sapiens
ccttcccacctactgcactt

SEQ ID NO: 6113374 - DNA, 14 bp, Homo sapiens
ccttcccacctctc

SEQ ID NO: 6113375 - DNA, 19 bp, Homo sapiens
ccttcccacctctctcact

SEQ ID NO: 6113376 - DNA, 18 bp, Homo sapiens
ccttcccactcaccccgg

SEQ ID NO: 6113377 - DNA, 18 bp, Homo sapiens
ccttcccactcttctcat

SEQ ID NO: 6113378 - DNA, 19 bp, Homo sapiens
ccttcccagaggggcctgc

SEQ ID NO: 6113379 - DNA, 20 bp, Homo sapiens
ccttcccagaggggcctgcc

SEQ ID NO: 6113380 - DNA, 18 bp, Homo sapiens
ccttcccagctctccctc

SEQ ID NO: 6113381 - DNA, 16 bp, Homo sapiens
ccttcccagctgctcc

SEQ ID NO: 6113382 - DNA, 13 bp, Homo sapiens
ccttcccaggcca

SEQ ID NO: 6113383 - DNA, 15 bp, Homo sapiens
ccttcccaggccagc

SEQ ID NO: 6113384 - DNA, 18 bp, Homo sapiens
ccttcccaggccagcgag

SEQ ID NO: 6113385 - DNA, 13 bp, Homo sapiens
ccttcccaggccc

SEQ ID NO: 6113386 - DNA, 13 bp, Homo sapiens
ccttcccagggac

SEQ ID NO: 6113387 - DNA, 20 bp, Homo sapiens
ccttcccagggagaaaccca

SEQ ID NO: 6113388 - DNA, 13 bp, Homo sapiens
ccttcccagtggg

SEQ ID NO: 6113389 - DNA, 20 bp, Homo sapiens
ccttcccagtgggctgtgtt

SEQ ID NO: 6113390 - DNA, 21 bp, Homo sapiens
ccttcccatgacccaggctgg

SEQ ID NO: 6113391 - DNA, 13 bp, Homo sapiens
ccttcccatggag

SEQ ID NO: 6113392 - DNA, 13 bp, Homo sapiens
ccttccccaagaa

SEQ ID NO: 6113393 - DNA, 20 bp, Homo sapiens
ccttccccacccttgagaag

SEQ ID NO: 6113394 - DNA, 11 bp, Homo sapiens
ccttccccact

SEQ ID NO: 6113395 - DNA, 19 bp, Homo sapiens
ccttccccactgcacacac

SEQ ID NO: 6113396 - DNA, 15 bp, Homo sapiens
ccttccccagaccca

SEQ ID NO: 6113397 - DNA, 14 bp, Homo sapiens
ccttccccagactc

SEQ ID NO: 6113398 - DNA, 19 bp, Homo sapiens
ccttccccagactcagctc

SEQ ID NO: 6113399 - DNA, 23 bp, Homo sapiens
ccttccccagactcagctccaga

SEQ ID NO: 6113400 - DNA, 16 bp, Homo sapiens
ccttccccagacttgc

SEQ ID NO: 6113401 - DNA, 19 bp, Homo sapiens
ccttccccagacttgcact

SEQ ID NO: 6113402 - DNA, 21 bp, Homo sapiens
ccttccccagacttgcactgg

SEQ ID NO: 6113403 - DNA, 13 bp, Homo sapiens
ccttccccagcat

SEQ ID NO: 6113404 - DNA, 13 bp, Homo sapiens
ccttccccagctc

SEQ ID NO: 6113405 - DNA, 14 bp, Homo sapiens
ccttccccagctcc

SEQ ID NO: 6113406 - DNA, 15 bp, Homo sapiens
ccttccccagctcca

SEQ ID NO: 6113407 - DNA, 19 bp, Homo sapiens
ccttccccagctccagcag

SEQ ID NO: 6113408 - DNA, 15 bp, Homo sapiens
ccttccccagctccc

SEQ ID NO: 6113409 - DNA, 22 bp, Homo sapiens
ccttccccagctcccccaggca

SEQ ID NO: 6113410 - DNA, 11 bp, Homo sapiens
ccttccccagg

SEQ ID NO: 6113411 - DNA, 22 bp, Homo sapiens
ccttccccatagataggcccct

SEQ ID NO: 6113412 - DNA, 21 bp, Homo sapiens
ccttccccatgaaccctgccc

SEQ ID NO: 6113413 - DNA, 21 bp, Homo sapiens
ccttccccatttcctcttcct

SEQ ID NO: 6113414 - DNA, 13 bp, Homo sapiens
ccttcccccagcc

SEQ ID NO: 6113415 - DNA, 15 bp, Homo sapiens
ccttcccccagccca

SEQ ID NO: 6113416 - DNA, 17 bp, Homo sapiens
ccttcccccagcccaat

SEQ ID NO: 6113417 - DNA, 18 bp, Homo sapiens
ccttcccccagcccaata

SEQ ID NO: 6113418 - DNA, 21 bp, Homo sapiens
ccttcccccagcccaataaag

SEQ ID NO: 6113419 - DNA, 20 bp, Homo sapiens
ccttcccccagctttccatc

SEQ ID NO: 6113420 - DNA, 23 bp, Homo sapiens
ccttcccccatcccctttcctcc

SEQ ID NO: 6113421 - DNA, 15 bp, Homo sapiens
ccttcccccatccct

SEQ ID NO: 6113422 - DNA, 21 bp, Homo sapiens
ccttcccccatccctaccact

SEQ ID NO: 6113423 - DNA, 18 bp, Homo sapiens
ccttccccccatctctga

SEQ ID NO: 6113424 - DNA, 19 bp, Homo sapiens
ccttccccctccaatccca

SEQ ID NO: 6113425 - DNA, 19 bp, Homo sapiens
ccttccccctgtagactag

SEQ ID NO: 6113426 - DNA, 14 bp, Homo sapiens
ccttcccccttcct

SEQ ID NO: 6113427 - DNA, 19 bp, Homo sapiens
ccttccccctttctctgcc

SEQ ID NO: 6113428 - DNA, 22 bp, Homo sapiens
ccttccccctttctctgcctgg

SEQ ID NO: 6113429 - DNA, 24 bp, Homo sapiens
ccttccccctttctctgcctggca

SEQ ID NO: 6113430 - DNA, 23 bp, Homo sapiens
ccttcccccttttttgtccccca

SEQ ID NO: 6113431 - DNA, 17 bp, Homo sapiens
ccttccccgtcccctgc

SEQ ID NO: 6113432 - DNA, 17 bp, Homo sapiens
ccttcccctcccctcct

SEQ ID NO: 6113433 - DNA, 20 bp, Homo sapiens
ccttcccctcccctccttgt

SEQ ID NO: 6113434 - DNA, 14 bp, Homo sapiens
ccttcccctccctg

SEQ ID NO: 6113435 - DNA, 15 bp, Homo sapiens
ccttcccctccctgg

SEQ ID NO: 6113436 - DNA, 17 bp, Homo sapiens
ccttcccctccctggct

SEQ ID NO: 6113437 - DNA, 18 bp, Homo sapiens
ccttcccctccctggctc

SEQ ID NO: 6113438 - DNA, 12 bp, Homo sapiens
ccttcccctgca

SEQ ID NO: 6113439 - DNA, 17 bp, Homo sapiens
ccttcccctgcacctgg

SEQ ID NO: 6113440 - DNA, 21 bp, Homo sapiens
ccttcccctgcgccctccctc

SEQ ID NO: 6113441 - DNA, 21 bp, Homo sapiens
ccttcccctgtcttcacctgc

SEQ ID NO: 6113442 - DNA, 22 bp, Homo sapiens
ccttcccctgtcttcacctgcc

SEQ ID NO: 6113443 - DNA, 14 bp, Homo sapiens
ccttcccctgtggt

SEQ ID NO: 6113444 - DNA, 21 bp, Homo sapiens
ccttccccttatcctccctgt

SEQ ID NO: 6113445 - DNA, 22 bp, Homo sapiens
ccttccccttcaccgctcccca

SEQ ID NO: 6113446 - DNA, 18 bp, Homo sapiens
ccttccccttgcccaggg

SEQ ID NO: 6113447 - DNA, 16 bp, Homo sapiens
ccttccccttgtccct

SEQ ID NO: 6113448 - DNA, 17 bp, Homo sapiens
ccttccccttgtccctg

SEQ ID NO: 6113449 - DNA, 18 bp, Homo sapiens
ccttccccttttgcctgg

SEQ ID NO: 6113450 - DNA, 19 bp, Homo sapiens
ccttcccgcagcaccagcc

SEQ ID NO: 6113451 - DNA, 21 bp, Homo sapiens
ccttcccgcagcaccagcctg

SEQ ID NO: 6113452 - DNA, 23 bp, Homo sapiens
ccttcccggcccccggccaagga

SEQ ID NO: 6113453 - DNA, 24 bp, Homo sapiens
ccttccctcaccttggcaccagac

SEQ ID NO: 6113454 - DNA, 15 bp, Homo sapiens
ccttccctcactctt

SEQ ID NO: 6113455 - DNA, 19 bp, Homo sapiens
ccttccctcactcttcctc

SEQ ID NO: 6113456 - DNA, 13 bp, Homo sapiens
ccttccctccaag

SEQ ID NO: 6113457 - DNA, 11 bp, Homo sapiens
ccttccctcct

SEQ ID NO: 6113458 - DNA, 13 bp, Homo sapiens
ccttccctcctcc

SEQ ID NO: 6113459 - DNA, 14 bp, Homo sapiens
ctaggcatcccagg

SEQ ID NO: 6113460 - DNA, 15 bp, Homo sapiens
ctaggcatcccaggg

SEQ ID NO: 6113461 - DNA, 19 bp, Homo sapiens
ctaggcatctcctctcccc

SEQ ID NO: 6113462 - DNA, 18 bp, Homo sapiens
ctaggcatgtcagaggac

SEQ ID NO: 6113463 - DNA, 17 bp, Homo sapiens
ctaggcattctggacct

SEQ ID NO: 6113464 - DNA, 21 bp, Homo sapiens
ctaggcattctggacctctgg

SEQ ID NO: 6113465 - DNA, 22 bp, Homo sapiens
ctaggcattctggacctctggg

SEQ ID NO: 6113466 - DNA, 16 bp, Homo sapiens
ctaggcattgcaggac

SEQ ID NO: 6113467 - DNA, 16 bp, Homo sapiens
ctaggcatttgtaaat

SEQ ID NO: 6113468 - DNA, 21 bp, Homo sapiens
ctaggcatttgtaaatattaa

SEQ ID NO: 6113469 - DNA, 19 bp, Homo sapiens
ctaggccaaatgcacaagc

SEQ ID NO: 6113470 - DNA, 20 bp, Homo sapiens
ctaggccaccccaacctctg

SEQ ID NO: 6113471 - DNA, 21 bp, Homo sapiens
ctaggccaccccaacctctgt

SEQ ID NO: 6113472 - DNA, 18 bp, Homo sapiens
ctaggccacgtccaggtc

SEQ ID NO: 6113473 - DNA, 14 bp, Homo sapiens
ctaggccactcctc

SEQ ID NO: 6113474 - DNA, 19 bp, Homo sapiens
ctaggccactcctccaaag

SEQ ID NO: 6113475 - DNA, 17 bp, Homo sapiens
ctaggccagagccatgc

SEQ ID NO: 6113476 - DNA, 14 bp, Homo sapiens
ctaggccagcaggg

SEQ ID NO: 6113477 - DNA, 22 bp, Homo sapiens
ctaggccagcaggggctgcccg

SEQ ID NO: 6113478 - DNA, 11 bp, Homo sapiens
ctaggccaggt

SEQ ID NO: 6113479 - DNA, 18 bp, Homo sapiens
ctaggccatcaccaacca

SEQ ID NO: 6113480 - DNA, 14 bp, Homo sapiens
ctaggccccagagc

SEQ ID NO: 6113481 - DNA, 18 bp, Homo sapiens
ctaggccccagaggccct

SEQ ID NO: 6113482 - DNA, 19 bp, Homo sapiens
ctaggccccagaggccctg

SEQ ID NO: 6113483 - DNA, 16 bp, Homo sapiens
ctaggcccccacttgc

SEQ ID NO: 6113484 - DNA, 21 bp, Homo sapiens
ctaggccccccagaaagctgc

SEQ ID NO: 6113485 - DNA, 15 bp, Homo sapiens
ctaggcccctcctag

SEQ ID NO: 6113486 - DNA, 17 bp, Homo sapiens
ctaggcccctcctagac

SEQ ID NO: 6113487 - DNA, 22 bp, Homo sapiens
ctaggcccctcctagacccagg

SEQ ID NO: 6113488 - DNA, 18 bp, Homo sapiens
ctaggccctgtgagcaca

SEQ ID NO: 6113489 - DNA, 12 bp, Homo sapiens
ctaggccgggcg

SEQ ID NO: 6113490 - DNA, 15 bp, Homo sapiens
ctaggcctagtcctg

SEQ ID NO: 6113491 - DNA, 16 bp, Homo sapiens
ctaggcctcaactcct

SEQ ID NO: 6113492 - DNA, 18 bp, Homo sapiens
ctaggcctcagccagaga

SEQ ID NO: 6113493 - DNA, 19 bp, Homo sapiens
ctaggcctccgttgtctgg

SEQ ID NO: 6113494 - DNA, 23 bp, Homo sapiens
ctaggcctctcacctctgtgcct

SEQ ID NO: 6113495 - DNA, 21 bp, Homo sapiens
ctaggcctgagttagctgttt

SEQ ID NO: 6113496 - DNA, 20 bp, Homo sapiens
ctaggcctggcatggcacct

SEQ ID NO: 6113497 - DNA, 13 bp, Homo sapiens
ctaggcctgggga

SEQ ID NO: 6113498 - DNA, 18 bp, Homo sapiens
ctaggcctttcctctgca

SEQ ID NO: 6113499 - DNA, 19 bp, Homo sapiens
ctaggcctttcctctgcac

SEQ ID NO: 6113500 - DNA, 15 bp, Homo sapiens
ctaggcgagtgccag

SEQ ID NO: 6113501 - DNA, 20 bp, Homo sapiens
ctaggcgagtgccaggactc

SEQ ID NO: 6113502 - DNA, 17 bp, Homo sapiens
ctaggcgcgatggctgt

SEQ ID NO: 6113503 - DNA, 14 bp, Homo sapiens
ctaggcgctcagag

SEQ ID NO: 6113504 - DNA, 16 bp, Homo sapiens
ctaggcgctcagaggc

SEQ ID NO: 6113505 - DNA, 15 bp, Homo sapiens
ctaggctaccctcct

SEQ ID NO: 6113506 - DNA, 15 bp, Homo sapiens
ctaggctcagcggcg

SEQ ID NO: 6113507 - DNA, 12 bp, Homo sapiens
ctaggctccctg

SEQ ID NO: 6113508 - DNA, 13 bp, Homo sapiens
ctaggctccctga

SEQ ID NO: 6113509 - DNA, 16 bp, Homo sapiens
ctaggctccctgaggt

SEQ ID NO: 6113510 - DNA, 17 bp, Homo sapiens
ctaggctcgccttccct

SEQ ID NO: 6113511 - DNA, 21 bp, Homo sapiens
ctaggctgacacctaactctt

SEQ ID NO: 6113512 - DNA, 14 bp, Homo sapiens
ctaggctgagatgc

SEQ ID NO: 6113513 - DNA, 16 bp, Homo sapiens
ctaggctgagatgcac

SEQ ID NO: 6113514 - DNA, 17 bp, Homo sapiens
ctaggctgagctggcat

SEQ ID NO: 6113515 - DNA, 23 bp, Homo sapiens
ctaggctgcattgaaaagagctg

SEQ ID NO: 6113516 - DNA, 15 bp, Homo sapiens
ctaggctgctgcaca

SEQ ID NO: 6113517 - DNA, 22 bp, Homo sapiens
ctaggctgctgcacaccaaggc

SEQ ID NO: 6113518 - DNA, 15 bp, Homo sapiens
ctaggctgctgctgt

SEQ ID NO: 6113519 - DNA, 17 bp, Homo sapiens
ctaggctggaaggagga

SEQ ID NO: 6113520 - DNA, 22 bp, Homo sapiens
ctaggctggggaagtcctctgg

SEQ ID NO: 6113521 - DNA, 18 bp, Homo sapiens
ctaggctgggtgcccaca

SEQ ID NO: 6113522 - DNA, 21 bp, Homo sapiens
ctaggctgggtgcccacagcc

SEQ ID NO: 6113523 - DNA, 22 bp, Homo sapiens
ctaggctgggtgcccacagccc

SEQ ID NO: 6113524 - DNA, 16 bp, Homo sapiens
ctaggctgttctgtag

SEQ ID NO: 6113525 - DNA, 16 bp, Homo sapiens
ctaggctgttttctcc

SEQ ID NO: 6113526 - DNA, 21 bp, Homo sapiens
ctaggcttcagcatatttata

SEQ ID NO: 6113527 - DNA, 22 bp, Homo sapiens
ctaggctttatttataaaataa

SEQ ID NO: 6113528 - DNA, 17 bp, Homo sapiens
ctagggaaacttcccgt

SEQ ID NO: 6113529 - DNA, 16 bp, Homo sapiens
ctagggaaggccacct

SEQ ID NO: 6113530 - DNA, 14 bp, Homo sapiens
ctagggaagggagg

SEQ ID NO: 6113531 - DNA, 15 bp, Homo sapiens
ctagggaatctggat

SEQ ID NO: 6113532 - DNA, 22 bp, Homo sapiens
ctagggacatgaaatttacaaa

SEQ ID NO: 6113533 - DNA, 16 bp, Homo sapiens
ctagggacccctcgcc

SEQ ID NO: 6113534 - DNA, 15 bp, Homo sapiens
ctagggagagggaag

SEQ ID NO: 6113535 - DNA, 17 bp, Homo sapiens
ctagggagccctgggcc

SEQ ID NO: 6113536 - DNA, 21 bp, Homo sapiens
ctagggaggaccttatctgtg

SEQ ID NO: 6113537 - DNA, 23 bp, Homo sapiens
ctagggaggaccttatctgtgcg

SEQ ID NO: 6113538 - DNA, 20 bp, Homo sapiens
ctagggaggctgaggcagga

SEQ ID NO: 6113539 - DNA, 19 bp, Homo sapiens
ctagggatataaaaacaga

SEQ ID NO: 6113540 - DNA, 23 bp, Homo sapiens
ctagggatccctcatctgtccct

SEQ ID NO: 6113541 - DNA, 20 bp, Homo sapiens
ctagggattcaggctgcttg

SEQ ID NO: 6113542 - DNA, 21 bp, Homo sapiens
ctagggcaagtcttaaatgtg

SEQ ID NO: 6113543 - DNA, 23 bp, Homo sapiens
ctagggcctcggaggctcctccc

SEQ ID NO: 6113544 - DNA, 21 bp, Homo sapiens
ctagggcgacgtcttcagagt

SEQ ID NO: 6113545 - DNA, 14 bp, Homo sapiens
ctagggctcagagg

SEQ ID NO: 6113546 - DNA, 23 bp, Homo sapiens
ctagggctccgaggagctggggc

SEQ ID NO: 6113547 - DNA, 20 bp, Homo sapiens
ctagggctctccaagcacta

SEQ ID NO: 6113548 - DNA, 17 bp, Homo sapiens
ctagggctgagcacctc

SEQ ID NO: 6113549 - DNA, 19 bp, Homo sapiens
ctagggctgaggggcctgc

SEQ ID NO: 6113550 - DNA, 14 bp, Homo sapiens
ctagggctgctgct

SEQ ID NO: 6113551 - DNA, 19 bp, Homo sapiens
ctagggctgctgcttctgc

SEQ ID NO: 6113552 - DNA, 11 bp, Homo sapiens
ctagggctgga

SEQ ID NO: 6113553 - DNA, 16 bp, Homo sapiens
ctagggctgggaaaca

SEQ ID NO: 6113554 - DNA, 17 bp, Homo sapiens
ctaggggaacagaccag

SEQ ID NO: 6113555 - DNA, 22 bp, Homo sapiens
ctaggggaaggactggccgtgg

SEQ ID NO: 6113556 - DNA, 23 bp, Homo sapiens
ctaggggaaggactggccgtggc

SEQ ID NO: 6113557 - DNA, 16 bp, Homo sapiens
ctaggggaagggcttt

SEQ ID NO: 6113558 - DNA, 17 bp, Homo sapiens
ctaggggacttggggat

SEQ ID NO: 6113559 - DNA, 16 bp, Homo sapiens
ctaggggagaagagcc

SEQ ID NO: 6113560 - DNA, 23 bp, Homo sapiens
ctaggggagaagagccctggaca

SEQ ID NO: 6113561 - DNA, 17 bp, Homo sapiens
ctaggggaggagagagg

SEQ ID NO: 6113562 - DNA, 13 bp, Homo sapiens
ctaggggaggggg

SEQ ID NO: 6113563 - DNA, 23 bp, Homo sapiens
ctaggggcagcctccgtcatcca

SEQ ID NO: 6113564 - DNA, 14 bp, Homo sapiens
ctaggggcaggtga

SEQ ID NO: 6113565 - DNA, 12 bp, Homo sapiens
ctaggggccgag

SEQ ID NO: 6113566 - DNA, 23 bp, Homo sapiens
ctaggggccgagggaaatgctgt

SEQ ID NO: 6113567 - DNA, 23 bp, Homo sapiens
ctaggggccgagtccaggagccc

SEQ ID NO: 6113568 - DNA, 22 bp, Homo sapiens
ctaggggcgggggcggaggagg

SEQ ID NO: 6113569 - DNA, 13 bp, Homo sapiens
ctaggggctgggg

SEQ ID NO: 6113570 - DNA, 16 bp, Homo sapiens
ctaggggcttggtcct

SEQ ID NO: 6113571 - DNA, 23 bp, Homo sapiens
ctagggggagccccttctgctca

SEQ ID NO: 6113572 - DNA, 15 bp, Homo sapiens
ctaggggtagctggt

SEQ ID NO: 6113573 - DNA, 21 bp, Homo sapiens
ctaggggtccacgggaagcct

SEQ ID NO: 6113574 - DNA, 17 bp, Homo sapiens
ctaggggtcctcgggat

SEQ ID NO: 6113575 - DNA, 23 bp, Homo sapiens
ctaggggtcttgttaagtgcagt

SEQ ID NO: 6113576 - DNA, 16 bp, Homo sapiens
ctaggggtggcgctca

SEQ ID NO: 6113577 - DNA, 14 bp, Homo sapiens
ctagggtccctgaa

SEQ ID NO: 6113578 - DNA, 13 bp, Homo sapiens
ctagggtcctcag

SEQ ID NO: 6113579 - DNA, 15 bp, Homo sapiens
ctagggtcctcaggc

SEQ ID NO: 6113580 - DNA, 19 bp, Homo sapiens
ctagggtcctcaggcagtg

SEQ ID NO: 6113581 - DNA, 17 bp, Homo sapiens
ctagggtcctggccctc

SEQ ID NO: 6113582 - DNA, 14 bp, Homo sapiens
ctagggtcctgggg

SEQ ID NO: 6113583 - DNA, 18 bp, Homo sapiens
ctagggtctataattcct

SEQ ID NO: 6113584 - DNA, 23 bp, Homo sapiens
ctagggtgagggtgacagaggga

SEQ ID NO: 6113585 - DNA, 17 bp, Homo sapiens
ctagggtggcccttgca

SEQ ID NO: 6113586 - DNA, 14 bp, Homo sapiens
ctagggtgttttaa

SEQ ID NO: 6113587 - DNA, 19 bp, Homo sapiens
ctagggttaggaggtcctt

SEQ ID NO: 6113588 - DNA, 18 bp, Homo sapiens
ctagggttccactggaga

SEQ ID NO: 6113589 - DNA, 19 bp, Homo sapiens
ctagggttccactggagaa

SEQ ID NO: 6113590 - DNA, 18 bp, Homo sapiens
ctagggttgctggagcct

SEQ ID NO: 6113591 - DNA, 18 bp, Homo sapiens
ctagggtttcttaaatat

SEQ ID NO: 6113592 - DNA, 15 bp, Homo sapiens
ctaggtaaaatttgt

SEQ ID NO: 6113593 - DNA, 15 bp, Homo sapiens
ctaggtaatttttac

SEQ ID NO: 6113594 - DNA, 19 bp, Homo sapiens
ctaggtacgatgacagtgt

SEQ ID NO: 6113595 - DNA, 19 bp, Homo sapiens
ctaggtagaaaaagggtca

SEQ ID NO: 6113596 - DNA, 15 bp, Homo sapiens
ctaggtagaggcatt

SEQ ID NO: 6113597 - DNA, 16 bp, Homo sapiens
ctaggtagaggcattt

SEQ ID NO: 6113598 - DNA, 23 bp, Homo sapiens
ctaggtaggcaccacagagaaga

SEQ ID NO: 6113599 - DNA, 21 bp, Homo sapiens
ctaggtaggcttctacctgca

SEQ ID NO: 6113600 - DNA, 15 bp, Homo sapiens
ctaggtagggtttaa

SEQ ID NO: 6113601 - DNA, 13 bp, Homo sapiens
ctaggtagtgggg

SEQ ID NO: 6113602 - DNA, 20 bp, Homo sapiens
ctaggtataaaaaataagta

SEQ ID NO: 6113603 - DNA, 22 bp, Homo sapiens
ctaggtattgtctactctgaag

SEQ ID NO: 6113604 - DNA, 20 bp, Homo sapiens
ctaggtcaaggcctgtccct

SEQ ID NO: 6113605 - DNA, 22 bp, Homo sapiens
ctaggtcaaggcctgtccctgg

SEQ ID NO: 6113606 - DNA, 19 bp, Homo sapiens
ctaggtcagtacccacctg

SEQ ID NO: 6113607 - DNA, 15 bp, Homo sapiens
ctaggtcagtctaac

SEQ ID NO: 6113608 - DNA, 14 bp, Homo sapiens
ctaggtcataaaga

SEQ ID NO: 6113609 - DNA, 17 bp, Homo sapiens
ctaggtcctttaggttt

SEQ ID NO: 6113610 - DNA, 16 bp, Homo sapiens
ctaggtctccacccct

SEQ ID NO: 6113611 - DNA, 19 bp, Homo sapiens
ctaggtctccacccctcaa

SEQ ID NO: 6113612 - DNA, 13 bp, Homo sapiens
ctaggtctccagt

SEQ ID NO: 6113613 - DNA, 16 bp, Homo sapiens
ctaggtctcctcaggg

SEQ ID NO: 6113614 - DNA, 17 bp, Homo sapiens
ctaggtctcctcagggt

SEQ ID NO: 6113615 - DNA, 12 bp, Homo sapiens
ctaggtctgata

SEQ ID NO: 6113616 - DNA, 20 bp, Homo sapiens
ctaggtctgctcctgaacca

SEQ ID NO: 6113617 - DNA, 16 bp, Homo sapiens
ctaggtgaacagcagg

SEQ ID NO: 6113618 - DNA, 18 bp, Homo sapiens
ctaggtgacagagtgaga

SEQ ID NO: 6113619 - DNA, 24 bp, Homo sapiens
ctaggtgacagagtgagactctgt

SEQ ID NO: 6113620 - DNA, 15 bp, Homo sapiens
ctaggtgacatatac

SEQ ID NO: 6113621 - DNA, 16 bp, Homo sapiens
ctaggtgacatataca

SEQ ID NO: 6113622 - DNA, 20 bp, Homo sapiens
ctaggtgacatgtctacttt

SEQ ID NO: 6113623 - DNA, 19 bp, Homo sapiens
ctaggtgcagctcctcagc

SEQ ID NO: 6113624 - DNA, 15 bp, Homo sapiens
ctaggtgcccagggc

SEQ ID NO: 6113625 - DNA, 19 bp, Homo sapiens
ctaggtgcccagggccagt

SEQ ID NO: 6113626 - DNA, 18 bp, Homo sapiens
ctaggtgcccttggaggc

SEQ ID NO: 6113627 - DNA, 12 bp, Homo sapiens
ctaggtgctgga

SEQ ID NO: 6113628 - DNA, 14 bp, Homo sapiens
ctaggtgctggcat

SEQ ID NO: 6113629 - DNA, 15 bp, Homo sapiens
ctaggtggaaaagcc

SEQ ID NO: 6113630 - DNA, 19 bp, Homo sapiens
ctaggtggaggttgtgcat

SEQ ID NO: 6113631 - DNA, 21 bp, Homo sapiens
ctaggtggaggttgtgcatgt

SEQ ID NO: 6113632 - DNA, 22 bp, Homo sapiens
ctaggtggaggttgtgcatgtt

SEQ ID NO: 6113633 - DNA, 17 bp, Homo sapiens
ctaggtggcaaggctgt

SEQ ID NO: 6113634 - DNA, 19 bp, Homo sapiens
ctaggtggcaaggctgtgc

SEQ ID NO: 6113635 - DNA, 13 bp, Homo sapiens
ctaggtgggagcc

SEQ ID NO: 6113636 - DNA, 15 bp, Homo sapiens
ccttccctcctgctt

SEQ ID NO: 6113637 - DNA, 15 bp, Homo sapiens
ccttccctcctttta

SEQ ID NO: 6113638 - DNA, 11 bp, Homo sapiens
ccttccctctc

SEQ ID NO: 6113639 - DNA, 12 bp, Homo sapiens
ccttccctctcc

SEQ ID NO: 6113640 - DNA, 19 bp, Homo sapiens
ccttccctctctccctgcc

SEQ ID NO: 6113641 - DNA, 20 bp, Homo sapiens
ccttccctctctccctgcct

SEQ ID NO: 6113642 - DNA, 21 bp, Homo sapiens
ccttccctctctccctgcctc

SEQ ID NO: 6113643 - DNA, 22 bp, Homo sapiens
ccttccctctctccctgcctca

SEQ ID NO: 6113644 - DNA, 12 bp, Homo sapiens
ccttccctctgc

SEQ ID NO: 6113645 - DNA, 14 bp, Homo sapiens
ccttccctctgcat

SEQ ID NO: 6113646 - DNA, 20 bp, Homo sapiens
ccttccctctgggcacgcct

SEQ ID NO: 6113647 - DNA, 12 bp, Homo sapiens
ccttccctctgt

SEQ ID NO: 6113648 - DNA, 19 bp, Homo sapiens
ccttccctctttccccacc

SEQ ID NO: 6113649 - DNA, 17 bp, Homo sapiens
ccttccctgacactgtc

SEQ ID NO: 6113650 - DNA, 21 bp, Homo sapiens
ccttccctgacactgtctgct

SEQ ID NO: 6113651 - DNA, 23 bp, Homo sapiens
ccttccctgatggcctttggacc

SEQ ID NO: 6113652 - DNA, 14 bp, Homo sapiens
ccttccctgcccca

SEQ ID NO: 6113653 - DNA, 20 bp, Homo sapiens
ccttccctgcctccagctgt

SEQ ID NO: 6113654 - DNA, 13 bp, Homo sapiens
ccttccctgcctt

SEQ ID NO: 6113655 - DNA, 14 bp, Homo sapiens
ccttccctggaggt

SEQ ID NO: 6113656 - DNA, 11 bp, Homo sapiens
ccttccctggc

SEQ ID NO: 6113657 - DNA, 14 bp, Homo sapiens
ccttccctggctac

SEQ ID NO: 6113658 - DNA, 14 bp, Homo sapiens
ccttccctgggaag

SEQ ID NO: 6113659 - DNA, 13 bp, Homo sapiens
ccttccctgggag

SEQ ID NO: 6113660 - DNA, 18 bp, Homo sapiens
ccttccctgggctgtgct

SEQ ID NO: 6113661 - DNA, 19 bp, Homo sapiens
ccttccctggggagccctc

SEQ ID NO: 6113662 - DNA, 21 bp, Homo sapiens
ccttccctggggagccctcag

SEQ ID NO: 6113663 - DNA, 14 bp, Homo sapiens
ccttccctgtccct

SEQ ID NO: 6113664 - DNA, 17 bp, Homo sapiens
ccttccctgtccctcta

SEQ ID NO: 6113665 - DNA, 20 bp, Homo sapiens
ccttcccttccactgcctct

SEQ ID NO: 6113666 - DNA, 17 bp, Homo sapiens
ccttcccttcctcagca

SEQ ID NO: 6113667 - DNA, 17 bp, Homo sapiens
ccttcccttctccatct

SEQ ID NO: 6113668 - DNA, 23 bp, Homo sapiens
ccttcccttcttttcctgggtgc

SEQ ID NO: 6113669 - DNA, 12 bp, Homo sapiens
ccttcccttgcc

SEQ ID NO: 6113670 - DNA, 12 bp, Homo sapiens
ccttcccttgct

SEQ ID NO: 6113671 - DNA, 19 bp, Homo sapiens
ccttccgacaccactggga

SEQ ID NO: 6113672 - DNA, 20 bp, Homo sapiens
ccttccgacaccactgggaa

SEQ ID NO: 6113673 - DNA, 18 bp, Homo sapiens
ccttccgaccctctggga

SEQ ID NO: 6113674 - DNA, 18 bp, Homo sapiens
ccttccgcagtgtggcca

SEQ ID NO: 6113675 - DNA, 22 bp, Homo sapiens
ccttccgcagtgtggccaggct

SEQ ID NO: 6113676 - DNA, 14 bp, Homo sapiens
ccttccgccaatct

SEQ ID NO: 6113677 - DNA, 20 bp, Homo sapiens
ccttccgccaatctggccct

SEQ ID NO: 6113678 - DNA, 16 bp, Homo sapiens
ccttccgccttctccc

SEQ ID NO: 6113679 - DNA, 16 bp, Homo sapiens
ccttccgctcccacca

SEQ ID NO: 6113680 - DNA, 20 bp, Homo sapiens
ccttccgctcctttacctac

SEQ ID NO: 6113681 - DNA, 16 bp, Homo sapiens
ccttccgcttggagct

SEQ ID NO: 6113682 - DNA, 17 bp, Homo sapiens
ccttccgtccatccccc

SEQ ID NO: 6113683 - DNA, 18 bp, Homo sapiens
ccttccgtccatccccct

SEQ ID NO: 6113684 - DNA, 21 bp, Homo sapiens
ccttcctaattccacagctgc

SEQ ID NO: 6113685 - DNA, 20 bp, Homo sapiens
ccttcctacacccttggact

SEQ ID NO: 6113686 - DNA, 11 bp, Homo sapiens
ccttcctataa

SEQ ID NO: 6113687 - DNA, 16 bp, Homo sapiens
ccttcctattctcctg

SEQ ID NO: 6113688 - DNA, 21 bp, Homo sapiens
ccttcctattctcctgccatg

SEQ ID NO: 6113689 - DNA, 14 bp, Homo sapiens
ccttcctcagcctg

SEQ ID NO: 6113690 - DNA, 21 bp, Homo sapiens
ccttcctcagctcagctgggc

SEQ ID NO: 6113691 - DNA, 19 bp, Homo sapiens
ccttcctcagctgcctcct

SEQ ID NO: 6113692 - DNA, 12 bp, Homo sapiens
ccttcctcatcc

SEQ ID NO: 6113693 - DNA, 18 bp, Homo sapiens
ccttcctcatccacccca

SEQ ID NO: 6113694 - DNA, 13 bp, Homo sapiens
ccttcctcatccc

SEQ ID NO: 6113695 - DNA, 15 bp, Homo sapiens
ccttcctcatccttc

SEQ ID NO: 6113696 - DNA, 12 bp, Homo sapiens
ccttcctcatct

SEQ ID NO: 6113697 - DNA, 17 bp, Homo sapiens
ccttcctcatctgtgcc

SEQ ID NO: 6113698 - DNA, 21 bp, Homo sapiens
ccttcctccatcctcctcctt

SEQ ID NO: 6113699 - DNA, 20 bp, Homo sapiens
ccttcctccccaacctgcaa

SEQ ID NO: 6113700 - DNA, 14 bp, Homo sapiens
ccttcctccccaca

SEQ ID NO: 6113701 - DNA, 19 bp, Homo sapiens
ccttcctccccacactcca

SEQ ID NO: 6113702 - DNA, 14 bp, Homo sapiens
ccttcctccccgcc

SEQ ID NO: 6113703 - DNA, 19 bp, Homo sapiens
ccttcctccccttttgccc

SEQ ID NO: 6113704 - DNA, 19 bp, Homo sapiens
ccttcctcccggggccttc

SEQ ID NO: 6113705 - DNA, 17 bp, Homo sapiens
ccttcctccctgtctct

SEQ ID NO: 6113706 - DNA, 21 bp, Homo sapiens
ccttcctccgctcccctttcc

SEQ ID NO: 6113707 - DNA, 23 bp, Homo sapiens
ccttcctcctccacagtgctgct

SEQ ID NO: 6113708 - DNA, 16 bp, Homo sapiens
ccttcctcctcctttg

SEQ ID NO: 6113709 - DNA, 14 bp, Homo sapiens
ccttcctcctctca

SEQ ID NO: 6113710 - DNA, 17 bp, Homo sapiens
ccttcctcctctcctgg

SEQ ID NO: 6113711 - DNA, 14 bp, Homo sapiens
ccttcctcctgcct

SEQ ID NO: 6113712 - DNA, 14 bp, Homo sapiens
ccttcctcgcacag

SEQ ID NO: 6113713 - DNA, 15 bp, Homo sapiens
ccttcctcgcagaga

SEQ ID NO: 6113714 - DNA, 17 bp, Homo sapiens
ccttcctcgcagagagg

SEQ ID NO: 6113715 - DNA, 19 bp, Homo sapiens
ccttcctcggtggctctgg

SEQ ID NO: 6113716 - DNA, 21 bp, Homo sapiens
ccttcctcggtggctctgggg

SEQ ID NO: 6113717 - DNA, 17 bp, Homo sapiens
ccttcctcgtgcagagc

SEQ ID NO: 6113718 - DNA, 21 bp, Homo sapiens
ccttcctctccaccctcccag

SEQ ID NO: 6113719 - DNA, 17 bp, Homo sapiens
ccttcctctccactgcc

SEQ ID NO: 6113720 - DNA, 14 bp, Homo sapiens
ccttcctctcccat

SEQ ID NO: 6113721 - DNA, 20 bp, Homo sapiens
ccttcctctgagccttggga

SEQ ID NO: 6113722 - DNA, 14 bp, Homo sapiens
ccttcctctgaggc

SEQ ID NO: 6113723 - DNA, 15 bp, Homo sapiens
ccttcctctgcagct

SEQ ID NO: 6113724 - DNA, 16 bp, Homo sapiens
ccttcctctgcagctg

SEQ ID NO: 6113725 - DNA, 22 bp, Homo sapiens
ccttcctctggggctctagggt

SEQ ID NO: 6113726 - DNA, 15 bp, Homo sapiens
ccttcctctgtcctc

SEQ ID NO: 6113727 - DNA, 12 bp, Homo sapiens
ccttcctcttcg

SEQ ID NO: 6113728 - DNA, 21 bp, Homo sapiens
ccttcctcttgtctgatttct

SEQ ID NO: 6113729 - DNA, 14 bp, Homo sapiens
ccttcctgaagagt

SEQ ID NO: 6113730 - DNA, 17 bp, Homo sapiens
ccttcctgaattcttta

SEQ ID NO: 6113731 - DNA, 12 bp, Homo sapiens
ccttcctgaccc

SEQ ID NO: 6113732 - DNA, 13 bp, Homo sapiens
ccttcctgactgg

SEQ ID NO: 6113733 - DNA, 16 bp, Homo sapiens
ccttcctgactgggaa

SEQ ID NO: 6113734 - DNA, 15 bp, Homo sapiens
ccttcctgcagacct

SEQ ID NO: 6113735 - DNA, 14 bp, Homo sapiens
ccttcctgccacca

SEQ ID NO: 6113736 - DNA, 16 bp, Homo sapiens
ccttcctgccaccagt

SEQ ID NO: 6113737 - DNA, 18 bp, Homo sapiens
ccttcctgccacctgctg

SEQ ID NO: 6113738 - DNA, 17 bp, Homo sapiens
ccttcctgccagcccct

SEQ ID NO: 6113739 - DNA, 18 bp, Homo sapiens
ccttcctggaaacagcat

SEQ ID NO: 6113740 - DNA, 19 bp, Homo sapiens
ccttcctggaaacagcatg

SEQ ID NO: 6113741 - DNA, 13 bp, Homo sapiens
ccttcctggacac

SEQ ID NO: 6113742 - DNA, 17 bp, Homo sapiens
ccttcctggacagctgt

SEQ ID NO: 6113743 - DNA, 22 bp, Homo sapiens
ccttcctggacagctgtgcctc

SEQ ID NO: 6113744 - DNA, 16 bp, Homo sapiens
ccttcctggactggcc

SEQ ID NO: 6113745 - DNA, 17 bp, Homo sapiens
ccttcctggactggccc

SEQ ID NO: 6113746 - DNA, 20 bp, Homo sapiens
ccttcctggagactgcccag

SEQ ID NO: 6113747 - DNA, 14 bp, Homo sapiens
ccttcctggaggct

SEQ ID NO: 6113748 - DNA, 12 bp, Homo sapiens
ccttcctggcac

SEQ ID NO: 6113749 - DNA, 13 bp, Homo sapiens
ccttcctggccca

SEQ ID NO: 6113750 - DNA, 16 bp, Homo sapiens
ccttcctggcccaggc

SEQ ID NO: 6113751 - DNA, 13 bp, Homo sapiens
ccttcctggcccc

SEQ ID NO: 6113752 - DNA, 18 bp, Homo sapiens
ccttcctggcctcactgg

SEQ ID NO: 6113753 - DNA, 13 bp, Homo sapiens
ccttcctggcctg

SEQ ID NO: 6113754 - DNA, 21 bp, Homo sapiens
ccttcctggcgggggtgggcc

SEQ ID NO: 6113755 - DNA, 17 bp, Homo sapiens
ccttcctgggaccccct

SEQ ID NO: 6113756 - DNA, 13 bp, Homo sapiens
ccttcctgggcac

SEQ ID NO: 6113757 - DNA, 21 bp, Homo sapiens
ccttcctgggcacacgctgct

SEQ ID NO: 6113758 - DNA, 23 bp, Homo sapiens
ccttcctgggcacacgctgctct

SEQ ID NO: 6113759 - DNA, 16 bp, Homo sapiens
ccttcctgggcagccc

SEQ ID NO: 6113760 - DNA, 17 bp, Homo sapiens
ccttcctgggcagccca

SEQ ID NO: 6113761 - DNA, 19 bp, Homo sapiens
ccttcctggggcatctggc

SEQ ID NO: 6113762 - DNA, 19 bp, Homo sapiens
ccttcctgtccctgaggtt

SEQ ID NO: 6113763 - DNA, 19 bp, Homo sapiens
ccttcctgtcctgcctcct

SEQ ID NO: 6113764 - DNA, 16 bp, Homo sapiens
ccttcctgtctcactc

SEQ ID NO: 6113765 - DNA, 16 bp, Homo sapiens
ccttcctgtctcccag

SEQ ID NO: 6113766 - DNA, 16 bp, Homo sapiens
ccttcctgtctggccc

SEQ ID NO: 6113767 - DNA, 17 bp, Homo sapiens
ccttcctgtctggccca

SEQ ID NO: 6113768 - DNA, 16 bp, Homo sapiens
ccttcctgttcttcct

SEQ ID NO: 6113769 - DNA, 17 bp, Homo sapiens
ccttcctgtttcagacc

SEQ ID NO: 6113770 - DNA, 21 bp, Homo sapiens
ccttcctgtttcagacccccc

SEQ ID NO: 6113771 - DNA, 17 bp, Homo sapiens
ccttccttcacccacca

SEQ ID NO: 6113772 - DNA, 12 bp, Homo sapiens
ccttccttcagg

SEQ ID NO: 6113773 - DNA, 14 bp, Homo sapiens
ccttccttcaggac

SEQ ID NO: 6113774 - DNA, 14 bp, Homo sapiens
ccttccttccctgg

SEQ ID NO: 6113775 - DNA, 23 bp, Homo sapiens
ccttccttccctggctacttccc

SEQ ID NO: 6113776 - DNA, 13 bp, Homo sapiens
ccttccttctaaa

SEQ ID NO: 6113777 - DNA, 14 bp, Homo sapiens
ccttccttctgctc

SEQ ID NO: 6113778 - DNA, 21 bp, Homo sapiens
ccttccttgaaatttctcagc

SEQ ID NO: 6113779 - DNA, 23 bp, Homo sapiens
ccttccttgaccagcagatccca

SEQ ID NO: 6113780 - DNA, 22 bp, Homo sapiens
ccttccttgactgtctagccac

SEQ ID NO: 6113781 - DNA, 21 bp, Homo sapiens
ccttccttgcgaccaccaaca

SEQ ID NO: 6113782 - DNA, 18 bp, Homo sapiens
ccttccttgtagcctttt

SEQ ID NO: 6113783 - DNA, 22 bp, Homo sapiens
ccttccttgttacccatgaaaa

SEQ ID NO: 6113784 - DNA, 22 bp, Homo sapiens
ccttcctttcctctgcagcact

SEQ ID NO: 6113785 - DNA, 12 bp, Homo sapiens
ccttcctttctc

SEQ ID NO: 6113786 - DNA, 16 bp, Homo sapiens
ccttcctttctccagg

SEQ ID NO: 6113787 - DNA, 17 bp, Homo sapiens
ccttcctttctccagga

SEQ ID NO: 6113788 - DNA, 15 bp, Homo sapiens
ccttcctttctcctg

SEQ ID NO: 6113789 - DNA, 17 bp, Homo sapiens
ccttcctttggtgcctc

SEQ ID NO: 6113790 - DNA, 20 bp, Homo sapiens
ccttccttttactaccattt

SEQ ID NO: 6113791 - DNA, 18 bp, Homo sapiens
ccttccttttccctgctt

SEQ ID NO: 6113792 - DNA, 21 bp, Homo sapiens
ccttccttttccctgcttcca

SEQ ID NO: 6113793 - DNA, 22 bp, Homo sapiens
ccttccttttgaggagctggag

SEQ ID NO: 6113794 - DNA, 22 bp, Homo sapiens
ccttcctttttattcagctaga

SEQ ID NO: 6113795 - DNA, 19 bp, Homo sapiens
ccttcgaaaagaaattgtc

SEQ ID NO: 6113796 - DNA, 15 bp, Homo sapiens
ccttcgacagcattt

SEQ ID NO: 6113797 - DNA, 18 bp, Homo sapiens
ccttcgacatgctgccag

SEQ ID NO: 6113798 - DNA, 19 bp, Homo sapiens
ccttcgacatgctgccagg

SEQ ID NO: 6113799 - DNA, 20 bp, Homo sapiens
ccttcgagggttccaggctg

SEQ ID NO: 6113800 - DNA, 20 bp, Homo sapiens
ccttcgatacaccgggcctg

SEQ ID NO: 6113801 - DNA, 13 bp, Homo sapiens
ccttcgccacctg

SEQ ID NO: 6113802 - DNA, 17 bp, Homo sapiens
ccttcgcggtggaaggc

SEQ ID NO: 6113803 - DNA, 22 bp, Homo sapiens
ccttcgcgtatttcaggattct

SEQ ID NO: 6113804 - DNA, 14 bp, Homo sapiens
ccttcgctcctgtg

SEQ ID NO: 6113805 - DNA, 18 bp, Homo sapiens
ccttcgctgccaggacac

SEQ ID NO: 6113806 - DNA, 19 bp, Homo sapiens
ccttcgctgccaggacacc

SEQ ID NO: 6113807 - DNA, 23 bp, Homo sapiens
ccttcgctgccaggacacctgcc

SEQ ID NO: 6113808 - DNA, 18 bp, Homo sapiens
ccttcgcttcttgcctct

SEQ ID NO: 6113809 - DNA, 23 bp, Homo sapiens
ccttcgcttcttgcctctgtgct

SEQ ID NO: 6113810 - DNA, 21 bp, Homo sapiens
ccttcgcttggagacccacaa

SEQ ID NO: 6113811 - DNA, 18 bp, Homo sapiens
ccttcggccaaacagaca

SEQ ID NO: 6113812 - DNA, 14 bp, Homo sapiens
ccttcggcctccat

SEQ ID NO: 6113813 - DNA, 16 bp, Homo sapiens
ccttcggcctccatcc

SEQ ID NO: 6113814 - DNA, 18 bp, Homo sapiens
ccttcggcctccatcctg

SEQ ID NO: 6113815 - DNA, 15 bp, Homo sapiens
ccttcggcgccttaa

SEQ ID NO: 6113816 - DNA, 15 bp, Homo sapiens
ctaggtgggccagcc

SEQ ID NO: 6113817 - DNA, 21 bp, Homo sapiens
ctaggtgggccagcccctccc

SEQ ID NO: 6113818 - DNA, 18 bp, Homo sapiens
ctaggtgggttgaaagcc

SEQ ID NO: 6113819 - DNA, 19 bp, Homo sapiens
ctaggtgggttgaaagcca

SEQ ID NO: 6113820 - DNA, 23 bp, Homo sapiens
ctaggtgggttgaaagccaagga

SEQ ID NO: 6113821 - DNA, 13 bp, Homo sapiens
ctaggtgtcccca

SEQ ID NO: 6113822 - DNA, 15 bp, Homo sapiens
ctaggtgtccccaac

SEQ ID NO: 6113823 - DNA, 18 bp, Homo sapiens
ctaggttaaagctaaact

SEQ ID NO: 6113824 - DNA, 22 bp, Homo sapiens
ctaggttatacaataacccagt

SEQ ID NO: 6113825 - DNA, 19 bp, Homo sapiens
ctaggttcaaaagaagttg

SEQ ID NO: 6113826 - DNA, 21 bp, Homo sapiens
ctaggttctgtagagccaatt

SEQ ID NO: 6113827 - DNA, 14 bp, Homo sapiens
ctaggttgcagaga

SEQ ID NO: 6113828 - DNA, 19 bp, Homo sapiens
ctaggttggacagccccct

SEQ ID NO: 6113829 - DNA, 18 bp, Homo sapiens
ctaggtttaaaacagcct

SEQ ID NO: 6113830 - DNA, 21 bp, Homo sapiens
ctaggtttaaaacagcctggg

SEQ ID NO: 6113831 - DNA, 22 bp, Homo sapiens
ctaggtttaaaacagcctgggt

SEQ ID NO: 6113832 - DNA, 14 bp, Homo sapiens
ctaggtttaactca

SEQ ID NO: 6113833 - DNA, 19 bp, Homo sapiens
ctaggtttaactcagatca

SEQ ID NO: 6113834 - DNA, 21 bp, Homo sapiens
ctaggtttatctcatttaagc

SEQ ID NO: 6113835 - DNA, 21 bp, Homo sapiens
ctaggtttcagcaacaagact

SEQ ID NO: 6113836 - DNA, 22 bp, Homo sapiens
ctaggtttttcctactgtcctc

SEQ ID NO: 6113837 - DNA, 13 bp, Homo sapiens
ctagtaaaacctt

SEQ ID NO: 6113838 - DNA, 20 bp, Homo sapiens
ctagtaaaaccttgttctat

SEQ ID NO: 6113839 - DNA, 14 bp, Homo sapiens
ctagtaaagacata

SEQ ID NO: 6113840 - DNA, 14 bp, Homo sapiens
ctagtaaaggagga

SEQ ID NO: 6113841 - DNA, 23 bp, Homo sapiens
ctagtaacaatacatgagaaaga

SEQ ID NO: 6113842 - DNA, 20 bp, Homo sapiens
ctagtaaccaaggccctgtc

SEQ ID NO: 6113843 - DNA, 22 bp, Homo sapiens
ctagtaagaagacaaactgctt

SEQ ID NO: 6113844 - DNA, 17 bp, Homo sapiens
ctagtaagtgcctgctg

SEQ ID NO: 6113845 - DNA, 16 bp, Homo sapiens
ctagtaataatgtaat

SEQ ID NO: 6113846 - DNA, 23 bp, Homo sapiens
ctagtaataatgtaatactgtag

SEQ ID NO: 6113847 - DNA, 16 bp, Homo sapiens
ctagtaatactgtctt

SEQ ID NO: 6113848 - DNA, 12 bp, Homo sapiens
ctagtaatatat

SEQ ID NO: 6113849 - DNA, 16 bp, Homo sapiens
ctagtaatatatttaa

SEQ ID NO: 6113850 - DNA, 21 bp, Homo sapiens
ctagtaatgggccaattaaaa

SEQ ID NO: 6113851 - DNA, 16 bp, Homo sapiens
ctagtaattggaaagg

SEQ ID NO: 6113852 - DNA, 12 bp, Homo sapiens
ctagtacaaatt

SEQ ID NO: 6113853 - DNA, 19 bp, Homo sapiens
ctagtacaagtggtaattt

SEQ ID NO: 6113854 - DNA, 17 bp, Homo sapiens
ctagtacaatcttggga

SEQ ID NO: 6113855 - DNA, 13 bp, Homo sapiens
ctagtacactttt

SEQ ID NO: 6113856 - DNA, 16 bp, Homo sapiens
ctagtacataattgat

SEQ ID NO: 6113857 - DNA, 19 bp, Homo sapiens
ctagtacataattgattaa

SEQ ID NO: 6113858 - DNA, 22 bp, Homo sapiens
ctagtacataattgattaaaat

SEQ ID NO: 6113859 - DNA, 21 bp, Homo sapiens
ctagtaccctatagagagggg

SEQ ID NO: 6113860 - DNA, 13 bp, Homo sapiens
ctagtactattac

SEQ ID NO: 6113861 - DNA, 19 bp, Homo sapiens
ctagtactctctgctctag

SEQ ID NO: 6113862 - DNA, 11 bp, Homo sapiens
ctagtactgta

SEQ ID NO: 6113863 - DNA, 17 bp, Homo sapiens
ctagtagaaagaaaatg

SEQ ID NO: 6113864 - DNA, 20 bp, Homo sapiens
ctagtagaaagaaaatgtct

SEQ ID NO: 6113865 - DNA, 22 bp, Homo sapiens
ctagtagaaagaaaatgtctgt

SEQ ID NO: 6113866 - DNA, 14 bp, Homo sapiens
ctagtagaactgga

SEQ ID NO: 6113867 - DNA, 21 bp, Homo sapiens
ctagtagaagaagctttgccg

SEQ ID NO: 6113868 - DNA, 18 bp, Homo sapiens
ctagtagagcaaagactt

SEQ ID NO: 6113869 - DNA, 18 bp, Homo sapiens
ctagtagcaatgtgcctt

SEQ ID NO: 6113870 - DNA, 14 bp, Homo sapiens
ctagtaggagctga

SEQ ID NO: 6113871 - DNA, 18 bp, Homo sapiens
ctagtaggagctgagctt

SEQ ID NO: 6113872 - DNA, 21 bp, Homo sapiens
ctagtaggggtaccactgaat

SEQ ID NO: 6113873 - DNA, 14 bp, Homo sapiens
ctagtagtgtggcc

SEQ ID NO: 6113874 - DNA, 15 bp, Homo sapiens
ctagtagtgtggcct

SEQ ID NO: 6113875 - DNA, 20 bp, Homo sapiens
ctagtagttagaaattaaat

SEQ ID NO: 6113876 - DNA, 18 bp, Homo sapiens
ctagtatacccactgcat

SEQ ID NO: 6113877 - DNA, 21 bp, Homo sapiens
ctagtatattagtttgattta

SEQ ID NO: 6113878 - DNA, 14 bp, Homo sapiens
ctagtatctattgt

SEQ ID NO: 6113879 - DNA, 17 bp, Homo sapiens
ctagtatctattgtgtt

SEQ ID NO: 6113880 - DNA, 14 bp, Homo sapiens
ctagtatctggctg

SEQ ID NO: 6113881 - DNA, 18 bp, Homo sapiens
ctagtatgaaagctgggg

SEQ ID NO: 6113882 - DNA, 16 bp, Homo sapiens
ctagtattctttatta

SEQ ID NO: 6113883 - DNA, 14 bp, Homo sapiens
ctagtattgacaaa

SEQ ID NO: 6113884 - DNA, 17 bp, Homo sapiens
ctagtattgacaaaatg

SEQ ID NO: 6113885 - DNA, 19 bp, Homo sapiens
ctagtatttctatgaaata

SEQ ID NO: 6113886 - DNA, 20 bp, Homo sapiens
ctagtatttctatgaaatat

SEQ ID NO: 6113887 - DNA, 15 bp, Homo sapiens
ctagtatttgaatta

SEQ ID NO: 6113888 - DNA, 23 bp, Homo sapiens
ctagtatttgtatcctggcaaat

SEQ ID NO: 6113889 - DNA, 15 bp, Homo sapiens
ctagtcaactgctgt

SEQ ID NO: 6113890 - DNA, 15 bp, Homo sapiens
ctagtcaagaaaaat

SEQ ID NO: 6113891 - DNA, 15 bp, Homo sapiens
ctagtcaagctcctc

SEQ ID NO: 6113892 - DNA, 19 bp, Homo sapiens
ctagtcaagctcctcctcc

SEQ ID NO: 6113893 - DNA, 20 bp, Homo sapiens
ctagtcaataactctgattt

SEQ ID NO: 6113894 - DNA, 16 bp, Homo sapiens
ctagtcaatcaagtct

SEQ ID NO: 6113895 - DNA, 15 bp, Homo sapiens
ctagtcaatgacatg

SEQ ID NO: 6113896 - DNA, 18 bp, Homo sapiens
ctagtcacataaatggat

SEQ ID NO: 6113897 - DNA, 18 bp, Homo sapiens
ctagtcacatatcaagtc

SEQ ID NO: 6113898 - DNA, 14 bp, Homo sapiens
ctagtcaccagaga

SEQ ID NO: 6113899 - DNA, 23 bp, Homo sapiens
ctagtcaccgacagcggccttga

SEQ ID NO: 6113900 - DNA, 17 bp, Homo sapiens
ctagtcacgcatgcagt

SEQ ID NO: 6113901 - DNA, 14 bp, Homo sapiens
ctagtcactggcag

SEQ ID NO: 6113902 - DNA, 20 bp, Homo sapiens
ctagtcactggcagcctgca

SEQ ID NO: 6113903 - DNA, 14 bp, Homo sapiens
ctagtcagccacat

SEQ ID NO: 6113904 - DNA, 17 bp, Homo sapiens
ctagtcagggcacagct

SEQ ID NO: 6113905 - DNA, 22 bp, Homo sapiens
ctagtcagtaaagatatttgaa

SEQ ID NO: 6113906 - DNA, 23 bp, Homo sapiens
ctagtcatagaaatacctcattc

SEQ ID NO: 6113907 - DNA, 22 bp, Homo sapiens
ctagtcatttgttaatatttct

SEQ ID NO: 6113908 - DNA, 19 bp, Homo sapiens
ctagtccaatcacccccag

SEQ ID NO: 6113909 - DNA, 17 bp, Homo sapiens
ctagtccccaaggcctc

SEQ ID NO: 6113910 - DNA, 20 bp, Homo sapiens
ctagtcccccaaagggcctc

SEQ ID NO: 6113911 - DNA, 17 bp, Homo sapiens
ctagtccccctgttttc

SEQ ID NO: 6113912 - DNA, 14 bp, Homo sapiens
ctagtcccttcccc

SEQ ID NO: 6113913 - DNA, 17 bp, Homo sapiens
ctagtcccttcccctcc

SEQ ID NO: 6113914 - DNA, 22 bp, Homo sapiens
ctagtcccttcccctccctggc

SEQ ID NO: 6113915 - DNA, 17 bp, Homo sapiens
ctagtcctagtgaacct

SEQ ID NO: 6113916 - DNA, 23 bp, Homo sapiens
ctagtcctgggggtaaagccctc

SEQ ID NO: 6113917 - DNA, 20 bp, Homo sapiens
ctagtccttggctggactgt

SEQ ID NO: 6113918 - DNA, 15 bp, Homo sapiens
ctagtcctttactaa

SEQ ID NO: 6113919 - DNA, 18 bp, Homo sapiens
ctagtcgcccctcagagc

SEQ ID NO: 6113920 - DNA, 20 bp, Homo sapiens
ctagtcgtgaatcatttctc

SEQ ID NO: 6113921 - DNA, 13 bp, Homo sapiens
ctagtctctctgg

SEQ ID NO: 6113922 - DNA, 18 bp, Homo sapiens
ctagtctctgatttgcaa

SEQ ID NO: 6113923 - DNA, 21 bp, Homo sapiens
ctagtctcttctcagagcagc

SEQ ID NO: 6113924 - DNA, 20 bp, Homo sapiens
ctagtctggaactgctgctg

SEQ ID NO: 6113925 - DNA, 23 bp, Homo sapiens
ctagtctggaactgctgctgacc

SEQ ID NO: 6113926 - DNA, 17 bp, Homo sapiens
ctagtctgtaactcttt

SEQ ID NO: 6113927 - DNA, 16 bp, Homo sapiens
ctagtctgtgcctcag

SEQ ID NO: 6113928 - DNA, 18 bp, Homo sapiens
ctagtctgtgtgctgtgg

SEQ ID NO: 6113929 - DNA, 15 bp, Homo sapiens
ctagtcttcacaact

SEQ ID NO: 6113930 - DNA, 13 bp, Homo sapiens
ctagtcttttgct

SEQ ID NO: 6113931 - DNA, 14 bp, Homo sapiens
ctagtcttttgctt

SEQ ID NO: 6113932 - DNA, 20 bp, Homo sapiens
ctagtgaaactcgttaattt

SEQ ID NO: 6113933 - DNA, 19 bp, Homo sapiens
ctagtgaaagaggcagctt

SEQ ID NO: 6113934 - DNA, 19 bp, Homo sapiens
ctagtgaaatggctggggc

SEQ ID NO: 6113935 - DNA, 14 bp, Homo sapiens
ctagtgaagaccag

SEQ ID NO: 6113936 - DNA, 21 bp, Homo sapiens
ctagtgaaggcttctctctgt

SEQ ID NO: 6113937 - DNA, 17 bp, Homo sapiens
ctagtgaagtggcctct

SEQ ID NO: 6113938 - DNA, 21 bp, Homo sapiens
ctagtgaagtggcctcttgga

SEQ ID NO: 6113939 - DNA, 19 bp, Homo sapiens
ctagtgaatgtaggctggc

SEQ ID NO: 6113940 - DNA, 21 bp, Homo sapiens
ctagtgaatgtaggctggctt

SEQ ID NO: 6113941 - DNA, 19 bp, Homo sapiens
ctagtgaatttctgaaaga

SEQ ID NO: 6113942 - DNA, 21 bp, Homo sapiens
ctagtgacagccacttggcct

SEQ ID NO: 6113943 - DNA, 16 bp, Homo sapiens
ctagtgacagcttgtg

SEQ ID NO: 6113944 - DNA, 22 bp, Homo sapiens
ctagtgaccatcttcataattt

SEQ ID NO: 6113945 - DNA, 17 bp, Homo sapiens
ctagtgacccacatgcc

SEQ ID NO: 6113946 - DNA, 18 bp, Homo sapiens
ctagtgacccggaggcca

SEQ ID NO: 6113947 - DNA, 23 bp, Homo sapiens
ctagtgactaagccccgcatatg

SEQ ID NO: 6113948 - DNA, 14 bp, Homo sapiens
ctagtgactgggga

SEQ ID NO: 6113949 - DNA, 21 bp, Homo sapiens
ctagtgagcagtcaggaaaga

SEQ ID NO: 6113950 - DNA, 13 bp, Homo sapiens
ctagtgagcctgg

SEQ ID NO: 6113951 - DNA, 17 bp, Homo sapiens
ctagtgagctgggcatg

SEQ ID NO: 6113952 - DNA, 15 bp, Homo sapiens
ctagtgagtcagcac

SEQ ID NO: 6113953 - DNA, 18 bp, Homo sapiens
ctagtgagtcagcacctt

SEQ ID NO: 6113954 - DNA, 19 bp, Homo sapiens
ctagtgagtcagcaccttg

SEQ ID NO: 6113955 - DNA, 23 bp, Homo sapiens
ctagtgatgtagaaagatacact

SEQ ID NO: 6113956 - DNA, 17 bp, Homo sapiens
ctagtgatttacacagg

SEQ ID NO: 6113957 - DNA, 20 bp, Homo sapiens
ctagtgcaattccaagaaaa

SEQ ID NO: 6113958 - DNA, 19 bp, Homo sapiens
ctagtgcagctgaaattga

SEQ ID NO: 6113959 - DNA, 15 bp, Homo sapiens
ctagtgcagctgatt

SEQ ID NO: 6113960 - DNA, 23 bp, Homo sapiens
ctagtgcagctgattttaacaat

SEQ ID NO: 6113961 - DNA, 13 bp, Homo sapiens
ctagtgcatttca

SEQ ID NO: 6113962 - DNA, 19 bp, Homo sapiens
ctagtgcatttcaaggaat

SEQ ID NO: 6113963 - DNA, 16 bp, Homo sapiens
ctagtgccatatattt

SEQ ID NO: 6113964 - DNA, 15 bp, Homo sapiens
ctagtgccccagact

SEQ ID NO: 6113965 - DNA, 16 bp, Homo sapiens
ctagtgccccagactg

SEQ ID NO: 6113966 - DNA, 20 bp, Homo sapiens
ctagtgccccagactgagct

SEQ ID NO: 6113967 - DNA, 15 bp, Homo sapiens
ctagtgctaaaccta

SEQ ID NO: 6113968 - DNA, 16 bp, Homo sapiens
ctagtgctaaacctat

SEQ ID NO: 6113969 - DNA, 21 bp, Homo sapiens
ctagtgctgaagcttattaat

SEQ ID NO: 6113970 - DNA, 22 bp, Homo sapiens
ctagtgctgtaatattgtaaat

SEQ ID NO: 6113971 - DNA, 23 bp, Homo sapiens
ctagtgctgtaatattgtaaata

SEQ ID NO: 6113972 - DNA, 20 bp, Homo sapiens
ctagtggaaagattgtgtct

SEQ ID NO: 6113973 - DNA, 21 bp, Homo sapiens
ctagtggaaagattgtgtctg

SEQ ID NO: 6113974 - DNA, 21 bp, Homo sapiens
ctagtggagggttggagaagg

SEQ ID NO: 6113975 - DNA, 21 bp, Homo sapiens
ctagtggagttttataaatta

SEQ ID NO: 6113976 - DNA, 22 bp, Homo sapiens
ctagtggagttttataaattaa

SEQ ID NO: 6113977 - DNA, 15 bp, Homo sapiens
ctagtggatgactgt

SEQ ID NO: 6113978 - DNA, 16 bp, Homo sapiens
ctagtggatgactgtt

SEQ ID NO: 6113979 - DNA, 22 bp, Homo sapiens
ctagtggcaataagttccatgt

SEQ ID NO: 6113980 - DNA, 18 bp, Homo sapiens
ctagtggccgaaccagaa

SEQ ID NO: 6113981 - DNA, 21 bp, Homo sapiens
ctagtggctctcagttaaaat

SEQ ID NO: 6113982 - DNA, 20 bp, Homo sapiens
ctagtggctgtccagtgccc

SEQ ID NO: 6113983 - DNA, 13 bp, Homo sapiens
ctagtggctgttc

SEQ ID NO: 6113984 - DNA, 14 bp, Homo sapiens
ctagtggcttcagc

SEQ ID NO: 6113985 - DNA, 18 bp, Homo sapiens
ctagtgggacagcccaga

SEQ ID NO: 6113986 - DNA, 23 bp, Homo sapiens
ctagtgggacagcccagagcctg

SEQ ID NO: 6113987 - DNA, 15 bp, Homo sapiens
ctagtgggagcccag

SEQ ID NO: 6113988 - DNA, 16 bp, Homo sapiens
ctagtgggagcccagc

SEQ ID NO: 6113989 - DNA, 18 bp, Homo sapiens
ctagtgggagcccagcac

SEQ ID NO: 6113990 - DNA, 20 bp, Homo sapiens
ctagtgggagcccagcacac

SEQ ID NO: 6113991 - DNA, 20 bp, Homo sapiens
ctagtgggccctctctctgg

SEQ ID NO: 6113992 - DNA, 17 bp, Homo sapiens
ccttcgggaccctgggg

SEQ ID NO: 6113993 - DNA, 19 bp, Homo sapiens
ccttcgggcagtcctgtgt

SEQ ID NO: 6113994 - DNA, 14 bp, Homo sapiens
ccttcgggctgtgc

SEQ ID NO: 6113995 - DNA, 20 bp, Homo sapiens
ccttcggggcgatgctccct

SEQ ID NO: 6113996 - DNA, 23 bp, Homo sapiens
ccttcggggcgatgctccctcag

SEQ ID NO: 6113997 - DNA, 14 bp, Homo sapiens
ccttcggtcacctg

SEQ ID NO: 6113998 - DNA, 15 bp, Homo sapiens
ccttcggtcacctgt

SEQ ID NO: 6113999 - DNA, 19 bp, Homo sapiens
ccttcgtctccatctctgg

SEQ ID NO: 6114000 - DNA, 20 bp, Homo sapiens
ccttcgtctccatctctggt

SEQ ID NO: 6114001 - DNA, 17 bp, Homo sapiens
ccttcgtgtctctccca

SEQ ID NO: 6114002 - DNA, 20 bp, Homo sapiens
ccttcgtgtctctcccaccc

SEQ ID NO: 6114003 - DNA, 22 bp, Homo sapiens
ccttcgtgtctctcccaccccg

SEQ ID NO: 6114004 - DNA, 15 bp, Homo sapiens
ccttcgtgtgctgct

SEQ ID NO: 6114005 - DNA, 16 bp, Homo sapiens
ccttcgtgtgctgctg

SEQ ID NO: 6114006 - DNA, 18 bp, Homo sapiens
ccttcgtgtgctgctgct

SEQ ID NO: 6114007 - DNA, 15 bp, Homo sapiens
ccttcgtgtggctcc

SEQ ID NO: 6114008 - DNA, 17 bp, Homo sapiens
ccttcgtgtggctcctg

SEQ ID NO: 6114009 - DNA, 19 bp, Homo sapiens
ccttcgtgtggctcctggt

SEQ ID NO: 6114010 - DNA, 20 bp, Homo sapiens
ccttcgtgtggctcctggta

SEQ ID NO: 6114011 - DNA, 17 bp, Homo sapiens
ccttcgtttactatgcc

SEQ ID NO: 6114012 - DNA, 22 bp, Homo sapiens
ccttcgtttactatgcctgtgt

SEQ ID NO: 6114013 - DNA, 10 bp, Homo sapiens
ccttctaaaa

SEQ ID NO: 6114014 - DNA, 18 bp, Homo sapiens
ccttctaaattcccaaat

SEQ ID NO: 6114015 - DNA, 20 bp, Homo sapiens
ccttctaacatgttatcaaa

SEQ ID NO: 6114016 - DNA, 20 bp, Homo sapiens
ccttctaagacattctgttg

SEQ ID NO: 6114017 - DNA, 22 bp, Homo sapiens
ccttctaatccatgtgctgctg

SEQ ID NO: 6114018 - DNA, 22 bp, Homo sapiens
ccttctaatctgctatgcttga

SEQ ID NO: 6114019 - DNA, 21 bp, Homo sapiens
ccttctacaaaagaagtgtga

SEQ ID NO: 6114020 - DNA, 14 bp, Homo sapiens
ccttctacaaggac

SEQ ID NO: 6114021 - DNA, 16 bp, Homo sapiens
ccttctacactctcct

SEQ ID NO: 6114022 - DNA, 19 bp, Homo sapiens
ccttctacactctcctggg

SEQ ID NO: 6114023 - DNA, 20 bp, Homo sapiens
ccttctacactctcctgggc

SEQ ID NO: 6114024 - DNA, 20 bp, Homo sapiens
ccttctaccccaaggccagt

SEQ ID NO: 6114025 - DNA, 21 bp, Homo sapiens
ccttctaccccaaggccagta

SEQ ID NO: 6114026 - DNA, 17 bp, Homo sapiens
ccttctaccccacctga

SEQ ID NO: 6114027 - DNA, 14 bp, Homo sapiens
ccttctaccctggg

SEQ ID NO: 6114028 - DNA, 15 bp, Homo sapiens
ccttctaccctgggt

SEQ ID NO: 6114029 - DNA, 12 bp, Homo sapiens
ccttctacctgc

SEQ ID NO: 6114030 - DNA, 14 bp, Homo sapiens
ccttctacctgcca

SEQ ID NO: 6114031 - DNA, 14 bp, Homo sapiens
ccttctactgagcc

SEQ ID NO: 6114032 - DNA, 15 bp, Homo sapiens
ccttctactgagcct

SEQ ID NO: 6114033 - DNA, 14 bp, Homo sapiens
ccttctactgcttc

SEQ ID NO: 6114034 - DNA, 22 bp, Homo sapiens
ccttctacttacacatcttcca

SEQ ID NO: 6114035 - DNA, 16 bp, Homo sapiens
ccttctactttttcct

SEQ ID NO: 6114036 - DNA, 17 bp, Homo sapiens
ccttctactttttcctt

SEQ ID NO: 6114037 - DNA, 13 bp, Homo sapiens
ccttctagaacac

SEQ ID NO: 6114038 - DNA, 20 bp, Homo sapiens
ccttctagaacacctgcctt

SEQ ID NO: 6114039 - DNA, 16 bp, Homo sapiens
ccttctagaacctggg

SEQ ID NO: 6114040 - DNA, 18 bp, Homo sapiens
ccttctagaacctgggct

SEQ ID NO: 6114041 - DNA, 20 bp, Homo sapiens
ccttctagaacctgggctgt

SEQ ID NO: 6114042 - DNA, 22 bp, Homo sapiens
ccttctagaacctgggctgtgc

SEQ ID NO: 6114043 - DNA, 23 bp, Homo sapiens
ccttctagacactgaaggcaaat

SEQ ID NO: 6114044 - DNA, 16 bp, Homo sapiens
ccttctaggcatctcc

SEQ ID NO: 6114045 - DNA, 20 bp, Homo sapiens
ccttctaggcatctcctctc

SEQ ID NO: 6114046 - DNA, 20 bp, Homo sapiens
ccttctagggttattgcatt

SEQ ID NO: 6114047 - DNA, 15 bp, Homo sapiens
ccttctagtgagcct

SEQ ID NO: 6114048 - DNA, 16 bp, Homo sapiens
ccttctagtgagcctg

SEQ ID NO: 6114049 - DNA, 20 bp, Homo sapiens
ccttctagtgagcctgggcc

SEQ ID NO: 6114050 - DNA, 16 bp, Homo sapiens
ccttctatcctctgta

SEQ ID NO: 6114051 - DNA, 22 bp, Homo sapiens
ccttctcacatggaatgagggt

SEQ ID NO: 6114052 - DNA, 16 bp, Homo sapiens
ccttctcaccagctgc

SEQ ID NO: 6114053 - DNA, 18 bp, Homo sapiens
ccttctcaccagctgcaa

SEQ ID NO: 6114054 - DNA, 14 bp, Homo sapiens
ccttctcactgcca

SEQ ID NO: 6114055 - DNA, 15 bp, Homo sapiens
ccttctcagaagcac

SEQ ID NO: 6114056 - DNA, 12 bp, Homo sapiens
ccttctcagcac

SEQ ID NO: 6114057 - DNA, 16 bp, Homo sapiens
ccttctcagccttggt

SEQ ID NO: 6114058 - DNA, 13 bp, Homo sapiens
ccttctcagctct

SEQ ID NO: 6114059 - DNA, 17 bp, Homo sapiens
ccttctcagctctccac

SEQ ID NO: 6114060 - DNA, 15 bp, Homo sapiens
ccttctcaggccccg

SEQ ID NO: 6114061 - DNA, 19 bp, Homo sapiens
ccttctcaggctggcatct

SEQ ID NO: 6114062 - DNA, 20 bp, Homo sapiens
ccttctcaggctggcttgag

SEQ ID NO: 6114063 - DNA, 15 bp, Homo sapiens
ccttctccaaatgag

SEQ ID NO: 6114064 - DNA, 20 bp, Homo sapiens
ccttctccaacaagttgcct

SEQ ID NO: 6114065 - DNA, 13 bp, Homo sapiens
ccttctccagcaa

SEQ ID NO: 6114066 - DNA, 22 bp, Homo sapiens
ccttctccagggacagaagcag

SEQ ID NO: 6114067 - DNA, 11 bp, Homo sapiens
ccttctccatc

SEQ ID NO: 6114068 - DNA, 16 bp, Homo sapiens
ccttctccatccacat

SEQ ID NO: 6114069 - DNA, 18 bp, Homo sapiens
ccttctccatggagtgtt

SEQ ID NO: 6114070 - DNA, 19 bp, Homo sapiens
ccttctccatggccctgcc

SEQ ID NO: 6114071 - DNA, 14 bp, Homo sapiens
ccttctcccacact

SEQ ID NO: 6114072 - DNA, 14 bp, Homo sapiens
ccttctcccactct

SEQ ID NO: 6114073 - DNA, 18 bp, Homo sapiens
ccttctcccactctccta

SEQ ID NO: 6114074 - DNA, 14 bp, Homo sapiens
ccttctcccagcac

SEQ ID NO: 6114075 - DNA, 13 bp, Homo sapiens
ccttctcccaggc

SEQ ID NO: 6114076 - DNA, 14 bp, Homo sapiens
ccttctccccagcc

SEQ ID NO: 6114077 - DNA, 17 bp, Homo sapiens
ccttctccccagccaga

SEQ ID NO: 6114078 - DNA, 20 bp, Homo sapiens
ccttctccccagctcccagg

SEQ ID NO: 6114079 - DNA, 17 bp, Homo sapiens
ccttctcccctcagcca

SEQ ID NO: 6114080 - DNA, 16 bp, Homo sapiens
ccttctcccctccacg

SEQ ID NO: 6114081 - DNA, 20 bp, Homo sapiens
ccttctcccctccagacccc

SEQ ID NO: 6114082 - DNA, 22 bp, Homo sapiens
ccttctcccctccagaccccta

SEQ ID NO: 6114083 - DNA, 22 bp, Homo sapiens
ccttctcccctctcccagggat

SEQ ID NO: 6114084 - DNA, 23 bp, Homo sapiens
ccttctcccctgcactgtaaaat

SEQ ID NO: 6114085 - DNA, 24 bp, Homo sapiens
ccttctcccctgcactgtaaaatg

SEQ ID NO: 6114086 - DNA, 20 bp, Homo sapiens
ccttctccccttcctggaca

SEQ ID NO: 6114087 - DNA, 19 bp, Homo sapiens
ccttctcccttgccctccc

SEQ ID NO: 6114088 - DNA, 21 bp, Homo sapiens
ccttctcctacttagggaaga

SEQ ID NO: 6114089 - DNA, 10 bp, Homo sapiens
ccttctcctc

SEQ ID NO: 6114090 - DNA, 21 bp, Homo sapiens
ccttctcctccccacccgccc

SEQ ID NO: 6114091 - DNA, 19 bp, Homo sapiens
ccttctcctctctgggcct

SEQ ID NO: 6114092 - DNA, 23 bp, Homo sapiens
ccttctcctcttgtagccagaat

SEQ ID NO: 6114093 - DNA, 14 bp, Homo sapiens
ccttctcctgccta

SEQ ID NO: 6114094 - DNA, 17 bp, Homo sapiens
ccttctccttccaactg

SEQ ID NO: 6114095 - DNA, 14 bp, Homo sapiens
ccttctccttccca

SEQ ID NO: 6114096 - DNA, 16 bp, Homo sapiens
ccttctccttccccag

SEQ ID NO: 6114097 - DNA, 21 bp, Homo sapiens
ccttctccttgataacagcta

SEQ ID NO: 6114098 - DNA, 14 bp, Homo sapiens
ccttctcctttcct

SEQ ID NO: 6114099 - DNA, 16 bp, Homo sapiens
ccttctcctttccttc

SEQ ID NO: 6114100 - DNA, 19 bp, Homo sapiens
ccttctcgcattttctcta

SEQ ID NO: 6114101 - DNA, 22 bp, Homo sapiens
ccttctcgcattttctctagct

SEQ ID NO: 6114102 - DNA, 22 bp, Homo sapiens
ccttctcgtgtttgcttaaaat

SEQ ID NO: 6114103 - DNA, 19 bp, Homo sapiens
ccttctctacccatctccc

SEQ ID NO: 6114104 - DNA, 21 bp, Homo sapiens
ccttctctactcatgccagat

SEQ ID NO: 6114105 - DNA, 17 bp, Homo sapiens
ccttctctcaatccctt

SEQ ID NO: 6114106 - DNA, 14 bp, Homo sapiens
ccttctctcagcct

SEQ ID NO: 6114107 - DNA, 15 bp, Homo sapiens
ccttctctcagcctc

SEQ ID NO: 6114108 - DNA, 14 bp, Homo sapiens
ccttctctcagctc

SEQ ID NO: 6114109 - DNA, 20 bp, Homo sapiens
ccttctctcagctcccaggc

SEQ ID NO: 6114110 - DNA, 22 bp, Homo sapiens
ccttctctcagctcccaggcca

SEQ ID NO: 6114111 - DNA, 16 bp, Homo sapiens
ccttctctcatctctt

SEQ ID NO: 6114112 - DNA, 13 bp, Homo sapiens
ccttctctccagc

SEQ ID NO: 6114113 - DNA, 16 bp, Homo sapiens
ccttctctccagcccc

SEQ ID NO: 6114114 - DNA, 11 bp, Homo sapiens
ccttctctctc

SEQ ID NO: 6114115 - DNA, 20 bp, Homo sapiens
ccttctctctcaatttttgg

SEQ ID NO: 6114116 - DNA, 14 bp, Homo sapiens
ccttctctctccag

SEQ ID NO: 6114117 - DNA, 15 bp, Homo sapiens
ccttctctctccaga

SEQ ID NO: 6114118 - DNA, 14 bp, Homo sapiens
ccttctctctctgg

SEQ ID NO: 6114119 - DNA, 15 bp, Homo sapiens
ccttctctctctggt

SEQ ID NO: 6114120 - DNA, 17 bp, Homo sapiens
ccttctctgaacacagg

SEQ ID NO: 6114121 - DNA, 21 bp, Homo sapiens
ccttctctgaacacaggcagc

SEQ ID NO: 6114122 - DNA, 19 bp, Homo sapiens
ccttctctgcccattcccc

SEQ ID NO: 6114123 - DNA, 22 bp, Homo sapiens
ccttctctgcccattccccagc

SEQ ID NO: 6114124 - DNA, 16 bp, Homo sapiens
ccttctctgcccccag

SEQ ID NO: 6114125 - DNA, 21 bp, Homo sapiens
ccttctctgcctcacctggtc

SEQ ID NO: 6114126 - DNA, 16 bp, Homo sapiens
ccttctctgctccacc

SEQ ID NO: 6114127 - DNA, 13 bp, Homo sapiens
ccttctctgggtc

SEQ ID NO: 6114128 - DNA, 18 bp, Homo sapiens
ccttctctgttcatttcc

SEQ ID NO: 6114129 - DNA, 19 bp, Homo sapiens
ccttctctgttcatttcct

SEQ ID NO: 6114130 - DNA, 14 bp, Homo sapiens
ccttctctgttggt

SEQ ID NO: 6114131 - DNA, 14 bp, Homo sapiens
ccttctcttaattt

SEQ ID NO: 6114132 - DNA, 17 bp, Homo sapiens
ccttctcttcacagtca

SEQ ID NO: 6114133 - DNA, 12 bp, Homo sapiens
ccttctcttcca

SEQ ID NO: 6114134 - DNA, 19 bp, Homo sapiens
ccttctcttctcttctttg

SEQ ID NO: 6114135 - DNA, 18 bp, Homo sapiens
ccttctcttttttcagag

SEQ ID NO: 6114136 - DNA, 20 bp, Homo sapiens
ccttctgaaaatatttacat

SEQ ID NO: 6114137 - DNA, 16 bp, Homo sapiens
ccttctgacagcccaa

SEQ ID NO: 6114138 - DNA, 24 bp, Homo sapiens
ccttctgacagcccaacttccaga

SEQ ID NO: 6114139 - DNA, 20 bp, Homo sapiens
ccttctgacccatgctgccc

SEQ ID NO: 6114140 - DNA, 11 bp, Homo sapiens
ccttctgacct

SEQ ID NO: 6114141 - DNA, 16 bp, Homo sapiens
ccttctgacgcagcct

SEQ ID NO: 6114142 - DNA, 21 bp, Homo sapiens
ccttctgacgcagcctgagaa

SEQ ID NO: 6114143 - DNA, 17 bp, Homo sapiens
ccttctgacggccctgc

SEQ ID NO: 6114144 - DNA, 18 bp, Homo sapiens
ccttctgacggccctgca

SEQ ID NO: 6114145 - DNA, 19 bp, Homo sapiens
ccttctgacggccctgcaa

SEQ ID NO: 6114146 - DNA, 14 bp, Homo sapiens
ccttctgactgttt

SEQ ID NO: 6114147 - DNA, 15 bp, Homo sapiens
ccttctgactgttta

SEQ ID NO: 6114148 - DNA, 16 bp, Homo sapiens
ccttctgactgtttat

SEQ ID NO: 6114149 - DNA, 17 bp, Homo sapiens
ccttctgagctccacct

SEQ ID NO: 6114150 - DNA, 21 bp, Homo sapiens
ccttctgagctccacctctgg

SEQ ID NO: 6114151 - DNA, 22 bp, Homo sapiens
ccttctgagctccacctctggt

SEQ ID NO: 6114152 - DNA, 22 bp, Homo sapiens
ccttctgagctcctgtcccctg

SEQ ID NO: 6114153 - DNA, 20 bp, Homo sapiens
ccttctgagctggcctctca

SEQ ID NO: 6114154 - DNA, 22 bp, Homo sapiens
ccttctgatgaagttgtacaac

SEQ ID NO: 6114155 - DNA, 17 bp, Homo sapiens
ccttctgcaaagtggca

SEQ ID NO: 6114156 - DNA, 13 bp, Homo sapiens
ccttctgcaccca

SEQ ID NO: 6114157 - DNA, 18 bp, Homo sapiens
ccttctgcacccagaaat

SEQ ID NO: 6114158 - DNA, 14 bp, Homo sapiens
ccttctgcagcagg

SEQ ID NO: 6114159 - DNA, 15 bp, Homo sapiens
ccttctgcagtcaga

SEQ ID NO: 6114160 - DNA, 18 bp, Homo sapiens
ccttctgcagtcagactg

SEQ ID NO: 6114161 - DNA, 21 bp, Homo sapiens
ccttctgccaaggccagccca

SEQ ID NO: 6114162 - DNA, 12 bp, Homo sapiens
ccttctgccacc

SEQ ID NO: 6114163 - DNA, 16 bp, Homo sapiens
ccttctgccagttccc

SEQ ID NO: 6114164 - DNA, 13 bp, Homo sapiens
ccttctgccctcc

SEQ ID NO: 6114165 - DNA, 15 bp, Homo sapiens
ccttctgccctcctg

SEQ ID NO: 6114166 - DNA, 16 bp, Homo sapiens
ccttctgccctcctgc

SEQ ID NO: 6114167 - DNA, 20 bp, Homo sapiens
ccttctgcccttcctccagg

SEQ ID NO: 6114168 - DNA, 16 bp, Homo sapiens
ccttctgcctgagctt

SEQ ID NO: 6114169 - DNA, 16 bp, Homo sapiens
ccttctgcggccagag

SEQ ID NO: 6114170 - DNA, 13 bp, Homo sapiens
ccttctgctactg

SEQ ID NO: 6114171 - DNA, 17 bp, Homo sapiens
ctagtggggtctccctc

SEQ ID NO: 6114172 - DNA, 23 bp, Homo sapiens
ctagtggggtctccctctcctgc

SEQ ID NO: 6114173 - DNA, 17 bp, Homo sapiens
ctagtggggtttcctgg

SEQ ID NO: 6114174 - DNA, 18 bp, Homo sapiens
ctagtggggtttcctggc

SEQ ID NO: 6114175 - DNA, 16 bp, Homo sapiens
ctagtgggttagtgtg

SEQ ID NO: 6114176 - DNA, 15 bp, Homo sapiens
ctagtggtagtatct

SEQ ID NO: 6114177 - DNA, 20 bp, Homo sapiens
ctagtggtagtatctcgtaa

SEQ ID NO: 6114178 - DNA, 14 bp, Homo sapiens
ctagtggtctcacc

SEQ ID NO: 6114179 - DNA, 17 bp, Homo sapiens
ctagtggtctcacctgg

SEQ ID NO: 6114180 - DNA, 17 bp, Homo sapiens
ctagtggtctttgtaag

SEQ ID NO: 6114181 - DNA, 19 bp, Homo sapiens
ctagtgtaacactgcaaga

SEQ ID NO: 6114182 - DNA, 24 bp, Homo sapiens
ctagtgtaccaagtgcttcctaca

SEQ ID NO: 6114183 - DNA, 19 bp, Homo sapiens
ctagtgtacctcctctcag

SEQ ID NO: 6114184 - DNA, 21 bp, Homo sapiens
ctagtgtacctcctctcagtg

SEQ ID NO: 6114185 - DNA, 13 bp, Homo sapiens
ctagtgtagaatt

SEQ ID NO: 6114186 - DNA, 16 bp, Homo sapiens
ctagtgtagctgccac

SEQ ID NO: 6114187 - DNA, 14 bp, Homo sapiens
ctagtgtcacctgc

SEQ ID NO: 6114188 - DNA, 15 bp, Homo sapiens
ctagtgtcaggcccc

SEQ ID NO: 6114189 - DNA, 20 bp, Homo sapiens
ctagtgtcaggcccccagtg

SEQ ID NO: 6114190 - DNA, 20 bp, Homo sapiens
ctagtgtccataaataaagt

SEQ ID NO: 6114191 - DNA, 22 bp, Homo sapiens
ctagtgtccgcataagaaaaag

SEQ ID NO: 6114192 - DNA, 13 bp, Homo sapiens
ctagtgtctcctc

SEQ ID NO: 6114193 - DNA, 22 bp, Homo sapiens
ctagtgtctgggtttggcccaa

SEQ ID NO: 6114194 - DNA, 12 bp, Homo sapiens
ctagtgtcttat

SEQ ID NO: 6114195 - DNA, 15 bp, Homo sapiens
ctagtgtctttaaat

SEQ ID NO: 6114196 - DNA, 16 bp, Homo sapiens
ctagtgtgagtggcag

SEQ ID NO: 6114197 - DNA, 22 bp, Homo sapiens
ctagtgtgagtggcagccatgc

SEQ ID NO: 6114198 - DNA, 23 bp, Homo sapiens
ctagtgtgagtggcagccatgcc

SEQ ID NO: 6114199 - DNA, 13 bp, Homo sapiens
ctagtgtgcaagt

SEQ ID NO: 6114200 - DNA, 14 bp, Homo sapiens
ctagtgtgcaagtg

SEQ ID NO: 6114201 - DNA, 15 bp, Homo sapiens
ctagtgtggtgtgtt

SEQ ID NO: 6114202 - DNA, 16 bp, Homo sapiens
ctagtgtgtcctgtga

SEQ ID NO: 6114203 - DNA, 17 bp, Homo sapiens
ctagtgtgtgtgctttc

SEQ ID NO: 6114204 - DNA, 17 bp, Homo sapiens
ctagtgttaatccagag

SEQ ID NO: 6114205 - DNA, 18 bp, Homo sapiens
ctagtgttaatccagaga

SEQ ID NO: 6114206 - DNA, 21 bp, Homo sapiens
ctagtgttaatccagagaacc

SEQ ID NO: 6114207 - DNA, 15 bp, Homo sapiens
ctagtgttctgtcta

SEQ ID NO: 6114208 - DNA, 18 bp, Homo sapiens
ctagtgttctgtttgtta

SEQ ID NO: 6114209 - DNA, 17 bp, Homo sapiens
ctagtgtttaaaaggct

SEQ ID NO: 6114210 - DNA, 21 bp, Homo sapiens
ctagtgtttctagctaaataa

SEQ ID NO: 6114211 - DNA, 16 bp, Homo sapiens
ctagtgtttctgcaga

SEQ ID NO: 6114212 - DNA, 15 bp, Homo sapiens
ctagtgtttgattgt

SEQ ID NO: 6114213 - DNA, 14 bp, Homo sapiens
ctagtgtttgttaa

SEQ ID NO: 6114214 - DNA, 22 bp, Homo sapiens
ctagtgttttcaattttaaaca

SEQ ID NO: 6114215 - DNA, 15 bp, Homo sapiens
ctagttaaaagcctt

SEQ ID NO: 6114216 - DNA, 22 bp, Homo sapiens
ctagttaaccaatcgcaaagca

SEQ ID NO: 6114217 - DNA, 23 bp, Homo sapiens
ctagttaaccaatcgcaaagcaa

SEQ ID NO: 6114218 - DNA, 16 bp, Homo sapiens
ctagttacctactttt

SEQ ID NO: 6114219 - DNA, 16 bp, Homo sapiens
ctagttagagactcgc

SEQ ID NO: 6114220 - DNA, 21 bp, Homo sapiens
ctagttagagactcgcctggg

SEQ ID NO: 6114221 - DNA, 23 bp, Homo sapiens
ctagttagcatccaggctggcca

SEQ ID NO: 6114222 - DNA, 15 bp, Homo sapiens
ctagttagctcacaa

SEQ ID NO: 6114223 - DNA, 23 bp, Homo sapiens
ctagttagctcacaagccgtgtt

SEQ ID NO: 6114224 - DNA, 23 bp, Homo sapiens
ctagttagctttaagcaccctag

SEQ ID NO: 6114225 - DNA, 13 bp, Homo sapiens
ctagttaggccac

SEQ ID NO: 6114226 - DNA, 23 bp, Homo sapiens
ctagttatacttatttgtatatg

SEQ ID NO: 6114227 - DNA, 16 bp, Homo sapiens
ctagttattggatcag

SEQ ID NO: 6114228 - DNA, 22 bp, Homo sapiens
ctagttatttacaggaacttca

SEQ ID NO: 6114229 - DNA, 12 bp, Homo sapiens
ctagttatttat

SEQ ID NO: 6114230 - DNA, 16 bp, Homo sapiens
ctagttatttattctg

SEQ ID NO: 6114231 - DNA, 20 bp, Homo sapiens
ctagttcaaatgatgaagac

SEQ ID NO: 6114232 - DNA, 14 bp, Homo sapiens
ctagttcagagcca

SEQ ID NO: 6114233 - DNA, 15 bp, Homo sapiens
ctagttcagagccaa

SEQ ID NO: 6114234 - DNA, 21 bp, Homo sapiens
ctagttcatccaatcctcact

SEQ ID NO: 6114235 - DNA, 24 bp, Homo sapiens
ctagttcatccaatcctcactggg

SEQ ID NO: 6114236 - DNA, 14 bp, Homo sapiens
ctagttccaccatc

SEQ ID NO: 6114237 - DNA, 16 bp, Homo sapiens
ctagttcccctgttta

SEQ ID NO: 6114238 - DNA, 18 bp, Homo sapiens
ctagttcccctgtttatt

SEQ ID NO: 6114239 - DNA, 20 bp, Homo sapiens
ctagttcccctgtttattca

SEQ ID NO: 6114240 - DNA, 20 bp, Homo sapiens
ctagttccctctgctcagcc

SEQ ID NO: 6114241 - DNA, 22 bp, Homo sapiens
ctagttcctgatgacccaggct

SEQ ID NO: 6114242 - DNA, 14 bp, Homo sapiens
ctagttctagaaaa

SEQ ID NO: 6114243 - DNA, 16 bp, Homo sapiens
ctagttctagaaaaac

SEQ ID NO: 6114244 - DNA, 20 bp, Homo sapiens
ctagttctcaatcactgctc

SEQ ID NO: 6114245 - DNA, 13 bp, Homo sapiens
ctagttctcagct

SEQ ID NO: 6114246 - DNA, 16 bp, Homo sapiens
ctagttctcagcttgc

SEQ ID NO: 6114247 - DNA, 19 bp, Homo sapiens
ctagttctcttctcctgtg

SEQ ID NO: 6114248 - DNA, 21 bp, Homo sapiens
ctagttctcttctcctgtgtt

SEQ ID NO: 6114249 - DNA, 16 bp, Homo sapiens
ctagttctgccaggag

SEQ ID NO: 6114250 - DNA, 21 bp, Homo sapiens
ctagttctgctgccctcttaa

SEQ ID NO: 6114251 - DNA, 15 bp, Homo sapiens
ctagttctgttgttt

SEQ ID NO: 6114252 - DNA, 13 bp, Homo sapiens
ctagttctttcct

SEQ ID NO: 6114253 - DNA, 16 bp, Homo sapiens
ctagttctttcctccc

SEQ ID NO: 6114254 - DNA, 18 bp, Homo sapiens
ctagttctttgcattcgt

SEQ ID NO: 6114255 - DNA, 22 bp, Homo sapiens
ctagttctttgttcatagccca

SEQ ID NO: 6114256 - DNA, 17 bp, Homo sapiens
ctagttgaatacttgaa

SEQ ID NO: 6114257 - DNA, 15 bp, Homo sapiens
ctagttgaggagttt

SEQ ID NO: 6114258 - DNA, 21 bp, Homo sapiens
ctagttgatgtatggtatctt

SEQ ID NO: 6114259 - DNA, 12 bp, Homo sapiens
ctagttgcattt

SEQ ID NO: 6114260 - DNA, 18 bp, Homo sapiens
ctagttgcccccattccc

SEQ ID NO: 6114261 - DNA, 20 bp, Homo sapiens
ctagttgcccccattcccag

SEQ ID NO: 6114262 - DNA, 19 bp, Homo sapiens
ctagttggagtgcttgttt

SEQ ID NO: 6114263 - DNA, 18 bp, Homo sapiens
ctagttggtgagaaacct

SEQ ID NO: 6114264 - DNA, 16 bp, Homo sapiens
ctagttggttgaattt

SEQ ID NO: 6114265 - DNA, 13 bp, Homo sapiens
ctagttgtcaata

SEQ ID NO: 6114266 - DNA, 17 bp, Homo sapiens
ctagttgtcaataaatg

SEQ ID NO: 6114267 - DNA, 16 bp, Homo sapiens
ctagtttaaaattatt

SEQ ID NO: 6114268 - DNA, 21 bp, Homo sapiens
ctagtttaaaattattaaaaa

SEQ ID NO: 6114269 - DNA, 16 bp, Homo sapiens
ctagtttactgttttg

SEQ ID NO: 6114270 - DNA, 20 bp, Homo sapiens
ctagtttcacgtaaatattc

SEQ ID NO: 6114271 - DNA, 13 bp, Homo sapiens
ctagtttccagtg

SEQ ID NO: 6114272 - DNA, 18 bp, Homo sapiens
ctagtttcctctccttcg

SEQ ID NO: 6114273 - DNA, 12 bp, Homo sapiens
ctagtttctagg

SEQ ID NO: 6114274 - DNA, 19 bp, Homo sapiens
ctagtttcttacacactgt

SEQ ID NO: 6114275 - DNA, 21 bp, Homo sapiens
ctagtttcttacacactgtct

SEQ ID NO: 6114276 - DNA, 17 bp, Homo sapiens
ctagtttctttctgtta

SEQ ID NO: 6114277 - DNA, 15 bp, Homo sapiens
ctagtttgattaaat

SEQ ID NO: 6114278 - DNA, 21 bp, Homo sapiens
ctagtttgattaaattcttgc

SEQ ID NO: 6114279 - DNA, 20 bp, Homo sapiens
ctagtttgcatacttcctgg

SEQ ID NO: 6114280 - DNA, 15 bp, Homo sapiens
ctagtttgctttttg

SEQ ID NO: 6114281 - DNA, 20 bp, Homo sapiens
ctagtttgtgagaaacatct

SEQ ID NO: 6114282 - DNA, 13 bp, Homo sapiens
ctagttttatctt

SEQ ID NO: 6114283 - DNA, 22 bp, Homo sapiens
ctagttttatcttaaactgttc

SEQ ID NO: 6114284 - DNA, 18 bp, Homo sapiens
ctagttttattttacaga

SEQ ID NO: 6114285 - DNA, 22 bp, Homo sapiens
ctagttttcagctgctcagaat

SEQ ID NO: 6114286 - DNA, 20 bp, Homo sapiens
ctagttttcagtttgtatat

SEQ ID NO: 6114287 - DNA, 20 bp, Homo sapiens
ctagttttccttgaaaaaaa

SEQ ID NO: 6114288 - DNA, 16 bp, Homo sapiens
ctagttttctcctccc

SEQ ID NO: 6114289 - DNA, 18 bp, Homo sapiens
ctagttttctcctcccag

SEQ ID NO: 6114290 - DNA, 19 bp, Homo sapiens
ctagttttctcctcccagg

SEQ ID NO: 6114291 - DNA, 18 bp, Homo sapiens
ctagttttctttcctcct

SEQ ID NO: 6114292 - DNA, 21 bp, Homo sapiens
ctagttttctttcctcctttc

SEQ ID NO: 6114293 - DNA, 13 bp, Homo sapiens
ctagttttgttta

SEQ ID NO: 6114294 - DNA, 13 bp, Homo sapiens
ctagtttttaatt

SEQ ID NO: 6114295 - DNA, 14 bp, Homo sapiens
ctagtttttaattt

SEQ ID NO: 6114296 - DNA, 17 bp, Homo sapiens
ctagtttttcctgtgca

SEQ ID NO: 6114297 - DNA, 18 bp, Homo sapiens
ctagttttttgcttctct

SEQ ID NO: 6114298 - DNA, 18 bp, Homo sapiens
ctagttttttttgtaaac

SEQ ID NO: 6114299 - DNA, 16 bp, Homo sapiens
ctataaaaaagaaaga

SEQ ID NO: 6114300 - DNA, 18 bp, Homo sapiens
ctataaaaaataaaataa

SEQ ID NO: 6114301 - DNA, 23 bp, Homo sapiens
ctataaaaagaaaaaaatggaaa

SEQ ID NO: 6114302 - DNA, 13 bp, Homo sapiens
ctataaaacaggt

SEQ ID NO: 6114303 - DNA, 18 bp, Homo sapiens
ctataaaactaggtgctg

SEQ ID NO: 6114304 - DNA, 13 bp, Homo sapiens
ctataaaactctg

SEQ ID NO: 6114305 - DNA, 15 bp, Homo sapiens
ctataaaactctgca

SEQ ID NO: 6114306 - DNA, 12 bp, Homo sapiens
ctataaaagctt

SEQ ID NO: 6114307 - DNA, 16 bp, Homo sapiens
ctataaaatgtcttca

SEQ ID NO: 6114308 - DNA, 18 bp, Homo sapiens
ctataaaattaaatgcct

SEQ ID NO: 6114309 - DNA, 21 bp, Homo sapiens
ctataaaattaaatgccttgt

SEQ ID NO: 6114310 - DNA, 16 bp, Homo sapiens
ctataaacaattacat

SEQ ID NO: 6114311 - DNA, 19 bp, Homo sapiens
ctataaacatgatgtcaac

SEQ ID NO: 6114312 - DNA, 12 bp, Homo sapiens
ctataaacatta

SEQ ID NO: 6114313 - DNA, 17 bp, Homo sapiens
ctataaactactgtaat

SEQ ID NO: 6114314 - DNA, 19 bp, Homo sapiens
ctataaacttaagggcaag

SEQ ID NO: 6114315 - DNA, 21 bp, Homo sapiens
ctataaacttaagggcaagga

SEQ ID NO: 6114316 - DNA, 14 bp, Homo sapiens
ctataaagaaactt

SEQ ID NO: 6114317 - DNA, 15 bp, Homo sapiens
ctataaagaaacttt

SEQ ID NO: 6114318 - DNA, 13 bp, Homo sapiens
ctataaagagaag

SEQ ID NO: 6114319 - DNA, 14 bp, Homo sapiens
ctataaagcagtat

SEQ ID NO: 6114320 - DNA, 18 bp, Homo sapiens
ctataaagcagtattttt

SEQ ID NO: 6114321 - DNA, 16 bp, Homo sapiens
ctataaagggtcaggc

SEQ ID NO: 6114322 - DNA, 20 bp, Homo sapiens
ctataaagtgcctcggacag

SEQ ID NO: 6114323 - DNA, 14 bp, Homo sapiens
ctataaatacaaat

SEQ ID NO: 6114324 - DNA, 13 bp, Homo sapiens
ctataaatagatt

SEQ ID NO: 6114325 - DNA, 17 bp, Homo sapiens
ctataaatagtattcca

SEQ ID NO: 6114326 - DNA, 17 bp, Homo sapiens
ctataaatagtgaaaat

SEQ ID NO: 6114327 - DNA, 23 bp, Homo sapiens
ctataaatatatatttttaaaat

SEQ ID NO: 6114328 - DNA, 15 bp, Homo sapiens
ctataaatcagtatt

SEQ ID NO: 6114329 - DNA, 17 bp, Homo sapiens
ctataaatcagtatttt

SEQ ID NO: 6114330 - DNA, 14 bp, Homo sapiens
ctataaatgaatgt

SEQ ID NO: 6114331 - DNA, 11 bp, Homo sapiens
ctataaatgac

SEQ ID NO: 6114332 - DNA, 14 bp, Homo sapiens
ctataaatgccaga

SEQ ID NO: 6114333 - DNA, 16 bp, Homo sapiens
ctataaatgccagagc

SEQ ID NO: 6114334 - DNA, 18 bp, Homo sapiens
ctataaatgccagagcca

SEQ ID NO: 6114335 - DNA, 19 bp, Homo sapiens
ctataaatgccagagccaa

SEQ ID NO: 6114336 - DNA, 20 bp, Homo sapiens
ctataaatgccagagccaac

SEQ ID NO: 6114337 - DNA, 22 bp, Homo sapiens
ctataaatgccagagccaacct

SEQ ID NO: 6114338 - DNA, 13 bp, Homo sapiens
ctataaattatat

SEQ ID NO: 6114339 - DNA, 15 bp, Homo sapiens
ctataaattgtagaa

SEQ ID NO: 6114340 - DNA, 21 bp, Homo sapiens
ctataaattgtagaacataga

SEQ ID NO: 6114341 - DNA, 22 bp, Homo sapiens
ctataaattgtagaacatagat

SEQ ID NO: 6114342 - DNA, 22 bp, Homo sapiens
ctataacaaaaaaagaaaagag

SEQ ID NO: 6114343 - DNA, 22 bp, Homo sapiens
ctataacaaatgctttattatt

SEQ ID NO: 6114344 - DNA, 18 bp, Homo sapiens
ctataacaactctatttt

SEQ ID NO: 6114345 - DNA, 15 bp, Homo sapiens
ctataacaatcactg

SEQ ID NO: 6114346 - DNA, 18 bp, Homo sapiens
ctataacaatcactggct

SEQ ID NO: 6114347 - DNA, 20 bp, Homo sapiens
ctataacacctgccaccact

SEQ ID NO: 6114348 - DNA, 19 bp, Homo sapiens
ctataacactgtgaagagc

SEQ ID NO: 6114349 - DNA, 17 bp, Homo sapiens
ccttctgctcagctctg

SEQ ID NO: 6114350 - DNA, 17 bp, Homo sapiens
ccttctgctgaaagact

SEQ ID NO: 6114351 - DNA, 16 bp, Homo sapiens
ccttctgctgcccagg

SEQ ID NO: 6114352 - DNA, 17 bp, Homo sapiens
ccttctgctgcccaggc

SEQ ID NO: 6114353 - DNA, 20 bp, Homo sapiens
ccttctgctgcccaggccac

SEQ ID NO: 6114354 - DNA, 22 bp, Homo sapiens
ccttctgctgcccaggccacag

SEQ ID NO: 6114355 - DNA, 20 bp, Homo sapiens
ccttctgctggataaaatga

SEQ ID NO: 6114356 - DNA, 21 bp, Homo sapiens
ccttctgctggataaaatgag

SEQ ID NO: 6114357 - DNA, 14 bp, Homo sapiens
ccttctgcttctcc

SEQ ID NO: 6114358 - DNA, 16 bp, Homo sapiens
ccttctggaaactgtg

SEQ ID NO: 6114359 - DNA, 22 bp, Homo sapiens
ccttctggaataaggagaatga

SEQ ID NO: 6114360 - DNA, 18 bp, Homo sapiens
ccttctggagctgggaga

SEQ ID NO: 6114361 - DNA, 22 bp, Homo sapiens
ccttctggagctgggagacaaa

SEQ ID NO: 6114362 - DNA, 22 bp, Homo sapiens
ccttctggaggacacacagtct

SEQ ID NO: 6114363 - DNA, 15 bp, Homo sapiens
ccttctggatccatg

SEQ ID NO: 6114364 - DNA, 17 bp, Homo sapiens
ccttctggatccatggg

SEQ ID NO: 6114365 - DNA, 17 bp, Homo sapiens
ccttctggattcttggc

SEQ ID NO: 6114366 - DNA, 21 bp, Homo sapiens
ccttctggattcttggcccgc

SEQ ID NO: 6114367 - DNA, 20 bp, Homo sapiens
ccttctggccgctgcagtca

SEQ ID NO: 6114368 - DNA, 18 bp, Homo sapiens
ccttctggcctctgctga

SEQ ID NO: 6114369 - DNA, 16 bp, Homo sapiens
ccttctggccttgtaa

SEQ ID NO: 6114370 - DNA, 14 bp, Homo sapiens
ccttctggctccaa

SEQ ID NO: 6114371 - DNA, 17 bp, Homo sapiens
ccttctggctgctgcag

SEQ ID NO: 6114372 - DNA, 12 bp, Homo sapiens
ccttctgggaaa

SEQ ID NO: 6114373 - DNA, 13 bp, Homo sapiens
ccttctgggaaac

SEQ ID NO: 6114374 - DNA, 16 bp, Homo sapiens
ccttctgggaactctc

SEQ ID NO: 6114375 - DNA, 19 bp, Homo sapiens
ccttctgggcatctgttct

SEQ ID NO: 6114376 - DNA, 22 bp, Homo sapiens
ccttctgggcatctgttctggt

SEQ ID NO: 6114377 - DNA, 13 bp, Homo sapiens
ccttctgggcttt

SEQ ID NO: 6114378 - DNA, 23 bp, Homo sapiens
ccttctggggagggacacagagg

SEQ ID NO: 6114379 - DNA, 13 bp, Homo sapiens
ccttctgtagcct

SEQ ID NO: 6114380 - DNA, 17 bp, Homo sapiens
ccttctgtagttttatc

SEQ ID NO: 6114381 - DNA, 14 bp, Homo sapiens
ccttctgtccacca

SEQ ID NO: 6114382 - DNA, 17 bp, Homo sapiens
ccttctgtccaccagac

SEQ ID NO: 6114383 - DNA, 14 bp, Homo sapiens
ccttctgtccccag

SEQ ID NO: 6114384 - DNA, 15 bp, Homo sapiens
ccttctgtccccagc

SEQ ID NO: 6114385 - DNA, 18 bp, Homo sapiens
ccttctgtccctcacagc

SEQ ID NO: 6114386 - DNA, 17 bp, Homo sapiens
ccttctgtcctggtgtc

SEQ ID NO: 6114387 - DNA, 18 bp, Homo sapiens
ccttctgtcctggtgtca

SEQ ID NO: 6114388 - DNA, 14 bp, Homo sapiens
ccttctgtcgtccc

SEQ ID NO: 6114389 - DNA, 21 bp, Homo sapiens
ccttctgtcgtccccagacca

SEQ ID NO: 6114390 - DNA, 13 bp, Homo sapiens
ccttctgtctctt

SEQ ID NO: 6114391 - DNA, 14 bp, Homo sapiens
ccttctgtgaagaa

SEQ ID NO: 6114392 - DNA, 21 bp, Homo sapiens
ccttctgtgaagaagccctgt

SEQ ID NO: 6114393 - DNA, 22 bp, Homo sapiens
ccttctgtgaagaagccctgtt

SEQ ID NO: 6114394 - DNA, 16 bp, Homo sapiens
ccttctgtgagataaa

SEQ ID NO: 6114395 - DNA, 13 bp, Homo sapiens
ccttctgtgcatc

SEQ ID NO: 6114396 - DNA, 17 bp, Homo sapiens
ccttctgtgcatctggc

SEQ ID NO: 6114397 - DNA, 15 bp, Homo sapiens
ccttctgtgcccagc

SEQ ID NO: 6114398 - DNA, 16 bp, Homo sapiens
ccttctgtgcccagct

SEQ ID NO: 6114399 - DNA, 18 bp, Homo sapiens
ccttctgtgcccagctca

SEQ ID NO: 6114400 - DNA, 19 bp, Homo sapiens
ccttctgtgcccagctcag

SEQ ID NO: 6114401 - DNA, 12 bp, Homo sapiens
ccttctgtgggg

SEQ ID NO: 6114402 - DNA, 20 bp, Homo sapiens
ccttctgtggggactccggc

SEQ ID NO: 6114403 - DNA, 19 bp, Homo sapiens
ccttctgtggggctgggca

SEQ ID NO: 6114404 - DNA, 20 bp, Homo sapiens
ccttctgtggggctgggcac

SEQ ID NO: 6114405 - DNA, 22 bp, Homo sapiens
ccttctgtggggctgggcaccg

SEQ ID NO: 6114406 - DNA, 13 bp, Homo sapiens
ccttctgttaaga

SEQ ID NO: 6114407 - DNA, 19 bp, Homo sapiens
ccttctgttaagaaaggat

SEQ ID NO: 6114408 - DNA, 19 bp, Homo sapiens
ccttctgttttccaaagga

SEQ ID NO: 6114409 - DNA, 18 bp, Homo sapiens
ccttcttatatctgaaga

SEQ ID NO: 6114410 - DNA, 19 bp, Homo sapiens
ccttcttattctcactcca

SEQ ID NO: 6114411 - DNA, 23 bp, Homo sapiens
ccttcttcaaacaggaatttctg

SEQ ID NO: 6114412 - DNA, 23 bp, Homo sapiens
ccttcttcacccagctaatctgt

SEQ ID NO: 6114413 - DNA, 18 bp, Homo sapiens
ccttcttcagcaggaagg

SEQ ID NO: 6114414 - DNA, 19 bp, Homo sapiens
ccttcttcagcaggaaggg

SEQ ID NO: 6114415 - DNA, 18 bp, Homo sapiens
ccttcttcaggctgccta

SEQ ID NO: 6114416 - DNA, 16 bp, Homo sapiens
ccttcttcagggcctg

SEQ ID NO: 6114417 - DNA, 19 bp, Homo sapiens
ccttcttccatcccaggac

SEQ ID NO: 6114418 - DNA, 22 bp, Homo sapiens
ccttcttccatcccaggacacc

SEQ ID NO: 6114419 - DNA, 12 bp, Homo sapiens
ccttcttcccaa

SEQ ID NO: 6114420 - DNA, 14 bp, Homo sapiens
ccttcttcccgccc

SEQ ID NO: 6114421 - DNA, 16 bp, Homo sapiens
ccttcttccctgtttt

SEQ ID NO: 6114422 - DNA, 21 bp, Homo sapiens
ccttcttcggggaactcctgg

SEQ ID NO: 6114423 - DNA, 12 bp, Homo sapiens
ccttcttctgag

SEQ ID NO: 6114424 - DNA, 14 bp, Homo sapiens
ccttcttgccctga

SEQ ID NO: 6114425 - DNA, 18 bp, Homo sapiens
ccttcttgcctgctgggc

SEQ ID NO: 6114426 - DNA, 15 bp, Homo sapiens
ccttcttgctgccca

SEQ ID NO: 6114427 - DNA, 16 bp, Homo sapiens
ccttcttgctgccctg

SEQ ID NO: 6114428 - DNA, 15 bp, Homo sapiens
ccttcttggcttcct

SEQ ID NO: 6114429 - DNA, 16 bp, Homo sapiens
ccttcttggcttcctg

SEQ ID NO: 6114430 - DNA, 17 bp, Homo sapiens
ccttcttggcttcctgg

SEQ ID NO: 6114431 - DNA, 15 bp, Homo sapiens
ccttcttggcttctg

SEQ ID NO: 6114432 - DNA, 16 bp, Homo sapiens
ccttcttggcttctgg

SEQ ID NO: 6114433 - DNA, 18 bp, Homo sapiens
ccttcttggcttctggga

SEQ ID NO: 6114434 - DNA, 14 bp, Homo sapiens
ccttcttgggactg

SEQ ID NO: 6114435 - DNA, 19 bp, Homo sapiens
ccttcttgggactgctgtg

SEQ ID NO: 6114436 - DNA, 17 bp, Homo sapiens
ccttcttgggccccaga

SEQ ID NO: 6114437 - DNA, 19 bp, Homo sapiens
ccttcttgggtctgccctg

SEQ ID NO: 6114438 - DNA, 17 bp, Homo sapiens
ccttctttaaatcaaaa

SEQ ID NO: 6114439 - DNA, 21 bp, Homo sapiens
ccttctttaaatcaaaagctg

SEQ ID NO: 6114440 - DNA, 16 bp, Homo sapiens
ccttctttaccttcat

SEQ ID NO: 6114441 - DNA, 23 bp, Homo sapiens
ccttctttcactctgtcatcttt

SEQ ID NO: 6114442 - DNA, 19 bp, Homo sapiens
ccttctttccatttctctc

SEQ ID NO: 6114443 - DNA, 13 bp, Homo sapiens
ccttctttccttc

SEQ ID NO: 6114444 - DNA, 17 bp, Homo sapiens
ccttctttccttccttt

SEQ ID NO: 6114445 - DNA, 13 bp, Homo sapiens
ccttctttctacc

SEQ ID NO: 6114446 - DNA, 19 bp, Homo sapiens
ccttctttctaccctgctg

SEQ ID NO: 6114447 - DNA, 20 bp, Homo sapiens
ccttctttctagagagggaa

SEQ ID NO: 6114448 - DNA, 20 bp, Homo sapiens
ccttctttctcttccctcct

SEQ ID NO: 6114449 - DNA, 17 bp, Homo sapiens
ccttctttctggactgg

SEQ ID NO: 6114450 - DNA, 19 bp, Homo sapiens
ccttctttgataatgttaa

SEQ ID NO: 6114451 - DNA, 15 bp, Homo sapiens
ccttctttgcagggc

SEQ ID NO: 6114452 - DNA, 16 bp, Homo sapiens
ccttctttgcagggct

SEQ ID NO: 6114453 - DNA, 19 bp, Homo sapiens
ccttcttttctcatgtgtt

SEQ ID NO: 6114454 - DNA, 21 bp, Homo sapiens
ccttcttttgaccccttcctg

SEQ ID NO: 6114455 - DNA, 16 bp, Homo sapiens
ccttctttttctggac

SEQ ID NO: 6114456 - DNA, 12 bp, Homo sapiens
ccttgaaaaaaa

SEQ ID NO: 6114457 - DNA, 19 bp, Homo sapiens
ccttgaaaacaaacaaatc

SEQ ID NO: 6114458 - DNA, 21 bp, Homo sapiens
ccttgaaagtcatgaacacat

SEQ ID NO: 6114459 - DNA, 18 bp, Homo sapiens
ccttgaaatttacacagt

SEQ ID NO: 6114460 - DNA, 20 bp, Homo sapiens
ccttgaacaaaaagtttttt

SEQ ID NO: 6114461 - DNA, 20 bp, Homo sapiens
ccttgaacactgggggaggg

SEQ ID NO: 6114462 - DNA, 15 bp, Homo sapiens
ccttgaaccacttcc

SEQ ID NO: 6114463 - DNA, 18 bp, Homo sapiens
ccttgaaccacttccctc

SEQ ID NO: 6114464 - DNA, 15 bp, Homo sapiens
ccttgaacccaacag

SEQ ID NO: 6114465 - DNA, 16 bp, Homo sapiens
ccttgaaccctaataa

SEQ ID NO: 6114466 - DNA, 21 bp, Homo sapiens
ccttgaacctgtgagtaaata

SEQ ID NO: 6114467 - DNA, 14 bp, Homo sapiens
ccttgaactcctgg

SEQ ID NO: 6114468 - DNA, 14 bp, Homo sapiens
ccttgaactgaggc

SEQ ID NO: 6114469 - DNA, 17 bp, Homo sapiens
ccttgaactgaggccct

SEQ ID NO: 6114470 - DNA, 18 bp, Homo sapiens
ccttgaactgaggccctg

SEQ ID NO: 6114471 - DNA, 20 bp, Homo sapiens
ccttgaactgaggccctgtg

SEQ ID NO: 6114472 - DNA, 15 bp, Homo sapiens
ccttgaagacagagc

SEQ ID NO: 6114473 - DNA, 23 bp, Homo sapiens
ccttgaagatatcttgaaatgaa

SEQ ID NO: 6114474 - DNA, 11 bp, Homo sapiens
ccttgaagcaa

SEQ ID NO: 6114475 - DNA, 16 bp, Homo sapiens
ccttgaagcaataact

SEQ ID NO: 6114476 - DNA, 17 bp, Homo sapiens
ccttgaagcaataactc

SEQ ID NO: 6114477 - DNA, 13 bp, Homo sapiens
ccttgaaggacta

SEQ ID NO: 6114478 - DNA, 11 bp, Homo sapiens
ccttgaagtgt

SEQ ID NO: 6114479 - DNA, 12 bp, Homo sapiens
ccttgaagtgtt

SEQ ID NO: 6114480 - DNA, 15 bp, Homo sapiens
ccttgaagttgtgga

SEQ ID NO: 6114481 - DNA, 19 bp, Homo sapiens
ccttgaagttgtggaggag

SEQ ID NO: 6114482 - DNA, 18 bp, Homo sapiens
ccttgaatccagaacaca

SEQ ID NO: 6114483 - DNA, 23 bp, Homo sapiens
ccttgaatcttctcccttgtcct

SEQ ID NO: 6114484 - DNA, 22 bp, Homo sapiens
ccttgaattcttttcctctctt

SEQ ID NO: 6114485 - DNA, 14 bp, Homo sapiens
ccttgaatttctag

SEQ ID NO: 6114486 - DNA, 23 bp, Homo sapiens
ccttgacaaagtcaagccacatg

SEQ ID NO: 6114487 - DNA, 16 bp, Homo sapiens
ccttgacaacagactg

SEQ ID NO: 6114488 - DNA, 17 bp, Homo sapiens
ccttgacaacagactga

SEQ ID NO: 6114489 - DNA, 15 bp, Homo sapiens
ccttgacaactggca

SEQ ID NO: 6114490 - DNA, 21 bp, Homo sapiens
ccttgacaactggcaggcagg

SEQ ID NO: 6114491 - DNA, 22 bp, Homo sapiens
ccttgacaatgttgtcctcctg

SEQ ID NO: 6114492 - DNA, 12 bp, Homo sapiens
ccttgacagagc

SEQ ID NO: 6114493 - DNA, 15 bp, Homo sapiens
ccttgacagggcaca

SEQ ID NO: 6114494 - DNA, 21 bp, Homo sapiens
ccttgacagggcacaccgggc

SEQ ID NO: 6114495 - DNA, 23 bp, Homo sapiens
ccttgacattgtagagcttctgg

SEQ ID NO: 6114496 - DNA, 18 bp, Homo sapiens
ccttgaccactggccctg

SEQ ID NO: 6114497 - DNA, 20 bp, Homo sapiens
ccttgaccagcagatcccag

SEQ ID NO: 6114498 - DNA, 12 bp, Homo sapiens
ccttgaccaggc

SEQ ID NO: 6114499 - DNA, 16 bp, Homo sapiens
ccttgaccaggcctgg

SEQ ID NO: 6114500 - DNA, 21 bp, Homo sapiens
ccttgaccattctccacctgc

SEQ ID NO: 6114501 - DNA, 23 bp, Homo sapiens
ccttgaccattctccacctgcca

SEQ ID NO: 6114502 - DNA, 14 bp, Homo sapiens
ccttgaccattggc

SEQ ID NO: 6114503 - DNA, 14 bp, Homo sapiens
ccttgaccccacac

SEQ ID NO: 6114504 - DNA, 23 bp, Homo sapiens
ccttgaccctgaaaggaacactg

SEQ ID NO: 6114505 - DNA, 13 bp, Homo sapiens
ccttgaccttcct

SEQ ID NO: 6114506 - DNA, 15 bp, Homo sapiens
ccttgacctttgtac

SEQ ID NO: 6114507 - DNA, 16 bp, Homo sapiens
ccttgacctttgtaca

SEQ ID NO: 6114508 - DNA, 17 bp, Homo sapiens
ccttgacctttgtacag

SEQ ID NO: 6114509 - DNA, 13 bp, Homo sapiens
ccttgactgaagc

SEQ ID NO: 6114510 - DNA, 21 bp, Homo sapiens
ccttgactgaagcgaacatct

SEQ ID NO: 6114511 - DNA, 22 bp, Homo sapiens
ccttgactgccgcatcatggga

SEQ ID NO: 6114512 - DNA, 18 bp, Homo sapiens
ccttgactgtacagagac

SEQ ID NO: 6114513 - DNA, 23 bp, Homo sapiens
ccttgactgtacagagactctat

SEQ ID NO: 6114514 - DNA, 13 bp, Homo sapiens
ccttgactgtcta

SEQ ID NO: 6114515 - DNA, 18 bp, Homo sapiens
ccttgactgtctagccac

SEQ ID NO: 6114516 - DNA, 22 bp, Homo sapiens
ccttgactgtctagccactccc

SEQ ID NO: 6114517 - DNA, 21 bp, Homo sapiens
ccttgactgttgatgtactga

SEQ ID NO: 6114518 - DNA, 20 bp, Homo sapiens
ccttgactttgaactaatga

SEQ ID NO: 6114519 - DNA, 20 bp, Homo sapiens
ccttgactttgctcctcaca

SEQ ID NO: 6114520 - DNA, 13 bp, Homo sapiens
ccttgacttttta

SEQ ID NO: 6114521 - DNA, 17 bp, Homo sapiens
ccttgagaattccctgt

SEQ ID NO: 6114522 - DNA, 22 bp, Homo sapiens
ccttgagacccccaagcttcca

SEQ ID NO: 6114523 - DNA, 20 bp, Homo sapiens
ccttgagaccctcttctctg

SEQ ID NO: 6114524 - DNA, 15 bp, Homo sapiens
ccttgagactggagc

SEQ ID NO: 6114525 - DNA, 20 bp, Homo sapiens
ccttgagagaccaggcaaag

SEQ ID NO: 6114526 - DNA, 21 bp, Homo sapiens
ccttgagagaccaggcaaagc

SEQ ID NO: 6114527 - DNA, 22 bp, Homo sapiens
ctataacagaaagtttgtaaaa

SEQ ID NO: 6114528 - DNA, 16 bp, Homo sapiens
ctataacatatttatt

SEQ ID NO: 6114529 - DNA, 14 bp, Homo sapiens
ctataacatgtctt

SEQ ID NO: 6114530 - DNA, 16 bp, Homo sapiens
ctataacattctgaca

SEQ ID NO: 6114531 - DNA, 20 bp, Homo sapiens
ctataacatttgctgaatat

SEQ ID NO: 6114532 - DNA, 16 bp, Homo sapiens
ctataacccctgcctg

SEQ ID NO: 6114533 - DNA, 17 bp, Homo sapiens
ctataacccctgcctgg

SEQ ID NO: 6114534 - DNA, 15 bp, Homo sapiens
ctataacctaaatga

SEQ ID NO: 6114535 - DNA, 20 bp, Homo sapiens
ctataactacatattgaata

SEQ ID NO: 6114536 - DNA, 23 bp, Homo sapiens
ctataactgtcatctagcccctt

SEQ ID NO: 6114537 - DNA, 15 bp, Homo sapiens
ctataacttgatgca

SEQ ID NO: 6114538 - DNA, 17 bp, Homo sapiens
ctataacttgatgcatg

SEQ ID NO: 6114539 - DNA, 13 bp, Homo sapiens
ctataactttttt

SEQ ID NO: 6114540 - DNA, 12 bp, Homo sapiens
ctataagaaaaa

SEQ ID NO: 6114541 - DNA, 16 bp, Homo sapiens
ctataagaaaagtgaa

SEQ ID NO: 6114542 - DNA, 20 bp, Homo sapiens
ctataagaaaagtgaaagta

SEQ ID NO: 6114543 - DNA, 17 bp, Homo sapiens
ctataagaactttgagc

SEQ ID NO: 6114544 - DNA, 17 bp, Homo sapiens
ctataagaagccttaat

SEQ ID NO: 6114545 - DNA, 15 bp, Homo sapiens
ctataagaagtagca

SEQ ID NO: 6114546 - DNA, 20 bp, Homo sapiens
ctataagaataaggcttttt

SEQ ID NO: 6114547 - DNA, 21 bp, Homo sapiens
ctataagaggaatttcttttc

SEQ ID NO: 6114548 - DNA, 20 bp, Homo sapiens
ctataagatacaataaaaca

SEQ ID NO: 6114549 - DNA, 21 bp, Homo sapiens
ctataagatacaataaaacaa

SEQ ID NO: 6114550 - DNA, 23 bp, Homo sapiens
ctataagattccaaaaagcacat

SEQ ID NO: 6114551 - DNA, 21 bp, Homo sapiens
ctataagcaaattgctttttt

SEQ ID NO: 6114552 - DNA, 22 bp, Homo sapiens
ctataagcaagaaggcaaaaat

SEQ ID NO: 6114553 - DNA, 17 bp, Homo sapiens
ctataagccaaaattaa

SEQ ID NO: 6114554 - DNA, 19 bp, Homo sapiens
ctataagcttaaataggaa

SEQ ID NO: 6114555 - DNA, 22 bp, Homo sapiens
ctataagcttaaataggaaagt

SEQ ID NO: 6114556 - DNA, 16 bp, Homo sapiens
ctataaggctgagggc

SEQ ID NO: 6114557 - DNA, 22 bp, Homo sapiens
ctataaggtgctctctttctgt

SEQ ID NO: 6114558 - DNA, 16 bp, Homo sapiens
ctataagtagttggtt

SEQ ID NO: 6114559 - DNA, 15 bp, Homo sapiens
ctataagtatataaa

SEQ ID NO: 6114560 - DNA, 14 bp, Homo sapiens
ctataataaaggct

SEQ ID NO: 6114561 - DNA, 13 bp, Homo sapiens
ctataataagttt

SEQ ID NO: 6114562 - DNA, 19 bp, Homo sapiens
ctataataagttttgatat

SEQ ID NO: 6114563 - DNA, 17 bp, Homo sapiens
ctataatacttgcaact

SEQ ID NO: 6114564 - DNA, 19 bp, Homo sapiens
ctataatacttgcaactaa

SEQ ID NO: 6114565 - DNA, 21 bp, Homo sapiens
ctataatcattagttttagag

SEQ ID NO: 6114566 - DNA, 14 bp, Homo sapiens
ctataatcccagct

SEQ ID NO: 6114567 - DNA, 15 bp, Homo sapiens
ctataatcccagcta

SEQ ID NO: 6114568 - DNA, 12 bp, Homo sapiens
ctataatctgtc

SEQ ID NO: 6114569 - DNA, 14 bp, Homo sapiens
ctataatctgtcaa

SEQ ID NO: 6114570 - DNA, 12 bp, Homo sapiens
ctataatgaagc

SEQ ID NO: 6114571 - DNA, 19 bp, Homo sapiens
ctataatgaagctttatac

SEQ ID NO: 6114572 - DNA, 21 bp, Homo sapiens
ctataatgatctaagaagcta

SEQ ID NO: 6114573 - DNA, 22 bp, Homo sapiens
ctataatgattaggagagctgt

SEQ ID NO: 6114574 - DNA, 17 bp, Homo sapiens
ctataatggaaacattt

SEQ ID NO: 6114575 - DNA, 11 bp, Homo sapiens
ctataatgtga

SEQ ID NO: 6114576 - DNA, 22 bp, Homo sapiens
ctataatgtgaaatgtaactgt

SEQ ID NO: 6114577 - DNA, 16 bp, Homo sapiens
ctataatgtgtgtatg

SEQ ID NO: 6114578 - DNA, 18 bp, Homo sapiens
ctataattccttaaaatt

SEQ ID NO: 6114579 - DNA, 20 bp, Homo sapiens
ctataattccttaaaatttt

SEQ ID NO: 6114580 - DNA, 13 bp, Homo sapiens
ctataattctata

SEQ ID NO: 6114581 - DNA, 12 bp, Homo sapiens
ctataatttaaa

SEQ ID NO: 6114582 - DNA, 13 bp, Homo sapiens
ctataatttaaat

SEQ ID NO: 6114583 - DNA, 22 bp, Homo sapiens
ctataatttacctgaagtcttt

SEQ ID NO: 6114584 - DNA, 18 bp, Homo sapiens
ctataattttgcaaatct

SEQ ID NO: 6114585 - DNA, 21 bp, Homo sapiens
ctatacaaattttcagaaggt

SEQ ID NO: 6114586 - DNA, 15 bp, Homo sapiens
ctatacacaagcaat

SEQ ID NO: 6114587 - DNA, 20 bp, Homo sapiens
ctatacacaagcaatgcaag

SEQ ID NO: 6114588 - DNA, 14 bp, Homo sapiens
ctatacacacacac

SEQ ID NO: 6114589 - DNA, 15 bp, Homo sapiens
ctatacacacacaca

SEQ ID NO: 6114590 - DNA, 16 bp, Homo sapiens
ctatacacaccctgcc

SEQ ID NO: 6114591 - DNA, 19 bp, Homo sapiens
ctatacacaccctgcccct

SEQ ID NO: 6114592 - DNA, 21 bp, Homo sapiens
ctatacacaccctgcccctgc

SEQ ID NO: 6114593 - DNA, 14 bp, Homo sapiens
ctatacactagaca

SEQ ID NO: 6114594 - DNA, 11 bp, Homo sapiens
ctatacagtag

SEQ ID NO: 6114595 - DNA, 13 bp, Homo sapiens
ctatacataaatg

SEQ ID NO: 6114596 - DNA, 14 bp, Homo sapiens
ctatacataaatgc

SEQ ID NO: 6114597 - DNA, 20 bp, Homo sapiens
ctatacatatctttattaat

SEQ ID NO: 6114598 - DNA, 16 bp, Homo sapiens
ctatacatctctcccc

SEQ ID NO: 6114599 - DNA, 17 bp, Homo sapiens
ctatacatgtttgcagt

SEQ ID NO: 6114600 - DNA, 11 bp, Homo sapiens
ctatacattcc

SEQ ID NO: 6114601 - DNA, 16 bp, Homo sapiens
ctatacattcctgaga

SEQ ID NO: 6114602 - DNA, 15 bp, Homo sapiens
ctatacatttctgtt

SEQ ID NO: 6114603 - DNA, 16 bp, Homo sapiens
ctataccaactgggcc

SEQ ID NO: 6114604 - DNA, 21 bp, Homo sapiens
ctataccaactgggcctctga

SEQ ID NO: 6114605 - DNA, 13 bp, Homo sapiens
ctataccaataaa

SEQ ID NO: 6114606 - DNA, 14 bp, Homo sapiens
ctataccaataaag

SEQ ID NO: 6114607 - DNA, 13 bp, Homo sapiens
ctatacccagcag

SEQ ID NO: 6114608 - DNA, 14 bp, Homo sapiens
ctatacccattctt

SEQ ID NO: 6114609 - DNA, 18 bp, Homo sapiens
ctatacccattcttcagt

SEQ ID NO: 6114610 - DNA, 15 bp, Homo sapiens
ctataccgagaccca

SEQ ID NO: 6114611 - DNA, 16 bp, Homo sapiens
ctataccgagacccac

SEQ ID NO: 6114612 - DNA, 23 bp, Homo sapiens
ctataccggagctccagtttctc

SEQ ID NO: 6114613 - DNA, 14 bp, Homo sapiens
ctatacctgagcct

SEQ ID NO: 6114614 - DNA, 14 bp, Homo sapiens
ctatacctgccttt

SEQ ID NO: 6114615 - DNA, 19 bp, Homo sapiens
ctatacctgccttttaagt

SEQ ID NO: 6114616 - DNA, 21 bp, Homo sapiens
ctatacctgggcatactaata

SEQ ID NO: 6114617 - DNA, 13 bp, Homo sapiens
ctatacctgggga

SEQ ID NO: 6114618 - DNA, 19 bp, Homo sapiens
ctatacctgtgcctcggct

SEQ ID NO: 6114619 - DNA, 19 bp, Homo sapiens
ctatacgcagcgtgcttta

SEQ ID NO: 6114620 - DNA, 19 bp, Homo sapiens
ctatactaccctgggctct

SEQ ID NO: 6114621 - DNA, 21 bp, Homo sapiens
ctatactgaaagatctctgtc

SEQ ID NO: 6114622 - DNA, 19 bp, Homo sapiens
ctatactgcatacttttta

SEQ ID NO: 6114623 - DNA, 23 bp, Homo sapiens
ctatactgcttggagctgagcaa

SEQ ID NO: 6114624 - DNA, 17 bp, Homo sapiens
ctatactggaaatgtaa

SEQ ID NO: 6114625 - DNA, 17 bp, Homo sapiens
ctatacttaatctaaga

SEQ ID NO: 6114626 - DNA, 21 bp, Homo sapiens
ctatacttgaacaaaagggtc

SEQ ID NO: 6114627 - DNA, 22 bp, Homo sapiens
ctatacttgaacaaaagggtca

SEQ ID NO: 6114628 - DNA, 14 bp, Homo sapiens
ctatactttacagg

SEQ ID NO: 6114629 - DNA, 15 bp, Homo sapiens
ctatactttctcaca

SEQ ID NO: 6114630 - DNA, 11 bp, Homo sapiens
ctatactttgt

SEQ ID NO: 6114631 - DNA, 12 bp, Homo sapiens
ctatactttgtt

SEQ ID NO: 6114632 - DNA, 20 bp, Homo sapiens
ctatactttgttctgttgtc

SEQ ID NO: 6114633 - DNA, 15 bp, Homo sapiens
ctatagaaagtgttc

SEQ ID NO: 6114634 - DNA, 20 bp, Homo sapiens
ctatagaaagtgttctgtta

SEQ ID NO: 6114635 - DNA, 16 bp, Homo sapiens
ctatagaaatagaaca

SEQ ID NO: 6114636 - DNA, 21 bp, Homo sapiens
ctatagactggaaaaaatgag

SEQ ID NO: 6114637 - DNA, 19 bp, Homo sapiens
ctatagagaaacccctggg

SEQ ID NO: 6114638 - DNA, 21 bp, Homo sapiens
ctatagagaaacccctgggga

SEQ ID NO: 6114639 - DNA, 19 bp, Homo sapiens
ctatagagagggggctctc

SEQ ID NO: 6114640 - DNA, 21 bp, Homo sapiens
ctatagagagggggctctcca

SEQ ID NO: 6114641 - DNA, 16 bp, Homo sapiens
ctatagagcctacctg

SEQ ID NO: 6114642 - DNA, 18 bp, Homo sapiens
ctatagatgatgatgtgt

SEQ ID NO: 6114643 - DNA, 14 bp, Homo sapiens
ctatagatgtcttt

SEQ ID NO: 6114644 - DNA, 15 bp, Homo sapiens
ctatagatgtctttt

SEQ ID NO: 6114645 - DNA, 22 bp, Homo sapiens
ctatagatgtcttttcccattt

SEQ ID NO: 6114646 - DNA, 22 bp, Homo sapiens
ctatagattctttattagtgaa

SEQ ID NO: 6114647 - DNA, 20 bp, Homo sapiens
ctatagattgatttaccttt

SEQ ID NO: 6114648 - DNA, 17 bp, Homo sapiens
ctatagcaaagtagtac

SEQ ID NO: 6114649 - DNA, 14 bp, Homo sapiens
ctatagcagggctg

SEQ ID NO: 6114650 - DNA, 15 bp, Homo sapiens
ctatagcagggctgg

SEQ ID NO: 6114651 - DNA, 15 bp, Homo sapiens
ctatagcagtcatca

SEQ ID NO: 6114652 - DNA, 20 bp, Homo sapiens
ctatagcatcacttaaaaca

SEQ ID NO: 6114653 - DNA, 13 bp, Homo sapiens
ctatagccaaaaa

SEQ ID NO: 6114654 - DNA, 19 bp, Homo sapiens
ctatagccaaaaatagcta

SEQ ID NO: 6114655 - DNA, 15 bp, Homo sapiens
ctatagccaaagctg

SEQ ID NO: 6114656 - DNA, 16 bp, Homo sapiens
ctatagcccctggtgt

SEQ ID NO: 6114657 - DNA, 20 bp, Homo sapiens
ctatagcccctggtgtgtaa

SEQ ID NO: 6114658 - DNA, 21 bp, Homo sapiens
ctatagcctaggtgacagagt

SEQ ID NO: 6114659 - DNA, 23 bp, Homo sapiens
ctatagctcaggacctgggacct

SEQ ID NO: 6114660 - DNA, 17 bp, Homo sapiens
ctatagctcttctattt

SEQ ID NO: 6114661 - DNA, 21 bp, Homo sapiens
ctatagcttgcagaactgtag

SEQ ID NO: 6114662 - DNA, 19 bp, Homo sapiens
ctataggaacagcccagca

SEQ ID NO: 6114663 - DNA, 21 bp, Homo sapiens
ctataggacttaatttagcag

SEQ ID NO: 6114664 - DNA, 12 bp, Homo sapiens
ctataggcagct

SEQ ID NO: 6114665 - DNA, 15 bp, Homo sapiens
ctataggcagcttct

SEQ ID NO: 6114666 - DNA, 19 bp, Homo sapiens
ctataggcagcttctaaga

SEQ ID NO: 6114667 - DNA, 18 bp, Homo sapiens
ctataggctggagaagct

SEQ ID NO: 6114668 - DNA, 19 bp, Homo sapiens
ctataggtaattaaggcag

SEQ ID NO: 6114669 - DNA, 20 bp, Homo sapiens
ctataggtgctacaaaaaca

SEQ ID NO: 6114670 - DNA, 21 bp, Homo sapiens
ctataggttttggttccacaa

SEQ ID NO: 6114671 - DNA, 15 bp, Homo sapiens
ctatagtaagtgctt

SEQ ID NO: 6114672 - DNA, 18 bp, Homo sapiens
ctatagtatagaatgaac

SEQ ID NO: 6114673 - DNA, 15 bp, Homo sapiens
ctatagtatttgatt

SEQ ID NO: 6114674 - DNA, 16 bp, Homo sapiens
ctatagtgaagaatag

SEQ ID NO: 6114675 - DNA, 20 bp, Homo sapiens
ctatagtgacatgcagttat

SEQ ID NO: 6114676 - DNA, 16 bp, Homo sapiens
ctatagtggtgagatg

SEQ ID NO: 6114677 - DNA, 18 bp, Homo sapiens
ctatagttactgtcctgt

SEQ ID NO: 6114678 - DNA, 21 bp, Homo sapiens
ctatagttcactgacacagta

SEQ ID NO: 6114679 - DNA, 14 bp, Homo sapiens
ctatagttgcagcc

SEQ ID NO: 6114680 - DNA, 20 bp, Homo sapiens
ctatagttgcagcccaagga

SEQ ID NO: 6114681 - DNA, 22 bp, Homo sapiens
ctatagttgcagcccaaggaca

SEQ ID NO: 6114682 - DNA, 19 bp, Homo sapiens
ctatagtttaaaacacatt

SEQ ID NO: 6114683 - DNA, 19 bp, Homo sapiens
ctatagtttcaccactcct

SEQ ID NO: 6114684 - DNA, 12 bp, Homo sapiens
ctatataaaaaa

SEQ ID NO: 6114685 - DNA, 12 bp, Homo sapiens
ctatataaaata

SEQ ID NO: 6114686 - DNA, 13 bp, Homo sapiens
ctatataaaatgt

SEQ ID NO: 6114687 - DNA, 15 bp, Homo sapiens
ctatataaaatgtat

SEQ ID NO: 6114688 - DNA, 21 bp, Homo sapiens
ctatataaaatgtattcaagc

SEQ ID NO: 6114689 - DNA, 21 bp, Homo sapiens
ctatataaagtactactgtag

SEQ ID NO: 6114690 - DNA, 14 bp, Homo sapiens
ctatataagacatt

SEQ ID NO: 6114691 - DNA, 17 bp, Homo sapiens
ctatataagacattaag

SEQ ID NO: 6114692 - DNA, 20 bp, Homo sapiens
ctatataatatatcatcttt

SEQ ID NO: 6114693 - DNA, 16 bp, Homo sapiens
ctatatacatatatat

SEQ ID NO: 6114694 - DNA, 13 bp, Homo sapiens
ctatatacatgtg

SEQ ID NO: 6114695 - DNA, 16 bp, Homo sapiens
ctatatacatgtgtgt

SEQ ID NO: 6114696 - DNA, 19 bp, Homo sapiens
ctatatacatgtgtgtata

SEQ ID NO: 6114697 - DNA, 22 bp, Homo sapiens
ctatatacatgtgtgtatatat

SEQ ID NO: 6114698 - DNA, 19 bp, Homo sapiens
ctatataccaaagcacatt

SEQ ID NO: 6114699 - DNA, 18 bp, Homo sapiens
ctatatacttttgcttgg

SEQ ID NO: 6114700 - DNA, 18 bp, Homo sapiens
ctatatagaatttcctgt

SEQ ID NO: 6114701 - DNA, 20 bp, Homo sapiens
ctatatagaatttcctgtaa

SEQ ID NO: 6114702 - DNA, 17 bp, Homo sapiens
ctatatagacttggaga

SEQ ID NO: 6114703 - DNA, 14 bp, Homo sapiens
ctatatagagatgt

SEQ ID NO: 6114704 - DNA, 15 bp, Homo sapiens
ctatatagagatgtt

SEQ ID NO: 6114705 - DNA, 19 bp, Homo sapiens
ctatatagctgatcagttt

SEQ ID NO: 6114706 - DNA, 18 bp, Homo sapiens
ccttgagagacccagctg

SEQ ID NO: 6114707 - DNA, 21 bp, Homo sapiens
ccttgagagacccagctgcag

SEQ ID NO: 6114708 - DNA, 16 bp, Homo sapiens
ccttgagaggagaaat

SEQ ID NO: 6114709 - DNA, 21 bp, Homo sapiens
ccttgagagtatcaggtctcc

SEQ ID NO: 6114710 - DNA, 16 bp, Homo sapiens
ccttgagagttccggg

SEQ ID NO: 6114711 - DNA, 20 bp, Homo sapiens
ccttgagatgagtttctggg

SEQ ID NO: 6114712 - DNA, 13 bp, Homo sapiens
ccttgagcacaaa

SEQ ID NO: 6114713 - DNA, 23 bp, Homo sapiens
ccttgagcactcagtctagtgaa

SEQ ID NO: 6114714 - DNA, 22 bp, Homo sapiens
ccttgagccctggctgttctgt

SEQ ID NO: 6114715 - DNA, 17 bp, Homo sapiens
ccttgagctccccaaaa

SEQ ID NO: 6114716 - DNA, 12 bp, Homo sapiens
ccttgagctgag

SEQ ID NO: 6114717 - DNA, 23 bp, Homo sapiens
ccttgagctgcctgctctgcagc

SEQ ID NO: 6114718 - DNA, 18 bp, Homo sapiens
ccttgagctggttttctc

SEQ ID NO: 6114719 - DNA, 21 bp, Homo sapiens
ccttgagctggttttctctga

SEQ ID NO: 6114720 - DNA, 15 bp, Homo sapiens
ccttgagctgttgtg

SEQ ID NO: 6114721 - DNA, 17 bp, Homo sapiens
ccttgaggatggagagc

SEQ ID NO: 6114722 - DNA, 15 bp, Homo sapiens
ccttgagggctgcag

SEQ ID NO: 6114723 - DNA, 12 bp, Homo sapiens
ccttgaggggca

SEQ ID NO: 6114724 - DNA, 22 bp, Homo sapiens
ccttgaggggcagtttgggaag

SEQ ID NO: 6114725 - DNA, 21 bp, Homo sapiens
ccttgaggggccccagcgtct

SEQ ID NO: 6114726 - DNA, 14 bp, Homo sapiens
ccttgagggtgggc

SEQ ID NO: 6114727 - DNA, 15 bp, Homo sapiens
ccttgagggtgggcc

SEQ ID NO: 6114728 - DNA, 16 bp, Homo sapiens
ccttgagggtgggcca

SEQ ID NO: 6114729 - DNA, 18 bp, Homo sapiens
ccttgagggtgggccagc

SEQ ID NO: 6114730 - DNA, 21 bp, Homo sapiens
ccttgagggtttgagagcccg

SEQ ID NO: 6114731 - DNA, 12 bp, Homo sapiens
ccttgaggtctt

SEQ ID NO: 6114732 - DNA, 17 bp, Homo sapiens
ccttgagtaggccctgc

SEQ ID NO: 6114733 - DNA, 20 bp, Homo sapiens
ccttgagtagtttttatctg

SEQ ID NO: 6114734 - DNA, 14 bp, Homo sapiens
ccttgagtcagaaa

SEQ ID NO: 6114735 - DNA, 17 bp, Homo sapiens
ccttgagtccccagggg

SEQ ID NO: 6114736 - DNA, 23 bp, Homo sapiens
ccttgagtggggttatctctgtg

SEQ ID NO: 6114737 - DNA, 17 bp, Homo sapiens
ccttgataaatatatat

SEQ ID NO: 6114738 - DNA, 16 bp, Homo sapiens
ccttgataatatattg

SEQ ID NO: 6114739 - DNA, 15 bp, Homo sapiens
ccttgatatttgtat

SEQ ID NO: 6114740 - DNA, 19 bp, Homo sapiens
ccttgatcgacttcttggt

SEQ ID NO: 6114741 - DNA, 14 bp, Homo sapiens
ccttgatgaagccc

SEQ ID NO: 6114742 - DNA, 20 bp, Homo sapiens
ccttgatgaagcctgtgcca

SEQ ID NO: 6114743 - DNA, 21 bp, Homo sapiens
ccttgatgaagcctgtgccac

SEQ ID NO: 6114744 - DNA, 14 bp, Homo sapiens
ccttgatgactgcc

SEQ ID NO: 6114745 - DNA, 23 bp, Homo sapiens
ccttgatgactgccttgcctcct

SEQ ID NO: 6114746 - DNA, 15 bp, Homo sapiens
ccttgatgatttaat

SEQ ID NO: 6114747 - DNA, 17 bp, Homo sapiens
ccttgatgccagagggc

SEQ ID NO: 6114748 - DNA, 18 bp, Homo sapiens
ccttgatgccagagggcc

SEQ ID NO: 6114749 - DNA, 22 bp, Homo sapiens
ccttgatgccagagggccagca

SEQ ID NO: 6114750 - DNA, 14 bp, Homo sapiens
ccttgatggagaag

SEQ ID NO: 6114751 - DNA, 19 bp, Homo sapiens
ccttgatggggtccagaga

SEQ ID NO: 6114752 - DNA, 14 bp, Homo sapiens
ccttgatggggtga

SEQ ID NO: 6114753 - DNA, 18 bp, Homo sapiens
ccttgatgtcttgagagc

SEQ ID NO: 6114754 - DNA, 20 bp, Homo sapiens
ccttgatgtcttgagagcgc

SEQ ID NO: 6114755 - DNA, 14 bp, Homo sapiens
ccttgatgtgcctg

SEQ ID NO: 6114756 - DNA, 17 bp, Homo sapiens
ccttgatgttgtgttgt

SEQ ID NO: 6114757 - DNA, 16 bp, Homo sapiens
ccttgattacttccac

SEQ ID NO: 6114758 - DNA, 19 bp, Homo sapiens
ccttgattacttccactga

SEQ ID NO: 6114759 - DNA, 18 bp, Homo sapiens
ccttgattggtgttgcca

SEQ ID NO: 6114760 - DNA, 18 bp, Homo sapiens
ccttgatttaaaatatca

SEQ ID NO: 6114761 - DNA, 19 bp, Homo sapiens
ccttgatttaaacacacag

SEQ ID NO: 6114762 - DNA, 21 bp, Homo sapiens
ccttgatttatcacacaaagc

SEQ ID NO: 6114763 - DNA, 13 bp, Homo sapiens
ccttgatttcaaa

SEQ ID NO: 6114764 - DNA, 19 bp, Homo sapiens
ccttgattttaattcaggt

SEQ ID NO: 6114765 - DNA, 20 bp, Homo sapiens
ccttgattttgccccctgag

SEQ ID NO: 6114766 - DNA, 16 bp, Homo sapiens
ccttgcaaactctata

SEQ ID NO: 6114767 - DNA, 18 bp, Homo sapiens
ccttgcaaactctataaa

SEQ ID NO: 6114768 - DNA, 23 bp, Homo sapiens
ccttgcaaagaccataaagtcca

SEQ ID NO: 6114769 - DNA, 18 bp, Homo sapiens
ccttgcaacacacagaca

SEQ ID NO: 6114770 - DNA, 14 bp, Homo sapiens
ccttgcaaccaggc

SEQ ID NO: 6114771 - DNA, 15 bp, Homo sapiens
ccttgcaaccaggca

SEQ ID NO: 6114772 - DNA, 16 bp, Homo sapiens
ccttgcaaccaggcag

SEQ ID NO: 6114773 - DNA, 18 bp, Homo sapiens
ccttgcaaccaggcagct

SEQ ID NO: 6114774 - DNA, 20 bp, Homo sapiens
ccttgcaaccaggcagctga

SEQ ID NO: 6114775 - DNA, 14 bp, Homo sapiens
ccttgcaagccata

SEQ ID NO: 6114776 - DNA, 23 bp, Homo sapiens
ccttgcaagccataacgtgcccc

SEQ ID NO: 6114777 - DNA, 18 bp, Homo sapiens
ccttgcacacccactgcc

SEQ ID NO: 6114778 - DNA, 12 bp, Homo sapiens
ccttgcacaggc

SEQ ID NO: 6114779 - DNA, 15 bp, Homo sapiens
ccttgcacaggccac

SEQ ID NO: 6114780 - DNA, 23 bp, Homo sapiens
ccttgcacaggccacttgctcag

SEQ ID NO: 6114781 - DNA, 13 bp, Homo sapiens
ccttgcacccctc

SEQ ID NO: 6114782 - DNA, 14 bp, Homo sapiens
ccttgcacccctca

SEQ ID NO: 6114783 - DNA, 13 bp, Homo sapiens
ccttgcacctgag

SEQ ID NO: 6114784 - DNA, 18 bp, Homo sapiens
ccttgcacctgagcctgt

SEQ ID NO: 6114785 - DNA, 12 bp, Homo sapiens
ccttgcacctgc

SEQ ID NO: 6114786 - DNA, 13 bp, Homo sapiens
ccttgcacctgca

SEQ ID NO: 6114787 - DNA, 15 bp, Homo sapiens
ccttgcacggctgct

SEQ ID NO: 6114788 - DNA, 14 bp, Homo sapiens
ccttgcactggtca

SEQ ID NO: 6114789 - DNA, 22 bp, Homo sapiens
ccttgcactgtatcatttcatg

SEQ ID NO: 6114790 - DNA, 13 bp, Homo sapiens
ccttgcactgtgg

SEQ ID NO: 6114791 - DNA, 13 bp, Homo sapiens
ccttgcactttca

SEQ ID NO: 6114792 - DNA, 13 bp, Homo sapiens
ccttgcagaactg

SEQ ID NO: 6114793 - DNA, 14 bp, Homo sapiens
ccttgcagaactgc

SEQ ID NO: 6114794 - DNA, 13 bp, Homo sapiens
ccttgcagcaggg

SEQ ID NO: 6114795 - DNA, 15 bp, Homo sapiens
ccttgcagctagttt

SEQ ID NO: 6114796 - DNA, 15 bp, Homo sapiens
ccttgcagctggccc

SEQ ID NO: 6114797 - DNA, 21 bp, Homo sapiens
ccttgcaggtcggtttggttt

SEQ ID NO: 6114798 - DNA, 19 bp, Homo sapiens
ccttgcagtgtaggaattc

SEQ ID NO: 6114799 - DNA, 22 bp, Homo sapiens
ccttgcagttcagcaccaccct

SEQ ID NO: 6114800 - DNA, 23 bp, Homo sapiens
ccttgcagttcagcaccacccta

SEQ ID NO: 6114801 - DNA, 15 bp, Homo sapiens
ccttgcagtttaaga

SEQ ID NO: 6114802 - DNA, 14 bp, Homo sapiens
ccttgcataatggt

SEQ ID NO: 6114803 - DNA, 21 bp, Homo sapiens
ccttgcatccattgttgtgtc

SEQ ID NO: 6114804 - DNA, 19 bp, Homo sapiens
ccttgccaaagcacttaca

SEQ ID NO: 6114805 - DNA, 19 bp, Homo sapiens
ccttgccaagctttcttct

SEQ ID NO: 6114806 - DNA, 16 bp, Homo sapiens
ccttgccaaggccgcc

SEQ ID NO: 6114807 - DNA, 12 bp, Homo sapiens
ccttgccacccc

SEQ ID NO: 6114808 - DNA, 19 bp, Homo sapiens
ccttgccaccccaccctcc

SEQ ID NO: 6114809 - DNA, 13 bp, Homo sapiens
ccttgccagacat

SEQ ID NO: 6114810 - DNA, 16 bp, Homo sapiens
ccttgccagagatcca

SEQ ID NO: 6114811 - DNA, 14 bp, Homo sapiens
ccttgccagcccca

SEQ ID NO: 6114812 - DNA, 15 bp, Homo sapiens
ccttgccagctgctg

SEQ ID NO: 6114813 - DNA, 23 bp, Homo sapiens
ccttgccagggaggtggaaggac

SEQ ID NO: 6114814 - DNA, 13 bp, Homo sapiens
ccttgccagggca

SEQ ID NO: 6114815 - DNA, 12 bp, Homo sapiens
ccttgccatcac

SEQ ID NO: 6114816 - DNA, 18 bp, Homo sapiens
ccttgccatccattctgg

SEQ ID NO: 6114817 - DNA, 21 bp, Homo sapiens
ccttgccatcccaagcccagt

SEQ ID NO: 6114818 - DNA, 17 bp, Homo sapiens
ccttgcccaactcccag

SEQ ID NO: 6114819 - DNA, 22 bp, Homo sapiens
ccttgcccaactcccagccacc

SEQ ID NO: 6114820 - DNA, 16 bp, Homo sapiens
ccttgcccacaggtgc

SEQ ID NO: 6114821 - DNA, 15 bp, Homo sapiens
ccttgcccaccccac

SEQ ID NO: 6114822 - DNA, 23 bp, Homo sapiens
ccttgcccagagatgcctccacc

SEQ ID NO: 6114823 - DNA, 13 bp, Homo sapiens
ccttgcccagctt

SEQ ID NO: 6114824 - DNA, 16 bp, Homo sapiens
ccttgcccagggctca

SEQ ID NO: 6114825 - DNA, 18 bp, Homo sapiens
ccttgcccagggctcagc

SEQ ID NO: 6114826 - DNA, 20 bp, Homo sapiens
ccttgcccagggctcagcct

SEQ ID NO: 6114827 - DNA, 21 bp, Homo sapiens
ccttgcccagggctcagcctg

SEQ ID NO: 6114828 - DNA, 23 bp, Homo sapiens
ccttgcccaggtgagggaaggag

SEQ ID NO: 6114829 - DNA, 15 bp, Homo sapiens
ccttgccccacagtt

SEQ ID NO: 6114830 - DNA, 14 bp, Homo sapiens
ccttgccccactcc

SEQ ID NO: 6114831 - DNA, 14 bp, Homo sapiens
ccttgccccaggcc

SEQ ID NO: 6114832 - DNA, 16 bp, Homo sapiens
ccttgccccaggccag

SEQ ID NO: 6114833 - DNA, 19 bp, Homo sapiens
ccttgccccaggccaggta

SEQ ID NO: 6114834 - DNA, 22 bp, Homo sapiens
ccttgccccaggccaggtagca

SEQ ID NO: 6114835 - DNA, 18 bp, Homo sapiens
ccttgccccaggccctgc

SEQ ID NO: 6114836 - DNA, 16 bp, Homo sapiens
ccttgccccagtcctg

SEQ ID NO: 6114837 - DNA, 17 bp, Homo sapiens
ccttgcccccagtgcct

SEQ ID NO: 6114838 - DNA, 19 bp, Homo sapiens
ccttgcccccagtgcctca

SEQ ID NO: 6114839 - DNA, 20 bp, Homo sapiens
ccttgcccccatccctcgga

SEQ ID NO: 6114840 - DNA, 14 bp, Homo sapiens
ccttgcccctgctc

SEQ ID NO: 6114841 - DNA, 12 bp, Homo sapiens
ccttgcccgcca

SEQ ID NO: 6114842 - DNA, 18 bp, Homo sapiens
ccttgcccgccagcctca

SEQ ID NO: 6114843 - DNA, 19 bp, Homo sapiens
ccttgcccgccagcctcag

SEQ ID NO: 6114844 - DNA, 19 bp, Homo sapiens
ccttgcccgtcgtgtgctg

SEQ ID NO: 6114845 - DNA, 13 bp, Homo sapiens
ccttgccctcctg

SEQ ID NO: 6114846 - DNA, 13 bp, Homo sapiens
ccttgccctgacc

SEQ ID NO: 6114847 - DNA, 15 bp, Homo sapiens
ccttgccctgacctc

SEQ ID NO: 6114848 - DNA, 16 bp, Homo sapiens
ccttgccctgacctcc

SEQ ID NO: 6114849 - DNA, 23 bp, Homo sapiens
ccttgccctgacctcccagccct

SEQ ID NO: 6114850 - DNA, 13 bp, Homo sapiens
ccttgccctgggc

SEQ ID NO: 6114851 - DNA, 17 bp, Homo sapiens
ccttgccctgggctgcc

SEQ ID NO: 6114852 - DNA, 19 bp, Homo sapiens
ccttgccctgggctgcctc

SEQ ID NO: 6114853 - DNA, 17 bp, Homo sapiens
ccttgcccttcctgacc

SEQ ID NO: 6114854 - DNA, 18 bp, Homo sapiens
ccttgcccttcctgaccc

SEQ ID NO: 6114855 - DNA, 15 bp, Homo sapiens
ccttgccctttccat

SEQ ID NO: 6114856 - DNA, 15 bp, Homo sapiens
ccttgccgctcccct

SEQ ID NO: 6114857 - DNA, 17 bp, Homo sapiens
ccttgccggggcctgga

SEQ ID NO: 6114858 - DNA, 19 bp, Homo sapiens
ccttgcctcaatgccagta

SEQ ID NO: 6114859 - DNA, 20 bp, Homo sapiens
ccttgcctcaatgccagtaa

SEQ ID NO: 6114860 - DNA, 19 bp, Homo sapiens
ccttgcctccaggaccttg

SEQ ID NO: 6114861 - DNA, 22 bp, Homo sapiens
ccttgcctccccatttcccatc

SEQ ID NO: 6114862 - DNA, 14 bp, Homo sapiens
ccttgcctcctcag

SEQ ID NO: 6114863 - DNA, 12 bp, Homo sapiens
ccttgcctctgc

SEQ ID NO: 6114864 - DNA, 18 bp, Homo sapiens
ccttgcctctgccctgga

SEQ ID NO: 6114865 - DNA, 17 bp, Homo sapiens
ccttgcctctgctctgt

SEQ ID NO: 6114866 - DNA, 23 bp, Homo sapiens
ccttgcctgaacatccttccttc

SEQ ID NO: 6114867 - DNA, 17 bp, Homo sapiens
ccttgcctgaactccag

SEQ ID NO: 6114868 - DNA, 12 bp, Homo sapiens
ccttgcctggcc

SEQ ID NO: 6114869 - DNA, 12 bp, Homo sapiens
ccttgcctggta

SEQ ID NO: 6114870 - DNA, 12 bp, Homo sapiens
ccttgccttaat

SEQ ID NO: 6114871 - DNA, 18 bp, Homo sapiens
ccttgccttaataaatat

SEQ ID NO: 6114872 - DNA, 17 bp, Homo sapiens
ccttgccttcccctgtc

SEQ ID NO: 6114873 - DNA, 23 bp, Homo sapiens
ccttgccttcccctgtcttcacc

SEQ ID NO: 6114874 - DNA, 19 bp, Homo sapiens
ccttgcctttcgaggcctg

SEQ ID NO: 6114875 - DNA, 15 bp, Homo sapiens
ccttgcctttgtggc

SEQ ID NO: 6114876 - DNA, 22 bp, Homo sapiens
ccttgcgaccaccaacacacag

SEQ ID NO: 6114877 - DNA, 23 bp, Homo sapiens
ccttgcgaccaccaacacacagg

SEQ ID NO: 6114878 - DNA, 20 bp, Homo sapiens
ccttgcgctgtcccaggcat

SEQ ID NO: 6114879 - DNA, 15 bp, Homo sapiens
ccttgcgctgttgcg

SEQ ID NO: 6114880 - DNA, 18 bp, Homo sapiens
ccttgcggctcctcaggg

SEQ ID NO: 6114881 - DNA, 20 bp, Homo sapiens
ccttgcggtatccgccccca

SEQ ID NO: 6114882 - DNA, 22 bp, Homo sapiens
ccttgcgtcccatgaggtcttc

SEQ ID NO: 6114883 - DNA, 11 bp, Homo sapiens
ccttgctacct

SEQ ID NO: 6114884 - DNA, 17 bp, Homo sapiens
ccttgctagctagccag

SEQ ID NO: 6114885 - DNA, 18 bp, Homo sapiens
ccttgctagctagccagc

SEQ ID NO: 6114886 - DNA, 23 bp, Homo sapiens
ctatataggcatcacatttttgt

SEQ ID NO: 6114887 - DNA, 20 bp, Homo sapiens
ctatatagtacctttgctct

SEQ ID NO: 6114888 - DNA, 14 bp, Homo sapiens
ctatatagttcctt

SEQ ID NO: 6114889 - DNA, 16 bp, Homo sapiens
ctatatagttccttgc

SEQ ID NO: 6114890 - DNA, 22 bp, Homo sapiens
ctatatagttccttgccttaat

SEQ ID NO: 6114891 - DNA, 22 bp, Homo sapiens
ctatatataaaacggtgctgtg

SEQ ID NO: 6114892 - DNA, 15 bp, Homo sapiens
ctatatataaatgac

SEQ ID NO: 6114893 - DNA, 13 bp, Homo sapiens
ctatatataattc

SEQ ID NO: 6114894 - DNA, 18 bp, Homo sapiens
ctatatataattctgtac

SEQ ID NO: 6114895 - DNA, 17 bp, Homo sapiens
ctatatatacatataca

SEQ ID NO: 6114896 - DNA, 21 bp, Homo sapiens
ctatatatacatatacacaaa

SEQ ID NO: 6114897 - DNA, 22 bp, Homo sapiens
ctatatatacatatacacaaag

SEQ ID NO: 6114898 - DNA, 18 bp, Homo sapiens
ctatatatacatatgtaa

SEQ ID NO: 6114899 - DNA, 17 bp, Homo sapiens
ctatatatacatgtata

SEQ ID NO: 6114900 - DNA, 14 bp, Homo sapiens
ctatatatatatgc

SEQ ID NO: 6114901 - DNA, 20 bp, Homo sapiens
ctatatatcttttgtaagac

SEQ ID NO: 6114902 - DNA, 12 bp, Homo sapiens
ctatatatggta

SEQ ID NO: 6114903 - DNA, 12 bp, Homo sapiens
ctatatatgtaa

SEQ ID NO: 6114904 - DNA, 21 bp, Homo sapiens
ctatatatgtaaatagctttt

SEQ ID NO: 6114905 - DNA, 18 bp, Homo sapiens
ctatatatgtgatgatct

SEQ ID NO: 6114906 - DNA, 23 bp, Homo sapiens
ctatatatgtgatgatctaccag

SEQ ID NO: 6114907 - DNA, 14 bp, Homo sapiens
ctatatatttagga

SEQ ID NO: 6114908 - DNA, 13 bp, Homo sapiens
ctatatatttcta

SEQ ID NO: 6114909 - DNA, 14 bp, Homo sapiens
ctatatatttctat

SEQ ID NO: 6114910 - DNA, 21 bp, Homo sapiens
ctatatcagggcctgagtgac

SEQ ID NO: 6114911 - DNA, 22 bp, Homo sapiens
ctatatcagggcctgagtgacc

SEQ ID NO: 6114912 - DNA, 22 bp, Homo sapiens
ctatatcataactatacttgat

SEQ ID NO: 6114913 - DNA, 20 bp, Homo sapiens
ctatatcatgctttaaagtg

SEQ ID NO: 6114914 - DNA, 21 bp, Homo sapiens
ctatatcattaaaagaacata

SEQ ID NO: 6114915 - DNA, 19 bp, Homo sapiens
ctatatccagaaggggagc

SEQ ID NO: 6114916 - DNA, 22 bp, Homo sapiens
ctatatccagaaggggagcttt

SEQ ID NO: 6114917 - DNA, 21 bp, Homo sapiens
ctatatccagttcctgctctc

SEQ ID NO: 6114918 - DNA, 14 bp, Homo sapiens
ctatatccatgtac

SEQ ID NO: 6114919 - DNA, 18 bp, Homo sapiens
ctatatccatgtactgta

SEQ ID NO: 6114920 - DNA, 21 bp, Homo sapiens
ctatatccatgtactgtagtt

SEQ ID NO: 6114921 - DNA, 17 bp, Homo sapiens
ctatatctataaacact

SEQ ID NO: 6114922 - DNA, 14 bp, Homo sapiens
ctatatctatatat

SEQ ID NO: 6114923 - DNA, 15 bp, Homo sapiens
ctatatctatttgag

SEQ ID NO: 6114924 - DNA, 15 bp, Homo sapiens
ctatatctgtatata

SEQ ID NO: 6114925 - DNA, 15 bp, Homo sapiens
ctatatgaaaaacaa

SEQ ID NO: 6114926 - DNA, 16 bp, Homo sapiens
ctatatgaatttaaat

SEQ ID NO: 6114927 - DNA, 20 bp, Homo sapiens
ctatatgaatttaaatataa

SEQ ID NO: 6114928 - DNA, 23 bp, Homo sapiens
ctatatgaatttaaatataattc

SEQ ID NO: 6114929 - DNA, 18 bp, Homo sapiens
ctatatgagaagaatagc

SEQ ID NO: 6114930 - DNA, 18 bp, Homo sapiens
ctatatgatcctgaaaaa

SEQ ID NO: 6114931 - DNA, 20 bp, Homo sapiens
ctatatgatcctgaaaaaat

SEQ ID NO: 6114932 - DNA, 14 bp, Homo sapiens
ctatatgatttagc

SEQ ID NO: 6114933 - DNA, 17 bp, Homo sapiens
ctatatgatttatagtt

SEQ ID NO: 6114934 - DNA, 18 bp, Homo sapiens
ctatatgatttatagttt

SEQ ID NO: 6114935 - DNA, 15 bp, Homo sapiens
ctatatgcacccctg

SEQ ID NO: 6114936 - DNA, 16 bp, Homo sapiens
ctatatgcacccctgg

SEQ ID NO: 6114937 - DNA, 16 bp, Homo sapiens
ctatatgcagtccttt

SEQ ID NO: 6114938 - DNA, 15 bp, Homo sapiens
ctatatgcagtctct

SEQ ID NO: 6114939 - DNA, 14 bp, Homo sapiens
ctatatgcatttaa

SEQ ID NO: 6114940 - DNA, 20 bp, Homo sapiens
ctatatgcctatatttataa

SEQ ID NO: 6114941 - DNA, 16 bp, Homo sapiens
ctatatggttctccaa

SEQ ID NO: 6114942 - DNA, 16 bp, Homo sapiens
ctatatgtacagctct

SEQ ID NO: 6114943 - DNA, 21 bp, Homo sapiens
ctatatgtacttgtcaaagaa

SEQ ID NO: 6114944 - DNA, 17 bp, Homo sapiens
ctatatgtagtgcattt

SEQ ID NO: 6114945 - DNA, 19 bp, Homo sapiens
ctatatgtagtgcattttt

SEQ ID NO: 6114946 - DNA, 15 bp, Homo sapiens
ctatatgtatatctt

SEQ ID NO: 6114947 - DNA, 21 bp, Homo sapiens
ctatatgtatatctttgcact

SEQ ID NO: 6114948 - DNA, 16 bp, Homo sapiens
ctatatgtccatttaa

SEQ ID NO: 6114949 - DNA, 20 bp, Homo sapiens
ctatatgtgaaacatttttt

SEQ ID NO: 6114950 - DNA, 21 bp, Homo sapiens
ctatatgtgaaacattttttc

SEQ ID NO: 6114951 - DNA, 22 bp, Homo sapiens
ctatatgtgaaacattttttct

SEQ ID NO: 6114952 - DNA, 18 bp, Homo sapiens
ctatatgtgaatcctctt

SEQ ID NO: 6114953 - DNA, 11 bp, Homo sapiens
ctatatgtgcg

SEQ ID NO: 6114954 - DNA, 19 bp, Homo sapiens
ctatattaaaggtatacaa

SEQ ID NO: 6114955 - DNA, 15 bp, Homo sapiens
ctatattaaagtgtt

SEQ ID NO: 6114956 - DNA, 18 bp, Homo sapiens
ctatattaaattctgaat

SEQ ID NO: 6114957 - DNA, 18 bp, Homo sapiens
ctatattaatcaccttct

SEQ ID NO: 6114958 - DNA, 17 bp, Homo sapiens
ctatattatgtcttctt

SEQ ID NO: 6114959 - DNA, 22 bp, Homo sapiens
ctatattccaggtttaagtaga

SEQ ID NO: 6114960 - DNA, 19 bp, Homo sapiens
ctatattccgggtgccatt

SEQ ID NO: 6114961 - DNA, 16 bp, Homo sapiens
ctatattcctccagct

SEQ ID NO: 6114962 - DNA, 17 bp, Homo sapiens
ctatattcctccagctg

SEQ ID NO: 6114963 - DNA, 12 bp, Homo sapiens
ctatattccttg

SEQ ID NO: 6114964 - DNA, 16 bp, Homo sapiens
ctatattcctttttct

SEQ ID NO: 6114965 - DNA, 22 bp, Homo sapiens
ctatattcctttttctatgaaa

SEQ ID NO: 6114966 - DNA, 17 bp, Homo sapiens
ctatattctaaagagct

SEQ ID NO: 6114967 - DNA, 23 bp, Homo sapiens
ctatattctatacacaccctgcc

SEQ ID NO: 6114968 - DNA, 20 bp, Homo sapiens
ctatattctggccagactcg

SEQ ID NO: 6114969 - DNA, 18 bp, Homo sapiens
ctatattgattgtccttt

SEQ ID NO: 6114970 - DNA, 23 bp, Homo sapiens
ctatattgatttaaaagtgtatt

SEQ ID NO: 6114971 - DNA, 22 bp, Homo sapiens
ctatattgcccaggctggtctt

SEQ ID NO: 6114972 - DNA, 20 bp, Homo sapiens
ctatattgctgaatgcaaga

SEQ ID NO: 6114973 - DNA, 14 bp, Homo sapiens
ctatattgtacaca

SEQ ID NO: 6114974 - DNA, 15 bp, Homo sapiens
ctatattgtacacac

SEQ ID NO: 6114975 - DNA, 22 bp, Homo sapiens
ctatattgttttcagtgtacat

SEQ ID NO: 6114976 - DNA, 16 bp, Homo sapiens
ctatatttaagtattc

SEQ ID NO: 6114977 - DNA, 21 bp, Homo sapiens
ctatatttaagtattcaagaa

SEQ ID NO: 6114978 - DNA, 15 bp, Homo sapiens
ctatatttacagtga

SEQ ID NO: 6114979 - DNA, 13 bp, Homo sapiens
ctatatttacatg

SEQ ID NO: 6114980 - DNA, 13 bp, Homo sapiens
ctatatttagatt

SEQ ID NO: 6114981 - DNA, 23 bp, Homo sapiens
ctatatttagattgttaaaataa

SEQ ID NO: 6114982 - DNA, 16 bp, Homo sapiens
ctatatttatttatgt

SEQ ID NO: 6114983 - DNA, 20 bp, Homo sapiens
ctatatttgagcactggtct

SEQ ID NO: 6114984 - DNA, 15 bp, Homo sapiens
ctatatttgtaactt

SEQ ID NO: 6114985 - DNA, 16 bp, Homo sapiens
ctatatttgtaacttt

SEQ ID NO: 6114986 - DNA, 20 bp, Homo sapiens
ctatatttgtaactttgcat

SEQ ID NO: 6114987 - DNA, 16 bp, Homo sapiens
ctatatttgtatatat

SEQ ID NO: 6114988 - DNA, 19 bp, Homo sapiens
ctatatttgtgctatttaa

SEQ ID NO: 6114989 - DNA, 17 bp, Homo sapiens
ctatatttttaaagaag

SEQ ID NO: 6114990 - DNA, 20 bp, Homo sapiens
ctatatttttaaagaaggag

SEQ ID NO: 6114991 - DNA, 17 bp, Homo sapiens
ctatatttttatttcat

SEQ ID NO: 6114992 - DNA, 18 bp, Homo sapiens
ctatcaaaacatatcaat

SEQ ID NO: 6114993 - DNA, 21 bp, Homo sapiens
ctatcaaaacatatcaattca

SEQ ID NO: 6114994 - DNA, 22 bp, Homo sapiens
ctatcaaaacatatcaattcaa

SEQ ID NO: 6114995 - DNA, 14 bp, Homo sapiens
ctatcaaaagaaat

SEQ ID NO: 6114996 - DNA, 15 bp, Homo sapiens
ctatcaaaagaaata

SEQ ID NO: 6114997 - DNA, 18 bp, Homo sapiens
ctatcaaaagaaatagaa

SEQ ID NO: 6114998 - DNA, 20 bp, Homo sapiens
ctatcaaaagaaatagaaaa

SEQ ID NO: 6114999 - DNA, 14 bp, Homo sapiens
ctatcaaaattgcc

SEQ ID NO: 6115000 - DNA, 12 bp, Homo sapiens
ctatcaaatgaa

SEQ ID NO: 6115001 - DNA, 19 bp, Homo sapiens
ctatcaacaataaaatttt

SEQ ID NO: 6115002 - DNA, 19 bp, Homo sapiens
ctatcaacctaagcaacag

SEQ ID NO: 6115003 - DNA, 21 bp, Homo sapiens
ctatcaagaggctgagacagg

SEQ ID NO: 6115004 - DNA, 23 bp, Homo sapiens
ctatcaagaggctgagacaggag

SEQ ID NO: 6115005 - DNA, 16 bp, Homo sapiens
ctatcaatagtcaaga

SEQ ID NO: 6115006 - DNA, 18 bp, Homo sapiens
ctatcaatatataaattt

SEQ ID NO: 6115007 - DNA, 22 bp, Homo sapiens
ctatcaatcaccgtctgtgttt

SEQ ID NO: 6115008 - DNA, 20 bp, Homo sapiens
ctatcaattcttgagaccca

SEQ ID NO: 6115009 - DNA, 12 bp, Homo sapiens
ctatcaatttta

SEQ ID NO: 6115010 - DNA, 20 bp, Homo sapiens
ctatcacacactttctcttc

SEQ ID NO: 6115011 - DNA, 19 bp, Homo sapiens
ctatcacacatgaataaag

SEQ ID NO: 6115012 - DNA, 16 bp, Homo sapiens
ctatcacatacaattt

SEQ ID NO: 6115013 - DNA, 17 bp, Homo sapiens
ctatcacatacaatttg

SEQ ID NO: 6115014 - DNA, 22 bp, Homo sapiens
ctatcacatgtgaaaagcttaa

SEQ ID NO: 6115015 - DNA, 15 bp, Homo sapiens
ctatcaccagtgcat

SEQ ID NO: 6115016 - DNA, 19 bp, Homo sapiens
ctatcaccagtgcatcaca

SEQ ID NO: 6115017 - DNA, 22 bp, Homo sapiens
ctatcaccagtgcatcacatct

SEQ ID NO: 6115018 - DNA, 23 bp, Homo sapiens
ctatcaccagtgcatcacatctg

SEQ ID NO: 6115019 - DNA, 20 bp, Homo sapiens
ctatcacctattacatttta

SEQ ID NO: 6115020 - DNA, 14 bp, Homo sapiens
ctatcacctcccct

SEQ ID NO: 6115021 - DNA, 15 bp, Homo sapiens
ctatcacctcccctc

SEQ ID NO: 6115022 - DNA, 13 bp, Homo sapiens
ctatcagaaacag

SEQ ID NO: 6115023 - DNA, 18 bp, Homo sapiens
ctatcagaaatacaaaaa

SEQ ID NO: 6115024 - DNA, 19 bp, Homo sapiens
ctatcagaaatacaaaaaa

SEQ ID NO: 6115025 - DNA, 20 bp, Homo sapiens
ctatcagaaatacaaaaaat

SEQ ID NO: 6115026 - DNA, 13 bp, Homo sapiens
ctatcagaagacc

SEQ ID NO: 6115027 - DNA, 16 bp, Homo sapiens
ctatcagaagttgtat

SEQ ID NO: 6115028 - DNA, 19 bp, Homo sapiens
ctatcagacgtgctccctc

SEQ ID NO: 6115029 - DNA, 19 bp, Homo sapiens
ctatcagagttgctgcaaa

SEQ ID NO: 6115030 - DNA, 12 bp, Homo sapiens
ctatcagcaatg

SEQ ID NO: 6115031 - DNA, 23 bp, Homo sapiens
ctatcagcaatgccccaaacttt

SEQ ID NO: 6115032 - DNA, 18 bp, Homo sapiens
ctatcagcattgtttcaa

SEQ ID NO: 6115033 - DNA, 15 bp, Homo sapiens
ctatcaggcagaaga

SEQ ID NO: 6115034 - DNA, 16 bp, Homo sapiens
ctatcaggcagaagaa

SEQ ID NO: 6115035 - DNA, 17 bp, Homo sapiens
ctatcagggaggaagat

SEQ ID NO: 6115036 - DNA, 15 bp, Homo sapiens
ctatcagggcaagct

SEQ ID NO: 6115037 - DNA, 24 bp, Homo sapiens
ctatcagggcaagctcatagcaca

SEQ ID NO: 6115038 - DNA, 13 bp, Homo sapiens
ctatcaggtaata

SEQ ID NO: 6115039 - DNA, 23 bp, Homo sapiens
ctatcaggtgcccctcttccaaa

SEQ ID NO: 6115040 - DNA, 18 bp, Homo sapiens
ctatcagtgtgcccccca

SEQ ID NO: 6115041 - DNA, 15 bp, Homo sapiens
ctatcagtgttcttc

SEQ ID NO: 6115042 - DNA, 21 bp, Homo sapiens
ctatcagtgttcttctcaagg

SEQ ID NO: 6115043 - DNA, 22 bp, Homo sapiens
ctatcatactactgaaacagat

SEQ ID NO: 6115044 - DNA, 18 bp, Homo sapiens
ctatcatcagtcctgcat

SEQ ID NO: 6115045 - DNA, 14 bp, Homo sapiens
ctatcatggagtga

SEQ ID NO: 6115046 - DNA, 18 bp, Homo sapiens
ctatcatgtcaaacgtga

SEQ ID NO: 6115047 - DNA, 13 bp, Homo sapiens
ctatcattaaagt

SEQ ID NO: 6115048 - DNA, 14 bp, Homo sapiens
ctatcattaaagtt

SEQ ID NO: 6115049 - DNA, 15 bp, Homo sapiens
ctatcattaaagttc

SEQ ID NO: 6115050 - DNA, 13 bp, Homo sapiens
ctatcattccaat

SEQ ID NO: 6115051 - DNA, 18 bp, Homo sapiens
ctatcattccctagaaca

SEQ ID NO: 6115052 - DNA, 19 bp, Homo sapiens
ctatcattgcttcctcctc

SEQ ID NO: 6115053 - DNA, 21 bp, Homo sapiens
ctatcatttaataatatactt

SEQ ID NO: 6115054 - DNA, 18 bp, Homo sapiens
ctatcatttttacactat

SEQ ID NO: 6115055 - DNA, 16 bp, Homo sapiens
ctatcatttttgtaca

SEQ ID NO: 6115056 - DNA, 17 bp, Homo sapiens
ctatcatttttgtacag

SEQ ID NO: 6115057 - DNA, 23 bp, Homo sapiens
ctatcatttttgtacagtttgct

SEQ ID NO: 6115058 - DNA, 20 bp, Homo sapiens
ctatccaaacatgtatttat

SEQ ID NO: 6115059 - DNA, 20 bp, Homo sapiens
ctatccaaagaacttgattt

SEQ ID NO: 6115060 - DNA, 23 bp, Homo sapiens
ctatccaaagaacttgatttgca

SEQ ID NO: 6115061 - DNA, 15 bp, Homo sapiens
ctatccaaaggaatc

SEQ ID NO: 6115062 - DNA, 12 bp, Homo sapiens
ctatccaagtgt

SEQ ID NO: 6115063 - DNA, 21 bp, Homo sapiens
ccttgctagctagccagccaa

SEQ ID NO: 6115064 - DNA, 18 bp, Homo sapiens
ccttgctcaccaagctgt

SEQ ID NO: 6115065 - DNA, 22 bp, Homo sapiens
ccttgctcaccaagctgttcca

SEQ ID NO: 6115066 - DNA, 23 bp, Homo sapiens
ccttgctcaccaagctgttccac

SEQ ID NO: 6115067 - DNA, 15 bp, Homo sapiens
ccttgctcactcact

SEQ ID NO: 6115068 - DNA, 15 bp, Homo sapiens
ccttgctcagtgcct

SEQ ID NO: 6115069 - DNA, 20 bp, Homo sapiens
ccttgctcagtgcctcctgg

SEQ ID NO: 6115070 - DNA, 16 bp, Homo sapiens
ccttgctcatgagctc

SEQ ID NO: 6115071 - DNA, 16 bp, Homo sapiens
ccttgctccagcctga

SEQ ID NO: 6115072 - DNA, 12 bp, Homo sapiens
ccttgctcctgg

SEQ ID NO: 6115073 - DNA, 21 bp, Homo sapiens
ccttgctcctggaacctggca

SEQ ID NO: 6115074 - DNA, 22 bp, Homo sapiens
ccttgctcctggaacctggcag

SEQ ID NO: 6115075 - DNA, 21 bp, Homo sapiens
ccttgctcctggccttgctga

SEQ ID NO: 6115076 - DNA, 15 bp, Homo sapiens
ccttgctctcagctg

SEQ ID NO: 6115077 - DNA, 22 bp, Homo sapiens
ccttgctctcccctgccctgct

SEQ ID NO: 6115078 - DNA, 14 bp, Homo sapiens
ccttgctctccctc

SEQ ID NO: 6115079 - DNA, 22 bp, Homo sapiens
ccttgctctctgttctcttgct

SEQ ID NO: 6115080 - DNA, 21 bp, Homo sapiens
ccttgctctcttcaataaacc

SEQ ID NO: 6115081 - DNA, 12 bp, Homo sapiens
ccttgctctgag

SEQ ID NO: 6115082 - DNA, 22 bp, Homo sapiens
ccttgctctgagcacaggtgac

SEQ ID NO: 6115083 - DNA, 20 bp, Homo sapiens
ccttgctcttctttctgaga

SEQ ID NO: 6115084 - DNA, 13 bp, Homo sapiens
ccttgctcttggg

SEQ ID NO: 6115085 - DNA, 18 bp, Homo sapiens
ccttgctcttggggaagg

SEQ ID NO: 6115086 - DNA, 19 bp, Homo sapiens
ccttgctcttggggaaggg

SEQ ID NO: 6115087 - DNA, 17 bp, Homo sapiens
ccttgctgacaataaag

SEQ ID NO: 6115088 - DNA, 12 bp, Homo sapiens
ccttgctgaccc

SEQ ID NO: 6115089 - DNA, 22 bp, Homo sapiens
ccttgctgaccccaggtcagcc

SEQ ID NO: 6115090 - DNA, 20 bp, Homo sapiens
ccttgctgacctcccagcct

SEQ ID NO: 6115091 - DNA, 22 bp, Homo sapiens
ccttgctgcaagcacagccctt

SEQ ID NO: 6115092 - DNA, 13 bp, Homo sapiens
ccttgctgcagct

SEQ ID NO: 6115093 - DNA, 14 bp, Homo sapiens
ccttgctgccaagt

SEQ ID NO: 6115094 - DNA, 23 bp, Homo sapiens
ccttgctgccaagtcctgccttt

SEQ ID NO: 6115095 - DNA, 20 bp, Homo sapiens
ccttgctgccacaacctgtg

SEQ ID NO: 6115096 - DNA, 19 bp, Homo sapiens
ccttgctgccttcaccctg

SEQ ID NO: 6115097 - DNA, 20 bp, Homo sapiens
ccttgctgccttcaccctga

SEQ ID NO: 6115098 - DNA, 13 bp, Homo sapiens
ccttgctgctgcc

SEQ ID NO: 6115099 - DNA, 13 bp, Homo sapiens
ccttgctgctgct

SEQ ID NO: 6115100 - DNA, 16 bp, Homo sapiens
ccttgctgctgctgca

SEQ ID NO: 6115101 - DNA, 17 bp, Homo sapiens
ccttgctgctggctccc

SEQ ID NO: 6115102 - DNA, 17 bp, Homo sapiens
ccttgctggatgctgct

SEQ ID NO: 6115103 - DNA, 14 bp, Homo sapiens
ccttgctggcccca

SEQ ID NO: 6115104 - DNA, 22 bp, Homo sapiens
ccttgctggccccagccctgct

SEQ ID NO: 6115105 - DNA, 11 bp, Homo sapiens
ccttgctgggc

SEQ ID NO: 6115106 - DNA, 13 bp, Homo sapiens
ccttgctgggcca

SEQ ID NO: 6115107 - DNA, 15 bp, Homo sapiens
ccttgctgggccagg

SEQ ID NO: 6115108 - DNA, 19 bp, Homo sapiens
ccttgctgggccagggaaa

SEQ ID NO: 6115109 - DNA, 16 bp, Homo sapiens
ccttgctgggcctggg

SEQ ID NO: 6115110 - DNA, 12 bp, Homo sapiens
ccttgctggggt

SEQ ID NO: 6115111 - DNA, 15 bp, Homo sapiens
ccttgctggggtcca

SEQ ID NO: 6115112 - DNA, 19 bp, Homo sapiens
ccttgctggggtccagggc

SEQ ID NO: 6115113 - DNA, 20 bp, Homo sapiens
ccttgctggggtccagggct

SEQ ID NO: 6115114 - DNA, 21 bp, Homo sapiens
ccttgctgggtccagggtagg

SEQ ID NO: 6115115 - DNA, 21 bp, Homo sapiens
ccttgctggttttctggatgg

SEQ ID NO: 6115116 - DNA, 21 bp, Homo sapiens
ccttgctgtatgctgatcatc

SEQ ID NO: 6115117 - DNA, 11 bp, Homo sapiens
ccttgctgtca

SEQ ID NO: 6115118 - DNA, 13 bp, Homo sapiens
ccttgctgtcctg

SEQ ID NO: 6115119 - DNA, 16 bp, Homo sapiens
ccttgctgtcctgatc

SEQ ID NO: 6115120 - DNA, 12 bp, Homo sapiens
ccttgctgtgaa

SEQ ID NO: 6115121 - DNA, 20 bp, Homo sapiens
ccttgctgttggtcatgtgg

SEQ ID NO: 6115122 - DNA, 21 bp, Homo sapiens
ccttgctgtttgtcctgagat

SEQ ID NO: 6115123 - DNA, 17 bp, Homo sapiens
ccttgcttacctctcag

SEQ ID NO: 6115124 - DNA, 17 bp, Homo sapiens
ccttgcttagcctgtgc

SEQ ID NO: 6115125 - DNA, 19 bp, Homo sapiens
ccttgcttagcctgtgctg

SEQ ID NO: 6115126 - DNA, 14 bp, Homo sapiens
ccttgcttctccca

SEQ ID NO: 6115127 - DNA, 18 bp, Homo sapiens
ccttgcttctcccatttc

SEQ ID NO: 6115128 - DNA, 21 bp, Homo sapiens
ccttgcttctcccatttcctg

SEQ ID NO: 6115129 - DNA, 22 bp, Homo sapiens
ccttgcttctcccatttcctga

SEQ ID NO: 6115130 - DNA, 20 bp, Homo sapiens
ccttgcttcttactgataat

SEQ ID NO: 6115131 - DNA, 22 bp, Homo sapiens
ccttgcttgctgccttctggat

SEQ ID NO: 6115132 - DNA, 16 bp, Homo sapiens
ccttgctttcctgggc

SEQ ID NO: 6115133 - DNA, 17 bp, Homo sapiens
ccttgctttcctgggcc

SEQ ID NO: 6115134 - DNA, 21 bp, Homo sapiens
ccttgctttcggagctcctgt

SEQ ID NO: 6115135 - DNA, 19 bp, Homo sapiens
ccttgctttgagactcctc

SEQ ID NO: 6115136 - DNA, 14 bp, Homo sapiens
ccttgctttgctgt

SEQ ID NO: 6115137 - DNA, 18 bp, Homo sapiens
ccttgctttgggctttgc

SEQ ID NO: 6115138 - DNA, 23 bp, Homo sapiens
ccttgctttggggggtgtgctga

SEQ ID NO: 6115139 - DNA, 15 bp, Homo sapiens
ccttgctttgtctgg

SEQ ID NO: 6115140 - DNA, 22 bp, Homo sapiens
ccttgcttttatagttgtattt

SEQ ID NO: 6115141 - DNA, 23 bp, Homo sapiens
ccttgcttttatagttgtatttt

SEQ ID NO: 6115142 - DNA, 13 bp, Homo sapiens
ccttgcttttatg

SEQ ID NO: 6115143 - DNA, 23 bp, Homo sapiens
ccttgctttttgctgtgtagttc

SEQ ID NO: 6115144 - DNA, 21 bp, Homo sapiens
ccttggaaacagttggcactg

SEQ ID NO: 6115145 - DNA, 18 bp, Homo sapiens
ccttggaaacctgccctg

SEQ ID NO: 6115146 - DNA, 23 bp, Homo sapiens
ccttggaaacctgccctgcctga

SEQ ID NO: 6115147 - DNA, 19 bp, Homo sapiens
ccttggaaagttcagccag

SEQ ID NO: 6115148 - DNA, 20 bp, Homo sapiens
ccttggaaagttcagccaga

SEQ ID NO: 6115149 - DNA, 20 bp, Homo sapiens
ccttggaaatcaaatgtaaa

SEQ ID NO: 6115150 - DNA, 21 bp, Homo sapiens
ccttggaacaccctggatgct

SEQ ID NO: 6115151 - DNA, 18 bp, Homo sapiens
ccttggaatatggccaag

SEQ ID NO: 6115152 - DNA, 21 bp, Homo sapiens
ccttggaatctaacgggcatt

SEQ ID NO: 6115153 - DNA, 17 bp, Homo sapiens
ccttggacctagaggat

SEQ ID NO: 6115154 - DNA, 23 bp, Homo sapiens
ccttggacctccaggggctcctg

SEQ ID NO: 6115155 - DNA, 15 bp, Homo sapiens
ccttggactcatttt

SEQ ID NO: 6115156 - DNA, 11 bp, Homo sapiens
ccttggactcc

SEQ ID NO: 6115157 - DNA, 16 bp, Homo sapiens
ccttggactcctccca

SEQ ID NO: 6115158 - DNA, 15 bp, Homo sapiens
ccttggacttgagga

SEQ ID NO: 6115159 - DNA, 16 bp, Homo sapiens
ccttggagaagtggca

SEQ ID NO: 6115160 - DNA, 16 bp, Homo sapiens
ccttggagagacacag

SEQ ID NO: 6115161 - DNA, 19 bp, Homo sapiens
ccttggagagacacagcgt

SEQ ID NO: 6115162 - DNA, 23 bp, Homo sapiens
ccttggagagagaggctgcctca

SEQ ID NO: 6115163 - DNA, 19 bp, Homo sapiens
ccttggagagcagctggct

SEQ ID NO: 6115164 - DNA, 14 bp, Homo sapiens
ccttggagagctca

SEQ ID NO: 6115165 - DNA, 16 bp, Homo sapiens
ccttggagagctcagg

SEQ ID NO: 6115166 - DNA, 14 bp, Homo sapiens
ccttggagcaggca

SEQ ID NO: 6115167 - DNA, 15 bp, Homo sapiens
ccttggagccttcca

SEQ ID NO: 6115168 - DNA, 16 bp, Homo sapiens
ccttggagccttccac

SEQ ID NO: 6115169 - DNA, 22 bp, Homo sapiens
ccttggagctgccgtgcctgtg

SEQ ID NO: 6115170 - DNA, 15 bp, Homo sapiens
ccttggaggacagtg

SEQ ID NO: 6115171 - DNA, 17 bp, Homo sapiens
ccttggaggacagtggg

SEQ ID NO: 6115172 - DNA, 17 bp, Homo sapiens
ccttggaggagggctgt

SEQ ID NO: 6115173 - DNA, 16 bp, Homo sapiens
ccttggaggccagcca

SEQ ID NO: 6115174 - DNA, 20 bp, Homo sapiens
ccttggagggagaggtggca

SEQ ID NO: 6115175 - DNA, 23 bp, Homo sapiens
ccttggagggtcccaagctgggc

SEQ ID NO: 6115176 - DNA, 16 bp, Homo sapiens
ccttggagtcccaggg

SEQ ID NO: 6115177 - DNA, 19 bp, Homo sapiens
ccttggagtcccaggggca

SEQ ID NO: 6115178 - DNA, 23 bp, Homo sapiens
ccttggataatgctgttgcctca

SEQ ID NO: 6115179 - DNA, 18 bp, Homo sapiens
ccttggatgtagtctgag

SEQ ID NO: 6115180 - DNA, 13 bp, Homo sapiens
ccttggattccct

SEQ ID NO: 6115181 - DNA, 17 bp, Homo sapiens
ccttggattttcctgaa

SEQ ID NO: 6115182 - DNA, 13 bp, Homo sapiens
ccttggcaacttt

SEQ ID NO: 6115183 - DNA, 20 bp, Homo sapiens
ccttggcaccaaagatgcag

SEQ ID NO: 6115184 - DNA, 17 bp, Homo sapiens
ccttggcaccaccaggg

SEQ ID NO: 6115185 - DNA, 20 bp, Homo sapiens
ccttggcaccagacacccag

SEQ ID NO: 6115186 - DNA, 21 bp, Homo sapiens
ccttggcaccagacacccagg

SEQ ID NO: 6115187 - DNA, 19 bp, Homo sapiens
ccttggcacccccatgctg

SEQ ID NO: 6115188 - DNA, 17 bp, Homo sapiens
ccttggcaccggcctct

SEQ ID NO: 6115189 - DNA, 17 bp, Homo sapiens
ccttggcactgatgggc

SEQ ID NO: 6115190 - DNA, 19 bp, Homo sapiens
ccttggcactgtggaactg

SEQ ID NO: 6115191 - DNA, 15 bp, Homo sapiens
ccttggcatgccttc

SEQ ID NO: 6115192 - DNA, 16 bp, Homo sapiens
ccttggccaagagaag

SEQ ID NO: 6115193 - DNA, 14 bp, Homo sapiens
ccttggccacagac

SEQ ID NO: 6115194 - DNA, 17 bp, Homo sapiens
ccttggccacagactga

SEQ ID NO: 6115195 - DNA, 15 bp, Homo sapiens
ccttggccatgcaga

SEQ ID NO: 6115196 - DNA, 17 bp, Homo sapiens
ccttggccatgcagaaa

SEQ ID NO: 6115197 - DNA, 20 bp, Homo sapiens
ccttggcccacactgaggct

SEQ ID NO: 6115198 - DNA, 14 bp, Homo sapiens
ccttggcccagaga

SEQ ID NO: 6115199 - DNA, 12 bp, Homo sapiens
ccttggcccagc

SEQ ID NO: 6115200 - DNA, 14 bp, Homo sapiens
ccttggcccagcag

SEQ ID NO: 6115201 - DNA, 16 bp, Homo sapiens
ccttggcccaggagct

SEQ ID NO: 6115202 - DNA, 20 bp, Homo sapiens
ccttggcccaggagctctgc

SEQ ID NO: 6115203 - DNA, 17 bp, Homo sapiens
ccttggccccagaggac

SEQ ID NO: 6115204 - DNA, 12 bp, Homo sapiens
ccttggcccctc

SEQ ID NO: 6115205 - DNA, 17 bp, Homo sapiens
ccttggcccctcacatc

SEQ ID NO: 6115206 - DNA, 20 bp, Homo sapiens
ccttggcccctcacatcctc

SEQ ID NO: 6115207 - DNA, 21 bp, Homo sapiens
ccttggccgcataggcccagc

SEQ ID NO: 6115208 - DNA, 19 bp, Homo sapiens
ccttggccgtgaggacacg

SEQ ID NO: 6115209 - DNA, 22 bp, Homo sapiens
ccttggcctagcccaccctgct

SEQ ID NO: 6115210 - DNA, 16 bp, Homo sapiens
ccttggcctagtcaga

SEQ ID NO: 6115211 - DNA, 13 bp, Homo sapiens
ccttggcctcaga

SEQ ID NO: 6115212 - DNA, 19 bp, Homo sapiens
ccttggcctccatttctgt

SEQ ID NO: 6115213 - DNA, 18 bp, Homo sapiens
ccttggcctctccttgga

SEQ ID NO: 6115214 - DNA, 20 bp, Homo sapiens
ccttggcctgacctggcaca

SEQ ID NO: 6115215 - DNA, 15 bp, Homo sapiens
ccttggcctggagca

SEQ ID NO: 6115216 - DNA, 13 bp, Homo sapiens
ccttggcctgggc

SEQ ID NO: 6115217 - DNA, 22 bp, Homo sapiens
ccttggcctgtctcatccccag

SEQ ID NO: 6115218 - DNA, 14 bp, Homo sapiens
ccttggccttctcc

SEQ ID NO: 6115219 - DNA, 14 bp, Homo sapiens
ccttggccttgggg

SEQ ID NO: 6115220 - DNA, 23 bp, Homo sapiens
ccttggcctttcctggaagccag

SEQ ID NO: 6115221 - DNA, 16 bp, Homo sapiens
ccttggcgagggcagc

SEQ ID NO: 6115222 - DNA, 16 bp, Homo sapiens
ccttggcgcgcagccc

SEQ ID NO: 6115223 - DNA, 21 bp, Homo sapiens
ccttggcgggcagcccagcct

SEQ ID NO: 6115224 - DNA, 15 bp, Homo sapiens
ccttggctcagacat

SEQ ID NO: 6115225 - DNA, 21 bp, Homo sapiens
ccttggctcccgggggcccca

SEQ ID NO: 6115226 - DNA, 17 bp, Homo sapiens
ccttggctctatttggc

SEQ ID NO: 6115227 - DNA, 23 bp, Homo sapiens
ccttggctctgccagtggatccc

SEQ ID NO: 6115228 - DNA, 14 bp, Homo sapiens
ccttggctgcagcc

SEQ ID NO: 6115229 - DNA, 16 bp, Homo sapiens
ccttggctgcagccat

SEQ ID NO: 6115230 - DNA, 14 bp, Homo sapiens
ccttggctgcaggg

SEQ ID NO: 6115231 - DNA, 18 bp, Homo sapiens
ccttggctgctcactgtc

SEQ ID NO: 6115232 - DNA, 12 bp, Homo sapiens
ccttggctgggc

SEQ ID NO: 6115233 - DNA, 13 bp, Homo sapiens
ccttggctggtgc

SEQ ID NO: 6115234 - DNA, 20 bp, Homo sapiens
ccttggctgtctgtgggccg

SEQ ID NO: 6115235 - DNA, 21 bp, Homo sapiens
ccttggctgttggcagtgagt

SEQ ID NO: 6115236 - DNA, 17 bp, Homo sapiens
ccttggcttacctgacc

SEQ ID NO: 6115237 - DNA, 14 bp, Homo sapiens
ccttggcttctgct

SEQ ID NO: 6115238 - DNA, 17 bp, Homo sapiens
ccttggcttctgcttca

SEQ ID NO: 6115239 - DNA, 14 bp, Homo sapiens
ccttggcttgatgg

SEQ ID NO: 6115240 - DNA, 16 bp, Homo sapiens
ccttggcttggccctg

SEQ ID NO: 6115241 - DNA, 14 bp, Homo sapiens
ctatccaagtgtta

SEQ ID NO: 6115242 - DNA, 22 bp, Homo sapiens
ctatccaagtgttataccaact

SEQ ID NO: 6115243 - DNA, 22 bp, Homo sapiens
ctatccaatgaatgatcattga

SEQ ID NO: 6115244 - DNA, 19 bp, Homo sapiens
ctatccaattaaaattaag

SEQ ID NO: 6115245 - DNA, 20 bp, Homo sapiens
ctatccacagaacctttgtc

SEQ ID NO: 6115246 - DNA, 21 bp, Homo sapiens
ctatccacagaacctttgtca

SEQ ID NO: 6115247 - DNA, 22 bp, Homo sapiens
ctatccacagaacctttgtcaa

SEQ ID NO: 6115248 - DNA, 17 bp, Homo sapiens
ctatccacagagagtcc

SEQ ID NO: 6115249 - DNA, 23 bp, Homo sapiens
ctatccacagagagtcccactgc

SEQ ID NO: 6115250 - DNA, 14 bp, Homo sapiens
ctatccaccacccc

SEQ ID NO: 6115251 - DNA, 16 bp, Homo sapiens
ctatccaccaccccac

SEQ ID NO: 6115252 - DNA, 17 bp, Homo sapiens
ctatccacccagcccat

SEQ ID NO: 6115253 - DNA, 19 bp, Homo sapiens
ctatccacccagcccattc

SEQ ID NO: 6115254 - DNA, 11 bp, Homo sapiens
ctatccagccg

SEQ ID NO: 6115255 - DNA, 20 bp, Homo sapiens
ctatccagtgacttgttctg

SEQ ID NO: 6115256 - DNA, 22 bp, Homo sapiens
ctatccagtggaaggagaattt

SEQ ID NO: 6115257 - DNA, 16 bp, Homo sapiens
ctatccagttgcaggt

SEQ ID NO: 6115258 - DNA, 15 bp, Homo sapiens
ctatccatctcctgg

SEQ ID NO: 6115259 - DNA, 16 bp, Homo sapiens
ctatccatctcctggt

SEQ ID NO: 6115260 - DNA, 22 bp, Homo sapiens
ctatccatggcactaaaccact

SEQ ID NO: 6115261 - DNA, 18 bp, Homo sapiens
ctatccattctctccttc

SEQ ID NO: 6115262 - DNA, 21 bp, Homo sapiens
ctatccattctctccttccct

SEQ ID NO: 6115263 - DNA, 21 bp, Homo sapiens
ctatcccaataggcagactgg

SEQ ID NO: 6115264 - DNA, 23 bp, Homo sapiens
ctatcccaatcaaagaattacag

SEQ ID NO: 6115265 - DNA, 23 bp, Homo sapiens
ctatcccacccaacagctcagag

SEQ ID NO: 6115266 - DNA, 12 bp, Homo sapiens
ctatcccatccc

SEQ ID NO: 6115267 - DNA, 16 bp, Homo sapiens
ctatcccatcccatcc

SEQ ID NO: 6115268 - DNA, 19 bp, Homo sapiens
ctatccccaaactccttta

SEQ ID NO: 6115269 - DNA, 14 bp, Homo sapiens
ctatccccaagctg

SEQ ID NO: 6115270 - DNA, 18 bp, Homo sapiens
ctatccccaggccaggtc

SEQ ID NO: 6115271 - DNA, 17 bp, Homo sapiens
ctatccccatctccctg

SEQ ID NO: 6115272 - DNA, 21 bp, Homo sapiens
ctatccccatctccctgcctg

SEQ ID NO: 6115273 - DNA, 22 bp, Homo sapiens
ctatccccatctccctgcctgg

SEQ ID NO: 6115274 - DNA, 20 bp, Homo sapiens
ctatccccggacgcatgcag

SEQ ID NO: 6115275 - DNA, 18 bp, Homo sapiens
ctatccctaacaggctgt

SEQ ID NO: 6115276 - DNA, 20 bp, Homo sapiens
ctatccctggccacctgcca

SEQ ID NO: 6115277 - DNA, 13 bp, Homo sapiens
ctatcccttctca

SEQ ID NO: 6115278 - DNA, 17 bp, Homo sapiens
ctatccgccctgcagca

SEQ ID NO: 6115279 - DNA, 15 bp, Homo sapiens
ctatccgctgccagc

SEQ ID NO: 6115280 - DNA, 22 bp, Homo sapiens
ctatccgctgccagccttgagc

SEQ ID NO: 6115281 - DNA, 19 bp, Homo sapiens
ctatcctagtcttcacaac

SEQ ID NO: 6115282 - DNA, 13 bp, Homo sapiens
ctatcctctctct

SEQ ID NO: 6115283 - DNA, 15 bp, Homo sapiens
ctatcctctcttcct

SEQ ID NO: 6115284 - DNA, 21 bp, Homo sapiens
ctatcctctgtatataggcct

SEQ ID NO: 6115285 - DNA, 11 bp, Homo sapiens
ctatcctgatt

SEQ ID NO: 6115286 - DNA, 15 bp, Homo sapiens
ctatcctgcaccctc

SEQ ID NO: 6115287 - DNA, 17 bp, Homo sapiens
ctatcctgcaccctctg

SEQ ID NO: 6115288 - DNA, 18 bp, Homo sapiens
ctatcctgcaccctctgc

SEQ ID NO: 6115289 - DNA, 21 bp, Homo sapiens
ctatcctgcaccctctgctat

SEQ ID NO: 6115290 - DNA, 16 bp, Homo sapiens
ctatcctgcaggaaat

SEQ ID NO: 6115291 - DNA, 13 bp, Homo sapiens
ctatcctggcttt

SEQ ID NO: 6115292 - DNA, 13 bp, Homo sapiens
ctatcctgggacc

SEQ ID NO: 6115293 - DNA, 14 bp, Homo sapiens
ctatcctgggacct

SEQ ID NO: 6115294 - DNA, 20 bp, Homo sapiens
ctatcctgggacctccccag

SEQ ID NO: 6115295 - DNA, 18 bp, Homo sapiens
ctatcctgttaacactgt

SEQ ID NO: 6115296 - DNA, 23 bp, Homo sapiens
ctatcctgttaacactgtaatat

SEQ ID NO: 6115297 - DNA, 16 bp, Homo sapiens
ctatcctgtttaataa

SEQ ID NO: 6115298 - DNA, 17 bp, Homo sapiens
ctatccttacatttcac

SEQ ID NO: 6115299 - DNA, 16 bp, Homo sapiens
ctatccttccagtggc

SEQ ID NO: 6115300 - DNA, 20 bp, Homo sapiens
ctatccttggagagcagctg

SEQ ID NO: 6115301 - DNA, 21 bp, Homo sapiens
ctatccttggagagcagctgg

SEQ ID NO: 6115302 - DNA, 11 bp, Homo sapiens
ctatccttggc

SEQ ID NO: 6115303 - DNA, 18 bp, Homo sapiens
ctatccttggcaccaaag

SEQ ID NO: 6115304 - DNA, 20 bp, Homo sapiens
ctatccttggcaccaaagat

SEQ ID NO: 6115305 - DNA, 14 bp, Homo sapiens
ctatccttttttcc

SEQ ID NO: 6115306 - DNA, 16 bp, Homo sapiens
ctatccttttttcctt

SEQ ID NO: 6115307 - DNA, 22 bp, Homo sapiens
ctatcgaaatgacggtgttaat

SEQ ID NO: 6115308 - DNA, 18 bp, Homo sapiens
ctatcgagtttgcaatgt

SEQ ID NO: 6115309 - DNA, 21 bp, Homo sapiens
ctatcgatctggaaagagctg

SEQ ID NO: 6115310 - DNA, 15 bp, Homo sapiens
ctatcgccctccttt

SEQ ID NO: 6115311 - DNA, 17 bp, Homo sapiens
ctatcgggggtgagcga

SEQ ID NO: 6115312 - DNA, 20 bp, Homo sapiens
ctatcgggggtgagcgaagc

SEQ ID NO: 6115313 - DNA, 19 bp, Homo sapiens
ctatcgttattataaatgt

SEQ ID NO: 6115314 - DNA, 20 bp, Homo sapiens
ctatcgttattataaatgtt

SEQ ID NO: 6115315 - DNA, 18 bp, Homo sapiens
ctatctaacacttttgct

SEQ ID NO: 6115316 - DNA, 16 bp, Homo sapiens
ctatctaaccctccca

SEQ ID NO: 6115317 - DNA, 13 bp, Homo sapiens
ctatctaatgaca

SEQ ID NO: 6115318 - DNA, 18 bp, Homo sapiens
ctatctaatttttattaa

SEQ ID NO: 6115319 - DNA, 21 bp, Homo sapiens
ctatctaatttttattaattt

SEQ ID NO: 6115320 - DNA, 12 bp, Homo sapiens
ctatctacaaaa

SEQ ID NO: 6115321 - DNA, 16 bp, Homo sapiens
ctatctacaaagaaaa

SEQ ID NO: 6115322 - DNA, 20 bp, Homo sapiens
ctatctacaaagaaaaatta

SEQ ID NO: 6115323 - DNA, 18 bp, Homo sapiens
ctatctactaagtttcct

SEQ ID NO: 6115324 - DNA, 20 bp, Homo sapiens
ctatctagcagtaaaagata

SEQ ID NO: 6115325 - DNA, 22 bp, Homo sapiens
ctatctaggtattttcttcaaa

SEQ ID NO: 6115326 - DNA, 22 bp, Homo sapiens
ctatctaggtggagttgaaaga

SEQ ID NO: 6115327 - DNA, 18 bp, Homo sapiens
ctatctagttctaacagt

SEQ ID NO: 6115328 - DNA, 18 bp, Homo sapiens
ctatctatacctgccttt

SEQ ID NO: 6115329 - DNA, 15 bp, Homo sapiens
ctatctatcctgaat

SEQ ID NO: 6115330 - DNA, 19 bp, Homo sapiens
ctatctattaaagtgactt

SEQ ID NO: 6115331 - DNA, 18 bp, Homo sapiens
ctatctcacagcacactc

SEQ ID NO: 6115332 - DNA, 22 bp, Homo sapiens
ctatctcatagggatgctgtga

SEQ ID NO: 6115333 - DNA, 15 bp, Homo sapiens
ctatctcatctgtct

SEQ ID NO: 6115334 - DNA, 18 bp, Homo sapiens
ctatctcatttccaagca

SEQ ID NO: 6115335 - DNA, 19 bp, Homo sapiens
ctatctccagcggccctgt

SEQ ID NO: 6115336 - DNA, 21 bp, Homo sapiens
ctatctccagcggccctgtca

SEQ ID NO: 6115337 - DNA, 20 bp, Homo sapiens
ctatctcccccaacccacct

SEQ ID NO: 6115338 - DNA, 13 bp, Homo sapiens
ctatctcccccag

SEQ ID NO: 6115339 - DNA, 15 bp, Homo sapiens
ctatctcccccagcc

SEQ ID NO: 6115340 - DNA, 18 bp, Homo sapiens
ctatctccctgcctcctg

SEQ ID NO: 6115341 - DNA, 19 bp, Homo sapiens
ctatctcgctagccatata

SEQ ID NO: 6115342 - DNA, 15 bp, Homo sapiens
ctatctctaataaaa

SEQ ID NO: 6115343 - DNA, 22 bp, Homo sapiens
ctatctctatataaaaaatata

SEQ ID NO: 6115344 - DNA, 17 bp, Homo sapiens
ctatctctcaaaacttg

SEQ ID NO: 6115345 - DNA, 12 bp, Homo sapiens
ctatctcttcct

SEQ ID NO: 6115346 - DNA, 19 bp, Homo sapiens
ctatctcttgtcatataaa

SEQ ID NO: 6115347 - DNA, 21 bp, Homo sapiens
ctatctcttgtcatataaacc

SEQ ID NO: 6115348 - DNA, 14 bp, Homo sapiens
ctatctgaactaat

SEQ ID NO: 6115349 - DNA, 16 bp, Homo sapiens
ctatctgacttcatac

SEQ ID NO: 6115350 - DNA, 17 bp, Homo sapiens
ctatctgattttgtgca

SEQ ID NO: 6115351 - DNA, 15 bp, Homo sapiens
ctatctgcaaatagt

SEQ ID NO: 6115352 - DNA, 21 bp, Homo sapiens
ctatctgcactctaaactgca

SEQ ID NO: 6115353 - DNA, 18 bp, Homo sapiens
ctatctgcatttataaat

SEQ ID NO: 6115354 - DNA, 22 bp, Homo sapiens
ctatctgcatttataaatgtgt

SEQ ID NO: 6115355 - DNA, 12 bp, Homo sapiens
ctatctgctggg

SEQ ID NO: 6115356 - DNA, 18 bp, Homo sapiens
ctatctgcttatgcagtt

SEQ ID NO: 6115357 - DNA, 12 bp, Homo sapiens
ctatctggaaaa

SEQ ID NO: 6115358 - DNA, 17 bp, Homo sapiens
ctatctggaatttaatt

SEQ ID NO: 6115359 - DNA, 20 bp, Homo sapiens
ctatctggaggccttccagc

SEQ ID NO: 6115360 - DNA, 16 bp, Homo sapiens
ctatctgggcctgggc

SEQ ID NO: 6115361 - DNA, 17 bp, Homo sapiens
ctatctgggcctgggct

SEQ ID NO: 6115362 - DNA, 21 bp, Homo sapiens
ctatctgggcctgggctaggg

SEQ ID NO: 6115363 - DNA, 15 bp, Homo sapiens
ctatctgggcttcct

SEQ ID NO: 6115364 - DNA, 17 bp, Homo sapiens
ctatctgggcttcctgg

SEQ ID NO: 6115365 - DNA, 19 bp, Homo sapiens
ctatctggggagctcctgg

SEQ ID NO: 6115366 - DNA, 22 bp, Homo sapiens
ctatctggggagctcctggcca

SEQ ID NO: 6115367 - DNA, 17 bp, Homo sapiens
ctatctggtgatttcta

SEQ ID NO: 6115368 - DNA, 13 bp, Homo sapiens
ctatctgtaagag

SEQ ID NO: 6115369 - DNA, 17 bp, Homo sapiens
ctatctgtatgtctgcc

SEQ ID NO: 6115370 - DNA, 12 bp, Homo sapiens
ctatctgtattc

SEQ ID NO: 6115371 - DNA, 19 bp, Homo sapiens
ctatctgtattggcagcac

SEQ ID NO: 6115372 - DNA, 13 bp, Homo sapiens
ctatctgtattta

SEQ ID NO: 6115373 - DNA, 14 bp, Homo sapiens
ctatctgtctggtg

SEQ ID NO: 6115374 - DNA, 16 bp, Homo sapiens
ctatctgtctggtggc

SEQ ID NO: 6115375 - DNA, 17 bp, Homo sapiens
ctatctgtctggtggcc

SEQ ID NO: 6115376 - DNA, 18 bp, Homo sapiens
ctatctgtctggtggccc

SEQ ID NO: 6115377 - DNA, 12 bp, Homo sapiens
ctatctgtgcta

SEQ ID NO: 6115378 - DNA, 14 bp, Homo sapiens
ctatcttaattttg

SEQ ID NO: 6115379 - DNA, 15 bp, Homo sapiens
ctatcttaattttgg

SEQ ID NO: 6115380 - DNA, 24 bp, Homo sapiens
ctatcttaggtagtcatgctgtgc

SEQ ID NO: 6115381 - DNA, 20 bp, Homo sapiens
ctatcttatctcagatattt

SEQ ID NO: 6115382 - DNA, 21 bp, Homo sapiens
ctatcttctctatatttttat

SEQ ID NO: 6115383 - DNA, 16 bp, Homo sapiens
ctatcttcttcaaata

SEQ ID NO: 6115384 - DNA, 14 bp, Homo sapiens
ctatcttgcatcta

SEQ ID NO: 6115385 - DNA, 17 bp, Homo sapiens
ctatcttgttccaaggc

SEQ ID NO: 6115386 - DNA, 12 bp, Homo sapiens
ctatctttaaac

SEQ ID NO: 6115387 - DNA, 16 bp, Homo sapiens
ctatctttcaggaaat

SEQ ID NO: 6115388 - DNA, 19 bp, Homo sapiens
ctatctttgccaccctcat

SEQ ID NO: 6115389 - DNA, 21 bp, Homo sapiens
ctatctttgccaccctcatgc

SEQ ID NO: 6115390 - DNA, 13 bp, Homo sapiens
ctatctttttgaa

SEQ ID NO: 6115391 - DNA, 15 bp, Homo sapiens
ctatcttttttagtg

SEQ ID NO: 6115392 - DNA, 14 bp, Homo sapiens
ctatgaaaagcaac

SEQ ID NO: 6115393 - DNA, 15 bp, Homo sapiens
ctatgaaaagcaact

SEQ ID NO: 6115394 - DNA, 18 bp, Homo sapiens
ctatgaaaatgagccctg

SEQ ID NO: 6115395 - DNA, 18 bp, Homo sapiens
ctatgaaacctttttcct

SEQ ID NO: 6115396 - DNA, 11 bp, Homo sapiens
ctatgaaagct

SEQ ID NO: 6115397 - DNA, 19 bp, Homo sapiens
ctatgaaatattatgttaa

SEQ ID NO: 6115398 - DNA, 13 bp, Homo sapiens
ctatgaacactgt

SEQ ID NO: 6115399 - DNA, 14 bp, Homo sapiens
ctatgaacactgtc

SEQ ID NO: 6115400 - DNA, 11 bp, Homo sapiens
ctatgaacaga

SEQ ID NO: 6115401 - DNA, 22 bp, Homo sapiens
ctatgaacagaaactacatttc

SEQ ID NO: 6115402 - DNA, 15 bp, Homo sapiens
ctatgaacagaccat

SEQ ID NO: 6115403 - DNA, 13 bp, Homo sapiens
ctatgaactacaa

SEQ ID NO: 6115404 - DNA, 13 bp, Homo sapiens
ctatgaactagag

SEQ ID NO: 6115405 - DNA, 17 bp, Homo sapiens
ctatgaagccaactgac

SEQ ID NO: 6115406 - DNA, 19 bp, Homo sapiens
ctatgaagccaactgacaa

SEQ ID NO: 6115407 - DNA, 18 bp, Homo sapiens
ctatgaaggatccatctt

SEQ ID NO: 6115408 - DNA, 13 bp, Homo sapiens
ctatgaaggctgt

SEQ ID NO: 6115409 - DNA, 18 bp, Homo sapiens
ctatgaagtatataatgg

SEQ ID NO: 6115410 - DNA, 17 bp, Homo sapiens
ctatgaagttgaaaaat

SEQ ID NO: 6115411 - DNA, 22 bp, Homo sapiens
ctatgaagtttattttctattt

SEQ ID NO: 6115412 - DNA, 22 bp, Homo sapiens
ctatgaatgggcaaaactgaat

SEQ ID NO: 6115413 - DNA, 17 bp, Homo sapiens
ctatgaattctaagtga

SEQ ID NO: 6115414 - DNA, 22 bp, Homo sapiens
ctatgaatttgtccatttaaaa

SEQ ID NO: 6115415 - DNA, 17 bp, Homo sapiens
ctatgacaaattcaaga

SEQ ID NO: 6115416 - DNA, 15 bp, Homo sapiens
ctatgacaataaatt

SEQ ID NO: 6115417 - DNA, 16 bp, Homo sapiens
ctatgacaataaattt

SEQ ID NO: 6115418 - DNA, 19 bp, Homo sapiens
ctatgacaatttttgctgt

SEQ ID NO: 6115419 - DNA, 18 bp, Homo sapiens
ctatgacactcatcaggt

SEQ ID NO: 6115420 - DNA, 13 bp, Homo sapiens
ccttggcttgtgt

SEQ ID NO: 6115421 - DNA, 23 bp, Homo sapiens
ccttggctttatgcaaatacaat

SEQ ID NO: 6115422 - DNA, 19 bp, Homo sapiens
ccttggctttatgcacatt

SEQ ID NO: 6115423 - DNA, 17 bp, Homo sapiens
ccttggctttcagagcc

SEQ ID NO: 6115424 - DNA, 20 bp, Homo sapiens
ccttggctttcagagccagc

SEQ ID NO: 6115425 - DNA, 18 bp, Homo sapiens
ccttggctttgaggccga

SEQ ID NO: 6115426 - DNA, 21 bp, Homo sapiens
ccttggcttttactgaagcct

SEQ ID NO: 6115427 - DNA, 19 bp, Homo sapiens
ccttgggaaggacacagca

SEQ ID NO: 6115428 - DNA, 12 bp, Homo sapiens
ccttgggacagc

SEQ ID NO: 6115429 - DNA, 18 bp, Homo sapiens
ccttgggaccaaaggggg

SEQ ID NO: 6115430 - DNA, 11 bp, Homo sapiens
ccttgggagag

SEQ ID NO: 6115431 - DNA, 14 bp, Homo sapiens
ccttgggagccact

SEQ ID NO: 6115432 - DNA, 18 bp, Homo sapiens
ccttgggaggaagcagaa

SEQ ID NO: 6115433 - DNA, 18 bp, Homo sapiens
ccttgggatcagatcaag

SEQ ID NO: 6115434 - DNA, 20 bp, Homo sapiens
ccttgggatcagatcaagag

SEQ ID NO: 6115435 - DNA, 21 bp, Homo sapiens
ccttgggcaagtcccttgacc

SEQ ID NO: 6115436 - DNA, 17 bp, Homo sapiens
ccttgggcacgggagag

SEQ ID NO: 6115437 - DNA, 22 bp, Homo sapiens
ccttgggcacgtgtgctgggat

SEQ ID NO: 6115438 - DNA, 22 bp, Homo sapiens
ccttgggcagagtcctgccttc

SEQ ID NO: 6115439 - DNA, 13 bp, Homo sapiens
ccttgggcagggt

SEQ ID NO: 6115440 - DNA, 24 bp, Homo sapiens
ccttgggcatccacccagtgctgc

SEQ ID NO: 6115441 - DNA, 16 bp, Homo sapiens
ccttgggccacgctct

SEQ ID NO: 6115442 - DNA, 23 bp, Homo sapiens
ccttgggccagaagtaccagact

SEQ ID NO: 6115443 - DNA, 22 bp, Homo sapiens
ccttgggccctttttcccttcc

SEQ ID NO: 6115444 - DNA, 19 bp, Homo sapiens
ccttgggccggtgctgggg

SEQ ID NO: 6115445 - DNA, 13 bp, Homo sapiens
ccttgggcctccc

SEQ ID NO: 6115446 - DNA, 15 bp, Homo sapiens
ccttgggcctcccac

SEQ ID NO: 6115447 - DNA, 11 bp, Homo sapiens
ccttgggcctg

SEQ ID NO: 6115448 - DNA, 18 bp, Homo sapiens
ccttgggcctgggcctct

SEQ ID NO: 6115449 - DNA, 18 bp, Homo sapiens
ccttgggccttgctgctg

SEQ ID NO: 6115450 - DNA, 19 bp, Homo sapiens
ccttgggccttgctgctgc

SEQ ID NO: 6115451 - DNA, 20 bp, Homo sapiens
ccttgggcgcttcccacctg

SEQ ID NO: 6115452 - DNA, 21 bp, Homo sapiens
ccttgggcgcttcccacctgc

SEQ ID NO: 6115453 - DNA, 14 bp, Homo sapiens
ccttgggcggctga

SEQ ID NO: 6115454 - DNA, 12 bp, Homo sapiens
ccttgggctcct

SEQ ID NO: 6115455 - DNA, 20 bp, Homo sapiens
ccttgggctcctggctgcca

SEQ ID NO: 6115456 - DNA, 21 bp, Homo sapiens
ccttgggctcctggctgccag

SEQ ID NO: 6115457 - DNA, 23 bp, Homo sapiens
ccttgggctcctggctgccaggc

SEQ ID NO: 6115458 - DNA, 16 bp, Homo sapiens
ccttgggctctgatga

SEQ ID NO: 6115459 - DNA, 15 bp, Homo sapiens
ccttgggctctgctg

SEQ ID NO: 6115460 - DNA, 14 bp, Homo sapiens
ccttgggctgctcc

SEQ ID NO: 6115461 - DNA, 15 bp, Homo sapiens
ccttgggctgctcct

SEQ ID NO: 6115462 - DNA, 22 bp, Homo sapiens
ccttgggctgggacttcttacc

SEQ ID NO: 6115463 - DNA, 21 bp, Homo sapiens
ccttggggaaccccgagctgg

SEQ ID NO: 6115464 - DNA, 17 bp, Homo sapiens
ccttggggaagggtggg

SEQ ID NO: 6115465 - DNA, 18 bp, Homo sapiens
ccttggggagcagtggcc

SEQ ID NO: 6115466 - DNA, 12 bp, Homo sapiens
ccttggggaggg

SEQ ID NO: 6115467 - DNA, 17 bp, Homo sapiens
ccttggggaggggtcag

SEQ ID NO: 6115468 - DNA, 21 bp, Homo sapiens
ccttggggaggggtcagctct

SEQ ID NO: 6115469 - DNA, 18 bp, Homo sapiens
ccttggggattcttccat

SEQ ID NO: 6115470 - DNA, 11 bp, Homo sapiens
ccttggggcac

SEQ ID NO: 6115471 - DNA, 14 bp, Homo sapiens
ccttggggcaggca

SEQ ID NO: 6115472 - DNA, 15 bp, Homo sapiens
ccttggggcaggcag

SEQ ID NO: 6115473 - DNA, 14 bp, Homo sapiens
ccttggggccagac

SEQ ID NO: 6115474 - DNA, 17 bp, Homo sapiens
ccttggggcctggcttg

SEQ ID NO: 6115475 - DNA, 23 bp, Homo sapiens
ccttggggctggggaagaggact

SEQ ID NO: 6115476 - DNA, 15 bp, Homo sapiens
ccttgggggctccca

SEQ ID NO: 6115477 - DNA, 13 bp, Homo sapiens
ccttggggggcca

SEQ ID NO: 6115478 - DNA, 20 bp, Homo sapiens
ccttgggggggctgcctttg

SEQ ID NO: 6115479 - DNA, 22 bp, Homo sapiens
ccttgggggggctgcctttgtg

SEQ ID NO: 6115480 - DNA, 22 bp, Homo sapiens
ccttgggggtcctcctccaggg

SEQ ID NO: 6115481 - DNA, 16 bp, Homo sapiens
ccttggggtccctcca

SEQ ID NO: 6115482 - DNA, 19 bp, Homo sapiens
ccttggggtccctccaccc

SEQ ID NO: 6115483 - DNA, 20 bp, Homo sapiens
ccttggggtgagggacagag

SEQ ID NO: 6115484 - DNA, 21 bp, Homo sapiens
ccttggggtggcgcgcctgcc

SEQ ID NO: 6115485 - DNA, 22 bp, Homo sapiens
ccttggggtggcgcgcctgcct

SEQ ID NO: 6115486 - DNA, 16 bp, Homo sapiens
ccttggggtgggggcc

SEQ ID NO: 6115487 - DNA, 20 bp, Homo sapiens
ccttggggtgggggccaggc

SEQ ID NO: 6115488 - DNA, 22 bp, Homo sapiens
ccttggggtgggggccaggcct

SEQ ID NO: 6115489 - DNA, 22 bp, Homo sapiens
ccttggggttcccccagacaga

SEQ ID NO: 6115490 - DNA, 13 bp, Homo sapiens
ccttgggtcattg

SEQ ID NO: 6115491 - DNA, 21 bp, Homo sapiens
ccttgggtgagtggcctgcta

SEQ ID NO: 6115492 - DNA, 14 bp, Homo sapiens
ccttgggtggcccc

SEQ ID NO: 6115493 - DNA, 19 bp, Homo sapiens
ccttgggttccaaccaggc

SEQ ID NO: 6115494 - DNA, 19 bp, Homo sapiens
ccttggtatgtgccaggct

SEQ ID NO: 6115495 - DNA, 14 bp, Homo sapiens
ccttggtcccagac

SEQ ID NO: 6115496 - DNA, 20 bp, Homo sapiens
ccttggtcccagacagctgg

SEQ ID NO: 6115497 - DNA, 23 bp, Homo sapiens
ccttggtctaacttttgtgtgaa

SEQ ID NO: 6115498 - DNA, 16 bp, Homo sapiens
ccttggtctcatgccc

SEQ ID NO: 6115499 - DNA, 18 bp, Homo sapiens
ccttggtctcatgccccg

SEQ ID NO: 6115500 - DNA, 11 bp, Homo sapiens
ccttggtctga

SEQ ID NO: 6115501 - DNA, 17 bp, Homo sapiens
ccttggtctttgtatct

SEQ ID NO: 6115502 - DNA, 13 bp, Homo sapiens
ccttggtgagaaa

SEQ ID NO: 6115503 - DNA, 20 bp, Homo sapiens
ccttggtgccacagagggct

SEQ ID NO: 6115504 - DNA, 14 bp, Homo sapiens
ccttggtgcctctg

SEQ ID NO: 6115505 - DNA, 16 bp, Homo sapiens
ccttggtgctcttgct

SEQ ID NO: 6115506 - DNA, 14 bp, Homo sapiens
ccttggtgctgtgt

SEQ ID NO: 6115507 - DNA, 16 bp, Homo sapiens
ccttggtgctgtgtgc

SEQ ID NO: 6115508 - DNA, 17 bp, Homo sapiens
ccttggtgctgtgtgcc

SEQ ID NO: 6115509 - DNA, 21 bp, Homo sapiens
ccttggtgctgtgtgccccac

SEQ ID NO: 6115510 - DNA, 16 bp, Homo sapiens
ccttggtggagcagcc

SEQ ID NO: 6115511 - DNA, 19 bp, Homo sapiens
ccttggtggagcagccaga

SEQ ID NO: 6115512 - DNA, 12 bp, Homo sapiens
ccttggtgggga

SEQ ID NO: 6115513 - DNA, 19 bp, Homo sapiens
ccttggtgggggagcctct

SEQ ID NO: 6115514 - DNA, 20 bp, Homo sapiens
ccttggtgggggagcctctg

SEQ ID NO: 6115515 - DNA, 18 bp, Homo sapiens
ccttggtgtagttgaact

SEQ ID NO: 6115516 - DNA, 18 bp, Homo sapiens
ccttggtgtccacctggc

SEQ ID NO: 6115517 - DNA, 20 bp, Homo sapiens
ccttggtgtccacctggccc

SEQ ID NO: 6115518 - DNA, 22 bp, Homo sapiens
ccttggtgtttcccttcctcgg

SEQ ID NO: 6115519 - DNA, 16 bp, Homo sapiens
ccttggttcccccact

SEQ ID NO: 6115520 - DNA, 13 bp, Homo sapiens
ccttggttcctaa

SEQ ID NO: 6115521 - DNA, 16 bp, Homo sapiens
ccttggttcctccagc

SEQ ID NO: 6115522 - DNA, 18 bp, Homo sapiens
ccttggttcctccagcaa

SEQ ID NO: 6115523 - DNA, 20 bp, Homo sapiens
ccttggttctgcactgttgc

SEQ ID NO: 6115524 - DNA, 21 bp, Homo sapiens
ccttggttctgcactgttgcc

SEQ ID NO: 6115525 - DNA, 21 bp, Homo sapiens
ccttggttggacctattgcca

SEQ ID NO: 6115526 - DNA, 24 bp, Homo sapiens
ccttggttgggtcaaggacagggc

SEQ ID NO: 6115527 - DNA, 20 bp, Homo sapiens
ccttggtttagaggaaccca

SEQ ID NO: 6115528 - DNA, 22 bp, Homo sapiens
ccttggtttagaggaacccaag

SEQ ID NO: 6115529 - DNA, 22 bp, Homo sapiens
ccttggtttcctgagccacctt

SEQ ID NO: 6115530 - DNA, 21 bp, Homo sapiens
ccttggtttggacacagtgtt

SEQ ID NO: 6115531 - DNA, 17 bp, Homo sapiens
ccttggttttgcctctt

SEQ ID NO: 6115532 - DNA, 19 bp, Homo sapiens
ccttggttttgcctcttta

SEQ ID NO: 6115533 - DNA, 15 bp, Homo sapiens
ccttgtaaatgctct

SEQ ID NO: 6115534 - DNA, 20 bp, Homo sapiens
ccttgtaaatgggaaaatat

SEQ ID NO: 6115535 - DNA, 18 bp, Homo sapiens
ccttgtaaattccccttc

SEQ ID NO: 6115536 - DNA, 16 bp, Homo sapiens
ccttgtaattctaaat

SEQ ID NO: 6115537 - DNA, 19 bp, Homo sapiens
ccttgtacagaaccagcac

SEQ ID NO: 6115538 - DNA, 16 bp, Homo sapiens
ccttgtacagtctgct

SEQ ID NO: 6115539 - DNA, 21 bp, Homo sapiens
ccttgtacagtctgctcctct

SEQ ID NO: 6115540 - DNA, 13 bp, Homo sapiens
ccttgtaccccat

SEQ ID NO: 6115541 - DNA, 15 bp, Homo sapiens
ccttgtaccccatcc

SEQ ID NO: 6115542 - DNA, 16 bp, Homo sapiens
ccttgtaccccatccc

SEQ ID NO: 6115543 - DNA, 18 bp, Homo sapiens
ccttgtactcttaggata

SEQ ID NO: 6115544 - DNA, 17 bp, Homo sapiens
ccttgtacttgcttgta

SEQ ID NO: 6115545 - DNA, 19 bp, Homo sapiens
ccttgtagaaaaatccctc

SEQ ID NO: 6115546 - DNA, 19 bp, Homo sapiens
ccttgtagacgcacctgct

SEQ ID NO: 6115547 - DNA, 22 bp, Homo sapiens
ccttgtagacgcacctgctgag

SEQ ID NO: 6115548 - DNA, 20 bp, Homo sapiens
ccttgtagatggagcaagtg

SEQ ID NO: 6115549 - DNA, 17 bp, Homo sapiens
ccttgtagctcctcccc

SEQ ID NO: 6115550 - DNA, 11 bp, Homo sapiens
ccttgtataaa

SEQ ID NO: 6115551 - DNA, 16 bp, Homo sapiens
ccttgtataaggagct

SEQ ID NO: 6115552 - DNA, 24 bp, Homo sapiens
ccttgtatagtgtccccatgggct

SEQ ID NO: 6115553 - DNA, 14 bp, Homo sapiens
ccttgtatttaaat

SEQ ID NO: 6115554 - DNA, 16 bp, Homo sapiens
ccttgtatttaaatat

SEQ ID NO: 6115555 - DNA, 19 bp, Homo sapiens
ccttgtcaatactgagcca

SEQ ID NO: 6115556 - DNA, 20 bp, Homo sapiens
ccttgtcaccagcaacatct

SEQ ID NO: 6115557 - DNA, 22 bp, Homo sapiens
ccttgtcacgatcacaggcctt

SEQ ID NO: 6115558 - DNA, 15 bp, Homo sapiens
ccttgtcacgccaga

SEQ ID NO: 6115559 - DNA, 18 bp, Homo sapiens
ccttgtcacgccagactt

SEQ ID NO: 6115560 - DNA, 14 bp, Homo sapiens
ccttgtcaggaccc

SEQ ID NO: 6115561 - DNA, 17 bp, Homo sapiens
ccttgtcaggacccagg

SEQ ID NO: 6115562 - DNA, 19 bp, Homo sapiens
ccttgtcaggacccaggcc

SEQ ID NO: 6115563 - DNA, 15 bp, Homo sapiens
ccttgtcagtgtgtc

SEQ ID NO: 6115564 - DNA, 14 bp, Homo sapiens
ccttgtcatcctcc

SEQ ID NO: 6115565 - DNA, 14 bp, Homo sapiens
ccttgtccacccac

SEQ ID NO: 6115566 - DNA, 21 bp, Homo sapiens
ccttgtccaggaactgcctgg

SEQ ID NO: 6115567 - DNA, 16 bp, Homo sapiens
ccttgtcccagccagt

SEQ ID NO: 6115568 - DNA, 17 bp, Homo sapiens
ccttgtccccacactcc

SEQ ID NO: 6115569 - DNA, 19 bp, Homo sapiens
ccttgtccccacactccta

SEQ ID NO: 6115570 - DNA, 17 bp, Homo sapiens
ccttgtccccagctcca

SEQ ID NO: 6115571 - DNA, 11 bp, Homo sapiens
ccttgtccccg

SEQ ID NO: 6115572 - DNA, 17 bp, Homo sapiens
ccttgtccctggggcac

SEQ ID NO: 6115573 - DNA, 21 bp, Homo sapiens
ccttgtccgcaaggggtgatg

SEQ ID NO: 6115574 - DNA, 13 bp, Homo sapiens
ccttgtcctctca

SEQ ID NO: 6115575 - DNA, 15 bp, Homo sapiens
ccttgtcctctcaga

SEQ ID NO: 6115576 - DNA, 21 bp, Homo sapiens
ccttgtcctctcagagcctca

SEQ ID NO: 6115577 - DNA, 14 bp, Homo sapiens
ccttgtcctctccc

SEQ ID NO: 6115578 - DNA, 15 bp, Homo sapiens
ccttgtcctctcccg

SEQ ID NO: 6115579 - DNA, 16 bp, Homo sapiens
ccttgtcctgaagccc

SEQ ID NO: 6115580 - DNA, 17 bp, Homo sapiens
ccttgtcctgccagctg

SEQ ID NO: 6115581 - DNA, 19 bp, Homo sapiens
ccttgtcctgccagctgcc

SEQ ID NO: 6115582 - DNA, 21 bp, Homo sapiens
ccttgtcctgccagctgcctt

SEQ ID NO: 6115583 - DNA, 21 bp, Homo sapiens
ccttgtcggccccaccagtgc

SEQ ID NO: 6115584 - DNA, 23 bp, Homo sapiens
ccttgtcggccccaccagtgcct

SEQ ID NO: 6115585 - DNA, 13 bp, Homo sapiens
ccttgtcgtggga

SEQ ID NO: 6115586 - DNA, 21 bp, Homo sapiens
ccttgtcgttgactttaggga

SEQ ID NO: 6115587 - DNA, 15 bp, Homo sapiens
ccttgtctaaagatc

SEQ ID NO: 6115588 - DNA, 18 bp, Homo sapiens
ccttgtctagtttcccac

SEQ ID NO: 6115589 - DNA, 15 bp, Homo sapiens
ccttgtctccctggt

SEQ ID NO: 6115590 - DNA, 17 bp, Homo sapiens
ccttgtctctcactgca

SEQ ID NO: 6115591 - DNA, 14 bp, Homo sapiens
ccttgtctctcatt

SEQ ID NO: 6115592 - DNA, 22 bp, Homo sapiens
ccttgtctctcattctctttct

SEQ ID NO: 6115593 - DNA, 17 bp, Homo sapiens
ccttgtctgaactggag

SEQ ID NO: 6115594 - DNA, 20 bp, Homo sapiens
ccttgtctggggaccctgta

SEQ ID NO: 6115595 - DNA, 13 bp, Homo sapiens
ccttgtctgggtg

SEQ ID NO: 6115596 - DNA, 19 bp, Homo sapiens
ccttgtctgggtgcagctg

SEQ ID NO: 6115597 - DNA, 17 bp, Homo sapiens
ctatgacagaaaagtaa

SEQ ID NO: 6115598 - DNA, 13 bp, Homo sapiens
ctatgacagctgg

SEQ ID NO: 6115599 - DNA, 14 bp, Homo sapiens
ctatgacagctggc

SEQ ID NO: 6115600 - DNA, 14 bp, Homo sapiens
ctatgaccaaaact

SEQ ID NO: 6115601 - DNA, 13 bp, Homo sapiens
ctatgaccctgtg

SEQ ID NO: 6115602 - DNA, 17 bp, Homo sapiens
ctatgaccctgtgcctg

SEQ ID NO: 6115603 - DNA, 19 bp, Homo sapiens
ctatgaccctgtgcctgtg

SEQ ID NO: 6115604 - DNA, 23 bp, Homo sapiens
ctatgacctaggggtttctgttg

SEQ ID NO: 6115605 - DNA, 15 bp, Homo sapiens
ctatgactacatttt

SEQ ID NO: 6115606 - DNA, 14 bp, Homo sapiens
ctatgactggagta

SEQ ID NO: 6115607 - DNA, 16 bp, Homo sapiens
ctatgactgtatcttg

SEQ ID NO: 6115608 - DNA, 15 bp, Homo sapiens
ctatgactgtgttta

SEQ ID NO: 6115609 - DNA, 20 bp, Homo sapiens
ctatgacttgggcaccccca

SEQ ID NO: 6115610 - DNA, 22 bp, Homo sapiens
ctatgagaacaagtcacagctg

SEQ ID NO: 6115611 - DNA, 21 bp, Homo sapiens
ctatgagaattgggattacat

SEQ ID NO: 6115612 - DNA, 18 bp, Homo sapiens
ctatgagacctcccccag

SEQ ID NO: 6115613 - DNA, 21 bp, Homo sapiens
ctatgagacctcccccaggga

SEQ ID NO: 6115614 - DNA, 18 bp, Homo sapiens
ctatgagatggccatgct

SEQ ID NO: 6115615 - DNA, 19 bp, Homo sapiens
ctatgagatggccatgctc

SEQ ID NO: 6115616 - DNA, 13 bp, Homo sapiens
ctatgagcccagc

SEQ ID NO: 6115617 - DNA, 21 bp, Homo sapiens
ctatgaggaaactgagtcact

SEQ ID NO: 6115618 - DNA, 23 bp, Homo sapiens
ctatgaggaaactgagtcactca

SEQ ID NO: 6115619 - DNA, 15 bp, Homo sapiens
ctatgaggagcctct

SEQ ID NO: 6115620 - DNA, 16 bp, Homo sapiens
ctatgaggagcctctg

SEQ ID NO: 6115621 - DNA, 17 bp, Homo sapiens
ctatgagggccttgagt

SEQ ID NO: 6115622 - DNA, 23 bp, Homo sapiens
ctatgagggtgtttcctctaaac

SEQ ID NO: 6115623 - DNA, 14 bp, Homo sapiens
ctatgagtctagat

SEQ ID NO: 6115624 - DNA, 20 bp, Homo sapiens
ctatgagttcacatgtgccc

SEQ ID NO: 6115625 - DNA, 23 bp, Homo sapiens
ctatgagttcacatgtgccctgc

SEQ ID NO: 6115626 - DNA, 13 bp, Homo sapiens
ctatgataaagtt

SEQ ID NO: 6115627 - DNA, 21 bp, Homo sapiens
ctatgataaattatgataata

SEQ ID NO: 6115628 - DNA, 19 bp, Homo sapiens
ctatgataagattgaaatt

SEQ ID NO: 6115629 - DNA, 17 bp, Homo sapiens
ctatgataattacaata

SEQ ID NO: 6115630 - DNA, 14 bp, Homo sapiens
ctatgatactgtct

SEQ ID NO: 6115631 - DNA, 14 bp, Homo sapiens
ctatgatatgtgct

SEQ ID NO: 6115632 - DNA, 21 bp, Homo sapiens
ctatgatatgtgcttgtgtgt

SEQ ID NO: 6115633 - DNA, 16 bp, Homo sapiens
ctatgatcacagtgac

SEQ ID NO: 6115634 - DNA, 14 bp, Homo sapiens
ctatgatcatcttg

SEQ ID NO: 6115635 - DNA, 22 bp, Homo sapiens
ctatgatcccagcactttggga

SEQ ID NO: 6115636 - DNA, 21 bp, Homo sapiens
ctatgatgaaggtaattaaag

SEQ ID NO: 6115637 - DNA, 19 bp, Homo sapiens
ctatgatgagaggccagca

SEQ ID NO: 6115638 - DNA, 20 bp, Homo sapiens
ctatgatgagaggccagcac

SEQ ID NO: 6115639 - DNA, 16 bp, Homo sapiens
ctatgatggaagtgtt

SEQ ID NO: 6115640 - DNA, 17 bp, Homo sapiens
ctatgatggatggcaga

SEQ ID NO: 6115641 - DNA, 22 bp, Homo sapiens
ctatgatggatggcagactctt

SEQ ID NO: 6115642 - DNA, 15 bp, Homo sapiens
ctatgatgggcttct

SEQ ID NO: 6115643 - DNA, 13 bp, Homo sapiens
ctatgatgtatac

SEQ ID NO: 6115644 - DNA, 20 bp, Homo sapiens
ctatgatgtatactgccact

SEQ ID NO: 6115645 - DNA, 19 bp, Homo sapiens
ctatgatgtgaaacacttt

SEQ ID NO: 6115646 - DNA, 13 bp, Homo sapiens
ctatgatgtttct

SEQ ID NO: 6115647 - DNA, 17 bp, Homo sapiens
ctatgattgtactttga

SEQ ID NO: 6115648 - DNA, 15 bp, Homo sapiens
ctatgattttctatt

SEQ ID NO: 6115649 - DNA, 17 bp, Homo sapiens
ctatgatttttagacta

SEQ ID NO: 6115650 - DNA, 13 bp, Homo sapiens
ctatgcaaaaaat

SEQ ID NO: 6115651 - DNA, 19 bp, Homo sapiens
ctatgcaaaaaattcttta

SEQ ID NO: 6115652 - DNA, 15 bp, Homo sapiens
ctatgcaaagaactc

SEQ ID NO: 6115653 - DNA, 15 bp, Homo sapiens
ctatgcaagagaaat

SEQ ID NO: 6115654 - DNA, 22 bp, Homo sapiens
ctatgcaataatccacccccag

SEQ ID NO: 6115655 - DNA, 14 bp, Homo sapiens
ctatgcaattttta

SEQ ID NO: 6115656 - DNA, 15 bp, Homo sapiens
ctatgcaatttttaa

SEQ ID NO: 6115657 - DNA, 18 bp, Homo sapiens
ctatgcaatttttaaact

SEQ ID NO: 6115658 - DNA, 19 bp, Homo sapiens
ctatgcaatttttaaacta

SEQ ID NO: 6115659 - DNA, 22 bp, Homo sapiens
ctatgcaatttttaaactagta

SEQ ID NO: 6115660 - DNA, 22 bp, Homo sapiens
ctatgcacaccaaattgctgag

SEQ ID NO: 6115661 - DNA, 13 bp, Homo sapiens
ctatgcacacttt

SEQ ID NO: 6115662 - DNA, 13 bp, Homo sapiens
ctatgcacagagc

SEQ ID NO: 6115663 - DNA, 15 bp, Homo sapiens
ctatgcacagagccc

SEQ ID NO: 6115664 - DNA, 13 bp, Homo sapiens
ctatgcacatatg

SEQ ID NO: 6115665 - DNA, 20 bp, Homo sapiens
ctatgcacatatggactctg

SEQ ID NO: 6115666 - DNA, 22 bp, Homo sapiens
ctatgcacatatggactctgca

SEQ ID NO: 6115667 - DNA, 16 bp, Homo sapiens
ctatgcacctataaat

SEQ ID NO: 6115668 - DNA, 18 bp, Homo sapiens
ctatgcacctataaatac

SEQ ID NO: 6115669 - DNA, 15 bp, Homo sapiens
ctatgcactgaagag

SEQ ID NO: 6115670 - DNA, 16 bp, Homo sapiens
ctatgcactgaagagc

SEQ ID NO: 6115671 - DNA, 18 bp, Homo sapiens
ctatgcactgaagagctc

SEQ ID NO: 6115672 - DNA, 19 bp, Homo sapiens
ctatgcactgaagagctct

SEQ ID NO: 6115673 - DNA, 17 bp, Homo sapiens
ctatgcagacatctctg

SEQ ID NO: 6115674 - DNA, 18 bp, Homo sapiens
ctatgcagacatctctgg

SEQ ID NO: 6115675 - DNA, 11 bp, Homo sapiens
ctatgcagcct

SEQ ID NO: 6115676 - DNA, 14 bp, Homo sapiens
ctatgcagggaggc

SEQ ID NO: 6115677 - DNA, 14 bp, Homo sapiens
ctatgcagtatctc

SEQ ID NO: 6115678 - DNA, 20 bp, Homo sapiens
ctatgcatattcaatgtatt

SEQ ID NO: 6115679 - DNA, 22 bp, Homo sapiens
ctatgcatattcaatgtattga

SEQ ID NO: 6115680 - DNA, 17 bp, Homo sapiens
ctatgcatatttataga

SEQ ID NO: 6115681 - DNA, 19 bp, Homo sapiens
ctatgcatggtgccccagg

SEQ ID NO: 6115682 - DNA, 20 bp, Homo sapiens
ctatgcatggtgccccagga

SEQ ID NO: 6115683 - DNA, 21 bp, Homo sapiens
ctatgcatggtgccccaggac

SEQ ID NO: 6115684 - DNA, 23 bp, Homo sapiens
ctatgcatggtgccccaggacca

SEQ ID NO: 6115685 - DNA, 15 bp, Homo sapiens
ctatgcatggtttca

SEQ ID NO: 6115686 - DNA, 18 bp, Homo sapiens
ctatgcatggtttcagca

SEQ ID NO: 6115687 - DNA, 19 bp, Homo sapiens
ctatgcatggtttcagcac

SEQ ID NO: 6115688 - DNA, 20 bp, Homo sapiens
ctatgcatggtttcagcact

SEQ ID NO: 6115689 - DNA, 15 bp, Homo sapiens
ctatgcattttcttc

SEQ ID NO: 6115690 - DNA, 22 bp, Homo sapiens
ctatgcattttcttcacagtgc

SEQ ID NO: 6115691 - DNA, 17 bp, Homo sapiens
ctatgccaaagatcact

SEQ ID NO: 6115692 - DNA, 18 bp, Homo sapiens
ctatgccaaagatcactt

SEQ ID NO: 6115693 - DNA, 20 bp, Homo sapiens
ctatgccaagtccctggaaa

SEQ ID NO: 6115694 - DNA, 15 bp, Homo sapiens
ctatgccacctgcag

SEQ ID NO: 6115695 - DNA, 20 bp, Homo sapiens
ctatgccacctgcagcgtct

SEQ ID NO: 6115696 - DNA, 18 bp, Homo sapiens
ctatgccactaggccctg

SEQ ID NO: 6115697 - DNA, 20 bp, Homo sapiens
ctatgccactaggccctggt

SEQ ID NO: 6115698 - DNA, 23 bp, Homo sapiens
ctatgccactaggccctggtctg

SEQ ID NO: 6115699 - DNA, 19 bp, Homo sapiens
ctatgccagtgctcaaggt

SEQ ID NO: 6115700 - DNA, 17 bp, Homo sapiens
ctatgcccacataccca

SEQ ID NO: 6115701 - DNA, 13 bp, Homo sapiens
ctatgcccagcct

SEQ ID NO: 6115702 - DNA, 15 bp, Homo sapiens
ctatgcccagcctcc

SEQ ID NO: 6115703 - DNA, 21 bp, Homo sapiens
ctatgcccctagtaactgctg

SEQ ID NO: 6115704 - DNA, 17 bp, Homo sapiens
ctatgccctgcagagca

SEQ ID NO: 6115705 - DNA, 21 bp, Homo sapiens
ctatgccctgcagagcaataa

SEQ ID NO: 6115706 - DNA, 18 bp, Homo sapiens
ctatgccctgcccttcct

SEQ ID NO: 6115707 - DNA, 23 bp, Homo sapiens
ctatgccgtgtagtttctggtat

SEQ ID NO: 6115708 - DNA, 21 bp, Homo sapiens
ctatgcctcacaaatgctgtg

SEQ ID NO: 6115709 - DNA, 16 bp, Homo sapiens
ctatgcctctctacag

SEQ ID NO: 6115710 - DNA, 12 bp, Homo sapiens
ctatgcctgcac

SEQ ID NO: 6115711 - DNA, 23 bp, Homo sapiens
ctatgcctgcactgggaaggaaa

SEQ ID NO: 6115712 - DNA, 14 bp, Homo sapiens
ctatgcctgtattt

SEQ ID NO: 6115713 - DNA, 18 bp, Homo sapiens
ctatgcctgtatttccaa

SEQ ID NO: 6115714 - DNA, 16 bp, Homo sapiens
ctatgccttcaaatag

SEQ ID NO: 6115715 - DNA, 17 bp, Homo sapiens
ctatgccttcaaatagt

SEQ ID NO: 6115716 - DNA, 14 bp, Homo sapiens
ctatgccttttgta

SEQ ID NO: 6115717 - DNA, 16 bp, Homo sapiens
ctatgccttttgtagc

SEQ ID NO: 6115718 - DNA, 15 bp, Homo sapiens
ctatgctaaactgtg

SEQ ID NO: 6115719 - DNA, 19 bp, Homo sapiens
ctatgctagaggcttttat

SEQ ID NO: 6115720 - DNA, 21 bp, Homo sapiens
ctatgctattaaaaaaaaaga

SEQ ID NO: 6115721 - DNA, 21 bp, Homo sapiens
ctatgctatttctggcctcag

SEQ ID NO: 6115722 - DNA, 20 bp, Homo sapiens
ctatgctcataactgtgtca

SEQ ID NO: 6115723 - DNA, 19 bp, Homo sapiens
ctatgctgaagacattcaa

SEQ ID NO: 6115724 - DNA, 13 bp, Homo sapiens
ctatgctgagttt

SEQ ID NO: 6115725 - DNA, 15 bp, Homo sapiens
ctatgctgcttttat

SEQ ID NO: 6115726 - DNA, 19 bp, Homo sapiens
ctatgctgcttttatatct

SEQ ID NO: 6115727 - DNA, 13 bp, Homo sapiens
ctatgctggcttt

SEQ ID NO: 6115728 - DNA, 22 bp, Homo sapiens
ctatgctggcttttcaccccag

SEQ ID NO: 6115729 - DNA, 18 bp, Homo sapiens
ctatgctggtgaaaacaa

SEQ ID NO: 6115730 - DNA, 14 bp, Homo sapiens
ctatgctgtatctg

SEQ ID NO: 6115731 - DNA, 14 bp, Homo sapiens
ctatgctgtgtgca

SEQ ID NO: 6115732 - DNA, 22 bp, Homo sapiens
ctatgctgttaacagctgtcaa

SEQ ID NO: 6115733 - DNA, 15 bp, Homo sapiens
ctatgctgttcattg

SEQ ID NO: 6115734 - DNA, 13 bp, Homo sapiens
ctatgctgtttgt

SEQ ID NO: 6115735 - DNA, 11 bp, Homo sapiens
ctatgctttga

SEQ ID NO: 6115736 - DNA, 19 bp, Homo sapiens
ctatgctttgaaacagaaa

SEQ ID NO: 6115737 - DNA, 21 bp, Homo sapiens
ctatggaaaagggtcttcttg

SEQ ID NO: 6115738 - DNA, 13 bp, Homo sapiens
ctatggaaacatt

SEQ ID NO: 6115739 - DNA, 23 bp, Homo sapiens
ctatggaaacattttatactgta

SEQ ID NO: 6115740 - DNA, 10 bp, Homo sapiens
ctatggaaat

SEQ ID NO: 6115741 - DNA, 13 bp, Homo sapiens
ctatggaaatgtg

SEQ ID NO: 6115742 - DNA, 15 bp, Homo sapiens
ctatggaaatgtgag

SEQ ID NO: 6115743 - DNA, 18 bp, Homo sapiens
ctatggaaatgtgagaaa

SEQ ID NO: 6115744 - DNA, 22 bp, Homo sapiens
ctatggaaatgtgagaaatgtc

SEQ ID NO: 6115745 - DNA, 20 bp, Homo sapiens
ctatggaatagttctgtata

SEQ ID NO: 6115746 - DNA, 17 bp, Homo sapiens
ctatggaatgtcagtgt

SEQ ID NO: 6115747 - DNA, 14 bp, Homo sapiens
ctatggacaactta

SEQ ID NO: 6115748 - DNA, 20 bp, Homo sapiens
ctatggaccaaatgtaaaat

SEQ ID NO: 6115749 - DNA, 18 bp, Homo sapiens
ctatggactgcacaaaag

SEQ ID NO: 6115750 - DNA, 18 bp, Homo sapiens
ctatggagactttgctgt

SEQ ID NO: 6115751 - DNA, 17 bp, Homo sapiens
ctatggagagccctggg

SEQ ID NO: 6115752 - DNA, 18 bp, Homo sapiens
ctatggagagccctggga

SEQ ID NO: 6115753 - DNA, 21 bp, Homo sapiens
ctatggagagggcttgaaatg

SEQ ID NO: 6115754 - DNA, 11 bp, Homo sapiens
ctatggagcag

SEQ ID NO: 6115755 - DNA, 14 bp, Homo sapiens
ctatggagggcaga

SEQ ID NO: 6115756 - DNA, 19 bp, Homo sapiens
ctatggagtcttgtgaaag

SEQ ID NO: 6115757 - DNA, 22 bp, Homo sapiens
ctatggatcaaagaaattcaga

SEQ ID NO: 6115758 - DNA, 15 bp, Homo sapiens
ctatggatggcttct

SEQ ID NO: 6115759 - DNA, 16 bp, Homo sapiens
ctatggatggcttcta

SEQ ID NO: 6115760 - DNA, 10 bp, Homo sapiens
ctatggatgt

SEQ ID NO: 6115761 - DNA, 18 bp, Homo sapiens
ctatggatgtggggtccc

SEQ ID NO: 6115762 - DNA, 22 bp, Homo sapiens
ctatggattcacttctatttat

SEQ ID NO: 6115763 - DNA, 21 bp, Homo sapiens
ctatggatttggggtgttaca

SEQ ID NO: 6115764 - DNA, 14 bp, Homo sapiens
ctatggcagaaaaa

SEQ ID NO: 6115765 - DNA, 22 bp, Homo sapiens
ctatggcagaaaaaatgtctgt

SEQ ID NO: 6115766 - DNA, 20 bp, Homo sapiens
ctatggcaggataagaaagc

SEQ ID NO: 6115767 - DNA, 17 bp, Homo sapiens
ctatggcagtccagcca

SEQ ID NO: 6115768 - DNA, 23 bp, Homo sapiens
ctatggcatattgataataaaat

SEQ ID NO: 6115769 - DNA, 15 bp, Homo sapiens
ctatggccactggcc

SEQ ID NO: 6115770 - DNA, 13 bp, Homo sapiens
ctatggccagtct

SEQ ID NO: 6115771 - DNA, 14 bp, Homo sapiens
ctatggcccagaaa

SEQ ID NO: 6115772 - DNA, 15 bp, Homo sapiens
ctatggcccagaaac

SEQ ID NO: 6115773 - DNA, 13 bp, Homo sapiens
ctatggcccagcc

SEQ ID NO: 6115774 - DNA, 18 bp, Homo sapiens
ctatggcccagccactgc

SEQ ID NO: 6115775 - DNA, 21 bp, Homo sapiens
ctatggcccagccactgcagc

SEQ ID NO: 6115776 - DNA, 16 bp, Homo sapiens
ctatggcccatctgta

SEQ ID NO: 6115777 - DNA, 16 bp, Homo sapiens
ctatggccctgcaaaa

SEQ ID NO: 6115778 - DNA, 18 bp, Homo sapiens
ctatggccctgcaaaaat

SEQ ID NO: 6115779 - DNA, 13 bp, Homo sapiens
ctatggcctccct

SEQ ID NO: 6115780 - DNA, 16 bp, Homo sapiens
ctatggcctcgcctcc

SEQ ID NO: 6115781 - DNA, 15 bp, Homo sapiens
ctatggctgtatttt

SEQ ID NO: 6115782 - DNA, 19 bp, Homo sapiens
ctatggctttaaataaatt

SEQ ID NO: 6115783 - DNA, 13 bp, Homo sapiens
ctatggctttcaa

SEQ ID NO: 6115784 - DNA, 16 bp, Homo sapiens
ctatggctttcaaagc

SEQ ID NO: 6115785 - DNA, 13 bp, Homo sapiens
ctatgggaacaat

SEQ ID NO: 6115786 - DNA, 18 bp, Homo sapiens
ctatgggaagctctgtgt

SEQ ID NO: 6115787 - DNA, 19 bp, Homo sapiens
ctatgggaagctctgtgtg

SEQ ID NO: 6115788 - DNA, 16 bp, Homo sapiens
ctatgggaatcagctg

SEQ ID NO: 6115789 - DNA, 18 bp, Homo sapiens
ctatgggactcaatgcac

SEQ ID NO: 6115790 - DNA, 22 bp, Homo sapiens
ctatgggactcaatgcactgac

SEQ ID NO: 6115791 - DNA, 21 bp, Homo sapiens
ctatgggagattaaaaccaga

SEQ ID NO: 6115792 - DNA, 13 bp, Homo sapiens
ctatgggagcccc

SEQ ID NO: 6115793 - DNA, 19 bp, Homo sapiens
ctatgggagccccagggtc

SEQ ID NO: 6115794 - DNA, 19 bp, Homo sapiens
ctatgggcctgccgggctg

SEQ ID NO: 6115795 - DNA, 17 bp, Homo sapiens
ctatgggcttggaccac

SEQ ID NO: 6115796 - DNA, 23 bp, Homo sapiens
ctatggggaaggttatcagtgct

SEQ ID NO: 6115797 - DNA, 17 bp, Homo sapiens
ctatggggagaaaagac

SEQ ID NO: 6115798 - DNA, 22 bp, Homo sapiens
ctatggggagaggaactccttg

SEQ ID NO: 6115799 - DNA, 16 bp, Homo sapiens
ctatggggaggccctg

SEQ ID NO: 6115800 - DNA, 20 bp, Homo sapiens
ctatggggatagatgtgtgg

SEQ ID NO: 6115801 - DNA, 18 bp, Homo sapiens
ctatggggatggtccact

SEQ ID NO: 6115802 - DNA, 21 bp, Homo sapiens
ctatggggtggggtgggtgta

SEQ ID NO: 6115803 - DNA, 22 bp, Homo sapiens
ctatgggtatcaaacagctcag

SEQ ID NO: 6115804 - DNA, 14 bp, Homo sapiens
ctatgggtgttaac

SEQ ID NO: 6115805 - DNA, 21 bp, Homo sapiens
ctatgggtttagttactttag

SEQ ID NO: 6115806 - DNA, 12 bp, Homo sapiens
ctatggtaaaga

SEQ ID NO: 6115807 - DNA, 22 bp, Homo sapiens
ctatggtaaagatattattcac

SEQ ID NO: 6115808 - DNA, 17 bp, Homo sapiens
ctatggtaaataactgt

SEQ ID NO: 6115809 - DNA, 19 bp, Homo sapiens
ctatggtaaataactgtga

SEQ ID NO: 6115810 - DNA, 22 bp, Homo sapiens
ctatggtaaataactgtgactg

SEQ ID NO: 6115811 - DNA, 17 bp, Homo sapiens
ctatggtatgctggcca

SEQ ID NO: 6115812 - DNA, 13 bp, Homo sapiens
ctatggtcacaga

SEQ ID NO: 6115813 - DNA, 15 bp, Homo sapiens
ctatggtcagttgag

SEQ ID NO: 6115814 - DNA, 12 bp, Homo sapiens
ctatggtcatct

SEQ ID NO: 6115815 - DNA, 21 bp, Homo sapiens
ctatggtcgggagacagcatc

SEQ ID NO: 6115816 - DNA, 19 bp, Homo sapiens
ctatggtgagatgcagctg

SEQ ID NO: 6115817 - DNA, 15 bp, Homo sapiens
ctatggtgccaatgg

SEQ ID NO: 6115818 - DNA, 16 bp, Homo sapiens
ctatggtgctctgtct

SEQ ID NO: 6115819 - DNA, 21 bp, Homo sapiens
ctatggtgctgccttgcttct

SEQ ID NO: 6115820 - DNA, 21 bp, Homo sapiens
ctatggtgtgcttatgttttt

SEQ ID NO: 6115821 - DNA, 15 bp, Homo sapiens
ctatggttatgaaag

SEQ ID NO: 6115822 - DNA, 23 bp, Homo sapiens
ctatggttcccaataaaagtgac

SEQ ID NO: 6115823 - DNA, 20 bp, Homo sapiens
ctatggttctaaatattgct

SEQ ID NO: 6115824 - DNA, 16 bp, Homo sapiens
ctatggttgccacccc

SEQ ID NO: 6115825 - DNA, 17 bp, Homo sapiens
ctatggttgccacccca

SEQ ID NO: 6115826 - DNA, 23 bp, Homo sapiens
ctatggtttgccattatttaata

SEQ ID NO: 6115827 - DNA, 14 bp, Homo sapiens
ctatgtaaaaatat

SEQ ID NO: 6115828 - DNA, 12 bp, Homo sapiens
ctatgtaaacaa

SEQ ID NO: 6115829 - DNA, 15 bp, Homo sapiens
ctatgtaaattattg

SEQ ID NO: 6115830 - DNA, 18 bp, Homo sapiens
ctatgtaaattattgtaa

SEQ ID NO: 6115831 - DNA, 23 bp, Homo sapiens
ctatgtaaattattgtaaacttt

SEQ ID NO: 6115832 - DNA, 17 bp, Homo sapiens
ctatgtaacttgttgca

SEQ ID NO: 6115833 - DNA, 21 bp, Homo sapiens
ctatgtaagaattcagaagac

SEQ ID NO: 6115834 - DNA, 22 bp, Homo sapiens
ctatgtaataatgtacagagga

SEQ ID NO: 6115835 - DNA, 19 bp, Homo sapiens
ctatgtaatgcttatgtgt

SEQ ID NO: 6115836 - DNA, 22 bp, Homo sapiens
ctatgtaatgcttatgtgttgc

SEQ ID NO: 6115837 - DNA, 17 bp, Homo sapiens
ctatgtaatgtaaatac

SEQ ID NO: 6115838 - DNA, 15 bp, Homo sapiens
ctatgtacaatattt

SEQ ID NO: 6115839 - DNA, 21 bp, Homo sapiens
ctatgtacaatattttaagca

SEQ ID NO: 6115840 - DNA, 22 bp, Homo sapiens
ctatgtacaatattttaagcat

SEQ ID NO: 6115841 - DNA, 17 bp, Homo sapiens
ctatgtacagagctttc

SEQ ID NO: 6115842 - DNA, 23 bp, Homo sapiens
ctatgtacagagctttcttttgt

SEQ ID NO: 6115843 - DNA, 15 bp, Homo sapiens
ctatgtagaactgtt

SEQ ID NO: 6115844 - DNA, 15 bp, Homo sapiens
ctatgtaggaaaaaa

SEQ ID NO: 6115845 - DNA, 13 bp, Homo sapiens
ctatgtagtcata

SEQ ID NO: 6115846 - DNA, 18 bp, Homo sapiens
ctatgtagtcataataaa

SEQ ID NO: 6115847 - DNA, 19 bp, Homo sapiens
ctatgtagtcataataaat

SEQ ID NO: 6115848 - DNA, 18 bp, Homo sapiens
ctatgtagtgccgctctt

SEQ ID NO: 6115849 - DNA, 17 bp, Homo sapiens
ctatgtataaaatacat

SEQ ID NO: 6115850 - DNA, 18 bp, Homo sapiens
ctatgtataaaatacata

SEQ ID NO: 6115851 - DNA, 13 bp, Homo sapiens
ctatgtatcaatg

SEQ ID NO: 6115852 - DNA, 19 bp, Homo sapiens
ctatgtatcaatgagtaac

SEQ ID NO: 6115853 - DNA, 14 bp, Homo sapiens
ctatgtatggaata

SEQ ID NO: 6115854 - DNA, 14 bp, Homo sapiens
ctatgtattaattt

SEQ ID NO: 6115855 - DNA, 15 bp, Homo sapiens
ctatgtattaattta

SEQ ID NO: 6115856 - DNA, 18 bp, Homo sapiens
ctatgtattaccagcccc

SEQ ID NO: 6115857 - DNA, 23 bp, Homo sapiens
ctatgtatttgcaaggctgattt

SEQ ID NO: 6115858 - DNA, 13 bp, Homo sapiens
ctatgtcatttca

SEQ ID NO: 6115859 - DNA, 13 bp, Homo sapiens
ctatgtcattttt

SEQ ID NO: 6115860 - DNA, 23 bp, Homo sapiens
ctatgtcatttttaatgtatcta

SEQ ID NO: 6115861 - DNA, 18 bp, Homo sapiens
ctatgtccaacagagtgg

SEQ ID NO: 6115862 - DNA, 20 bp, Homo sapiens
ctatgtccaacagagtggac

SEQ ID NO: 6115863 - DNA, 20 bp, Homo sapiens
ctatgtccatgaaaaacagc

SEQ ID NO: 6115864 - DNA, 22 bp, Homo sapiens
ctatgtccatgaaaaacagcag

SEQ ID NO: 6115865 - DNA, 23 bp, Homo sapiens
ctatgtccatgaaaaacagcaga

SEQ ID NO: 6115866 - DNA, 14 bp, Homo sapiens
ctatgtcccaagag

SEQ ID NO: 6115867 - DNA, 19 bp, Homo sapiens
ctatgtcccaagagccata

SEQ ID NO: 6115868 - DNA, 19 bp, Homo sapiens
ctatgtcccagcccctggt

SEQ ID NO: 6115869 - DNA, 20 bp, Homo sapiens
ctatgtcccagcccctggta

SEQ ID NO: 6115870 - DNA, 15 bp, Homo sapiens
ctatgtcctaaggac

SEQ ID NO: 6115871 - DNA, 20 bp, Homo sapiens
ctatgtcctaaggacacact

SEQ ID NO: 6115872 - DNA, 16 bp, Homo sapiens
ctatgtcctaataata

SEQ ID NO: 6115873 - DNA, 19 bp, Homo sapiens
ctatgtcctagtttcctta

SEQ ID NO: 6115874 - DNA, 21 bp, Homo sapiens
ctatgtcgtgttttcaaggaa

SEQ ID NO: 6115875 - DNA, 23 bp, Homo sapiens
ctatgtctagagcctcttgggga

SEQ ID NO: 6115876 - DNA, 13 bp, Homo sapiens
ctatgtctcagga

SEQ ID NO: 6115877 - DNA, 15 bp, Homo sapiens
ctatgtctcatgttt

SEQ ID NO: 6115878 - DNA, 14 bp, Homo sapiens
ctatgtctctagca

SEQ ID NO: 6115879 - DNA, 15 bp, Homo sapiens
ctatgtctgccttcg

SEQ ID NO: 6115880 - DNA, 12 bp, Homo sapiens
ctatgtctggca

SEQ ID NO: 6115881 - DNA, 12 bp, Homo sapiens
ctatgtctgtga

SEQ ID NO: 6115882 - DNA, 13 bp, Homo sapiens
ctatgtcttgttt

SEQ ID NO: 6115883 - DNA, 23 bp, Homo sapiens
ctatgtgaaactctattatggaa

SEQ ID NO: 6115884 - DNA, 15 bp, Homo sapiens
ctatgtgaatatgga

SEQ ID NO: 6115885 - DNA, 21 bp, Homo sapiens
ctatgtgacatttctcttccc

SEQ ID NO: 6115886 - DNA, 17 bp, Homo sapiens
ctatgtgagcacaaagg

SEQ ID NO: 6115887 - DNA, 21 bp, Homo sapiens
ctatgtgatgaaactttgaaa

SEQ ID NO: 6115888 - DNA, 18 bp, Homo sapiens
ctatgtgattctggaagc

SEQ ID NO: 6115889 - DNA, 13 bp, Homo sapiens
ctatgtgcacagc

SEQ ID NO: 6115890 - DNA, 17 bp, Homo sapiens
ctatgtgccagttcctg

SEQ ID NO: 6115891 - DNA, 18 bp, Homo sapiens
ctatgtgccagttcctgt

SEQ ID NO: 6115892 - DNA, 22 bp, Homo sapiens
ctatgtgccttatgttgaaaaa

SEQ ID NO: 6115893 - DNA, 17 bp, Homo sapiens
ctatgtgcgaagcaaga

SEQ ID NO: 6115894 - DNA, 22 bp, Homo sapiens
ctatgtgcgaagcaagaagaat

SEQ ID NO: 6115895 - DNA, 14 bp, Homo sapiens
ctatgtgcgagaca

SEQ ID NO: 6115896 - DNA, 16 bp, Homo sapiens
ctatgtgctgggtgcc

SEQ ID NO: 6115897 - DNA, 14 bp, Homo sapiens
ctatgtggcagctg

SEQ ID NO: 6115898 - DNA, 15 bp, Homo sapiens
ctatgtggcagctgg

SEQ ID NO: 6115899 - DNA, 22 bp, Homo sapiens
ctatgtggcagctggggagcag

SEQ ID NO: 6115900 - DNA, 14 bp, Homo sapiens
ctatgtggcatgtg

SEQ ID NO: 6115901 - DNA, 15 bp, Homo sapiens
ctatgtggctgaaaa

SEQ ID NO: 6115902 - DNA, 22 bp, Homo sapiens
ctatgtgggaaaaaagaaatcc

SEQ ID NO: 6115903 - DNA, 11 bp, Homo sapiens
ctatgtgtata

SEQ ID NO: 6115904 - DNA, 14 bp, Homo sapiens
ctatgtgtatatat

SEQ ID NO: 6115905 - DNA, 18 bp, Homo sapiens
ctatgtgtatgttgactt

SEQ ID NO: 6115906 - DNA, 17 bp, Homo sapiens
ctatgtgtgttgtttcc

SEQ ID NO: 6115907 - DNA, 19 bp, Homo sapiens
ctatgtgtttggtttataa

SEQ ID NO: 6115908 - DNA, 14 bp, Homo sapiens
ctatgttaatattt

SEQ ID NO: 6115909 - DNA, 17 bp, Homo sapiens
ctatgttattttcagtg

SEQ ID NO: 6115910 - DNA, 18 bp, Homo sapiens
ctatgttattttcagtgc

SEQ ID NO: 6115911 - DNA, 21 bp, Homo sapiens
ctatgttcagaacttcatctg

SEQ ID NO: 6115912 - DNA, 13 bp, Homo sapiens
ctatgttccctcc

SEQ ID NO: 6115913 - DNA, 19 bp, Homo sapiens
ctatgttctgtcttcccaa

SEQ ID NO: 6115914 - DNA, 13 bp, Homo sapiens
ctatgttgcccaa

SEQ ID NO: 6115915 - DNA, 14 bp, Homo sapiens
ctatgttgcccagg

SEQ ID NO: 6115916 - DNA, 15 bp, Homo sapiens
ctatgttgcccaggc

SEQ ID NO: 6115917 - DNA, 17 bp, Homo sapiens
ctatgttgcccaggcag

SEQ ID NO: 6115918 - DNA, 19 bp, Homo sapiens
ctatgttgcccaggcaggt

SEQ ID NO: 6115919 - DNA, 19 bp, Homo sapiens
ctatgttgcctaggctgga

SEQ ID NO: 6115920 - DNA, 21 bp, Homo sapiens
ctatgttgggggggaccctgc

SEQ ID NO: 6115921 - DNA, 23 bp, Homo sapiens
ctatgttgggggggaccctgcct

SEQ ID NO: 6115922 - DNA, 13 bp, Homo sapiens
ctatgttggtttc

SEQ ID NO: 6115923 - DNA, 16 bp, Homo sapiens
ctatgttgtgatcctt

SEQ ID NO: 6115924 - DNA, 18 bp, Homo sapiens
ctatgttgtggtccatca

SEQ ID NO: 6115925 - DNA, 20 bp, Homo sapiens
ctatgtttacaaatggacat

SEQ ID NO: 6115926 - DNA, 11 bp, Homo sapiens
ctatgtttact

SEQ ID NO: 6115927 - DNA, 16 bp, Homo sapiens
ctatgtttattctagt

SEQ ID NO: 6115928 - DNA, 13 bp, Homo sapiens
ctatgtttgtatt

SEQ ID NO: 6115929 - DNA, 17 bp, Homo sapiens
ctatgtttgtgtgattt

SEQ ID NO: 6115930 - DNA, 21 bp, Homo sapiens
ctatgtttgtgtgatttccta

SEQ ID NO: 6115931 - DNA, 23 bp, Homo sapiens
ctatgtttgtgtgatttcctaaa

SEQ ID NO: 6115932 - DNA, 16 bp, Homo sapiens
ctatgttttaaaataa

SEQ ID NO: 6115933 - DNA, 14 bp, Homo sapiens
ctatgtttttaaag

SEQ ID NO: 6115934 - DNA, 15 bp, Homo sapiens
ctatgtttttaaagt

SEQ ID NO: 6115935 - DNA, 15 bp, Homo sapiens
ctattaaaagactca

SEQ ID NO: 6115936 - DNA, 17 bp, Homo sapiens
ctattaaaagactcatc

SEQ ID NO: 6115937 - DNA, 19 bp, Homo sapiens
ctattaaaagactcatccg

SEQ ID NO: 6115938 - DNA, 11 bp, Homo sapiens
ctattaaaatt

SEQ ID NO: 6115939 - DNA, 21 bp, Homo sapiens
ctattaaacatgctgtacata

SEQ ID NO: 6115940 - DNA, 14 bp, Homo sapiens
ctattaaaggaaaa

SEQ ID NO: 6115941 - DNA, 23 bp, Homo sapiens
ctattaaaggttcctttgttccc

SEQ ID NO: 6115942 - DNA, 14 bp, Homo sapiens
ctattaaagtgact

SEQ ID NO: 6115943 - DNA, 17 bp, Homo sapiens
ctattaaagtgccattt

SEQ ID NO: 6115944 - DNA, 22 bp, Homo sapiens
ctattaaagtgctaaggttcta

SEQ ID NO: 6115945 - DNA, 23 bp, Homo sapiens
ctattaaagtgctaaggttctaa

SEQ ID NO: 6115946 - DNA, 17 bp, Homo sapiens
ctattaaatgttgcaca

SEQ ID NO: 6115947 - DNA, 18 bp, Homo sapiens
ctattaacatgatgtact

SEQ ID NO: 6115948 - DNA, 21 bp, Homo sapiens
ctattaacatgatgtactaaa

SEQ ID NO: 6115949 - DNA, 12 bp, Homo sapiens
ctattaactctg

SEQ ID NO: 6115950 - DNA, 13 bp, Homo sapiens
ctattaagaaggc

SEQ ID NO: 6115951 - DNA, 22 bp, Homo sapiens
ctattaagcagtaaaaactgtt

SEQ ID NO: 6115952 - DNA, 22 bp, Homo sapiens
ctattaaggatgtagcttttca

SEQ ID NO: 6115953 - DNA, 21 bp, Homo sapiens
ctattaaggtgatatatttaa

SEQ ID NO: 6115954 - DNA, 21 bp, Homo sapiens
ccttgtcttattcccttcctg

SEQ ID NO: 6115955 - DNA, 20 bp, Homo sapiens
ccttgtcttcccccctctcc

SEQ ID NO: 6115956 - DNA, 21 bp, Homo sapiens
ccttgtcttcccccctctcct

SEQ ID NO: 6115957 - DNA, 22 bp, Homo sapiens
ccttgtcttttcaagtaatttt

SEQ ID NO: 6115958 - DNA, 17 bp, Homo sapiens
ccttgtgaccttctcta

SEQ ID NO: 6115959 - DNA, 16 bp, Homo sapiens
ccttgtgactcagtgt

SEQ ID NO: 6115960 - DNA, 19 bp, Homo sapiens
ccttgtgacttacaatttg

SEQ ID NO: 6115961 - DNA, 12 bp, Homo sapiens
ccttgtgaggat

SEQ ID NO: 6115962 - DNA, 15 bp, Homo sapiens
ccttgtgagggagag

SEQ ID NO: 6115963 - DNA, 21 bp, Homo sapiens
ccttgtgatgtcatacagaga

SEQ ID NO: 6115964 - DNA, 23 bp, Homo sapiens
ccttgtgatgtcatacagagaag

SEQ ID NO: 6115965 - DNA, 20 bp, Homo sapiens
ccttgtgatgtgcacgtaaa

SEQ ID NO: 6115966 - DNA, 16 bp, Homo sapiens
ccttgtgcaattgtct

SEQ ID NO: 6115967 - DNA, 13 bp, Homo sapiens
ccttgtgccctgc

SEQ ID NO: 6115968 - DNA, 18 bp, Homo sapiens
ccttgtgccctgccccca

SEQ ID NO: 6115969 - DNA, 20 bp, Homo sapiens
ccttgtgcctgctcctgtac

SEQ ID NO: 6115970 - DNA, 12 bp, Homo sapiens
ccttgtgcctgg

SEQ ID NO: 6115971 - DNA, 13 bp, Homo sapiens
ccttgtgcctggg

SEQ ID NO: 6115972 - DNA, 14 bp, Homo sapiens
ccttgtgctcctgc

SEQ ID NO: 6115973 - DNA, 15 bp, Homo sapiens
ccttgtgctgccagt

SEQ ID NO: 6115974 - DNA, 13 bp, Homo sapiens
ccttgtgctgggg

SEQ ID NO: 6115975 - DNA, 12 bp, Homo sapiens
ccttgtgcttgg

SEQ ID NO: 6115976 - DNA, 24 bp, Homo sapiens
ccttgtgcttggtggggctcgtgg

SEQ ID NO: 6115977 - DNA, 21 bp, Homo sapiens
ccttgtggactggctgtgccc

SEQ ID NO: 6115978 - DNA, 22 bp, Homo sapiens
ccttgtggatgctagtgctgta

SEQ ID NO: 6115979 - DNA, 21 bp, Homo sapiens
ccttgtggcacgttgacccaa

SEQ ID NO: 6115980 - DNA, 16 bp, Homo sapiens
ccttgtggcagaggat

SEQ ID NO: 6115981 - DNA, 16 bp, Homo sapiens
ccttgtggcctatgaa

SEQ ID NO: 6115982 - DNA, 12 bp, Homo sapiens
ccttgtggcttc

SEQ ID NO: 6115983 - DNA, 19 bp, Homo sapiens
ccttgtgggaccagtccca

SEQ ID NO: 6115984 - DNA, 21 bp, Homo sapiens
ccttgtgggaccagtcccaca

SEQ ID NO: 6115985 - DNA, 14 bp, Homo sapiens
ccttgtgggcaaag

SEQ ID NO: 6115986 - DNA, 17 bp, Homo sapiens
ccttgtgggcctgggct

SEQ ID NO: 6115987 - DNA, 20 bp, Homo sapiens
ccttgtgggtgtgagcagca

SEQ ID NO: 6115988 - DNA, 17 bp, Homo sapiens
ccttgtggtccaaatag

SEQ ID NO: 6115989 - DNA, 20 bp, Homo sapiens
ccttgtggtcccaccccaca

SEQ ID NO: 6115990 - DNA, 23 bp, Homo sapiens
ccttgtggtctcgatgctgctgg

SEQ ID NO: 6115991 - DNA, 23 bp, Homo sapiens
ccttgtggtctttgctgctgctc

SEQ ID NO: 6115992 - DNA, 19 bp, Homo sapiens
ccttgtgtactttcttccc

SEQ ID NO: 6115993 - DNA, 17 bp, Homo sapiens
ccttgtgtatcctgaca

SEQ ID NO: 6115994 - DNA, 20 bp, Homo sapiens
ccttgtgtatcctgacagcg

SEQ ID NO: 6115995 - DNA, 15 bp, Homo sapiens
ccttgtgtcactggc

SEQ ID NO: 6115996 - DNA, 21 bp, Homo sapiens
ccttgtgtcagagctgggagt

SEQ ID NO: 6115997 - DNA, 23 bp, Homo sapiens
ccttgtgtctacagagaacctgg

SEQ ID NO: 6115998 - DNA, 18 bp, Homo sapiens
ccttgtgtgctggcttcc

SEQ ID NO: 6115999 - DNA, 14 bp, Homo sapiens
ccttgtgtgtcagg

SEQ ID NO: 6116000 - DNA, 17 bp, Homo sapiens
ccttgtgtgtgccctgg

SEQ ID NO: 6116001 - DNA, 12 bp, Homo sapiens
ccttgtgttcct

SEQ ID NO: 6116002 - DNA, 17 bp, Homo sapiens
ccttgtgttccttctgt

SEQ ID NO: 6116003 - DNA, 20 bp, Homo sapiens
ccttgtgttccttctgtgaa

SEQ ID NO: 6116004 - DNA, 20 bp, Homo sapiens
ccttgtgttgcactgaacag

SEQ ID NO: 6116005 - DNA, 21 bp, Homo sapiens
ccttgtgttgcactgaacagg

SEQ ID NO: 6116006 - DNA, 18 bp, Homo sapiens
ccttgttacccatgaaaa

SEQ ID NO: 6116007 - DNA, 19 bp, Homo sapiens
ccttgttcaaggagggcac

SEQ ID NO: 6116008 - DNA, 15 bp, Homo sapiens
ccttgttccagcttt

SEQ ID NO: 6116009 - DNA, 14 bp, Homo sapiens
ccttgttctatttt

SEQ ID NO: 6116010 - DNA, 21 bp, Homo sapiens
ccttgttctgataatgaaaat

SEQ ID NO: 6116011 - DNA, 18 bp, Homo sapiens
ccttgttcttagagcaga

SEQ ID NO: 6116012 - DNA, 17 bp, Homo sapiens
ccttgttgcactgcccc

SEQ ID NO: 6116013 - DNA, 19 bp, Homo sapiens
ccttgttgcactgccccct

SEQ ID NO: 6116014 - DNA, 20 bp, Homo sapiens
ccttgttgcactgccccctg

SEQ ID NO: 6116015 - DNA, 23 bp, Homo sapiens
ccttgttgcactgccccctgctt

SEQ ID NO: 6116016 - DNA, 21 bp, Homo sapiens
ccttgttgcctgcacccttcc

SEQ ID NO: 6116017 - DNA, 17 bp, Homo sapiens
ccttgttggagcctgca

SEQ ID NO: 6116018 - DNA, 23 bp, Homo sapiens
ccttgttggggagtgggtggcag

SEQ ID NO: 6116019 - DNA, 17 bp, Homo sapiens
ccttgtttacagtgagg

SEQ ID NO: 6116020 - DNA, 20 bp, Homo sapiens
ccttgtttatcagatacatc

SEQ ID NO: 6116021 - DNA, 12 bp, Homo sapiens
ccttgtttatta

SEQ ID NO: 6116022 - DNA, 14 bp, Homo sapiens
ccttgtttcaaaca

SEQ ID NO: 6116023 - DNA, 21 bp, Homo sapiens
ccttgtttctcttcctttctt

SEQ ID NO: 6116024 - DNA, 16 bp, Homo sapiens
ccttgtttctgttgtt

SEQ ID NO: 6116025 - DNA, 15 bp, Homo sapiens
ccttgtttctttctg

SEQ ID NO: 6116026 - DNA, 20 bp, Homo sapiens
ccttgtttctttctgaagtg

SEQ ID NO: 6116027 - DNA, 22 bp, Homo sapiens
ccttgtttgagtttttcctccc

SEQ ID NO: 6116028 - DNA, 23 bp, Homo sapiens
ccttgtttgagtttttcctccca

SEQ ID NO: 6116029 - DNA, 22 bp, Homo sapiens
ccttgtttgcctttaggcagga

SEQ ID NO: 6116030 - DNA, 19 bp, Homo sapiens
ccttgtttggggcaggagt

SEQ ID NO: 6116031 - DNA, 18 bp, Homo sapiens
ccttgtttgttttattca

SEQ ID NO: 6116032 - DNA, 11 bp, Homo sapiens
ccttgttttga

SEQ ID NO: 6116033 - DNA, 15 bp, Homo sapiens
ccttgttttgccagt

SEQ ID NO: 6116034 - DNA, 16 bp, Homo sapiens
ccttgttttggacagt

SEQ ID NO: 6116035 - DNA, 20 bp, Homo sapiens
cctttaaaaaaatttaagtg

SEQ ID NO: 6116036 - DNA, 13 bp, Homo sapiens
cctttaaaaagca

SEQ ID NO: 6116037 - DNA, 21 bp, Homo sapiens
cctttaaaaccagtaacgtgc

SEQ ID NO: 6116038 - DNA, 23 bp, Homo sapiens
cctttaaaacgcgtctgcctggg

SEQ ID NO: 6116039 - DNA, 13 bp, Homo sapiens
cctttaaactgtc

SEQ ID NO: 6116040 - DNA, 14 bp, Homo sapiens
cctttaaactgtct

SEQ ID NO: 6116041 - DNA, 22 bp, Homo sapiens
cctttaaagagagtttgccact

SEQ ID NO: 6116042 - DNA, 23 bp, Homo sapiens
cctttaaaggtaacttctccctt

SEQ ID NO: 6116043 - DNA, 23 bp, Homo sapiens
cctttaaaggtcgcacctccttg

SEQ ID NO: 6116044 - DNA, 11 bp, Homo sapiens
cctttaaatat

SEQ ID NO: 6116045 - DNA, 15 bp, Homo sapiens
cctttaaatatcatt

SEQ ID NO: 6116046 - DNA, 22 bp, Homo sapiens
cctttaaatatcattctttgta

SEQ ID NO: 6116047 - DNA, 21 bp, Homo sapiens
cctttaacaacatgtttccag

SEQ ID NO: 6116048 - DNA, 19 bp, Homo sapiens
cctttaacacagaccccta

SEQ ID NO: 6116049 - DNA, 12 bp, Homo sapiens
cctttaactctg

SEQ ID NO: 6116050 - DNA, 20 bp, Homo sapiens
cctttaactgacaagccatc

SEQ ID NO: 6116051 - DNA, 15 bp, Homo sapiens
cctttaactgagggc

SEQ ID NO: 6116052 - DNA, 12 bp, Homo sapiens
cctttaagaaaa

SEQ ID NO: 6116053 - DNA, 19 bp, Homo sapiens
cctttaagaaccttaatga

SEQ ID NO: 6116054 - DNA, 22 bp, Homo sapiens
cctttaagccaaagaaacaagc

SEQ ID NO: 6116055 - DNA, 14 bp, Homo sapiens
cctttaagccaaga

SEQ ID NO: 6116056 - DNA, 19 bp, Homo sapiens
cctttaagcctgcattctt

SEQ ID NO: 6116057 - DNA, 21 bp, Homo sapiens
cctttaagcctgcattcttaa

SEQ ID NO: 6116058 - DNA, 11 bp, Homo sapiens
cctttaatgag

SEQ ID NO: 6116059 - DNA, 16 bp, Homo sapiens
cctttaatgagaaaaa

SEQ ID NO: 6116060 - DNA, 19 bp, Homo sapiens
cctttaattaagactgaaa

SEQ ID NO: 6116061 - DNA, 14 bp, Homo sapiens
cctttaattcaggt

SEQ ID NO: 6116062 - DNA, 16 bp, Homo sapiens
cctttacaaaagaaat

SEQ ID NO: 6116063 - DNA, 22 bp, Homo sapiens
cctttacaaaagaaataccttg

SEQ ID NO: 6116064 - DNA, 20 bp, Homo sapiens
cctttacaaccatactttat

SEQ ID NO: 6116065 - DNA, 16 bp, Homo sapiens
cctttacaatgtgaat

SEQ ID NO: 6116066 - DNA, 18 bp, Homo sapiens
cctttacaccaactccta

SEQ ID NO: 6116067 - DNA, 22 bp, Homo sapiens
cctttacagctctcctccagcc

SEQ ID NO: 6116068 - DNA, 22 bp, Homo sapiens
cctttacagtttgtgctctact

SEQ ID NO: 6116069 - DNA, 12 bp, Homo sapiens
cctttacatgag

SEQ ID NO: 6116070 - DNA, 18 bp, Homo sapiens
cctttacatgaggactct

SEQ ID NO: 6116071 - DNA, 19 bp, Homo sapiens
cctttacatggacagaatt

SEQ ID NO: 6116072 - DNA, 22 bp, Homo sapiens
cctttaccctctttgctgcaga

SEQ ID NO: 6116073 - DNA, 13 bp, Homo sapiens
cctttacctacca

SEQ ID NO: 6116074 - DNA, 16 bp, Homo sapiens
cctttacctaccacct

SEQ ID NO: 6116075 - DNA, 22 bp, Homo sapiens
cctttacctaccaccttccctc

SEQ ID NO: 6116076 - DNA, 15 bp, Homo sapiens
cctttacgtgtttaa

SEQ ID NO: 6116077 - DNA, 19 bp, Homo sapiens
cctttacgtgtttaaaaaa

SEQ ID NO: 6116078 - DNA, 18 bp, Homo sapiens
cctttactatcattctca

SEQ ID NO: 6116079 - DNA, 14 bp, Homo sapiens
cctttactcagccc

SEQ ID NO: 6116080 - DNA, 16 bp, Homo sapiens
cctttactcagcccag

SEQ ID NO: 6116081 - DNA, 14 bp, Homo sapiens
cctttactgaatgt

SEQ ID NO: 6116082 - DNA, 16 bp, Homo sapiens
cctttactgaccctgg

SEQ ID NO: 6116083 - DNA, 18 bp, Homo sapiens
cctttacttgtctttctg

SEQ ID NO: 6116084 - DNA, 13 bp, Homo sapiens
cctttactttccc

SEQ ID NO: 6116085 - DNA, 14 bp, Homo sapiens
cctttactttctct

SEQ ID NO: 6116086 - DNA, 12 bp, Homo sapiens
cctttagaaaat

SEQ ID NO: 6116087 - DNA, 16 bp, Homo sapiens
cctttagatctctgaa

SEQ ID NO: 6116088 - DNA, 18 bp, Homo sapiens
cctttagcacgtttaaag

SEQ ID NO: 6116089 - DNA, 14 bp, Homo sapiens
cctttagcgcccag

SEQ ID NO: 6116090 - DNA, 15 bp, Homo sapiens
cctttagctttgaca

SEQ ID NO: 6116091 - DNA, 21 bp, Homo sapiens
cctttaggatgttttcctcct

SEQ ID NO: 6116092 - DNA, 18 bp, Homo sapiens
cctttaggcagcctgccg

SEQ ID NO: 6116093 - DNA, 13 bp, Homo sapiens
cctttagggcagc

SEQ ID NO: 6116094 - DNA, 15 bp, Homo sapiens
cctttagggcagctt

SEQ ID NO: 6116095 - DNA, 20 bp, Homo sapiens
cctttagggcagcttgcccc

SEQ ID NO: 6116096 - DNA, 22 bp, Homo sapiens
cctttagggcagcttgccccgg

SEQ ID NO: 6116097 - DNA, 18 bp, Homo sapiens
cctttagggttctgcctc

SEQ ID NO: 6116098 - DNA, 15 bp, Homo sapiens
cctttaggtctggtt

SEQ ID NO: 6116099 - DNA, 16 bp, Homo sapiens
cctttaggtctggttg

SEQ ID NO: 6116100 - DNA, 19 bp, Homo sapiens
cctttagtacctgaaaagt

SEQ ID NO: 6116101 - DNA, 21 bp, Homo sapiens
cctttagtatcagtgttttaa

SEQ ID NO: 6116102 - DNA, 13 bp, Homo sapiens
cctttagtgcttt

SEQ ID NO: 6116103 - DNA, 18 bp, Homo sapiens
cctttagtggtggccatt

SEQ ID NO: 6116104 - DNA, 15 bp, Homo sapiens
cctttagttataaag

SEQ ID NO: 6116105 - DNA, 18 bp, Homo sapiens
cctttatagctctcatca

SEQ ID NO: 6116106 - DNA, 14 bp, Homo sapiens
cctttatatatgta

SEQ ID NO: 6116107 - DNA, 19 bp, Homo sapiens
cctttatcaagcttagtga

SEQ ID NO: 6116108 - DNA, 22 bp, Homo sapiens
cctttatcctagttccattctt

SEQ ID NO: 6116109 - DNA, 15 bp, Homo sapiens
cctttatctcagcca

SEQ ID NO: 6116110 - DNA, 15 bp, Homo sapiens
cctttatctgcacct

SEQ ID NO: 6116111 - DNA, 18 bp, Homo sapiens
cctttatcttgaagtcag

SEQ ID NO: 6116112 - DNA, 20 bp, Homo sapiens
cctttatcttgaagtcagcc

SEQ ID NO: 6116113 - DNA, 16 bp, Homo sapiens
cctttatctttcacct

SEQ ID NO: 6116114 - DNA, 14 bp, Homo sapiens
cctttatgatgcta

SEQ ID NO: 6116115 - DNA, 22 bp, Homo sapiens
cctttatgatgctaagctgata

SEQ ID NO: 6116116 - DNA, 12 bp, Homo sapiens
cctttatgtgaa

SEQ ID NO: 6116117 - DNA, 16 bp, Homo sapiens
cctttatgttctttca

SEQ ID NO: 6116118 - DNA, 19 bp, Homo sapiens
cctttattaaaaccattgt

SEQ ID NO: 6116119 - DNA, 16 bp, Homo sapiens
cctttattaaaatctt

SEQ ID NO: 6116120 - DNA, 20 bp, Homo sapiens
cctttattcacccctgcccc

SEQ ID NO: 6116121 - DNA, 16 bp, Homo sapiens
cctttattctttaatt

SEQ ID NO: 6116122 - DNA, 21 bp, Homo sapiens
cctttattgggtatcaagaca

SEQ ID NO: 6116123 - DNA, 24 bp, Homo sapiens
cctttattggtaaattctggtata

SEQ ID NO: 6116124 - DNA, 12 bp, Homo sapiens
cctttattgtgt

SEQ ID NO: 6116125 - DNA, 19 bp, Homo sapiens
cctttatttattaaacttc

SEQ ID NO: 6116126 - DNA, 15 bp, Homo sapiens
cctttatttctcttc

SEQ ID NO: 6116127 - DNA, 19 bp, Homo sapiens
cctttattttattgaaatg

SEQ ID NO: 6116128 - DNA, 21 bp, Homo sapiens
cctttattttattgaaatgta

SEQ ID NO: 6116129 - DNA, 22 bp, Homo sapiens
cctttattttattgaaatgtat

SEQ ID NO: 6116130 - DNA, 15 bp, Homo sapiens
cctttattttatttt

SEQ ID NO: 6116131 - DNA, 16 bp, Homo sapiens
cctttattttattttt

SEQ ID NO: 6116132 - DNA, 21 bp, Homo sapiens
ctattaagtcatcatctccaa

SEQ ID NO: 6116133 - DNA, 16 bp, Homo sapiens
ctattaagtttgaaaa

SEQ ID NO: 6116134 - DNA, 21 bp, Homo sapiens
ctattaatatatgtattattt

SEQ ID NO: 6116135 - DNA, 20 bp, Homo sapiens
ctattaatatcaactctgaa

SEQ ID NO: 6116136 - DNA, 11 bp, Homo sapiens
ctattaatatt

SEQ ID NO: 6116137 - DNA, 20 bp, Homo sapiens
ctattaatcaagagaaactt

SEQ ID NO: 6116138 - DNA, 21 bp, Homo sapiens
ctattaatcatttgatttaaa

SEQ ID NO: 6116139 - DNA, 16 bp, Homo sapiens
ctattaattactgtgt

SEQ ID NO: 6116140 - DNA, 13 bp, Homo sapiens
ctattaatttatt

SEQ ID NO: 6116141 - DNA, 17 bp, Homo sapiens
ctattacagtattgcta

SEQ ID NO: 6116142 - DNA, 14 bp, Homo sapiens
ctattacagtgttg

SEQ ID NO: 6116143 - DNA, 20 bp, Homo sapiens
ctattacagtgttggagaac

SEQ ID NO: 6116144 - DNA, 17 bp, Homo sapiens
ctattacatgtgttagt

SEQ ID NO: 6116145 - DNA, 13 bp, Homo sapiens
ctattacatttta

SEQ ID NO: 6116146 - DNA, 16 bp, Homo sapiens
ctattaccactgaaga

SEQ ID NO: 6116147 - DNA, 20 bp, Homo sapiens
ctattaccactgaagataga

SEQ ID NO: 6116148 - DNA, 14 bp, Homo sapiens
ctattactctgaca

SEQ ID NO: 6116149 - DNA, 19 bp, Homo sapiens
ctattactctgacataaac

SEQ ID NO: 6116150 - DNA, 13 bp, Homo sapiens
ctattactgcaga

SEQ ID NO: 6116151 - DNA, 20 bp, Homo sapiens
ctattacttgaactttccaa

SEQ ID NO: 6116152 - DNA, 20 bp, Homo sapiens
ctattagactttagaaataa

SEQ ID NO: 6116153 - DNA, 21 bp, Homo sapiens
ctattagactttagaaataaa

SEQ ID NO: 6116154 - DNA, 22 bp, Homo sapiens
ctattagatacacttcttaaat

SEQ ID NO: 6116155 - DNA, 17 bp, Homo sapiens
ctattagatgttttaca

SEQ ID NO: 6116156 - DNA, 13 bp, Homo sapiens
ctattagctgggt

SEQ ID NO: 6116157 - DNA, 21 bp, Homo sapiens
ctattagcttactgattaact

SEQ ID NO: 6116158 - DNA, 21 bp, Homo sapiens
ctattaggtgcaatttcaagg

SEQ ID NO: 6116159 - DNA, 16 bp, Homo sapiens
ctattataatttaatg

SEQ ID NO: 6116160 - DNA, 17 bp, Homo sapiens
ctattataatttaatgc

SEQ ID NO: 6116161 - DNA, 21 bp, Homo sapiens
ctattatactgttatccatat

SEQ ID NO: 6116162 - DNA, 18 bp, Homo sapiens
ctattatactttatcaaa

SEQ ID NO: 6116163 - DNA, 18 bp, Homo sapiens
ctattatagccacatccc

SEQ ID NO: 6116164 - DNA, 18 bp, Homo sapiens
ctattatcccagctgcct

SEQ ID NO: 6116165 - DNA, 22 bp, Homo sapiens
ctattatctgggttttagaaat

SEQ ID NO: 6116166 - DNA, 16 bp, Homo sapiens
ctattatggaaaactg

SEQ ID NO: 6116167 - DNA, 20 bp, Homo sapiens
ctattatgtaacatccagaa

SEQ ID NO: 6116168 - DNA, 20 bp, Homo sapiens
ctattatgttgttagagaaa

SEQ ID NO: 6116169 - DNA, 15 bp, Homo sapiens
ctattattgaaatag

SEQ ID NO: 6116170 - DNA, 13 bp, Homo sapiens
ctattatttggag

SEQ ID NO: 6116171 - DNA, 22 bp, Homo sapiens
ctattatttggagcctgccaag

SEQ ID NO: 6116172 - DNA, 23 bp, Homo sapiens
ctattatttttttaaagaaaact

SEQ ID NO: 6116173 - DNA, 22 bp, Homo sapiens
ctattcaaggtggccaaattat

SEQ ID NO: 6116174 - DNA, 14 bp, Homo sapiens
ctattcaatgcaat

SEQ ID NO: 6116175 - DNA, 23 bp, Homo sapiens
ctattcaatgcaatgcaattcaa

SEQ ID NO: 6116176 - DNA, 17 bp, Homo sapiens
ctattcacaattattcc

SEQ ID NO: 6116177 - DNA, 14 bp, Homo sapiens
ctattcacacacac

SEQ ID NO: 6116178 - DNA, 15 bp, Homo sapiens
ctattcacacacaca

SEQ ID NO: 6116179 - DNA, 20 bp, Homo sapiens
ctattcacgccgtaattctt

SEQ ID NO: 6116180 - DNA, 22 bp, Homo sapiens
ctattcacgccgtaattctttc

SEQ ID NO: 6116181 - DNA, 23 bp, Homo sapiens
ctattcacgccgtaattctttct

SEQ ID NO: 6116182 - DNA, 20 bp, Homo sapiens
ctattcagaatcaaaccttt

SEQ ID NO: 6116183 - DNA, 13 bp, Homo sapiens
ctattcagacaag

SEQ ID NO: 6116184 - DNA, 17 bp, Homo sapiens
ctattcagtaataactc

SEQ ID NO: 6116185 - DNA, 19 bp, Homo sapiens
ctattcagtggcgagaaat

SEQ ID NO: 6116186 - DNA, 17 bp, Homo sapiens
ctattcagttcccagaa

SEQ ID NO: 6116187 - DNA, 15 bp, Homo sapiens
ctattcatcaatgaa

SEQ ID NO: 6116188 - DNA, 18 bp, Homo sapiens
ctattcattaaatgtttg

SEQ ID NO: 6116189 - DNA, 23 bp, Homo sapiens
ctattcattaagtaatcttttta

SEQ ID NO: 6116190 - DNA, 23 bp, Homo sapiens
ctattccagctcattcattttat

SEQ ID NO: 6116191 - DNA, 15 bp, Homo sapiens
ctattccatgtttta

SEQ ID NO: 6116192 - DNA, 16 bp, Homo sapiens
ctattccatgttttaa

SEQ ID NO: 6116193 - DNA, 15 bp, Homo sapiens
ctattcccaaagaac

SEQ ID NO: 6116194 - DNA, 19 bp, Homo sapiens
ctattcccacacctccaca

SEQ ID NO: 6116195 - DNA, 16 bp, Homo sapiens
ctattcccactttcat

SEQ ID NO: 6116196 - DNA, 18 bp, Homo sapiens
ctattcccactttcattc

SEQ ID NO: 6116197 - DNA, 14 bp, Homo sapiens
ctattcccaggcag

SEQ ID NO: 6116198 - DNA, 16 bp, Homo sapiens
ctattcccaggcaggg

SEQ ID NO: 6116199 - DNA, 14 bp, Homo sapiens
ctattcccattgtg

SEQ ID NO: 6116200 - DNA, 23 bp, Homo sapiens
ctattccctaactctcgggacct

SEQ ID NO: 6116201 - DNA, 14 bp, Homo sapiens
ctattccctaactt

SEQ ID NO: 6116202 - DNA, 14 bp, Homo sapiens
ctattccctggaga

SEQ ID NO: 6116203 - DNA, 16 bp, Homo sapiens
ctattccctttgactt

SEQ ID NO: 6116204 - DNA, 21 bp, Homo sapiens
ctattccctttgacttcagct

SEQ ID NO: 6116205 - DNA, 22 bp, Homo sapiens
ctattcctgtaaataagagttg

SEQ ID NO: 6116206 - DNA, 17 bp, Homo sapiens
ctattccttctggcctt

SEQ ID NO: 6116207 - DNA, 15 bp, Homo sapiens
ctattcctttccaga

SEQ ID NO: 6116208 - DNA, 14 bp, Homo sapiens
ctattcctttccct

SEQ ID NO: 6116209 - DNA, 18 bp, Homo sapiens
ctattcctttcccttcct

SEQ ID NO: 6116210 - DNA, 22 bp, Homo sapiens
ctattcctttcccttcctcttc

SEQ ID NO: 6116211 - DNA, 18 bp, Homo sapiens
ctattccttttctgtata

SEQ ID NO: 6116212 - DNA, 17 bp, Homo sapiens
ctattcgaatgaaaaga

SEQ ID NO: 6116213 - DNA, 17 bp, Homo sapiens
ctattcgtaagttctgt

SEQ ID NO: 6116214 - DNA, 20 bp, Homo sapiens
ctattcgtaagttctgtgca

SEQ ID NO: 6116215 - DNA, 17 bp, Homo sapiens
ctattctagcctgcatt

SEQ ID NO: 6116216 - DNA, 18 bp, Homo sapiens
ctattctcaaagttaaaa

SEQ ID NO: 6116217 - DNA, 23 bp, Homo sapiens
ctattctcaaagttaaaagtaaa

SEQ ID NO: 6116218 - DNA, 15 bp, Homo sapiens
ctattctcaccagga

SEQ ID NO: 6116219 - DNA, 18 bp, Homo sapiens
ctattctcatgcctcagc

SEQ ID NO: 6116220 - DNA, 21 bp, Homo sapiens
ctattctccagaaaaatcaat

SEQ ID NO: 6116221 - DNA, 15 bp, Homo sapiens
ctattctccagacat

SEQ ID NO: 6116222 - DNA, 16 bp, Homo sapiens
ctattctcctgccatg

SEQ ID NO: 6116223 - DNA, 18 bp, Homo sapiens
ctattctctaaactggca

SEQ ID NO: 6116224 - DNA, 22 bp, Homo sapiens
ctattctctgcaatttgtttaa

SEQ ID NO: 6116225 - DNA, 13 bp, Homo sapiens
ctattctctgcct

SEQ ID NO: 6116226 - DNA, 20 bp, Homo sapiens
ctattctgaaaaagacataa

SEQ ID NO: 6116227 - DNA, 15 bp, Homo sapiens
ctattctgagatgac

SEQ ID NO: 6116228 - DNA, 15 bp, Homo sapiens
ctattctgagccttg

SEQ ID NO: 6116229 - DNA, 19 bp, Homo sapiens
ctattctgtcagtgttaaa

SEQ ID NO: 6116230 - DNA, 17 bp, Homo sapiens
ctattctgtgaaactaa

SEQ ID NO: 6116231 - DNA, 18 bp, Homo sapiens
ctattctgtgaaactaat

SEQ ID NO: 6116232 - DNA, 19 bp, Homo sapiens
ctattctgtgttgcattat

SEQ ID NO: 6116233 - DNA, 16 bp, Homo sapiens
ctattcttaagcactt

SEQ ID NO: 6116234 - DNA, 18 bp, Homo sapiens
ctattcttaagcactttg

SEQ ID NO: 6116235 - DNA, 16 bp, Homo sapiens
ctattcttgatgtaaa

SEQ ID NO: 6116236 - DNA, 21 bp, Homo sapiens
ctattcttgatttatttgctt

SEQ ID NO: 6116237 - DNA, 22 bp, Homo sapiens
ctattcttggaccatgccagat

SEQ ID NO: 6116238 - DNA, 17 bp, Homo sapiens
ctattcttggttcttat

SEQ ID NO: 6116239 - DNA, 18 bp, Homo sapiens
ctattcttggttcttatt

SEQ ID NO: 6116240 - DNA, 22 bp, Homo sapiens
ctattctttaactcccattacc

SEQ ID NO: 6116241 - DNA, 22 bp, Homo sapiens
ctattctttgaccaaactgtgg

SEQ ID NO: 6116242 - DNA, 15 bp, Homo sapiens
ctattgaaaacagtg

SEQ ID NO: 6116243 - DNA, 20 bp, Homo sapiens
ctattgaaaaggttaacaga

SEQ ID NO: 6116244 - DNA, 17 bp, Homo sapiens
ctattgaaaatatatat

SEQ ID NO: 6116245 - DNA, 21 bp, Homo sapiens
ctattgaaagtttttaatatt

SEQ ID NO: 6116246 - DNA, 14 bp, Homo sapiens
ctattgaaattact

SEQ ID NO: 6116247 - DNA, 15 bp, Homo sapiens
ctattgaaattactg

SEQ ID NO: 6116248 - DNA, 13 bp, Homo sapiens
ctattgaactgag

SEQ ID NO: 6116249 - DNA, 15 bp, Homo sapiens
ctattgaactgagcc

SEQ ID NO: 6116250 - DNA, 17 bp, Homo sapiens
ctattgaactgtattct

SEQ ID NO: 6116251 - DNA, 17 bp, Homo sapiens
ctattgacaataaaata

SEQ ID NO: 6116252 - DNA, 13 bp, Homo sapiens
ctattgacttcaa

SEQ ID NO: 6116253 - DNA, 14 bp, Homo sapiens
ctattgagaaagac

SEQ ID NO: 6116254 - DNA, 13 bp, Homo sapiens
ctattgagccttg

SEQ ID NO: 6116255 - DNA, 14 bp, Homo sapiens
ctattgagccttgc

SEQ ID NO: 6116256 - DNA, 17 bp, Homo sapiens
ctattgagtcttcatgt

SEQ ID NO: 6116257 - DNA, 21 bp, Homo sapiens
ctattgatataaataaaacat

SEQ ID NO: 6116258 - DNA, 19 bp, Homo sapiens
ctattgatgtacagtctgt

SEQ ID NO: 6116259 - DNA, 20 bp, Homo sapiens
ctattgatgtacagtctgtc

SEQ ID NO: 6116260 - DNA, 21 bp, Homo sapiens
ctattgatgtacagtctgtca

SEQ ID NO: 6116261 - DNA, 23 bp, Homo sapiens
ctattgatgtacagtctgtcatg

SEQ ID NO: 6116262 - DNA, 17 bp, Homo sapiens
ctattgatttaagcttt

SEQ ID NO: 6116263 - DNA, 21 bp, Homo sapiens
ctattgatttgaaaagaattt

SEQ ID NO: 6116264 - DNA, 21 bp, Homo sapiens
ctattgcaaaggttccaactg

SEQ ID NO: 6116265 - DNA, 13 bp, Homo sapiens
ctattgcactcca

SEQ ID NO: 6116266 - DNA, 16 bp, Homo sapiens
ctattgcagatatttg

SEQ ID NO: 6116267 - DNA, 19 bp, Homo sapiens
ctattgccaggaatgtttc

SEQ ID NO: 6116268 - DNA, 22 bp, Homo sapiens
ctattgccatgaaccatgctta

SEQ ID NO: 6116269 - DNA, 12 bp, Homo sapiens
ctattgcccagg

SEQ ID NO: 6116270 - DNA, 11 bp, Homo sapiens
ctattgcctct

SEQ ID NO: 6116271 - DNA, 14 bp, Homo sapiens
ctattgcctctgag

SEQ ID NO: 6116272 - DNA, 12 bp, Homo sapiens
ctattgccttct

SEQ ID NO: 6116273 - DNA, 17 bp, Homo sapiens
ctattgctagagctcct

SEQ ID NO: 6116274 - DNA, 14 bp, Homo sapiens
ctattgctgtctgg

SEQ ID NO: 6116275 - DNA, 23 bp, Homo sapiens
ctattgctgtctggtgaggtggc

SEQ ID NO: 6116276 - DNA, 12 bp, Homo sapiens
ctattgcttaaa

SEQ ID NO: 6116277 - DNA, 15 bp, Homo sapiens
ctattgcttaaacaa

SEQ ID NO: 6116278 - DNA, 18 bp, Homo sapiens
ctattgcttggacttaac

SEQ ID NO: 6116279 - DNA, 17 bp, Homo sapiens
ctattgcttgggtctct

SEQ ID NO: 6116280 - DNA, 15 bp, Homo sapiens
ctattggacagacac

SEQ ID NO: 6116281 - DNA, 19 bp, Homo sapiens
ctattggacagacacagag

SEQ ID NO: 6116282 - DNA, 17 bp, Homo sapiens
ctattggagagaaaaaa

SEQ ID NO: 6116283 - DNA, 13 bp, Homo sapiens
ctattggatttgt

SEQ ID NO: 6116284 - DNA, 17 bp, Homo sapiens
ctattggcataaaacaa

SEQ ID NO: 6116285 - DNA, 17 bp, Homo sapiens
ctattgggagggatgag

SEQ ID NO: 6116286 - DNA, 20 bp, Homo sapiens
ctattgggcacagcctaggg

SEQ ID NO: 6116287 - DNA, 20 bp, Homo sapiens
ctattgggccctagaggaca

SEQ ID NO: 6116288 - DNA, 16 bp, Homo sapiens
ctattgggttcattat

SEQ ID NO: 6116289 - DNA, 11 bp, Homo sapiens
ctattggtaaa

SEQ ID NO: 6116290 - DNA, 15 bp, Homo sapiens
ctattggtgcttgac

SEQ ID NO: 6116291 - DNA, 17 bp, Homo sapiens
ctattgtaaatatgttt

SEQ ID NO: 6116292 - DNA, 14 bp, Homo sapiens
ctattgtaaggtct

SEQ ID NO: 6116293 - DNA, 18 bp, Homo sapiens
ctattgtaaggtctttgt

SEQ ID NO: 6116294 - DNA, 20 bp, Homo sapiens
ctattgtaaggtctttgtaa

SEQ ID NO: 6116295 - DNA, 19 bp, Homo sapiens
ctattgtaatatagaaaaa

SEQ ID NO: 6116296 - DNA, 20 bp, Homo sapiens
ctattgtaatatagaaaaaa

SEQ ID NO: 6116297 - DNA, 19 bp, Homo sapiens
ctattgtaatcgtgtgcca

SEQ ID NO: 6116298 - DNA, 20 bp, Homo sapiens
ctattgtaatcgtgtgccat

SEQ ID NO: 6116299 - DNA, 14 bp, Homo sapiens
ctattgtagagcca

SEQ ID NO: 6116300 - DNA, 14 bp, Homo sapiens
ctattgtcattaaa

SEQ ID NO: 6116301 - DNA, 15 bp, Homo sapiens
ctattgtcattaaag

SEQ ID NO: 6116302 - DNA, 16 bp, Homo sapiens
ctattgtccttgtgta

SEQ ID NO: 6116303 - DNA, 13 bp, Homo sapiens
ctattgtgatttg

SEQ ID NO: 6116304 - DNA, 19 bp, Homo sapiens
ctattgtgatttgactgtt

SEQ ID NO: 6116305 - DNA, 22 bp, Homo sapiens
ctattgtgttggctttacaaat

SEQ ID NO: 6116306 - DNA, 23 bp, Homo sapiens
ctattgtgttttttttttttggt

SEQ ID NO: 6116307 - DNA, 15 bp, Homo sapiens
ctattgttaaacaaa

SEQ ID NO: 6116308 - DNA, 20 bp, Homo sapiens
ctattgttaaacaaatgatt

SEQ ID NO: 6116309 - DNA, 16 bp, Homo sapiens
ctattgttgaataaat

SEQ ID NO: 6116310 - DNA, 13 bp, Homo sapiens
cctttattttcag

SEQ ID NO: 6116311 - DNA, 14 bp, Homo sapiens
cctttcaaagaact

SEQ ID NO: 6116312 - DNA, 16 bp, Homo sapiens
cctttcaaagaactcc

SEQ ID NO: 6116313 - DNA, 16 bp, Homo sapiens
cctttcaaagccattt

SEQ ID NO: 6116314 - DNA, 15 bp, Homo sapiens
cctttcaaatttcac

SEQ ID NO: 6116315 - DNA, 18 bp, Homo sapiens
cctttcaagcggtgccta

SEQ ID NO: 6116316 - DNA, 17 bp, Homo sapiens
cctttcaaggaaagtga

SEQ ID NO: 6116317 - DNA, 21 bp, Homo sapiens
cctttcaataaagttgttgca

SEQ ID NO: 6116318 - DNA, 17 bp, Homo sapiens
cctttcaattccaccag

SEQ ID NO: 6116319 - DNA, 23 bp, Homo sapiens
cctttcaattccaccagggccag

SEQ ID NO: 6116320 - DNA, 21 bp, Homo sapiens
cctttcacagagcagagtctg

SEQ ID NO: 6116321 - DNA, 19 bp, Homo sapiens
cctttcacaggactctgca

SEQ ID NO: 6116322 - DNA, 17 bp, Homo sapiens
cctttcactcctttcct

SEQ ID NO: 6116323 - DNA, 16 bp, Homo sapiens
cctttcactgaagtga

SEQ ID NO: 6116324 - DNA, 20 bp, Homo sapiens
cctttcagaatcttttcaat

SEQ ID NO: 6116325 - DNA, 17 bp, Homo sapiens
cctttcagatgaccttt

SEQ ID NO: 6116326 - DNA, 21 bp, Homo sapiens
cctttcagatgtcttctgcct

SEQ ID NO: 6116327 - DNA, 22 bp, Homo sapiens
cctttcagatgtcttctgcctg

SEQ ID NO: 6116328 - DNA, 23 bp, Homo sapiens
cctttcagccacatgccccaggc

SEQ ID NO: 6116329 - DNA, 15 bp, Homo sapiens
cctttcagctgtgaa

SEQ ID NO: 6116330 - DNA, 14 bp, Homo sapiens
cctttcaggatcta

SEQ ID NO: 6116331 - DNA, 15 bp, Homo sapiens
cctttcaggccaagg

SEQ ID NO: 6116332 - DNA, 23 bp, Homo sapiens
cctttcaggccaaggctatgaag

SEQ ID NO: 6116333 - DNA, 21 bp, Homo sapiens
cctttcaggcctacagccaca

SEQ ID NO: 6116334 - DNA, 20 bp, Homo sapiens
cctttcagggaatttcagga

SEQ ID NO: 6116335 - DNA, 17 bp, Homo sapiens
cctttcaggtccaggcc

SEQ ID NO: 6116336 - DNA, 21 bp, Homo sapiens
cctttcagtgtagcgggagga

SEQ ID NO: 6116337 - DNA, 13 bp, Homo sapiens
cctttcatcctca

SEQ ID NO: 6116338 - DNA, 16 bp, Homo sapiens
cctttcatcctcagca

SEQ ID NO: 6116339 - DNA, 17 bp, Homo sapiens
cctttcatcctcagcaa

SEQ ID NO: 6116340 - DNA, 17 bp, Homo sapiens
cctttcatctctctacc

SEQ ID NO: 6116341 - DNA, 18 bp, Homo sapiens
cctttcatctctctacct

SEQ ID NO: 6116342 - DNA, 21 bp, Homo sapiens
cctttcatctctctacctcca

SEQ ID NO: 6116343 - DNA, 22 bp, Homo sapiens
cctttcatctctctacctccac

SEQ ID NO: 6116344 - DNA, 23 bp, Homo sapiens
cctttcatctctctacctccacc

SEQ ID NO: 6116345 - DNA, 13 bp, Homo sapiens
cctttcatcttga

SEQ ID NO: 6116346 - DNA, 20 bp, Homo sapiens
cctttcatcttgaagttttt

SEQ ID NO: 6116347 - DNA, 20 bp, Homo sapiens
cctttcattaccctacagac

SEQ ID NO: 6116348 - DNA, 17 bp, Homo sapiens
cctttcattaggcaaag

SEQ ID NO: 6116349 - DNA, 18 bp, Homo sapiens
cctttcattaggcaaagt

SEQ ID NO: 6116350 - DNA, 21 bp, Homo sapiens
cctttcattttctttcctttc

SEQ ID NO: 6116351 - DNA, 15 bp, Homo sapiens
cctttcattttgctt

SEQ ID NO: 6116352 - DNA, 16 bp, Homo sapiens
cctttccaaggcttct

SEQ ID NO: 6116353 - DNA, 24 bp, Homo sapiens
cctttccaatgaaggaaacatcag

SEQ ID NO: 6116354 - DNA, 15 bp, Homo sapiens
cctttccacccagac

SEQ ID NO: 6116355 - DNA, 15 bp, Homo sapiens
cctttccacctgctt

SEQ ID NO: 6116356 - DNA, 13 bp, Homo sapiens
cctttccaccttc

SEQ ID NO: 6116357 - DNA, 17 bp, Homo sapiens
cctttccaccttctcac

SEQ ID NO: 6116358 - DNA, 18 bp, Homo sapiens
cctttccaccttctcaca

SEQ ID NO: 6116359 - DNA, 19 bp, Homo sapiens
cctttccactcccactgcc

SEQ ID NO: 6116360 - DNA, 20 bp, Homo sapiens
cctttccactcccactgcca

SEQ ID NO: 6116361 - DNA, 13 bp, Homo sapiens
cctttccagccta

SEQ ID NO: 6116362 - DNA, 18 bp, Homo sapiens
cctttccagggttattta

SEQ ID NO: 6116363 - DNA, 22 bp, Homo sapiens
cctttccataaatccttgatga

SEQ ID NO: 6116364 - DNA, 14 bp, Homo sapiens
cctttccatctgtc

SEQ ID NO: 6116365 - DNA, 11 bp, Homo sapiens
cctttcccacc

SEQ ID NO: 6116366 - DNA, 22 bp, Homo sapiens
cctttcccacccactagccctc

SEQ ID NO: 6116367 - DNA, 22 bp, Homo sapiens
cctttcccaccccaacctgctc

SEQ ID NO: 6116368 - DNA, 13 bp, Homo sapiens
cctttcccaccct

SEQ ID NO: 6116369 - DNA, 15 bp, Homo sapiens
cctttcccaccctcc

SEQ ID NO: 6116370 - DNA, 20 bp, Homo sapiens
cctttcccaccctcctgccc

SEQ ID NO: 6116371 - DNA, 23 bp, Homo sapiens
cctttcccaccctcctgccccac

SEQ ID NO: 6116372 - DNA, 17 bp, Homo sapiens
cctttcccatcacccct

SEQ ID NO: 6116373 - DNA, 12 bp, Homo sapiens
cctttccccagc

SEQ ID NO: 6116374 - DNA, 16 bp, Homo sapiens
cctttccccagcatca

SEQ ID NO: 6116375 - DNA, 21 bp, Homo sapiens
cctttccccagcatcactccc

SEQ ID NO: 6116376 - DNA, 14 bp, Homo sapiens
cctttccccagccc

SEQ ID NO: 6116377 - DNA, 14 bp, Homo sapiens
cctttccccagcct

SEQ ID NO: 6116378 - DNA, 22 bp, Homo sapiens
cctttccccagcctctcctcct

SEQ ID NO: 6116379 - DNA, 15 bp, Homo sapiens
cctttccccagtgtg

SEQ ID NO: 6116380 - DNA, 18 bp, Homo sapiens
cctttccccattcagtga

SEQ ID NO: 6116381 - DNA, 19 bp, Homo sapiens
cctttcccccaccccagag

SEQ ID NO: 6116382 - DNA, 18 bp, Homo sapiens
cctttcccccttctctta

SEQ ID NO: 6116383 - DNA, 19 bp, Homo sapiens
cctttcccctagatccaga

SEQ ID NO: 6116384 - DNA, 12 bp, Homo sapiens
cctttcccctct

SEQ ID NO: 6116385 - DNA, 13 bp, Homo sapiens
cctttcccctctc

SEQ ID NO: 6116386 - DNA, 14 bp, Homo sapiens
cctttcccctctca

SEQ ID NO: 6116387 - DNA, 15 bp, Homo sapiens
cctttcccctctcat

SEQ ID NO: 6116388 - DNA, 14 bp, Homo sapiens
cctttcccctctct

SEQ ID NO: 6116389 - DNA, 20 bp, Homo sapiens
cctttcccctctctgcccct

SEQ ID NO: 6116390 - DNA, 16 bp, Homo sapiens
cctttccccttcccct

SEQ ID NO: 6116391 - DNA, 16 bp, Homo sapiens
cctttcccgggccctc

SEQ ID NO: 6116392 - DNA, 20 bp, Homo sapiens
cctttcccgggccctcagcc

SEQ ID NO: 6116393 - DNA, 14 bp, Homo sapiens
cctttccctaaaga

SEQ ID NO: 6116394 - DNA, 15 bp, Homo sapiens
cctttccctaagcca

SEQ ID NO: 6116395 - DNA, 21 bp, Homo sapiens
cctttccctcaccccctccca

SEQ ID NO: 6116396 - DNA, 12 bp, Homo sapiens
cctttcccttcc

SEQ ID NO: 6116397 - DNA, 16 bp, Homo sapiens
cctttcccttcctctt

SEQ ID NO: 6116398 - DNA, 12 bp, Homo sapiens
cctttcccttct

SEQ ID NO: 6116399 - DNA, 20 bp, Homo sapiens
cctttcccttgtagctcctc

SEQ ID NO: 6116400 - DNA, 17 bp, Homo sapiens
cctttccgcggagccct

SEQ ID NO: 6116401 - DNA, 21 bp, Homo sapiens
cctttccgcggagcccttggc

SEQ ID NO: 6116402 - DNA, 16 bp, Homo sapiens
cctttccggcacactg

SEQ ID NO: 6116403 - DNA, 17 bp, Homo sapiens
cctttccggcacactgc

SEQ ID NO: 6116404 - DNA, 21 bp, Homo sapiens
cctttccggcacactgccaaa

SEQ ID NO: 6116405 - DNA, 18 bp, Homo sapiens
cctttccgtgccgggagc

SEQ ID NO: 6116406 - DNA, 11 bp, Homo sapiens
cctttcctaaa

SEQ ID NO: 6116407 - DNA, 17 bp, Homo sapiens
cctttcctactgtcctg

SEQ ID NO: 6116408 - DNA, 22 bp, Homo sapiens
cctttcctccgcctgtccacag

SEQ ID NO: 6116409 - DNA, 18 bp, Homo sapiens
cctttcctcctttatcac

SEQ ID NO: 6116410 - DNA, 12 bp, Homo sapiens
cctttcctctga

SEQ ID NO: 6116411 - DNA, 13 bp, Homo sapiens
cctttcctctgca

SEQ ID NO: 6116412 - DNA, 14 bp, Homo sapiens
cctttcctctgcac

SEQ ID NO: 6116413 - DNA, 20 bp, Homo sapiens
cctttcctgaagtgtcgagt

SEQ ID NO: 6116414 - DNA, 12 bp, Homo sapiens
cctttcctggaa

SEQ ID NO: 6116415 - DNA, 14 bp, Homo sapiens
cctttcctggcagt

SEQ ID NO: 6116416 - DNA, 14 bp, Homo sapiens
cctttcctggtttc

SEQ ID NO: 6116417 - DNA, 20 bp, Homo sapiens
cctttcctgttcagcattct

SEQ ID NO: 6116418 - DNA, 16 bp, Homo sapiens
cctttccttcactgcc

SEQ ID NO: 6116419 - DNA, 12 bp, Homo sapiens
cctttccttccc

SEQ ID NO: 6116420 - DNA, 13 bp, Homo sapiens
cctttccttccca

SEQ ID NO: 6116421 - DNA, 15 bp, Homo sapiens
cctttccttcccagg

SEQ ID NO: 6116422 - DNA, 12 bp, Homo sapiens
cctttccttcct

SEQ ID NO: 6116423 - DNA, 13 bp, Homo sapiens
cctttccttcctt

SEQ ID NO: 6116424 - DNA, 12 bp, Homo sapiens
cctttccttctc

SEQ ID NO: 6116425 - DNA, 14 bp, Homo sapiens
cctttccttctcgt

SEQ ID NO: 6116426 - DNA, 19 bp, Homo sapiens
cctttccttctcgtcttcc

SEQ ID NO: 6116427 - DNA, 22 bp, Homo sapiens
cctttcctttttctttcctttc

SEQ ID NO: 6116428 - DNA, 21 bp, Homo sapiens
cctttcggatccagggaggct

SEQ ID NO: 6116429 - DNA, 23 bp, Homo sapiens
cctttcggcagaggaacccccac

SEQ ID NO: 6116430 - DNA, 21 bp, Homo sapiens
cctttctaaggatagcctttg

SEQ ID NO: 6116431 - DNA, 16 bp, Homo sapiens
cctttctagcaattgc

SEQ ID NO: 6116432 - DNA, 14 bp, Homo sapiens
cctttctagttgaa

SEQ ID NO: 6116433 - DNA, 17 bp, Homo sapiens
cctttctataattttac

SEQ ID NO: 6116434 - DNA, 14 bp, Homo sapiens
cctttctatgttca

SEQ ID NO: 6116435 - DNA, 11 bp, Homo sapiens
cctttctcagg

SEQ ID NO: 6116436 - DNA, 15 bp, Homo sapiens
cctttctccagccag

SEQ ID NO: 6116437 - DNA, 20 bp, Homo sapiens
cctttctccagccagcaatg

SEQ ID NO: 6116438 - DNA, 23 bp, Homo sapiens
cctttctccagcccatgctggct

SEQ ID NO: 6116439 - DNA, 16 bp, Homo sapiens
cctttctccaggccct

SEQ ID NO: 6116440 - DNA, 19 bp, Homo sapiens
cctttctcccctgccccca

SEQ ID NO: 6116441 - DNA, 20 bp, Homo sapiens
cctttctcccctgcccccag

SEQ ID NO: 6116442 - DNA, 14 bp, Homo sapiens
cctttctccctgca

SEQ ID NO: 6116443 - DNA, 14 bp, Homo sapiens
cctttctcctcccc

SEQ ID NO: 6116444 - DNA, 13 bp, Homo sapiens
cctttctcctgtg

SEQ ID NO: 6116445 - DNA, 17 bp, Homo sapiens
cctttctcctgtgaatg

SEQ ID NO: 6116446 - DNA, 17 bp, Homo sapiens
cctttctctcctggctc

SEQ ID NO: 6116447 - DNA, 15 bp, Homo sapiens
cctttctctctccac

SEQ ID NO: 6116448 - DNA, 16 bp, Homo sapiens
cctttctctctcctct

SEQ ID NO: 6116449 - DNA, 19 bp, Homo sapiens
cctttctctctcctctctg

SEQ ID NO: 6116450 - DNA, 21 bp, Homo sapiens
cctttctctctcctctctgct

SEQ ID NO: 6116451 - DNA, 16 bp, Homo sapiens
cctttctctctttctt

SEQ ID NO: 6116452 - DNA, 13 bp, Homo sapiens
cctttctctgcct

SEQ ID NO: 6116453 - DNA, 15 bp, Homo sapiens
cctttctctgcctgg

SEQ ID NO: 6116454 - DNA, 16 bp, Homo sapiens
cctttctctgcctggc

SEQ ID NO: 6116455 - DNA, 17 bp, Homo sapiens
cctttctctgcctggca

SEQ ID NO: 6116456 - DNA, 18 bp, Homo sapiens
cctttctctgcctggcaa

SEQ ID NO: 6116457 - DNA, 16 bp, Homo sapiens
cctttctctggctcca

SEQ ID NO: 6116458 - DNA, 17 bp, Homo sapiens
cctttctctggctccag

SEQ ID NO: 6116459 - DNA, 16 bp, Homo sapiens
cctttctctttctctc

SEQ ID NO: 6116460 - DNA, 22 bp, Homo sapiens
cctttctgacatcagcacttta

SEQ ID NO: 6116461 - DNA, 18 bp, Homo sapiens
cctttctgactgtccctg

SEQ ID NO: 6116462 - DNA, 11 bp, Homo sapiens
cctttctgagt

SEQ ID NO: 6116463 - DNA, 15 bp, Homo sapiens
cctttctgatcttca

SEQ ID NO: 6116464 - DNA, 19 bp, Homo sapiens
cctttctgccttggcctcg

SEQ ID NO: 6116465 - DNA, 17 bp, Homo sapiens
cctttctggaagtttct

SEQ ID NO: 6116466 - DNA, 19 bp, Homo sapiens
cctttctggaagtttctgg

SEQ ID NO: 6116467 - DNA, 11 bp, Homo sapiens
cctttctggcc

SEQ ID NO: 6116468 - DNA, 12 bp, Homo sapiens
cctttctggccc

SEQ ID NO: 6116469 - DNA, 13 bp, Homo sapiens
cctttctggcccc

SEQ ID NO: 6116470 - DNA, 15 bp, Homo sapiens
cctttctggcctgtt

SEQ ID NO: 6116471 - DNA, 18 bp, Homo sapiens
cctttctggcctgttatg

SEQ ID NO: 6116472 - DNA, 13 bp, Homo sapiens
cctttctgggctt

SEQ ID NO: 6116473 - DNA, 20 bp, Homo sapiens
cctttctgggctttctcctg

SEQ ID NO: 6116474 - DNA, 21 bp, Homo sapiens
cctttctgggctttctcctgg

SEQ ID NO: 6116475 - DNA, 16 bp, Homo sapiens
cctttctgtaccattt

SEQ ID NO: 6116476 - DNA, 13 bp, Homo sapiens
cctttctgtccca

SEQ ID NO: 6116477 - DNA, 14 bp, Homo sapiens
cctttctgtcccac

SEQ ID NO: 6116478 - DNA, 17 bp, Homo sapiens
cctttctgtcccatcct

SEQ ID NO: 6116479 - DNA, 18 bp, Homo sapiens
cctttcttcactgcagat

SEQ ID NO: 6116480 - DNA, 10 bp, Homo sapiens
cctttcttcc

SEQ ID NO: 6116481 - DNA, 12 bp, Homo sapiens
cctttcttccgg

SEQ ID NO: 6116482 - DNA, 12 bp, Homo sapiens
cctttcttcctc

SEQ ID NO: 6116483 - DNA, 13 bp, Homo sapiens
cctttcttccttc

SEQ ID NO: 6116484 - DNA, 15 bp, Homo sapiens
cctttcttccttcct

SEQ ID NO: 6116485 - DNA, 18 bp, Homo sapiens
cctttcttccttcctttc

SEQ ID NO: 6116486 - DNA, 10 bp, Homo sapiens
cctttcttct

SEQ ID NO: 6116487 - DNA, 12 bp, Homo sapiens
cctttcttctcc

SEQ ID NO: 6116488 - DNA, 17 bp, Homo sapiens
cctttcttctcccccat

SEQ ID NO: 6116489 - DNA, 21 bp, Homo sapiens
cctttcttcttgtgtctcctt

SEQ ID NO: 6116490 - DNA, 14 bp, Homo sapiens
cctttcttgacaaa

SEQ ID NO: 6116491 - DNA, 23 bp, Homo sapiens
cctttcttgacaaaacctaactt

SEQ ID NO: 6116492 - DNA, 15 bp, Homo sapiens
ctattgttgtgggct

SEQ ID NO: 6116493 - DNA, 11 bp, Homo sapiens
ctattgtttac

SEQ ID NO: 6116494 - DNA, 14 bp, Homo sapiens
ctattgtttatagg

SEQ ID NO: 6116495 - DNA, 22 bp, Homo sapiens
ctattgtttattctttttaaag

SEQ ID NO: 6116496 - DNA, 15 bp, Homo sapiens
ctattgtttgtaaaa

SEQ ID NO: 6116497 - DNA, 17 bp, Homo sapiens
ctattgtttgttgcact

SEQ ID NO: 6116498 - DNA, 15 bp, Homo sapiens
ctatttaaaaaataa

SEQ ID NO: 6116499 - DNA, 19 bp, Homo sapiens
ctatttaaaaaataaaaaa

SEQ ID NO: 6116500 - DNA, 23 bp, Homo sapiens
ctatttaaaaaataaaaaaatac

SEQ ID NO: 6116501 - DNA, 20 bp, Homo sapiens
ctatttaaaaagctctttca

SEQ ID NO: 6116502 - DNA, 16 bp, Homo sapiens
ctatttaaaacttgta

SEQ ID NO: 6116503 - DNA, 18 bp, Homo sapiens
ctatttaaaattggcacc

SEQ ID NO: 6116504 - DNA, 20 bp, Homo sapiens
ctatttaaacttataaatca

SEQ ID NO: 6116505 - DNA, 13 bp, Homo sapiens
ctatttaaattct

SEQ ID NO: 6116506 - DNA, 17 bp, Homo sapiens
ctatttaacatgggagg

SEQ ID NO: 6116507 - DNA, 13 bp, Homo sapiens
ctatttaacattt

SEQ ID NO: 6116508 - DNA, 14 bp, Homo sapiens
ctatttaacatttt

SEQ ID NO: 6116509 - DNA, 15 bp, Homo sapiens
ctatttaactgacta

SEQ ID NO: 6116510 - DNA, 22 bp, Homo sapiens
ctatttaactggcttcagcctc

SEQ ID NO: 6116511 - DNA, 9 bp, Homo sapiens
ctatttaag

SEQ ID NO: 6116512 - DNA, 10 bp, Homo sapiens
ctatttaaga

SEQ ID NO: 6116513 - DNA, 11 bp, Homo sapiens
ctatttaagat

SEQ ID NO: 6116514 - DNA, 15 bp, Homo sapiens
ctatttaagatgtga

SEQ ID NO: 6116515 - DNA, 10 bp, Homo sapiens
ctatttaagc

SEQ ID NO: 6116516 - DNA, 11 bp, Homo sapiens
ctatttaagtg

SEQ ID NO: 6116517 - DNA, 21 bp, Homo sapiens
ctatttaagttatcaacttta

SEQ ID NO: 6116518 - DNA, 14 bp, Homo sapiens
ctatttaatacagc

SEQ ID NO: 6116519 - DNA, 22 bp, Homo sapiens
ctatttaatatctggcactgtt

SEQ ID NO: 6116520 - DNA, 14 bp, Homo sapiens
ctatttaatattta

SEQ ID NO: 6116521 - DNA, 12 bp, Homo sapiens
ctatttaatgga

SEQ ID NO: 6116522 - DNA, 21 bp, Homo sapiens
ctatttaattaggaaaaaaac

SEQ ID NO: 6116523 - DNA, 13 bp, Homo sapiens
ctatttaattgaa

SEQ ID NO: 6116524 - DNA, 22 bp, Homo sapiens
ctatttaattgaaactctctgt

SEQ ID NO: 6116525 - DNA, 15 bp, Homo sapiens
ctatttacatataat

SEQ ID NO: 6116526 - DNA, 13 bp, Homo sapiens
ctatttacctcct

SEQ ID NO: 6116527 - DNA, 14 bp, Homo sapiens
ctatttacctccta

SEQ ID NO: 6116528 - DNA, 23 bp, Homo sapiens
ctatttacctgcaggctgagcca

SEQ ID NO: 6116529 - DNA, 15 bp, Homo sapiens
ctatttactggaaac

SEQ ID NO: 6116530 - DNA, 22 bp, Homo sapiens
ctatttagacactacaacatat

SEQ ID NO: 6116531 - DNA, 18 bp, Homo sapiens
ctatttagagaatgattt

SEQ ID NO: 6116532 - DNA, 13 bp, Homo sapiens
ctatttagcatga

SEQ ID NO: 6116533 - DNA, 22 bp, Homo sapiens
ctatttagtgttagttataaat

SEQ ID NO: 6116534 - DNA, 23 bp, Homo sapiens
ctatttagtttttgtaatttatt

SEQ ID NO: 6116535 - DNA, 18 bp, Homo sapiens
ctatttataagtgacttt

SEQ ID NO: 6116536 - DNA, 24 bp, Homo sapiens
ctatttatatatcatagtataaat

SEQ ID NO: 6116537 - DNA, 17 bp, Homo sapiens
ctatttatatgtacatg

SEQ ID NO: 6116538 - DNA, 14 bp, Homo sapiens
ctatttatcttcat

SEQ ID NO: 6116539 - DNA, 21 bp, Homo sapiens
ctatttatgccttgatgattt

SEQ ID NO: 6116540 - DNA, 15 bp, Homo sapiens
ctatttattagccaa

SEQ ID NO: 6116541 - DNA, 19 bp, Homo sapiens
ctatttattccctgttaaa

SEQ ID NO: 6116542 - DNA, 15 bp, Homo sapiens
ctatttattcctgtt

SEQ ID NO: 6116543 - DNA, 14 bp, Homo sapiens
ctatttattgactt

SEQ ID NO: 6116544 - DNA, 17 bp, Homo sapiens
ctatttattgactttga

SEQ ID NO: 6116545 - DNA, 17 bp, Homo sapiens
ctatttattgtgctggg

SEQ ID NO: 6116546 - DNA, 18 bp, Homo sapiens
ctatttatttactgagct

SEQ ID NO: 6116547 - DNA, 19 bp, Homo sapiens
ctatttatttatttattca

SEQ ID NO: 6116548 - DNA, 13 bp, Homo sapiens
ctatttattttcc

SEQ ID NO: 6116549 - DNA, 14 bp, Homo sapiens
ctatttatttttac

SEQ ID NO: 6116550 - DNA, 15 bp, Homo sapiens
ctatttcaaaatgtc

SEQ ID NO: 6116551 - DNA, 18 bp, Homo sapiens
ctatttcaacttcaggaa

SEQ ID NO: 6116552 - DNA, 13 bp, Homo sapiens
ctatttcactgga

SEQ ID NO: 6116553 - DNA, 14 bp, Homo sapiens
ctatttcactggag

SEQ ID NO: 6116554 - DNA, 17 bp, Homo sapiens
ctatttcactggagcac

SEQ ID NO: 6116555 - DNA, 12 bp, Homo sapiens
ctatttcagaag

SEQ ID NO: 6116556 - DNA, 19 bp, Homo sapiens
ctatttcagaagtttaaat

SEQ ID NO: 6116557 - DNA, 20 bp, Homo sapiens
ctatttcagccaatctggac

SEQ ID NO: 6116558 - DNA, 16 bp, Homo sapiens
ctatttcagcctcctg

SEQ ID NO: 6116559 - DNA, 15 bp, Homo sapiens
ctatttcagctgctt

SEQ ID NO: 6116560 - DNA, 17 bp, Homo sapiens
ctatttcaggccctcag

SEQ ID NO: 6116561 - DNA, 17 bp, Homo sapiens
ctatttcatgtttttga

SEQ ID NO: 6116562 - DNA, 19 bp, Homo sapiens
ctatttccaaaagcacatg

SEQ ID NO: 6116563 - DNA, 15 bp, Homo sapiens
ctatttccacccatt

SEQ ID NO: 6116564 - DNA, 14 bp, Homo sapiens
ctatttccattcca

SEQ ID NO: 6116565 - DNA, 17 bp, Homo sapiens
ctatttccattccagaa

SEQ ID NO: 6116566 - DNA, 15 bp, Homo sapiens
ctatttcccaagctg

SEQ ID NO: 6116567 - DNA, 19 bp, Homo sapiens
ctatttccccctttcttcc

SEQ ID NO: 6116568 - DNA, 19 bp, Homo sapiens
ctatttcctgaacctggaa

SEQ ID NO: 6116569 - DNA, 14 bp, Homo sapiens
ctatttctatattt

SEQ ID NO: 6116570 - DNA, 16 bp, Homo sapiens
ctatttctatattttc

SEQ ID NO: 6116571 - DNA, 18 bp, Homo sapiens
ctatttctatattttcat

SEQ ID NO: 6116572 - DNA, 19 bp, Homo sapiens
ctatttctatattttcatt

SEQ ID NO: 6116573 - DNA, 12 bp, Homo sapiens
ctatttctatct

SEQ ID NO: 6116574 - DNA, 15 bp, Homo sapiens
ctatttctatctgca

SEQ ID NO: 6116575 - DNA, 21 bp, Homo sapiens
ctatttctatgtatgtgccaa

SEQ ID NO: 6116576 - DNA, 13 bp, Homo sapiens
ctatttctatgtc

SEQ ID NO: 6116577 - DNA, 12 bp, Homo sapiens
ctatttctattc

SEQ ID NO: 6116578 - DNA, 17 bp, Homo sapiens
ctatttctcccttcaat

SEQ ID NO: 6116579 - DNA, 14 bp, Homo sapiens
ctatttctctatgt

SEQ ID NO: 6116580 - DNA, 16 bp, Homo sapiens
ctatttctctccccac

SEQ ID NO: 6116581 - DNA, 17 bp, Homo sapiens
ctatttctctccttaat

SEQ ID NO: 6116582 - DNA, 13 bp, Homo sapiens
ctatttctctgtg

SEQ ID NO: 6116583 - DNA, 22 bp, Homo sapiens
ctatttctgggtcttttgctac

SEQ ID NO: 6116584 - DNA, 15 bp, Homo sapiens
ctatttctgtgtcca

SEQ ID NO: 6116585 - DNA, 11 bp, Homo sapiens
ctatttcttga

SEQ ID NO: 6116586 - DNA, 16 bp, Homo sapiens
ctatttcttgaagaat

SEQ ID NO: 6116587 - DNA, 15 bp, Homo sapiens
ctatttctttcatca

SEQ ID NO: 6116588 - DNA, 21 bp, Homo sapiens
ctatttgaaatactaaaagca

SEQ ID NO: 6116589 - DNA, 19 bp, Homo sapiens
ctatttgaaatgaattcct

SEQ ID NO: 6116590 - DNA, 14 bp, Homo sapiens
ctatttgaacaagt

SEQ ID NO: 6116591 - DNA, 12 bp, Homo sapiens
ctatttgaagaa

SEQ ID NO: 6116592 - DNA, 16 bp, Homo sapiens
ctatttgaataaatta

SEQ ID NO: 6116593 - DNA, 23 bp, Homo sapiens
ctatttgaccagaactttttcct

SEQ ID NO: 6116594 - DNA, 21 bp, Homo sapiens
ctatttgagaagttctcagaa

SEQ ID NO: 6116595 - DNA, 20 bp, Homo sapiens
ctatttgagcatgcacagct

SEQ ID NO: 6116596 - DNA, 22 bp, Homo sapiens
ctatttgattagggtagtaatt

SEQ ID NO: 6116597 - DNA, 19 bp, Homo sapiens
ctatttgcaccttaaaaga

SEQ ID NO: 6116598 - DNA, 16 bp, Homo sapiens
ctatttgccaatgtat

SEQ ID NO: 6116599 - DNA, 23 bp, Homo sapiens
ctatttgccatgggcttcactgt

SEQ ID NO: 6116600 - DNA, 14 bp, Homo sapiens
ctatttgctaatgt

SEQ ID NO: 6116601 - DNA, 18 bp, Homo sapiens
ctatttgcttatttaata

SEQ ID NO: 6116602 - DNA, 19 bp, Homo sapiens
ctatttgcttatttaataa

SEQ ID NO: 6116603 - DNA, 12 bp, Homo sapiens
ctatttggaatt

SEQ ID NO: 6116604 - DNA, 21 bp, Homo sapiens
ctatttgtaaatctgccacaa

SEQ ID NO: 6116605 - DNA, 14 bp, Homo sapiens
ctatttgtacaaat

SEQ ID NO: 6116606 - DNA, 16 bp, Homo sapiens
ctatttgtacaaataa

SEQ ID NO: 6116607 - DNA, 17 bp, Homo sapiens
ctatttgtacaaataaa

SEQ ID NO: 6116608 - DNA, 22 bp, Homo sapiens
ctatttgtacaaataaacctga

SEQ ID NO: 6116609 - DNA, 13 bp, Homo sapiens
ctatttgtacaat

SEQ ID NO: 6116610 - DNA, 21 bp, Homo sapiens
ctatttgtacaattttaaagt

SEQ ID NO: 6116611 - DNA, 16 bp, Homo sapiens
ctatttgtataaaaat

SEQ ID NO: 6116612 - DNA, 17 bp, Homo sapiens
ctatttgtctttcagga

SEQ ID NO: 6116613 - DNA, 15 bp, Homo sapiens
ctatttgtgaattct

SEQ ID NO: 6116614 - DNA, 23 bp, Homo sapiens
ctatttgtggcaattttatgttt

SEQ ID NO: 6116615 - DNA, 20 bp, Homo sapiens
ctatttgtgtaactgaaagg

SEQ ID NO: 6116616 - DNA, 13 bp, Homo sapiens
ctatttgtttcat

SEQ ID NO: 6116617 - DNA, 19 bp, Homo sapiens
ctattttaaaaccatgcag

SEQ ID NO: 6116618 - DNA, 13 bp, Homo sapiens
ctattttaaaata

SEQ ID NO: 6116619 - DNA, 14 bp, Homo sapiens
ctattttaaaataa

SEQ ID NO: 6116620 - DNA, 22 bp, Homo sapiens
ctattttaaaataaattagttg

SEQ ID NO: 6116621 - DNA, 14 bp, Homo sapiens
ctattttaaagctg

SEQ ID NO: 6116622 - DNA, 16 bp, Homo sapiens
ctattttaaagtaaaa

SEQ ID NO: 6116623 - DNA, 19 bp, Homo sapiens
ctattttaaatatccattt

SEQ ID NO: 6116624 - DNA, 14 bp, Homo sapiens
ctattttaagccat

SEQ ID NO: 6116625 - DNA, 22 bp, Homo sapiens
ctattttaataaacactcttga

SEQ ID NO: 6116626 - DNA, 23 bp, Homo sapiens
ctattttaatgtatatttgctgc

SEQ ID NO: 6116627 - DNA, 14 bp, Homo sapiens
ctattttactgtct

SEQ ID NO: 6116628 - DNA, 15 bp, Homo sapiens
ctattttactgtctt

SEQ ID NO: 6116629 - DNA, 17 bp, Homo sapiens
ctattttactgtcttaa

SEQ ID NO: 6116630 - DNA, 16 bp, Homo sapiens
ctattttactttgtac

SEQ ID NO: 6116631 - DNA, 19 bp, Homo sapiens
ctattttactttgtacttg

SEQ ID NO: 6116632 - DNA, 19 bp, Homo sapiens
ctattttagggttctaaat

SEQ ID NO: 6116633 - DNA, 20 bp, Homo sapiens
ctattttagggttctaaatg

SEQ ID NO: 6116634 - DNA, 18 bp, Homo sapiens
ctattttataagggcact

SEQ ID NO: 6116635 - DNA, 16 bp, Homo sapiens
ctattttattatgaag

SEQ ID NO: 6116636 - DNA, 23 bp, Homo sapiens
ctattttattctaaacagactca

SEQ ID NO: 6116637 - DNA, 10 bp, Homo sapiens
ctattttcag

SEQ ID NO: 6116638 - DNA, 12 bp, Homo sapiens
ctattttcagaa

SEQ ID NO: 6116639 - DNA, 22 bp, Homo sapiens
ctattttcagaatctgaatgta

SEQ ID NO: 6116640 - DNA, 21 bp, Homo sapiens
ctattttcataatcagtaaat

SEQ ID NO: 6116641 - DNA, 14 bp, Homo sapiens
ctattttcatttgt

SEQ ID NO: 6116642 - DNA, 15 bp, Homo sapiens
ctattttcatttgta

SEQ ID NO: 6116643 - DNA, 16 bp, Homo sapiens
ctattttcatttgtac

SEQ ID NO: 6116644 - DNA, 19 bp, Homo sapiens
ctattttccaggcttctgc

SEQ ID NO: 6116645 - DNA, 14 bp, Homo sapiens
ctattttcctctgg

SEQ ID NO: 6116646 - DNA, 14 bp, Homo sapiens
ctattttctacaat

SEQ ID NO: 6116647 - DNA, 11 bp, Homo sapiens
ctattttctat

SEQ ID NO: 6116648 - DNA, 21 bp, Homo sapiens
ctattttctcagaatctattc

SEQ ID NO: 6116649 - DNA, 12 bp, Homo sapiens
ctattttctgac

SEQ ID NO: 6116650 - DNA, 14 bp, Homo sapiens
ctattttctgacca

SEQ ID NO: 6116651 - DNA, 18 bp, Homo sapiens
ctattttctgaccaaaat

SEQ ID NO: 6116652 - DNA, 12 bp, Homo sapiens
ctattttcttaa

SEQ ID NO: 6116653 - DNA, 15 bp, Homo sapiens
ctattttctttttta

SEQ ID NO: 6116654 - DNA, 18 bp, Homo sapiens
ctattttgaaaaattcct

SEQ ID NO: 6116655 - DNA, 20 bp, Homo sapiens
ctattttgaaaggtcagaat

SEQ ID NO: 6116656 - DNA, 12 bp, Homo sapiens
ctattttgaaga

SEQ ID NO: 6116657 - DNA, 15 bp, Homo sapiens
ctattttgatgcagc

SEQ ID NO: 6116658 - DNA, 15 bp, Homo sapiens
ctattttgcagcagt

SEQ ID NO: 6116659 - DNA, 17 bp, Homo sapiens
ctattttggattgtata

SEQ ID NO: 6116660 - DNA, 17 bp, Homo sapiens
ctattttgttttaatct

SEQ ID NO: 6116661 - DNA, 22 bp, Homo sapiens
ctatttttaaaaagtaccacat

SEQ ID NO: 6116662 - DNA, 14 bp, Homo sapiens
ctatttttaaataa

SEQ ID NO: 6116663 - DNA, 14 bp, Homo sapiens
ctatttttaatgca

SEQ ID NO: 6116664 - DNA, 19 bp, Homo sapiens
ctatttttaatgtttgtac

SEQ ID NO: 6116665 - DNA, 21 bp, Homo sapiens
ctatttttactagaacacaga

SEQ ID NO: 6116666 - DNA, 13 bp, Homo sapiens
ctatttttataca

SEQ ID NO: 6116667 - DNA, 19 bp, Homo sapiens
ctatttttatcatgaattc

SEQ ID NO: 6116668 - DNA, 15 bp, Homo sapiens
ctatttttatgatga

SEQ ID NO: 6116669 - DNA, 22 bp, Homo sapiens
ctatttttattttcttatgtaa

SEQ ID NO: 6116670 - DNA, 12 bp, Homo sapiens
ctatttttcctt

SEQ ID NO: 6116671 - DNA, 22 bp, Homo sapiens
ctatttttgacatggaaatgaa

SEQ ID NO: 6116672 - DNA, 22 bp, Homo sapiens
ctatttttgactgtagccacag

SEQ ID NO: 6116673 - DNA, 13 bp, Homo sapiens
ctatttttgagga

SEQ ID NO: 6116674 - DNA, 19 bp, Homo sapiens
cctttcttgtgccctgggc

SEQ ID NO: 6116675 - DNA, 20 bp, Homo sapiens
cctttcttgtgccctgggcc

SEQ ID NO: 6116676 - DNA, 16 bp, Homo sapiens
cctttctttgcctctg

SEQ ID NO: 6116677 - DNA, 16 bp, Homo sapiens
cctttcttttttttct

SEQ ID NO: 6116678 - DNA, 12 bp, Homo sapiens
cctttgaagaag

SEQ ID NO: 6116679 - DNA, 17 bp, Homo sapiens
cctttgaagaaggcaag

SEQ ID NO: 6116680 - DNA, 14 bp, Homo sapiens
cctttgaagaggaa

SEQ ID NO: 6116681 - DNA, 23 bp, Homo sapiens
cctttgaagaggaaaatgaataa

SEQ ID NO: 6116682 - DNA, 14 bp, Homo sapiens
cctttgaagcctca

SEQ ID NO: 6116683 - DNA, 20 bp, Homo sapiens
cctttgaatattttttgaag

SEQ ID NO: 6116684 - DNA, 15 bp, Homo sapiens
cctttgaccttcccc

SEQ ID NO: 6116685 - DNA, 18 bp, Homo sapiens
cctttgacgccatcccag

SEQ ID NO: 6116686 - DNA, 20 bp, Homo sapiens
cctttgacgccatcccagcc

SEQ ID NO: 6116687 - DNA, 23 bp, Homo sapiens
cctttgacgccatcccagcccca

SEQ ID NO: 6116688 - DNA, 20 bp, Homo sapiens
cctttgacttcagctgcctg

SEQ ID NO: 6116689 - DNA, 15 bp, Homo sapiens
cctttgagaaagaaa

SEQ ID NO: 6116690 - DNA, 17 bp, Homo sapiens
cctttgagaaagaaata

SEQ ID NO: 6116691 - DNA, 21 bp, Homo sapiens
cctttgagagacgccactccc

SEQ ID NO: 6116692 - DNA, 15 bp, Homo sapiens
cctttgagagagggg

SEQ ID NO: 6116693 - DNA, 16 bp, Homo sapiens
cctttgagcttctcct

SEQ ID NO: 6116694 - DNA, 17 bp, Homo sapiens
cctttgaggccccaact

SEQ ID NO: 6116695 - DNA, 22 bp, Homo sapiens
cctttgagggcagtggggagca

SEQ ID NO: 6116696 - DNA, 19 bp, Homo sapiens
cctttgatgaattcttcct

SEQ ID NO: 6116697 - DNA, 23 bp, Homo sapiens
cctttgatgaattcttcctctcc

SEQ ID NO: 6116698 - DNA, 19 bp, Homo sapiens
cctttgattagagaccaga

SEQ ID NO: 6116699 - DNA, 20 bp, Homo sapiens
cctttgcaagatgcttggtt

SEQ ID NO: 6116700 - DNA, 22 bp, Homo sapiens
cctttgcaatagcagttataac

SEQ ID NO: 6116701 - DNA, 23 bp, Homo sapiens
cctttgcaatagcagttataaca

SEQ ID NO: 6116702 - DNA, 16 bp, Homo sapiens
cctttgcaccctgtag

SEQ ID NO: 6116703 - DNA, 15 bp, Homo sapiens
cctttgcacctgaga

SEQ ID NO: 6116704 - DNA, 17 bp, Homo sapiens
cctttgcactgagggcc

SEQ ID NO: 6116705 - DNA, 18 bp, Homo sapiens
cctttgcactgagggcca

SEQ ID NO: 6116706 - DNA, 13 bp, Homo sapiens
cctttgcactgta

SEQ ID NO: 6116707 - DNA, 15 bp, Homo sapiens
cctttgcagctcaga

SEQ ID NO: 6116708 - DNA, 13 bp, Homo sapiens
cctttgcaggcat

SEQ ID NO: 6116709 - DNA, 17 bp, Homo sapiens
cctttgcagggcagccc

SEQ ID NO: 6116710 - DNA, 15 bp, Homo sapiens
cctttgcatggagtg

SEQ ID NO: 6116711 - DNA, 15 bp, Homo sapiens
cctttgcattcatct

SEQ ID NO: 6116712 - DNA, 15 bp, Homo sapiens
cctttgccagcagag

SEQ ID NO: 6116713 - DNA, 19 bp, Homo sapiens
cctttgccagcagagccag

SEQ ID NO: 6116714 - DNA, 18 bp, Homo sapiens
cctttgccagccacccct

SEQ ID NO: 6116715 - DNA, 12 bp, Homo sapiens
cctttgcccaca

SEQ ID NO: 6116716 - DNA, 17 bp, Homo sapiens
cctttgccccaaggctg

SEQ ID NO: 6116717 - DNA, 21 bp, Homo sapiens
cctttgccccaaggctgctca

SEQ ID NO: 6116718 - DNA, 14 bp, Homo sapiens
cctttgccccctgt

SEQ ID NO: 6116719 - DNA, 17 bp, Homo sapiens
cctttgcccttcctcct

SEQ ID NO: 6116720 - DNA, 19 bp, Homo sapiens
cctttgccgtgagcatgca

SEQ ID NO: 6116721 - DNA, 22 bp, Homo sapiens
cctttgcctaggaggccttctc

SEQ ID NO: 6116722 - DNA, 16 bp, Homo sapiens
cctttgccttaaacct

SEQ ID NO: 6116723 - DNA, 18 bp, Homo sapiens
cctttgccttaaacctga

SEQ ID NO: 6116724 - DNA, 11 bp, Homo sapiens
cctttgccttt

SEQ ID NO: 6116725 - DNA, 17 bp, Homo sapiens
cctttgcgtcaggagca

SEQ ID NO: 6116726 - DNA, 18 bp, Homo sapiens
cctttgctagtgtctttg

SEQ ID NO: 6116727 - DNA, 22 bp, Homo sapiens
cctttgctagttgtttgggctt

SEQ ID NO: 6116728 - DNA, 17 bp, Homo sapiens
cctttgctatgtaaggg

SEQ ID NO: 6116729 - DNA, 12 bp, Homo sapiens
cctttgctcccg

SEQ ID NO: 6116730 - DNA, 13 bp, Homo sapiens
cctttgctctgga

SEQ ID NO: 6116731 - DNA, 13 bp, Homo sapiens
cctttgctcttgc

SEQ ID NO: 6116732 - DNA, 14 bp, Homo sapiens
cctttgctcttgcc

SEQ ID NO: 6116733 - DNA, 20 bp, Homo sapiens
cctttgctgaagtctccccg

SEQ ID NO: 6116734 - DNA, 21 bp, Homo sapiens
cctttgctgaccctccccaaa

SEQ ID NO: 6116735 - DNA, 11 bp, Homo sapiens
cctttgctgcc

SEQ ID NO: 6116736 - DNA, 15 bp, Homo sapiens
cctttgctgcccttg

SEQ ID NO: 6116737 - DNA, 12 bp, Homo sapiens
cctttgctgcct

SEQ ID NO: 6116738 - DNA, 15 bp, Homo sapiens
cctttgctgtagtgt

SEQ ID NO: 6116739 - DNA, 11 bp, Homo sapiens
cctttgctgtc

SEQ ID NO: 6116740 - DNA, 13 bp, Homo sapiens
cctttgctgtgag

SEQ ID NO: 6116741 - DNA, 23 bp, Homo sapiens
cctttgctgtgaggctgtcctgt

SEQ ID NO: 6116742 - DNA, 13 bp, Homo sapiens
cctttgctgttcg

SEQ ID NO: 6116743 - DNA, 14 bp, Homo sapiens
cctttgcttccctt

SEQ ID NO: 6116744 - DNA, 18 bp, Homo sapiens
cctttgctttttcttctc

SEQ ID NO: 6116745 - DNA, 13 bp, Homo sapiens
cctttggaaaaat

SEQ ID NO: 6116746 - DNA, 18 bp, Homo sapiens
cctttggaaaaatcttgg

SEQ ID NO: 6116747 - DNA, 21 bp, Homo sapiens
cctttggaaagctctgaccac

SEQ ID NO: 6116748 - DNA, 22 bp, Homo sapiens
cctttggacccagggcctgact

SEQ ID NO: 6116749 - DNA, 14 bp, Homo sapiens
cctttggagaccat

SEQ ID NO: 6116750 - DNA, 22 bp, Homo sapiens
cctttggagcaaagaaggagct

SEQ ID NO: 6116751 - DNA, 12 bp, Homo sapiens
cctttggaggga

SEQ ID NO: 6116752 - DNA, 18 bp, Homo sapiens
cctttggcaaaaggcatg

SEQ ID NO: 6116753 - DNA, 15 bp, Homo sapiens
cctttggcatgttta

SEQ ID NO: 6116754 - DNA, 21 bp, Homo sapiens
cctttggcatgtttaattgtg

SEQ ID NO: 6116755 - DNA, 17 bp, Homo sapiens
cctttggccaacagggt

SEQ ID NO: 6116756 - DNA, 15 bp, Homo sapiens
cctttggccattcca

SEQ ID NO: 6116757 - DNA, 11 bp, Homo sapiens
cctttggcctg

SEQ ID NO: 6116758 - DNA, 23 bp, Homo sapiens
cctttggcctggggtgcatctcc

SEQ ID NO: 6116759 - DNA, 16 bp, Homo sapiens
cctttggctctggaga

SEQ ID NO: 6116760 - DNA, 14 bp, Homo sapiens
cctttgggaagggg

SEQ ID NO: 6116761 - DNA, 14 bp, Homo sapiens
cctttgggagcagg

SEQ ID NO: 6116762 - DNA, 19 bp, Homo sapiens
cctttgggaggctgaggcg

SEQ ID NO: 6116763 - DNA, 18 bp, Homo sapiens
cctttgggatcagcctcc

SEQ ID NO: 6116764 - DNA, 19 bp, Homo sapiens
cctttgggcaaaggccccc

SEQ ID NO: 6116765 - DNA, 16 bp, Homo sapiens
cctttgggcccaggga

SEQ ID NO: 6116766 - DNA, 15 bp, Homo sapiens
cctttgggccctgca

SEQ ID NO: 6116767 - DNA, 19 bp, Homo sapiens
cctttgggcttcagctgcc

SEQ ID NO: 6116768 - DNA, 16 bp, Homo sapiens
cctttggggaagttta

SEQ ID NO: 6116769 - DNA, 19 bp, Homo sapiens
cctttggggatagtctgga

SEQ ID NO: 6116770 - DNA, 23 bp, Homo sapiens
cctttggggcttctgtgaaaaac

SEQ ID NO: 6116771 - DNA, 12 bp, Homo sapiens
cctttgggggtt

SEQ ID NO: 6116772 - DNA, 18 bp, Homo sapiens
cctttggggttgcccagc

SEQ ID NO: 6116773 - DNA, 19 bp, Homo sapiens
cctttgggtcctgggcagg

SEQ ID NO: 6116774 - DNA, 19 bp, Homo sapiens
cctttgggtgctgttttgc

SEQ ID NO: 6116775 - DNA, 12 bp, Homo sapiens
cctttgggtgtg

SEQ ID NO: 6116776 - DNA, 21 bp, Homo sapiens
cctttgggttctttctggggg

SEQ ID NO: 6116777 - DNA, 16 bp, Homo sapiens
cctttggtatttcact

SEQ ID NO: 6116778 - DNA, 15 bp, Homo sapiens
cctttggtcctggtg

SEQ ID NO: 6116779 - DNA, 17 bp, Homo sapiens
cctttggtcctgtcccc

SEQ ID NO: 6116780 - DNA, 15 bp, Homo sapiens
cctttggtgaataac

SEQ ID NO: 6116781 - DNA, 16 bp, Homo sapiens
cctttggtgaattcct

SEQ ID NO: 6116782 - DNA, 14 bp, Homo sapiens
cctttggtgcagag

SEQ ID NO: 6116783 - DNA, 17 bp, Homo sapiens
cctttggtgcagaggtt

SEQ ID NO: 6116784 - DNA, 22 bp, Homo sapiens
cctttggttctatgcaaataaa

SEQ ID NO: 6116785 - DNA, 15 bp, Homo sapiens
cctttggttctggcc

SEQ ID NO: 6116786 - DNA, 17 bp, Homo sapiens
cctttggtttggcctcc

SEQ ID NO: 6116787 - DNA, 16 bp, Homo sapiens
cctttggtttttttct

SEQ ID NO: 6116788 - DNA, 12 bp, Homo sapiens
cctttgtaacca

SEQ ID NO: 6116789 - DNA, 12 bp, Homo sapiens
cctttgtaagac

SEQ ID NO: 6116790 - DNA, 15 bp, Homo sapiens
cctttgtaagacaca

SEQ ID NO: 6116791 - DNA, 19 bp, Homo sapiens
cctttgtaagacacacagc

SEQ ID NO: 6116792 - DNA, 18 bp, Homo sapiens
cctttgtaagacatttgt

SEQ ID NO: 6116793 - DNA, 15 bp, Homo sapiens
cctttgtaagttatt

SEQ ID NO: 6116794 - DNA, 18 bp, Homo sapiens
cctttgtaatatgagaat

SEQ ID NO: 6116795 - DNA, 21 bp, Homo sapiens
cctttgtaatatgagaatgta

SEQ ID NO: 6116796 - DNA, 22 bp, Homo sapiens
cctttgtaatatgagaatgtat

SEQ ID NO: 6116797 - DNA, 23 bp, Homo sapiens
cctttgtaatatgagaatgtatt

SEQ ID NO: 6116798 - DNA, 16 bp, Homo sapiens
cctttgtagcactcag

SEQ ID NO: 6116799 - DNA, 23 bp, Homo sapiens
cctttgtaggggttttttggttc

SEQ ID NO: 6116800 - DNA, 12 bp, Homo sapiens
cctttgtatatt

SEQ ID NO: 6116801 - DNA, 19 bp, Homo sapiens
cctttgtatattatttcta

SEQ ID NO: 6116802 - DNA, 12 bp, Homo sapiens
cctttgtattat

SEQ ID NO: 6116803 - DNA, 14 bp, Homo sapiens
cctttgtattataa

SEQ ID NO: 6116804 - DNA, 19 bp, Homo sapiens
cctttgtattataaaagct

SEQ ID NO: 6116805 - DNA, 15 bp, Homo sapiens
cctttgtattataat

SEQ ID NO: 6116806 - DNA, 15 bp, Homo sapiens
cctttgtattctctc

SEQ ID NO: 6116807 - DNA, 22 bp, Homo sapiens
cctttgtattctctcctgtacc

SEQ ID NO: 6116808 - DNA, 23 bp, Homo sapiens
cctttgtattctctcctgtacct

SEQ ID NO: 6116809 - DNA, 14 bp, Homo sapiens
cctttgtattctgt

SEQ ID NO: 6116810 - DNA, 19 bp, Homo sapiens
cctttgtcatcattgtata

SEQ ID NO: 6116811 - DNA, 18 bp, Homo sapiens
cctttgtcatctttcttc

SEQ ID NO: 6116812 - DNA, 14 bp, Homo sapiens
cctttgtcccagaa

SEQ ID NO: 6116813 - DNA, 22 bp, Homo sapiens
cctttgtccccacacagcctct

SEQ ID NO: 6116814 - DNA, 18 bp, Homo sapiens
cctttgtccccaccgcag

SEQ ID NO: 6116815 - DNA, 22 bp, Homo sapiens
cctttgtctcacgattccagtg

SEQ ID NO: 6116816 - DNA, 20 bp, Homo sapiens
cctttgtctgtcaatcacag

SEQ ID NO: 6116817 - DNA, 13 bp, Homo sapiens
cctttgtcttgga

SEQ ID NO: 6116818 - DNA, 12 bp, Homo sapiens
cctttgtctttc

SEQ ID NO: 6116819 - DNA, 23 bp, Homo sapiens
cctttgtctttctttgtcattca

SEQ ID NO: 6116820 - DNA, 13 bp, Homo sapiens
cctttgtgaatat

SEQ ID NO: 6116821 - DNA, 16 bp, Homo sapiens
cctttgtgaggaagcc

SEQ ID NO: 6116822 - DNA, 17 bp, Homo sapiens
cctttgtgaggaagccg

SEQ ID NO: 6116823 - DNA, 16 bp, Homo sapiens
cctttgtgagtcaata

SEQ ID NO: 6116824 - DNA, 15 bp, Homo sapiens
cctttgtgcagcttc

SEQ ID NO: 6116825 - DNA, 13 bp, Homo sapiens
cctttgtgcccta

SEQ ID NO: 6116826 - DNA, 14 bp, Homo sapiens
cctttgtgccctat

SEQ ID NO: 6116827 - DNA, 14 bp, Homo sapiens
cctttgtgctctat

SEQ ID NO: 6116828 - DNA, 21 bp, Homo sapiens
cctttgtgctgcgcctgcagg

SEQ ID NO: 6116829 - DNA, 17 bp, Homo sapiens
cctttgtggactttatt

SEQ ID NO: 6116830 - DNA, 18 bp, Homo sapiens
cctttgtggactttattt

SEQ ID NO: 6116831 - DNA, 14 bp, Homo sapiens
cctttgtgtaaaga

SEQ ID NO: 6116832 - DNA, 13 bp, Homo sapiens
cctttgtgtggct

SEQ ID NO: 6116833 - DNA, 14 bp, Homo sapiens
cctttgtgtggctc

SEQ ID NO: 6116834 - DNA, 20 bp, Homo sapiens
cctttgtgtggctgccccac

SEQ ID NO: 6116835 - DNA, 22 bp, Homo sapiens
cctttgtgtgtattcagaggca

SEQ ID NO: 6116836 - DNA, 16 bp, Homo sapiens
cctttgtgtgtgtgtc

SEQ ID NO: 6116837 - DNA, 21 bp, Homo sapiens
cctttgtgtgtgtgtcagctg

SEQ ID NO: 6116838 - DNA, 13 bp, Homo sapiens
cctttgtgtttat

SEQ ID NO: 6116839 - DNA, 15 bp, Homo sapiens
cctttgtgtttatat

SEQ ID NO: 6116840 - DNA, 20 bp, Homo sapiens
cctttgtgtttatatggcgt

SEQ ID NO: 6116841 - DNA, 13 bp, Homo sapiens
cctttgtgtttct

SEQ ID NO: 6116842 - DNA, 15 bp, Homo sapiens
cctttgttaaattta

SEQ ID NO: 6116843 - DNA, 21 bp, Homo sapiens
cctttgttaaccttaaataca

SEQ ID NO: 6116844 - DNA, 18 bp, Homo sapiens
cctttgttacttctctaa

SEQ ID NO: 6116845 - DNA, 20 bp, Homo sapiens
cctttgttattatcctgcat

SEQ ID NO: 6116846 - DNA, 20 bp, Homo sapiens
cctttgttcccaaggacttc

SEQ ID NO: 6116847 - DNA, 14 bp, Homo sapiens
cctttgttcccggc

SEQ ID NO: 6116848 - DNA, 15 bp, Homo sapiens
cctttgttgaaaaat

SEQ ID NO: 6116849 - DNA, 14 bp, Homo sapiens
cctttgttgctcag

SEQ ID NO: 6116850 - DNA, 23 bp, Homo sapiens
cctttgttggagtcaaaaagaac

SEQ ID NO: 6116851 - DNA, 18 bp, Homo sapiens
cctttgtttccttgttgg

SEQ ID NO: 6116852 - DNA, 23 bp, Homo sapiens
ccttttaaaaaaataatataaat

SEQ ID NO: 6116853 - DNA, 13 bp, Homo sapiens
ccttttaaaagaa

SEQ ID NO: 6116854 - DNA, 15 bp, Homo sapiens
ccttttaaaattgaa

SEQ ID NO: 6116855 - DNA, 23 bp, Homo sapiens
ctatttttgcactggaatatctg

SEQ ID NO: 6116856 - DNA, 18 bp, Homo sapiens
ctatttttggcagtctga

SEQ ID NO: 6116857 - DNA, 19 bp, Homo sapiens
ctatttttgtaaagtttcc

SEQ ID NO: 6116858 - DNA, 13 bp, Homo sapiens
ctatttttgtaga

SEQ ID NO: 6116859 - DNA, 17 bp, Homo sapiens
ctatttttgtccttgca

SEQ ID NO: 6116860 - DNA, 22 bp, Homo sapiens
ctatttttgtcttatatatatt

SEQ ID NO: 6116861 - DNA, 20 bp, Homo sapiens
ctatttttgtgtttgaaagt

SEQ ID NO: 6116862 - DNA, 13 bp, Homo sapiens
ctatttttgttgt

SEQ ID NO: 6116863 - DNA, 15 bp, Homo sapiens
ctattttttaataaa

SEQ ID NO: 6116864 - DNA, 16 bp, Homo sapiens
ctattttttaataaaa

SEQ ID NO: 6116865 - DNA, 17 bp, Homo sapiens
ctattttttaataaaag

SEQ ID NO: 6116866 - DNA, 22 bp, Homo sapiens
ctattttttatcattgaaacat

SEQ ID NO: 6116867 - DNA, 20 bp, Homo sapiens
ctatttttttaaaatcacta

SEQ ID NO: 6116868 - DNA, 21 bp, Homo sapiens
ctatttttttaaaatcactaa

SEQ ID NO: 6116869 - DNA, 23 bp, Homo sapiens
ctatttttttaactgaaaatgta

SEQ ID NO: 6116870 - DNA, 13 bp, Homo sapiens
ctatttttttaga

SEQ ID NO: 6116871 - DNA, 21 bp, Homo sapiens
ctatttttttcctaagacatt

SEQ ID NO: 6116872 - DNA, 17 bp, Homo sapiens
ctatttttttgttgctg

SEQ ID NO: 6116873 - DNA, 18 bp, Homo sapiens
ctatttttttttcttttt

SEQ ID NO: 6116874 - DNA, 18 bp, Homo sapiens
ctatttttttttttttgt

SEQ ID NO: 6116875 - DNA, 21 bp, Homo sapiens
ctcaaaaaaaaaaaagtgtct

SEQ ID NO: 6116876 - DNA, 19 bp, Homo sapiens
ctcaaaaaacattgttttg

SEQ ID NO: 6116877 - DNA, 20 bp, Homo sapiens
ctcaaaaaccattacaaaat

SEQ ID NO: 6116878 - DNA, 13 bp, Homo sapiens
ctcaaaaagcaga

SEQ ID NO: 6116879 - DNA, 18 bp, Homo sapiens
ctcaaaaagcagaaggag

SEQ ID NO: 6116880 - DNA, 19 bp, Homo sapiens
ctcaaaaagctgcctggga

SEQ ID NO: 6116881 - DNA, 20 bp, Homo sapiens
ctcaaaacacttccagtctg

SEQ ID NO: 6116882 - DNA, 19 bp, Homo sapiens
ctcaaaacccatctgggct

SEQ ID NO: 6116883 - DNA, 19 bp, Homo sapiens
ctcaaaacgggtcagtatt

SEQ ID NO: 6116884 - DNA, 16 bp, Homo sapiens
ctcaaaacttaacata

SEQ ID NO: 6116885 - DNA, 12 bp, Homo sapiens
ctcaaaagaact

SEQ ID NO: 6116886 - DNA, 16 bp, Homo sapiens
ctcaaaagacaaacat

SEQ ID NO: 6116887 - DNA, 20 bp, Homo sapiens
ctcaaaagagaaaaacaaaa

SEQ ID NO: 6116888 - DNA, 16 bp, Homo sapiens
ctcaaaagaggttact

SEQ ID NO: 6116889 - DNA, 19 bp, Homo sapiens
ctcaaaagaggttacttta

SEQ ID NO: 6116890 - DNA, 20 bp, Homo sapiens
ctcaaaagcacccttgacgt

SEQ ID NO: 6116891 - DNA, 18 bp, Homo sapiens
ctcaaaagctgggcaggt

SEQ ID NO: 6116892 - DNA, 18 bp, Homo sapiens
ctcaaaaggaaaccaagt

SEQ ID NO: 6116893 - DNA, 20 bp, Homo sapiens
ctcaaaaggagaactgtgct

SEQ ID NO: 6116894 - DNA, 23 bp, Homo sapiens
ctcaaaaggagaactgtgctctc

SEQ ID NO: 6116895 - DNA, 16 bp, Homo sapiens
ctcaaaagtctatttt

SEQ ID NO: 6116896 - DNA, 17 bp, Homo sapiens
ctcaaaataaaaccaga

SEQ ID NO: 6116897 - DNA, 18 bp, Homo sapiens
ctcaaaataaagaagtat

SEQ ID NO: 6116898 - DNA, 23 bp, Homo sapiens
ctcaaaataaggggcacctggga

SEQ ID NO: 6116899 - DNA, 17 bp, Homo sapiens
ctcaaaatatcctaaga

SEQ ID NO: 6116900 - DNA, 13 bp, Homo sapiens
ctcaaaatatttg

SEQ ID NO: 6116901 - DNA, 17 bp, Homo sapiens
ctcaaaatgacagtttc

SEQ ID NO: 6116902 - DNA, 12 bp, Homo sapiens
ctcaaaatgtgc

SEQ ID NO: 6116903 - DNA, 16 bp, Homo sapiens
ctcaaacaacactggt

SEQ ID NO: 6116904 - DNA, 17 bp, Homo sapiens
ctcaaacaacactggtg

SEQ ID NO: 6116905 - DNA, 13 bp, Homo sapiens
ctcaaacaatgac

SEQ ID NO: 6116906 - DNA, 20 bp, Homo sapiens
ctcaaacaatgacaaagcag

SEQ ID NO: 6116907 - DNA, 20 bp, Homo sapiens
ctcaaacacacaaactatta

SEQ ID NO: 6116908 - DNA, 14 bp, Homo sapiens
ctcaaacactgcag

SEQ ID NO: 6116909 - DNA, 19 bp, Homo sapiens
ctcaaaccaaatcactgaa

SEQ ID NO: 6116910 - DNA, 12 bp, Homo sapiens
ctcaaacccctg

SEQ ID NO: 6116911 - DNA, 17 bp, Homo sapiens
ctcaaaccctgtttacg

SEQ ID NO: 6116912 - DNA, 13 bp, Homo sapiens
ctcaaacctccaa

SEQ ID NO: 6116913 - DNA, 18 bp, Homo sapiens
ctcaaacctccaaaagcc

SEQ ID NO: 6116914 - DNA, 14 bp, Homo sapiens
ctcaaacctcctct

SEQ ID NO: 6116915 - DNA, 16 bp, Homo sapiens
ctcaaacctggagctg

SEQ ID NO: 6116916 - DNA, 18 bp, Homo sapiens
ctcaaacctggcagatgg

SEQ ID NO: 6116917 - DNA, 13 bp, Homo sapiens
ctcaaactcaagg

SEQ ID NO: 6116918 - DNA, 13 bp, Homo sapiens
ctcaaactcattg

SEQ ID NO: 6116919 - DNA, 13 bp, Homo sapiens
ctcaaactcctga

SEQ ID NO: 6116920 - DNA, 21 bp, Homo sapiens
ctcaaactcctgacctcaggt

SEQ ID NO: 6116921 - DNA, 14 bp, Homo sapiens
ctcaaactcctggg

SEQ ID NO: 6116922 - DNA, 11 bp, Homo sapiens
ctcaaactgca

SEQ ID NO: 6116923 - DNA, 12 bp, Homo sapiens
ctcaaactgcac

SEQ ID NO: 6116924 - DNA, 13 bp, Homo sapiens
ctcaaactgcaca

SEQ ID NO: 6116925 - DNA, 16 bp, Homo sapiens
ctcaaagaagtactgt

SEQ ID NO: 6116926 - DNA, 16 bp, Homo sapiens
ctcaaagaatataatc

SEQ ID NO: 6116927 - DNA, 12 bp, Homo sapiens
ctcaaagaatgt

SEQ ID NO: 6116928 - DNA, 20 bp, Homo sapiens
ctcaaagagaattgtatgta

SEQ ID NO: 6116929 - DNA, 14 bp, Homo sapiens
ctcaaagaggcagt

SEQ ID NO: 6116930 - DNA, 20 bp, Homo sapiens
ctcaaagaggccagtacttt

SEQ ID NO: 6116931 - DNA, 19 bp, Homo sapiens
ctcaaagagggggctctgc

SEQ ID NO: 6116932 - DNA, 13 bp, Homo sapiens
ctcaaagatgcat

SEQ ID NO: 6116933 - DNA, 23 bp, Homo sapiens
ctcaaagatgcgtttgcctcctg

SEQ ID NO: 6116934 - DNA, 16 bp, Homo sapiens
ctcaaagatgtaatgt

SEQ ID NO: 6116935 - DNA, 17 bp, Homo sapiens
ctcaaagatgtactgag

SEQ ID NO: 6116936 - DNA, 24 bp, Homo sapiens
ctcaaagatgtactgagaggaggg

SEQ ID NO: 6116937 - DNA, 21 bp, Homo sapiens
ctcaaagcaacccgctggagc

SEQ ID NO: 6116938 - DNA, 22 bp, Homo sapiens
ctcaaagcaacccgctggagcc

SEQ ID NO: 6116939 - DNA, 19 bp, Homo sapiens
ctcaaagcaagctcttctc

SEQ ID NO: 6116940 - DNA, 15 bp, Homo sapiens
ctcaaagcacaatgt

SEQ ID NO: 6116941 - DNA, 22 bp, Homo sapiens
ctcaaagcagaagtggaatcca

SEQ ID NO: 6116942 - DNA, 15 bp, Homo sapiens
ctcaaagcagcagga

SEQ ID NO: 6116943 - DNA, 19 bp, Homo sapiens
ctcaaagccccattaactg

SEQ ID NO: 6116944 - DNA, 23 bp, Homo sapiens
ctcaaagcttggattaaatacat

SEQ ID NO: 6116945 - DNA, 23 bp, Homo sapiens
ctcaaaggagaaaaaaaaccttg

SEQ ID NO: 6116946 - DNA, 13 bp, Homo sapiens
ctcaaaggccaga

SEQ ID NO: 6116947 - DNA, 17 bp, Homo sapiens
ctcaaagggagagaaaa

SEQ ID NO: 6116948 - DNA, 18 bp, Homo sapiens
ctcaaagggagagaaaag

SEQ ID NO: 6116949 - DNA, 23 bp, Homo sapiens
ctcaaagggcagttttgaggcat

SEQ ID NO: 6116950 - DNA, 19 bp, Homo sapiens
ctcaaagtatgcaatgctt

SEQ ID NO: 6116951 - DNA, 18 bp, Homo sapiens
ctcaaagtcccttgagac

SEQ ID NO: 6116952 - DNA, 15 bp, Homo sapiens
ctcaaagttaattca

SEQ ID NO: 6116953 - DNA, 19 bp, Homo sapiens
ctcaaagtttaacacaatt

SEQ ID NO: 6116954 - DNA, 22 bp, Homo sapiens
ctcaaagtttaacacaatttaa

SEQ ID NO: 6116955 - DNA, 15 bp, Homo sapiens
ctcaaagttttgaaa

SEQ ID NO: 6116956 - DNA, 17 bp, Homo sapiens
ctcaaagttttgaaaag

SEQ ID NO: 6116957 - DNA, 21 bp, Homo sapiens
ctcaaagttttgaaaagctat

SEQ ID NO: 6116958 - DNA, 23 bp, Homo sapiens
ctcaaagttttgaaaagctatta

SEQ ID NO: 6116959 - DNA, 20 bp, Homo sapiens
ctcaaagtttttacagtgta

SEQ ID NO: 6116960 - DNA, 14 bp, Homo sapiens
ctcaaataaaataa

SEQ ID NO: 6116961 - DNA, 12 bp, Homo sapiens
ctcaaataacta

SEQ ID NO: 6116962 - DNA, 15 bp, Homo sapiens
ctcaaatacacattt

SEQ ID NO: 6116963 - DNA, 20 bp, Homo sapiens
ctcaaatacagtagtataat

SEQ ID NO: 6116964 - DNA, 17 bp, Homo sapiens
ctcaaatacatgcacag

SEQ ID NO: 6116965 - DNA, 18 bp, Homo sapiens
ctcaaatacatgcacagt

SEQ ID NO: 6116966 - DNA, 21 bp, Homo sapiens
ctcaaatacatgcacagtcat

SEQ ID NO: 6116967 - DNA, 23 bp, Homo sapiens
ctcaaatacgtgggcattcaaat

SEQ ID NO: 6116968 - DNA, 21 bp, Homo sapiens
ctcaaatattgaatgtttaaa

SEQ ID NO: 6116969 - DNA, 14 bp, Homo sapiens
ctcaaatccaggac

SEQ ID NO: 6116970 - DNA, 14 bp, Homo sapiens
ctcaaatccctctc

SEQ ID NO: 6116971 - DNA, 12 bp, Homo sapiens
ctcaaatccttg

SEQ ID NO: 6116972 - DNA, 16 bp, Homo sapiens
ctcaaatctattcaga

SEQ ID NO: 6116973 - DNA, 22 bp, Homo sapiens
ctcaaatctattcagacaagca

SEQ ID NO: 6116974 - DNA, 14 bp, Homo sapiens
ctcaaatgaatttg

SEQ ID NO: 6116975 - DNA, 21 bp, Homo sapiens
ctcaaatgagtaacatttgct

SEQ ID NO: 6116976 - DNA, 19 bp, Homo sapiens
ctcaaatgatcctcccacc

SEQ ID NO: 6116977 - DNA, 20 bp, Homo sapiens
ctcaaatgatgtgcctgctt

SEQ ID NO: 6116978 - DNA, 22 bp, Homo sapiens
ctcaaatgctcagaccagctct

SEQ ID NO: 6116979 - DNA, 16 bp, Homo sapiens
ctcaaatggggccaga

SEQ ID NO: 6116980 - DNA, 19 bp, Homo sapiens
ctcaaatggggccagatcc

SEQ ID NO: 6116981 - DNA, 22 bp, Homo sapiens
ctcaaatggtgtcatggctgaa

SEQ ID NO: 6116982 - DNA, 12 bp, Homo sapiens
ctcaaatgtgtg

SEQ ID NO: 6116983 - DNA, 20 bp, Homo sapiens
ctcaaatgtgtgttcctgct

SEQ ID NO: 6116984 - DNA, 23 bp, Homo sapiens
ctcaaatgttctaagtttctaag

SEQ ID NO: 6116985 - DNA, 14 bp, Homo sapiens
ctcaaattcagctc

SEQ ID NO: 6116986 - DNA, 18 bp, Homo sapiens
ctcaaattgtaattaata

SEQ ID NO: 6116987 - DNA, 17 bp, Homo sapiens
ctcaaattgtcagcaat

SEQ ID NO: 6116988 - DNA, 12 bp, Homo sapiens
ctcaaatttatt

SEQ ID NO: 6116989 - DNA, 14 bp, Homo sapiens
ctcaaatttctaaa

SEQ ID NO: 6116990 - DNA, 17 bp, Homo sapiens
ctcaaatttctaaatct

SEQ ID NO: 6116991 - DNA, 21 bp, Homo sapiens
ctcaaattttttgactttttt

SEQ ID NO: 6116992 - DNA, 19 bp, Homo sapiens
ctcaacaaagcacagtgtt

SEQ ID NO: 6116993 - DNA, 15 bp, Homo sapiens
ctcaacaacatcttt

SEQ ID NO: 6116994 - DNA, 12 bp, Homo sapiens
ctcaacaagaaa

SEQ ID NO: 6116995 - DNA, 14 bp, Homo sapiens
ctcaacaataaaac

SEQ ID NO: 6116996 - DNA, 13 bp, Homo sapiens
ctcaacaccctgc

SEQ ID NO: 6116997 - DNA, 23 bp, Homo sapiens
ctcaacaccctgcttctcccggg

SEQ ID NO: 6116998 - DNA, 14 bp, Homo sapiens
ctcaacagagagga

SEQ ID NO: 6116999 - DNA, 24 bp, Homo sapiens
ctcaacagagaggaccaacatcca

SEQ ID NO: 6117000 - DNA, 19 bp, Homo sapiens
ctcaacagatctgtgggcc

SEQ ID NO: 6117001 - DNA, 15 bp, Homo sapiens
ctcaacagcaggagg

SEQ ID NO: 6117002 - DNA, 16 bp, Homo sapiens
ctcaacagcaggaggc

SEQ ID NO: 6117003 - DNA, 19 bp, Homo sapiens
ctcaacagcaggaggcaca

SEQ ID NO: 6117004 - DNA, 22 bp, Homo sapiens
ctcaacagcaggaggcacagca

SEQ ID NO: 6117005 - DNA, 15 bp, Homo sapiens
ctcaacagccaagtg

SEQ ID NO: 6117006 - DNA, 18 bp, Homo sapiens
ctcaacaggcccagggag

SEQ ID NO: 6117007 - DNA, 15 bp, Homo sapiens
ctcaacaggcctcag

SEQ ID NO: 6117008 - DNA, 16 bp, Homo sapiens
ctcaacaggcctcagg

SEQ ID NO: 6117009 - DNA, 22 bp, Homo sapiens
ctcaacaggcctcagggctcct

SEQ ID NO: 6117010 - DNA, 14 bp, Homo sapiens
ctcaacatactgta

SEQ ID NO: 6117011 - DNA, 15 bp, Homo sapiens
ctcaacatgagtcaa

SEQ ID NO: 6117012 - DNA, 18 bp, Homo sapiens
ctcaacatgagtcaagag

SEQ ID NO: 6117013 - DNA, 20 bp, Homo sapiens
ctcaacatgtgtttctgaca

SEQ ID NO: 6117014 - DNA, 16 bp, Homo sapiens
ctcaacattgcatggt

SEQ ID NO: 6117015 - DNA, 20 bp, Homo sapiens
ctcaacatttgtctggtctt

SEQ ID NO: 6117016 - DNA, 20 bp, Homo sapiens
ctcaaccaaattaaaaattt

SEQ ID NO: 6117017 - DNA, 18 bp, Homo sapiens
ctcaaccacctttcagat

SEQ ID NO: 6117018 - DNA, 15 bp, Homo sapiens
ctcaaccagacagat

SEQ ID NO: 6117019 - DNA, 16 bp, Homo sapiens
ctcaacccattgttgt

SEQ ID NO: 6117020 - DNA, 22 bp, Homo sapiens
ctcaaccccaccatatgaattg

SEQ ID NO: 6117021 - DNA, 19 bp, Homo sapiens
ctcaacccccatttctatt

SEQ ID NO: 6117022 - DNA, 14 bp, Homo sapiens
ctcaacccccctcc

SEQ ID NO: 6117023 - DNA, 22 bp, Homo sapiens
ctcaacccccctcccagacagg

SEQ ID NO: 6117024 - DNA, 19 bp, Homo sapiens
ctcaacccctcccctccat

SEQ ID NO: 6117025 - DNA, 21 bp, Homo sapiens
ctcaaccctccctcagcccct

SEQ ID NO: 6117026 - DNA, 18 bp, Homo sapiens
ctcaacctacagtggagg

SEQ ID NO: 6117027 - DNA, 20 bp, Homo sapiens
ctcaacctacagtggaggga

SEQ ID NO: 6117028 - DNA, 13 bp, Homo sapiens
ctcaacctacctc

SEQ ID NO: 6117029 - DNA, 13 bp, Homo sapiens
ctcaacctcacca

SEQ ID NO: 6117030 - DNA, 17 bp, Homo sapiens
ctcaacctcctgggttc

SEQ ID NO: 6117031 - DNA, 14 bp, Homo sapiens
ctcaacctctcaga

SEQ ID NO: 6117032 - DNA, 18 bp, Homo sapiens
ctcaacctctcagatccc

SEQ ID NO: 6117033 - DNA, 19 bp, Homo sapiens
ccttttaaaattttgtgtt

SEQ ID NO: 6117034 - DNA, 12 bp, Homo sapiens
ccttttaaagaa

SEQ ID NO: 6117035 - DNA, 19 bp, Homo sapiens
ccttttaaagaagctttat

SEQ ID NO: 6117036 - DNA, 17 bp, Homo sapiens
ccttttaaagaattttt

SEQ ID NO: 6117037 - DNA, 19 bp, Homo sapiens
ccttttaaagtgtttcagc

SEQ ID NO: 6117038 - DNA, 21 bp, Homo sapiens
ccttttaaatcctgttgaaaa

SEQ ID NO: 6117039 - DNA, 14 bp, Homo sapiens
ccttttaacatttt

SEQ ID NO: 6117040 - DNA, 17 bp, Homo sapiens
ccttttaagacattttc

SEQ ID NO: 6117041 - DNA, 14 bp, Homo sapiens
ccttttaagcatgt

SEQ ID NO: 6117042 - DNA, 18 bp, Homo sapiens
ccttttaagcatgtgatg

SEQ ID NO: 6117043 - DNA, 16 bp, Homo sapiens
ccttttaatataaaag

SEQ ID NO: 6117044 - DNA, 20 bp, Homo sapiens
ccttttaatcagagcccagg

SEQ ID NO: 6117045 - DNA, 19 bp, Homo sapiens
ccttttacagaattagaaa

SEQ ID NO: 6117046 - DNA, 17 bp, Homo sapiens
ccttttacatactgctg

SEQ ID NO: 6117047 - DNA, 18 bp, Homo sapiens
ccttttacatactgctgt

SEQ ID NO: 6117048 - DNA, 18 bp, Homo sapiens
ccttttacattctgtgtg

SEQ ID NO: 6117049 - DNA, 20 bp, Homo sapiens
ccttttactggttgcatgga

SEQ ID NO: 6117050 - DNA, 18 bp, Homo sapiens
ccttttagaaacctcatt

SEQ ID NO: 6117051 - DNA, 14 bp, Homo sapiens
ccttttaggctcag

SEQ ID NO: 6117052 - DNA, 22 bp, Homo sapiens
ccttttagtggtggtgtctcac

SEQ ID NO: 6117053 - DNA, 16 bp, Homo sapiens
ccttttagttcctgtg

SEQ ID NO: 6117054 - DNA, 22 bp, Homo sapiens
ccttttagttcctgtgcacagc

SEQ ID NO: 6117055 - DNA, 16 bp, Homo sapiens
ccttttatatcccatt

SEQ ID NO: 6117056 - DNA, 20 bp, Homo sapiens
ccttttatctccttgtggcc

SEQ ID NO: 6117057 - DNA, 16 bp, Homo sapiens
ccttttatctggtgcc

SEQ ID NO: 6117058 - DNA, 16 bp, Homo sapiens
ccttttatcttctagc

SEQ ID NO: 6117059 - DNA, 19 bp, Homo sapiens
ccttttatgaatcaaatat

SEQ ID NO: 6117060 - DNA, 20 bp, Homo sapiens
ccttttattaacatatattg

SEQ ID NO: 6117061 - DNA, 15 bp, Homo sapiens
ccttttattgacaca

SEQ ID NO: 6117062 - DNA, 23 bp, Homo sapiens
ccttttatttttatttctgactc

SEQ ID NO: 6117063 - DNA, 14 bp, Homo sapiens
ccttttcaaattaa

SEQ ID NO: 6117064 - DNA, 13 bp, Homo sapiens
ccttttcagccct

SEQ ID NO: 6117065 - DNA, 23 bp, Homo sapiens
ccttttcagcgatgtatgcagct

SEQ ID NO: 6117066 - DNA, 18 bp, Homo sapiens
ccttttcagctgagccct

SEQ ID NO: 6117067 - DNA, 21 bp, Homo sapiens
ccttttcagctgagccctggg

SEQ ID NO: 6117068 - DNA, 10 bp, Homo sapiens
ccttttcata

SEQ ID NO: 6117069 - DNA, 11 bp, Homo sapiens
ccttttcatag

SEQ ID NO: 6117070 - DNA, 22 bp, Homo sapiens
ccttttcataggtctgaaattt

SEQ ID NO: 6117071 - DNA, 18 bp, Homo sapiens
ccttttcatctgttgttc

SEQ ID NO: 6117072 - DNA, 16 bp, Homo sapiens
ccttttcatgatttta

SEQ ID NO: 6117073 - DNA, 21 bp, Homo sapiens
ccttttccaaatgcccaagga

SEQ ID NO: 6117074 - DNA, 15 bp, Homo sapiens
ccttttccagagcat

SEQ ID NO: 6117075 - DNA, 20 bp, Homo sapiens
ccttttccagttgctgtgga

SEQ ID NO: 6117076 - DNA, 15 bp, Homo sapiens
ccttttccatcatct

SEQ ID NO: 6117077 - DNA, 16 bp, Homo sapiens
ccttttccatcccact

SEQ ID NO: 6117078 - DNA, 20 bp, Homo sapiens
ccttttccccaaccacagag

SEQ ID NO: 6117079 - DNA, 15 bp, Homo sapiens
ccttttccccaggag

SEQ ID NO: 6117080 - DNA, 16 bp, Homo sapiens
ccttttccccaggagc

SEQ ID NO: 6117081 - DNA, 17 bp, Homo sapiens
ccttttccccaggagca

SEQ ID NO: 6117082 - DNA, 17 bp, Homo sapiens
ccttttcccctacagaa

SEQ ID NO: 6117083 - DNA, 21 bp, Homo sapiens
ccttttcccggggaggagaga

SEQ ID NO: 6117084 - DNA, 13 bp, Homo sapiens
ccttttccctgct

SEQ ID NO: 6117085 - DNA, 15 bp, Homo sapiens
ccttttcccttgctg

SEQ ID NO: 6117086 - DNA, 15 bp, Homo sapiens
ccttttccttcagag

SEQ ID NO: 6117087 - DNA, 15 bp, Homo sapiens
ccttttcctttctgg

SEQ ID NO: 6117088 - DNA, 18 bp, Homo sapiens
ccttttcgtttagaatca

SEQ ID NO: 6117089 - DNA, 22 bp, Homo sapiens
ccttttcgtttagaatcagaat

SEQ ID NO: 6117090 - DNA, 23 bp, Homo sapiens
ccttttcgtttagaatcagaata

SEQ ID NO: 6117091 - DNA, 11 bp, Homo sapiens
ccttttctcag

SEQ ID NO: 6117092 - DNA, 12 bp, Homo sapiens
ccttttctcagg

SEQ ID NO: 6117093 - DNA, 14 bp, Homo sapiens
ccttttctcccatt

SEQ ID NO: 6117094 - DNA, 15 bp, Homo sapiens
ccttttctccccacg

SEQ ID NO: 6117095 - DNA, 16 bp, Homo sapiens
ccttttctctcccata

SEQ ID NO: 6117096 - DNA, 18 bp, Homo sapiens
ccttttctctgctcttgt

SEQ ID NO: 6117097 - DNA, 13 bp, Homo sapiens
ccttttctcttca

SEQ ID NO: 6117098 - DNA, 22 bp, Homo sapiens
ccttttctgcattttgctattg

SEQ ID NO: 6117099 - DNA, 14 bp, Homo sapiens
ccttttctggctcc

SEQ ID NO: 6117100 - DNA, 14 bp, Homo sapiens
ccttttctgtggct

SEQ ID NO: 6117101 - DNA, 19 bp, Homo sapiens
ccttttctgtggctggctc

SEQ ID NO: 6117102 - DNA, 16 bp, Homo sapiens
ccttttctgtttagga

SEQ ID NO: 6117103 - DNA, 12 bp, Homo sapiens
ccttttcttaaa

SEQ ID NO: 6117104 - DNA, 11 bp, Homo sapiens
ccttttcttca

SEQ ID NO: 6117105 - DNA, 16 bp, Homo sapiens
ccttttcttcattttg

SEQ ID NO: 6117106 - DNA, 12 bp, Homo sapiens
ccttttcttcct

SEQ ID NO: 6117107 - DNA, 19 bp, Homo sapiens
ccttttcttccttctttct

SEQ ID NO: 6117108 - DNA, 16 bp, Homo sapiens
ccttttcttgtctctg

SEQ ID NO: 6117109 - DNA, 19 bp, Homo sapiens
ccttttcttgtctctgagg

SEQ ID NO: 6117110 - DNA, 12 bp, Homo sapiens
ccttttctttcc

SEQ ID NO: 6117111 - DNA, 16 bp, Homo sapiens
ccttttctttcctttt

SEQ ID NO: 6117112 - DNA, 13 bp, Homo sapiens
ccttttcttttgt

SEQ ID NO: 6117113 - DNA, 18 bp, Homo sapiens
ccttttcttttgttactg

SEQ ID NO: 6117114 - DNA, 20 bp, Homo sapiens
ccttttcttttgttactgtt

SEQ ID NO: 6117115 - DNA, 21 bp, Homo sapiens
ccttttcttttgttactgttc

SEQ ID NO: 6117116 - DNA, 20 bp, Homo sapiens
ccttttctttttcccttgaa

SEQ ID NO: 6117117 - DNA, 20 bp, Homo sapiens
ccttttgaatacatttgtat

SEQ ID NO: 6117118 - DNA, 15 bp, Homo sapiens
ccttttgacacagtt

SEQ ID NO: 6117119 - DNA, 18 bp, Homo sapiens
ccttttgacactgctcta

SEQ ID NO: 6117120 - DNA, 22 bp, Homo sapiens
ccttttgagggacaaatttaaa

SEQ ID NO: 6117121 - DNA, 15 bp, Homo sapiens
ccttttgagtgcctt

SEQ ID NO: 6117122 - DNA, 17 bp, Homo sapiens
ccttttgagtgccttac

SEQ ID NO: 6117123 - DNA, 18 bp, Homo sapiens
ccttttgataaaatgttc

SEQ ID NO: 6117124 - DNA, 21 bp, Homo sapiens
ccttttgataaaatgttcctt

SEQ ID NO: 6117125 - DNA, 19 bp, Homo sapiens
ccttttgatgttcagagtg

SEQ ID NO: 6117126 - DNA, 21 bp, Homo sapiens
ccttttgatgttcagagtggc

SEQ ID NO: 6117127 - DNA, 23 bp, Homo sapiens
ccttttgatgttcagagtggctc

SEQ ID NO: 6117128 - DNA, 11 bp, Homo sapiens
ccttttgcaaa

SEQ ID NO: 6117129 - DNA, 17 bp, Homo sapiens
ccttttgcaaacaattt

SEQ ID NO: 6117130 - DNA, 19 bp, Homo sapiens
ccttttgcacccctcccat

SEQ ID NO: 6117131 - DNA, 20 bp, Homo sapiens
ccttttgcacccctcccatt

SEQ ID NO: 6117132 - DNA, 19 bp, Homo sapiens
ccttttgcagaagagggtg

SEQ ID NO: 6117133 - DNA, 12 bp, Homo sapiens
ccttttgcagga

SEQ ID NO: 6117134 - DNA, 18 bp, Homo sapiens
ccttttgcataagattaa

SEQ ID NO: 6117135 - DNA, 14 bp, Homo sapiens
ccttttgcatcatt

SEQ ID NO: 6117136 - DNA, 12 bp, Homo sapiens
ccttttgccaat

SEQ ID NO: 6117137 - DNA, 13 bp, Homo sapiens
ccttttgcccccg

SEQ ID NO: 6117138 - DNA, 15 bp, Homo sapiens
ccttttgcctggctg

SEQ ID NO: 6117139 - DNA, 19 bp, Homo sapiens
ccttttgcggatgggaggg

SEQ ID NO: 6117140 - DNA, 23 bp, Homo sapiens
ccttttgctctgtcctccccacc

SEQ ID NO: 6117141 - DNA, 13 bp, Homo sapiens
ccttttgctgctg

SEQ ID NO: 6117142 - DNA, 15 bp, Homo sapiens
ccttttgctgctgct

SEQ ID NO: 6117143 - DNA, 15 bp, Homo sapiens
ccttttgctgtgtga

SEQ ID NO: 6117144 - DNA, 18 bp, Homo sapiens
ccttttggaacatttctt

SEQ ID NO: 6117145 - DNA, 20 bp, Homo sapiens
ccttttggcccccgagctgg

SEQ ID NO: 6117146 - DNA, 21 bp, Homo sapiens
ccttttggcccccgagctggg

SEQ ID NO: 6117147 - DNA, 18 bp, Homo sapiens
ccttttgggtttgcctta

SEQ ID NO: 6117148 - DNA, 15 bp, Homo sapiens
ccttttggtcttcag

SEQ ID NO: 6117149 - DNA, 19 bp, Homo sapiens
ccttttggtcttcagcctc

SEQ ID NO: 6117150 - DNA, 19 bp, Homo sapiens
ccttttgtagaatgaacca

SEQ ID NO: 6117151 - DNA, 23 bp, Homo sapiens
ccttttgtaggctgttccctttg

SEQ ID NO: 6117152 - DNA, 15 bp, Homo sapiens
ccttttgtataaagc

SEQ ID NO: 6117153 - DNA, 19 bp, Homo sapiens
ccttttgtatacatcctgg

SEQ ID NO: 6117154 - DNA, 21 bp, Homo sapiens
ccttttgtatcttcctttctt

SEQ ID NO: 6117155 - DNA, 14 bp, Homo sapiens
ccttttgtccccag

SEQ ID NO: 6117156 - DNA, 17 bp, Homo sapiens
ccttttgtccccagggc

SEQ ID NO: 6117157 - DNA, 20 bp, Homo sapiens
ccttttgtccccagggcccc

SEQ ID NO: 6117158 - DNA, 21 bp, Homo sapiens
ccttttgtccccagggcccct

SEQ ID NO: 6117159 - DNA, 21 bp, Homo sapiens
ccttttgtgtgatgcgccttg

SEQ ID NO: 6117160 - DNA, 18 bp, Homo sapiens
ccttttgttttgaagctg

SEQ ID NO: 6117161 - DNA, 14 bp, Homo sapiens
ccttttgtttttcc

SEQ ID NO: 6117162 - DNA, 17 bp, Homo sapiens
cctttttaaaacacatg

SEQ ID NO: 6117163 - DNA, 21 bp, Homo sapiens
cctttttaaatgagacttgtt

SEQ ID NO: 6117164 - DNA, 14 bp, Homo sapiens
cctttttaagtatt

SEQ ID NO: 6117165 - DNA, 23 bp, Homo sapiens
cctttttaataaaaatacacatg

SEQ ID NO: 6117166 - DNA, 19 bp, Homo sapiens
cctttttaatatgcttaaa

SEQ ID NO: 6117167 - DNA, 16 bp, Homo sapiens
cctttttacagccaac

SEQ ID NO: 6117168 - DNA, 22 bp, Homo sapiens
cctttttacctggcctagaaag

SEQ ID NO: 6117169 - DNA, 14 bp, Homo sapiens
cctttttactcccc

SEQ ID NO: 6117170 - DNA, 23 bp, Homo sapiens
cctttttactccccttgagctga

SEQ ID NO: 6117171 - DNA, 15 bp, Homo sapiens
cctttttagggcaga

SEQ ID NO: 6117172 - DNA, 13 bp, Homo sapiens
cctttttatttat

SEQ ID NO: 6117173 - DNA, 22 bp, Homo sapiens
cctttttatttttttgtacaga

SEQ ID NO: 6117174 - DNA, 19 bp, Homo sapiens
cctttttcaccctattttc

SEQ ID NO: 6117175 - DNA, 17 bp, Homo sapiens
cctttttcactttgaaa

SEQ ID NO: 6117176 - DNA, 19 bp, Homo sapiens
cctttttcataaattattt

SEQ ID NO: 6117177 - DNA, 20 bp, Homo sapiens
cctttttccaatgttttatt

SEQ ID NO: 6117178 - DNA, 13 bp, Homo sapiens
cctttttccatca

SEQ ID NO: 6117179 - DNA, 17 bp, Homo sapiens
cctttttcccaataaat

SEQ ID NO: 6117180 - DNA, 21 bp, Homo sapiens
cctttttccccaaagtcttaa

SEQ ID NO: 6117181 - DNA, 16 bp, Homo sapiens
cctttttcctctccac

SEQ ID NO: 6117182 - DNA, 22 bp, Homo sapiens
cctttttcctgcgtcccagcct

SEQ ID NO: 6117183 - DNA, 22 bp, Homo sapiens
cctttttccttatttcaagggt

SEQ ID NO: 6117184 - DNA, 13 bp, Homo sapiens
cctttttccttcc

SEQ ID NO: 6117185 - DNA, 17 bp, Homo sapiens
cctttttccttgtcccc

SEQ ID NO: 6117186 - DNA, 12 bp, Homo sapiens
cctttttctaaa

SEQ ID NO: 6117187 - DNA, 12 bp, Homo sapiens
cctttttctagt

SEQ ID NO: 6117188 - DNA, 16 bp, Homo sapiens
cctttttctccacact

SEQ ID NO: 6117189 - DNA, 16 bp, Homo sapiens
cctttttctccagctg

SEQ ID NO: 6117190 - DNA, 14 bp, Homo sapiens
cctttttctgagat

SEQ ID NO: 6117191 - DNA, 13 bp, Homo sapiens
cctttttctgatt

SEQ ID NO: 6117192 - DNA, 19 bp, Homo sapiens
cctttttctggccttgact

SEQ ID NO: 6117193 - DNA, 13 bp, Homo sapiens
cctttttctttcc

SEQ ID NO: 6117194 - DNA, 12 bp, Homo sapiens
cctttttgaagt

SEQ ID NO: 6117195 - DNA, 15 bp, Homo sapiens
cctttttgaattgtg

SEQ ID NO: 6117196 - DNA, 13 bp, Homo sapiens
cctttttgacact

SEQ ID NO: 6117197 - DNA, 14 bp, Homo sapiens
cctttttgacactg

SEQ ID NO: 6117198 - DNA, 20 bp, Homo sapiens
cctttttgcaggggactggg

SEQ ID NO: 6117199 - DNA, 16 bp, Homo sapiens
cctttttgcttatttt

SEQ ID NO: 6117200 - DNA, 19 bp, Homo sapiens
cctttttgcttattttaca

SEQ ID NO: 6117201 - DNA, 13 bp, Homo sapiens
cctttttgcttga

SEQ ID NO: 6117202 - DNA, 16 bp, Homo sapiens
cctttttggactagcc

SEQ ID NO: 6117203 - DNA, 18 bp, Homo sapiens
cctttttggcctgtgatg

SEQ ID NO: 6117204 - DNA, 21 bp, Homo sapiens
cctttttggtacttattactg

SEQ ID NO: 6117205 - DNA, 18 bp, Homo sapiens
cctttttgtaaatatgtg

SEQ ID NO: 6117206 - DNA, 12 bp, Homo sapiens
cctttttgtaac

SEQ ID NO: 6117207 - DNA, 14 bp, Homo sapiens
cctttttgtataaa

SEQ ID NO: 6117208 - DNA, 19 bp, Homo sapiens
cctttttgtataaaataga

SEQ ID NO: 6117209 - DNA, 17 bp, Homo sapiens
cctttttgtatgtgaac

SEQ ID NO: 6117210 - DNA, 18 bp, Homo sapiens
cctttttgtatgtgaaca

SEQ ID NO: 6117211 - DNA, 18 bp, Homo sapiens
cctttttgttgatgagga

SEQ ID NO: 6117212 - DNA, 17 bp, Homo sapiens
ccttttttaaaaatgca

SEQ ID NO: 6117213 - DNA, 20 bp, Homo sapiens
ctcaacctctctccttctgg

SEQ ID NO: 6117214 - DNA, 20 bp, Homo sapiens
ctcaacctgtaaattatttt

SEQ ID NO: 6117215 - DNA, 17 bp, Homo sapiens
ctcaaccttatcaagga

SEQ ID NO: 6117216 - DNA, 20 bp, Homo sapiens
ctcaaccttccaacttcctg

SEQ ID NO: 6117217 - DNA, 18 bp, Homo sapiens
ctcaaccttggccttctc

SEQ ID NO: 6117218 - DNA, 19 bp, Homo sapiens
ctcaaccttggccttctcc

SEQ ID NO: 6117219 - DNA, 23 bp, Homo sapiens
ctcaaccttggccttctcccctc

SEQ ID NO: 6117220 - DNA, 17 bp, Homo sapiens
ctcaacggtctggcagg

SEQ ID NO: 6117221 - DNA, 20 bp, Homo sapiens
ctcaactaaagaatagtgcc

SEQ ID NO: 6117222 - DNA, 23 bp, Homo sapiens
ctcaactaaagaatagtgcctca

SEQ ID NO: 6117223 - DNA, 17 bp, Homo sapiens
ctcaactcacctaatgt

SEQ ID NO: 6117224 - DNA, 14 bp, Homo sapiens
ctcaactccaggat

SEQ ID NO: 6117225 - DNA, 19 bp, Homo sapiens
ctcaactcgggggcgcctg

SEQ ID NO: 6117226 - DNA, 18 bp, Homo sapiens
ctcaactctcctccagag

SEQ ID NO: 6117227 - DNA, 13 bp, Homo sapiens
ctcaactctgagc

SEQ ID NO: 6117228 - DNA, 23 bp, Homo sapiens
ctcaactgaaggggtgcacccac

SEQ ID NO: 6117229 - DNA, 19 bp, Homo sapiens
ctcaactgagaagccaagc

SEQ ID NO: 6117230 - DNA, 20 bp, Homo sapiens
ctcaactgagaagccaagcc

SEQ ID NO: 6117231 - DNA, 15 bp, Homo sapiens
ctcaactgagggcca

SEQ ID NO: 6117232 - DNA, 13 bp, Homo sapiens
ctcaactgatgat

SEQ ID NO: 6117233 - DNA, 17 bp, Homo sapiens
ctcaactgggtccagaa

SEQ ID NO: 6117234 - DNA, 16 bp, Homo sapiens
ctcaactttctgttgg

SEQ ID NO: 6117235 - DNA, 15 bp, Homo sapiens
ctcaacttttttccc

SEQ ID NO: 6117236 - DNA, 21 bp, Homo sapiens
ctcaagaaataaaaggaagcc

SEQ ID NO: 6117237 - DNA, 23 bp, Homo sapiens
ctcaagaacatgatgggcctgaa

SEQ ID NO: 6117238 - DNA, 13 bp, Homo sapiens
ctcaagaagcagg

SEQ ID NO: 6117239 - DNA, 14 bp, Homo sapiens
ctcaagaagcaggc

SEQ ID NO: 6117240 - DNA, 23 bp, Homo sapiens
ctcaagaagcaggctacactgac

SEQ ID NO: 6117241 - DNA, 14 bp, Homo sapiens
ctcaagacaaggct

SEQ ID NO: 6117242 - DNA, 15 bp, Homo sapiens
ctcaagacaaggctg

SEQ ID NO: 6117243 - DNA, 21 bp, Homo sapiens
ctcaagaccaaatggaaacag

SEQ ID NO: 6117244 - DNA, 22 bp, Homo sapiens
ctcaagaccaggctgcagcctc

SEQ ID NO: 6117245 - DNA, 12 bp, Homo sapiens
ctcaagaccccc

SEQ ID NO: 6117246 - DNA, 21 bp, Homo sapiens
ctcaagacccccatttgtccc

SEQ ID NO: 6117247 - DNA, 23 bp, Homo sapiens
ctcaagacccccatttgtcccag

SEQ ID NO: 6117248 - DNA, 14 bp, Homo sapiens
ctcaagacctgagt

SEQ ID NO: 6117249 - DNA, 23 bp, Homo sapiens
ctcaagacggagatgcatggcct

SEQ ID NO: 6117250 - DNA, 16 bp, Homo sapiens
ctcaagacttccagag

SEQ ID NO: 6117251 - DNA, 17 bp, Homo sapiens
ctcaagagaaaatgtgt

SEQ ID NO: 6117252 - DNA, 15 bp, Homo sapiens
ctcaagagatcccaa

SEQ ID NO: 6117253 - DNA, 12 bp, Homo sapiens
ctcaagagccct

SEQ ID NO: 6117254 - DNA, 17 bp, Homo sapiens
ctcaagagcccttccag

SEQ ID NO: 6117255 - DNA, 17 bp, Homo sapiens
ctcaagaggaatctgtt

SEQ ID NO: 6117256 - DNA, 14 bp, Homo sapiens
ctcaagaggcccag

SEQ ID NO: 6117257 - DNA, 17 bp, Homo sapiens
ctcaagaggcccaggga

SEQ ID NO: 6117258 - DNA, 20 bp, Homo sapiens
ctcaagaggcccagggagca

SEQ ID NO: 6117259 - DNA, 16 bp, Homo sapiens
ctcaagaggctgaggc

SEQ ID NO: 6117260 - DNA, 21 bp, Homo sapiens
ctcaagagggcactggtggcc

SEQ ID NO: 6117261 - DNA, 18 bp, Homo sapiens
ctcaagatcaatgaaatg

SEQ ID NO: 6117262 - DNA, 15 bp, Homo sapiens
ctcaagatgggggca

SEQ ID NO: 6117263 - DNA, 16 bp, Homo sapiens
ctcaagattcccagga

SEQ ID NO: 6117264 - DNA, 21 bp, Homo sapiens
ctcaagcaaggaagcagagca

SEQ ID NO: 6117265 - DNA, 13 bp, Homo sapiens
ctcaagcaagttt

SEQ ID NO: 6117266 - DNA, 18 bp, Homo sapiens
ctcaagcaagtttaatca

SEQ ID NO: 6117267 - DNA, 19 bp, Homo sapiens
ctcaagcaatccacctgcc

SEQ ID NO: 6117268 - DNA, 16 bp, Homo sapiens
ctcaagcaatcctcct

SEQ ID NO: 6117269 - DNA, 17 bp, Homo sapiens
ctcaagcaatcctcctg

SEQ ID NO: 6117270 - DNA, 18 bp, Homo sapiens
ctcaagcaatcctcctga

SEQ ID NO: 6117271 - DNA, 20 bp, Homo sapiens
ctcaagcaatcctcctgagt

SEQ ID NO: 6117272 - DNA, 20 bp, Homo sapiens
ctcaagcaatcctcctgcct

SEQ ID NO: 6117273 - DNA, 22 bp, Homo sapiens
ctcaagcaatcctcctgcctca

SEQ ID NO: 6117274 - DNA, 16 bp, Homo sapiens
ctcaagcacttttcct

SEQ ID NO: 6117275 - DNA, 23 bp, Homo sapiens
ctcaagcagcgaccgccccctcc

SEQ ID NO: 6117276 - DNA, 16 bp, Homo sapiens
ctcaagcagttctccc

SEQ ID NO: 6117277 - DNA, 18 bp, Homo sapiens
ctcaagccaagcagccaa

SEQ ID NO: 6117278 - DNA, 12 bp, Homo sapiens
ctcaagccagcc

SEQ ID NO: 6117279 - DNA, 13 bp, Homo sapiens
ctcaagccagccc

SEQ ID NO: 6117280 - DNA, 16 bp, Homo sapiens
ctcaagccagccccct

SEQ ID NO: 6117281 - DNA, 23 bp, Homo sapiens
ctcaagccagccccctccagctc

SEQ ID NO: 6117282 - DNA, 12 bp, Homo sapiens
ctcaagccagga

SEQ ID NO: 6117283 - DNA, 14 bp, Homo sapiens
ctcaagccaggaga

SEQ ID NO: 6117284 - DNA, 15 bp, Homo sapiens
ctcaagccaggagac

SEQ ID NO: 6117285 - DNA, 22 bp, Homo sapiens
ctcaagccaggagaccctgtct

SEQ ID NO: 6117286 - DNA, 16 bp, Homo sapiens
ctcaagccccagcagc

SEQ ID NO: 6117287 - DNA, 18 bp, Homo sapiens
ctcaagccccagcagccc

SEQ ID NO: 6117288 - DNA, 17 bp, Homo sapiens
ctcaagccccatttcct

SEQ ID NO: 6117289 - DNA, 14 bp, Homo sapiens
ctcaagccccttct

SEQ ID NO: 6117290 - DNA, 19 bp, Homo sapiens
ctcaagccccttctctcaa

SEQ ID NO: 6117291 - DNA, 12 bp, Homo sapiens
ctcaagccctga

SEQ ID NO: 6117292 - DNA, 15 bp, Homo sapiens
ctcaagccctgaggg

SEQ ID NO: 6117293 - DNA, 13 bp, Homo sapiens
ctcaagccctgca

SEQ ID NO: 6117294 - DNA, 22 bp, Homo sapiens
ctcaagccctgcagtcacagct

SEQ ID NO: 6117295 - DNA, 19 bp, Homo sapiens
ctcaagcccttggggaggg

SEQ ID NO: 6117296 - DNA, 16 bp, Homo sapiens
ctcaagccgcaagctc

SEQ ID NO: 6117297 - DNA, 17 bp, Homo sapiens
ctcaagccgcaagctct

SEQ ID NO: 6117298 - DNA, 18 bp, Homo sapiens
ctcaagccgcaagctctc

SEQ ID NO: 6117299 - DNA, 15 bp, Homo sapiens
ctcaagcctgtgggc

SEQ ID NO: 6117300 - DNA, 17 bp, Homo sapiens
ctcaagcgattctcctg

SEQ ID NO: 6117301 - DNA, 20 bp, Homo sapiens
ctcaagcgggtggctctggg

SEQ ID NO: 6117302 - DNA, 18 bp, Homo sapiens
ctcaagctaagtaaaaat

SEQ ID NO: 6117303 - DNA, 17 bp, Homo sapiens
ctcaagctagccagagg

SEQ ID NO: 6117304 - DNA, 20 bp, Homo sapiens
ctcaagctagtgtttctagc

SEQ ID NO: 6117305 - DNA, 21 bp, Homo sapiens
ctcaagctatgatcagaagac

SEQ ID NO: 6117306 - DNA, 13 bp, Homo sapiens
ctcaagctttcct

SEQ ID NO: 6117307 - DNA, 22 bp, Homo sapiens
ctcaagctttcctgctgtcttc

SEQ ID NO: 6117308 - DNA, 14 bp, Homo sapiens
ctcaaggaaagggg

SEQ ID NO: 6117309 - DNA, 20 bp, Homo sapiens
ctcaaggaagagccagccgt

SEQ ID NO: 6117310 - DNA, 20 bp, Homo sapiens
ctcaaggacaaagtctccag

SEQ ID NO: 6117311 - DNA, 13 bp, Homo sapiens
ctcaaggacagga

SEQ ID NO: 6117312 - DNA, 18 bp, Homo sapiens
ctcaaggacttgaaagca

SEQ ID NO: 6117313 - DNA, 19 bp, Homo sapiens
ctcaaggacttgaaagcat

SEQ ID NO: 6117314 - DNA, 20 bp, Homo sapiens
ctcaaggacttgaaagcatc

SEQ ID NO: 6117315 - DNA, 22 bp, Homo sapiens
ctcaaggactttgcagccggca

SEQ ID NO: 6117316 - DNA, 19 bp, Homo sapiens
ctcaaggcaccgcagcctg

SEQ ID NO: 6117317 - DNA, 22 bp, Homo sapiens
ctcaaggcaccgcagcctgtca

SEQ ID NO: 6117318 - DNA, 22 bp, Homo sapiens
ctcaaggccaccttggaggagg

SEQ ID NO: 6117319 - DNA, 16 bp, Homo sapiens
ctcaaggcctcccaca

SEQ ID NO: 6117320 - DNA, 20 bp, Homo sapiens
ctcaaggcctcccacagtga

SEQ ID NO: 6117321 - DNA, 16 bp, Homo sapiens
ctcaaggctgtgcagg

SEQ ID NO: 6117322 - DNA, 14 bp, Homo sapiens
ctcaaggcttggag

SEQ ID NO: 6117323 - DNA, 15 bp, Homo sapiens
ctcaagggacaagga

SEQ ID NO: 6117324 - DNA, 14 bp, Homo sapiens
ctcaagggacaggg

SEQ ID NO: 6117325 - DNA, 22 bp, Homo sapiens
ctcaagggcagagaactgtctt

SEQ ID NO: 6117326 - DNA, 23 bp, Homo sapiens
ctcaagggcagagaactgtcttt

SEQ ID NO: 6117327 - DNA, 20 bp, Homo sapiens
ctcaaggggccatcctgtcc

SEQ ID NO: 6117328 - DNA, 14 bp, Homo sapiens
ctcaaggggctgga

SEQ ID NO: 6117329 - DNA, 15 bp, Homo sapiens
ctcaaggggctggaa

SEQ ID NO: 6117330 - DNA, 22 bp, Homo sapiens
ctcaagggtagggtctgcgtgt

SEQ ID NO: 6117331 - DNA, 15 bp, Homo sapiens
ctcaagggtccagaa

SEQ ID NO: 6117332 - DNA, 18 bp, Homo sapiens
ctcaagggttctttcctc

SEQ ID NO: 6117333 - DNA, 18 bp, Homo sapiens
ctcaagggttttccaggt

SEQ ID NO: 6117334 - DNA, 16 bp, Homo sapiens
ctcaaggtgagaatta

SEQ ID NO: 6117335 - DNA, 14 bp, Homo sapiens
ctcaaggttttagg

SEQ ID NO: 6117336 - DNA, 13 bp, Homo sapiens
ctcaagtaaaaca

SEQ ID NO: 6117337 - DNA, 22 bp, Homo sapiens
ctcaagtaaaacaaatgaaatt

SEQ ID NO: 6117338 - DNA, 13 bp, Homo sapiens
ctcaagtaaaaga

SEQ ID NO: 6117339 - DNA, 14 bp, Homo sapiens
ctcaagtaaaagaa

SEQ ID NO: 6117340 - DNA, 15 bp, Homo sapiens
ctcaagtaaaagaaa

SEQ ID NO: 6117341 - DNA, 14 bp, Homo sapiens
ctcaagtatataaa

SEQ ID NO: 6117342 - DNA, 19 bp, Homo sapiens
ctcaagtatcttctatttt

SEQ ID NO: 6117343 - DNA, 22 bp, Homo sapiens
ctcaagtccccgtctgcctggc

SEQ ID NO: 6117344 - DNA, 21 bp, Homo sapiens
ctcaagtcctcttttctgaga

SEQ ID NO: 6117345 - DNA, 14 bp, Homo sapiens
ctcaagtctaccct

SEQ ID NO: 6117346 - DNA, 15 bp, Homo sapiens
ctcaagtctggcaga

SEQ ID NO: 6117347 - DNA, 21 bp, Homo sapiens
ctcaagtctttctctttccct

SEQ ID NO: 6117348 - DNA, 19 bp, Homo sapiens
ctcaagtgatccacctgcc

SEQ ID NO: 6117349 - DNA, 17 bp, Homo sapiens
ctcaagtgatcctccca

SEQ ID NO: 6117350 - DNA, 18 bp, Homo sapiens
ctcaagtgatcctcccac

SEQ ID NO: 6117351 - DNA, 17 bp, Homo sapiens
ctcaagtgattctcctg

SEQ ID NO: 6117352 - DNA, 16 bp, Homo sapiens
ctcaagtgcaatgccc

SEQ ID NO: 6117353 - DNA, 20 bp, Homo sapiens
ctcaagtgcaatgccccctc

SEQ ID NO: 6117354 - DNA, 20 bp, Homo sapiens
ctcaagtgtagaagaaaata

SEQ ID NO: 6117355 - DNA, 21 bp, Homo sapiens
ctcaagtgtcacctccttccc

SEQ ID NO: 6117356 - DNA, 23 bp, Homo sapiens
ctcaagtgtcacctccttcccca

SEQ ID NO: 6117357 - DNA, 18 bp, Homo sapiens
ctcaagtgttaaattatt

SEQ ID NO: 6117358 - DNA, 15 bp, Homo sapiens
ctcaagtgttttgga

SEQ ID NO: 6117359 - DNA, 14 bp, Homo sapiens
ctcaagttcaagga

SEQ ID NO: 6117360 - DNA, 17 bp, Homo sapiens
ctcaagttcaaggacca

SEQ ID NO: 6117361 - DNA, 18 bp, Homo sapiens
ctcaagttcaaggaccaa

SEQ ID NO: 6117362 - DNA, 19 bp, Homo sapiens
ctcaagttcaaggaccaac

SEQ ID NO: 6117363 - DNA, 14 bp, Homo sapiens
ctcaagttcaccag

SEQ ID NO: 6117364 - DNA, 16 bp, Homo sapiens
ctcaagttccagtgca

SEQ ID NO: 6117365 - DNA, 15 bp, Homo sapiens
ctcaagttctaagat

SEQ ID NO: 6117366 - DNA, 19 bp, Homo sapiens
ctcaagttctaagattcta

SEQ ID NO: 6117367 - DNA, 14 bp, Homo sapiens
ctcaagttcttgga

SEQ ID NO: 6117368 - DNA, 17 bp, Homo sapiens
ctcaagttcttggacca

SEQ ID NO: 6117369 - DNA, 22 bp, Homo sapiens
ctcaagttgattagaaagacca

SEQ ID NO: 6117370 - DNA, 15 bp, Homo sapiens
ctcaagttgtgtgct

SEQ ID NO: 6117371 - DNA, 16 bp, Homo sapiens
ctcaagttgtttaact

SEQ ID NO: 6117372 - DNA, 21 bp, Homo sapiens
ctcaagttgtttaactgtgca

SEQ ID NO: 6117373 - DNA, 13 bp, Homo sapiens
ctcaagtttaaag

SEQ ID NO: 6117374 - DNA, 18 bp, Homo sapiens
ctcaagtttttcagaaag

SEQ ID NO: 6117375 - DNA, 19 bp, Homo sapiens
ctcaagtttttcagaaagc

SEQ ID NO: 6117376 - DNA, 17 bp, Homo sapiens
ctcaataaaagaatctg

SEQ ID NO: 6117377 - DNA, 23 bp, Homo sapiens
ctcaataaaatcatgtacatttc

SEQ ID NO: 6117378 - DNA, 15 bp, Homo sapiens
ctcaataaaattata

SEQ ID NO: 6117379 - DNA, 20 bp, Homo sapiens
ctcaataaaattatagctct

SEQ ID NO: 6117380 - DNA, 16 bp, Homo sapiens
ctcaataaacacttgt

SEQ ID NO: 6117381 - DNA, 17 bp, Homo sapiens
ctcaataaacatttcat

SEQ ID NO: 6117382 - DNA, 21 bp, Homo sapiens
ctcaataaactgaatttttct

SEQ ID NO: 6117383 - DNA, 12 bp, Homo sapiens
ctcaataaagct

SEQ ID NO: 6117384 - DNA, 15 bp, Homo sapiens
ctcaataaattgcaa

SEQ ID NO: 6117385 - DNA, 18 bp, Homo sapiens
ctcaataatggaactctt

SEQ ID NO: 6117386 - DNA, 14 bp, Homo sapiens
ctcaatactacctc

SEQ ID NO: 6117387 - DNA, 13 bp, Homo sapiens
ctcaatagctcca

SEQ ID NO: 6117388 - DNA, 23 bp, Homo sapiens
ctcaatagctccaagctgttaaa

SEQ ID NO: 6117389 - DNA, 15 bp, Homo sapiens
ctcaatatatagtta

SEQ ID NO: 6117390 - DNA, 16 bp, Homo sapiens
ctcaatatatagttag

SEQ ID NO: 6117391 - DNA, 14 bp, Homo sapiens
ccttttttaagatt

SEQ ID NO: 6117392 - DNA, 12 bp, Homo sapiens
ccttttttatac

SEQ ID NO: 6117393 - DNA, 17 bp, Homo sapiens
ccttttttatcatttct

SEQ ID NO: 6117394 - DNA, 18 bp, Homo sapiens
ccttttttatcatttcta

SEQ ID NO: 6117395 - DNA, 20 bp, Homo sapiens
ccttttttatgatgctattt

SEQ ID NO: 6117396 - DNA, 18 bp, Homo sapiens
ccttttttattgaataac

SEQ ID NO: 6117397 - DNA, 22 bp, Homo sapiens
ccttttttatttttttaagctg

SEQ ID NO: 6117398 - DNA, 17 bp, Homo sapiens
ccttttttcaatatgca

SEQ ID NO: 6117399 - DNA, 21 bp, Homo sapiens
ccttttttcccataagacaat

SEQ ID NO: 6117400 - DNA, 18 bp, Homo sapiens
ccttttttcctttccacc

SEQ ID NO: 6117401 - DNA, 18 bp, Homo sapiens
ccttttttctatatcaaa

SEQ ID NO: 6117402 - DNA, 20 bp, Homo sapiens
ccttttttctcttctgtcca

SEQ ID NO: 6117403 - DNA, 21 bp, Homo sapiens
ccttttttctcttctgtccat

SEQ ID NO: 6117404 - DNA, 20 bp, Homo sapiens
ccttttttctgcctccttta

SEQ ID NO: 6117405 - DNA, 13 bp, Homo sapiens
ccttttttcttcc

SEQ ID NO: 6117406 - DNA, 23 bp, Homo sapiens
ccttttttgagattttttttccg

SEQ ID NO: 6117407 - DNA, 18 bp, Homo sapiens
ccttttttggctgctgaa

SEQ ID NO: 6117408 - DNA, 16 bp, Homo sapiens
ccttttttgtctatga

SEQ ID NO: 6117409 - DNA, 19 bp, Homo sapiens
ccttttttgtcttattgaa

SEQ ID NO: 6117410 - DNA, 19 bp, Homo sapiens
cctttttttagtaaatcct

SEQ ID NO: 6117411 - DNA, 22 bp, Homo sapiens
ccttttttttacggaattccaa

SEQ ID NO: 6117412 - DNA, 15 bp, Homo sapiens
cctttttttttgaaa

SEQ ID NO: 6117413 - DNA, 16 bp, Homo sapiens
cctttttttttgaaac

SEQ ID NO: 6117414 - DNA, 16 bp, Homo sapiens
ccttttttttttttcc

SEQ ID NO: 6117415 - DNA, 17 bp, Homo sapiens
ccttttttttttttcca

SEQ ID NO: 6117416 - DNA, 20 bp, Homo sapiens
ccttttttttttttttaaga

SEQ ID NO: 6117417 - DNA, 21 bp, Homo sapiens
ccttttttttttttttcagtt

SEQ ID NO: 6117418 - DNA, 21 bp, Homo sapiens
cgaaaaatcctcttcctctga

SEQ ID NO: 6117419 - DNA, 10 bp, Homo sapiens
cgaaaaatgt

SEQ ID NO: 6117420 - DNA, 14 bp, Homo sapiens
cgaaaaatgtgtgg

SEQ ID NO: 6117421 - DNA, 15 bp, Homo sapiens
cgaaaacgtggctgc

SEQ ID NO: 6117422 - DNA, 18 bp, Homo sapiens
cgaaaacgtggctgcttc

SEQ ID NO: 6117423 - DNA, 18 bp, Homo sapiens
cgaaaacgttgacccctt

SEQ ID NO: 6117424 - DNA, 21 bp, Homo sapiens
cgaaaacgttgacccctttcc

SEQ ID NO: 6117425 - DNA, 19 bp, Homo sapiens
cgaaaatgtattattgtaa

SEQ ID NO: 6117426 - DNA, 23 bp, Homo sapiens
cgaaacacaaaccacaactgaca

SEQ ID NO: 6117427 - DNA, 16 bp, Homo sapiens
cgaaacacagaactca

SEQ ID NO: 6117428 - DNA, 15 bp, Homo sapiens
cgaaacaccccgctc

SEQ ID NO: 6117429 - DNA, 22 bp, Homo sapiens
cgaaacaggctactctcctcgg

SEQ ID NO: 6117430 - DNA, 21 bp, Homo sapiens
cgaaaccagttaagaatggaa

SEQ ID NO: 6117431 - DNA, 18 bp, Homo sapiens
cgaaacccttgactgtta

SEQ ID NO: 6117432 - DNA, 22 bp, Homo sapiens
cgaaactccatctcaaaacaaa

SEQ ID NO: 6117433 - DNA, 23 bp, Homo sapiens
cgaaactccatctcaaaacaaaa

SEQ ID NO: 6117434 - DNA, 16 bp, Homo sapiens
cgaaactggaagttat

SEQ ID NO: 6117435 - DNA, 18 bp, Homo sapiens
cgaaactggaagttattt

SEQ ID NO: 6117436 - DNA, 12 bp, Homo sapiens
cgaaagaaggca

SEQ ID NO: 6117437 - DNA, 19 bp, Homo sapiens
cgaaagaaggcatggactt

SEQ ID NO: 6117438 - DNA, 20 bp, Homo sapiens
cgaaagaggcacccttccat

SEQ ID NO: 6117439 - DNA, 23 bp, Homo sapiens
cgaaagaggcacccttccatctg

SEQ ID NO: 6117440 - DNA, 15 bp, Homo sapiens
cgaaagcatcactgc

SEQ ID NO: 6117441 - DNA, 17 bp, Homo sapiens
cgaaagcatcactgcct

SEQ ID NO: 6117442 - DNA, 16 bp, Homo sapiens
cgaaaggatgagcaga

SEQ ID NO: 6117443 - DNA, 18 bp, Homo sapiens
cgaaaggatgagcagagc

SEQ ID NO: 6117444 - DNA, 23 bp, Homo sapiens
cgaaaggatgtaaacagtgcctg

SEQ ID NO: 6117445 - DNA, 11 bp, Homo sapiens
cgaaaggcctt

SEQ ID NO: 6117446 - DNA, 21 bp, Homo sapiens
cgaaaggccttcagacacatg

SEQ ID NO: 6117447 - DNA, 19 bp, Homo sapiens
cgaaagggacttggaagct

SEQ ID NO: 6117448 - DNA, 23 bp, Homo sapiens
cgaaagggacttggaagctccgc

SEQ ID NO: 6117449 - DNA, 13 bp, Homo sapiens
cgaaaggtgcagc

SEQ ID NO: 6117450 - DNA, 19 bp, Homo sapiens
cgaaaggtgcagctgcgtt

SEQ ID NO: 6117451 - DNA, 12 bp, Homo sapiens
cgaaagtttctt

SEQ ID NO: 6117452 - DNA, 22 bp, Homo sapiens
cgaaataaaaatggcaaatgca

SEQ ID NO: 6117453 - DNA, 17 bp, Homo sapiens
cgaaataacaatgttaa

SEQ ID NO: 6117454 - DNA, 20 bp, Homo sapiens
cgaaataacaatgttaagga

SEQ ID NO: 6117455 - DNA, 18 bp, Homo sapiens
cgaaatagatatcctctc

SEQ ID NO: 6117456 - DNA, 15 bp, Homo sapiens
cgaaatatcaaagtc

SEQ ID NO: 6117457 - DNA, 15 bp, Homo sapiens
cgaaatccctgctca

SEQ ID NO: 6117458 - DNA, 22 bp, Homo sapiens
cgaaatccctgctcactgcagc

SEQ ID NO: 6117459 - DNA, 20 bp, Homo sapiens
cgaaatctgtattctgtttg

SEQ ID NO: 6117460 - DNA, 13 bp, Homo sapiens
cgaaatgaaaatg

SEQ ID NO: 6117461 - DNA, 19 bp, Homo sapiens
cgaaatgccacgtggtcac

SEQ ID NO: 6117462 - DNA, 22 bp, Homo sapiens
cgaaatggaaacacacacagac

SEQ ID NO: 6117463 - DNA, 14 bp, Homo sapiens
cgaaatgttatttt

SEQ ID NO: 6117464 - DNA, 20 bp, Homo sapiens
cgaaatgttctcatgaacta

SEQ ID NO: 6117465 - DNA, 23 bp, Homo sapiens
cgaacacgcatgcctcagccagc

SEQ ID NO: 6117466 - DNA, 19 bp, Homo sapiens
cgaacagccttagagctct

SEQ ID NO: 6117467 - DNA, 15 bp, Homo sapiens
cgaacagtccaatca

SEQ ID NO: 6117468 - DNA, 20 bp, Homo sapiens
cgaacatatcatttgtgaag

SEQ ID NO: 6117469 - DNA, 14 bp, Homo sapiens
cgaacatcttcata

SEQ ID NO: 6117470 - DNA, 16 bp, Homo sapiens
cgaacatcttcatata

SEQ ID NO: 6117471 - DNA, 20 bp, Homo sapiens
cgaacatgcctgattttaaa

SEQ ID NO: 6117472 - DNA, 22 bp, Homo sapiens
cgaacatggaactcattcctgc

SEQ ID NO: 6117473 - DNA, 12 bp, Homo sapiens
cgaacatgtgtt

SEQ ID NO: 6117474 - DNA, 16 bp, Homo sapiens
cgaaccacccaaaaca

SEQ ID NO: 6117475 - DNA, 12 bp, Homo sapiens
cgaaccaggagc

SEQ ID NO: 6117476 - DNA, 23 bp, Homo sapiens
cgaacccacctgctgagagaccc

SEQ ID NO: 6117477 - DNA, 11 bp, Homo sapiens
cgaacccactc

SEQ ID NO: 6117478 - DNA, 15 bp, Homo sapiens
cgaaccccccactcc

SEQ ID NO: 6117479 - DNA, 23 bp, Homo sapiens
cgaaccgtgagcaggaaggcctg

SEQ ID NO: 6117480 - DNA, 17 bp, Homo sapiens
cgaaccgtgaggagggg

SEQ ID NO: 6117481 - DNA, 16 bp, Homo sapiens
cgaacctcctctgtga

SEQ ID NO: 6117482 - DNA, 16 bp, Homo sapiens
cgaacctcggggtggg

SEQ ID NO: 6117483 - DNA, 17 bp, Homo sapiens
cgaaccttggcctgggc

SEQ ID NO: 6117484 - DNA, 22 bp, Homo sapiens
cgaacgtatttctccagaccca

SEQ ID NO: 6117485 - DNA, 19 bp, Homo sapiens
cgaactcaagggttttcca

SEQ ID NO: 6117486 - DNA, 16 bp, Homo sapiens
cgaactccaggctggg

SEQ ID NO: 6117487 - DNA, 17 bp, Homo sapiens
cgaactccaggctgggc

SEQ ID NO: 6117488 - DNA, 18 bp, Homo sapiens
cgaactccaggctgggct

SEQ ID NO: 6117489 - DNA, 22 bp, Homo sapiens
cgaactcctgacctcaagtgat

SEQ ID NO: 6117490 - DNA, 15 bp, Homo sapiens
cgaactcctggcctc

SEQ ID NO: 6117491 - DNA, 16 bp, Homo sapiens
cgaactcctggcctca

SEQ ID NO: 6117492 - DNA, 12 bp, Homo sapiens
cgaactcctggg

SEQ ID NO: 6117493 - DNA, 13 bp, Homo sapiens
cgaactggcgcct

SEQ ID NO: 6117494 - DNA, 21 bp, Homo sapiens
cgaactggttgtagtgggaag

SEQ ID NO: 6117495 - DNA, 21 bp, Homo sapiens
cgaactgttcaagtgtcccca

SEQ ID NO: 6117496 - DNA, 16 bp, Homo sapiens
cgaactgttgtataaa

SEQ ID NO: 6117497 - DNA, 14 bp, Homo sapiens
cgaacttcacaact

SEQ ID NO: 6117498 - DNA, 23 bp, Homo sapiens
cgaagaaaagatatgtattctaa

SEQ ID NO: 6117499 - DNA, 15 bp, Homo sapiens
cgaagaagagccaca

SEQ ID NO: 6117500 - DNA, 16 bp, Homo sapiens
cgaagaagagccacag

SEQ ID NO: 6117501 - DNA, 18 bp, Homo sapiens
cgaagaagagccacagtg

SEQ ID NO: 6117502 - DNA, 14 bp, Homo sapiens
cgaagaagatgctc

SEQ ID NO: 6117503 - DNA, 19 bp, Homo sapiens
cgaagaaggaccagtgaag

SEQ ID NO: 6117504 - DNA, 17 bp, Homo sapiens
cgaagaatggagaggaa

SEQ ID NO: 6117505 - DNA, 14 bp, Homo sapiens
cgaagagcaggcca

SEQ ID NO: 6117506 - DNA, 16 bp, Homo sapiens
cgaagagccctgagct

SEQ ID NO: 6117507 - DNA, 22 bp, Homo sapiens
cgaagaggggtggtggggggca

SEQ ID NO: 6117508 - DNA, 21 bp, Homo sapiens
cgaagagtatttttgacagaa

SEQ ID NO: 6117509 - DNA, 15 bp, Homo sapiens
cgaagagtcagcccc

SEQ ID NO: 6117510 - DNA, 13 bp, Homo sapiens
cgaagcaagaaga

SEQ ID NO: 6117511 - DNA, 15 bp, Homo sapiens
cgaagcaagaagaat

SEQ ID NO: 6117512 - DNA, 19 bp, Homo sapiens
cgaagcaatactgtccagt

SEQ ID NO: 6117513 - DNA, 22 bp, Homo sapiens
cgaagcaatcagcaaacacaat

SEQ ID NO: 6117514 - DNA, 13 bp, Homo sapiens
cgaagcagagagg

SEQ ID NO: 6117515 - DNA, 13 bp, Homo sapiens
cgaagccacaggc

SEQ ID NO: 6117516 - DNA, 22 bp, Homo sapiens
cgaagccatcacttctccccgc

SEQ ID NO: 6117517 - DNA, 20 bp, Homo sapiens
cgaagccatctttctttgga

SEQ ID NO: 6117518 - DNA, 20 bp, Homo sapiens
cgaagccccttggagagaga

SEQ ID NO: 6117519 - DNA, 15 bp, Homo sapiens
cgaagcccttccagt

SEQ ID NO: 6117520 - DNA, 18 bp, Homo sapiens
cgaagcccttccagtggt

SEQ ID NO: 6117521 - DNA, 19 bp, Homo sapiens
cgaagcccttccagtggta

SEQ ID NO: 6117522 - DNA, 22 bp, Homo sapiens
cgaagcccttccagtggtacca

SEQ ID NO: 6117523 - DNA, 22 bp, Homo sapiens
cgaagccggacacggcttcact

SEQ ID NO: 6117524 - DNA, 16 bp, Homo sapiens
cgaagcctagaagcac

SEQ ID NO: 6117525 - DNA, 12 bp, Homo sapiens
cgaagcctgagc

SEQ ID NO: 6117526 - DNA, 17 bp, Homo sapiens
cgaagcggagagagcca

SEQ ID NO: 6117527 - DNA, 15 bp, Homo sapiens
cgaagcgttgtcctc

SEQ ID NO: 6117528 - DNA, 13 bp, Homo sapiens
cgaagctcagccc

SEQ ID NO: 6117529 - DNA, 15 bp, Homo sapiens
cgaagctctggctga

SEQ ID NO: 6117530 - DNA, 21 bp, Homo sapiens
cgaagctcttgtgaactgtct

SEQ ID NO: 6117531 - DNA, 22 bp, Homo sapiens
cgaagctgataaccgtccttca

SEQ ID NO: 6117532 - DNA, 20 bp, Homo sapiens
cgaagctgcaggggcaggag

SEQ ID NO: 6117533 - DNA, 21 bp, Homo sapiens
cgaagctgcgggggcaggccg

SEQ ID NO: 6117534 - DNA, 16 bp, Homo sapiens
cgaagctgctgtgact

SEQ ID NO: 6117535 - DNA, 22 bp, Homo sapiens
cgaagctgctgtgactgtgtcc

SEQ ID NO: 6117536 - DNA, 18 bp, Homo sapiens
cgaaggatgctctttccc

SEQ ID NO: 6117537 - DNA, 15 bp, Homo sapiens
cgaagggattgtgta

SEQ ID NO: 6117538 - DNA, 13 bp, Homo sapiens
cgaagggcagccc

SEQ ID NO: 6117539 - DNA, 22 bp, Homo sapiens
cgaaggggaggcacactttctg

SEQ ID NO: 6117540 - DNA, 21 bp, Homo sapiens
cgaaggggccccggggctggc

SEQ ID NO: 6117541 - DNA, 22 bp, Homo sapiens
cgaaggggccccggggctggca

SEQ ID NO: 6117542 - DNA, 13 bp, Homo sapiens
cgaaggggccctg

SEQ ID NO: 6117543 - DNA, 16 bp, Homo sapiens
cgaaggtcccacagcc

SEQ ID NO: 6117544 - DNA, 16 bp, Homo sapiens
cgaaggtctctctggc

SEQ ID NO: 6117545 - DNA, 13 bp, Homo sapiens
cgaaggtgctgga

SEQ ID NO: 6117546 - DNA, 15 bp, Homo sapiens
cgaagtagcttgctc

SEQ ID NO: 6117547 - DNA, 15 bp, Homo sapiens
cgaagtccagctttc

SEQ ID NO: 6117548 - DNA, 14 bp, Homo sapiens
cgaagtcccggctt

SEQ ID NO: 6117549 - DNA, 15 bp, Homo sapiens
cgaagtccgaggcct

SEQ ID NO: 6117550 - DNA, 17 bp, Homo sapiens
cgaagtctgatccctgc

SEQ ID NO: 6117551 - DNA, 16 bp, Homo sapiens
cgaagtcttccatcag

SEQ ID NO: 6117552 - DNA, 22 bp, Homo sapiens
cgaagtcttccatcagcagtga

SEQ ID NO: 6117553 - DNA, 17 bp, Homo sapiens
cgaagtctttgccttct

SEQ ID NO: 6117554 - DNA, 19 bp, Homo sapiens
cgaagtggactggcccctg

SEQ ID NO: 6117555 - DNA, 17 bp, Homo sapiens
cgaagttcaagatcaaa

SEQ ID NO: 6117556 - DNA, 14 bp, Homo sapiens
cgaagttgatgcaa

SEQ ID NO: 6117557 - DNA, 13 bp, Homo sapiens
cgaagtttgcaac

SEQ ID NO: 6117558 - DNA, 17 bp, Homo sapiens
cgaagtttgcaaccttt

SEQ ID NO: 6117559 - DNA, 21 bp, Homo sapiens
cgaataaaatctgctgcacct

SEQ ID NO: 6117560 - DNA, 14 bp, Homo sapiens
cgaataaatgttca

SEQ ID NO: 6117561 - DNA, 15 bp, Homo sapiens
cgaataaatgttcaa

SEQ ID NO: 6117562 - DNA, 14 bp, Homo sapiens
cgaatacaaaattg

SEQ ID NO: 6117563 - DNA, 17 bp, Homo sapiens
cgaatactttgaatgtt

SEQ ID NO: 6117564 - DNA, 19 bp, Homo sapiens
cgaatacttttgccctttg

SEQ ID NO: 6117565 - DNA, 14 bp, Homo sapiens
cgaatagacatcaa

SEQ ID NO: 6117566 - DNA, 15 bp, Homo sapiens
cgaatagacatcaaa

SEQ ID NO: 6117567 - DNA, 13 bp, Homo sapiens
cgaatagctggga

SEQ ID NO: 6117568 - DNA, 16 bp, Homo sapiens
cgaatatagttctgtg

SEQ ID NO: 6117569 - DNA, 11 bp, Homo sapiens
ctcaatatttt

SEQ ID NO: 6117570 - DNA, 19 bp, Homo sapiens
ctcaatattttccatgaaa

SEQ ID NO: 6117571 - DNA, 23 bp, Homo sapiens
ctcaatcactgctcccccgtgtg

SEQ ID NO: 6117572 - DNA, 15 bp, Homo sapiens
ctcaatcagtgcagt

SEQ ID NO: 6117573 - DNA, 16 bp, Homo sapiens
ctcaatcagtgcagtg

SEQ ID NO: 6117574 - DNA, 19 bp, Homo sapiens
ctcaatcattgtcagagat

SEQ ID NO: 6117575 - DNA, 14 bp, Homo sapiens
ctcaatccatgttc

SEQ ID NO: 6117576 - DNA, 18 bp, Homo sapiens
ctcaatcccagctactca

SEQ ID NO: 6117577 - DNA, 15 bp, Homo sapiens
ctcaatccctgagga

SEQ ID NO: 6117578 - DNA, 19 bp, Homo sapiens
ctcaatcctaatttctcct

SEQ ID NO: 6117579 - DNA, 22 bp, Homo sapiens
ctcaatcctaatttctcctccc

SEQ ID NO: 6117580 - DNA, 17 bp, Homo sapiens
ctcaatcctgcagtggg

SEQ ID NO: 6117581 - DNA, 18 bp, Homo sapiens
ctcaatctaaattaaaaa

SEQ ID NO: 6117582 - DNA, 16 bp, Homo sapiens
ctcaatctccagggct

SEQ ID NO: 6117583 - DNA, 20 bp, Homo sapiens
ctcaatctctgttgcacctg

SEQ ID NO: 6117584 - DNA, 15 bp, Homo sapiens
ctcaatcttttacct

SEQ ID NO: 6117585 - DNA, 13 bp, Homo sapiens
ctcaatgaaaaat

SEQ ID NO: 6117586 - DNA, 22 bp, Homo sapiens
ctcaatgaaaaatagtgtcttt

SEQ ID NO: 6117587 - DNA, 21 bp, Homo sapiens
ctcaatgagcatgtttagact

SEQ ID NO: 6117588 - DNA, 16 bp, Homo sapiens
ctcaatgatagcacct

SEQ ID NO: 6117589 - DNA, 16 bp, Homo sapiens
ctcaatgcagccagac

SEQ ID NO: 6117590 - DNA, 15 bp, Homo sapiens
ctcaatgcatgatga

SEQ ID NO: 6117591 - DNA, 20 bp, Homo sapiens
ctcaatgcatgatgactctt

SEQ ID NO: 6117592 - DNA, 23 bp, Homo sapiens
ctcaatgcatgatgactcttctt

SEQ ID NO: 6117593 - DNA, 20 bp, Homo sapiens
ctcaatgcattgtcttgtgg

SEQ ID NO: 6117594 - DNA, 15 bp, Homo sapiens
ctcaatgcctggaga

SEQ ID NO: 6117595 - DNA, 12 bp, Homo sapiens
ctcaatgctcat

SEQ ID NO: 6117596 - DNA, 13 bp, Homo sapiens
ctcaatgctcata

SEQ ID NO: 6117597 - DNA, 15 bp, Homo sapiens
ctcaatgctcataac

SEQ ID NO: 6117598 - DNA, 16 bp, Homo sapiens
ctcaatgcttaggaga

SEQ ID NO: 6117599 - DNA, 15 bp, Homo sapiens
ctcaatgctttattt

SEQ ID NO: 6117600 - DNA, 17 bp, Homo sapiens
ctcaatgctttatttgt

SEQ ID NO: 6117601 - DNA, 19 bp, Homo sapiens
ctcaatggaaacatcactg

SEQ ID NO: 6117602 - DNA, 14 bp, Homo sapiens
ctcaatggactgga

SEQ ID NO: 6117603 - DNA, 20 bp, Homo sapiens
ctcaatggactggaagggga

SEQ ID NO: 6117604 - DNA, 23 bp, Homo sapiens
ctcaatggcctaaaactggcctg

SEQ ID NO: 6117605 - DNA, 20 bp, Homo sapiens
ctcaatgggagaatcagcag

SEQ ID NO: 6117606 - DNA, 21 bp, Homo sapiens
ctcaatggggaattttttgat

SEQ ID NO: 6117607 - DNA, 16 bp, Homo sapiens
ctcaatgggggggcgg

SEQ ID NO: 6117608 - DNA, 17 bp, Homo sapiens
ctcaatgggggggcggc

SEQ ID NO: 6117609 - DNA, 16 bp, Homo sapiens
ctcaatggtgctataa

SEQ ID NO: 6117610 - DNA, 14 bp, Homo sapiens
ctcaatgtgaccag

SEQ ID NO: 6117611 - DNA, 21 bp, Homo sapiens
ctcaatgtgcaagttgtactg

SEQ ID NO: 6117612 - DNA, 13 bp, Homo sapiens
ctcaatgtgctgt

SEQ ID NO: 6117613 - DNA, 15 bp, Homo sapiens
ctcaatgtgctgttg

SEQ ID NO: 6117614 - DNA, 17 bp, Homo sapiens
ctcaatgtttctggaca

SEQ ID NO: 6117615 - DNA, 14 bp, Homo sapiens
ctcaattatttgca

SEQ ID NO: 6117616 - DNA, 23 bp, Homo sapiens
ctcaattattttgcattttttct

SEQ ID NO: 6117617 - DNA, 17 bp, Homo sapiens
ctcaattcaacaatgtg

SEQ ID NO: 6117618 - DNA, 12 bp, Homo sapiens
ctcaattctgtc

SEQ ID NO: 6117619 - DNA, 18 bp, Homo sapiens
ctcaattctgtttttcgt

SEQ ID NO: 6117620 - DNA, 19 bp, Homo sapiens
ctcaattcttccctatctt

SEQ ID NO: 6117621 - DNA, 16 bp, Homo sapiens
ctcaattgctttgtaa

SEQ ID NO: 6117622 - DNA, 18 bp, Homo sapiens
ctcaattgttcttttcct

SEQ ID NO: 6117623 - DNA, 13 bp, Homo sapiens
ctcaattgttttt

SEQ ID NO: 6117624 - DNA, 15 bp, Homo sapiens
ctcaattgtttttgt

SEQ ID NO: 6117625 - DNA, 14 bp, Homo sapiens
ctcaatttcagcac

SEQ ID NO: 6117626 - DNA, 12 bp, Homo sapiens
ctcaatttcatt

SEQ ID NO: 6117627 - DNA, 13 bp, Homo sapiens
ctcaatttctccc

SEQ ID NO: 6117628 - DNA, 14 bp, Homo sapiens
ctcaatttgaaaca

SEQ ID NO: 6117629 - DNA, 16 bp, Homo sapiens
ctcaatttggtgctca

SEQ ID NO: 6117630 - DNA, 23 bp, Homo sapiens
ctcaattttatccctcacctgta

SEQ ID NO: 6117631 - DNA, 23 bp, Homo sapiens
ctcaattttatgtattctttctg

SEQ ID NO: 6117632 - DNA, 15 bp, Homo sapiens
ctcaattttcactgt

SEQ ID NO: 6117633 - DNA, 22 bp, Homo sapiens
ctcaatttttgtttttgagtac

SEQ ID NO: 6117634 - DNA, 19 bp, Homo sapiens
ctcaattttttcaaatgaa

SEQ ID NO: 6117635 - DNA, 21 bp, Homo sapiens
ctcacaaaaaggcaaatattg

SEQ ID NO: 6117636 - DNA, 13 bp, Homo sapiens
ctcacaaaaggct

SEQ ID NO: 6117637 - DNA, 23 bp, Homo sapiens
ctcacaaaaggctggatgtgctt

SEQ ID NO: 6117638 - DNA, 18 bp, Homo sapiens
ctcacaaatgaaacctga

SEQ ID NO: 6117639 - DNA, 15 bp, Homo sapiens
ctcacaaatgctgtg

SEQ ID NO: 6117640 - DNA, 16 bp, Homo sapiens
ctcacaacctgaacct

SEQ ID NO: 6117641 - DNA, 19 bp, Homo sapiens
ctcacaactccttccatcc

SEQ ID NO: 6117642 - DNA, 13 bp, Homo sapiens
ctcacaactgttt

SEQ ID NO: 6117643 - DNA, 15 bp, Homo sapiens
ctcacaagaagacca

SEQ ID NO: 6117644 - DNA, 19 bp, Homo sapiens
ctcacaagaagaccagact

SEQ ID NO: 6117645 - DNA, 21 bp, Homo sapiens
ctcacaagccgtgttttatga

SEQ ID NO: 6117646 - DNA, 20 bp, Homo sapiens
ctcacaagcgctcccagcct

SEQ ID NO: 6117647 - DNA, 17 bp, Homo sapiens
ctcacaaggcagcaagg

SEQ ID NO: 6117648 - DNA, 15 bp, Homo sapiens
ctcacaaggcccagg

SEQ ID NO: 6117649 - DNA, 17 bp, Homo sapiens
ctcacaaggcccaggag

SEQ ID NO: 6117650 - DNA, 17 bp, Homo sapiens
ctcacaatccttgccac

SEQ ID NO: 6117651 - DNA, 15 bp, Homo sapiens
ctcacaatgaggcta

SEQ ID NO: 6117652 - DNA, 18 bp, Homo sapiens
ctcacacacacagctggg

SEQ ID NO: 6117653 - DNA, 21 bp, Homo sapiens
ctcacacacacagctgggcaa

SEQ ID NO: 6117654 - DNA, 17 bp, Homo sapiens
ctcacacacctctgccc

SEQ ID NO: 6117655 - DNA, 19 bp, Homo sapiens
ctcacacacctctgcccct

SEQ ID NO: 6117656 - DNA, 18 bp, Homo sapiens
ctcacacacggaggccag

SEQ ID NO: 6117657 - DNA, 13 bp, Homo sapiens
ctcacacagctgg

SEQ ID NO: 6117658 - DNA, 12 bp, Homo sapiens
ctcacacaggca

SEQ ID NO: 6117659 - DNA, 13 bp, Homo sapiens
ctcacacaggcat

SEQ ID NO: 6117660 - DNA, 21 bp, Homo sapiens
ctcacacaggcatttcctggg

SEQ ID NO: 6117661 - DNA, 17 bp, Homo sapiens
ctcacacatcacattcc

SEQ ID NO: 6117662 - DNA, 19 bp, Homo sapiens
ctcacacatccccagccag

SEQ ID NO: 6117663 - DNA, 17 bp, Homo sapiens
ctcacacatcctgtcag

SEQ ID NO: 6117664 - DNA, 24 bp, Homo sapiens
ctcacacatgagcatcaggccagg

SEQ ID NO: 6117665 - DNA, 14 bp, Homo sapiens
ctcacaccagccct

SEQ ID NO: 6117666 - DNA, 23 bp, Homo sapiens
ctcacaccaggcttgcctgcagg

SEQ ID NO: 6117667 - DNA, 14 bp, Homo sapiens
ctcacacccacctg

SEQ ID NO: 6117668 - DNA, 18 bp, Homo sapiens
ctcacacccacctgctgc

SEQ ID NO: 6117669 - DNA, 19 bp, Homo sapiens
ctcacacccacctgctgct

SEQ ID NO: 6117670 - DNA, 20 bp, Homo sapiens
ctcacacccacctgctgctg

SEQ ID NO: 6117671 - DNA, 14 bp, Homo sapiens
ctcacacccagagg

SEQ ID NO: 6117672 - DNA, 18 bp, Homo sapiens
ctcacaccctaccttccc

SEQ ID NO: 6117673 - DNA, 12 bp, Homo sapiens
ctcacaccctgg

SEQ ID NO: 6117674 - DNA, 19 bp, Homo sapiens
ctcacaccgcgtctggtga

SEQ ID NO: 6117675 - DNA, 22 bp, Homo sapiens
ctcacaccggcactgtgcactc

SEQ ID NO: 6117676 - DNA, 22 bp, Homo sapiens
ctcacaccgttcgtacgcccag

SEQ ID NO: 6117677 - DNA, 17 bp, Homo sapiens
ctcacacctcccttcat

SEQ ID NO: 6117678 - DNA, 20 bp, Homo sapiens
ctcacacctcccttcatccc

SEQ ID NO: 6117679 - DNA, 15 bp, Homo sapiens
ctcacacctgaactg

SEQ ID NO: 6117680 - DNA, 22 bp, Homo sapiens
ctcacacctgcaatcccagcac

SEQ ID NO: 6117681 - DNA, 19 bp, Homo sapiens
ctcacacctgtccttctca

SEQ ID NO: 6117682 - DNA, 19 bp, Homo sapiens
ctcacactactgtatttca

SEQ ID NO: 6117683 - DNA, 22 bp, Homo sapiens
ctcacactacttgagaaaatgc

SEQ ID NO: 6117684 - DNA, 23 bp, Homo sapiens
ctcacactcatccacacttaagc

SEQ ID NO: 6117685 - DNA, 12 bp, Homo sapiens
ctcacactcctc

SEQ ID NO: 6117686 - DNA, 14 bp, Homo sapiens
ctcacactcctcct

SEQ ID NO: 6117687 - DNA, 15 bp, Homo sapiens
ctcacactcctcctg

SEQ ID NO: 6117688 - DNA, 17 bp, Homo sapiens
ctcacactcctcctgcc

SEQ ID NO: 6117689 - DNA, 14 bp, Homo sapiens
ctcacactcctggg

SEQ ID NO: 6117690 - DNA, 21 bp, Homo sapiens
ctcacactcctgggctctgaa

SEQ ID NO: 6117691 - DNA, 15 bp, Homo sapiens
ctcacactctctgca

SEQ ID NO: 6117692 - DNA, 19 bp, Homo sapiens
ctcacactctctgcagccc

SEQ ID NO: 6117693 - DNA, 21 bp, Homo sapiens
ctcacactctctgcagcccag

SEQ ID NO: 6117694 - DNA, 22 bp, Homo sapiens
ctcacactctctgcagcccagc

SEQ ID NO: 6117695 - DNA, 23 bp, Homo sapiens
ctcacactgatgggctggggcag

SEQ ID NO: 6117696 - DNA, 14 bp, Homo sapiens
ctcacactgcacca

SEQ ID NO: 6117697 - DNA, 13 bp, Homo sapiens
ctcacactgctgt

SEQ ID NO: 6117698 - DNA, 21 bp, Homo sapiens
ctcacactgctgtcctctccc

SEQ ID NO: 6117699 - DNA, 14 bp, Homo sapiens
ctcacactggagga

SEQ ID NO: 6117700 - DNA, 18 bp, Homo sapiens
ctcacactggtctgctgt

SEQ ID NO: 6117701 - DNA, 22 bp, Homo sapiens
ctcacactggtggaggagctgg

SEQ ID NO: 6117702 - DNA, 21 bp, Homo sapiens
ctcacactggttctcaatgaa

SEQ ID NO: 6117703 - DNA, 22 bp, Homo sapiens
ctcacacttgggcgctctgccc

SEQ ID NO: 6117704 - DNA, 13 bp, Homo sapiens
ctcacagaagaat

SEQ ID NO: 6117705 - DNA, 23 bp, Homo sapiens
ctcacagacaggacccctgcagt

SEQ ID NO: 6117706 - DNA, 17 bp, Homo sapiens
ctcacagacctctgctt

SEQ ID NO: 6117707 - DNA, 14 bp, Homo sapiens
ctcacagacctgga

SEQ ID NO: 6117708 - DNA, 20 bp, Homo sapiens
ctcacagacctggagcccct

SEQ ID NO: 6117709 - DNA, 15 bp, Homo sapiens
ctcacagactcttcc

SEQ ID NO: 6117710 - DNA, 16 bp, Homo sapiens
ctcacagactcttcca

SEQ ID NO: 6117711 - DNA, 19 bp, Homo sapiens
ctcacagactcttccacca

SEQ ID NO: 6117712 - DNA, 21 bp, Homo sapiens
ctcacagactcttccaccaga

SEQ ID NO: 6117713 - DNA, 15 bp, Homo sapiens
ctcacagactgctgt

SEQ ID NO: 6117714 - DNA, 16 bp, Homo sapiens
ctcacagactgctgtc

SEQ ID NO: 6117715 - DNA, 24 bp, Homo sapiens
ctcacagagaagctcctgctactt

SEQ ID NO: 6117716 - DNA, 13 bp, Homo sapiens
ctcacagagtcaa

SEQ ID NO: 6117717 - DNA, 17 bp, Homo sapiens
ctcacagagtcaaggcc

SEQ ID NO: 6117718 - DNA, 19 bp, Homo sapiens
ctcacagagtcaaggcctg

SEQ ID NO: 6117719 - DNA, 14 bp, Homo sapiens
ctcacagatgctgg

SEQ ID NO: 6117720 - DNA, 19 bp, Homo sapiens
ctcacagattgctgcctca

SEQ ID NO: 6117721 - DNA, 16 bp, Homo sapiens
ctcacagcacttgttt

SEQ ID NO: 6117722 - DNA, 21 bp, Homo sapiens
ctcacagcagtcacaggccca

SEQ ID NO: 6117723 - DNA, 22 bp, Homo sapiens
ctcacagcagtcacaggcccag

SEQ ID NO: 6117724 - DNA, 22 bp, Homo sapiens
ctcacagcatttgccaagtctc

SEQ ID NO: 6117725 - DNA, 12 bp, Homo sapiens
ctcacagccacc

SEQ ID NO: 6117726 - DNA, 16 bp, Homo sapiens
ctcacagccaccacct

SEQ ID NO: 6117727 - DNA, 14 bp, Homo sapiens
ctcacagcctctcc

SEQ ID NO: 6117728 - DNA, 15 bp, Homo sapiens
ctcacagcctctccc

SEQ ID NO: 6117729 - DNA, 18 bp, Homo sapiens
ctcacagcctctccctta

SEQ ID NO: 6117730 - DNA, 13 bp, Homo sapiens
ctcacagcctctg

SEQ ID NO: 6117731 - DNA, 14 bp, Homo sapiens
ctcacagcctctga

SEQ ID NO: 6117732 - DNA, 15 bp, Homo sapiens
ctcacagccttggct

SEQ ID NO: 6117733 - DNA, 17 bp, Homo sapiens
ctcacagccttggctcc

SEQ ID NO: 6117734 - DNA, 23 bp, Homo sapiens
ctcacagccttggctcctgagaa

SEQ ID NO: 6117735 - DNA, 16 bp, Homo sapiens
ctcacagctgtaataa

SEQ ID NO: 6117736 - DNA, 14 bp, Homo sapiens
ctcacagcttctcc

SEQ ID NO: 6117737 - DNA, 15 bp, Homo sapiens
ctcacaggagcagac

SEQ ID NO: 6117738 - DNA, 22 bp, Homo sapiens
ctcacaggagcagacagagaaa

SEQ ID NO: 6117739 - DNA, 16 bp, Homo sapiens
ctcacagggatgctgg

SEQ ID NO: 6117740 - DNA, 18 bp, Homo sapiens
ctcacagggatgctggtg

SEQ ID NO: 6117741 - DNA, 15 bp, Homo sapiens
ctcacagggcaggcc

SEQ ID NO: 6117742 - DNA, 17 bp, Homo sapiens
ctcacagggcaggcctt

SEQ ID NO: 6117743 - DNA, 18 bp, Homo sapiens
ctcacagggcaggccttg

SEQ ID NO: 6117744 - DNA, 19 bp, Homo sapiens
ctcacagggcaggccttgc

SEQ ID NO: 6117745 - DNA, 15 bp, Homo sapiens
ctcacaggtcccaaa

SEQ ID NO: 6117746 - DNA, 21 bp, Homo sapiens
ctcacaggtgtttgaggccaa

SEQ ID NO: 6117747 - DNA, 20 bp, Homo sapiens
ctcacaggttcacccagcgc

SEQ ID NO: 6117748 - DNA, 14 bp, Homo sapiens
cgaatatattactg

SEQ ID NO: 6117749 - DNA, 12 bp, Homo sapiens
cgaatattgctg

SEQ ID NO: 6117750 - DNA, 21 bp, Homo sapiens
cgaatcacgaggtcaggagtt

SEQ ID NO: 6117751 - DNA, 18 bp, Homo sapiens
cgaatcagctatttactg

SEQ ID NO: 6117752 - DNA, 20 bp, Homo sapiens
cgaatcatgacagtcagcaa

SEQ ID NO: 6117753 - DNA, 17 bp, Homo sapiens
cgaatcatttgttcaaa

SEQ ID NO: 6117754 - DNA, 18 bp, Homo sapiens
cgaatcccctccctgtca

SEQ ID NO: 6117755 - DNA, 19 bp, Homo sapiens
cgaatcccctccctgtcaa

SEQ ID NO: 6117756 - DNA, 17 bp, Homo sapiens
cgaatctactaattcca

SEQ ID NO: 6117757 - DNA, 16 bp, Homo sapiens
cgaatctagaggaggg

SEQ ID NO: 6117758 - DNA, 17 bp, Homo sapiens
cgaatctagaggagggg

SEQ ID NO: 6117759 - DNA, 15 bp, Homo sapiens
cgaatctcaaaatta

SEQ ID NO: 6117760 - DNA, 13 bp, Homo sapiens
cgaatctctgccc

SEQ ID NO: 6117761 - DNA, 14 bp, Homo sapiens
cgaatctctgcccc

SEQ ID NO: 6117762 - DNA, 12 bp, Homo sapiens
cgaatctctgtg

SEQ ID NO: 6117763 - DNA, 16 bp, Homo sapiens
cgaatctctgtgcctt

SEQ ID NO: 6117764 - DNA, 17 bp, Homo sapiens
cgaatcttatttttcct

SEQ ID NO: 6117765 - DNA, 22 bp, Homo sapiens
cgaatcttatttttcctgtcct

SEQ ID NO: 6117766 - DNA, 22 bp, Homo sapiens
cgaatgaaaataactgaatttg

SEQ ID NO: 6117767 - DNA, 12 bp, Homo sapiens
cgaatgacactg

SEQ ID NO: 6117768 - DNA, 17 bp, Homo sapiens
cgaatgacggtaagtgt

SEQ ID NO: 6117769 - DNA, 16 bp, Homo sapiens
cgaatgactatgtcca

SEQ ID NO: 6117770 - DNA, 22 bp, Homo sapiens
cgaatgcatattcaacacactg

SEQ ID NO: 6117771 - DNA, 23 bp, Homo sapiens
cgaatggaccctctcctggactc

SEQ ID NO: 6117772 - DNA, 17 bp, Homo sapiens
cgaatggagtccagacc

SEQ ID NO: 6117773 - DNA, 20 bp, Homo sapiens
cgaatggagtccagacctgg

SEQ ID NO: 6117774 - DNA, 22 bp, Homo sapiens
cgaatggggtccccctcccact

SEQ ID NO: 6117775 - DNA, 15 bp, Homo sapiens
cgaatggtctttgct

SEQ ID NO: 6117776 - DNA, 21 bp, Homo sapiens
cgaatggtctttgctccagat

SEQ ID NO: 6117777 - DNA, 18 bp, Homo sapiens
cgaatgtaattggaatct

SEQ ID NO: 6117778 - DNA, 21 bp, Homo sapiens
cgaatgtgcaggtttgttaca

SEQ ID NO: 6117779 - DNA, 15 bp, Homo sapiens
cgaatgtgtacaact

SEQ ID NO: 6117780 - DNA, 14 bp, Homo sapiens
cgaatgtgtcttta

SEQ ID NO: 6117781 - DNA, 18 bp, Homo sapiens
cgaatgtgtctttagata

SEQ ID NO: 6117782 - DNA, 15 bp, Homo sapiens
cgaatgtttcaaatc

SEQ ID NO: 6117783 - DNA, 14 bp, Homo sapiens
cgaattaatagctt

SEQ ID NO: 6117784 - DNA, 22 bp, Homo sapiens
cgaattagtttgcacttcctgt

SEQ ID NO: 6117785 - DNA, 13 bp, Homo sapiens
cgaattatactcc

SEQ ID NO: 6117786 - DNA, 19 bp, Homo sapiens
cgaattatttttttaaact

SEQ ID NO: 6117787 - DNA, 20 bp, Homo sapiens
cgaattatttttttaaactt

SEQ ID NO: 6117788 - DNA, 19 bp, Homo sapiens
cgaattatttttttaaagt

SEQ ID NO: 6117789 - DNA, 23 bp, Homo sapiens
cgaattctcagacgacacctgga

SEQ ID NO: 6117790 - DNA, 18 bp, Homo sapiens
cgaattgtgtggagaact

SEQ ID NO: 6117791 - DNA, 16 bp, Homo sapiens
cgaatttaaaatgtag

SEQ ID NO: 6117792 - DNA, 18 bp, Homo sapiens
cgaatttggtacacatgt

SEQ ID NO: 6117793 - DNA, 19 bp, Homo sapiens
cgaatttggtacacatgtg

SEQ ID NO: 6117794 - DNA, 20 bp, Homo sapiens
cgaatttggtacacatgtgt

SEQ ID NO: 6117795 - DNA, 23 bp, Homo sapiens
cgaatttggtgtggctgtattca

SEQ ID NO: 6117796 - DNA, 23 bp, Homo sapiens
cgaatttgtcttcagattattaa

SEQ ID NO: 6117797 - DNA, 14 bp, Homo sapiens
cgaattttaaaaca

SEQ ID NO: 6117798 - DNA, 15 bp, Homo sapiens
cgaattttattttac

SEQ ID NO: 6117799 - DNA, 16 bp, Homo sapiens
cgaattttattttaca

SEQ ID NO: 6117800 - DNA, 20 bp, Homo sapiens
cgacaaaacattttgaagga

SEQ ID NO: 6117801 - DNA, 16 bp, Homo sapiens
cgacaaaatctaatgt

SEQ ID NO: 6117802 - DNA, 17 bp, Homo sapiens
cgacaaaatctcctggc

SEQ ID NO: 6117803 - DNA, 14 bp, Homo sapiens
cgacaaaattccag

SEQ ID NO: 6117804 - DNA, 22 bp, Homo sapiens
cgacaaagcatcattgtaaatt

SEQ ID NO: 6117805 - DNA, 23 bp, Homo sapiens
cgacaaagcatcattgtaaatta

SEQ ID NO: 6117806 - DNA, 21 bp, Homo sapiens
cgacaaagctgctaaatctcc

SEQ ID NO: 6117807 - DNA, 20 bp, Homo sapiens
cgacaaagggaaggctgctg

SEQ ID NO: 6117808 - DNA, 15 bp, Homo sapiens
cgacaaatctgtctg

SEQ ID NO: 6117809 - DNA, 17 bp, Homo sapiens
cgacaacagattggatt

SEQ ID NO: 6117810 - DNA, 21 bp, Homo sapiens
cgacaaccgatgctccagcca

SEQ ID NO: 6117811 - DNA, 13 bp, Homo sapiens
cgacaagaatgtc

SEQ ID NO: 6117812 - DNA, 18 bp, Homo sapiens
cgacaatgccctgctggc

SEQ ID NO: 6117813 - DNA, 15 bp, Homo sapiens
cgacacatttaccaa

SEQ ID NO: 6117814 - DNA, 16 bp, Homo sapiens
cgacacatttaccaaa

SEQ ID NO: 6117815 - DNA, 14 bp, Homo sapiens
cgacaccactggga

SEQ ID NO: 6117816 - DNA, 16 bp, Homo sapiens
cgacaccactgggaac

SEQ ID NO: 6117817 - DNA, 17 bp, Homo sapiens
cgacaccagccctgctg

SEQ ID NO: 6117818 - DNA, 21 bp, Homo sapiens
cgacactcagggcagctgcct

SEQ ID NO: 6117819 - DNA, 15 bp, Homo sapiens
cgacactgagctgtg

SEQ ID NO: 6117820 - DNA, 15 bp, Homo sapiens
cgacactgctgcacc

SEQ ID NO: 6117821 - DNA, 14 bp, Homo sapiens
cgacactttggttt

SEQ ID NO: 6117822 - DNA, 18 bp, Homo sapiens
cgacagaaaacctcaagg

SEQ ID NO: 6117823 - DNA, 15 bp, Homo sapiens
cgacagagagagggg

SEQ ID NO: 6117824 - DNA, 20 bp, Homo sapiens
cgacagagcgagactccatc

SEQ ID NO: 6117825 - DNA, 19 bp, Homo sapiens
cgacagattcataaagtaa

SEQ ID NO: 6117826 - DNA, 20 bp, Homo sapiens
cgacagcattttaaggttct

SEQ ID NO: 6117827 - DNA, 11 bp, Homo sapiens
cgacagcccag

SEQ ID NO: 6117828 - DNA, 14 bp, Homo sapiens
cgacagcccagcct

SEQ ID NO: 6117829 - DNA, 15 bp, Homo sapiens
cgacagcgcccctgc

SEQ ID NO: 6117830 - DNA, 17 bp, Homo sapiens
cgacagcgcccctgctg

SEQ ID NO: 6117831 - DNA, 14 bp, Homo sapiens
cgacaggccctggc

SEQ ID NO: 6117832 - DNA, 22 bp, Homo sapiens
cgacaggcgagagaggagccag

SEQ ID NO: 6117833 - DNA, 23 bp, Homo sapiens
cgacaggcgagagaggagccaga

SEQ ID NO: 6117834 - DNA, 19 bp, Homo sapiens
cgacagggcctggagcccc

SEQ ID NO: 6117835 - DNA, 18 bp, Homo sapiens
cgacagtcggtgacccca

SEQ ID NO: 6117836 - DNA, 19 bp, Homo sapiens
cgacataccccactgggca

SEQ ID NO: 6117837 - DNA, 17 bp, Homo sapiens
cgacatcactgttcatg

SEQ ID NO: 6117838 - DNA, 18 bp, Homo sapiens
cgacatcccagaccagcc

SEQ ID NO: 6117839 - DNA, 20 bp, Homo sapiens
cgacatcccagtagtgtttg

SEQ ID NO: 6117840 - DNA, 19 bp, Homo sapiens
cgacatcctagccccaccc

SEQ ID NO: 6117841 - DNA, 20 bp, Homo sapiens
cgacatcttctcaaccttat

SEQ ID NO: 6117842 - DNA, 16 bp, Homo sapiens
cgaccacaccagcctc

SEQ ID NO: 6117843 - DNA, 14 bp, Homo sapiens
cgaccacagggtct

SEQ ID NO: 6117844 - DNA, 18 bp, Homo sapiens
cgaccaccaacacacagg

SEQ ID NO: 6117845 - DNA, 13 bp, Homo sapiens
cgaccacccctgt

SEQ ID NO: 6117846 - DNA, 21 bp, Homo sapiens
cgaccaccgcccctggccgcg

SEQ ID NO: 6117847 - DNA, 16 bp, Homo sapiens
cgaccacgccccagga

SEQ ID NO: 6117848 - DNA, 17 bp, Homo sapiens
cgaccacttttcagttc

SEQ ID NO: 6117849 - DNA, 23 bp, Homo sapiens
cgaccagacaccttgacagggca

SEQ ID NO: 6117850 - DNA, 20 bp, Homo sapiens
cgaccagcaggctcctcagc

SEQ ID NO: 6117851 - DNA, 12 bp, Homo sapiens
cgaccagcccct

SEQ ID NO: 6117852 - DNA, 11 bp, Homo sapiens
cgaccaggaaa

SEQ ID NO: 6117853 - DNA, 14 bp, Homo sapiens
cgaccaggctggac

SEQ ID NO: 6117854 - DNA, 16 bp, Homo sapiens
cgaccaggctggacac

SEQ ID NO: 6117855 - DNA, 19 bp, Homo sapiens
cgaccaggctggacaccct

SEQ ID NO: 6117856 - DNA, 22 bp, Homo sapiens
cgaccaggctggacaccctctg

SEQ ID NO: 6117857 - DNA, 15 bp, Homo sapiens
cgaccatcgtccagc

SEQ ID NO: 6117858 - DNA, 18 bp, Homo sapiens
cgaccatcgtccagccct

SEQ ID NO: 6117859 - DNA, 20 bp, Homo sapiens
cgaccatcgtccagccctcc

SEQ ID NO: 6117860 - DNA, 13 bp, Homo sapiens
cgaccatctgatt

SEQ ID NO: 6117861 - DNA, 13 bp, Homo sapiens
cgacccagccagc

SEQ ID NO: 6117862 - DNA, 14 bp, Homo sapiens
cgacccagccagct

SEQ ID NO: 6117863 - DNA, 17 bp, Homo sapiens
cgaccccacctgaggca

SEQ ID NO: 6117864 - DNA, 15 bp, Homo sapiens
cgaccccagactgta

SEQ ID NO: 6117865 - DNA, 14 bp, Homo sapiens
cgaccccatctgcc

SEQ ID NO: 6117866 - DNA, 18 bp, Homo sapiens
cgaccccatctgcccagg

SEQ ID NO: 6117867 - DNA, 16 bp, Homo sapiens
cgaccccccgtgggct

SEQ ID NO: 6117868 - DNA, 18 bp, Homo sapiens
cgaccccccgtgggctcc

SEQ ID NO: 6117869 - DNA, 21 bp, Homo sapiens
cgacccccctaccccatgctg

SEQ ID NO: 6117870 - DNA, 18 bp, Homo sapiens
cgacccccgcagaggcag

SEQ ID NO: 6117871 - DNA, 19 bp, Homo sapiens
cgaccccgtcacagcctca

SEQ ID NO: 6117872 - DNA, 19 bp, Homo sapiens
cgacccctagttccctctg

SEQ ID NO: 6117873 - DNA, 14 bp, Homo sapiens
cgacccctgcctcg

SEQ ID NO: 6117874 - DNA, 19 bp, Homo sapiens
cgacccctgcctcgagggc

SEQ ID NO: 6117875 - DNA, 21 bp, Homo sapiens
cgacccctgcctcgagggccg

SEQ ID NO: 6117876 - DNA, 14 bp, Homo sapiens
cgaccctcatggcc

SEQ ID NO: 6117877 - DNA, 15 bp, Homo sapiens
cgaccctcatggccc

SEQ ID NO: 6117878 - DNA, 19 bp, Homo sapiens
cgaccctcatggcccccag

SEQ ID NO: 6117879 - DNA, 13 bp, Homo sapiens
cgaccctccccgg

SEQ ID NO: 6117880 - DNA, 18 bp, Homo sapiens
cgaccctcctggccttcc

SEQ ID NO: 6117881 - DNA, 14 bp, Homo sapiens
cgaccctctgggaa

SEQ ID NO: 6117882 - DNA, 15 bp, Homo sapiens
cgaccctctgggaac

SEQ ID NO: 6117883 - DNA, 15 bp, Homo sapiens
cgaccctggctctgc

SEQ ID NO: 6117884 - DNA, 16 bp, Homo sapiens
cgaccctggctctgcc

SEQ ID NO: 6117885 - DNA, 12 bp, Homo sapiens
cgaccctggggg

SEQ ID NO: 6117886 - DNA, 17 bp, Homo sapiens
cgaccctgggggcacag

SEQ ID NO: 6117887 - DNA, 20 bp, Homo sapiens
cgaccctgtcccctagggac

SEQ ID NO: 6117888 - DNA, 17 bp, Homo sapiens
cgacccttttgagccta

SEQ ID NO: 6117889 - DNA, 14 bp, Homo sapiens
cgaccgacgcccct

SEQ ID NO: 6117890 - DNA, 18 bp, Homo sapiens
cgaccgacgcccctccgg

SEQ ID NO: 6117891 - DNA, 20 bp, Homo sapiens
cgaccgaggctggagctggc

SEQ ID NO: 6117892 - DNA, 16 bp, Homo sapiens
cgaccgcctgcttcac

SEQ ID NO: 6117893 - DNA, 14 bp, Homo sapiens
cgaccgggccaggc

SEQ ID NO: 6117894 - DNA, 22 bp, Homo sapiens
cgaccgggcctcccctccatgg

SEQ ID NO: 6117895 - DNA, 19 bp, Homo sapiens
cgacctaaacagctgcttt

SEQ ID NO: 6117896 - DNA, 16 bp, Homo sapiens
cgacctacatctgaaa

SEQ ID NO: 6117897 - DNA, 18 bp, Homo sapiens
cgacctcaagtgtcctga

SEQ ID NO: 6117898 - DNA, 12 bp, Homo sapiens
cgacctcagcct

SEQ ID NO: 6117899 - DNA, 14 bp, Homo sapiens
cgacctccctggct

SEQ ID NO: 6117900 - DNA, 16 bp, Homo sapiens
cgacctctctcagccc

SEQ ID NO: 6117901 - DNA, 17 bp, Homo sapiens
cgacctcttagaaaata

SEQ ID NO: 6117902 - DNA, 20 bp, Homo sapiens
cgacctcttagaaaataaat

SEQ ID NO: 6117903 - DNA, 16 bp, Homo sapiens
cgacctgcctcggcct

SEQ ID NO: 6117904 - DNA, 21 bp, Homo sapiens
cgacctggctgcccctcacct

SEQ ID NO: 6117905 - DNA, 18 bp, Homo sapiens
cgacctggtttttaaata

SEQ ID NO: 6117906 - DNA, 14 bp, Homo sapiens
cgaccttggccgca

SEQ ID NO: 6117907 - DNA, 21 bp, Homo sapiens
cgacgatcattgtgcccactt

SEQ ID NO: 6117908 - DNA, 14 bp, Homo sapiens
cgacgcccacccaa

SEQ ID NO: 6117909 - DNA, 17 bp, Homo sapiens
cgacgccccgaacctca

SEQ ID NO: 6117910 - DNA, 21 bp, Homo sapiens
cgacgctcccctgagaggttt

SEQ ID NO: 6117911 - DNA, 16 bp, Homo sapiens
cgacgcttgctctgtt

SEQ ID NO: 6117912 - DNA, 13 bp, Homo sapiens
cgacggaaaagtc

SEQ ID NO: 6117913 - DNA, 19 bp, Homo sapiens
cgacggagccactggggtg

SEQ ID NO: 6117914 - DNA, 15 bp, Homo sapiens
cgacggcctccagga

SEQ ID NO: 6117915 - DNA, 16 bp, Homo sapiens
cgacggcctccaggag

SEQ ID NO: 6117916 - DNA, 19 bp, Homo sapiens
cgacggtttcaaaccagga

SEQ ID NO: 6117917 - DNA, 14 bp, Homo sapiens
cgacgtcagcctct

SEQ ID NO: 6117918 - DNA, 16 bp, Homo sapiens
cgacgtgctcccctgc

SEQ ID NO: 6117919 - DNA, 16 bp, Homo sapiens
cgacgttttctccgca

SEQ ID NO: 6117920 - DNA, 21 bp, Homo sapiens
cgactaaactagattttcact

SEQ ID NO: 6117921 - DNA, 18 bp, Homo sapiens
cgactactgctcctgtgg

SEQ ID NO: 6117922 - DNA, 14 bp, Homo sapiens
cgactactttgcta

SEQ ID NO: 6117923 - DNA, 17 bp, Homo sapiens
cgactagcaggcatgcc

SEQ ID NO: 6117924 - DNA, 12 bp, Homo sapiens
cgactatagaaa

SEQ ID NO: 6117925 - DNA, 17 bp, Homo sapiens
cgactatccctgcacat

SEQ ID NO: 6117926 - DNA, 12 bp, Homo sapiens
cgactcagcacc

SEQ ID NO: 6117927 - DNA, 13 bp, Homo sapiens
cgactcagggacc

SEQ ID NO: 6117928 - DNA, 23 bp, Homo sapiens
ctcacagtaacccaaacctcaag

SEQ ID NO: 6117929 - DNA, 20 bp, Homo sapiens
ctcacagtacagcatgtgcc

SEQ ID NO: 6117930 - DNA, 17 bp, Homo sapiens
ctcacagtccttaccag

SEQ ID NO: 6117931 - DNA, 22 bp, Homo sapiens
ctcacagtgaacactcagtggc

SEQ ID NO: 6117932 - DNA, 12 bp, Homo sapiens
ctcacagtgaca

SEQ ID NO: 6117933 - DNA, 12 bp, Homo sapiens
ctcacagtgacc

SEQ ID NO: 6117934 - DNA, 16 bp, Homo sapiens
ctcacagtgacccttc

SEQ ID NO: 6117935 - DNA, 19 bp, Homo sapiens
ctcacagtgggagccaggg

SEQ ID NO: 6117936 - DNA, 22 bp, Homo sapiens
ctcacagtgggagccagggctg

SEQ ID NO: 6117937 - DNA, 17 bp, Homo sapiens
ctcacagtgttgcccag

SEQ ID NO: 6117938 - DNA, 16 bp, Homo sapiens
ctcacagttattacat

SEQ ID NO: 6117939 - DNA, 16 bp, Homo sapiens
ctcacagttcctcgcc

SEQ ID NO: 6117940 - DNA, 20 bp, Homo sapiens
ctcacagttcctcgccctgg

SEQ ID NO: 6117941 - DNA, 22 bp, Homo sapiens
ctcacatacataagcagcattt

SEQ ID NO: 6117942 - DNA, 20 bp, Homo sapiens
ctcacatagcttacaagcca

SEQ ID NO: 6117943 - DNA, 13 bp, Homo sapiens
ctcacatcctctc

SEQ ID NO: 6117944 - DNA, 15 bp, Homo sapiens
ctcacatcctctcca

SEQ ID NO: 6117945 - DNA, 22 bp, Homo sapiens
ctcacatgattccagccatcac

SEQ ID NO: 6117946 - DNA, 16 bp, Homo sapiens
ctcacatgcccgctgt

SEQ ID NO: 6117947 - DNA, 23 bp, Homo sapiens
ctcacatgcccgctgtcccaggg

SEQ ID NO: 6117948 - DNA, 21 bp, Homo sapiens
ctcacatgctggacaggtctg

SEQ ID NO: 6117949 - DNA, 19 bp, Homo sapiens
ctcacatgctgtttttcct

SEQ ID NO: 6117950 - DNA, 18 bp, Homo sapiens
ctcacatggaatgagggt

SEQ ID NO: 6117951 - DNA, 20 bp, Homo sapiens
ctcacatggaatgagggttt

SEQ ID NO: 6117952 - DNA, 23 bp, Homo sapiens
ctcacatggcgtcctgcccttgc

SEQ ID NO: 6117953 - DNA, 19 bp, Homo sapiens
ctcacatgggactgggata

SEQ ID NO: 6117954 - DNA, 23 bp, Homo sapiens
ctcacatggtgctacgcctgcat

SEQ ID NO: 6117955 - DNA, 16 bp, Homo sapiens
ctcacatgtggcacgt

SEQ ID NO: 6117956 - DNA, 16 bp, Homo sapiens
ctcacattagatctag

SEQ ID NO: 6117957 - DNA, 12 bp, Homo sapiens
ctcacattccca

SEQ ID NO: 6117958 - DNA, 15 bp, Homo sapiens
ctcacattccctctc

SEQ ID NO: 6117959 - DNA, 17 bp, Homo sapiens
ctcacattccctctcat

SEQ ID NO: 6117960 - DNA, 19 bp, Homo sapiens
ctcacattccctctcatcc

SEQ ID NO: 6117961 - DNA, 20 bp, Homo sapiens
ctcacattccctctcatcca

SEQ ID NO: 6117962 - DNA, 22 bp, Homo sapiens
ctcacattcgacataccccact

SEQ ID NO: 6117963 - DNA, 17 bp, Homo sapiens
ctcacattgccttgagc

SEQ ID NO: 6117964 - DNA, 13 bp, Homo sapiens
ctcacattgctgt

SEQ ID NO: 6117965 - DNA, 13 bp, Homo sapiens
ctcacatttatat

SEQ ID NO: 6117966 - DNA, 15 bp, Homo sapiens
ctcacatttattctg

SEQ ID NO: 6117967 - DNA, 14 bp, Homo sapiens
ctcacattttctca

SEQ ID NO: 6117968 - DNA, 20 bp, Homo sapiens
ctcacattttctcagtgtgc

SEQ ID NO: 6117969 - DNA, 12 bp, Homo sapiens
ctcacattttgt

SEQ ID NO: 6117970 - DNA, 14 bp, Homo sapiens
ctcaccaaaatata

SEQ ID NO: 6117971 - DNA, 13 bp, Homo sapiens
ctcaccaataact

SEQ ID NO: 6117972 - DNA, 17 bp, Homo sapiens
ctcaccaataacttcag

SEQ ID NO: 6117973 - DNA, 20 bp, Homo sapiens
ctcaccaataacttcagaga

SEQ ID NO: 6117974 - DNA, 12 bp, Homo sapiens
ctcaccaccccc

SEQ ID NO: 6117975 - DNA, 16 bp, Homo sapiens
ctcaccacccccactg

SEQ ID NO: 6117976 - DNA, 23 bp, Homo sapiens
ctcaccacctctttctacagcct

SEQ ID NO: 6117977 - DNA, 16 bp, Homo sapiens
ctcaccacctgcccgg

SEQ ID NO: 6117978 - DNA, 15 bp, Homo sapiens
ctcaccacctgcctc

SEQ ID NO: 6117979 - DNA, 18 bp, Homo sapiens
ctcaccacctgcctctaa

SEQ ID NO: 6117980 - DNA, 23 bp, Homo sapiens
ctcaccacgatgacgcctctgga

SEQ ID NO: 6117981 - DNA, 23 bp, Homo sapiens
ctcaccactaccagccagcctca

SEQ ID NO: 6117982 - DNA, 21 bp, Homo sapiens
ctcaccactgccccctgctgc

SEQ ID NO: 6117983 - DNA, 16 bp, Homo sapiens
ctcaccagagaccagg

SEQ ID NO: 6117984 - DNA, 19 bp, Homo sapiens
ctcaccagagaccaggagg

SEQ ID NO: 6117985 - DNA, 19 bp, Homo sapiens
ctcaccagccccactgcca

SEQ ID NO: 6117986 - DNA, 22 bp, Homo sapiens
ctcaccagccccactgccagca

SEQ ID NO: 6117987 - DNA, 17 bp, Homo sapiens
ctcaccagccccagtgc

SEQ ID NO: 6117988 - DNA, 20 bp, Homo sapiens
ctcaccagccccagtgccca

SEQ ID NO: 6117989 - DNA, 18 bp, Homo sapiens
ctcaccagccctagctgt

SEQ ID NO: 6117990 - DNA, 12 bp, Homo sapiens
ctcaccagcctt

SEQ ID NO: 6117991 - DNA, 14 bp, Homo sapiens
ctcaccagccttga

SEQ ID NO: 6117992 - DNA, 12 bp, Homo sapiens
ctcaccagctca

SEQ ID NO: 6117993 - DNA, 22 bp, Homo sapiens
ctcaccagctcagccccggcca

SEQ ID NO: 6117994 - DNA, 23 bp, Homo sapiens
ctcaccagctcagccccggccac

SEQ ID NO: 6117995 - DNA, 11 bp, Homo sapiens
ctcaccagctg

SEQ ID NO: 6117996 - DNA, 16 bp, Homo sapiens
ctcaccagctgcaaag

SEQ ID NO: 6117997 - DNA, 18 bp, Homo sapiens
ctcaccagctgcaaagtg

SEQ ID NO: 6117998 - DNA, 13 bp, Homo sapiens
ctcaccaggaagg

SEQ ID NO: 6117999 - DNA, 18 bp, Homo sapiens
ctcaccaggcagcctctg

SEQ ID NO: 6118000 - DNA, 20 bp, Homo sapiens
ctcaccaggcccacgaggag

SEQ ID NO: 6118001 - DNA, 13 bp, Homo sapiens
ctcaccaggcctg

SEQ ID NO: 6118002 - DNA, 18 bp, Homo sapiens
ctcaccaggcctggcctc

SEQ ID NO: 6118003 - DNA, 10 bp, Homo sapiens
ctcaccaggg

SEQ ID NO: 6118004 - DNA, 13 bp, Homo sapiens
ctcaccaggggca

SEQ ID NO: 6118005 - DNA, 14 bp, Homo sapiens
ctcaccaggggcag

SEQ ID NO: 6118006 - DNA, 15 bp, Homo sapiens
ctcaccaggggcagg

SEQ ID NO: 6118007 - DNA, 21 bp, Homo sapiens
ctcaccaggggcaggcacagc

SEQ ID NO: 6118008 - DNA, 15 bp, Homo sapiens
ctcaccagtggcctt

SEQ ID NO: 6118009 - DNA, 16 bp, Homo sapiens
ctcaccagtggccttt

SEQ ID NO: 6118010 - DNA, 17 bp, Homo sapiens
ctcaccagtggcctttc

SEQ ID NO: 6118011 - DNA, 19 bp, Homo sapiens
ctcaccagtggcctttcag

SEQ ID NO: 6118012 - DNA, 24 bp, Homo sapiens
ctcaccagtgtcccctccactgtc

SEQ ID NO: 6118013 - DNA, 18 bp, Homo sapiens
ctcaccatatttgaattg

SEQ ID NO: 6118014 - DNA, 16 bp, Homo sapiens
ctcaccatccagtggg

SEQ ID NO: 6118015 - DNA, 14 bp, Homo sapiens
ctcaccatctgtgc

SEQ ID NO: 6118016 - DNA, 21 bp, Homo sapiens
ctcaccatgaatatctggggt

SEQ ID NO: 6118017 - DNA, 20 bp, Homo sapiens
ctcaccattccaagtctcca

SEQ ID NO: 6118018 - DNA, 22 bp, Homo sapiens
ctcaccattccaagtctccacc

SEQ ID NO: 6118019 - DNA, 21 bp, Homo sapiens
ctcaccatttaatcatttcca

SEQ ID NO: 6118020 - DNA, 12 bp, Homo sapiens
ctcaccatttca

SEQ ID NO: 6118021 - DNA, 13 bp, Homo sapiens
ctcacccacacca

SEQ ID NO: 6118022 - DNA, 20 bp, Homo sapiens
ctcacccaccatggaccagc

SEQ ID NO: 6118023 - DNA, 14 bp, Homo sapiens
ctcacccacctctg

SEQ ID NO: 6118024 - DNA, 16 bp, Homo sapiens
ctcacccactctggtg

SEQ ID NO: 6118025 - DNA, 18 bp, Homo sapiens
ctcacccagaatccctct

SEQ ID NO: 6118026 - DNA, 13 bp, Homo sapiens
ctcacccagatca

SEQ ID NO: 6118027 - DNA, 19 bp, Homo sapiens
ctcacccagatcaggaacc

SEQ ID NO: 6118028 - DNA, 14 bp, Homo sapiens
ctcacccagcctgg

SEQ ID NO: 6118029 - DNA, 14 bp, Homo sapiens
ctcacccaggacct

SEQ ID NO: 6118030 - DNA, 14 bp, Homo sapiens
ctcacccagtcacc

SEQ ID NO: 6118031 - DNA, 16 bp, Homo sapiens
ctcacccagtccccac

SEQ ID NO: 6118032 - DNA, 22 bp, Homo sapiens
ctcacccagtccccacccgcct

SEQ ID NO: 6118033 - DNA, 13 bp, Homo sapiens
ctcacccagtgcc

SEQ ID NO: 6118034 - DNA, 14 bp, Homo sapiens
ctcacccagtgccc

SEQ ID NO: 6118035 - DNA, 14 bp, Homo sapiens
ctcacccatcctag

SEQ ID NO: 6118036 - DNA, 18 bp, Homo sapiens
ctcacccattgtctcatt

SEQ ID NO: 6118037 - DNA, 22 bp, Homo sapiens
ctcaccccaaacccagaacatg

SEQ ID NO: 6118038 - DNA, 22 bp, Homo sapiens
ctcaccccaatccctgccactg

SEQ ID NO: 6118039 - DNA, 12 bp, Homo sapiens
ctcaccccactc

SEQ ID NO: 6118040 - DNA, 12 bp, Homo sapiens
ctcaccccagcc

SEQ ID NO: 6118041 - DNA, 13 bp, Homo sapiens
ctcaccccagccc

SEQ ID NO: 6118042 - DNA, 15 bp, Homo sapiens
ctcaccccagcctca

SEQ ID NO: 6118043 - DNA, 14 bp, Homo sapiens
ctcaccccagctcc

SEQ ID NO: 6118044 - DNA, 20 bp, Homo sapiens
ctcaccccagctccgacctc

SEQ ID NO: 6118045 - DNA, 12 bp, Homo sapiens
ctcaccccagga

SEQ ID NO: 6118046 - DNA, 13 bp, Homo sapiens
ctcaccccaggat

SEQ ID NO: 6118047 - DNA, 22 bp, Homo sapiens
ctcaccccatcccacaccctgg

SEQ ID NO: 6118048 - DNA, 13 bp, Homo sapiens
ctcacccccacct

SEQ ID NO: 6118049 - DNA, 21 bp, Homo sapiens
ctcacccccagcacaggggga

SEQ ID NO: 6118050 - DNA, 14 bp, Homo sapiens
ctcacccccagctt

SEQ ID NO: 6118051 - DNA, 17 bp, Homo sapiens
ctcacccccagctttgc

SEQ ID NO: 6118052 - DNA, 19 bp, Homo sapiens
ctcacccccagctttgcta

SEQ ID NO: 6118053 - DNA, 16 bp, Homo sapiens
ctcacccccaggtgtt

SEQ ID NO: 6118054 - DNA, 21 bp, Homo sapiens
ctcaccccccgacctggctga

SEQ ID NO: 6118055 - DNA, 21 bp, Homo sapiens
ctcacccccgacggtgtggct

SEQ ID NO: 6118056 - DNA, 14 bp, Homo sapiens
ctcaccccctcacc

SEQ ID NO: 6118057 - DNA, 19 bp, Homo sapiens
ctcaccccctcctggcaat

SEQ ID NO: 6118058 - DNA, 15 bp, Homo sapiens
ctcaccccctccttc

SEQ ID NO: 6118059 - DNA, 13 bp, Homo sapiens
ctcaccccctcgg

SEQ ID NO: 6118060 - DNA, 19 bp, Homo sapiens
ctcaccccgaggccctgca

SEQ ID NO: 6118061 - DNA, 14 bp, Homo sapiens
ctcacccctagccc

SEQ ID NO: 6118062 - DNA, 18 bp, Homo sapiens
ctcacccctagccctggt

SEQ ID NO: 6118063 - DNA, 18 bp, Homo sapiens
ctcacccctgccctggga

SEQ ID NO: 6118064 - DNA, 21 bp, Homo sapiens
ctcacccctggttctcatctt

SEQ ID NO: 6118065 - DNA, 18 bp, Homo sapiens
ctcacccctgtagggaaa

SEQ ID NO: 6118066 - DNA, 13 bp, Homo sapiens
ctcacccctgtcc

SEQ ID NO: 6118067 - DNA, 15 bp, Homo sapiens
ctcacccctgtcctc

SEQ ID NO: 6118068 - DNA, 19 bp, Homo sapiens
ctcacccctgtcctcactg

SEQ ID NO: 6118069 - DNA, 21 bp, Homo sapiens
ctcacccctgtcctcactgct

SEQ ID NO: 6118070 - DNA, 22 bp, Homo sapiens
ctcacccctgtcctcactgctc

SEQ ID NO: 6118071 - DNA, 15 bp, Homo sapiens
ctcaccccttccttt

SEQ ID NO: 6118072 - DNA, 17 bp, Homo sapiens
ctcaccccttgccataa

SEQ ID NO: 6118073 - DNA, 20 bp, Homo sapiens
ctcacccgctgcccagccct

SEQ ID NO: 6118074 - DNA, 21 bp, Homo sapiens
ctcacccgctgcccagccctc

SEQ ID NO: 6118075 - DNA, 16 bp, Homo sapiens
ctcaccctcataccat

SEQ ID NO: 6118076 - DNA, 23 bp, Homo sapiens
ctcaccctcctagcctgctctgc

SEQ ID NO: 6118077 - DNA, 16 bp, Homo sapiens
ctcaccctctcttggt

SEQ ID NO: 6118078 - DNA, 17 bp, Homo sapiens
ctcaccctctcttggtg

SEQ ID NO: 6118079 - DNA, 17 bp, Homo sapiens
ctcaccctctgtccttc

SEQ ID NO: 6118080 - DNA, 19 bp, Homo sapiens
ctcaccctgagccccttcc

SEQ ID NO: 6118081 - DNA, 17 bp, Homo sapiens
ctcaccctgcccgctcc

SEQ ID NO: 6118082 - DNA, 23 bp, Homo sapiens
ctcaccctgcccgctcccaaccc

SEQ ID NO: 6118083 - DNA, 14 bp, Homo sapiens
ctcaccctgcttgg

SEQ ID NO: 6118084 - DNA, 15 bp, Homo sapiens
ctcaccctgggagcc

SEQ ID NO: 6118085 - DNA, 14 bp, Homo sapiens
ctcaccctggggct

SEQ ID NO: 6118086 - DNA, 14 bp, Homo sapiens
ctcaccctgtggga

SEQ ID NO: 6118087 - DNA, 16 bp, Homo sapiens
ctcaccctgtgggacc

SEQ ID NO: 6118088 - DNA, 17 bp, Homo sapiens
ctcacccttcctggccc

SEQ ID NO: 6118089 - DNA, 19 bp, Homo sapiens
ctcacccttcctggcccag

SEQ ID NO: 6118090 - DNA, 22 bp, Homo sapiens
ctcacccttcctggcccaggcc

SEQ ID NO: 6118091 - DNA, 23 bp, Homo sapiens
ctcacccttcctggcccaggcct

SEQ ID NO: 6118092 - DNA, 20 bp, Homo sapiens
ctcaccctttaccttcctca

SEQ ID NO: 6118093 - DNA, 20 bp, Homo sapiens
ctcaccgactcacctgcgca

SEQ ID NO: 6118094 - DNA, 15 bp, Homo sapiens
ctcaccgcagtcgtc

SEQ ID NO: 6118095 - DNA, 18 bp, Homo sapiens
ctcaccgcggctggatgg

SEQ ID NO: 6118096 - DNA, 18 bp, Homo sapiens
ctcaccgctcaccctcct

SEQ ID NO: 6118097 - DNA, 16 bp, Homo sapiens
ctcaccgctggccctt

SEQ ID NO: 6118098 - DNA, 19 bp, Homo sapiens
ctcaccgctggcccttaga

SEQ ID NO: 6118099 - DNA, 21 bp, Homo sapiens
ctcaccgtgcagagctgcact

SEQ ID NO: 6118100 - DNA, 21 bp, Homo sapiens
ctcaccgtggctaagagtgtc

SEQ ID NO: 6118101 - DNA, 19 bp, Homo sapiens
ctcacctaaaccctctgtg

SEQ ID NO: 6118102 - DNA, 21 bp, Homo sapiens
ctcacctaattatgaggtggg

SEQ ID NO: 6118103 - DNA, 14 bp, Homo sapiens
ctcacctacttcct

SEQ ID NO: 6118104 - DNA, 16 bp, Homo sapiens
ctcacctacttcctcc

SEQ ID NO: 6118105 - DNA, 17 bp, Homo sapiens
ctcacctacttcctcct

SEQ ID NO: 6118106 - DNA, 14 bp, Homo sapiens
ctcacctagagcca

SEQ ID NO: 6118107 - DNA, 14 bp, Homo sapiens
cgactcagggacct

SEQ ID NO: 6118108 - DNA, 21 bp, Homo sapiens
cgactccagatatgaacaggg

SEQ ID NO: 6118109 - DNA, 10 bp, Homo sapiens
cgactccagc

SEQ ID NO: 6118110 - DNA, 14 bp, Homo sapiens
cgactccagccagc

SEQ ID NO: 6118111 - DNA, 16 bp, Homo sapiens
cgactccagccagcgc

SEQ ID NO: 6118112 - DNA, 17 bp, Homo sapiens
cgactccagccagcgcc

SEQ ID NO: 6118113 - DNA, 18 bp, Homo sapiens
cgactccagccagcgcct

SEQ ID NO: 6118114 - DNA, 16 bp, Homo sapiens
cgactcccccctggcc

SEQ ID NO: 6118115 - DNA, 16 bp, Homo sapiens
cgactctaagctgtgt

SEQ ID NO: 6118116 - DNA, 17 bp, Homo sapiens
cgactctaagctgtgtg

SEQ ID NO: 6118117 - DNA, 18 bp, Homo sapiens
cgactctatagactctag

SEQ ID NO: 6118118 - DNA, 16 bp, Homo sapiens
cgactctgcacccgcc

SEQ ID NO: 6118119 - DNA, 16 bp, Homo sapiens
cgactctggccctggc

SEQ ID NO: 6118120 - DNA, 16 bp, Homo sapiens
cgactctgtgctggcc

SEQ ID NO: 6118121 - DNA, 13 bp, Homo sapiens
cgactcttcctgc

SEQ ID NO: 6118122 - DNA, 15 bp, Homo sapiens
cgactcttcctgcaa

SEQ ID NO: 6118123 - DNA, 21 bp, Homo sapiens
cgactctttctgagtgccttc

SEQ ID NO: 6118124 - DNA, 16 bp, Homo sapiens
cgactctttgatatgc

SEQ ID NO: 6118125 - DNA, 20 bp, Homo sapiens
cgactgaagtcagtgtagac

SEQ ID NO: 6118126 - DNA, 13 bp, Homo sapiens
cgactgaccactg

SEQ ID NO: 6118127 - DNA, 17 bp, Homo sapiens
cgactgaccactggcct

SEQ ID NO: 6118128 - DNA, 16 bp, Homo sapiens
cgactgcacagcggcc

SEQ ID NO: 6118129 - DNA, 12 bp, Homo sapiens
cgactgcccaga

SEQ ID NO: 6118130 - DNA, 16 bp, Homo sapiens
cgactgcccagccact

SEQ ID NO: 6118131 - DNA, 23 bp, Homo sapiens
cgactgcccctgctgtgctgctc

SEQ ID NO: 6118132 - DNA, 17 bp, Homo sapiens
cgactgcgaacactgaa

SEQ ID NO: 6118133 - DNA, 18 bp, Homo sapiens
cgactgcgggagccagac

SEQ ID NO: 6118134 - DNA, 22 bp, Homo sapiens
cgactgctgttcccctcttccc

SEQ ID NO: 6118135 - DNA, 14 bp, Homo sapiens
cgactgggctgctg

SEQ ID NO: 6118136 - DNA, 19 bp, Homo sapiens
cgactgggctgctggggca

SEQ ID NO: 6118137 - DNA, 23 bp, Homo sapiens
cgactgggctgctggggcagggc

SEQ ID NO: 6118138 - DNA, 12 bp, Homo sapiens
cgactggtccag

SEQ ID NO: 6118139 - DNA, 14 bp, Homo sapiens
cgactggtccagct

SEQ ID NO: 6118140 - DNA, 19 bp, Homo sapiens
cgactggtccagctctgac

SEQ ID NO: 6118141 - DNA, 16 bp, Homo sapiens
cgactgtgaaagtatg

SEQ ID NO: 6118142 - DNA, 17 bp, Homo sapiens
cgactgtgacctgtggg

SEQ ID NO: 6118143 - DNA, 11 bp, Homo sapiens
cgactgttgtt

SEQ ID NO: 6118144 - DNA, 17 bp, Homo sapiens
cgacttcccctgggcaa

SEQ ID NO: 6118145 - DNA, 18 bp, Homo sapiens
cgacttctcaggacgacg

SEQ ID NO: 6118146 - DNA, 22 bp, Homo sapiens
cgacttgaatattcctggactt

SEQ ID NO: 6118147 - DNA, 19 bp, Homo sapiens
cgacttgaattttcccact

SEQ ID NO: 6118148 - DNA, 16 bp, Homo sapiens
cgacttgccaaattta

SEQ ID NO: 6118149 - DNA, 21 bp, Homo sapiens
cgacttgctgttttgttctgt

SEQ ID NO: 6118150 - DNA, 22 bp, Homo sapiens
cgacttggagactcctggtctg

SEQ ID NO: 6118151 - DNA, 23 bp, Homo sapiens
cgacttgggacggaagtggcctg

SEQ ID NO: 6118152 - DNA, 14 bp, Homo sapiens
cgactttctgcctg

SEQ ID NO: 6118153 - DNA, 16 bp, Homo sapiens
cgactttctgcctgga

SEQ ID NO: 6118154 - DNA, 16 bp, Homo sapiens
cgactttctttaacat

SEQ ID NO: 6118155 - DNA, 17 bp, Homo sapiens
cgactttgtacccccca

SEQ ID NO: 6118156 - DNA, 22 bp, Homo sapiens
cgacttttctaaagctctgaac

SEQ ID NO: 6118157 - DNA, 20 bp, Homo sapiens
cgacttttgttctcttctgc

SEQ ID NO: 6118158 - DNA, 15 bp, Homo sapiens
cgagaaaaggagaaa

SEQ ID NO: 6118159 - DNA, 17 bp, Homo sapiens
cgagaaacagcctgtgt

SEQ ID NO: 6118160 - DNA, 15 bp, Homo sapiens
cgagaaccctgagca

SEQ ID NO: 6118161 - DNA, 17 bp, Homo sapiens
cgagaactttcattttt

SEQ ID NO: 6118162 - DNA, 13 bp, Homo sapiens
cgagaagcaagaa

SEQ ID NO: 6118163 - DNA, 15 bp, Homo sapiens
cgagaaggggaaaaa

SEQ ID NO: 6118164 - DNA, 13 bp, Homo sapiens
cgagaagtgctct

SEQ ID NO: 6118165 - DNA, 13 bp, Homo sapiens
cgagaagtgcttt

SEQ ID NO: 6118166 - DNA, 19 bp, Homo sapiens
cgagaatgcaggccccgcc

SEQ ID NO: 6118167 - DNA, 18 bp, Homo sapiens
cgagacaacagcacacag

SEQ ID NO: 6118168 - DNA, 20 bp, Homo sapiens
cgagacaacagcacacaggc

SEQ ID NO: 6118169 - DNA, 23 bp, Homo sapiens
cgagacaacagcacacaggcagc

SEQ ID NO: 6118170 - DNA, 17 bp, Homo sapiens
cgagacacattgccttc

SEQ ID NO: 6118171 - DNA, 16 bp, Homo sapiens
cgagacaccatcctga

SEQ ID NO: 6118172 - DNA, 21 bp, Homo sapiens
cgagacaccctaactcttgct

SEQ ID NO: 6118173 - DNA, 12 bp, Homo sapiens
cgagacagtcca

SEQ ID NO: 6118174 - DNA, 17 bp, Homo sapiens
cgagaccaacctgacca

SEQ ID NO: 6118175 - DNA, 14 bp, Homo sapiens
cgagaccagcctgg

SEQ ID NO: 6118176 - DNA, 15 bp, Homo sapiens
cgagaccagcctggc

SEQ ID NO: 6118177 - DNA, 22 bp, Homo sapiens
cgagaccagcctggccatcatg

SEQ ID NO: 6118178 - DNA, 13 bp, Homo sapiens
cgagaccagtctg

SEQ ID NO: 6118179 - DNA, 17 bp, Homo sapiens
cgagaccatcctggccc

SEQ ID NO: 6118180 - DNA, 18 bp, Homo sapiens
cgagaccatcctggcccc

SEQ ID NO: 6118181 - DNA, 17 bp, Homo sapiens
cgagacccaagggcaga

SEQ ID NO: 6118182 - DNA, 22 bp, Homo sapiens
cgagacccatttccttgtgctc

SEQ ID NO: 6118183 - DNA, 15 bp, Homo sapiens
cgagacccccatcca

SEQ ID NO: 6118184 - DNA, 12 bp, Homo sapiens
cgagactcagcc

SEQ ID NO: 6118185 - DNA, 17 bp, Homo sapiens
cgagactcagcctctgc

SEQ ID NO: 6118186 - DNA, 18 bp, Homo sapiens
cgagactcagcctctgct

SEQ ID NO: 6118187 - DNA, 20 bp, Homo sapiens
cgagactcagcctctgctgg

SEQ ID NO: 6118188 - DNA, 22 bp, Homo sapiens
cgagactcagcctctgctggag

SEQ ID NO: 6118189 - DNA, 19 bp, Homo sapiens
cgagactcctcgggcaagg

SEQ ID NO: 6118190 - DNA, 21 bp, Homo sapiens
cgagactcctcgggcaagggc

SEQ ID NO: 6118191 - DNA, 14 bp, Homo sapiens
cgagactttctcct

SEQ ID NO: 6118192 - DNA, 19 bp, Homo sapiens
cgagagagaccccaccgcc

SEQ ID NO: 6118193 - DNA, 12 bp, Homo sapiens
cgagagaggcgc

SEQ ID NO: 6118194 - DNA, 17 bp, Homo sapiens
cgagagatcaaagatga

SEQ ID NO: 6118195 - DNA, 13 bp, Homo sapiens
cgagagatgtgtg

SEQ ID NO: 6118196 - DNA, 16 bp, Homo sapiens
cgagagcagcctggcc

SEQ ID NO: 6118197 - DNA, 17 bp, Homo sapiens
cgagagcagcctggcca

SEQ ID NO: 6118198 - DNA, 23 bp, Homo sapiens
cgagagcctcgctttttcatcct

SEQ ID NO: 6118199 - DNA, 15 bp, Homo sapiens
cgagagcctgctccc

SEQ ID NO: 6118200 - DNA, 20 bp, Homo sapiens
cgagagcctgctcccccacc

SEQ ID NO: 6118201 - DNA, 23 bp, Homo sapiens
cgagagccttacttcaaagtgcc

SEQ ID NO: 6118202 - DNA, 22 bp, Homo sapiens
cgagagctcttagtttttaaaa

SEQ ID NO: 6118203 - DNA, 14 bp, Homo sapiens
cgagagctggccaa

SEQ ID NO: 6118204 - DNA, 23 bp, Homo sapiens
cgagagctggccaaagagccttt

SEQ ID NO: 6118205 - DNA, 22 bp, Homo sapiens
cgagagcttggactacacaata

SEQ ID NO: 6118206 - DNA, 13 bp, Homo sapiens
cgagaggacagaa

SEQ ID NO: 6118207 - DNA, 16 bp, Homo sapiens
cgagaggacagaatgg

SEQ ID NO: 6118208 - DNA, 14 bp, Homo sapiens
cgagaggcagagaa

SEQ ID NO: 6118209 - DNA, 19 bp, Homo sapiens
cgagaggccaaaggctggt

SEQ ID NO: 6118210 - DNA, 15 bp, Homo sapiens
cgagaggccagttga

SEQ ID NO: 6118211 - DNA, 13 bp, Homo sapiens
cgagagggagaga

SEQ ID NO: 6118212 - DNA, 20 bp, Homo sapiens
cgagagggctgagcccctcc

SEQ ID NO: 6118213 - DNA, 12 bp, Homo sapiens
cgagagggctgt

SEQ ID NO: 6118214 - DNA, 22 bp, Homo sapiens
cgagaggggaagagtgtactgg

SEQ ID NO: 6118215 - DNA, 18 bp, Homo sapiens
cgagaggtatgcctgtac

SEQ ID NO: 6118216 - DNA, 16 bp, Homo sapiens
cgagaggtccctgctt

SEQ ID NO: 6118217 - DNA, 17 bp, Homo sapiens
cgagaggtccctgctta

SEQ ID NO: 6118218 - DNA, 15 bp, Homo sapiens
cgagagtctggccct

SEQ ID NO: 6118219 - DNA, 19 bp, Homo sapiens
cgagagtctggccctagac

SEQ ID NO: 6118220 - DNA, 21 bp, Homo sapiens
cgagataccatctcacaccag

SEQ ID NO: 6118221 - DNA, 20 bp, Homo sapiens
cgagataccccacctccctc

SEQ ID NO: 6118222 - DNA, 16 bp, Homo sapiens
cgagataggggagggg

SEQ ID NO: 6118223 - DNA, 21 bp, Homo sapiens
cgagatagggggaagacagat

SEQ ID NO: 6118224 - DNA, 17 bp, Homo sapiens
cgagatcacgccactgc

SEQ ID NO: 6118225 - DNA, 20 bp, Homo sapiens
cgagatcacgccactgcact

SEQ ID NO: 6118226 - DNA, 19 bp, Homo sapiens
cgagatcagtatttaacta

SEQ ID NO: 6118227 - DNA, 13 bp, Homo sapiens
cgagatcccaaca

SEQ ID NO: 6118228 - DNA, 15 bp, Homo sapiens
cgagatcccatctct

SEQ ID NO: 6118229 - DNA, 18 bp, Homo sapiens
cgagatcgggaagcagaa

SEQ ID NO: 6118230 - DNA, 19 bp, Homo sapiens
cgagatcggggtggcagaa

SEQ ID NO: 6118231 - DNA, 15 bp, Homo sapiens
cgagatctcaggagc

SEQ ID NO: 6118232 - DNA, 16 bp, Homo sapiens
cgagatgtgacccacc

SEQ ID NO: 6118233 - DNA, 21 bp, Homo sapiens
cgagatgtgacccaccagtgc

SEQ ID NO: 6118234 - DNA, 16 bp, Homo sapiens
cgagatgtgagtcctg

SEQ ID NO: 6118235 - DNA, 21 bp, Homo sapiens
cgagattatcgttttcttaaa

SEQ ID NO: 6118236 - DNA, 18 bp, Homo sapiens
cgagattcagactgcttc

SEQ ID NO: 6118237 - DNA, 14 bp, Homo sapiens
cgagattgcaccac

SEQ ID NO: 6118238 - DNA, 18 bp, Homo sapiens
cgagattgcaccactgca

SEQ ID NO: 6118239 - DNA, 20 bp, Homo sapiens
cgagattgcaccactgcact

SEQ ID NO: 6118240 - DNA, 16 bp, Homo sapiens
cgagattgctggaaac

SEQ ID NO: 6118241 - DNA, 13 bp, Homo sapiens
cgagatttctttt

SEQ ID NO: 6118242 - DNA, 23 bp, Homo sapiens
cgagatttgccaggggcatccaa

SEQ ID NO: 6118243 - DNA, 15 bp, Homo sapiens
cgagcaaacccagag

SEQ ID NO: 6118244 - DNA, 15 bp, Homo sapiens
cgagcaaagatcaaa

SEQ ID NO: 6118245 - DNA, 20 bp, Homo sapiens
cgagcaaagatcaaaataaa

SEQ ID NO: 6118246 - DNA, 23 bp, Homo sapiens
cgagcaaagatcaaaataaaaag

SEQ ID NO: 6118247 - DNA, 13 bp, Homo sapiens
cgagcaacagtgc

SEQ ID NO: 6118248 - DNA, 14 bp, Homo sapiens
cgagcaaccgtggc

SEQ ID NO: 6118249 - DNA, 18 bp, Homo sapiens
cgagcacatagagctttt

SEQ ID NO: 6118250 - DNA, 23 bp, Homo sapiens
cgagcacatagagctttttaata

SEQ ID NO: 6118251 - DNA, 18 bp, Homo sapiens
cgagcacctccagcctga

SEQ ID NO: 6118252 - DNA, 22 bp, Homo sapiens
cgagcactctaattagagaact

SEQ ID NO: 6118253 - DNA, 16 bp, Homo sapiens
cgagcactggccagag

SEQ ID NO: 6118254 - DNA, 21 bp, Homo sapiens
cgagcagacacccttggagct

SEQ ID NO: 6118255 - DNA, 18 bp, Homo sapiens
cgagcagagcgcagcccc

SEQ ID NO: 6118256 - DNA, 20 bp, Homo sapiens
cgagcagagcgcagccccca

SEQ ID NO: 6118257 - DNA, 21 bp, Homo sapiens
cgagcagagcgcagcccccac

SEQ ID NO: 6118258 - DNA, 22 bp, Homo sapiens
cgagcagagcgcagcccccacg

SEQ ID NO: 6118259 - DNA, 14 bp, Homo sapiens
cgagcagcccaggg

SEQ ID NO: 6118260 - DNA, 17 bp, Homo sapiens
cgagcagcccagggcct

SEQ ID NO: 6118261 - DNA, 11 bp, Homo sapiens
cgagcagctga

SEQ ID NO: 6118262 - DNA, 13 bp, Homo sapiens
cgagcagctgagc

SEQ ID NO: 6118263 - DNA, 14 bp, Homo sapiens
cgagcagctgagca

SEQ ID NO: 6118264 - DNA, 20 bp, Homo sapiens
cgagcaggcttcttcccccc

SEQ ID NO: 6118265 - DNA, 18 bp, Homo sapiens
cgagcatgcctggatggg

SEQ ID NO: 6118266 - DNA, 18 bp, Homo sapiens
cgagcatgcggagccagc

SEQ ID NO: 6118267 - DNA, 22 bp, Homo sapiens
cgagcatgcggagccagcaggc

SEQ ID NO: 6118268 - DNA, 18 bp, Homo sapiens
cgagcatgggggctgcca

SEQ ID NO: 6118269 - DNA, 19 bp, Homo sapiens
cgagcatgggggctgccag

SEQ ID NO: 6118270 - DNA, 12 bp, Homo sapiens
cgagcatttccc

SEQ ID NO: 6118271 - DNA, 21 bp, Homo sapiens
cgagccaactctaacaggcac

SEQ ID NO: 6118272 - DNA, 17 bp, Homo sapiens
cgagccacaagctgcac

SEQ ID NO: 6118273 - DNA, 22 bp, Homo sapiens
cgagccacaagctgcactgtga

SEQ ID NO: 6118274 - DNA, 15 bp, Homo sapiens
cgagccacaggaacg

SEQ ID NO: 6118275 - DNA, 17 bp, Homo sapiens
cgagccacgcagtgcct

SEQ ID NO: 6118276 - DNA, 23 bp, Homo sapiens
cgagccatttgtcccaagtgcca

SEQ ID NO: 6118277 - DNA, 21 bp, Homo sapiens
cgagcccacaccatctggccc

SEQ ID NO: 6118278 - DNA, 16 bp, Homo sapiens
cgagcccagacctccc

SEQ ID NO: 6118279 - DNA, 22 bp, Homo sapiens
cgagcccagacctcccctcttc

SEQ ID NO: 6118280 - DNA, 15 bp, Homo sapiens
cgagcccaggcagct

SEQ ID NO: 6118281 - DNA, 19 bp, Homo sapiens
cgagccccacagagcagga

SEQ ID NO: 6118282 - DNA, 20 bp, Homo sapiens
cgagcccctcggctctggag

SEQ ID NO: 6118283 - DNA, 11 bp, Homo sapiens
cgagcccctgc

SEQ ID NO: 6118284 - DNA, 12 bp, Homo sapiens
cgagccctgact

SEQ ID NO: 6118285 - DNA, 17 bp, Homo sapiens
cgagccctgactcctgg

SEQ ID NO: 6118286 - DNA, 13 bp, Homo sapiens
ctcacctcagagc

SEQ ID NO: 6118287 - DNA, 20 bp, Homo sapiens
ctcacctcagagcagggcca

SEQ ID NO: 6118288 - DNA, 21 bp, Homo sapiens
ctcacctcaggaccccagagg

SEQ ID NO: 6118289 - DNA, 22 bp, Homo sapiens
ctcacctcaggaccccagaggg

SEQ ID NO: 6118290 - DNA, 14 bp, Homo sapiens
ctcacctcatgccc

SEQ ID NO: 6118291 - DNA, 23 bp, Homo sapiens
ctcacctcatgcccaccccctgc

SEQ ID NO: 6118292 - DNA, 23 bp, Homo sapiens
ctcacctccatccccctctgtct

SEQ ID NO: 6118293 - DNA, 13 bp, Homo sapiens
ctcacctcccagg

SEQ ID NO: 6118294 - DNA, 18 bp, Homo sapiens
ctcacctcccagggctac

SEQ ID NO: 6118295 - DNA, 19 bp, Homo sapiens
ctcacctcccagggctaca

SEQ ID NO: 6118296 - DNA, 19 bp, Homo sapiens
ctcacctcccgaagccacc

SEQ ID NO: 6118297 - DNA, 12 bp, Homo sapiens
ctcacctcctcc

SEQ ID NO: 6118298 - DNA, 16 bp, Homo sapiens
ctcacctctaaaacag

SEQ ID NO: 6118299 - DNA, 13 bp, Homo sapiens
ctcacctctaccc

SEQ ID NO: 6118300 - DNA, 15 bp, Homo sapiens
ctcacctctacccaa

SEQ ID NO: 6118301 - DNA, 18 bp, Homo sapiens
ctcacctctacccaaacc

SEQ ID NO: 6118302 - DNA, 20 bp, Homo sapiens
ctcacctctaggcctcagtg

SEQ ID NO: 6118303 - DNA, 17 bp, Homo sapiens
ctcacctctccaggtgc

SEQ ID NO: 6118304 - DNA, 18 bp, Homo sapiens
ctcacctctccaggtgct

SEQ ID NO: 6118305 - DNA, 14 bp, Homo sapiens
ctcacctctccctt

SEQ ID NO: 6118306 - DNA, 15 bp, Homo sapiens
ctcacctctctctaa

SEQ ID NO: 6118307 - DNA, 12 bp, Homo sapiens
ctcacctctgcc

SEQ ID NO: 6118308 - DNA, 13 bp, Homo sapiens
ctcacctctgcct

SEQ ID NO: 6118309 - DNA, 18 bp, Homo sapiens
ctcacctctgcctcaatg

SEQ ID NO: 6118310 - DNA, 22 bp, Homo sapiens
ctcacctctggactggctagag

SEQ ID NO: 6118311 - DNA, 12 bp, Homo sapiens
ctcacctgacat

SEQ ID NO: 6118312 - DNA, 13 bp, Homo sapiens
ctcacctgcagcc

SEQ ID NO: 6118313 - DNA, 14 bp, Homo sapiens
ctcacctgcagccc

SEQ ID NO: 6118314 - DNA, 13 bp, Homo sapiens
ctcacctgcatcc

SEQ ID NO: 6118315 - DNA, 16 bp, Homo sapiens
ctcacctgcatcctct

SEQ ID NO: 6118316 - DNA, 14 bp, Homo sapiens
ctcacctgcccctc

SEQ ID NO: 6118317 - DNA, 17 bp, Homo sapiens
ctcacctgcccctctgt

SEQ ID NO: 6118318 - DNA, 19 bp, Homo sapiens
ctcacctgcccctctgttc

SEQ ID NO: 6118319 - DNA, 14 bp, Homo sapiens
ctcacctgccggct

SEQ ID NO: 6118320 - DNA, 17 bp, Homo sapiens
ctcacctgccggctctg

SEQ ID NO: 6118321 - DNA, 21 bp, Homo sapiens
ctcacctgcgcaagtgcctgg

SEQ ID NO: 6118322 - DNA, 13 bp, Homo sapiens
ctcacctggactt

SEQ ID NO: 6118323 - DNA, 22 bp, Homo sapiens
ctcacctggaggcaagagggag

SEQ ID NO: 6118324 - DNA, 13 bp, Homo sapiens
ctcacctggcttc

SEQ ID NO: 6118325 - DNA, 20 bp, Homo sapiens
ctcacctgggcacctgggga

SEQ ID NO: 6118326 - DNA, 15 bp, Homo sapiens
ctcacctgggccttt

SEQ ID NO: 6118327 - DNA, 17 bp, Homo sapiens
ctcacctggggctgctg

SEQ ID NO: 6118328 - DNA, 12 bp, Homo sapiens
ctcacctggggt

SEQ ID NO: 6118329 - DNA, 21 bp, Homo sapiens
ctcacctggggtgtgggaggc

SEQ ID NO: 6118330 - DNA, 13 bp, Homo sapiens
ctcacctggttga

SEQ ID NO: 6118331 - DNA, 17 bp, Homo sapiens
ctcacctggttgaccca

SEQ ID NO: 6118332 - DNA, 22 bp, Homo sapiens
ctcacctgtctaggtctcctca

SEQ ID NO: 6118333 - DNA, 16 bp, Homo sapiens
ctcaccttaactcagc

SEQ ID NO: 6118334 - DNA, 15 bp, Homo sapiens
ctcaccttcctgtgg

SEQ ID NO: 6118335 - DNA, 16 bp, Homo sapiens
ctcaccttcgcctttg

SEQ ID NO: 6118336 - DNA, 17 bp, Homo sapiens
ctcaccttcgcctttgc

SEQ ID NO: 6118337 - DNA, 16 bp, Homo sapiens
ctcaccttggcaccag

SEQ ID NO: 6118338 - DNA, 13 bp, Homo sapiens
ctcaccttgggct

SEQ ID NO: 6118339 - DNA, 18 bp, Homo sapiens
ctcaccttgggctggggg

SEQ ID NO: 6118340 - DNA, 14 bp, Homo sapiens
ctcaccttggggcc

SEQ ID NO: 6118341 - DNA, 16 bp, Homo sapiens
ctcaccttggttcctg

SEQ ID NO: 6118342 - DNA, 17 bp, Homo sapiens
ctcaccttgtaaccagt

SEQ ID NO: 6118343 - DNA, 17 bp, Homo sapiens
ctcacctttcccatctt

SEQ ID NO: 6118344 - DNA, 23 bp, Homo sapiens
ctcacctttgcaaagttacagat

SEQ ID NO: 6118345 - DNA, 14 bp, Homo sapiens
ctcacctttgtttt

SEQ ID NO: 6118346 - DNA, 16 bp, Homo sapiens
ctcacgaaactggaat

SEQ ID NO: 6118347 - DNA, 19 bp, Homo sapiens
ctcacgaaagtatttactt

SEQ ID NO: 6118348 - DNA, 20 bp, Homo sapiens
ctcacgaatattatgcccag

SEQ ID NO: 6118349 - DNA, 19 bp, Homo sapiens
ctcacgactcttcctgcaa

SEQ ID NO: 6118350 - DNA, 18 bp, Homo sapiens
ctcacgagatttgccagg

SEQ ID NO: 6118351 - DNA, 13 bp, Homo sapiens
ctcacgattccag

SEQ ID NO: 6118352 - DNA, 18 bp, Homo sapiens
ctcacgattccagtgcag

SEQ ID NO: 6118353 - DNA, 18 bp, Homo sapiens
ctcacgcaactcacacct

SEQ ID NO: 6118354 - DNA, 13 bp, Homo sapiens
ctcacgcaggctg

SEQ ID NO: 6118355 - DNA, 15 bp, Homo sapiens
ctcacgcattctctg

SEQ ID NO: 6118356 - DNA, 19 bp, Homo sapiens
ctcacgcccttcaatgctg

SEQ ID NO: 6118357 - DNA, 18 bp, Homo sapiens
ctcacgcctgtaatccca

SEQ ID NO: 6118358 - DNA, 19 bp, Homo sapiens
ctcacgcctgtaatcccag

SEQ ID NO: 6118359 - DNA, 22 bp, Homo sapiens
ctcacgcctgtaatcccagcac

SEQ ID NO: 6118360 - DNA, 14 bp, Homo sapiens
ctcacgccttggcc

SEQ ID NO: 6118361 - DNA, 13 bp, Homo sapiens
ctcacgctctcca

SEQ ID NO: 6118362 - DNA, 15 bp, Homo sapiens
ctcacgctctggaca

SEQ ID NO: 6118363 - DNA, 20 bp, Homo sapiens
ctcacgctgacagcctccta

SEQ ID NO: 6118364 - DNA, 21 bp, Homo sapiens
ctcacgctgacagcctcctag

SEQ ID NO: 6118365 - DNA, 14 bp, Homo sapiens
ctcacgctgccatt

SEQ ID NO: 6118366 - DNA, 22 bp, Homo sapiens
ctcacggaccactcgaggcctg

SEQ ID NO: 6118367 - DNA, 15 bp, Homo sapiens
ctcacggctgcacct

SEQ ID NO: 6118368 - DNA, 16 bp, Homo sapiens
ctcacggctgcacctg

SEQ ID NO: 6118369 - DNA, 17 bp, Homo sapiens
ctcacgggcatgggcac

SEQ ID NO: 6118370 - DNA, 14 bp, Homo sapiens
ctcacggggcctcc

SEQ ID NO: 6118371 - DNA, 17 bp, Homo sapiens
ctcacgtaatgcattgc

SEQ ID NO: 6118372 - DNA, 20 bp, Homo sapiens
ctcacgtaatgcattgcctg

SEQ ID NO: 6118373 - DNA, 14 bp, Homo sapiens
ctcacgtcaaatgc

SEQ ID NO: 6118374 - DNA, 16 bp, Homo sapiens
ctcacgtccaggttca

SEQ ID NO: 6118375 - DNA, 15 bp, Homo sapiens
ctcacgtcctgagaa

SEQ ID NO: 6118376 - DNA, 12 bp, Homo sapiens
ctcacgtctctg

SEQ ID NO: 6118377 - DNA, 21 bp, Homo sapiens
ctcacgtctgtgagtctgtcc

SEQ ID NO: 6118378 - DNA, 17 bp, Homo sapiens
ctcacgtgaccagcccc

SEQ ID NO: 6118379 - DNA, 16 bp, Homo sapiens
ctcacgtgagagtgtc

SEQ ID NO: 6118380 - DNA, 14 bp, Homo sapiens
ctcacgtgtcctta

SEQ ID NO: 6118381 - DNA, 17 bp, Homo sapiens
ctcacgtttcttcccca

SEQ ID NO: 6118382 - DNA, 14 bp, Homo sapiens
ctcactaaagcatg

SEQ ID NO: 6118383 - DNA, 19 bp, Homo sapiens
ctcactaaagcatgaaatg

SEQ ID NO: 6118384 - DNA, 14 bp, Homo sapiens
ctcactaagccccg

SEQ ID NO: 6118385 - DNA, 13 bp, Homo sapiens
ctcactaattttt

SEQ ID NO: 6118386 - DNA, 23 bp, Homo sapiens
ctcactaatttttgtattatttt

SEQ ID NO: 6118387 - DNA, 16 bp, Homo sapiens
ctcactacatgggcca

SEQ ID NO: 6118388 - DNA, 18 bp, Homo sapiens
ctcactacatgggccagc

SEQ ID NO: 6118389 - DNA, 20 bp, Homo sapiens
ctcactacatgggccagccc

SEQ ID NO: 6118390 - DNA, 23 bp, Homo sapiens
ctcactacatgggccagcccttg

SEQ ID NO: 6118391 - DNA, 17 bp, Homo sapiens
ctcactaccgtggacca

SEQ ID NO: 6118392 - DNA, 15 bp, Homo sapiens
ctcactacctcctca

SEQ ID NO: 6118393 - DNA, 18 bp, Homo sapiens
ctcactacctcctcaggg

SEQ ID NO: 6118394 - DNA, 16 bp, Homo sapiens
ctcactactgaacaca

SEQ ID NO: 6118395 - DNA, 15 bp, Homo sapiens
ctcactagaatattc

SEQ ID NO: 6118396 - DNA, 13 bp, Homo sapiens
ctcactagctccc

SEQ ID NO: 6118397 - DNA, 14 bp, Homo sapiens
ctcactagctcccc

SEQ ID NO: 6118398 - DNA, 18 bp, Homo sapiens
ctcactaggctaaactca

SEQ ID NO: 6118399 - DNA, 14 bp, Homo sapiens
ctcactagtgccaa

SEQ ID NO: 6118400 - DNA, 15 bp, Homo sapiens
ctcactagtgccaat

SEQ ID NO: 6118401 - DNA, 22 bp, Homo sapiens
ctcactagtgtcaggcccccag

SEQ ID NO: 6118402 - DNA, 21 bp, Homo sapiens
ctcactatcccggctgccctt

SEQ ID NO: 6118403 - DNA, 17 bp, Homo sapiens
ctcactatcctacccca

SEQ ID NO: 6118404 - DNA, 16 bp, Homo sapiens
ctcactatctagggag

SEQ ID NO: 6118405 - DNA, 22 bp, Homo sapiens
ctcactatgaatctattatact

SEQ ID NO: 6118406 - DNA, 11 bp, Homo sapiens
ctcactatgac

SEQ ID NO: 6118407 - DNA, 19 bp, Homo sapiens
ctcactatgctgctatgga

SEQ ID NO: 6118408 - DNA, 15 bp, Homo sapiens
ctcactatggtgcca

SEQ ID NO: 6118409 - DNA, 17 bp, Homo sapiens
ctcactatggtgccaat

SEQ ID NO: 6118410 - DNA, 16 bp, Homo sapiens
ctcactatgttgccca

SEQ ID NO: 6118411 - DNA, 21 bp, Homo sapiens
ctcactatgttgcccaggcag

SEQ ID NO: 6118412 - DNA, 15 bp, Homo sapiens
ctcactatgtttctc

SEQ ID NO: 6118413 - DNA, 17 bp, Homo sapiens
ctcactatgtttctcag

SEQ ID NO: 6118414 - DNA, 20 bp, Homo sapiens
ctcactattacttgaacttt

SEQ ID NO: 6118415 - DNA, 22 bp, Homo sapiens
ctcactattcttggaccatgcc

SEQ ID NO: 6118416 - DNA, 15 bp, Homo sapiens
ctcactcaagaccag

SEQ ID NO: 6118417 - DNA, 21 bp, Homo sapiens
ctcactcaagttcaaggacca

SEQ ID NO: 6118418 - DNA, 16 bp, Homo sapiens
ctcactcacagagtca

SEQ ID NO: 6118419 - DNA, 13 bp, Homo sapiens
ctcactcacattt

SEQ ID NO: 6118420 - DNA, 14 bp, Homo sapiens
ctcactcaccttca

SEQ ID NO: 6118421 - DNA, 16 bp, Homo sapiens
ctcactcactcattcc

SEQ ID NO: 6118422 - DNA, 17 bp, Homo sapiens
ctcactcactccaagac

SEQ ID NO: 6118423 - DNA, 12 bp, Homo sapiens
ctcactcactct

SEQ ID NO: 6118424 - DNA, 15 bp, Homo sapiens
ctcactcactgttta

SEQ ID NO: 6118425 - DNA, 21 bp, Homo sapiens
ctcactcagaagtccagagtc

SEQ ID NO: 6118426 - DNA, 13 bp, Homo sapiens
ctcactcagcacc

SEQ ID NO: 6118427 - DNA, 14 bp, Homo sapiens
ctcactcagcactt

SEQ ID NO: 6118428 - DNA, 21 bp, Homo sapiens
ctcactcagccaccctgagtt

SEQ ID NO: 6118429 - DNA, 19 bp, Homo sapiens
ctcactcaggaaccctgga

SEQ ID NO: 6118430 - DNA, 12 bp, Homo sapiens
ctcactcaggac

SEQ ID NO: 6118431 - DNA, 20 bp, Homo sapiens
ctcactccaagaccaccagg

SEQ ID NO: 6118432 - DNA, 22 bp, Homo sapiens
ctcactccaagaccaccagggt

SEQ ID NO: 6118433 - DNA, 14 bp, Homo sapiens
ctcactccaccacc

SEQ ID NO: 6118434 - DNA, 15 bp, Homo sapiens
ctcactccactcccc

SEQ ID NO: 6118435 - DNA, 14 bp, Homo sapiens
ctcactccagccca

SEQ ID NO: 6118436 - DNA, 14 bp, Homo sapiens
ctcactccattcct

SEQ ID NO: 6118437 - DNA, 16 bp, Homo sapiens
ctcactccatttccca

SEQ ID NO: 6118438 - DNA, 21 bp, Homo sapiens
ctcactccatttcccacttcc

SEQ ID NO: 6118439 - DNA, 20 bp, Homo sapiens
ctcactcccaagggacagca

SEQ ID NO: 6118440 - DNA, 14 bp, Homo sapiens
ctcactcccacctg

SEQ ID NO: 6118441 - DNA, 15 bp, Homo sapiens
ctcactcccagtcca

SEQ ID NO: 6118442 - DNA, 12 bp, Homo sapiens
ctcactccccac

SEQ ID NO: 6118443 - DNA, 16 bp, Homo sapiens
ctcactccccactccc

SEQ ID NO: 6118444 - DNA, 13 bp, Homo sapiens
ctcactccccagc

SEQ ID NO: 6118445 - DNA, 19 bp, Homo sapiens
ctcactccccagggagctc

SEQ ID NO: 6118446 - DNA, 22 bp, Homo sapiens
ctcactccccagggagctctgg

SEQ ID NO: 6118447 - DNA, 19 bp, Homo sapiens
ctcactccccatgccacgt

SEQ ID NO: 6118448 - DNA, 14 bp, Homo sapiens
ctcactccctaggc

SEQ ID NO: 6118449 - DNA, 17 bp, Homo sapiens
ctcactccctaggccca

SEQ ID NO: 6118450 - DNA, 15 bp, Homo sapiens
ctcactccctctgca

SEQ ID NO: 6118451 - DNA, 17 bp, Homo sapiens
ctcactccctctgcaga

SEQ ID NO: 6118452 - DNA, 15 bp, Homo sapiens
ctcactccctgggaa

SEQ ID NO: 6118453 - DNA, 22 bp, Homo sapiens
ctcactcccttctacctgccac

SEQ ID NO: 6118454 - DNA, 17 bp, Homo sapiens
ctcactcccttctcctt

SEQ ID NO: 6118455 - DNA, 22 bp, Homo sapiens
ctcactcctgagacccctggcc

SEQ ID NO: 6118456 - DNA, 13 bp, Homo sapiens
ctcactcctgagt

SEQ ID NO: 6118457 - DNA, 12 bp, Homo sapiens
ctcactcctgtt

SEQ ID NO: 6118458 - DNA, 14 bp, Homo sapiens
ctcactcgtctccc

SEQ ID NO: 6118459 - DNA, 16 bp, Homo sapiens
ctcactctagtgataa

SEQ ID NO: 6118460 - DNA, 14 bp, Homo sapiens
ctcactctcaggaa

SEQ ID NO: 6118461 - DNA, 22 bp, Homo sapiens
ctcactctccccagtcctcagg

SEQ ID NO: 6118462 - DNA, 16 bp, Homo sapiens
ctcactctcttccttt

SEQ ID NO: 6118463 - DNA, 12 bp, Homo sapiens
ctcactctgcca

SEQ ID NO: 6118464 - DNA, 13 bp, Homo sapiens
ctcactctgccag

SEQ ID NO: 6118465 - DNA, 14 bp, Homo sapiens
ctcactctgccagg

SEQ ID NO: 6118466 - DNA, 18 bp, Homo sapiens
ctcactctgccagggcag

SEQ ID NO: 6118467 - DNA, 21 bp, Homo sapiens
ctcactctggcagcctcagag

SEQ ID NO: 6118468 - DNA, 14 bp, Homo sapiens
ctcactctggcccc

SEQ ID NO: 6118469 - DNA, 12 bp, Homo sapiens
ctcactctgggc

SEQ ID NO: 6118470 - DNA, 15 bp, Homo sapiens
ctcactctgggctgt

SEQ ID NO: 6118471 - DNA, 14 bp, Homo sapiens
ctcactctgtcagc

SEQ ID NO: 6118472 - DNA, 18 bp, Homo sapiens
ctcactctgtcagccagc

SEQ ID NO: 6118473 - DNA, 19 bp, Homo sapiens
ctcactctgtcagccagcc

SEQ ID NO: 6118474 - DNA, 12 bp, Homo sapiens
ctcactctgtcg

SEQ ID NO: 6118475 - DNA, 21 bp, Homo sapiens
ctcactctgtcgcccagtctg

SEQ ID NO: 6118476 - DNA, 23 bp, Homo sapiens
ctcactctgtcgctcaggctgga

SEQ ID NO: 6118477 - DNA, 12 bp, Homo sapiens
ctcactctgttg

SEQ ID NO: 6118478 - DNA, 21 bp, Homo sapiens
ctcactctgttgaccaggctg

SEQ ID NO: 6118479 - DNA, 13 bp, Homo sapiens
ctcactcttcctc

SEQ ID NO: 6118480 - DNA, 16 bp, Homo sapiens
ctcactcttctgtctt

SEQ ID NO: 6118481 - DNA, 20 bp, Homo sapiens
ctcactcttctgtcttgtcc

SEQ ID NO: 6118482 - DNA, 19 bp, Homo sapiens
ctcactcttgaagtccagg

SEQ ID NO: 6118483 - DNA, 19 bp, Homo sapiens
ctcactctttcttctctct

SEQ ID NO: 6118484 - DNA, 15 bp, Homo sapiens
ctcactgaactccac

SEQ ID NO: 6118485 - DNA, 17 bp, Homo sapiens
ctcactgaactccaccg

SEQ ID NO: 6118486 - DNA, 22 bp, Homo sapiens
ctcactgaactccttccccact

SEQ ID NO: 6118487 - DNA, 15 bp, Homo sapiens
ctcactgaagcctgc

SEQ ID NO: 6118488 - DNA, 14 bp, Homo sapiens
ctcactgaagctca

SEQ ID NO: 6118489 - DNA, 19 bp, Homo sapiens
ctcactgaaggacctgagc

SEQ ID NO: 6118490 - DNA, 20 bp, Homo sapiens
ctcactgaaggacctgagct

SEQ ID NO: 6118491 - DNA, 22 bp, Homo sapiens
ctcactgaaggacctgagctgg

SEQ ID NO: 6118492 - DNA, 15 bp, Homo sapiens
ctcactgacacagga

SEQ ID NO: 6118493 - DNA, 15 bp, Homo sapiens
ctcactgacttctcc

SEQ ID NO: 6118494 - DNA, 20 bp, Homo sapiens
ctcactgagaaggccccagg

SEQ ID NO: 6118495 - DNA, 22 bp, Homo sapiens
ctcactgagaaggccccagggc

SEQ ID NO: 6118496 - DNA, 12 bp, Homo sapiens
ctcactgagagg

SEQ ID NO: 6118497 - DNA, 17 bp, Homo sapiens
ctcactgagcactgttt

SEQ ID NO: 6118498 - DNA, 18 bp, Homo sapiens
ctcactgaggaagggaga

SEQ ID NO: 6118499 - DNA, 13 bp, Homo sapiens
ctcactgaggcca

SEQ ID NO: 6118500 - DNA, 19 bp, Homo sapiens
ctcactgaggccatcaggg

SEQ ID NO: 6118501 - DNA, 22 bp, Homo sapiens
ctcactgaggccatcagggccc

SEQ ID NO: 6118502 - DNA, 23 bp, Homo sapiens
ctcactgaggccatcagggccct

SEQ ID NO: 6118503 - DNA, 15 bp, Homo sapiens
ctcactgagtgatac

SEQ ID NO: 6118504 - DNA, 15 bp, Homo sapiens
ctcactgatatattt

SEQ ID NO: 6118505 - DNA, 17 bp, Homo sapiens
ctcactgcaacctccac

SEQ ID NO: 6118506 - DNA, 23 bp, Homo sapiens
ctcactgcaacctccacctccca

SEQ ID NO: 6118507 - DNA, 17 bp, Homo sapiens
ctcactgcaatctctgc

SEQ ID NO: 6118508 - DNA, 11 bp, Homo sapiens
ctcactgcagc

SEQ ID NO: 6118509 - DNA, 12 bp, Homo sapiens
ctcactgcagcc

SEQ ID NO: 6118510 - DNA, 14 bp, Homo sapiens
ctcactgcagcctc

SEQ ID NO: 6118511 - DNA, 15 bp, Homo sapiens
ctcactgcagcctca

SEQ ID NO: 6118512 - DNA, 16 bp, Homo sapiens
ctcactgcagcctcaa

SEQ ID NO: 6118513 - DNA, 22 bp, Homo sapiens
ctcactgcagcctcaacctcct

SEQ ID NO: 6118514 - DNA, 18 bp, Homo sapiens
ctcactgcagcctcagcg

SEQ ID NO: 6118515 - DNA, 21 bp, Homo sapiens
ctcactgcagcctcagcgtcc

SEQ ID NO: 6118516 - DNA, 16 bp, Homo sapiens
ctcactgcagcctccg

SEQ ID NO: 6118517 - DNA, 17 bp, Homo sapiens
ctcactgcagcctccgc

SEQ ID NO: 6118518 - DNA, 15 bp, Homo sapiens
ctcactgcagcctct

SEQ ID NO: 6118519 - DNA, 19 bp, Homo sapiens
ctcactgcagccttgtcct

SEQ ID NO: 6118520 - DNA, 15 bp, Homo sapiens
ctcactgcaggcatg

SEQ ID NO: 6118521 - DNA, 18 bp, Homo sapiens
ctcactgcagtcttattt

SEQ ID NO: 6118522 - DNA, 22 bp, Homo sapiens
ctcactgcatcctctgcctccc

SEQ ID NO: 6118523 - DNA, 12 bp, Homo sapiens
ctcactgcattt

SEQ ID NO: 6118524 - DNA, 13 bp, Homo sapiens
ctcactgccaggc

SEQ ID NO: 6118525 - DNA, 15 bp, Homo sapiens
ctcactgccaggcca

SEQ ID NO: 6118526 - DNA, 21 bp, Homo sapiens
ctcactgccaggccagcctcc

SEQ ID NO: 6118527 - DNA, 13 bp, Homo sapiens
ctcactgccccac

SEQ ID NO: 6118528 - DNA, 18 bp, Homo sapiens
ctcactgcccgcacaccc

SEQ ID NO: 6118529 - DNA, 12 bp, Homo sapiens
ctcactgccctc

SEQ ID NO: 6118530 - DNA, 17 bp, Homo sapiens
ctcactgccctccctcg

SEQ ID NO: 6118531 - DNA, 19 bp, Homo sapiens
ctcactgcctaggaggctg

SEQ ID NO: 6118532 - DNA, 14 bp, Homo sapiens
ctcactgcctcccc

SEQ ID NO: 6118533 - DNA, 17 bp, Homo sapiens
ctcactgcctgcagctg

SEQ ID NO: 6118534 - DNA, 19 bp, Homo sapiens
ctcactgcctgcagctgag

SEQ ID NO: 6118535 - DNA, 17 bp, Homo sapiens
ctcactgcctggtaaaa

SEQ ID NO: 6118536 - DNA, 14 bp, Homo sapiens
ctcactgccttcca

SEQ ID NO: 6118537 - DNA, 20 bp, Homo sapiens
ctcactgcctttgtttagaa

SEQ ID NO: 6118538 - DNA, 12 bp, Homo sapiens
ctcactgctcaa

SEQ ID NO: 6118539 - DNA, 16 bp, Homo sapiens
ctcactgctcaagaag

SEQ ID NO: 6118540 - DNA, 19 bp, Homo sapiens
ctcactgctcaagaagaca

SEQ ID NO: 6118541 - DNA, 19 bp, Homo sapiens
ctcactgctccctgaagcc

SEQ ID NO: 6118542 - DNA, 20 bp, Homo sapiens
ctcactgctccctgaagcca

SEQ ID NO: 6118543 - DNA, 20 bp, Homo sapiens
ctcactgctggggagtccct

SEQ ID NO: 6118544 - DNA, 21 bp, Homo sapiens
ctcactgctgtgagtgcgcct

SEQ ID NO: 6118545 - DNA, 22 bp, Homo sapiens
ctcactgctgtgagtgcgcctc

SEQ ID NO: 6118546 - DNA, 14 bp, Homo sapiens
ctcactggaggagc

SEQ ID NO: 6118547 - DNA, 18 bp, Homo sapiens
ctcactggcagccccagc

SEQ ID NO: 6118548 - DNA, 19 bp, Homo sapiens
ctcactggcagccccagca

SEQ ID NO: 6118549 - DNA, 12 bp, Homo sapiens
ctcactggcagg

SEQ ID NO: 6118550 - DNA, 16 bp, Homo sapiens
ctcactggcaggtgtg

SEQ ID NO: 6118551 - DNA, 12 bp, Homo sapiens
ctcactggccag

SEQ ID NO: 6118552 - DNA, 14 bp, Homo sapiens
ctcactggccatcc

SEQ ID NO: 6118553 - DNA, 15 bp, Homo sapiens
ctcactggctcatgc

SEQ ID NO: 6118554 - DNA, 18 bp, Homo sapiens
ctcactggctctcctggc

SEQ ID NO: 6118555 - DNA, 12 bp, Homo sapiens
ctcactggctgg

SEQ ID NO: 6118556 - DNA, 16 bp, Homo sapiens
ctcactggctggggca

SEQ ID NO: 6118557 - DNA, 14 bp, Homo sapiens
ctcactgggctcac

SEQ ID NO: 6118558 - DNA, 17 bp, Homo sapiens
ctcactgggctcactgc

SEQ ID NO: 6118559 - DNA, 13 bp, Homo sapiens
ctcactgggggct

SEQ ID NO: 6118560 - DNA, 17 bp, Homo sapiens
ctcactggggtcctggg

SEQ ID NO: 6118561 - DNA, 22 bp, Homo sapiens
ctcactggggtcctggggcctc

SEQ ID NO: 6118562 - DNA, 16 bp, Homo sapiens
ctcactgggtgtggcc

SEQ ID NO: 6118563 - DNA, 21 bp, Homo sapiens
ctcactggtccatttctcagt

SEQ ID NO: 6118564 - DNA, 22 bp, Homo sapiens
ctcactggtccatttctcagtg

SEQ ID NO: 6118565 - DNA, 15 bp, Homo sapiens
ctcactggtctacac

SEQ ID NO: 6118566 - DNA, 15 bp, Homo sapiens
ctcactggtgcattt

SEQ ID NO: 6118567 - DNA, 17 bp, Homo sapiens
ctcactggtgcatttaa

SEQ ID NO: 6118568 - DNA, 21 bp, Homo sapiens
ctcactggtgcatttaaaatg

SEQ ID NO: 6118569 - DNA, 16 bp, Homo sapiens
ctcactggtttacaaa

SEQ ID NO: 6118570 - DNA, 17 bp, Homo sapiens
ctcactggtttacaaat

SEQ ID NO: 6118571 - DNA, 23 bp, Homo sapiens
ctcactgtaacctcaaactctgg

SEQ ID NO: 6118572 - DNA, 18 bp, Homo sapiens
ctcactgtcagtcccact

SEQ ID NO: 6118573 - DNA, 13 bp, Homo sapiens
ctcactgtcatct

SEQ ID NO: 6118574 - DNA, 14 bp, Homo sapiens
ctcactgtcatctg

SEQ ID NO: 6118575 - DNA, 16 bp, Homo sapiens
ctcactgtcatctgcc

SEQ ID NO: 6118576 - DNA, 17 bp, Homo sapiens
ctcactgtcatctgcca

SEQ ID NO: 6118577 - DNA, 15 bp, Homo sapiens
ctcactgtcctgtga

SEQ ID NO: 6118578 - DNA, 16 bp, Homo sapiens
ctcactgtctatttaa

SEQ ID NO: 6118579 - DNA, 16 bp, Homo sapiens
ctcactgtgacctgct

SEQ ID NO: 6118580 - DNA, 23 bp, Homo sapiens
ctcactgtgacctgctcctgccc

SEQ ID NO: 6118581 - DNA, 12 bp, Homo sapiens
ctcactgtgatc

SEQ ID NO: 6118582 - DNA, 24 bp, Homo sapiens
ctcactgtgggaaggccagctgcc

SEQ ID NO: 6118583 - DNA, 20 bp, Homo sapiens
ctcactgtgtataggaattt

SEQ ID NO: 6118584 - DNA, 23 bp, Homo sapiens
ctcactgtgtcacccagactgga

SEQ ID NO: 6118585 - DNA, 19 bp, Homo sapiens
ctcactgtgtcacccaggc

SEQ ID NO: 6118586 - DNA, 12 bp, Homo sapiens
ctcactgtgtgt

SEQ ID NO: 6118587 - DNA, 18 bp, Homo sapiens
ctcactgtgttactgctt

SEQ ID NO: 6118588 - DNA, 21 bp, Homo sapiens
ctcactgtgttactgctttgc

SEQ ID NO: 6118589 - DNA, 19 bp, Homo sapiens
ctcactgtgttgcccaggc

SEQ ID NO: 6118590 - DNA, 21 bp, Homo sapiens
ctcactgtgttgcccaggctg

SEQ ID NO: 6118591 - DNA, 16 bp, Homo sapiens
ctcactgttccttctt

SEQ ID NO: 6118592 - DNA, 16 bp, Homo sapiens
ctcactgttctgcaaa

SEQ ID NO: 6118593 - DNA, 19 bp, Homo sapiens
ctcactgttgcagtggcct

SEQ ID NO: 6118594 - DNA, 15 bp, Homo sapiens
ctcactgttgcccag

SEQ ID NO: 6118595 - DNA, 19 bp, Homo sapiens
ctcactgttgcccaggctg

SEQ ID NO: 6118596 - DNA, 20 bp, Homo sapiens
ctcactgttgcccaggctgg

SEQ ID NO: 6118597 - DNA, 21 bp, Homo sapiens
ctcactgttgcccaggctggc

SEQ ID NO: 6118598 - DNA, 19 bp, Homo sapiens
ctcactgtttgtttttatt

SEQ ID NO: 6118599 - DNA, 21 bp, Homo sapiens
ctcacttaccccgagacctca

SEQ ID NO: 6118600 - DNA, 21 bp, Homo sapiens
ctcacttataccaaagggaaa

SEQ ID NO: 6118601 - DNA, 17 bp, Homo sapiens
ctcacttatagagctct

SEQ ID NO: 6118602 - DNA, 21 bp, Homo sapiens
ctcacttatcccaagagaatg

SEQ ID NO: 6118603 - DNA, 14 bp, Homo sapiens
ctcacttattatta

SEQ ID NO: 6118604 - DNA, 20 bp, Homo sapiens
ctcacttcaagctcaccctg

SEQ ID NO: 6118605 - DNA, 14 bp, Homo sapiens
ctcacttcaatgtg

SEQ ID NO: 6118606 - DNA, 12 bp, Homo sapiens
ctcacttcatca

SEQ ID NO: 6118607 - DNA, 20 bp, Homo sapiens
ctcacttccatacagctcta

SEQ ID NO: 6118608 - DNA, 17 bp, Homo sapiens
ctcacttccctgggaac

SEQ ID NO: 6118609 - DNA, 21 bp, Homo sapiens
ctcacttcctaagttcccttc

SEQ ID NO: 6118610 - DNA, 17 bp, Homo sapiens
ctcacttcgcttcctgg

SEQ ID NO: 6118611 - DNA, 18 bp, Homo sapiens
ctcacttctagatctcag

SEQ ID NO: 6118612 - DNA, 15 bp, Homo sapiens
ctcacttctgtctcc

SEQ ID NO: 6118613 - DNA, 18 bp, Homo sapiens
ctcacttctgtctcctgt

SEQ ID NO: 6118614 - DNA, 19 bp, Homo sapiens
ctcacttctgtctcctgtc

SEQ ID NO: 6118615 - DNA, 21 bp, Homo sapiens
ctcacttctgtctcctgtctt

SEQ ID NO: 6118616 - DNA, 16 bp, Homo sapiens
ctcacttgaggaggag

SEQ ID NO: 6118617 - DNA, 23 bp, Homo sapiens
ctcacttgatgtttcctggaagc

SEQ ID NO: 6118618 - DNA, 16 bp, Homo sapiens
ctcacttgattcatct

SEQ ID NO: 6118619 - DNA, 16 bp, Homo sapiens
ctcacttggctgtctg

SEQ ID NO: 6118620 - DNA, 19 bp, Homo sapiens
ctcacttggctgtctgacc

SEQ ID NO: 6118621 - DNA, 20 bp, Homo sapiens
ctcacttggctgtctgacca

SEQ ID NO: 6118622 - DNA, 19 bp, Homo sapiens
ctcacttggtctgccaggc

SEQ ID NO: 6118623 - DNA, 20 bp, Homo sapiens
ctcacttggtctgccaggcc

SEQ ID NO: 6118624 - DNA, 21 bp, Homo sapiens
ctcacttggtgatatgtccta

SEQ ID NO: 6118625 - DNA, 23 bp, Homo sapiens
ctcacttgtggcagcttccctga

SEQ ID NO: 6118626 - DNA, 15 bp, Homo sapiens
ctcacttgtttttct

SEQ ID NO: 6118627 - DNA, 17 bp, Homo sapiens
ctcactttactttcaag

SEQ ID NO: 6118628 - DNA, 21 bp, Homo sapiens
ctcactttattacaagatctt

SEQ ID NO: 6118629 - DNA, 16 bp, Homo sapiens
ctcactttattatccc

SEQ ID NO: 6118630 - DNA, 22 bp, Homo sapiens
ctcactttccaccaagtgtcta

SEQ ID NO: 6118631 - DNA, 24 bp, Homo sapiens
ctcactttccaccctctctccacc

SEQ ID NO: 6118632 - DNA, 20 bp, Homo sapiens
ctcactttcccttgtgtcaa

SEQ ID NO: 6118633 - DNA, 20 bp, Homo sapiens
ctcactttcctcctgaggct

SEQ ID NO: 6118634 - DNA, 13 bp, Homo sapiens
ctcactttcttct

SEQ ID NO: 6118635 - DNA, 14 bp, Homo sapiens
ctcactttcttcta

SEQ ID NO: 6118636 - DNA, 16 bp, Homo sapiens
ctcacttttcacttgt

SEQ ID NO: 6118637 - DNA, 16 bp, Homo sapiens
ctcacttttcatctgg

SEQ ID NO: 6118638 - DNA, 16 bp, Homo sapiens
ctcacttttcccactc

SEQ ID NO: 6118639 - DNA, 13 bp, Homo sapiens
ctcacttttccct

SEQ ID NO: 6118640 - DNA, 21 bp, Homo sapiens
ctcactttttttttttgtttg

SEQ ID NO: 6118641 - DNA, 19 bp, Homo sapiens
ctcagaaaaaggcagtggc

SEQ ID NO: 6118642 - DNA, 19 bp, Homo sapiens
ctcagaaaacaaggatgaa

SEQ ID NO: 6118643 - DNA, 23 bp, Homo sapiens
ctcagaaaacttctcttctgagc

SEQ ID NO: 6118644 - DNA, 18 bp, Homo sapiens
ctcagaaaattccctggg

SEQ ID NO: 6118645 - DNA, 21 bp, Homo sapiens
ctcagaaacgagatcgggaag

SEQ ID NO: 6118646 - DNA, 18 bp, Homo sapiens
cgagccctgactcctgga

SEQ ID NO: 6118647 - DNA, 21 bp, Homo sapiens
cgagccctgactcctggactc

SEQ ID NO: 6118648 - DNA, 15 bp, Homo sapiens
cgagccctgcagcca

SEQ ID NO: 6118649 - DNA, 13 bp, Homo sapiens
cgagcccttagcc

SEQ ID NO: 6118650 - DNA, 15 bp, Homo sapiens
cgagcccttagcctt

SEQ ID NO: 6118651 - DNA, 19 bp, Homo sapiens
cgagccgagctctcctggg

SEQ ID NO: 6118652 - DNA, 15 bp, Homo sapiens
cgagcctcctcaggg

SEQ ID NO: 6118653 - DNA, 22 bp, Homo sapiens
cgagcctcctcagggggtagga

SEQ ID NO: 6118654 - DNA, 20 bp, Homo sapiens
cgagcctctgtcactgcagg

SEQ ID NO: 6118655 - DNA, 15 bp, Homo sapiens
cgagcgacggctcct

SEQ ID NO: 6118656 - DNA, 20 bp, Homo sapiens
cgagcgacggctcctccccg

SEQ ID NO: 6118657 - DNA, 13 bp, Homo sapiens
cgagcgccctgca

SEQ ID NO: 6118658 - DNA, 16 bp, Homo sapiens
cgagcgccctgcagac

SEQ ID NO: 6118659 - DNA, 19 bp, Homo sapiens
cgagcgctatcttcacata

SEQ ID NO: 6118660 - DNA, 23 bp, Homo sapiens
cgagcgctttctggaaaagagga

SEQ ID NO: 6118661 - DNA, 13 bp, Homo sapiens
cgagctcctgggg

SEQ ID NO: 6118662 - DNA, 22 bp, Homo sapiens
cgagctcctggggagctcctgg

SEQ ID NO: 6118663 - DNA, 21 bp, Homo sapiens
cgagctccttgggtcctgcaa

SEQ ID NO: 6118664 - DNA, 17 bp, Homo sapiens
cgagctctcctgggcca

SEQ ID NO: 6118665 - DNA, 18 bp, Homo sapiens
cgagctctcctgggccag

SEQ ID NO: 6118666 - DNA, 11 bp, Homo sapiens
cgagctctgta

SEQ ID NO: 6118667 - DNA, 21 bp, Homo sapiens
cgagctctgtagcctggtctg

SEQ ID NO: 6118668 - DNA, 18 bp, Homo sapiens
cgagctctgtcctctgtc

SEQ ID NO: 6118669 - DNA, 14 bp, Homo sapiens
cgagctctgtggga

SEQ ID NO: 6118670 - DNA, 23 bp, Homo sapiens
cgagctctgtgggaaaaaagaaa

SEQ ID NO: 6118671 - DNA, 14 bp, Homo sapiens
cgagctcttggcct

SEQ ID NO: 6118672 - DNA, 17 bp, Homo sapiens
cgagctcttggcctttg

SEQ ID NO: 6118673 - DNA, 14 bp, Homo sapiens
cgagctgaagaact

SEQ ID NO: 6118674 - DNA, 10 bp, Homo sapiens
cgagctgctt

SEQ ID NO: 6118675 - DNA, 15 bp, Homo sapiens
cgagctgctttgtgg

SEQ ID NO: 6118676 - DNA, 12 bp, Homo sapiens
cgagctgggggc

SEQ ID NO: 6118677 - DNA, 19 bp, Homo sapiens
cgagctggggggttggcag

SEQ ID NO: 6118678 - DNA, 13 bp, Homo sapiens
cgagctggtgcat

SEQ ID NO: 6118679 - DNA, 19 bp, Homo sapiens
cgagctgtcggagggctgg

SEQ ID NO: 6118680 - DNA, 12 bp, Homo sapiens
cgagctgtggac

SEQ ID NO: 6118681 - DNA, 21 bp, Homo sapiens
cgagctgtttatgtttttata

SEQ ID NO: 6118682 - DNA, 15 bp, Homo sapiens
cgagcttgcctcagg

SEQ ID NO: 6118683 - DNA, 19 bp, Homo sapiens
cgagcttgcctcagggcca

SEQ ID NO: 6118684 - DNA, 14 bp, Homo sapiens
cgagcttggccttg

SEQ ID NO: 6118685 - DNA, 18 bp, Homo sapiens
cgagcttggccttgggcc

SEQ ID NO: 6118686 - DNA, 13 bp, Homo sapiens
cgaggaaaaacaa

SEQ ID NO: 6118687 - DNA, 19 bp, Homo sapiens
cgaggaaaaggtccttgcc

SEQ ID NO: 6118688 - DNA, 20 bp, Homo sapiens
cgaggaaacgaaacccactc

SEQ ID NO: 6118689 - DNA, 14 bp, Homo sapiens
cgaggaaactcaga

SEQ ID NO: 6118690 - DNA, 18 bp, Homo sapiens
cgaggaaaggattttacc

SEQ ID NO: 6118691 - DNA, 17 bp, Homo sapiens
cgaggaactcgcctcag

SEQ ID NO: 6118692 - DNA, 18 bp, Homo sapiens
cgaggaactcgcctcagc

SEQ ID NO: 6118693 - DNA, 22 bp, Homo sapiens
cgaggaactcgcctcagcctga

SEQ ID NO: 6118694 - DNA, 14 bp, Homo sapiens
cgaggaagcacagc

SEQ ID NO: 6118695 - DNA, 20 bp, Homo sapiens
cgaggaagcagcaattaatt

SEQ ID NO: 6118696 - DNA, 16 bp, Homo sapiens
cgaggaagggccgagg

SEQ ID NO: 6118697 - DNA, 16 bp, Homo sapiens
cgaggaatctgtgggt

SEQ ID NO: 6118698 - DNA, 21 bp, Homo sapiens
cgaggaatgtgaagccagatc

SEQ ID NO: 6118699 - DNA, 22 bp, Homo sapiens
cgaggacactcgcttgccgggc

SEQ ID NO: 6118700 - DNA, 17 bp, Homo sapiens
cgaggacagcctgcctc

SEQ ID NO: 6118701 - DNA, 22 bp, Homo sapiens
cgaggacagcctgcctctgcca

SEQ ID NO: 6118702 - DNA, 14 bp, Homo sapiens
cgaggacagggagg

SEQ ID NO: 6118703 - DNA, 20 bp, Homo sapiens
cgaggaccaccagcaggcag

SEQ ID NO: 6118704 - DNA, 14 bp, Homo sapiens
cgaggacccagacc

SEQ ID NO: 6118705 - DNA, 17 bp, Homo sapiens
cgaggacccagacccag

SEQ ID NO: 6118706 - DNA, 20 bp, Homo sapiens
cgaggacccagacccagtgg

SEQ ID NO: 6118707 - DNA, 19 bp, Homo sapiens
cgaggaccgggcactcccg

SEQ ID NO: 6118708 - DNA, 19 bp, Homo sapiens
cgaggacgtgaagcctccc

SEQ ID NO: 6118709 - DNA, 19 bp, Homo sapiens
cgaggactgtatttgtgac

SEQ ID NO: 6118710 - DNA, 18 bp, Homo sapiens
cgaggagataaactgaaa

SEQ ID NO: 6118711 - DNA, 13 bp, Homo sapiens
cgaggagcagcag

SEQ ID NO: 6118712 - DNA, 19 bp, Homo sapiens
cgaggagccccagccccgt

SEQ ID NO: 6118713 - DNA, 14 bp, Homo sapiens
cgaggagctgggcc

SEQ ID NO: 6118714 - DNA, 19 bp, Homo sapiens
cgaggaggccgactgggct

SEQ ID NO: 6118715 - DNA, 16 bp, Homo sapiens
cgaggaggcgcggcct

SEQ ID NO: 6118716 - DNA, 12 bp, Homo sapiens
cgaggaggggcc

SEQ ID NO: 6118717 - DNA, 16 bp, Homo sapiens
cgaggaggtgcctgga

SEQ ID NO: 6118718 - DNA, 22 bp, Homo sapiens
cgaggaggtgtctcaggctgcc

SEQ ID NO: 6118719 - DNA, 13 bp, Homo sapiens
cgaggagtaacaa

SEQ ID NO: 6118720 - DNA, 13 bp, Homo sapiens
cgaggatcctggt

SEQ ID NO: 6118721 - DNA, 16 bp, Homo sapiens
cgaggatgctgtcagg

SEQ ID NO: 6118722 - DNA, 15 bp, Homo sapiens
cgaggattataaatg

SEQ ID NO: 6118723 - DNA, 13 bp, Homo sapiens
cgaggatttctgg

SEQ ID NO: 6118724 - DNA, 15 bp, Homo sapiens
cgaggatttctggga

SEQ ID NO: 6118725 - DNA, 19 bp, Homo sapiens
cgaggcaatgactgtgagc

SEQ ID NO: 6118726 - DNA, 17 bp, Homo sapiens
cgaggcaccggcgctgc

SEQ ID NO: 6118727 - DNA, 19 bp, Homo sapiens
cgaggcagaatggtgggct

SEQ ID NO: 6118728 - DNA, 23 bp, Homo sapiens
cgaggcagacgtctgtcaggggc

SEQ ID NO: 6118729 - DNA, 12 bp, Homo sapiens
cgaggcagagga

SEQ ID NO: 6118730 - DNA, 19 bp, Homo sapiens
cgaggcaggggctgggcag

SEQ ID NO: 6118731 - DNA, 13 bp, Homo sapiens
cgaggccagggcc

SEQ ID NO: 6118732 - DNA, 19 bp, Homo sapiens
cgaggccagtacctttcca

SEQ ID NO: 6118733 - DNA, 11 bp, Homo sapiens
cgaggcccagc

SEQ ID NO: 6118734 - DNA, 15 bp, Homo sapiens
cgaggcccagcgggc

SEQ ID NO: 6118735 - DNA, 19 bp, Homo sapiens
cgaggcccagcgggcagat

SEQ ID NO: 6118736 - DNA, 14 bp, Homo sapiens
cgaggcccccctct

SEQ ID NO: 6118737 - DNA, 23 bp, Homo sapiens
cgaggcccccctctgcctttgag

SEQ ID NO: 6118738 - DNA, 15 bp, Homo sapiens
cgaggcccctcccag

SEQ ID NO: 6118739 - DNA, 16 bp, Homo sapiens
cgaggcccctcccagt

SEQ ID NO: 6118740 - DNA, 22 bp, Homo sapiens
cgaggccctcaatccaccttca

SEQ ID NO: 6118741 - DNA, 11 bp, Homo sapiens
cgaggccctgc

SEQ ID NO: 6118742 - DNA, 13 bp, Homo sapiens
cgaggccctgcat

SEQ ID NO: 6118743 - DNA, 17 bp, Homo sapiens
cgaggccggagagctgg

SEQ ID NO: 6118744 - DNA, 19 bp, Homo sapiens
cgaggcctacagaggaggc

SEQ ID NO: 6118745 - DNA, 21 bp, Homo sapiens
cgaggcctacagaggaggcct

SEQ ID NO: 6118746 - DNA, 23 bp, Homo sapiens
cgaggcctacagaggaggcctca

SEQ ID NO: 6118747 - DNA, 17 bp, Homo sapiens
cgaggcctacctgctcc

SEQ ID NO: 6118748 - DNA, 23 bp, Homo sapiens
cgaggcctattgttgaataaatg

SEQ ID NO: 6118749 - DNA, 22 bp, Homo sapiens
cgaggcctctctcaggagcagg

SEQ ID NO: 6118750 - DNA, 10 bp, Homo sapiens
cgaggcctga

SEQ ID NO: 6118751 - DNA, 19 bp, Homo sapiens
cgaggcctgacacaggcca

SEQ ID NO: 6118752 - DNA, 23 bp, Homo sapiens
cgaggccttcagaaaagacactt

SEQ ID NO: 6118753 - DNA, 18 bp, Homo sapiens
cgaggccttctctgaagg

SEQ ID NO: 6118754 - DNA, 13 bp, Homo sapiens
cgaggcgaggctg

SEQ ID NO: 6118755 - DNA, 14 bp, Homo sapiens
cgaggcgaggctgc

SEQ ID NO: 6118756 - DNA, 18 bp, Homo sapiens
cgaggcgatgccacgctt

SEQ ID NO: 6118757 - DNA, 20 bp, Homo sapiens
cgaggcgggggagcctggag

SEQ ID NO: 6118758 - DNA, 21 bp, Homo sapiens
cgaggcgggggagcctggagc

SEQ ID NO: 6118759 - DNA, 15 bp, Homo sapiens
cgaggcgggggatcc

SEQ ID NO: 6118760 - DNA, 20 bp, Homo sapiens
cgaggcgggggatcctggag

SEQ ID NO: 6118761 - DNA, 17 bp, Homo sapiens
cgaggctacagctccac

SEQ ID NO: 6118762 - DNA, 18 bp, Homo sapiens
cgaggctacagctccaca

SEQ ID NO: 6118763 - DNA, 14 bp, Homo sapiens
cgaggctccccgcc

SEQ ID NO: 6118764 - DNA, 15 bp, Homo sapiens
cgaggctccccgcct

SEQ ID NO: 6118765 - DNA, 18 bp, Homo sapiens
cgaggctccccgcctcca

SEQ ID NO: 6118766 - DNA, 20 bp, Homo sapiens
cgaggctccccgcctccact

SEQ ID NO: 6118767 - DNA, 22 bp, Homo sapiens
cgaggctccccgcctccactct

SEQ ID NO: 6118768 - DNA, 16 bp, Homo sapiens
cgaggctccctcttcc

SEQ ID NO: 6118769 - DNA, 21 bp, Homo sapiens
cgaggctcgagctcggggctg

SEQ ID NO: 6118770 - DNA, 23 bp, Homo sapiens
cgaggctcgagctcggggctggg

SEQ ID NO: 6118771 - DNA, 12 bp, Homo sapiens
cgaggctgagaa

SEQ ID NO: 6118772 - DNA, 12 bp, Homo sapiens
cgaggctgcccc

SEQ ID NO: 6118773 - DNA, 21 bp, Homo sapiens
cgaggctgcccccatccagcc

SEQ ID NO: 6118774 - DNA, 18 bp, Homo sapiens
cgaggctgcctctgggtg

SEQ ID NO: 6118775 - DNA, 14 bp, Homo sapiens
cgaggctgggacac

SEQ ID NO: 6118776 - DNA, 13 bp, Homo sapiens
cgaggctgggcca

SEQ ID NO: 6118777 - DNA, 15 bp, Homo sapiens
cgaggctgggccaag

SEQ ID NO: 6118778 - DNA, 12 bp, Homo sapiens
cgaggctgggct

SEQ ID NO: 6118779 - DNA, 22 bp, Homo sapiens
cgaggctggtcttagatgcagc

SEQ ID NO: 6118780 - DNA, 13 bp, Homo sapiens
cgaggctggtgcc

SEQ ID NO: 6118781 - DNA, 15 bp, Homo sapiens
cgaggctggtgccag

SEQ ID NO: 6118782 - DNA, 19 bp, Homo sapiens
cgaggctggtgccaggcgc

SEQ ID NO: 6118783 - DNA, 13 bp, Homo sapiens
cgagggaagcagt

SEQ ID NO: 6118784 - DNA, 17 bp, Homo sapiens
cgagggagctgctggct

SEQ ID NO: 6118785 - DNA, 22 bp, Homo sapiens
cgagggagctgctggctgacct

SEQ ID NO: 6118786 - DNA, 15 bp, Homo sapiens
cgagggaggggaggt

SEQ ID NO: 6118787 - DNA, 16 bp, Homo sapiens
cgagggaggggaggtg

SEQ ID NO: 6118788 - DNA, 17 bp, Homo sapiens
cgagggatgatgaggga

SEQ ID NO: 6118789 - DNA, 19 bp, Homo sapiens
cgagggatgggatttcatg

SEQ ID NO: 6118790 - DNA, 17 bp, Homo sapiens
cgagggcaacagggagc

SEQ ID NO: 6118791 - DNA, 17 bp, Homo sapiens
cgagggcagcgggagcc

SEQ ID NO: 6118792 - DNA, 12 bp, Homo sapiens
cgagggccaggc

SEQ ID NO: 6118793 - DNA, 13 bp, Homo sapiens
cgagggccaggca

SEQ ID NO: 6118794 - DNA, 15 bp, Homo sapiens
cgagggccaggcacc

SEQ ID NO: 6118795 - DNA, 15 bp, Homo sapiens
cgagggccaggcaga

SEQ ID NO: 6118796 - DNA, 17 bp, Homo sapiens
cgagggccccacgtccc

SEQ ID NO: 6118797 - DNA, 12 bp, Homo sapiens
cgagggccgaat

SEQ ID NO: 6118798 - DNA, 18 bp, Homo sapiens
cgagggccgaggagcgcc

SEQ ID NO: 6118799 - DNA, 20 bp, Homo sapiens
cgagggccgcctgccttagc

SEQ ID NO: 6118800 - DNA, 14 bp, Homo sapiens
cgagggcggccagg

SEQ ID NO: 6118801 - DNA, 17 bp, Homo sapiens
cgagggctactcagcag

SEQ ID NO: 6118802 - DNA, 16 bp, Homo sapiens
cgagggctcagaagag

SEQ ID NO: 6118803 - DNA, 16 bp, Homo sapiens
cgagggctgaggagca

SEQ ID NO: 6118804 - DNA, 21 bp, Homo sapiens
cgagggctgaggagcagccag

SEQ ID NO: 6118805 - DNA, 21 bp, Homo sapiens
cgagggctgatggaggaaaaa

SEQ ID NO: 6118806 - DNA, 23 bp, Homo sapiens
cgagggctggctggcctcaccca

SEQ ID NO: 6118807 - DNA, 18 bp, Homo sapiens
cgaggggacccatggggg

SEQ ID NO: 6118808 - DNA, 18 bp, Homo sapiens
cgaggggagggtggcagg

SEQ ID NO: 6118809 - DNA, 19 bp, Homo sapiens
cgaggggagggtggcaggt

SEQ ID NO: 6118810 - DNA, 22 bp, Homo sapiens
cgaggggcccagggaagcctgg

SEQ ID NO: 6118811 - DNA, 13 bp, Homo sapiens
cgaggggcctaga

SEQ ID NO: 6118812 - DNA, 21 bp, Homo sapiens
cgaggggcgggacccaggcac

SEQ ID NO: 6118813 - DNA, 16 bp, Homo sapiens
cgaggggctcaggaaa

SEQ ID NO: 6118814 - DNA, 23 bp, Homo sapiens
cgaggggctcatgttcaggcaga

SEQ ID NO: 6118815 - DNA, 17 bp, Homo sapiens
cgagggggctgctccca

SEQ ID NO: 6118816 - DNA, 18 bp, Homo sapiens
cgaggggtgtcttgggca

SEQ ID NO: 6118817 - DNA, 17 bp, Homo sapiens
cgagggtcacgcttgcc

SEQ ID NO: 6118818 - DNA, 14 bp, Homo sapiens
cgagggtcctggct

SEQ ID NO: 6118819 - DNA, 15 bp, Homo sapiens
cgagggtcctggctc

SEQ ID NO: 6118820 - DNA, 15 bp, Homo sapiens
cgagggttccaggct

SEQ ID NO: 6118821 - DNA, 15 bp, Homo sapiens
cgaggtcaacagaga

SEQ ID NO: 6118822 - DNA, 17 bp, Homo sapiens
cgaggtcaacagagaag

SEQ ID NO: 6118823 - DNA, 14 bp, Homo sapiens
cgaggtccagaccc

SEQ ID NO: 6118824 - DNA, 16 bp, Homo sapiens
cgaggtccctgctgcc

SEQ ID NO: 6118825 - DNA, 13 bp, Homo sapiens
cgaggtcctcctg

SEQ ID NO: 6118826 - DNA, 20 bp, Homo sapiens
ctcagaaagaggtctcccca

SEQ ID NO: 6118827 - DNA, 22 bp, Homo sapiens
ctcagaaagaggtctccccatc

SEQ ID NO: 6118828 - DNA, 15 bp, Homo sapiens
ctcagaaagccttcc

SEQ ID NO: 6118829 - DNA, 23 bp, Homo sapiens
ctcagaaagtgcagcatggagga

SEQ ID NO: 6118830 - DNA, 17 bp, Homo sapiens
ctcagaaagtgcctgac

SEQ ID NO: 6118831 - DNA, 23 bp, Homo sapiens
ctcagaaagtgtataataagaaa

SEQ ID NO: 6118832 - DNA, 15 bp, Homo sapiens
ctcagaaataaatca

SEQ ID NO: 6118833 - DNA, 21 bp, Homo sapiens
ctcagaaatggacaaagaaaa

SEQ ID NO: 6118834 - DNA, 15 bp, Homo sapiens
ctcagaaatgtcatg

SEQ ID NO: 6118835 - DNA, 17 bp, Homo sapiens
ctcagaacacattcttt

SEQ ID NO: 6118836 - DNA, 14 bp, Homo sapiens
ctcagaacaccaag

SEQ ID NO: 6118837 - DNA, 19 bp, Homo sapiens
ctcagaacaccaagtaaat

SEQ ID NO: 6118838 - DNA, 20 bp, Homo sapiens
ctcagaacaccccgctctgg

SEQ ID NO: 6118839 - DNA, 14 bp, Homo sapiens
ctcagaacagctga

SEQ ID NO: 6118840 - DNA, 14 bp, Homo sapiens
ctcagaacagtctg

SEQ ID NO: 6118841 - DNA, 13 bp, Homo sapiens
ctcagaacataaa

SEQ ID NO: 6118842 - DNA, 20 bp, Homo sapiens
ctcagaacataaaaaggaac

SEQ ID NO: 6118843 - DNA, 16 bp, Homo sapiens
ctcagaacatactgat

SEQ ID NO: 6118844 - DNA, 13 bp, Homo sapiens
ctcagaacatgag

SEQ ID NO: 6118845 - DNA, 21 bp, Homo sapiens
ctcagaacccacagtgagagg

SEQ ID NO: 6118846 - DNA, 21 bp, Homo sapiens
ctcagaacccttggcttgccc

SEQ ID NO: 6118847 - DNA, 22 bp, Homo sapiens
ctcagaaccttgtcccagccag

SEQ ID NO: 6118848 - DNA, 17 bp, Homo sapiens
ctcagaactctccaggg

SEQ ID NO: 6118849 - DNA, 19 bp, Homo sapiens
ctcagaactctccagggag

SEQ ID NO: 6118850 - DNA, 15 bp, Homo sapiens
ctcagaactgttggc

SEQ ID NO: 6118851 - DNA, 20 bp, Homo sapiens
ctcagaactgttggctgctc

SEQ ID NO: 6118852 - DNA, 14 bp, Homo sapiens
ctcagaacttgctg

SEQ ID NO: 6118853 - DNA, 23 bp, Homo sapiens
ctcagaacttgctgctgtcttgt

SEQ ID NO: 6118854 - DNA, 12 bp, Homo sapiens
ctcagaagaaaa

SEQ ID NO: 6118855 - DNA, 13 bp, Homo sapiens
ctcagaagacact

SEQ ID NO: 6118856 - DNA, 17 bp, Homo sapiens
ctcagaagacactgatg

SEQ ID NO: 6118857 - DNA, 22 bp, Homo sapiens
ctcagaagacactgatgggcaa

SEQ ID NO: 6118858 - DNA, 23 bp, Homo sapiens
ctcagaagacactgatgggcaac

SEQ ID NO: 6118859 - DNA, 19 bp, Homo sapiens
ctcagaagagaaatacagc

SEQ ID NO: 6118860 - DNA, 12 bp, Homo sapiens
ctcagaagagca

SEQ ID NO: 6118861 - DNA, 19 bp, Homo sapiens
ctcagaagccagtctgcgt

SEQ ID NO: 6118862 - DNA, 21 bp, Homo sapiens
ctcagaagccagtctgcgtca

SEQ ID NO: 6118863 - DNA, 17 bp, Homo sapiens
ctcagaagcctcgactg

SEQ ID NO: 6118864 - DNA, 14 bp, Homo sapiens
ctcagaagcctgag

SEQ ID NO: 6118865 - DNA, 15 bp, Homo sapiens
ctcagaagcctgagg

SEQ ID NO: 6118866 - DNA, 17 bp, Homo sapiens
ctcagaagcctgaggct

SEQ ID NO: 6118867 - DNA, 14 bp, Homo sapiens
ctcagaagcctggg

SEQ ID NO: 6118868 - DNA, 18 bp, Homo sapiens
ctcagaagccttcttgct

SEQ ID NO: 6118869 - DNA, 20 bp, Homo sapiens
ctcagaagccttcttgctgc

SEQ ID NO: 6118870 - DNA, 21 bp, Homo sapiens
ctcagaagccttcttgctgcc

SEQ ID NO: 6118871 - DNA, 16 bp, Homo sapiens
ctcagaaggccccaga

SEQ ID NO: 6118872 - DNA, 17 bp, Homo sapiens
ctcagaaggctctatct

SEQ ID NO: 6118873 - DNA, 15 bp, Homo sapiens
ctcagaaggctcttc

SEQ ID NO: 6118874 - DNA, 20 bp, Homo sapiens
ctcagaaggctcttctgact

SEQ ID NO: 6118875 - DNA, 15 bp, Homo sapiens
ctcagaaggctttgg

SEQ ID NO: 6118876 - DNA, 21 bp, Homo sapiens
ctcagaaggctttgggatatg

SEQ ID NO: 6118877 - DNA, 22 bp, Homo sapiens
ctcagaagggagctagccagag

SEQ ID NO: 6118878 - DNA, 14 bp, Homo sapiens
ctcagaagggaggc

SEQ ID NO: 6118879 - DNA, 16 bp, Homo sapiens
ctcagaaggtattcct

SEQ ID NO: 6118880 - DNA, 11 bp, Homo sapiens
ctcagaagtaa

SEQ ID NO: 6118881 - DNA, 12 bp, Homo sapiens
ctcagaagtaaa

SEQ ID NO: 6118882 - DNA, 13 bp, Homo sapiens
ctcagaagtaaag

SEQ ID NO: 6118883 - DNA, 15 bp, Homo sapiens
ctcagaagtccctgt

SEQ ID NO: 6118884 - DNA, 19 bp, Homo sapiens
ctcagaagtgaaaaagact

SEQ ID NO: 6118885 - DNA, 18 bp, Homo sapiens
ctcagaagttgtgctaaa

SEQ ID NO: 6118886 - DNA, 19 bp, Homo sapiens
ctcagaagtttcttcttta

SEQ ID NO: 6118887 - DNA, 19 bp, Homo sapiens
ctcagaatatattcacttt

SEQ ID NO: 6118888 - DNA, 13 bp, Homo sapiens
ctcagaatattaa

SEQ ID NO: 6118889 - DNA, 18 bp, Homo sapiens
ctcagaatattaagcaca

SEQ ID NO: 6118890 - DNA, 14 bp, Homo sapiens
ctcagaatccaaag

SEQ ID NO: 6118891 - DNA, 18 bp, Homo sapiens
ctcagaatccaaagatca

SEQ ID NO: 6118892 - DNA, 23 bp, Homo sapiens
ctcagaatccaagtgaacactag

SEQ ID NO: 6118893 - DNA, 18 bp, Homo sapiens
ctcagaatgatttgtaaa

SEQ ID NO: 6118894 - DNA, 15 bp, Homo sapiens
ctcagaatgctctac

SEQ ID NO: 6118895 - DNA, 15 bp, Homo sapiens
ctcagaatgggggct

SEQ ID NO: 6118896 - DNA, 17 bp, Homo sapiens
ctcagaatgggggcttt

SEQ ID NO: 6118897 - DNA, 17 bp, Homo sapiens
ctcagaattatttttaa

SEQ ID NO: 6118898 - DNA, 11 bp, Homo sapiens
ctcagaattcg

SEQ ID NO: 6118899 - DNA, 22 bp, Homo sapiens
ctcagaattcggtgtgctgcca

SEQ ID NO: 6118900 - DNA, 23 bp, Homo sapiens
ctcagaattcggtgtgctgccaa

SEQ ID NO: 6118901 - DNA, 19 bp, Homo sapiens
ctcagaatttatctccctt

SEQ ID NO: 6118902 - DNA, 22 bp, Homo sapiens
ctcagacactgccgacatcagc

SEQ ID NO: 6118903 - DNA, 15 bp, Homo sapiens
ctcagacagccccct

SEQ ID NO: 6118904 - DNA, 13 bp, Homo sapiens
ctcagacattggc

SEQ ID NO: 6118905 - DNA, 12 bp, Homo sapiens
ctcagacatttt

SEQ ID NO: 6118906 - DNA, 13 bp, Homo sapiens
ctcagaccaactc

SEQ ID NO: 6118907 - DNA, 23 bp, Homo sapiens
ctcagaccagctcccagatggcc

SEQ ID NO: 6118908 - DNA, 14 bp, Homo sapiens
ctcagacccaacag

SEQ ID NO: 6118909 - DNA, 21 bp, Homo sapiens
ctcagacccagacgtggtgct

SEQ ID NO: 6118910 - DNA, 17 bp, Homo sapiens
ctcagacccaggagtcc

SEQ ID NO: 6118911 - DNA, 17 bp, Homo sapiens
ctcagacccaggggtcc

SEQ ID NO: 6118912 - DNA, 19 bp, Homo sapiens
ctcagacccaggggtccag

SEQ ID NO: 6118913 - DNA, 13 bp, Homo sapiens
ctcagacccccac

SEQ ID NO: 6118914 - DNA, 14 bp, Homo sapiens
ctcagacccccact

SEQ ID NO: 6118915 - DNA, 13 bp, Homo sapiens
ctcagaccccctc

SEQ ID NO: 6118916 - DNA, 19 bp, Homo sapiens
ctcagacccctcagcccca

SEQ ID NO: 6118917 - DNA, 20 bp, Homo sapiens
ctcagacccctcagccccag

SEQ ID NO: 6118918 - DNA, 15 bp, Homo sapiens
ctcagacggcggcca

SEQ ID NO: 6118919 - DNA, 16 bp, Homo sapiens
ctcagacggcggccag

SEQ ID NO: 6118920 - DNA, 20 bp, Homo sapiens
ctcagacggcggccaggcac

SEQ ID NO: 6118921 - DNA, 16 bp, Homo sapiens
ctcagacgtgtgacct

SEQ ID NO: 6118922 - DNA, 16 bp, Homo sapiens
ctcagacgttgcctga

SEQ ID NO: 6118923 - DNA, 22 bp, Homo sapiens
ctcagactcagaggtccaggcc

SEQ ID NO: 6118924 - DNA, 12 bp, Homo sapiens
ctcagactcctg

SEQ ID NO: 6118925 - DNA, 13 bp, Homo sapiens
ctcagactcctgg

SEQ ID NO: 6118926 - DNA, 16 bp, Homo sapiens
ctcagactcctggctt

SEQ ID NO: 6118927 - DNA, 17 bp, Homo sapiens
ctcagactcctggcttc

SEQ ID NO: 6118928 - DNA, 21 bp, Homo sapiens
ctcagactcctggcttcatgt

SEQ ID NO: 6118929 - DNA, 22 bp, Homo sapiens
ctcagactctttttgtacctgg

SEQ ID NO: 6118930 - DNA, 15 bp, Homo sapiens
ctcagactgcaccca

SEQ ID NO: 6118931 - DNA, 17 bp, Homo sapiens
ctcagactgcacccagg

SEQ ID NO: 6118932 - DNA, 19 bp, Homo sapiens
ctcagactgcacccaggag

SEQ ID NO: 6118933 - DNA, 13 bp, Homo sapiens
ctcagactgctca

SEQ ID NO: 6118934 - DNA, 16 bp, Homo sapiens
ctcagacttttgtaca

SEQ ID NO: 6118935 - DNA, 19 bp, Homo sapiens
ctcagagaaaaatgctccc

SEQ ID NO: 6118936 - DNA, 23 bp, Homo sapiens
ctcagagaaaaatgctccccaca

SEQ ID NO: 6118937 - DNA, 17 bp, Homo sapiens
ctcagagaaaagagatt

SEQ ID NO: 6118938 - DNA, 21 bp, Homo sapiens
ctcagagaaatcactgaacct

SEQ ID NO: 6118939 - DNA, 19 bp, Homo sapiens
ctcagagaaccagtgcaga

SEQ ID NO: 6118940 - DNA, 21 bp, Homo sapiens
ctcagagacaccaaactgcca

SEQ ID NO: 6118941 - DNA, 22 bp, Homo sapiens
ctcagagacactgttgataaaa

SEQ ID NO: 6118942 - DNA, 23 bp, Homo sapiens
ctcagagacagcgcgagtagcac

SEQ ID NO: 6118943 - DNA, 19 bp, Homo sapiens
ctcagagacaggtggccta

SEQ ID NO: 6118944 - DNA, 21 bp, Homo sapiens
ctcagagaccagcactcagcc

SEQ ID NO: 6118945 - DNA, 13 bp, Homo sapiens
ctcagagaccagg

SEQ ID NO: 6118946 - DNA, 16 bp, Homo sapiens
ctcagagaccgtgagc

SEQ ID NO: 6118947 - DNA, 20 bp, Homo sapiens
ctcagagagcatcttttcct

SEQ ID NO: 6118948 - DNA, 15 bp, Homo sapiens
ctcagagaggacaaa

SEQ ID NO: 6118949 - DNA, 14 bp, Homo sapiens
ctcagagaggcatg

SEQ ID NO: 6118950 - DNA, 13 bp, Homo sapiens
ctcagagaggtag

SEQ ID NO: 6118951 - DNA, 23 bp, Homo sapiens
ctcagagaggtagcactctcaga

SEQ ID NO: 6118952 - DNA, 14 bp, Homo sapiens
ctcagagagtacac

SEQ ID NO: 6118953 - DNA, 20 bp, Homo sapiens
ctcagagagtacactgtgtc

SEQ ID NO: 6118954 - DNA, 21 bp, Homo sapiens
ctcagagagtacactgtgtct

SEQ ID NO: 6118955 - DNA, 22 bp, Homo sapiens
ctcagagagtacactgtgtctc

SEQ ID NO: 6118956 - DNA, 19 bp, Homo sapiens
ctcagagagttgtctgtcc

SEQ ID NO: 6118957 - DNA, 22 bp, Homo sapiens
ctcagagatgtgcacccatggg

SEQ ID NO: 6118958 - DNA, 13 bp, Homo sapiens
ctcagagcaagcc

SEQ ID NO: 6118959 - DNA, 14 bp, Homo sapiens
ctcagagcaagcct

SEQ ID NO: 6118960 - DNA, 16 bp, Homo sapiens
ctcagagcaagccttt

SEQ ID NO: 6118961 - DNA, 13 bp, Homo sapiens
ctcagagcagagc

SEQ ID NO: 6118962 - DNA, 17 bp, Homo sapiens
ctcagagcagcactggg

SEQ ID NO: 6118963 - DNA, 22 bp, Homo sapiens
ctcagagcaggctcagactctg

SEQ ID NO: 6118964 - DNA, 19 bp, Homo sapiens
ctcagagcagggccaaagc

SEQ ID NO: 6118965 - DNA, 23 bp, Homo sapiens
ctcagagcagggccaaagcacag

SEQ ID NO: 6118966 - DNA, 16 bp, Homo sapiens
ctcagagcaggggcca

SEQ ID NO: 6118967 - DNA, 14 bp, Homo sapiens
ctcagagcatctgg

SEQ ID NO: 6118968 - DNA, 16 bp, Homo sapiens
ctcagagcatctggct

SEQ ID NO: 6118969 - DNA, 18 bp, Homo sapiens
ctcagagcatctggctgt

SEQ ID NO: 6118970 - DNA, 23 bp, Homo sapiens
ctcagagcatgatgggaggtgtg

SEQ ID NO: 6118971 - DNA, 14 bp, Homo sapiens
ctcagagcatgtgt

SEQ ID NO: 6118972 - DNA, 15 bp, Homo sapiens
ctcagagccaagggg

SEQ ID NO: 6118973 - DNA, 13 bp, Homo sapiens
ctcagagccaagt

SEQ ID NO: 6118974 - DNA, 15 bp, Homo sapiens
ctcagagccaagtcc

SEQ ID NO: 6118975 - DNA, 15 bp, Homo sapiens
ctcagagccacccct

SEQ ID NO: 6118976 - DNA, 14 bp, Homo sapiens
ctcagagcccatgg

SEQ ID NO: 6118977 - DNA, 18 bp, Homo sapiens
ctcagagccccgccccac

SEQ ID NO: 6118978 - DNA, 20 bp, Homo sapiens
ctcagagcccctccctgcta

SEQ ID NO: 6118979 - DNA, 11 bp, Homo sapiens
ctcagagccct

SEQ ID NO: 6118980 - DNA, 22 bp, Homo sapiens
ctcagagccctcaactattctg

SEQ ID NO: 6118981 - DNA, 14 bp, Homo sapiens
ctcagagcctcagc

SEQ ID NO: 6118982 - DNA, 17 bp, Homo sapiens
ctcagagcctcagcttc

SEQ ID NO: 6118983 - DNA, 21 bp, Homo sapiens
ctcagagcctcagcttctggg

SEQ ID NO: 6118984 - DNA, 16 bp, Homo sapiens
ctcagagcctgacctg

SEQ ID NO: 6118985 - DNA, 18 bp, Homo sapiens
ctcagagcctgacctgag

SEQ ID NO: 6118986 - DNA, 11 bp, Homo sapiens
ctcagagcctt

SEQ ID NO: 6118987 - DNA, 18 bp, Homo sapiens
ctcagagctacttgggcc

SEQ ID NO: 6118988 - DNA, 19 bp, Homo sapiens
ctcagagctacttgggcca

SEQ ID NO: 6118989 - DNA, 17 bp, Homo sapiens
ctcagagctccacagaa

SEQ ID NO: 6118990 - DNA, 12 bp, Homo sapiens
ctcagagctgcg

SEQ ID NO: 6118991 - DNA, 15 bp, Homo sapiens
ctcagagctgcgggc

SEQ ID NO: 6118992 - DNA, 16 bp, Homo sapiens
ctcagagctgcgggct

SEQ ID NO: 6118993 - DNA, 17 bp, Homo sapiens
ctcagagctgcgggctg

SEQ ID NO: 6118994 - DNA, 20 bp, Homo sapiens
ctcagagctgcgggctgagg

SEQ ID NO: 6118995 - DNA, 22 bp, Homo sapiens
ctcagagctgcgggctgagggc

SEQ ID NO: 6118996 - DNA, 14 bp, Homo sapiens
ctcagagcttcctg

SEQ ID NO: 6118997 - DNA, 15 bp, Homo sapiens
ctcagagcttcctgg

SEQ ID NO: 6118998 - DNA, 22 bp, Homo sapiens
ctcagagcttcctggggaccaa

SEQ ID NO: 6118999 - DNA, 15 bp, Homo sapiens
ctcagagcttgaaga

SEQ ID NO: 6119000 - DNA, 17 bp, Homo sapiens
ctcagagcttgaagatt

SEQ ID NO: 6119001 - DNA, 23 bp, Homo sapiens
ctcagagctttaaaagtatcttt

SEQ ID NO: 6119002 - DNA, 14 bp, Homo sapiens
ctcagagctttgtc

SEQ ID NO: 6119003 - DNA, 15 bp, Homo sapiens
ctcagagctttgtca

SEQ ID NO: 6119004 - DNA, 19 bp, Homo sapiens
ctcagagctttgtcacttg

SEQ ID NO: 6119005 - DNA, 13 bp, Homo sapiens
cgaggtcttgtga

SEQ ID NO: 6119006 - DNA, 22 bp, Homo sapiens
cgaggtggatcacagaggcttc

SEQ ID NO: 6119007 - DNA, 16 bp, Homo sapiens
cgaggtgtcaccctgc

SEQ ID NO: 6119008 - DNA, 19 bp, Homo sapiens
cgaggtgtcaccctgcaga

SEQ ID NO: 6119009 - DNA, 21 bp, Homo sapiens
cgaggtgtcaccctgcagagc

SEQ ID NO: 6119010 - DNA, 17 bp, Homo sapiens
cgaggttaaagaagctg

SEQ ID NO: 6119011 - DNA, 19 bp, Homo sapiens
cgaggttaaagaagctgca

SEQ ID NO: 6119012 - DNA, 14 bp, Homo sapiens
cgaggttcctgtca

SEQ ID NO: 6119013 - DNA, 13 bp, Homo sapiens
cgaggttgagagg

SEQ ID NO: 6119014 - DNA, 17 bp, Homo sapiens
cgaggttgtggggaggc

SEQ ID NO: 6119015 - DNA, 18 bp, Homo sapiens
cgaggttttgaggcggga

SEQ ID NO: 6119016 - DNA, 14 bp, Homo sapiens
cgagtaagattaag

SEQ ID NO: 6119017 - DNA, 19 bp, Homo sapiens
cgagtaccccagccactcc

SEQ ID NO: 6119018 - DNA, 12 bp, Homo sapiens
cgagtacctcca

SEQ ID NO: 6119019 - DNA, 23 bp, Homo sapiens
cgagtactatgtattaccagccc

SEQ ID NO: 6119020 - DNA, 14 bp, Homo sapiens
cgagtactgtgggc

SEQ ID NO: 6119021 - DNA, 16 bp, Homo sapiens
cgagtactgtgggcaa

SEQ ID NO: 6119022 - DNA, 22 bp, Homo sapiens
cgagtactgtgggcaatttaga

SEQ ID NO: 6119023 - DNA, 22 bp, Homo sapiens
cgagtagaaaatgtgaccctcc

SEQ ID NO: 6119024 - DNA, 19 bp, Homo sapiens
cgagtagagaggcccgccc

SEQ ID NO: 6119025 - DNA, 17 bp, Homo sapiens
cgagtagaggtttaaag

SEQ ID NO: 6119026 - DNA, 19 bp, Homo sapiens
cgagtagctgagattatag

SEQ ID NO: 6119027 - DNA, 13 bp, Homo sapiens
cgagtagctggga

SEQ ID NO: 6119028 - DNA, 20 bp, Homo sapiens
cgagtagctgggattacagg

SEQ ID NO: 6119029 - DNA, 19 bp, Homo sapiens
cgagtagttgggattacag

SEQ ID NO: 6119030 - DNA, 16 bp, Homo sapiens
cgagtcaatcccctca

SEQ ID NO: 6119031 - DNA, 21 bp, Homo sapiens
cgagtcaattaaacagctggt

SEQ ID NO: 6119032 - DNA, 22 bp, Homo sapiens
cgagtcacacccggtggctctg

SEQ ID NO: 6119033 - DNA, 15 bp, Homo sapiens
cgagtcacctgcaag

SEQ ID NO: 6119034 - DNA, 16 bp, Homo sapiens
cgagtcacctgcaagc

SEQ ID NO: 6119035 - DNA, 20 bp, Homo sapiens
cgagtcacctgcaagcccca

SEQ ID NO: 6119036 - DNA, 15 bp, Homo sapiens
cgagtcaccttccag

SEQ ID NO: 6119037 - DNA, 16 bp, Homo sapiens
cgagtcaccttccagg

SEQ ID NO: 6119038 - DNA, 14 bp, Homo sapiens
cgagtcactgcctc

SEQ ID NO: 6119039 - DNA, 15 bp, Homo sapiens
cgagtcactgcctct

SEQ ID NO: 6119040 - DNA, 18 bp, Homo sapiens
cgagtcattcgttctgtg

SEQ ID NO: 6119041 - DNA, 13 bp, Homo sapiens
cgagtccaagctg

SEQ ID NO: 6119042 - DNA, 14 bp, Homo sapiens
cgagtccaagctgg

SEQ ID NO: 6119043 - DNA, 15 bp, Homo sapiens
cgagtccaagctggg

SEQ ID NO: 6119044 - DNA, 12 bp, Homo sapiens
cgagtccagaca

SEQ ID NO: 6119045 - DNA, 15 bp, Homo sapiens
cgagtccagtccttt

SEQ ID NO: 6119046 - DNA, 17 bp, Homo sapiens
cgagtccccccacccct

SEQ ID NO: 6119047 - DNA, 18 bp, Homo sapiens
cgagtccccccacccctc

SEQ ID NO: 6119048 - DNA, 19 bp, Homo sapiens
cgagtcccggagccccacc

SEQ ID NO: 6119049 - DNA, 17 bp, Homo sapiens
cgagtcctaaggcctta

SEQ ID NO: 6119050 - DNA, 15 bp, Homo sapiens
cgagtcctcaggtac

SEQ ID NO: 6119051 - DNA, 18 bp, Homo sapiens
cgagtctcttctccactg

SEQ ID NO: 6119052 - DNA, 13 bp, Homo sapiens
cgagtctgaggcc

SEQ ID NO: 6119053 - DNA, 14 bp, Homo sapiens
cgagtctggagacc

SEQ ID NO: 6119054 - DNA, 15 bp, Homo sapiens
cgagtctggagacca

SEQ ID NO: 6119055 - DNA, 15 bp, Homo sapiens
cgagtctgggacaca

SEQ ID NO: 6119056 - DNA, 13 bp, Homo sapiens
cgagtctgtcctg

SEQ ID NO: 6119057 - DNA, 18 bp, Homo sapiens
cgagtctttctcactgcc

SEQ ID NO: 6119058 - DNA, 20 bp, Homo sapiens
cgagtctttctcactgcctt

SEQ ID NO: 6119059 - DNA, 17 bp, Homo sapiens
cgagtgagacaaaattt

SEQ ID NO: 6119060 - DNA, 20 bp, Homo sapiens
cgagtgagctaccaggaaga

SEQ ID NO: 6119061 - DNA, 23 bp, Homo sapiens
cgagtgcccctgtcccacctggc

SEQ ID NO: 6119062 - DNA, 22 bp, Homo sapiens
cgagtgccttcaacacagcttg

SEQ ID NO: 6119063 - DNA, 14 bp, Homo sapiens
cgagtggagtctgc

SEQ ID NO: 6119064 - DNA, 19 bp, Homo sapiens
cgagtggagtctgccaccc

SEQ ID NO: 6119065 - DNA, 17 bp, Homo sapiens
cgagtggatagatgccc

SEQ ID NO: 6119066 - DNA, 18 bp, Homo sapiens
cgagtggatgctgtgcta

SEQ ID NO: 6119067 - DNA, 12 bp, Homo sapiens
cgagtggctgcc

SEQ ID NO: 6119068 - DNA, 20 bp, Homo sapiens
cgagtggtctcctctcagct

SEQ ID NO: 6119069 - DNA, 19 bp, Homo sapiens
cgagtggtttcggaaaaaa

SEQ ID NO: 6119070 - DNA, 15 bp, Homo sapiens
cgagtgtggagctgc

SEQ ID NO: 6119071 - DNA, 11 bp, Homo sapiens
cgagtgtgtgc

SEQ ID NO: 6119072 - DNA, 19 bp, Homo sapiens
cgagtgtgtgcatgtgtgt

SEQ ID NO: 6119073 - DNA, 17 bp, Homo sapiens
cgagttcctcgctctgg

SEQ ID NO: 6119074 - DNA, 13 bp, Homo sapiens
cgagttcctctgg

SEQ ID NO: 6119075 - DNA, 17 bp, Homo sapiens
cgagttctctttggaaa

SEQ ID NO: 6119076 - DNA, 22 bp, Homo sapiens
cgagttgtggaaagcctctgct

SEQ ID NO: 6119077 - DNA, 21 bp, Homo sapiens
cgagtttctggtaagactgct

SEQ ID NO: 6119078 - DNA, 18 bp, Homo sapiens
cgagtttgcaatgtcaca

SEQ ID NO: 6119079 - DNA, 22 bp, Homo sapiens
cgagtttggatgttgtaaataa

SEQ ID NO: 6119080 - DNA, 21 bp, Homo sapiens
cgataaaattacaaaagagca

SEQ ID NO: 6119081 - DNA, 14 bp, Homo sapiens
cgataaatgaacat

SEQ ID NO: 6119082 - DNA, 23 bp, Homo sapiens
cgataagctttcaatagtggcat

SEQ ID NO: 6119083 - DNA, 15 bp, Homo sapiens
cgataatcagagaaa

SEQ ID NO: 6119084 - DNA, 19 bp, Homo sapiens
cgataatcgctcttttcca

SEQ ID NO: 6119085 - DNA, 17 bp, Homo sapiens
cgataatgcatgaagca

SEQ ID NO: 6119086 - DNA, 18 bp, Homo sapiens
cgatacaccgggcctgga

SEQ ID NO: 6119087 - DNA, 23 bp, Homo sapiens
cgatacccaggaccaagccacag

SEQ ID NO: 6119088 - DNA, 20 bp, Homo sapiens
cgatactgcgactttctgcc

SEQ ID NO: 6119089 - DNA, 12 bp, Homo sapiens
cgatagagtctc

SEQ ID NO: 6119090 - DNA, 16 bp, Homo sapiens
cgatagtttactgaga

SEQ ID NO: 6119091 - DNA, 17 bp, Homo sapiens
cgatatatgtaaatata

SEQ ID NO: 6119092 - DNA, 15 bp, Homo sapiens
cgatatgagagggat

SEQ ID NO: 6119093 - DNA, 13 bp, Homo sapiens
cgatatttattga

SEQ ID NO: 6119094 - DNA, 17 bp, Homo sapiens
cgatatttattgatgtt

SEQ ID NO: 6119095 - DNA, 22 bp, Homo sapiens
cgatatttcgtttggtcttagg

SEQ ID NO: 6119096 - DNA, 16 bp, Homo sapiens
cgatcaaaaccttcct

SEQ ID NO: 6119097 - DNA, 20 bp, Homo sapiens
cgatcaaaaccttccttccc

SEQ ID NO: 6119098 - DNA, 15 bp, Homo sapiens
cgatcaagagaatca

SEQ ID NO: 6119099 - DNA, 14 bp, Homo sapiens
cgatcaagtccaga

SEQ ID NO: 6119100 - DNA, 15 bp, Homo sapiens
cgatcaagtccagag

SEQ ID NO: 6119101 - DNA, 21 bp, Homo sapiens
cgatcacaaatgactttatta

SEQ ID NO: 6119102 - DNA, 23 bp, Homo sapiens
cgatcacaacgtgcattgtgctt

SEQ ID NO: 6119103 - DNA, 24 bp, Homo sapiens
cgatcacaacgtgcattgtgcttc

SEQ ID NO: 6119104 - DNA, 19 bp, Homo sapiens
cgatcaggaatcttgctcc

SEQ ID NO: 6119105 - DNA, 12 bp, Homo sapiens
cgatcaggagga

SEQ ID NO: 6119106 - DNA, 19 bp, Homo sapiens
cgatcatatttccccttgg

SEQ ID NO: 6119107 - DNA, 20 bp, Homo sapiens
cgatcatggctcactgcagc

SEQ ID NO: 6119108 - DNA, 21 bp, Homo sapiens
cgatcatggctcactgcagcc

SEQ ID NO: 6119109 - DNA, 17 bp, Homo sapiens
cgatcatttatttcatg

SEQ ID NO: 6119110 - DNA, 18 bp, Homo sapiens
cgatcatttatttcatga

SEQ ID NO: 6119111 - DNA, 18 bp, Homo sapiens
cgatccagattcccaggc

SEQ ID NO: 6119112 - DNA, 20 bp, Homo sapiens
cgatccccatggaacagccc

SEQ ID NO: 6119113 - DNA, 18 bp, Homo sapiens
cgatccccgacagtggct

SEQ ID NO: 6119114 - DNA, 12 bp, Homo sapiens
cgatcccctccc

SEQ ID NO: 6119115 - DNA, 15 bp, Homo sapiens
cgatcccctccccca

SEQ ID NO: 6119116 - DNA, 17 bp, Homo sapiens
cgatcctgccaccctgt

SEQ ID NO: 6119117 - DNA, 19 bp, Homo sapiens
cgatcggggcactgcaggg

SEQ ID NO: 6119118 - DNA, 13 bp, Homo sapiens
cgatctcagctca

SEQ ID NO: 6119119 - DNA, 14 bp, Homo sapiens
cgatctcccacctt

SEQ ID NO: 6119120 - DNA, 13 bp, Homo sapiens
cgatctcccaggg

SEQ ID NO: 6119121 - DNA, 17 bp, Homo sapiens
cgatctcccagggctct

SEQ ID NO: 6119122 - DNA, 18 bp, Homo sapiens
cgatctcccagggctctc

SEQ ID NO: 6119123 - DNA, 19 bp, Homo sapiens
cgatctcccagggctctct

SEQ ID NO: 6119124 - DNA, 12 bp, Homo sapiens
cgatcttccccc

SEQ ID NO: 6119125 - DNA, 12 bp, Homo sapiens
cgatgaatgtaa

SEQ ID NO: 6119126 - DNA, 23 bp, Homo sapiens
cgatgaatgtgttgatttgagaa

SEQ ID NO: 6119127 - DNA, 22 bp, Homo sapiens
cgatgatgcttgtaacaagaaa

SEQ ID NO: 6119128 - DNA, 16 bp, Homo sapiens
cgatgatggaaattag

SEQ ID NO: 6119129 - DNA, 11 bp, Homo sapiens
cgatgcacagt

SEQ ID NO: 6119130 - DNA, 13 bp, Homo sapiens
cgatgcactgacc

SEQ ID NO: 6119131 - DNA, 23 bp, Homo sapiens
cgatgcagacagggggccagaac

SEQ ID NO: 6119132 - DNA, 16 bp, Homo sapiens
cgatgcagctctcttt

SEQ ID NO: 6119133 - DNA, 15 bp, Homo sapiens
cgatgcatttaataa

SEQ ID NO: 6119134 - DNA, 17 bp, Homo sapiens
cgatgcatttaataaag

SEQ ID NO: 6119135 - DNA, 13 bp, Homo sapiens
cgatgccagccaa

SEQ ID NO: 6119136 - DNA, 15 bp, Homo sapiens
cgatgccagccttgg

SEQ ID NO: 6119137 - DNA, 19 bp, Homo sapiens
cgatgccataatcagaaca

SEQ ID NO: 6119138 - DNA, 12 bp, Homo sapiens
cgatgcctgatt

SEQ ID NO: 6119139 - DNA, 14 bp, Homo sapiens
cgatgcctgattcg

SEQ ID NO: 6119140 - DNA, 16 bp, Homo sapiens
cgatgcctggcctgcc

SEQ ID NO: 6119141 - DNA, 17 bp, Homo sapiens
cgatgcctttgctgttt

SEQ ID NO: 6119142 - DNA, 15 bp, Homo sapiens
cgatgcgtattctgt

SEQ ID NO: 6119143 - DNA, 14 bp, Homo sapiens
cgatgcgtggctcc

SEQ ID NO: 6119144 - DNA, 13 bp, Homo sapiens
cgatgctcactgc

SEQ ID NO: 6119145 - DNA, 14 bp, Homo sapiens
cgatgctccagcca

SEQ ID NO: 6119146 - DNA, 22 bp, Homo sapiens
cgatgctccagccaacccctgt

SEQ ID NO: 6119147 - DNA, 23 bp, Homo sapiens
cgatgctccagccaacccctgtg

SEQ ID NO: 6119148 - DNA, 11 bp, Homo sapiens
cgatgctccct

SEQ ID NO: 6119149 - DNA, 15 bp, Homo sapiens
cgatgctccctcagc

SEQ ID NO: 6119150 - DNA, 20 bp, Homo sapiens
cgatgctccctcagcctcag

SEQ ID NO: 6119151 - DNA, 17 bp, Homo sapiens
cgatgctgacctcacct

SEQ ID NO: 6119152 - DNA, 16 bp, Homo sapiens
cgatgctgaggccacc

SEQ ID NO: 6119153 - DNA, 12 bp, Homo sapiens
cgatgctgctgg

SEQ ID NO: 6119154 - DNA, 13 bp, Homo sapiens
cgatgctgctggc

SEQ ID NO: 6119155 - DNA, 18 bp, Homo sapiens
cgatgctgctttcccctg

SEQ ID NO: 6119156 - DNA, 22 bp, Homo sapiens
cgatgctgctttcccctgtggg

SEQ ID NO: 6119157 - DNA, 18 bp, Homo sapiens
cgatgctggaggccctcg

SEQ ID NO: 6119158 - DNA, 22 bp, Homo sapiens
cgatgctttaccaaacagcaaa

SEQ ID NO: 6119159 - DNA, 13 bp, Homo sapiens
cgatggacctcag

SEQ ID NO: 6119160 - DNA, 23 bp, Homo sapiens
cgatggacctcagcaagctgccc

SEQ ID NO: 6119161 - DNA, 16 bp, Homo sapiens
cgatggagcccccaga

SEQ ID NO: 6119162 - DNA, 13 bp, Homo sapiens
cgatggaggccta

SEQ ID NO: 6119163 - DNA, 18 bp, Homo sapiens
cgatggatatatgttttt

SEQ ID NO: 6119164 - DNA, 19 bp, Homo sapiens
cgatggcggggatctggga

SEQ ID NO: 6119165 - DNA, 22 bp, Homo sapiens
cgatgggctttcccaacagctc

SEQ ID NO: 6119166 - DNA, 17 bp, Homo sapiens
cgatggggactctgccg

SEQ ID NO: 6119167 - DNA, 19 bp, Homo sapiens
cgatggggcaagacagaaa

SEQ ID NO: 6119168 - DNA, 20 bp, Homo sapiens
cgatggggcaagacagaaaa

SEQ ID NO: 6119169 - DNA, 11 bp, Homo sapiens
cgatggggcat

SEQ ID NO: 6119170 - DNA, 18 bp, Homo sapiens
cgatggtacgtgaccctc

SEQ ID NO: 6119171 - DNA, 16 bp, Homo sapiens
cgatggtctctctccc

SEQ ID NO: 6119172 - DNA, 21 bp, Homo sapiens
cgatggtgctgcccaggcctc

SEQ ID NO: 6119173 - DNA, 17 bp, Homo sapiens
cgatgtcaaggactcct

SEQ ID NO: 6119174 - DNA, 15 bp, Homo sapiens
cgatgtcactcagcc

SEQ ID NO: 6119175 - DNA, 22 bp, Homo sapiens
cgatgtcactcagccccttccc

SEQ ID NO: 6119176 - DNA, 16 bp, Homo sapiens
cgatgtccctgtcccc

SEQ ID NO: 6119177 - DNA, 15 bp, Homo sapiens
cgatgtcctcctctg

SEQ ID NO: 6119178 - DNA, 17 bp, Homo sapiens
cgatgtcctcctctgtg

SEQ ID NO: 6119179 - DNA, 18 bp, Homo sapiens
cgatgtcctcctctgtga

SEQ ID NO: 6119180 - DNA, 19 bp, Homo sapiens
cgatgtcctcctctgtgaa

SEQ ID NO: 6119181 - DNA, 20 bp, Homo sapiens
cgatgtcctcctctgtgaaa

SEQ ID NO: 6119182 - DNA, 12 bp, Homo sapiens
cgatgtgagccg

SEQ ID NO: 6119183 - DNA, 18 bp, Homo sapiens
cgatgtgcgcacacacag

SEQ ID NO: 6119184 - DNA, 20 bp, Homo sapiens
cgatgtggaactgctgccac

SEQ ID NO: 6119185 - DNA, 20 bp, Homo sapiens
ctcagaggaaaaatgggagc

SEQ ID NO: 6119186 - DNA, 15 bp, Homo sapiens
ctcagaggagaggag

SEQ ID NO: 6119187 - DNA, 17 bp, Homo sapiens
ctcagaggagaggagca

SEQ ID NO: 6119188 - DNA, 18 bp, Homo sapiens
ctcagaggagaggagcaa

SEQ ID NO: 6119189 - DNA, 22 bp, Homo sapiens
ctcagaggagtctgggaagggg

SEQ ID NO: 6119190 - DNA, 14 bp, Homo sapiens
ctcagaggcccagg

SEQ ID NO: 6119191 - DNA, 13 bp, Homo sapiens
ctcagaggcccca

SEQ ID NO: 6119192 - DNA, 21 bp, Homo sapiens
ctcagaggccccaatacccca

SEQ ID NO: 6119193 - DNA, 22 bp, Homo sapiens
ctcagaggccccaataccccat

SEQ ID NO: 6119194 - DNA, 23 bp, Homo sapiens
ctcagaggccccaataccccatg

SEQ ID NO: 6119195 - DNA, 15 bp, Homo sapiens
ctcagaggcccccag

SEQ ID NO: 6119196 - DNA, 17 bp, Homo sapiens
ctcagaggcccccagtg

SEQ ID NO: 6119197 - DNA, 22 bp, Homo sapiens
ctcagaggcccccagtggggac

SEQ ID NO: 6119198 - DNA, 23 bp, Homo sapiens
ctcagaggcccccagtggggaca

SEQ ID NO: 6119199 - DNA, 21 bp, Homo sapiens
ctcagaggccccttgctgctg

SEQ ID NO: 6119200 - DNA, 14 bp, Homo sapiens
ctcagaggcctgct

SEQ ID NO: 6119201 - DNA, 22 bp, Homo sapiens
ctcagaggcctgctgccagtgc

SEQ ID NO: 6119202 - DNA, 13 bp, Homo sapiens
ctcagaggccttg

SEQ ID NO: 6119203 - DNA, 16 bp, Homo sapiens
ctcagaggccttgctg

SEQ ID NO: 6119204 - DNA, 18 bp, Homo sapiens
ctcagaggcgcactgtga

SEQ ID NO: 6119205 - DNA, 18 bp, Homo sapiens
ctcagaggctcagagact

SEQ ID NO: 6119206 - DNA, 20 bp, Homo sapiens
ctcagaggctcagagactgc

SEQ ID NO: 6119207 - DNA, 16 bp, Homo sapiens
ctcagaggctgagccc

SEQ ID NO: 6119208 - DNA, 17 bp, Homo sapiens
ctcagaggctgagccct

SEQ ID NO: 6119209 - DNA, 15 bp, Homo sapiens
ctcagaggctgggag

SEQ ID NO: 6119210 - DNA, 20 bp, Homo sapiens
ctcagagggaggagtttttc

SEQ ID NO: 6119211 - DNA, 21 bp, Homo sapiens
ctcagagggaggagtttttct

SEQ ID NO: 6119212 - DNA, 22 bp, Homo sapiens
ctcagagggataaggcagttga

SEQ ID NO: 6119213 - DNA, 13 bp, Homo sapiens
ctcagagggggac

SEQ ID NO: 6119214 - DNA, 18 bp, Homo sapiens
ctcagagggggactgctg

SEQ ID NO: 6119215 - DNA, 19 bp, Homo sapiens
ctcagagggtccctaggtg

SEQ ID NO: 6119216 - DNA, 16 bp, Homo sapiens
ctcagagggtgtcctg

SEQ ID NO: 6119217 - DNA, 18 bp, Homo sapiens
ctcagagggttgttctcc

SEQ ID NO: 6119218 - DNA, 23 bp, Homo sapiens
ctcagaggtttacctagagaaca

SEQ ID NO: 6119219 - DNA, 18 bp, Homo sapiens
ctcagagtatggagctca

SEQ ID NO: 6119220 - DNA, 14 bp, Homo sapiens
ctcagagtccaggc

SEQ ID NO: 6119221 - DNA, 18 bp, Homo sapiens
ctcagagtcggaacggag

SEQ ID NO: 6119222 - DNA, 15 bp, Homo sapiens
ctcagagtctatcaa

SEQ ID NO: 6119223 - DNA, 17 bp, Homo sapiens
ctcagagtgaagagtga

SEQ ID NO: 6119224 - DNA, 23 bp, Homo sapiens
ctcagagtgaagagtgaagagca

SEQ ID NO: 6119225 - DNA, 19 bp, Homo sapiens
ctcagagtgaccctcagct

SEQ ID NO: 6119226 - DNA, 20 bp, Homo sapiens
ctcagagtgaccctcagctg

SEQ ID NO: 6119227 - DNA, 21 bp, Homo sapiens
ctcagagtgaccctcagctgt

SEQ ID NO: 6119228 - DNA, 16 bp, Homo sapiens
ctcagagtggagttga

SEQ ID NO: 6119229 - DNA, 16 bp, Homo sapiens
ctcagagtggtggggg

SEQ ID NO: 6119230 - DNA, 15 bp, Homo sapiens
ctcagagtgtttaat

SEQ ID NO: 6119231 - DNA, 18 bp, Homo sapiens
ctcagagttctatactgt

SEQ ID NO: 6119232 - DNA, 21 bp, Homo sapiens
ctcagataaggtaaaatgcca

SEQ ID NO: 6119233 - DNA, 17 bp, Homo sapiens
ctcagatacccagtgga

SEQ ID NO: 6119234 - DNA, 18 bp, Homo sapiens
ctcagatacccagtggaa

SEQ ID NO: 6119235 - DNA, 18 bp, Homo sapiens
ctcagatagaatgacagt

SEQ ID NO: 6119236 - DNA, 15 bp, Homo sapiens
ctcagatataagaga

SEQ ID NO: 6119237 - DNA, 16 bp, Homo sapiens
ctcagatatttgcacc

SEQ ID NO: 6119238 - DNA, 17 bp, Homo sapiens
ctcagatcactactgca

SEQ ID NO: 6119239 - DNA, 13 bp, Homo sapiens
ctcagatcactgc

SEQ ID NO: 6119240 - DNA, 20 bp, Homo sapiens
ctcagatccaggcaggagca

SEQ ID NO: 6119241 - DNA, 17 bp, Homo sapiens
ctcagatccagggacag

SEQ ID NO: 6119242 - DNA, 20 bp, Homo sapiens
ctcagatcccacttttgcca

SEQ ID NO: 6119243 - DNA, 22 bp, Homo sapiens
ctcagatcccacttttgccaga

SEQ ID NO: 6119244 - DNA, 12 bp, Homo sapiens
ctcagatcccag

SEQ ID NO: 6119245 - DNA, 14 bp, Homo sapiens
ctcagatcccaggg

SEQ ID NO: 6119246 - DNA, 19 bp, Homo sapiens
ctcagatccccagctttct

SEQ ID NO: 6119247 - DNA, 23 bp, Homo sapiens
ctcagatccctcggtcagcaccg

SEQ ID NO: 6119248 - DNA, 17 bp, Homo sapiens
ctcagatccttgtttca

SEQ ID NO: 6119249 - DNA, 14 bp, Homo sapiens
ctcagatctgcact

SEQ ID NO: 6119250 - DNA, 22 bp, Homo sapiens
ctcagatctgcactcctgtctc

SEQ ID NO: 6119251 - DNA, 16 bp, Homo sapiens
ctcagatctggtttct

SEQ ID NO: 6119252 - DNA, 19 bp, Homo sapiens
ctcagatctttgcaccaga

SEQ ID NO: 6119253 - DNA, 15 bp, Homo sapiens
ctcagatgaaaataa

SEQ ID NO: 6119254 - DNA, 19 bp, Homo sapiens
ctcagatgaaaataaaata

SEQ ID NO: 6119255 - DNA, 13 bp, Homo sapiens
ctcagatgctcaa

SEQ ID NO: 6119256 - DNA, 14 bp, Homo sapiens
ctcagatgctcaaa

SEQ ID NO: 6119257 - DNA, 15 bp, Homo sapiens
ctcagatgctcaaag

SEQ ID NO: 6119258 - DNA, 20 bp, Homo sapiens
ctcagatggaaccgcaggaa

SEQ ID NO: 6119259 - DNA, 21 bp, Homo sapiens
ctcagatggaaccgcaggaag

SEQ ID NO: 6119260 - DNA, 23 bp, Homo sapiens
ctcagatggaaccgcaggaagct

SEQ ID NO: 6119261 - DNA, 20 bp, Homo sapiens
ctcagatggactgggaggag

SEQ ID NO: 6119262 - DNA, 12 bp, Homo sapiens
ctcagatggcag

SEQ ID NO: 6119263 - DNA, 15 bp, Homo sapiens
ctcagatggcagctt

SEQ ID NO: 6119264 - DNA, 17 bp, Homo sapiens
ctcagatggcagctttt

SEQ ID NO: 6119265 - DNA, 16 bp, Homo sapiens
ctcagatggggcacca

SEQ ID NO: 6119266 - DNA, 15 bp, Homo sapiens
ctcagatggggcctg

SEQ ID NO: 6119267 - DNA, 19 bp, Homo sapiens
ctcagatggggcctgggct

SEQ ID NO: 6119268 - DNA, 20 bp, Homo sapiens
ctcagatggggcctgggctg

SEQ ID NO: 6119269 - DNA, 14 bp, Homo sapiens
ctcagatggtgtgt

SEQ ID NO: 6119270 - DNA, 22 bp, Homo sapiens
ctcagattcaataatgagagct

SEQ ID NO: 6119271 - DNA, 14 bp, Homo sapiens
ctcagattccacag

SEQ ID NO: 6119272 - DNA, 18 bp, Homo sapiens
ctcagattccccccatct

SEQ ID NO: 6119273 - DNA, 21 bp, Homo sapiens
ctcagattccccccatctcca

SEQ ID NO: 6119274 - DNA, 16 bp, Homo sapiens
ctcagattccttccca

SEQ ID NO: 6119275 - DNA, 15 bp, Homo sapiens
ctcagattcttcact

SEQ ID NO: 6119276 - DNA, 23 bp, Homo sapiens
ctcagattgacctataaaacaaa

SEQ ID NO: 6119277 - DNA, 19 bp, Homo sapiens
ctcagattgactaaataaa

SEQ ID NO: 6119278 - DNA, 13 bp, Homo sapiens
ctcagattgctga

SEQ ID NO: 6119279 - DNA, 22 bp, Homo sapiens
ctcagattgtaatatgtaaatg

SEQ ID NO: 6119280 - DNA, 17 bp, Homo sapiens
ctcagatttaagcctta

SEQ ID NO: 6119281 - DNA, 18 bp, Homo sapiens
ctcagattttattatgta

SEQ ID NO: 6119282 - DNA, 15 bp, Homo sapiens
ctcagcaaacccaaa

SEQ ID NO: 6119283 - DNA, 19 bp, Homo sapiens
ctcagcaaacccaaagatg

SEQ ID NO: 6119284 - DNA, 20 bp, Homo sapiens
ctcagcaaacccaaagatgt

SEQ ID NO: 6119285 - DNA, 15 bp, Homo sapiens
ctcagcaaatcctct

SEQ ID NO: 6119286 - DNA, 18 bp, Homo sapiens
ctcagcaactttcccttg

SEQ ID NO: 6119287 - DNA, 20 bp, Homo sapiens
ctcagcaactttcccttgcc

SEQ ID NO: 6119288 - DNA, 12 bp, Homo sapiens
ctcagcaagacc

SEQ ID NO: 6119289 - DNA, 14 bp, Homo sapiens
ctcagcaagctgcc

SEQ ID NO: 6119290 - DNA, 16 bp, Homo sapiens
ctcagcaagctgccca

SEQ ID NO: 6119291 - DNA, 19 bp, Homo sapiens
ctcagcaagctgcccagcc

SEQ ID NO: 6119292 - DNA, 23 bp, Homo sapiens
ctcagcaagctgcccagccctgg

SEQ ID NO: 6119293 - DNA, 15 bp, Homo sapiens
ctcagcaaggccacc

SEQ ID NO: 6119294 - DNA, 16 bp, Homo sapiens
ctcagcaaggccacct

SEQ ID NO: 6119295 - DNA, 16 bp, Homo sapiens
ctcagcaaggggctct

SEQ ID NO: 6119296 - DNA, 11 bp, Homo sapiens
ctcagcaagtg

SEQ ID NO: 6119297 - DNA, 15 bp, Homo sapiens
ctcagcaagtgccca

SEQ ID NO: 6119298 - DNA, 16 bp, Homo sapiens
ctcagcaagtgcccag

SEQ ID NO: 6119299 - DNA, 17 bp, Homo sapiens
ctcagcaagtgcccagt

SEQ ID NO: 6119300 - DNA, 20 bp, Homo sapiens
ctcagcaagtgcccagtgga

SEQ ID NO: 6119301 - DNA, 14 bp, Homo sapiens
ctcagcacagcctc

SEQ ID NO: 6119302 - DNA, 21 bp, Homo sapiens
ctcagcaccacattgcctcat

SEQ ID NO: 6119303 - DNA, 17 bp, Homo sapiens
ctcagcaccactcaaga

SEQ ID NO: 6119304 - DNA, 18 bp, Homo sapiens
ctcagcaccactcaagac

SEQ ID NO: 6119305 - DNA, 22 bp, Homo sapiens
ctcagcaccactcaagaccaaa

SEQ ID NO: 6119306 - DNA, 14 bp, Homo sapiens
ctcagcaccccact

SEQ ID NO: 6119307 - DNA, 20 bp, Homo sapiens
ctcagcaccccactcctcag

SEQ ID NO: 6119308 - DNA, 20 bp, Homo sapiens
ctcagcacccccttctctgc

SEQ ID NO: 6119309 - DNA, 21 bp, Homo sapiens
ctcagcaccccttccatgtgg

SEQ ID NO: 6119310 - DNA, 14 bp, Homo sapiens
ctcagcactctgga

SEQ ID NO: 6119311 - DNA, 18 bp, Homo sapiens
ctcagcactctggactcc

SEQ ID NO: 6119312 - DNA, 19 bp, Homo sapiens
ctcagcactgcctgctccc

SEQ ID NO: 6119313 - DNA, 18 bp, Homo sapiens
ctcagcacttggcccttc

SEQ ID NO: 6119314 - DNA, 15 bp, Homo sapiens
ctcagcagaaggcct

SEQ ID NO: 6119315 - DNA, 18 bp, Homo sapiens
ctcagcagacatttatct

SEQ ID NO: 6119316 - DNA, 13 bp, Homo sapiens
ctcagcagaggca

SEQ ID NO: 6119317 - DNA, 15 bp, Homo sapiens
ctcagcagaggcagt

SEQ ID NO: 6119318 - DNA, 16 bp, Homo sapiens
ctcagcagaggcagtg

SEQ ID NO: 6119319 - DNA, 14 bp, Homo sapiens
ctcagcagagtgag

SEQ ID NO: 6119320 - DNA, 23 bp, Homo sapiens
ctcagcagcaaatgccactctgg

SEQ ID NO: 6119321 - DNA, 18 bp, Homo sapiens
ctcagcagcagagagccc

SEQ ID NO: 6119322 - DNA, 11 bp, Homo sapiens
ctcagcagccc

SEQ ID NO: 6119323 - DNA, 18 bp, Homo sapiens
ctcagcagccccctgccc

SEQ ID NO: 6119324 - DNA, 12 bp, Homo sapiens
ctcagcagccct

SEQ ID NO: 6119325 - DNA, 13 bp, Homo sapiens
ctcagcagcccta

SEQ ID NO: 6119326 - DNA, 15 bp, Homo sapiens
ctcagcagccctagc

SEQ ID NO: 6119327 - DNA, 22 bp, Homo sapiens
ctcagcagccctagcggctgct

SEQ ID NO: 6119328 - DNA, 20 bp, Homo sapiens
ctcagcagcgaccacccctg

SEQ ID NO: 6119329 - DNA, 13 bp, Homo sapiens
ctcagcagctctg

SEQ ID NO: 6119330 - DNA, 13 bp, Homo sapiens
ctcagcaggaacc

SEQ ID NO: 6119331 - DNA, 22 bp, Homo sapiens
ctcagcaggagcccccagctgc

SEQ ID NO: 6119332 - DNA, 13 bp, Homo sapiens
ctcagcagggctg

SEQ ID NO: 6119333 - DNA, 22 bp, Homo sapiens
ctcagcagggctggtcacctcc

SEQ ID NO: 6119334 - DNA, 23 bp, Homo sapiens
ctcagcaggttggcttttttccc

SEQ ID NO: 6119335 - DNA, 19 bp, Homo sapiens
ctcagcagtaagcaggcct

SEQ ID NO: 6119336 - DNA, 12 bp, Homo sapiens
ctcagcatacct

SEQ ID NO: 6119337 - DNA, 16 bp, Homo sapiens
ctcagcatacctgctg

SEQ ID NO: 6119338 - DNA, 19 bp, Homo sapiens
ctcagcatagcctgcctga

SEQ ID NO: 6119339 - DNA, 19 bp, Homo sapiens
ctcagcataggtatgctta

SEQ ID NO: 6119340 - DNA, 21 bp, Homo sapiens
ctcagcataggtatgcttact

SEQ ID NO: 6119341 - DNA, 21 bp, Homo sapiens
ctcagcatatatataaaatac

SEQ ID NO: 6119342 - DNA, 18 bp, Homo sapiens
ctcagcatatttgtatag

SEQ ID NO: 6119343 - DNA, 19 bp, Homo sapiens
ctcagcatatttgtatagt

SEQ ID NO: 6119344 - DNA, 20 bp, Homo sapiens
ctcagcatcaaaatatttca

SEQ ID NO: 6119345 - DNA, 17 bp, Homo sapiens
ctcagcatcctggaaat

SEQ ID NO: 6119346 - DNA, 17 bp, Homo sapiens
ctcagcatctcataact

SEQ ID NO: 6119347 - DNA, 19 bp, Homo sapiens
ctcagcatgtagggcttct

SEQ ID NO: 6119348 - DNA, 22 bp, Homo sapiens
ctcagcatgtagggcttctgtg

SEQ ID NO: 6119349 - DNA, 22 bp, Homo sapiens
ctcagcattacctctttggaaa

SEQ ID NO: 6119350 - DNA, 16 bp, Homo sapiens
ctcagcattgtcagcc

SEQ ID NO: 6119351 - DNA, 18 bp, Homo sapiens
ctcagcattgtcagcctg

SEQ ID NO: 6119352 - DNA, 21 bp, Homo sapiens
ctcagcattgtcagcctgaag

SEQ ID NO: 6119353 - DNA, 23 bp, Homo sapiens
ctcagcatttccttccagcccat

SEQ ID NO: 6119354 - DNA, 14 bp, Homo sapiens
ctcagcatttgatt

SEQ ID NO: 6119355 - DNA, 14 bp, Homo sapiens
ctcagccaaacaca

SEQ ID NO: 6119356 - DNA, 20 bp, Homo sapiens
ctcagccaaccttacttaca

SEQ ID NO: 6119357 - DNA, 20 bp, Homo sapiens
ctcagccaagcacagtggtg

SEQ ID NO: 6119358 - DNA, 23 bp, Homo sapiens
ctcagccaagcacagtggtggca

SEQ ID NO: 6119359 - DNA, 19 bp, Homo sapiens
ctcagccacacccaggcac

SEQ ID NO: 6119360 - DNA, 14 bp, Homo sapiens
ctcagccacacccc

SEQ ID NO: 6119361 - DNA, 15 bp, Homo sapiens
ctcagccacacccca

SEQ ID NO: 6119362 - DNA, 23 bp, Homo sapiens
cgatgtggacctctactttccag

SEQ ID NO: 6119363 - DNA, 21 bp, Homo sapiens
cgatgtggacgtcacgctccc

SEQ ID NO: 6119364 - DNA, 15 bp, Homo sapiens
cgatgtggccctggc

SEQ ID NO: 6119365 - DNA, 22 bp, Homo sapiens
cgatgtggccctggcctgctgg

SEQ ID NO: 6119366 - DNA, 19 bp, Homo sapiens
cgatgtgggtccctctctt

SEQ ID NO: 6119367 - DNA, 17 bp, Homo sapiens
cgatgtggtcacagctg

SEQ ID NO: 6119368 - DNA, 16 bp, Homo sapiens
cgatgtgtctcccaga

SEQ ID NO: 6119369 - DNA, 17 bp, Homo sapiens
cgatgtgtctcccagaa

SEQ ID NO: 6119370 - DNA, 13 bp, Homo sapiens
cgatgtgttttat

SEQ ID NO: 6119371 - DNA, 21 bp, Homo sapiens
cgatgttaaaacaaattaaaa

SEQ ID NO: 6119372 - DNA, 14 bp, Homo sapiens
cgatgttgaacttt

SEQ ID NO: 6119373 - DNA, 16 bp, Homo sapiens
cgatgttgaacttttt

SEQ ID NO: 6119374 - DNA, 14 bp, Homo sapiens
cgattaatttatgg

SEQ ID NO: 6119375 - DNA, 18 bp, Homo sapiens
cgattagactggacagct

SEQ ID NO: 6119376 - DNA, 15 bp, Homo sapiens
cgattatttatttct

SEQ ID NO: 6119377 - DNA, 17 bp, Homo sapiens
cgattatttatttctgt

SEQ ID NO: 6119378 - DNA, 19 bp, Homo sapiens
cgattatttatttctgtaa

SEQ ID NO: 6119379 - DNA, 12 bp, Homo sapiens
cgattcacagcc

SEQ ID NO: 6119380 - DNA, 16 bp, Homo sapiens
cgattcaccctgtcca

SEQ ID NO: 6119381 - DNA, 11 bp, Homo sapiens
cgattccagtg

SEQ ID NO: 6119382 - DNA, 12 bp, Homo sapiens
cgattcccaagc

SEQ ID NO: 6119383 - DNA, 13 bp, Homo sapiens
cgattcctgccaa

SEQ ID NO: 6119384 - DNA, 15 bp, Homo sapiens
cgattctcatgcctc

SEQ ID NO: 6119385 - DNA, 18 bp, Homo sapiens
cgattctcccgcctcagc

SEQ ID NO: 6119386 - DNA, 20 bp, Homo sapiens
cgattctcccgcctcagcct

SEQ ID NO: 6119387 - DNA, 23 bp, Homo sapiens
cgattctcctgtctcagcctcct

SEQ ID NO: 6119388 - DNA, 13 bp, Homo sapiens
cgattctctgccc

SEQ ID NO: 6119389 - DNA, 21 bp, Homo sapiens
cgattctctgcccgggcccct

SEQ ID NO: 6119390 - DNA, 17 bp, Homo sapiens
cgattcttgtgcctcag

SEQ ID NO: 6119391 - DNA, 18 bp, Homo sapiens
cgattcttgtgcctcagc

SEQ ID NO: 6119392 - DNA, 16 bp, Homo sapiens
cgattcttgtgcctcg

SEQ ID NO: 6119393 - DNA, 21 bp, Homo sapiens
cgattgattgatgtacagaac

SEQ ID NO: 6119394 - DNA, 17 bp, Homo sapiens
cgattggagaatacttt

SEQ ID NO: 6119395 - DNA, 13 bp, Homo sapiens
cgattggctttaa

SEQ ID NO: 6119396 - DNA, 15 bp, Homo sapiens
cgattggctttaaac

SEQ ID NO: 6119397 - DNA, 12 bp, Homo sapiens
cgattgtaactc

SEQ ID NO: 6119398 - DNA, 19 bp, Homo sapiens
cgattgtgtacttttcctt

SEQ ID NO: 6119399 - DNA, 20 bp, Homo sapiens
cgattgtgtacttttccttt

SEQ ID NO: 6119400 - DNA, 15 bp, Homo sapiens
cgatttaattctctt

SEQ ID NO: 6119401 - DNA, 18 bp, Homo sapiens
cgatttaattctcttgaa

SEQ ID NO: 6119402 - DNA, 19 bp, Homo sapiens
cgatttcagcacatgcact

SEQ ID NO: 6119403 - DNA, 11 bp, Homo sapiens
cgatttctaaa

SEQ ID NO: 6119404 - DNA, 12 bp, Homo sapiens
cgatttctccat

SEQ ID NO: 6119405 - DNA, 12 bp, Homo sapiens
cgatttctgcta

SEQ ID NO: 6119406 - DNA, 17 bp, Homo sapiens
cgatttctgtaaactct

SEQ ID NO: 6119407 - DNA, 12 bp, Homo sapiens
cgatttctgttt

SEQ ID NO: 6119408 - DNA, 17 bp, Homo sapiens
cgatttgtattaatgta

SEQ ID NO: 6119409 - DNA, 23 bp, Homo sapiens
cgatttgttttcttcaacatgtg

SEQ ID NO: 6119410 - DNA, 15 bp, Homo sapiens
cgattttatctgtta

SEQ ID NO: 6119411 - DNA, 17 bp, Homo sapiens
cgattttcaagattcta

SEQ ID NO: 6119412 - DNA, 18 bp, Homo sapiens
cgattttgtatctgcagg

SEQ ID NO: 6119413 - DNA, 20 bp, Homo sapiens
cgatttttaagagccttcaa

SEQ ID NO: 6119414 - DNA, 12 bp, Homo sapiens
cgatttttgtat

SEQ ID NO: 6119415 - DNA, 22 bp, Homo sapiens
cgatttttgtatgttatgaaca

SEQ ID NO: 6119416 - DNA, 20 bp, Homo sapiens
cgattttttttttttcctct

SEQ ID NO: 6119417 - DNA, 13 bp, Homo sapiens
cgcaaaaatagct

SEQ ID NO: 6119418 - DNA, 18 bp, Homo sapiens
cgcaaaccaacctttctg

SEQ ID NO: 6119419 - DNA, 18 bp, Homo sapiens
cgcaaaccacactggact

SEQ ID NO: 6119420 - DNA, 18 bp, Homo sapiens
cgcaaacctctccttcct

SEQ ID NO: 6119421 - DNA, 16 bp, Homo sapiens
cgcaaagagagatttt

SEQ ID NO: 6119422 - DNA, 18 bp, Homo sapiens
cgcaaatacaaaatgatt

SEQ ID NO: 6119423 - DNA, 17 bp, Homo sapiens
cgcaacccacagctcag

SEQ ID NO: 6119424 - DNA, 13 bp, Homo sapiens
cgcaaccctgcct

SEQ ID NO: 6119425 - DNA, 16 bp, Homo sapiens
cgcaacccttgctgct

SEQ ID NO: 6119426 - DNA, 14 bp, Homo sapiens
cgcaacgctctgcg

SEQ ID NO: 6119427 - DNA, 15 bp, Homo sapiens
cgcaactctccagcc

SEQ ID NO: 6119428 - DNA, 12 bp, Homo sapiens
cgcaactcttgt

SEQ ID NO: 6119429 - DNA, 13 bp, Homo sapiens
cgcaagaggcatc

SEQ ID NO: 6119430 - DNA, 14 bp, Homo sapiens
cgcaagagggacag

SEQ ID NO: 6119431 - DNA, 18 bp, Homo sapiens
cgcaagaggtttcagcat

SEQ ID NO: 6119432 - DNA, 20 bp, Homo sapiens
cgcaagatagatttggaata

SEQ ID NO: 6119433 - DNA, 15 bp, Homo sapiens
cgcaagcctcagcca

SEQ ID NO: 6119434 - DNA, 22 bp, Homo sapiens
cgcaagcgacacaggctgccgc

SEQ ID NO: 6119435 - DNA, 17 bp, Homo sapiens
cgcaagcgcagggagga

SEQ ID NO: 6119436 - DNA, 13 bp, Homo sapiens
cgcaaggccctgt

SEQ ID NO: 6119437 - DNA, 18 bp, Homo sapiens
cgcaaggccctgtcccag

SEQ ID NO: 6119438 - DNA, 18 bp, Homo sapiens
cgcaaggcctgtgctgca

SEQ ID NO: 6119439 - DNA, 15 bp, Homo sapiens
cgcaaggctgtgctc

SEQ ID NO: 6119440 - DNA, 22 bp, Homo sapiens
cgcaaggctgtgctcttcctct

SEQ ID NO: 6119441 - DNA, 18 bp, Homo sapiens
cgcaagggaggcccagcg

SEQ ID NO: 6119442 - DNA, 21 bp, Homo sapiens
cgcaagggcatcaggcactgg

SEQ ID NO: 6119443 - DNA, 15 bp, Homo sapiens
cgcaagggcctggac

SEQ ID NO: 6119444 - DNA, 12 bp, Homo sapiens
cgcaagtgcctg

SEQ ID NO: 6119445 - DNA, 14 bp, Homo sapiens
cgcaagtgcctggg

SEQ ID NO: 6119446 - DNA, 15 bp, Homo sapiens
cgcaagttcagggaa

SEQ ID NO: 6119447 - DNA, 17 bp, Homo sapiens
cgcaatagttttttact

SEQ ID NO: 6119448 - DNA, 17 bp, Homo sapiens
cgcaattctcgattctt

SEQ ID NO: 6119449 - DNA, 16 bp, Homo sapiens
cgcaattgtatatata

SEQ ID NO: 6119450 - DNA, 23 bp, Homo sapiens
cgcacaaatgaccgcacgttctc

SEQ ID NO: 6119451 - DNA, 21 bp, Homo sapiens
cgcacaaggctgaccaagaga

SEQ ID NO: 6119452 - DNA, 22 bp, Homo sapiens
cgcacaatagtaacctgggtaa

SEQ ID NO: 6119453 - DNA, 18 bp, Homo sapiens
cgcacacacacacataca

SEQ ID NO: 6119454 - DNA, 22 bp, Homo sapiens
cgcacacacaccggtcaccgag

SEQ ID NO: 6119455 - DNA, 14 bp, Homo sapiens
cgcacacacactct

SEQ ID NO: 6119456 - DNA, 16 bp, Homo sapiens
cgcacacagctgagca

SEQ ID NO: 6119457 - DNA, 12 bp, Homo sapiens
cgcacacagctt

SEQ ID NO: 6119458 - DNA, 19 bp, Homo sapiens
cgcacacatcttacctctc

SEQ ID NO: 6119459 - DNA, 19 bp, Homo sapiens
cgcacacatggacacagac

SEQ ID NO: 6119460 - DNA, 18 bp, Homo sapiens
cgcacaccctgcccctgg

SEQ ID NO: 6119461 - DNA, 14 bp, Homo sapiens
cgcacacgcacaca

SEQ ID NO: 6119462 - DNA, 16 bp, Homo sapiens
cgcacacgcacacatc

SEQ ID NO: 6119463 - DNA, 10 bp, Homo sapiens
cgcacactgg

SEQ ID NO: 6119464 - DNA, 22 bp, Homo sapiens
cgcacactgtgattttgccctc

SEQ ID NO: 6119465 - DNA, 12 bp, Homo sapiens
cgcacagacagg

SEQ ID NO: 6119466 - DNA, 9 bp, Homo sapiens
cgcacagca

SEQ ID NO: 6119467 - DNA, 10 bp, Homo sapiens
cgcacagcac

SEQ ID NO: 6119468 - DNA, 15 bp, Homo sapiens
cgcacagcagcctgc

SEQ ID NO: 6119469 - DNA, 12 bp, Homo sapiens
cgcacagccacc

SEQ ID NO: 6119470 - DNA, 15 bp, Homo sapiens
cgcacagccacccgt

SEQ ID NO: 6119471 - DNA, 17 bp, Homo sapiens
cgcacagccacccgtgg

SEQ ID NO: 6119472 - DNA, 13 bp, Homo sapiens
cgcacagctgctc

SEQ ID NO: 6119473 - DNA, 14 bp, Homo sapiens
cgcacaggtgctga

SEQ ID NO: 6119474 - DNA, 13 bp, Homo sapiens
cgcacagtctctc

SEQ ID NO: 6119475 - DNA, 13 bp, Homo sapiens
cgcacagtgcagt

SEQ ID NO: 6119476 - DNA, 16 bp, Homo sapiens
cgcacatggtgtgggg

SEQ ID NO: 6119477 - DNA, 13 bp, Homo sapiens
cgcaccaagcaga

SEQ ID NO: 6119478 - DNA, 20 bp, Homo sapiens
cgcaccactgcactccagcc

SEQ ID NO: 6119479 - DNA, 13 bp, Homo sapiens
cgcaccactgctt

SEQ ID NO: 6119480 - DNA, 17 bp, Homo sapiens
cgcaccagcccagaagt

SEQ ID NO: 6119481 - DNA, 18 bp, Homo sapiens
cgcaccagctgctctgcc

SEQ ID NO: 6119482 - DNA, 20 bp, Homo sapiens
cgcaccagctgctctgcccc

SEQ ID NO: 6119483 - DNA, 16 bp, Homo sapiens
cgcaccatgtgggcac

SEQ ID NO: 6119484 - DNA, 14 bp, Homo sapiens
cgcaccattctgac

SEQ ID NO: 6119485 - DNA, 20 bp, Homo sapiens
cgcacccagagaaaattaat

SEQ ID NO: 6119486 - DNA, 12 bp, Homo sapiens
cgcaccccacag

SEQ ID NO: 6119487 - DNA, 21 bp, Homo sapiens
cgcaccccacagctggggccg

SEQ ID NO: 6119488 - DNA, 14 bp, Homo sapiens
cgcaccccagagtg

SEQ ID NO: 6119489 - DNA, 13 bp, Homo sapiens
cgcaccccagtgc

SEQ ID NO: 6119490 - DNA, 17 bp, Homo sapiens
cgcaccccccaagctgt

SEQ ID NO: 6119491 - DNA, 18 bp, Homo sapiens
cgcacccccctgttctaa

SEQ ID NO: 6119492 - DNA, 13 bp, Homo sapiens
cgcacccccgcca

SEQ ID NO: 6119493 - DNA, 22 bp, Homo sapiens
cgcaccccgatgtggacctcta

SEQ ID NO: 6119494 - DNA, 18 bp, Homo sapiens
cgcaccccgcccctgcat

SEQ ID NO: 6119495 - DNA, 22 bp, Homo sapiens
cgcacccctacttcacagagga

SEQ ID NO: 6119496 - DNA, 12 bp, Homo sapiens
cgcacccctcct

SEQ ID NO: 6119497 - DNA, 18 bp, Homo sapiens
cgcacccggcagcccccc

SEQ ID NO: 6119498 - DNA, 23 bp, Homo sapiens
cgcaccctcctttctcaccagcc

SEQ ID NO: 6119499 - DNA, 13 bp, Homo sapiens
cgcaccctgcacc

SEQ ID NO: 6119500 - DNA, 14 bp, Homo sapiens
cgcaccctgcacct

SEQ ID NO: 6119501 - DNA, 14 bp, Homo sapiens
cgcaccctgcctac

SEQ ID NO: 6119502 - DNA, 14 bp, Homo sapiens
cgcaccctggcctg

SEQ ID NO: 6119503 - DNA, 15 bp, Homo sapiens
cgcaccctgtcctgc

SEQ ID NO: 6119504 - DNA, 22 bp, Homo sapiens
cgcaccgacttcaatttcccac

SEQ ID NO: 6119505 - DNA, 15 bp, Homo sapiens
cgcaccgccgccacc

SEQ ID NO: 6119506 - DNA, 13 bp, Homo sapiens
cgcacctaaagca

SEQ ID NO: 6119507 - DNA, 20 bp, Homo sapiens
cgcacctccacgccactgcc

SEQ ID NO: 6119508 - DNA, 12 bp, Homo sapiens
cgcacctcccat

SEQ ID NO: 6119509 - DNA, 16 bp, Homo sapiens
cgcacctcccatccta

SEQ ID NO: 6119510 - DNA, 19 bp, Homo sapiens
cgcacctgtagtcccagct

SEQ ID NO: 6119511 - DNA, 13 bp, Homo sapiens
cgcaccttcctcc

SEQ ID NO: 6119512 - DNA, 18 bp, Homo sapiens
cgcacgacgtcagcctct

SEQ ID NO: 6119513 - DNA, 16 bp, Homo sapiens
cgcacgcaacccttgc

SEQ ID NO: 6119514 - DNA, 21 bp, Homo sapiens
cgcacgcaacccttgctgctg

SEQ ID NO: 6119515 - DNA, 16 bp, Homo sapiens
cgcacgcaagcctcag

SEQ ID NO: 6119516 - DNA, 11 bp, Homo sapiens
cgcacgcacac

SEQ ID NO: 6119517 - DNA, 16 bp, Homo sapiens
cgcacgcctctccctg

SEQ ID NO: 6119518 - DNA, 14 bp, Homo sapiens
cgcacggcttccta

SEQ ID NO: 6119519 - DNA, 18 bp, Homo sapiens
cgcacgtccgcgggtccc

SEQ ID NO: 6119520 - DNA, 14 bp, Homo sapiens
cgcactacatctga

SEQ ID NO: 6119521 - DNA, 19 bp, Homo sapiens
cgcactcaggagcacagcc

SEQ ID NO: 6119522 - DNA, 17 bp, Homo sapiens
cgcactccatgagcacc

SEQ ID NO: 6119523 - DNA, 13 bp, Homo sapiens
cgcactctggcag

SEQ ID NO: 6119524 - DNA, 13 bp, Homo sapiens
cgcactgcagacg

SEQ ID NO: 6119525 - DNA, 13 bp, Homo sapiens
cgcactgcatggg

SEQ ID NO: 6119526 - DNA, 17 bp, Homo sapiens
cgcactggacagcatca

SEQ ID NO: 6119527 - DNA, 11 bp, Homo sapiens
cgcactgggag

SEQ ID NO: 6119528 - DNA, 13 bp, Homo sapiens
cgcactgggagca

SEQ ID NO: 6119529 - DNA, 16 bp, Homo sapiens
cgcactgggccacgga

SEQ ID NO: 6119530 - DNA, 15 bp, Homo sapiens
cgcactggtgccaaa

SEQ ID NO: 6119531 - DNA, 13 bp, Homo sapiens
cgcactgtcccag

SEQ ID NO: 6119532 - DNA, 13 bp, Homo sapiens
cgcacttacaagt

SEQ ID NO: 6119533 - DNA, 17 bp, Homo sapiens
cgcacttcccatttgtg

SEQ ID NO: 6119534 - DNA, 17 bp, Homo sapiens
cgcacttctggggccag

SEQ ID NO: 6119535 - DNA, 22 bp, Homo sapiens
cgcacttctggggccagcccct

SEQ ID NO: 6119536 - DNA, 22 bp, Homo sapiens
cgcacttgcctgttggctgctg

SEQ ID NO: 6119537 - DNA, 14 bp, Homo sapiens
cgcactttccactt

SEQ ID NO: 6119538 - DNA, 20 bp, Homo sapiens
cgcagaacgaaccttggcct

SEQ ID NO: 6119539 - DNA, 14 bp, Homo sapiens
cgcagaagcagccc

SEQ ID NO: 6119540 - DNA, 16 bp, Homo sapiens
cgcagaagcagcccct

SEQ ID NO: 6119541 - DNA, 11 bp, Homo sapiens
cgcagacacac

SEQ ID NO: 6119542 - DNA, 12 bp, Homo sapiens
cgcagacacaca

SEQ ID NO: 6119543 - DNA, 13 bp, Homo sapiens
cgcagacacacac

SEQ ID NO: 6119544 - DNA, 14 bp, Homo sapiens
cgcagacacacaca

SEQ ID NO: 6119545 - DNA, 16 bp, Homo sapiens
cgcagacagacagaca

SEQ ID NO: 6119546 - DNA, 18 bp, Homo sapiens
ctcagccaccctgagttg

SEQ ID NO: 6119547 - DNA, 24 bp, Homo sapiens
ctcagccacccttggtctcatgcc

SEQ ID NO: 6119548 - DNA, 19 bp, Homo sapiens
ctcagccacgaccagcccc

SEQ ID NO: 6119549 - DNA, 16 bp, Homo sapiens
ctcagccacgcctctc

SEQ ID NO: 6119550 - DNA, 18 bp, Homo sapiens
ctcagccacgcctctctc

SEQ ID NO: 6119551 - DNA, 17 bp, Homo sapiens
ctcagccactcccaggg

SEQ ID NO: 6119552 - DNA, 15 bp, Homo sapiens
ctcagccactgtcac

SEQ ID NO: 6119553 - DNA, 19 bp, Homo sapiens
ctcagccactgtcacaggc

SEQ ID NO: 6119554 - DNA, 13 bp, Homo sapiens
ctcagccagcact

SEQ ID NO: 6119555 - DNA, 14 bp, Homo sapiens
ctcagccagccctg

SEQ ID NO: 6119556 - DNA, 15 bp, Homo sapiens
ctcagccagccctgg

SEQ ID NO: 6119557 - DNA, 20 bp, Homo sapiens
ctcagccagccctggaggct

SEQ ID NO: 6119558 - DNA, 22 bp, Homo sapiens
ctcagccagccctggaggctgg

SEQ ID NO: 6119559 - DNA, 14 bp, Homo sapiens
ctcagccagcctcg

SEQ ID NO: 6119560 - DNA, 15 bp, Homo sapiens
ctcagccagctgccc

SEQ ID NO: 6119561 - DNA, 15 bp, Homo sapiens
ctcagccagctgttt

SEQ ID NO: 6119562 - DNA, 14 bp, Homo sapiens
ctcagccaggccct

SEQ ID NO: 6119563 - DNA, 22 bp, Homo sapiens
ctcagccagggctgccagccag

SEQ ID NO: 6119564 - DNA, 20 bp, Homo sapiens
ctcagccaggtgctgtgaca

SEQ ID NO: 6119565 - DNA, 19 bp, Homo sapiens
ctcagccataaagtgccag

SEQ ID NO: 6119566 - DNA, 20 bp, Homo sapiens
ctcagccatccgcagactgc

SEQ ID NO: 6119567 - DNA, 20 bp, Homo sapiens
ctcagccattctctacccat

SEQ ID NO: 6119568 - DNA, 22 bp, Homo sapiens
ctcagccatttccccctcctca

SEQ ID NO: 6119569 - DNA, 17 bp, Homo sapiens
ctcagcccacctgcacc

SEQ ID NO: 6119570 - DNA, 21 bp, Homo sapiens
ctcagcccacctgcacccagg

SEQ ID NO: 6119571 - DNA, 22 bp, Homo sapiens
ctcagcccacctgcacccaggt

SEQ ID NO: 6119572 - DNA, 22 bp, Homo sapiens
ctcagcccagctggccacctag

SEQ ID NO: 6119573 - DNA, 23 bp, Homo sapiens
ctcagcccagctggccacctaga

SEQ ID NO: 6119574 - DNA, 13 bp, Homo sapiens
ctcagcccaggca

SEQ ID NO: 6119575 - DNA, 15 bp, Homo sapiens
ctcagcccatcccct

SEQ ID NO: 6119576 - DNA, 19 bp, Homo sapiens
ctcagcccatcccctgcct

SEQ ID NO: 6119577 - DNA, 20 bp, Homo sapiens
ctcagcccatcccctgcctc

SEQ ID NO: 6119578 - DNA, 17 bp, Homo sapiens
ctcagccccaccccagg

SEQ ID NO: 6119579 - DNA, 19 bp, Homo sapiens
ctcagccccaccccagggc

SEQ ID NO: 6119580 - DNA, 14 bp, Homo sapiens
ctcagccccactga

SEQ ID NO: 6119581 - DNA, 12 bp, Homo sapiens
ctcagccccaga

SEQ ID NO: 6119582 - DNA, 18 bp, Homo sapiens
ctcagccccagacctgcc

SEQ ID NO: 6119583 - DNA, 15 bp, Homo sapiens
ctcagccccagccca

SEQ ID NO: 6119584 - DNA, 23 bp, Homo sapiens
ctcagccccagcccagcccagct

SEQ ID NO: 6119585 - DNA, 14 bp, Homo sapiens
ctcagccccaggag

SEQ ID NO: 6119586 - DNA, 13 bp, Homo sapiens
ctcagccccaggg

SEQ ID NO: 6119587 - DNA, 17 bp, Homo sapiens
ctcagccccagggccct

SEQ ID NO: 6119588 - DNA, 21 bp, Homo sapiens
ctcagccccagggccctgctc

SEQ ID NO: 6119589 - DNA, 16 bp, Homo sapiens
ctcagcccccaggcca

SEQ ID NO: 6119590 - DNA, 14 bp, Homo sapiens
ctcagccccggcca

SEQ ID NO: 6119591 - DNA, 20 bp, Homo sapiens
ctcagccccggccactccct

SEQ ID NO: 6119592 - DNA, 21 bp, Homo sapiens
ctcagccccggccactccctg

SEQ ID NO: 6119593 - DNA, 17 bp, Homo sapiens
ctcagccccgggcctgc

SEQ ID NO: 6119594 - DNA, 23 bp, Homo sapiens
ctcagccccgggcctgcctctga

SEQ ID NO: 6119595 - DNA, 22 bp, Homo sapiens
ctcagcccctacccctgccctg

SEQ ID NO: 6119596 - DNA, 23 bp, Homo sapiens
ctcagcccctacccctgccctgc

SEQ ID NO: 6119597 - DNA, 16 bp, Homo sapiens
ctcagcccctcagaga

SEQ ID NO: 6119598 - DNA, 19 bp, Homo sapiens
ctcagcccctcttgccccc

SEQ ID NO: 6119599 - DNA, 20 bp, Homo sapiens
ctcagcccctgatcctgtga

SEQ ID NO: 6119600 - DNA, 15 bp, Homo sapiens
ctcagccccttcccg

SEQ ID NO: 6119601 - DNA, 17 bp, Homo sapiens
ctcagccccttcccggt

SEQ ID NO: 6119602 - DNA, 13 bp, Homo sapiens
ctcagcccgcttg

SEQ ID NO: 6119603 - DNA, 18 bp, Homo sapiens
ctcagcccgcttggccac

SEQ ID NO: 6119604 - DNA, 23 bp, Homo sapiens
ctcagcccgggatcctgatggca

SEQ ID NO: 6119605 - DNA, 22 bp, Homo sapiens
ctcagccctagaggcgagccag

SEQ ID NO: 6119606 - DNA, 23 bp, Homo sapiens
ctcagccctagaggcgagccagg

SEQ ID NO: 6119607 - DNA, 19 bp, Homo sapiens
ctcagccctagccctcagc

SEQ ID NO: 6119608 - DNA, 18 bp, Homo sapiens
ctcagccctcacacaccc

SEQ ID NO: 6119609 - DNA, 13 bp, Homo sapiens
ctcagccctcaga

SEQ ID NO: 6119610 - DNA, 13 bp, Homo sapiens
ctcagccctcagt

SEQ ID NO: 6119611 - DNA, 14 bp, Homo sapiens
ctcagccctccctg

SEQ ID NO: 6119612 - DNA, 15 bp, Homo sapiens
ctcagccctgaccct

SEQ ID NO: 6119613 - DNA, 19 bp, Homo sapiens
ctcagccctgactggtgct

SEQ ID NO: 6119614 - DNA, 13 bp, Homo sapiens
ctcagccctgagc

SEQ ID NO: 6119615 - DNA, 17 bp, Homo sapiens
ctcagccctgaggacag

SEQ ID NO: 6119616 - DNA, 15 bp, Homo sapiens
ctcagccctgagttg

SEQ ID NO: 6119617 - DNA, 17 bp, Homo sapiens
ctcagccctgagttggc

SEQ ID NO: 6119618 - DNA, 14 bp, Homo sapiens
ctcagccctgctcc

SEQ ID NO: 6119619 - DNA, 17 bp, Homo sapiens
ctcagccctgctccctg

SEQ ID NO: 6119620 - DNA, 12 bp, Homo sapiens
ctcagccctgga

SEQ ID NO: 6119621 - DNA, 19 bp, Homo sapiens
ctcagccctggaggtgcca

SEQ ID NO: 6119622 - DNA, 14 bp, Homo sapiens
ctcagccctggccc

SEQ ID NO: 6119623 - DNA, 17 bp, Homo sapiens
ctcagccctggccctgc

SEQ ID NO: 6119624 - DNA, 17 bp, Homo sapiens
ctcagccctggcctggc

SEQ ID NO: 6119625 - DNA, 20 bp, Homo sapiens
ctcagccctggcctttttct

SEQ ID NO: 6119626 - DNA, 17 bp, Homo sapiens
ctcagccgagaaattgg

SEQ ID NO: 6119627 - DNA, 20 bp, Homo sapiens
ctcagccgtagggtggcact

SEQ ID NO: 6119628 - DNA, 16 bp, Homo sapiens
ctcagccgtcagccat

SEQ ID NO: 6119629 - DNA, 18 bp, Homo sapiens
ctcagccgtcagccatca

SEQ ID NO: 6119630 - DNA, 16 bp, Homo sapiens
ctcagcctaagaaaca

SEQ ID NO: 6119631 - DNA, 22 bp, Homo sapiens
ctcagcctactccgctcactga

SEQ ID NO: 6119632 - DNA, 15 bp, Homo sapiens
ctcagcctcagagga

SEQ ID NO: 6119633 - DNA, 21 bp, Homo sapiens
ctcagcctcagaggagctcta

SEQ ID NO: 6119634 - DNA, 14 bp, Homo sapiens
ctcagcctccaaag

SEQ ID NO: 6119635 - DNA, 18 bp, Homo sapiens
ctcagcctccactccctg

SEQ ID NO: 6119636 - DNA, 12 bp, Homo sapiens
ctcagcctccag

SEQ ID NO: 6119637 - DNA, 14 bp, Homo sapiens
ctcagcctccaggc

SEQ ID NO: 6119638 - DNA, 11 bp, Homo sapiens
ctcagcctccc

SEQ ID NO: 6119639 - DNA, 13 bp, Homo sapiens
ctcagcctcccaa

SEQ ID NO: 6119640 - DNA, 17 bp, Homo sapiens
ctcagcctcccaaagtg

SEQ ID NO: 6119641 - DNA, 20 bp, Homo sapiens
ctcagcctcccaaagtgctg

SEQ ID NO: 6119642 - DNA, 16 bp, Homo sapiens
ctcagcctcccagagt

SEQ ID NO: 6119643 - DNA, 17 bp, Homo sapiens
ctcagcctcccagagtg

SEQ ID NO: 6119644 - DNA, 13 bp, Homo sapiens
ctcagcctcccat

SEQ ID NO: 6119645 - DNA, 13 bp, Homo sapiens
ctcagcctcccct

SEQ ID NO: 6119646 - DNA, 17 bp, Homo sapiens
ctcagcctccccttctt

SEQ ID NO: 6119647 - DNA, 12 bp, Homo sapiens
ctcagcctcccg

SEQ ID NO: 6119648 - DNA, 13 bp, Homo sapiens
ctcagcctcccga

SEQ ID NO: 6119649 - DNA, 15 bp, Homo sapiens
ctcagcctcccgagt

SEQ ID NO: 6119650 - DNA, 21 bp, Homo sapiens
ctcagcctcccgagtagctgg

SEQ ID NO: 6119651 - DNA, 17 bp, Homo sapiens
ctcagcctccctttgcc

SEQ ID NO: 6119652 - DNA, 15 bp, Homo sapiens
ctcagcctcctaagc

SEQ ID NO: 6119653 - DNA, 14 bp, Homo sapiens
ctcagcctcctcag

SEQ ID NO: 6119654 - DNA, 21 bp, Homo sapiens
ctcagcctcctgagcctgtgg

SEQ ID NO: 6119655 - DNA, 18 bp, Homo sapiens
ctcagcctcctgagtagc

SEQ ID NO: 6119656 - DNA, 15 bp, Homo sapiens
ctcagcctcctgtgt

SEQ ID NO: 6119657 - DNA, 21 bp, Homo sapiens
ctcagcctctcccctgcctgc

SEQ ID NO: 6119658 - DNA, 17 bp, Homo sapiens
ctcagcctctgaatatg

SEQ ID NO: 6119659 - DNA, 21 bp, Homo sapiens
ctcagcctctgcaactgcaag

SEQ ID NO: 6119660 - DNA, 22 bp, Homo sapiens
ctcagcctctgcaactgcaaga

SEQ ID NO: 6119661 - DNA, 13 bp, Homo sapiens
ctcagcctctgct

SEQ ID NO: 6119662 - DNA, 15 bp, Homo sapiens
ctcagcctctgctgg

SEQ ID NO: 6119663 - DNA, 16 bp, Homo sapiens
ctcagcctgaacccca

SEQ ID NO: 6119664 - DNA, 19 bp, Homo sapiens
ctcagcctgaaccccaggg

SEQ ID NO: 6119665 - DNA, 23 bp, Homo sapiens
ctcagcctgatcaggcttcctgg

SEQ ID NO: 6119666 - DNA, 10 bp, Homo sapiens
ctcagcctgc

SEQ ID NO: 6119667 - DNA, 18 bp, Homo sapiens
ctcagcctgcccacctct

SEQ ID NO: 6119668 - DNA, 19 bp, Homo sapiens
ctcagcctgcccacctctc

SEQ ID NO: 6119669 - DNA, 22 bp, Homo sapiens
ctcagcctgcccacctctccct

SEQ ID NO: 6119670 - DNA, 13 bp, Homo sapiens
ctcagcctgcctg

SEQ ID NO: 6119671 - DNA, 16 bp, Homo sapiens
ctcagcctgcctgaag

SEQ ID NO: 6119672 - DNA, 18 bp, Homo sapiens
ctcagcctgcctgaagag

SEQ ID NO: 6119673 - DNA, 21 bp, Homo sapiens
ctcagcctgcctgaagagagg

SEQ ID NO: 6119674 - DNA, 17 bp, Homo sapiens
ctcagcctgcctgggag

SEQ ID NO: 6119675 - DNA, 14 bp, Homo sapiens
ctcagcctgctgcc

SEQ ID NO: 6119676 - DNA, 21 bp, Homo sapiens
ctcagcctgctttcctgcagc

SEQ ID NO: 6119677 - DNA, 11 bp, Homo sapiens
ctcagcctgga

SEQ ID NO: 6119678 - DNA, 22 bp, Homo sapiens
ctcagcctggagaggcctgggg

SEQ ID NO: 6119679 - DNA, 14 bp, Homo sapiens
ctcagcctgggaca

SEQ ID NO: 6119680 - DNA, 20 bp, Homo sapiens
ctcagcctgggcccctcagc

SEQ ID NO: 6119681 - DNA, 14 bp, Homo sapiens
ctcagcctgggcgc

SEQ ID NO: 6119682 - DNA, 17 bp, Homo sapiens
ctcagcctggggctctc

SEQ ID NO: 6119683 - DNA, 16 bp, Homo sapiens
ctcagcctggggtttg

SEQ ID NO: 6119684 - DNA, 12 bp, Homo sapiens
ctcagcctggtg

SEQ ID NO: 6119685 - DNA, 18 bp, Homo sapiens
ctcagcctggtgggcctc

SEQ ID NO: 6119686 - DNA, 20 bp, Homo sapiens
ctcagcctggtttctgggtg

SEQ ID NO: 6119687 - DNA, 16 bp, Homo sapiens
ctcagcctgtgctgcc

SEQ ID NO: 6119688 - DNA, 18 bp, Homo sapiens
ctcagcctgttccttcct

SEQ ID NO: 6119689 - DNA, 19 bp, Homo sapiens
ctcagcctgttccttcctg

SEQ ID NO: 6119690 - DNA, 14 bp, Homo sapiens
ctcagcctgttgcc

SEQ ID NO: 6119691 - DNA, 18 bp, Homo sapiens
ctcagccttacatttgtg

SEQ ID NO: 6119692 - DNA, 13 bp, Homo sapiens
ctcagccttctcc

SEQ ID NO: 6119693 - DNA, 21 bp, Homo sapiens
ctcagccttctcctcccaagg

SEQ ID NO: 6119694 - DNA, 16 bp, Homo sapiens
ctcagccttctgagta

SEQ ID NO: 6119695 - DNA, 23 bp, Homo sapiens
ctcagccttgactatgtctagag

SEQ ID NO: 6119696 - DNA, 12 bp, Homo sapiens
ctcagccttgca

SEQ ID NO: 6119697 - DNA, 20 bp, Homo sapiens
ctcagccttgcaaatagcca

SEQ ID NO: 6119698 - DNA, 21 bp, Homo sapiens
ctcagccttgcacacccactg

SEQ ID NO: 6119699 - DNA, 18 bp, Homo sapiens
ctcagccttgccagagat

SEQ ID NO: 6119700 - DNA, 15 bp, Homo sapiens
ctcagccttgctgct

SEQ ID NO: 6119701 - DNA, 16 bp, Homo sapiens
ctcagccttgctgctc

SEQ ID NO: 6119702 - DNA, 18 bp, Homo sapiens
ctcagccttgctgctctg

SEQ ID NO: 6119703 - DNA, 23 bp, Homo sapiens
ctcagccttgctgctctgcgtgg

SEQ ID NO: 6119704 - DNA, 15 bp, Homo sapiens
ctcagccttttggga

SEQ ID NO: 6119705 - DNA, 14 bp, Homo sapiens
ctcagcgcaggctg

SEQ ID NO: 6119706 - DNA, 15 bp, Homo sapiens
ctcagcgcaggctgc

SEQ ID NO: 6119707 - DNA, 21 bp, Homo sapiens
ctcagcgcccccagagcccgt

SEQ ID NO: 6119708 - DNA, 14 bp, Homo sapiens
ctcagcgcggccct

SEQ ID NO: 6119709 - DNA, 14 bp, Homo sapiens
ctcagcgctccctg

SEQ ID NO: 6119710 - DNA, 16 bp, Homo sapiens
ctcagcgctccctgtc

SEQ ID NO: 6119711 - DNA, 17 bp, Homo sapiens
ctcagcgctcctcctgt

SEQ ID NO: 6119712 - DNA, 20 bp, Homo sapiens
ctcagcgctcctcctgtgtg

SEQ ID NO: 6119713 - DNA, 13 bp, Homo sapiens
ctcagcgcttaaa

SEQ ID NO: 6119714 - DNA, 20 bp, Homo sapiens
ctcagcggcgaccgccctcc

SEQ ID NO: 6119715 - DNA, 14 bp, Homo sapiens
ctcagcggggacag

SEQ ID NO: 6119716 - DNA, 15 bp, Homo sapiens
ctcagcggggacagc

SEQ ID NO: 6119717 - DNA, 20 bp, Homo sapiens
ctcagcggggacagctcctt

SEQ ID NO: 6119718 - DNA, 21 bp, Homo sapiens
ctcagcggggacagctccttc

SEQ ID NO: 6119719 - DNA, 23 bp, Homo sapiens
ctcagcggggacagctccttctg

SEQ ID NO: 6119720 - DNA, 13 bp, Homo sapiens
ctcagcgggggcc

SEQ ID NO: 6119721 - DNA, 18 bp, Homo sapiens
ctcagcgggggccttgaa

SEQ ID NO: 6119722 - DNA, 21 bp, Homo sapiens
ctcagcgggggccttgaagac

SEQ ID NO: 6119723 - DNA, 22 bp, Homo sapiens
ctcagcgggggccttgaagact

SEQ ID NO: 6119724 - DNA, 18 bp, Homo sapiens
ctcagcgtctccccatgc

SEQ ID NO: 6119725 - DNA, 16 bp, Homo sapiens
cgcagacaggaccagg

SEQ ID NO: 6119726 - DNA, 12 bp, Homo sapiens
cgcagacctccc

SEQ ID NO: 6119727 - DNA, 15 bp, Homo sapiens
cgcagacctccccag

SEQ ID NO: 6119728 - DNA, 16 bp, Homo sapiens
cgcagacctccccagc

SEQ ID NO: 6119729 - DNA, 17 bp, Homo sapiens
cgcagacctccccagcc

SEQ ID NO: 6119730 - DNA, 18 bp, Homo sapiens
cgcagacctccccagccc

SEQ ID NO: 6119731 - DNA, 19 bp, Homo sapiens
cgcagacctccccagcccc

SEQ ID NO: 6119732 - DNA, 20 bp, Homo sapiens
cgcagacctccccagcccct

SEQ ID NO: 6119733 - DNA, 15 bp, Homo sapiens
cgcagacctctggat

SEQ ID NO: 6119734 - DNA, 19 bp, Homo sapiens
cgcagacctctggattagg

SEQ ID NO: 6119735 - DNA, 11 bp, Homo sapiens
cgcagacctgg

SEQ ID NO: 6119736 - DNA, 13 bp, Homo sapiens
cgcagacctggag

SEQ ID NO: 6119737 - DNA, 14 bp, Homo sapiens
cgcagacctggagc

SEQ ID NO: 6119738 - DNA, 16 bp, Homo sapiens
cgcagacgggcacaga

SEQ ID NO: 6119739 - DNA, 19 bp, Homo sapiens
cgcagacgggcacagacac

SEQ ID NO: 6119740 - DNA, 14 bp, Homo sapiens
cgcagactcctcca

SEQ ID NO: 6119741 - DNA, 15 bp, Homo sapiens
cgcagactcctccac

SEQ ID NO: 6119742 - DNA, 19 bp, Homo sapiens
cgcagactgcttggccaga

SEQ ID NO: 6119743 - DNA, 20 bp, Homo sapiens
cgcagactgcttggccagat

SEQ ID NO: 6119744 - DNA, 21 bp, Homo sapiens
cgcagagaaatcggtgtctga

SEQ ID NO: 6119745 - DNA, 21 bp, Homo sapiens
cgcagagaaatgccccagtgt

SEQ ID NO: 6119746 - DNA, 21 bp, Homo sapiens
cgcagagaagtgacggttcct

SEQ ID NO: 6119747 - DNA, 22 bp, Homo sapiens
cgcagagactggggcctggact

SEQ ID NO: 6119748 - DNA, 14 bp, Homo sapiens
cgcagagaggccag

SEQ ID NO: 6119749 - DNA, 12 bp, Homo sapiens
cgcagagcccac

SEQ ID NO: 6119750 - DNA, 14 bp, Homo sapiens
cgcagagccctcca

SEQ ID NO: 6119751 - DNA, 18 bp, Homo sapiens
cgcagagccctccaggcc

SEQ ID NO: 6119752 - DNA, 19 bp, Homo sapiens
cgcagagccctccaggcct

SEQ ID NO: 6119753 - DNA, 18 bp, Homo sapiens
cgcagagcttttcagatt

SEQ ID NO: 6119754 - DNA, 17 bp, Homo sapiens
cgcagaggacatcacct

SEQ ID NO: 6119755 - DNA, 13 bp, Homo sapiens
cgcagaggacgca

SEQ ID NO: 6119756 - DNA, 19 bp, Homo sapiens
cgcagaggacgcacgctcg

SEQ ID NO: 6119757 - DNA, 23 bp, Homo sapiens
cgcagaggacgcacgctcgctgc

SEQ ID NO: 6119758 - DNA, 21 bp, Homo sapiens
cgcagaggcggaaaccttgca

SEQ ID NO: 6119759 - DNA, 12 bp, Homo sapiens
cgcagaggtccc

SEQ ID NO: 6119760 - DNA, 23 bp, Homo sapiens
cgcagaggtcccagccccaggcc

SEQ ID NO: 6119761 - DNA, 12 bp, Homo sapiens
cgcagatcctgt

SEQ ID NO: 6119762 - DNA, 16 bp, Homo sapiens
cgcagatcctgtccca

SEQ ID NO: 6119763 - DNA, 14 bp, Homo sapiens
cgcagatctgtgcc

SEQ ID NO: 6119764 - DNA, 16 bp, Homo sapiens
cgcagatctgtgcctg

SEQ ID NO: 6119765 - DNA, 19 bp, Homo sapiens
cgcagatgtgcagcagatt

SEQ ID NO: 6119766 - DNA, 16 bp, Homo sapiens
cgcagattgggctggc

SEQ ID NO: 6119767 - DNA, 21 bp, Homo sapiens
cgcagcacagagtcgctggca

SEQ ID NO: 6119768 - DNA, 17 bp, Homo sapiens
cgcagcacatttccgct

SEQ ID NO: 6119769 - DNA, 16 bp, Homo sapiens
cgcagcaccagcctga

SEQ ID NO: 6119770 - DNA, 22 bp, Homo sapiens
cgcagcaccagcctgagccaca

SEQ ID NO: 6119771 - DNA, 10 bp, Homo sapiens
cgcagcagct

SEQ ID NO: 6119772 - DNA, 20 bp, Homo sapiens
cgcagcagctgggacccctc

SEQ ID NO: 6119773 - DNA, 16 bp, Homo sapiens
cgcagcaggaggccag

SEQ ID NO: 6119774 - DNA, 19 bp, Homo sapiens
cgcagcatattcaggaagc

SEQ ID NO: 6119775 - DNA, 13 bp, Homo sapiens
cgcagccaaggcc

SEQ ID NO: 6119776 - DNA, 14 bp, Homo sapiens
cgcagccacacagt

SEQ ID NO: 6119777 - DNA, 20 bp, Homo sapiens
cgcagccacacagtggccgg

SEQ ID NO: 6119778 - DNA, 16 bp, Homo sapiens
cgcagccacaccgctg

SEQ ID NO: 6119779 - DNA, 21 bp, Homo sapiens
cgcagccacaccgctggctcc

SEQ ID NO: 6119780 - DNA, 17 bp, Homo sapiens
cgcagccaccctgagga

SEQ ID NO: 6119781 - DNA, 17 bp, Homo sapiens
cgcagcccccactgacc

SEQ ID NO: 6119782 - DNA, 21 bp, Homo sapiens
cgcagccccccacgcttctgg

SEQ ID NO: 6119783 - DNA, 18 bp, Homo sapiens
cgcagcccgaagcccagt

SEQ ID NO: 6119784 - DNA, 12 bp, Homo sapiens
cgcagcccgtga

SEQ ID NO: 6119785 - DNA, 22 bp, Homo sapiens
cgcagcccgtgaagcagtgcct

SEQ ID NO: 6119786 - DNA, 23 bp, Homo sapiens
cgcagcccgtgaagcagtgcctc

SEQ ID NO: 6119787 - DNA, 17 bp, Homo sapiens
cgcagccctagagcctg

SEQ ID NO: 6119788 - DNA, 18 bp, Homo sapiens
cgcagccctagagcctgc

SEQ ID NO: 6119789 - DNA, 14 bp, Homo sapiens
cgcagccctagtgg

SEQ ID NO: 6119790 - DNA, 18 bp, Homo sapiens
cgcagccctgcagagggc

SEQ ID NO: 6119791 - DNA, 18 bp, Homo sapiens
cgcagccctgggggccag

SEQ ID NO: 6119792 - DNA, 16 bp, Homo sapiens
cgcagccgagccccag

SEQ ID NO: 6119793 - DNA, 22 bp, Homo sapiens
cgcagccgccgccgcccacgcc

SEQ ID NO: 6119794 - DNA, 21 bp, Homo sapiens
cgcagccgcgctctgcccctc

SEQ ID NO: 6119795 - DNA, 17 bp, Homo sapiens
cgcagcctccagggccc

SEQ ID NO: 6119796 - DNA, 13 bp, Homo sapiens
cgcagcctccagt

SEQ ID NO: 6119797 - DNA, 16 bp, Homo sapiens
cgcagcctccctctga

SEQ ID NO: 6119798 - DNA, 23 bp, Homo sapiens
cgcagcctctcagtgccctccag

SEQ ID NO: 6119799 - DNA, 14 bp, Homo sapiens
cgcagcctctgccc

SEQ ID NO: 6119800 - DNA, 12 bp, Homo sapiens
cgcagcctgaga

SEQ ID NO: 6119801 - DNA, 17 bp, Homo sapiens
cgcagcctggcatctgt

SEQ ID NO: 6119802 - DNA, 18 bp, Homo sapiens
cgcagcctggcggggcag

SEQ ID NO: 6119803 - DNA, 18 bp, Homo sapiens
cgcagcgcctccaccctg

SEQ ID NO: 6119804 - DNA, 18 bp, Homo sapiens
cgcagcggcgtcagactt

SEQ ID NO: 6119805 - DNA, 22 bp, Homo sapiens
cgcagcgggcgcgggacaggac

SEQ ID NO: 6119806 - DNA, 17 bp, Homo sapiens
cgcagcggtgggaagga

SEQ ID NO: 6119807 - DNA, 15 bp, Homo sapiens
cgcagcgtcccccgc

SEQ ID NO: 6119808 - DNA, 17 bp, Homo sapiens
cgcagctaccctcagcc

SEQ ID NO: 6119809 - DNA, 14 bp, Homo sapiens
cgcagctccttccc

SEQ ID NO: 6119810 - DNA, 13 bp, Homo sapiens
cgcagctcttgcc

SEQ ID NO: 6119811 - DNA, 20 bp, Homo sapiens
cgcagctcttgcccttccct

SEQ ID NO: 6119812 - DNA, 15 bp, Homo sapiens
cgcagctgaagcctg

SEQ ID NO: 6119813 - DNA, 12 bp, Homo sapiens
cgcagctgccta

SEQ ID NO: 6119814 - DNA, 11 bp, Homo sapiens
cgcagctgctg

SEQ ID NO: 6119815 - DNA, 14 bp, Homo sapiens
cgcagctgctgcca

SEQ ID NO: 6119816 - DNA, 16 bp, Homo sapiens
cgcagctgctgccact

SEQ ID NO: 6119817 - DNA, 21 bp, Homo sapiens
cgcagctgctgccactctgct

SEQ ID NO: 6119818 - DNA, 23 bp, Homo sapiens
cgcagctgctgccactctgctgc

SEQ ID NO: 6119819 - DNA, 22 bp, Homo sapiens
cgcagctggcgcgtgtgtggcc

SEQ ID NO: 6119820 - DNA, 23 bp, Homo sapiens
cgcagctggcgcgtgtgtggcct

SEQ ID NO: 6119821 - DNA, 23 bp, Homo sapiens
cgcagctgggtgcagaagctgtg

SEQ ID NO: 6119822 - DNA, 18 bp, Homo sapiens
cgcagctggttgggggca

SEQ ID NO: 6119823 - DNA, 21 bp, Homo sapiens
cgcagctggttgggggcacca

SEQ ID NO: 6119824 - DNA, 21 bp, Homo sapiens
cgcagcttcctgtctgtttat

SEQ ID NO: 6119825 - DNA, 19 bp, Homo sapiens
cgcaggaaccgaggactcc

SEQ ID NO: 6119826 - DNA, 21 bp, Homo sapiens
cgcaggaaccgaggactccag

SEQ ID NO: 6119827 - DNA, 20 bp, Homo sapiens
cgcaggaactgggctgggcc

SEQ ID NO: 6119828 - DNA, 12 bp, Homo sapiens
cgcaggaagctg

SEQ ID NO: 6119829 - DNA, 13 bp, Homo sapiens
cgcaggaagctgc

SEQ ID NO: 6119830 - DNA, 21 bp, Homo sapiens
cgcaggagaatcactgcagcc

SEQ ID NO: 6119831 - DNA, 12 bp, Homo sapiens
cgcaggagagag

SEQ ID NO: 6119832 - DNA, 15 bp, Homo sapiens
cgcaggagagagaga

SEQ ID NO: 6119833 - DNA, 18 bp, Homo sapiens
cgcaggagcacacccagc

SEQ ID NO: 6119834 - DNA, 14 bp, Homo sapiens
cgcaggagggaggc

SEQ ID NO: 6119835 - DNA, 23 bp, Homo sapiens
cgcaggagggaggcggggaggag

SEQ ID NO: 6119836 - DNA, 19 bp, Homo sapiens
cgcaggagtctctgccacc

SEQ ID NO: 6119837 - DNA, 21 bp, Homo sapiens
cgcaggagtctctgccaccca

SEQ ID NO: 6119838 - DNA, 18 bp, Homo sapiens
cgcaggatccctcctgag

SEQ ID NO: 6119839 - DNA, 18 bp, Homo sapiens
cgcaggatccgctgccac

SEQ ID NO: 6119840 - DNA, 20 bp, Homo sapiens
cgcaggatccgctgccacca

SEQ ID NO: 6119841 - DNA, 12 bp, Homo sapiens
cgcaggcccagt

SEQ ID NO: 6119842 - DNA, 10 bp, Homo sapiens
cgcaggcccc

SEQ ID NO: 6119843 - DNA, 19 bp, Homo sapiens
cgcaggcccctctcctccg

SEQ ID NO: 6119844 - DNA, 20 bp, Homo sapiens
cgcaggccctccgcggggga

SEQ ID NO: 6119845 - DNA, 19 bp, Homo sapiens
cgcaggccctggtggagag

SEQ ID NO: 6119846 - DNA, 18 bp, Homo sapiens
cgcaggccctgtccagcc

SEQ ID NO: 6119847 - DNA, 15 bp, Homo sapiens
cgcaggcctccctgc

SEQ ID NO: 6119848 - DNA, 21 bp, Homo sapiens
cgcaggcctccctgcctcagc

SEQ ID NO: 6119849 - DNA, 19 bp, Homo sapiens
cgcaggcctgccttctcag

SEQ ID NO: 6119850 - DNA, 20 bp, Homo sapiens
cgcaggcctgccttctcagg

SEQ ID NO: 6119851 - DNA, 17 bp, Homo sapiens
cgcaggcggccagggcg

SEQ ID NO: 6119852 - DNA, 20 bp, Homo sapiens
cgcaggcggccagggcggcc

SEQ ID NO: 6119853 - DNA, 18 bp, Homo sapiens
cgcaggcgggactatcag

SEQ ID NO: 6119854 - DNA, 18 bp, Homo sapiens
cgcaggctgagtccagag

SEQ ID NO: 6119855 - DNA, 14 bp, Homo sapiens
cgcaggctgagtgc

SEQ ID NO: 6119856 - DNA, 13 bp, Homo sapiens
cgcaggctgcaga

SEQ ID NO: 6119857 - DNA, 16 bp, Homo sapiens
cgcaggctgcagagcc

SEQ ID NO: 6119858 - DNA, 17 bp, Homo sapiens
cgcaggctgcagagccc

SEQ ID NO: 6119859 - DNA, 18 bp, Homo sapiens
cgcaggctgcagagcccg

SEQ ID NO: 6119860 - DNA, 14 bp, Homo sapiens
cgcaggctggccct

SEQ ID NO: 6119861 - DNA, 18 bp, Homo sapiens
cgcagggaatgcagcagg

SEQ ID NO: 6119862 - DNA, 19 bp, Homo sapiens
cgcagggaggatgccacag

SEQ ID NO: 6119863 - DNA, 21 bp, Homo sapiens
cgcagggaggatgccacagcc

SEQ ID NO: 6119864 - DNA, 22 bp, Homo sapiens
cgcagggaggatgccacagccc

SEQ ID NO: 6119865 - DNA, 21 bp, Homo sapiens
cgcagggccatccactgtgac

SEQ ID NO: 6119866 - DNA, 19 bp, Homo sapiens
cgcagggcccaccttggac

SEQ ID NO: 6119867 - DNA, 14 bp, Homo sapiens
cgcaggggactgtc

SEQ ID NO: 6119868 - DNA, 15 bp, Homo sapiens
cgcaggggactgtct

SEQ ID NO: 6119869 - DNA, 19 bp, Homo sapiens
cgcaggggccctgagccaa

SEQ ID NO: 6119870 - DNA, 20 bp, Homo sapiens
cgcaggggcgctggctgcac

SEQ ID NO: 6119871 - DNA, 16 bp, Homo sapiens
cgcagggtgcaggagc

SEQ ID NO: 6119872 - DNA, 14 bp, Homo sapiens
cgcagggtggtggt

SEQ ID NO: 6119873 - DNA, 22 bp, Homo sapiens
cgcagggtggtggtattctgtc

SEQ ID NO: 6119874 - DNA, 23 bp, Homo sapiens
cgcaggtatttagaagcagaggg

SEQ ID NO: 6119875 - DNA, 23 bp, Homo sapiens
cgcaggtcatattgtcagtccta

SEQ ID NO: 6119876 - DNA, 16 bp, Homo sapiens
cgcaggtctcttctgg

SEQ ID NO: 6119877 - DNA, 18 bp, Homo sapiens
cgcaggtctcttctgggc

SEQ ID NO: 6119878 - DNA, 15 bp, Homo sapiens
cgcaggtgccatgcc

SEQ ID NO: 6119879 - DNA, 19 bp, Homo sapiens
cgcaggtgctcatgctgct

SEQ ID NO: 6119880 - DNA, 15 bp, Homo sapiens
cgcaggttaccttgg

SEQ ID NO: 6119881 - DNA, 19 bp, Homo sapiens
cgcaggttatgtcagcagc

SEQ ID NO: 6119882 - DNA, 20 bp, Homo sapiens
cgcagtagtttggtttgact

SEQ ID NO: 6119883 - DNA, 19 bp, Homo sapiens
cgcagtccacttctgacag

SEQ ID NO: 6119884 - DNA, 23 bp, Homo sapiens
cgcagtccacttctgacagcctc

SEQ ID NO: 6119885 - DNA, 12 bp, Homo sapiens
cgcagtccccag

SEQ ID NO: 6119886 - DNA, 21 bp, Homo sapiens
cgcagtccccagcccttctgc

SEQ ID NO: 6119887 - DNA, 16 bp, Homo sapiens
cgcagtcgcaggatcc

SEQ ID NO: 6119888 - DNA, 23 bp, Homo sapiens
cgcagtcgcaggatccgctgcca

SEQ ID NO: 6119889 - DNA, 21 bp, Homo sapiens
cgcagtcgtcagcctccctga

SEQ ID NO: 6119890 - DNA, 15 bp, Homo sapiens
cgcagtcgtcgcaca

SEQ ID NO: 6119891 - DNA, 16 bp, Homo sapiens
cgcagtcgtcgcacag

SEQ ID NO: 6119892 - DNA, 22 bp, Homo sapiens
cgcagtctggcctgggcgacag

SEQ ID NO: 6119893 - DNA, 18 bp, Homo sapiens
cgcagtgctgggaccaga

SEQ ID NO: 6119894 - DNA, 19 bp, Homo sapiens
cgcagtgctgggaccagag

SEQ ID NO: 6119895 - DNA, 22 bp, Homo sapiens
cgcagtgctgggaccagagcca

SEQ ID NO: 6119896 - DNA, 22 bp, Homo sapiens
cgcagtggcttttgccccagaa

SEQ ID NO: 6119897 - DNA, 22 bp, Homo sapiens
cgcagtgggagcaaactgcatg

SEQ ID NO: 6119898 - DNA, 22 bp, Homo sapiens
cgcagtgtgcactaaggggccc

SEQ ID NO: 6119899 - DNA, 17 bp, Homo sapiens
cgcagttgtagcagaaa

SEQ ID NO: 6119900 - DNA, 20 bp, Homo sapiens
cgcagttgtgtggcccagca

SEQ ID NO: 6119901 - DNA, 20 bp, Homo sapiens
cgcagttttttttttcttgt

SEQ ID NO: 6119902 - DNA, 23 bp, Homo sapiens
ctcagcgtttttttgtttttaat

SEQ ID NO: 6119903 - DNA, 21 bp, Homo sapiens
ctcagctacccactatccttc

SEQ ID NO: 6119904 - DNA, 17 bp, Homo sapiens
ctcagctactcaggagg

SEQ ID NO: 6119905 - DNA, 20 bp, Homo sapiens
ctcagctactcaggaggctg

SEQ ID NO: 6119906 - DNA, 12 bp, Homo sapiens
ctcagctagaag

SEQ ID NO: 6119907 - DNA, 23 bp, Homo sapiens
ctcagctagttggggagctaagg

SEQ ID NO: 6119908 - DNA, 14 bp, Homo sapiens
ctcagctcaatgca

SEQ ID NO: 6119909 - DNA, 22 bp, Homo sapiens
ctcagctcactgcaacctccac

SEQ ID NO: 6119910 - DNA, 17 bp, Homo sapiens
ctcagctcactgtgacc

SEQ ID NO: 6119911 - DNA, 14 bp, Homo sapiens
ctcagctcagcctc

SEQ ID NO: 6119912 - DNA, 13 bp, Homo sapiens
ctcagctcagcgc

SEQ ID NO: 6119913 - DNA, 15 bp, Homo sapiens
ctcagctcagcgcca

SEQ ID NO: 6119914 - DNA, 22 bp, Homo sapiens
ctcagctcatagtgaacacagc

SEQ ID NO: 6119915 - DNA, 14 bp, Homo sapiens
ctcagctccactct

SEQ ID NO: 6119916 - DNA, 16 bp, Homo sapiens
ctcagctccactctga

SEQ ID NO: 6119917 - DNA, 10 bp, Homo sapiens
ctcagctccc

SEQ ID NO: 6119918 - DNA, 16 bp, Homo sapiens
ctcagctcccaggcca

SEQ ID NO: 6119919 - DNA, 12 bp, Homo sapiens
ctcagctcccca

SEQ ID NO: 6119920 - DNA, 16 bp, Homo sapiens
ctcagctccccagagt

SEQ ID NO: 6119921 - DNA, 14 bp, Homo sapiens
ctcagctccccctg

SEQ ID NO: 6119922 - DNA, 15 bp, Homo sapiens
ctcagctccccctgt

SEQ ID NO: 6119923 - DNA, 12 bp, Homo sapiens
ctcagctccctg

SEQ ID NO: 6119924 - DNA, 21 bp, Homo sapiens
ctcagctccctgaccccctgt

SEQ ID NO: 6119925 - DNA, 15 bp, Homo sapiens
ctcagctccctggaa

SEQ ID NO: 6119926 - DNA, 18 bp, Homo sapiens
ctcagctccgtcatctgc

SEQ ID NO: 6119927 - DNA, 18 bp, Homo sapiens
ctcagctcctacctctgt

SEQ ID NO: 6119928 - DNA, 19 bp, Homo sapiens
ctcagctcctacctctgtg

SEQ ID NO: 6119929 - DNA, 16 bp, Homo sapiens
ctcagctcgctgccca

SEQ ID NO: 6119930 - DNA, 15 bp, Homo sapiens
ctcagctcggggagc

SEQ ID NO: 6119931 - DNA, 13 bp, Homo sapiens
ctcagctctccct

SEQ ID NO: 6119932 - DNA, 16 bp, Homo sapiens
ctcagctctccctcac

SEQ ID NO: 6119933 - DNA, 15 bp, Homo sapiens
ctcagctctctggga

SEQ ID NO: 6119934 - DNA, 21 bp, Homo sapiens
ctcagctctctgggacctcct

SEQ ID NO: 6119935 - DNA, 23 bp, Homo sapiens
ctcagctctgacattctgattcg

SEQ ID NO: 6119936 - DNA, 12 bp, Homo sapiens
ctcagctctggc

SEQ ID NO: 6119937 - DNA, 19 bp, Homo sapiens
ctcagctctggctcacaga

SEQ ID NO: 6119938 - DNA, 16 bp, Homo sapiens
ctcagctctgggagag

SEQ ID NO: 6119939 - DNA, 23 bp, Homo sapiens
ctcagctctgggccattctccac

SEQ ID NO: 6119940 - DNA, 19 bp, Homo sapiens
ctcagctctggtccaggcc

SEQ ID NO: 6119941 - DNA, 13 bp, Homo sapiens
ctcagctctgtct

SEQ ID NO: 6119942 - DNA, 16 bp, Homo sapiens
ctcagctctgtctgct

SEQ ID NO: 6119943 - DNA, 16 bp, Homo sapiens
ctcagctcttagctgg

SEQ ID NO: 6119944 - DNA, 14 bp, Homo sapiens
ctcagctcttccat

SEQ ID NO: 6119945 - DNA, 16 bp, Homo sapiens
ctcagctcttccatga

SEQ ID NO: 6119946 - DNA, 16 bp, Homo sapiens
ctcagctcttctgact

SEQ ID NO: 6119947 - DNA, 17 bp, Homo sapiens
ctcagctcttggctcca

SEQ ID NO: 6119948 - DNA, 18 bp, Homo sapiens
ctcagctcttggctccac

SEQ ID NO: 6119949 - DNA, 20 bp, Homo sapiens
ctcagctcttggtgggccca

SEQ ID NO: 6119950 - DNA, 21 bp, Homo sapiens
ctcagctcttggtgggcccag

SEQ ID NO: 6119951 - DNA, 23 bp, Homo sapiens
ctcagctgaatgcctcctgtggg

SEQ ID NO: 6119952 - DNA, 16 bp, Homo sapiens
ctcagctgacccggcc

SEQ ID NO: 6119953 - DNA, 19 bp, Homo sapiens
ctcagctgagaaggccagc

SEQ ID NO: 6119954 - DNA, 23 bp, Homo sapiens
ctcagctgcacattcctggcccc

SEQ ID NO: 6119955 - DNA, 18 bp, Homo sapiens
ctcagctgcatctgataa

SEQ ID NO: 6119956 - DNA, 19 bp, Homo sapiens
ctcagctgcatctgataaa

SEQ ID NO: 6119957 - DNA, 20 bp, Homo sapiens
ctcagctgcccatcccagtc

SEQ ID NO: 6119958 - DNA, 21 bp, Homo sapiens
ctcagctgcccatcccagtcc

SEQ ID NO: 6119959 - DNA, 14 bp, Homo sapiens
ctcagctgcctcct

SEQ ID NO: 6119960 - DNA, 20 bp, Homo sapiens
ctcagctgcctcctgcgccc

SEQ ID NO: 6119961 - DNA, 14 bp, Homo sapiens
ctcagctgctccca

SEQ ID NO: 6119962 - DNA, 16 bp, Homo sapiens
ctcagctgctcgcaca

SEQ ID NO: 6119963 - DNA, 19 bp, Homo sapiens
ctcagctgctcgcacagat

SEQ ID NO: 6119964 - DNA, 11 bp, Homo sapiens
ctcagctgctg

SEQ ID NO: 6119965 - DNA, 17 bp, Homo sapiens
ctcagctgcttctccca

SEQ ID NO: 6119966 - DNA, 22 bp, Homo sapiens
ctcagctggaagtctacctgct

SEQ ID NO: 6119967 - DNA, 23 bp, Homo sapiens
ctcagctggatgatggtcttcag

SEQ ID NO: 6119968 - DNA, 14 bp, Homo sapiens
ctcagctggccggg

SEQ ID NO: 6119969 - DNA, 23 bp, Homo sapiens
ctcagctggcggaacctggctgc

SEQ ID NO: 6119970 - DNA, 13 bp, Homo sapiens
ctcagctggctgt

SEQ ID NO: 6119971 - DNA, 15 bp, Homo sapiens
ctcagctggctgtat

SEQ ID NO: 6119972 - DNA, 19 bp, Homo sapiens
ctcagctgggccactcctc

SEQ ID NO: 6119973 - DNA, 17 bp, Homo sapiens
ctcagctggtcctgacc

SEQ ID NO: 6119974 - DNA, 18 bp, Homo sapiens
ctcagctgtcaaggctca

SEQ ID NO: 6119975 - DNA, 16 bp, Homo sapiens
ctcagctgtcacctgc

SEQ ID NO: 6119976 - DNA, 17 bp, Homo sapiens
ctcagctgtcacctgct

SEQ ID NO: 6119977 - DNA, 23 bp, Homo sapiens
ctcagctgtcacctgctcacagg

SEQ ID NO: 6119978 - DNA, 17 bp, Homo sapiens
ctcagctgtcctgcagc

SEQ ID NO: 6119979 - DNA, 16 bp, Homo sapiens
ctcagctgtctgtggc

SEQ ID NO: 6119980 - DNA, 13 bp, Homo sapiens
ctcagctgtgcct

SEQ ID NO: 6119981 - DNA, 16 bp, Homo sapiens
ctcagctgtggtccca

SEQ ID NO: 6119982 - DNA, 23 bp, Homo sapiens
ctcagctgtggtcccacccagga

SEQ ID NO: 6119983 - DNA, 20 bp, Homo sapiens
ctcagcttatctcttttata

SEQ ID NO: 6119984 - DNA, 19 bp, Homo sapiens
ctcagcttcatttccgtga

SEQ ID NO: 6119985 - DNA, 23 bp, Homo sapiens
ctcagcttcatttccgtgaaggg

SEQ ID NO: 6119986 - DNA, 14 bp, Homo sapiens
ctcagcttccccag

SEQ ID NO: 6119987 - DNA, 20 bp, Homo sapiens
ctcagcttctaattttgtgc

SEQ ID NO: 6119988 - DNA, 17 bp, Homo sapiens
ctcagcttcttctttca

SEQ ID NO: 6119989 - DNA, 17 bp, Homo sapiens
ctcagcttgcagctgga

SEQ ID NO: 6119990 - DNA, 20 bp, Homo sapiens
ctcagcttggcactcaggtg

SEQ ID NO: 6119991 - DNA, 21 bp, Homo sapiens
ctcagcttggcactcaggtgc

SEQ ID NO: 6119992 - DNA, 23 bp, Homo sapiens
ctcagcttggcactcaggtgctg

SEQ ID NO: 6119993 - DNA, 21 bp, Homo sapiens
ctcagcttgggcttcttcctc

SEQ ID NO: 6119994 - DNA, 13 bp, Homo sapiens
ctcagcttgtgcc

SEQ ID NO: 6119995 - DNA, 19 bp, Homo sapiens
ctcagctttccctgccaca

SEQ ID NO: 6119996 - DNA, 14 bp, Homo sapiens
ctcagctttctaag

SEQ ID NO: 6119997 - DNA, 12 bp, Homo sapiens
ctcagctttgag

SEQ ID NO: 6119998 - DNA, 16 bp, Homo sapiens
ctcagctttgagaagc

SEQ ID NO: 6119999 - DNA, 21 bp, Homo sapiens
ctcagctttgagaagccttca

SEQ ID NO: 6120000 - DNA, 22 bp, Homo sapiens
ctcagctttgagaagccttcag

SEQ ID NO: 6120001 - DNA, 17 bp, Homo sapiens
ctcagctttttgtcttt

SEQ ID NO: 6120002 - DNA, 12 bp, Homo sapiens
ctcaggaaaacg

SEQ ID NO: 6120003 - DNA, 20 bp, Homo sapiens
ctcaggaaaccacaaccttg

SEQ ID NO: 6120004 - DNA, 22 bp, Homo sapiens
ctcaggaaacgagactttccat

SEQ ID NO: 6120005 - DNA, 11 bp, Homo sapiens
ctcaggaaaga

SEQ ID NO: 6120006 - DNA, 21 bp, Homo sapiens
ctcaggaaatgctgacccatg

SEQ ID NO: 6120007 - DNA, 22 bp, Homo sapiens
ctcaggaaatgctgacccatgg

SEQ ID NO: 6120008 - DNA, 12 bp, Homo sapiens
ctcaggaacaga

SEQ ID NO: 6120009 - DNA, 15 bp, Homo sapiens
ctcaggaacagaaca

SEQ ID NO: 6120010 - DNA, 17 bp, Homo sapiens
ctcaggaacccaccctc

SEQ ID NO: 6120011 - DNA, 22 bp, Homo sapiens
ctcaggaacccaccctctccac

SEQ ID NO: 6120012 - DNA, 14 bp, Homo sapiens
ctcaggaaccctgg

SEQ ID NO: 6120013 - DNA, 17 bp, Homo sapiens
ctcaggaaccctggaga

SEQ ID NO: 6120014 - DNA, 18 bp, Homo sapiens
ctcaggaaccctggagac

SEQ ID NO: 6120015 - DNA, 21 bp, Homo sapiens
ctcaggaaccctggagacaga

SEQ ID NO: 6120016 - DNA, 17 bp, Homo sapiens
ctcaggaaccgaggcag

SEQ ID NO: 6120017 - DNA, 19 bp, Homo sapiens
ctcaggaaccgaggcaggg

SEQ ID NO: 6120018 - DNA, 14 bp, Homo sapiens
ctcaggaagaagag

SEQ ID NO: 6120019 - DNA, 14 bp, Homo sapiens
ctcaggaagagcta

SEQ ID NO: 6120020 - DNA, 22 bp, Homo sapiens
ctcaggaagatcgtgaacataa

SEQ ID NO: 6120021 - DNA, 19 bp, Homo sapiens
ctcaggaagcccccaagtt

SEQ ID NO: 6120022 - DNA, 17 bp, Homo sapiens
ctcaggaattccctgga

SEQ ID NO: 6120023 - DNA, 13 bp, Homo sapiens
ctcaggacacagg

SEQ ID NO: 6120024 - DNA, 15 bp, Homo sapiens
ctcaggacacaggcc

SEQ ID NO: 6120025 - DNA, 17 bp, Homo sapiens
ctcaggacacaggcctg

SEQ ID NO: 6120026 - DNA, 19 bp, Homo sapiens
ctcaggacacaggcctgtg

SEQ ID NO: 6120027 - DNA, 21 bp, Homo sapiens
ctcaggacacaggcctgtgta

SEQ ID NO: 6120028 - DNA, 16 bp, Homo sapiens
ctcaggacagaacagt

SEQ ID NO: 6120029 - DNA, 19 bp, Homo sapiens
ctcaggacagatgccacac

SEQ ID NO: 6120030 - DNA, 19 bp, Homo sapiens
ctcaggaccaaagaacact

SEQ ID NO: 6120031 - DNA, 14 bp, Homo sapiens
ctcaggaccaccct

SEQ ID NO: 6120032 - DNA, 15 bp, Homo sapiens
ctcaggaccaccctg

SEQ ID NO: 6120033 - DNA, 16 bp, Homo sapiens
ctcaggaccaccctgc

SEQ ID NO: 6120034 - DNA, 17 bp, Homo sapiens
ctcaggaccaccctgcc

SEQ ID NO: 6120035 - DNA, 14 bp, Homo sapiens
ctcaggaccaggca

SEQ ID NO: 6120036 - DNA, 13 bp, Homo sapiens
ctcaggacccagg

SEQ ID NO: 6120037 - DNA, 14 bp, Homo sapiens
ctcaggacccaggc

SEQ ID NO: 6120038 - DNA, 15 bp, Homo sapiens
ctcaggacccaggcc

SEQ ID NO: 6120039 - DNA, 12 bp, Homo sapiens
ctcaggacccat

SEQ ID NO: 6120040 - DNA, 22 bp, Homo sapiens
ctcaggacccatccctgcctgg

SEQ ID NO: 6120041 - DNA, 16 bp, Homo sapiens
ctcaggaccccagagg

SEQ ID NO: 6120042 - DNA, 18 bp, Homo sapiens
ctcaggaccccagaggga

SEQ ID NO: 6120043 - DNA, 20 bp, Homo sapiens
ctcaggaccctcgctggccc

SEQ ID NO: 6120044 - DNA, 21 bp, Homo sapiens
ctcaggaccctcgctggcccc

SEQ ID NO: 6120045 - DNA, 22 bp, Homo sapiens
ctcaggaccctcgctggccccc

SEQ ID NO: 6120046 - DNA, 23 bp, Homo sapiens
ctcaggacctctgtaggcagcag

SEQ ID NO: 6120047 - DNA, 17 bp, Homo sapiens
ctcaggacgacgaatct

SEQ ID NO: 6120048 - DNA, 14 bp, Homo sapiens
ctcaggactcagaa

SEQ ID NO: 6120049 - DNA, 15 bp, Homo sapiens
ctcaggactcctctc

SEQ ID NO: 6120050 - DNA, 17 bp, Homo sapiens
ctcaggactgcaacagg

SEQ ID NO: 6120051 - DNA, 17 bp, Homo sapiens
ctcaggagaaggcctgc

SEQ ID NO: 6120052 - DNA, 23 bp, Homo sapiens
ctcaggagaaggcctgcccccct

SEQ ID NO: 6120053 - DNA, 13 bp, Homo sapiens
ctcaggagagggc

SEQ ID NO: 6120054 - DNA, 14 bp, Homo sapiens
ctcaggagagggcc

SEQ ID NO: 6120055 - DNA, 21 bp, Homo sapiens
ctcaggagcacagccatagca

SEQ ID NO: 6120056 - DNA, 17 bp, Homo sapiens
ctcaggagcacaggcag

SEQ ID NO: 6120057 - DNA, 21 bp, Homo sapiens
ctcaggagcaccctgtcttct

SEQ ID NO: 6120058 - DNA, 20 bp, Homo sapiens
ctcaggagcccgatggggaa

SEQ ID NO: 6120059 - DNA, 14 bp, Homo sapiens
ctcaggagccctgg

SEQ ID NO: 6120060 - DNA, 16 bp, Homo sapiens
ctcaggagccctggga

SEQ ID NO: 6120061 - DNA, 21 bp, Homo sapiens
ctcaggagccctgggaggctc

SEQ ID NO: 6120062 - DNA, 23 bp, Homo sapiens
ctcaggagccctgggaggctctg

SEQ ID NO: 6120063 - DNA, 13 bp, Homo sapiens
ctcaggagcctcc

SEQ ID NO: 6120064 - DNA, 14 bp, Homo sapiens
ctcaggagcctgtg

SEQ ID NO: 6120065 - DNA, 16 bp, Homo sapiens
ctcaggagcctgtgac

SEQ ID NO: 6120066 - DNA, 24 bp, Homo sapiens
ctcaggaggaggctgccctgaggg

SEQ ID NO: 6120067 - DNA, 13 bp, Homo sapiens
ctcaggaggaggg

SEQ ID NO: 6120068 - DNA, 15 bp, Homo sapiens
ctcaggaggaggggt

SEQ ID NO: 6120069 - DNA, 24 bp, Homo sapiens
ctcaggaggcagaggttgcagtga

SEQ ID NO: 6120070 - DNA, 18 bp, Homo sapiens
ctcaggaggcaggacctt

SEQ ID NO: 6120071 - DNA, 13 bp, Homo sapiens
ctcaggaggcagt

SEQ ID NO: 6120072 - DNA, 22 bp, Homo sapiens
ctcaggaggcgaataaatgttc

SEQ ID NO: 6120073 - DNA, 16 bp, Homo sapiens
ctcaggaggcgcagcc

SEQ ID NO: 6120074 - DNA, 14 bp, Homo sapiens
ctcaggaggctgag

SEQ ID NO: 6120075 - DNA, 18 bp, Homo sapiens
ctcaggaggctgaggcag

SEQ ID NO: 6120076 - DNA, 19 bp, Homo sapiens
ctcaggaggctgaggcaga

SEQ ID NO: 6120077 - DNA, 23 bp, Homo sapiens
ctcaggaggctgaggcaggagaa

SEQ ID NO: 6120078 - DNA, 16 bp, Homo sapiens
ctcaggaggctgaggg

SEQ ID NO: 6120079 - DNA, 14 bp, Homo sapiens
ctcaggagggcagg

SEQ ID NO: 6120080 - DNA, 19 bp, Homo sapiens
ctcaggagggtgacgccca

SEQ ID NO: 6120081 - DNA, 21 bp, Homo sapiens
cgcagttttttttttcttgtc

SEQ ID NO: 6120082 - DNA, 22 bp, Homo sapiens
cgcatatgtgagtgaaagtact

SEQ ID NO: 6120083 - DNA, 14 bp, Homo sapiens
cgcatcaaaagaca

SEQ ID NO: 6120084 - DNA, 13 bp, Homo sapiens
cgcatcagacaga

SEQ ID NO: 6120085 - DNA, 16 bp, Homo sapiens
cgcatcagctgctcag

SEQ ID NO: 6120086 - DNA, 13 bp, Homo sapiens
cgcatcccctgcc

SEQ ID NO: 6120087 - DNA, 15 bp, Homo sapiens
cgcatcccctgcctc

SEQ ID NO: 6120088 - DNA, 14 bp, Homo sapiens
cgcatcccggctga

SEQ ID NO: 6120089 - DNA, 17 bp, Homo sapiens
cgcatcccggctgaccc

SEQ ID NO: 6120090 - DNA, 20 bp, Homo sapiens
cgcatcccggctgaccctgt

SEQ ID NO: 6120091 - DNA, 12 bp, Homo sapiens
cgcatccctgct

SEQ ID NO: 6120092 - DNA, 20 bp, Homo sapiens
cgcatccgcctctgagccag

SEQ ID NO: 6120093 - DNA, 16 bp, Homo sapiens
cgcatccgtcctgggc

SEQ ID NO: 6120094 - DNA, 17 bp, Homo sapiens
cgcatccgtcctgggcg

SEQ ID NO: 6120095 - DNA, 14 bp, Homo sapiens
cgcatcctatgctt

SEQ ID NO: 6120096 - DNA, 19 bp, Homo sapiens
cgcatcctcactgggctca

SEQ ID NO: 6120097 - DNA, 12 bp, Homo sapiens
cgcatcctccag

SEQ ID NO: 6120098 - DNA, 13 bp, Homo sapiens
cgcatcctccagg

SEQ ID NO: 6120099 - DNA, 17 bp, Homo sapiens
cgcatcctccagggggc

SEQ ID NO: 6120100 - DNA, 15 bp, Homo sapiens
cgcatcctcttccat

SEQ ID NO: 6120101 - DNA, 20 bp, Homo sapiens
cgcatctcaaaacagagggc

SEQ ID NO: 6120102 - DNA, 13 bp, Homo sapiens
cgcatctgcctgg

SEQ ID NO: 6120103 - DNA, 22 bp, Homo sapiens
cgcatctgcctggagcctgggc

SEQ ID NO: 6120104 - DNA, 16 bp, Homo sapiens
cgcatctgctcatctg

SEQ ID NO: 6120105 - DNA, 16 bp, Homo sapiens
cgcatcttgcctccag

SEQ ID NO: 6120106 - DNA, 19 bp, Homo sapiens
cgcatcttgcctccaggtg

SEQ ID NO: 6120107 - DNA, 19 bp, Homo sapiens
cgcatgagtatctgtggga

SEQ ID NO: 6120108 - DNA, 14 bp, Homo sapiens
cgcatgcagcagct

SEQ ID NO: 6120109 - DNA, 16 bp, Homo sapiens
cgcatgcagcagcttg

SEQ ID NO: 6120110 - DNA, 21 bp, Homo sapiens
cgcatgcagggcccccactgg

SEQ ID NO: 6120111 - DNA, 14 bp, Homo sapiens
cgcatgccagagcc

SEQ ID NO: 6120112 - DNA, 15 bp, Homo sapiens
cgcatgccctcaatc

SEQ ID NO: 6120113 - DNA, 17 bp, Homo sapiens
cgcatgcctcccaggcc

SEQ ID NO: 6120114 - DNA, 16 bp, Homo sapiens
cgcatgcggcccagga

SEQ ID NO: 6120115 - DNA, 13 bp, Homo sapiens
cgcatgctcagtg

SEQ ID NO: 6120116 - DNA, 16 bp, Homo sapiens
cgcatgctcagtgcct

SEQ ID NO: 6120117 - DNA, 18 bp, Homo sapiens
cgcatgctgcctgcctcc

SEQ ID NO: 6120118 - DNA, 12 bp, Homo sapiens
cgcatggcagct

SEQ ID NO: 6120119 - DNA, 14 bp, Homo sapiens
cgcatggcagctgg

SEQ ID NO: 6120120 - DNA, 23 bp, Homo sapiens
cgcatggcagctgggcccacagc

SEQ ID NO: 6120121 - DNA, 20 bp, Homo sapiens
cgcatggcccctccaggaac

SEQ ID NO: 6120122 - DNA, 21 bp, Homo sapiens
cgcatggcccctccaggaaca

SEQ ID NO: 6120123 - DNA, 16 bp, Homo sapiens
cgcatggcgccccggg

SEQ ID NO: 6120124 - DNA, 14 bp, Homo sapiens
cgcatgggcattgc

SEQ ID NO: 6120125 - DNA, 16 bp, Homo sapiens
cgcatggtcacacact

SEQ ID NO: 6120126 - DNA, 14 bp, Homo sapiens
cgcatggtttttat

SEQ ID NO: 6120127 - DNA, 12 bp, Homo sapiens
cgcatgtacaaa

SEQ ID NO: 6120128 - DNA, 16 bp, Homo sapiens
cgcatgtacaaaaaca

SEQ ID NO: 6120129 - DNA, 18 bp, Homo sapiens
cgcattaagcacacacat

SEQ ID NO: 6120130 - DNA, 22 bp, Homo sapiens
cgcattaagggcctgctggaga

SEQ ID NO: 6120131 - DNA, 12 bp, Homo sapiens
cgcattccaggg

SEQ ID NO: 6120132 - DNA, 18 bp, Homo sapiens
cgcattctaacctggagg

SEQ ID NO: 6120133 - DNA, 14 bp, Homo sapiens
cgcattctcatgga

SEQ ID NO: 6120134 - DNA, 18 bp, Homo sapiens
cgcattctcgtatccaac

SEQ ID NO: 6120135 - DNA, 15 bp, Homo sapiens
cgcattctcttgtgt

SEQ ID NO: 6120136 - DNA, 18 bp, Homo sapiens
cgcattgctgtccttggg

SEQ ID NO: 6120137 - DNA, 16 bp, Homo sapiens
cgcattggtgactcac

SEQ ID NO: 6120138 - DNA, 16 bp, Homo sapiens
cgcattgttttgcatc

SEQ ID NO: 6120139 - DNA, 13 bp, Homo sapiens
cgcatttcatcaa

SEQ ID NO: 6120140 - DNA, 13 bp, Homo sapiens
cgcatttcctaag

SEQ ID NO: 6120141 - DNA, 19 bp, Homo sapiens
cgcattttgggttgtttaa

SEQ ID NO: 6120142 - DNA, 15 bp, Homo sapiens
cgccaaactgtctct

SEQ ID NO: 6120143 - DNA, 17 bp, Homo sapiens
cgccaaataatgtctct

SEQ ID NO: 6120144 - DNA, 14 bp, Homo sapiens
cgccaacagccccc

SEQ ID NO: 6120145 - DNA, 15 bp, Homo sapiens
cgccaaccccagcag

SEQ ID NO: 6120146 - DNA, 14 bp, Homo sapiens
cgccaacgcacgca

SEQ ID NO: 6120147 - DNA, 17 bp, Homo sapiens
cgccaacttctcccacc

SEQ ID NO: 6120148 - DNA, 13 bp, Homo sapiens
cgccaagatctac

SEQ ID NO: 6120149 - DNA, 19 bp, Homo sapiens
cgccaaggaggtgggccac

SEQ ID NO: 6120150 - DNA, 12 bp, Homo sapiens
cgccaaggccta

SEQ ID NO: 6120151 - DNA, 13 bp, Homo sapiens
cgccaaggctggg

SEQ ID NO: 6120152 - DNA, 23 bp, Homo sapiens
cgccaaggctgggggaagaagct

SEQ ID NO: 6120153 - DNA, 22 bp, Homo sapiens
cgccaaggtagccatcccatga

SEQ ID NO: 6120154 - DNA, 17 bp, Homo sapiens
cgccaagtctggcacca

SEQ ID NO: 6120155 - DNA, 16 bp, Homo sapiens
cgccaagtgcgtgccg

SEQ ID NO: 6120156 - DNA, 12 bp, Homo sapiens
cgccaatctcat

SEQ ID NO: 6120157 - DNA, 22 bp, Homo sapiens
cgccaatgttatgccagctcca

SEQ ID NO: 6120158 - DNA, 20 bp, Homo sapiens
cgccacaaaaatagagaaaa

SEQ ID NO: 6120159 - DNA, 21 bp, Homo sapiens
cgccacacagaccaccatcca

SEQ ID NO: 6120160 - DNA, 19 bp, Homo sapiens
cgccacacgctcactccag

SEQ ID NO: 6120161 - DNA, 17 bp, Homo sapiens
cgccacagcccttttgt

SEQ ID NO: 6120162 - DNA, 16 bp, Homo sapiens
cgccacatggcttcct

SEQ ID NO: 6120163 - DNA, 23 bp, Homo sapiens
cgccaccatcctgcagcctcctc

SEQ ID NO: 6120164 - DNA, 11 bp, Homo sapiens
cgccaccattc

SEQ ID NO: 6120165 - DNA, 13 bp, Homo sapiens
cgccacccccatc

SEQ ID NO: 6120166 - DNA, 17 bp, Homo sapiens
cgccacccccatcttcc

SEQ ID NO: 6120167 - DNA, 11 bp, Homo sapiens
cgccacccgcc

SEQ ID NO: 6120168 - DNA, 15 bp, Homo sapiens
cgccaccctgtctca

SEQ ID NO: 6120169 - DNA, 15 bp, Homo sapiens
cgccaccgctgcctt

SEQ ID NO: 6120170 - DNA, 19 bp, Homo sapiens
cgccaccgtgtgcctttcc

SEQ ID NO: 6120171 - DNA, 13 bp, Homo sapiens
cgccacctcaggg

SEQ ID NO: 6120172 - DNA, 15 bp, Homo sapiens
cgccacctcagggca

SEQ ID NO: 6120173 - DNA, 16 bp, Homo sapiens
cgccacctcagggcac

SEQ ID NO: 6120174 - DNA, 21 bp, Homo sapiens
cgccacctgtgtgttcttttg

SEQ ID NO: 6120175 - DNA, 20 bp, Homo sapiens
cgccaccttgtacagaacca

SEQ ID NO: 6120176 - DNA, 13 bp, Homo sapiens
cgccacgctcagt

SEQ ID NO: 6120177 - DNA, 20 bp, Homo sapiens
cgccacggcactccagcctg

SEQ ID NO: 6120178 - DNA, 13 bp, Homo sapiens
cgccacggccacc

SEQ ID NO: 6120179 - DNA, 14 bp, Homo sapiens
cgccacggccaccc

SEQ ID NO: 6120180 - DNA, 18 bp, Homo sapiens
cgccacggccaccctcct

SEQ ID NO: 6120181 - DNA, 16 bp, Homo sapiens
cgccacggcctggctg

SEQ ID NO: 6120182 - DNA, 17 bp, Homo sapiens
cgccacgggtttccctc

SEQ ID NO: 6120183 - DNA, 22 bp, Homo sapiens
cgccactacactccagcctgag

SEQ ID NO: 6120184 - DNA, 19 bp, Homo sapiens
cgccactaggtgtccccaa

SEQ ID NO: 6120185 - DNA, 19 bp, Homo sapiens
cgccactcagccatttccc

SEQ ID NO: 6120186 - DNA, 15 bp, Homo sapiens
cgccactcgcttccc

SEQ ID NO: 6120187 - DNA, 17 bp, Homo sapiens
cgccactgcactccagc

SEQ ID NO: 6120188 - DNA, 20 bp, Homo sapiens
cgccactgcactccagcctg

SEQ ID NO: 6120189 - DNA, 21 bp, Homo sapiens
cgccactgcactccagcctgg

SEQ ID NO: 6120190 - DNA, 13 bp, Homo sapiens
cgccactgccatc

SEQ ID NO: 6120191 - DNA, 19 bp, Homo sapiens
cgccactgtccgctgtctc

SEQ ID NO: 6120192 - DNA, 21 bp, Homo sapiens
cgccactgtccgctgtctccc

SEQ ID NO: 6120193 - DNA, 23 bp, Homo sapiens
cgccactgttttgaatctcataa

SEQ ID NO: 6120194 - DNA, 13 bp, Homo sapiens
cgccacttccttt

SEQ ID NO: 6120195 - DNA, 14 bp, Homo sapiens
cgccagaccccgtg

SEQ ID NO: 6120196 - DNA, 22 bp, Homo sapiens
cgccagaccccgtggctctggg

SEQ ID NO: 6120197 - DNA, 15 bp, Homo sapiens
cgccagagtgtcctg

SEQ ID NO: 6120198 - DNA, 22 bp, Homo sapiens
cgccagattctttcctgaggct

SEQ ID NO: 6120199 - DNA, 14 bp, Homo sapiens
cgccagccacagga

SEQ ID NO: 6120200 - DNA, 16 bp, Homo sapiens
cgccagccacaggacc

SEQ ID NO: 6120201 - DNA, 18 bp, Homo sapiens
cgccagccccgctcccac

SEQ ID NO: 6120202 - DNA, 18 bp, Homo sapiens
cgccagcgtgtggagcag

SEQ ID NO: 6120203 - DNA, 22 bp, Homo sapiens
cgccagcgtgtggagcagagct

SEQ ID NO: 6120204 - DNA, 22 bp, Homo sapiens
cgccagctcaccccatcatccc

SEQ ID NO: 6120205 - DNA, 18 bp, Homo sapiens
cgccagctcctctctgaa

SEQ ID NO: 6120206 - DNA, 23 bp, Homo sapiens
cgccagctcctctctgaagcgac

SEQ ID NO: 6120207 - DNA, 19 bp, Homo sapiens
cgccagctctgttcttcct

SEQ ID NO: 6120208 - DNA, 13 bp, Homo sapiens
cgccagctgatga

SEQ ID NO: 6120209 - DNA, 15 bp, Homo sapiens
cgccagctgccgcac

SEQ ID NO: 6120210 - DNA, 20 bp, Homo sapiens
cgccagctgccgcaccagcc

SEQ ID NO: 6120211 - DNA, 19 bp, Homo sapiens
cgccagctgggagcactgg

SEQ ID NO: 6120212 - DNA, 18 bp, Homo sapiens
cgccagcttctcctgcgc

SEQ ID NO: 6120213 - DNA, 19 bp, Homo sapiens
cgccaggacagcagcactc

SEQ ID NO: 6120214 - DNA, 20 bp, Homo sapiens
cgccaggaccgccaaagaat

SEQ ID NO: 6120215 - DNA, 19 bp, Homo sapiens
cgccaggagaagttgaggg

SEQ ID NO: 6120216 - DNA, 17 bp, Homo sapiens
cgccaggaggtcctcct

SEQ ID NO: 6120217 - DNA, 21 bp, Homo sapiens
cgccaggatggaacacggcca

SEQ ID NO: 6120218 - DNA, 23 bp, Homo sapiens
cgccaggatggaacacggccaca

SEQ ID NO: 6120219 - DNA, 17 bp, Homo sapiens
cgccaggcaccacagcc

SEQ ID NO: 6120220 - DNA, 18 bp, Homo sapiens
cgccaggcaccacagcct

SEQ ID NO: 6120221 - DNA, 16 bp, Homo sapiens
cgccaggcagagctga

SEQ ID NO: 6120222 - DNA, 15 bp, Homo sapiens
cgccaggccagcagg

SEQ ID NO: 6120223 - DNA, 11 bp, Homo sapiens
cgccaggcgca

SEQ ID NO: 6120224 - DNA, 15 bp, Homo sapiens
cgccaggcgctgcag

SEQ ID NO: 6120225 - DNA, 20 bp, Homo sapiens
cgccaggctgaccacagcac

SEQ ID NO: 6120226 - DNA, 21 bp, Homo sapiens
cgccaggctgaccacagcaca

SEQ ID NO: 6120227 - DNA, 23 bp, Homo sapiens
cgccaggctgaccacagcacagc

SEQ ID NO: 6120228 - DNA, 16 bp, Homo sapiens
cgccagggaccccaga

SEQ ID NO: 6120229 - DNA, 18 bp, Homo sapiens
cgccagggagacctggac

SEQ ID NO: 6120230 - DNA, 14 bp, Homo sapiens
cgccagggctgggg

SEQ ID NO: 6120231 - DNA, 22 bp, Homo sapiens
cgccaggggaaaatcagcctgc

SEQ ID NO: 6120232 - DNA, 15 bp, Homo sapiens
cgccagtacttgtca

SEQ ID NO: 6120233 - DNA, 16 bp, Homo sapiens
cgccagtgcacaggga

SEQ ID NO: 6120234 - DNA, 18 bp, Homo sapiens
cgccataaatcagccgca

SEQ ID NO: 6120235 - DNA, 14 bp, Homo sapiens
cgccatagccccag

SEQ ID NO: 6120236 - DNA, 21 bp, Homo sapiens
cgccatcaccccctaccccag

SEQ ID NO: 6120237 - DNA, 14 bp, Homo sapiens
cgccatcagcccaa

SEQ ID NO: 6120238 - DNA, 16 bp, Homo sapiens
cgccatccagggtctg

SEQ ID NO: 6120239 - DNA, 16 bp, Homo sapiens
cgccatcccagcccca

SEQ ID NO: 6120240 - DNA, 20 bp, Homo sapiens
cgccatccgggacgcttcca

SEQ ID NO: 6120241 - DNA, 23 bp, Homo sapiens
cgccatccgggacgcttccagac

SEQ ID NO: 6120242 - DNA, 13 bp, Homo sapiens
cgccatcctctgc

SEQ ID NO: 6120243 - DNA, 17 bp, Homo sapiens
cgccatccttcaccaga

SEQ ID NO: 6120244 - DNA, 24 bp, Homo sapiens
cgccatccttcaccagagcccatg

SEQ ID NO: 6120245 - DNA, 15 bp, Homo sapiens
cgccatctcctgggc

SEQ ID NO: 6120246 - DNA, 23 bp, Homo sapiens
cgccatctcggctcactgcaacc

SEQ ID NO: 6120247 - DNA, 23 bp, Homo sapiens
cgccatctgatccccatgcctag

SEQ ID NO: 6120248 - DNA, 17 bp, Homo sapiens
cgccatctgcgcagggt

SEQ ID NO: 6120249 - DNA, 22 bp, Homo sapiens
cgccatctgtgtgcagcaacca

SEQ ID NO: 6120250 - DNA, 16 bp, Homo sapiens
cgccatcttcttccct

SEQ ID NO: 6120251 - DNA, 19 bp, Homo sapiens
cgccatgcaactccatgcc

SEQ ID NO: 6120252 - DNA, 20 bp, Homo sapiens
cgccatgcaactccatgcct

SEQ ID NO: 6120253 - DNA, 15 bp, Homo sapiens
cgccatgctcctggc

SEQ ID NO: 6120254 - DNA, 17 bp, Homo sapiens
cgccatgctcctggccc

SEQ ID NO: 6120255 - DNA, 15 bp, Homo sapiens
cgccatggtcaccct

SEQ ID NO: 6120256 - DNA, 14 bp, Homo sapiens
cgccatgtgctgtg

SEQ ID NO: 6120257 - DNA, 20 bp, Homo sapiens
cgccattcactgattggaag

SEQ ID NO: 6120258 - DNA, 11 bp, Homo sapiens
cgccattccag

SEQ ID NO: 6120259 - DNA, 19 bp, Homo sapiens
cgccattctcctgcctcag

SEQ ID NO: 6120260 - DNA, 18 bp, Homo sapiens
cgccattgcactccagcc

SEQ ID NO: 6120261 - DNA, 14 bp, Homo sapiens
cgccattgccacca

SEQ ID NO: 6120262 - DNA, 20 bp, Homo sapiens
cgccattgtactccagcctg

SEQ ID NO: 6120263 - DNA, 13 bp, Homo sapiens
cgccatttaaaag

SEQ ID NO: 6120264 - DNA, 20 bp, Homo sapiens
cgcccaaacctttcccccat

SEQ ID NO: 6120265 - DNA, 20 bp, Homo sapiens
cgcccaaaggacgcactgag

SEQ ID NO: 6120266 - DNA, 15 bp, Homo sapiens
cgcccaacccttccc

SEQ ID NO: 6120267 - DNA, 18 bp, Homo sapiens
cgcccaactaatttttgt

SEQ ID NO: 6120268 - DNA, 12 bp, Homo sapiens
cgcccaaggccc

SEQ ID NO: 6120269 - DNA, 17 bp, Homo sapiens
cgcccaaggccttcccc

SEQ ID NO: 6120270 - DNA, 16 bp, Homo sapiens
cgcccaaggggacttg

SEQ ID NO: 6120271 - DNA, 15 bp, Homo sapiens
cgcccacaaactgat

SEQ ID NO: 6120272 - DNA, 22 bp, Homo sapiens
cgcccacccacaccccgtctgc

SEQ ID NO: 6120273 - DNA, 15 bp, Homo sapiens
cgcccacccagctgg

SEQ ID NO: 6120274 - DNA, 13 bp, Homo sapiens
cgcccacccccac

SEQ ID NO: 6120275 - DNA, 19 bp, Homo sapiens
cgcccacccccacccccag

SEQ ID NO: 6120276 - DNA, 18 bp, Homo sapiens
cgcccaccccgctgcctg

SEQ ID NO: 6120277 - DNA, 19 bp, Homo sapiens
cgcccaccccgctgcctgg

SEQ ID NO: 6120278 - DNA, 16 bp, Homo sapiens
cgcccacccgccttgt

SEQ ID NO: 6120279 - DNA, 18 bp, Homo sapiens
cgcccacccggcccggct

SEQ ID NO: 6120280 - DNA, 17 bp, Homo sapiens
cgcccaccctgggctcc

SEQ ID NO: 6120281 - DNA, 16 bp, Homo sapiens
cgcccaccgcatgccc

SEQ ID NO: 6120282 - DNA, 21 bp, Homo sapiens
cgcccacctagtgcttccact

SEQ ID NO: 6120283 - DNA, 14 bp, Homo sapiens
cgcccacctcagcc

SEQ ID NO: 6120284 - DNA, 11 bp, Homo sapiens
cgcccacctcc

SEQ ID NO: 6120285 - DNA, 12 bp, Homo sapiens
cgcccacctccc

SEQ ID NO: 6120286 - DNA, 22 bp, Homo sapiens
cgcccacctcgctcccctctgg

SEQ ID NO: 6120287 - DNA, 20 bp, Homo sapiens
cgcccacctctgctgcccac

SEQ ID NO: 6120288 - DNA, 15 bp, Homo sapiens
cgcccacctgcatca

SEQ ID NO: 6120289 - DNA, 18 bp, Homo sapiens
cgcccacctgcatcagcc

SEQ ID NO: 6120290 - DNA, 14 bp, Homo sapiens
cgcccacctgccca

SEQ ID NO: 6120291 - DNA, 17 bp, Homo sapiens
cgcccacctgcccagtt

SEQ ID NO: 6120292 - DNA, 15 bp, Homo sapiens
cgcccacctgggccc

SEQ ID NO: 6120293 - DNA, 20 bp, Homo sapiens
cgcccacctgggccctaggc

SEQ ID NO: 6120294 - DNA, 18 bp, Homo sapiens
cgcccaccttcgggcagt

SEQ ID NO: 6120295 - DNA, 22 bp, Homo sapiens
cgcccacgccggcctctgctgc

SEQ ID NO: 6120296 - DNA, 18 bp, Homo sapiens
cgcccactctccacctca

SEQ ID NO: 6120297 - DNA, 20 bp, Homo sapiens
cgcccactctccacctcact

SEQ ID NO: 6120298 - DNA, 24 bp, Homo sapiens
cgcccagacaccacagacgccacc

SEQ ID NO: 6120299 - DNA, 16 bp, Homo sapiens
cgcccagacaccatgt

SEQ ID NO: 6120300 - DNA, 19 bp, Homo sapiens
cgcccagaggagcccagcg

SEQ ID NO: 6120301 - DNA, 16 bp, Homo sapiens
cgcccagatcatgccg

SEQ ID NO: 6120302 - DNA, 14 bp, Homo sapiens
cgcccagcagcctg

SEQ ID NO: 6120303 - DNA, 18 bp, Homo sapiens
cgcccagcagcctgccag

SEQ ID NO: 6120304 - DNA, 13 bp, Homo sapiens
cgcccagcccagg

SEQ ID NO: 6120305 - DNA, 14 bp, Homo sapiens
cgcccagcccaggc

SEQ ID NO: 6120306 - DNA, 11 bp, Homo sapiens
cgcccagcccc

SEQ ID NO: 6120307 - DNA, 12 bp, Homo sapiens
cgcccagcccca

SEQ ID NO: 6120308 - DNA, 14 bp, Homo sapiens
cgcccagcccccac

SEQ ID NO: 6120309 - DNA, 16 bp, Homo sapiens
cgcccagcgctcgcca

SEQ ID NO: 6120310 - DNA, 22 bp, Homo sapiens
cgcccagctcctgacactgctg

SEQ ID NO: 6120311 - DNA, 15 bp, Homo sapiens
cgcccagctgcacct

SEQ ID NO: 6120312 - DNA, 23 bp, Homo sapiens
cgcccagctgcacctgccagcct

SEQ ID NO: 6120313 - DNA, 14 bp, Homo sapiens
cgcccaggacccca

SEQ ID NO: 6120314 - DNA, 11 bp, Homo sapiens
cgcccaggaga

SEQ ID NO: 6120315 - DNA, 17 bp, Homo sapiens
cgcccaggatcagattg

SEQ ID NO: 6120316 - DNA, 22 bp, Homo sapiens
cgcccaggatgaaggggccaga

SEQ ID NO: 6120317 - DNA, 12 bp, Homo sapiens
cgcccaggcctg

SEQ ID NO: 6120318 - DNA, 14 bp, Homo sapiens
cgcccaggcctgct

SEQ ID NO: 6120319 - DNA, 20 bp, Homo sapiens
cgcccaggcctgggatgcag

SEQ ID NO: 6120320 - DNA, 15 bp, Homo sapiens
cgcccaggctggagc

SEQ ID NO: 6120321 - DNA, 20 bp, Homo sapiens
cgcccaggctggagtgcaat

SEQ ID NO: 6120322 - DNA, 15 bp, Homo sapiens
cgcccaggggcccgg

SEQ ID NO: 6120323 - DNA, 15 bp, Homo sapiens
cgcccagtcccagca

SEQ ID NO: 6120324 - DNA, 18 bp, Homo sapiens
cgcccagtcccagcagcc

SEQ ID NO: 6120325 - DNA, 21 bp, Homo sapiens
cgcccagtcccagcagccagc

SEQ ID NO: 6120326 - DNA, 13 bp, Homo sapiens
cgcccagtctgga

SEQ ID NO: 6120327 - DNA, 20 bp, Homo sapiens
cgcccagtgggacccacagt

SEQ ID NO: 6120328 - DNA, 17 bp, Homo sapiens
cgcccatcaccttggag

SEQ ID NO: 6120329 - DNA, 13 bp, Homo sapiens
cgcccatcagtgc

SEQ ID NO: 6120330 - DNA, 20 bp, Homo sapiens
cgcccatcagtgccagcccc

SEQ ID NO: 6120331 - DNA, 18 bp, Homo sapiens
cgcccattcggactgctg

SEQ ID NO: 6120332 - DNA, 19 bp, Homo sapiens
cgcccattcgtctgtccca

SEQ ID NO: 6120333 - DNA, 17 bp, Homo sapiens
cgccccaaagttgctca

SEQ ID NO: 6120334 - DNA, 21 bp, Homo sapiens
cgccccaacccgtggaggctg

SEQ ID NO: 6120335 - DNA, 12 bp, Homo sapiens
cgccccacctcc

SEQ ID NO: 6120336 - DNA, 15 bp, Homo sapiens
cgccccacctcccat

SEQ ID NO: 6120337 - DNA, 13 bp, Homo sapiens
cgccccagacaca

SEQ ID NO: 6120338 - DNA, 11 bp, Homo sapiens
cgccccagaga

SEQ ID NO: 6120339 - DNA, 16 bp, Homo sapiens
cgccccagagactgcc

SEQ ID NO: 6120340 - DNA, 18 bp, Homo sapiens
cgccccagagactgccca

SEQ ID NO: 6120341 - DNA, 19 bp, Homo sapiens
cgccccagataccagcccc

SEQ ID NO: 6120342 - DNA, 13 bp, Homo sapiens
cgccccagccctc

SEQ ID NO: 6120343 - DNA, 15 bp, Homo sapiens
cgccccagccctcag

SEQ ID NO: 6120344 - DNA, 16 bp, Homo sapiens
cgccccagccctcagt

SEQ ID NO: 6120345 - DNA, 12 bp, Homo sapiens
cgccccagcctc

SEQ ID NO: 6120346 - DNA, 18 bp, Homo sapiens
cgccccagcctcctgagt

SEQ ID NO: 6120347 - DNA, 19 bp, Homo sapiens
cgccccaggccccagcagt

SEQ ID NO: 6120348 - DNA, 12 bp, Homo sapiens
cgccccagggtc

SEQ ID NO: 6120349 - DNA, 19 bp, Homo sapiens
cgccccagtggcactgaag

SEQ ID NO: 6120350 - DNA, 18 bp, Homo sapiens
cgccccatccctgcttgc

SEQ ID NO: 6120351 - DNA, 18 bp, Homo sapiens
cgccccatgggccctcag

SEQ ID NO: 6120352 - DNA, 20 bp, Homo sapiens
cgccccatgggccctcagcg

SEQ ID NO: 6120353 - DNA, 15 bp, Homo sapiens
cgcccccacccctgg

SEQ ID NO: 6120354 - DNA, 21 bp, Homo sapiens
cgcccccaccgggctgcaggt

SEQ ID NO: 6120355 - DNA, 18 bp, Homo sapiens
cgcccccactcctcctcc

SEQ ID NO: 6120356 - DNA, 21 bp, Homo sapiens
cgcccccactcctcctccttt

SEQ ID NO: 6120357 - DNA, 12 bp, Homo sapiens
cgcccccacttt

SEQ ID NO: 6120358 - DNA, 13 bp, Homo sapiens
cgcccccagccta

SEQ ID NO: 6120359 - DNA, 12 bp, Homo sapiens
cgcccccagtgt

SEQ ID NO: 6120360 - DNA, 14 bp, Homo sapiens
cgccccccagagcc

SEQ ID NO: 6120361 - DNA, 21 bp, Homo sapiens
cgccccccagagccagggctg

SEQ ID NO: 6120362 - DNA, 20 bp, Homo sapiens
cgccccccggcctggccccc

SEQ ID NO: 6120363 - DNA, 22 bp, Homo sapiens
cgcccccctttggtttggcctc

SEQ ID NO: 6120364 - DNA, 15 bp, Homo sapiens
cgcccccgagccctg

SEQ ID NO: 6120365 - DNA, 15 bp, Homo sapiens
cgcccccgccccagg

SEQ ID NO: 6120366 - DNA, 13 bp, Homo sapiens
cgcccccgcctgg

SEQ ID NO: 6120367 - DNA, 16 bp, Homo sapiens
cgcccccgcctgggca

SEQ ID NO: 6120368 - DNA, 14 bp, Homo sapiens
cgccccctccctat

SEQ ID NO: 6120369 - DNA, 18 bp, Homo sapiens
cgccccctccctgctccc

SEQ ID NO: 6120370 - DNA, 17 bp, Homo sapiens
cgccccctccgccctgc

SEQ ID NO: 6120371 - DNA, 13 bp, Homo sapiens
cgccccctgaaac

SEQ ID NO: 6120372 - DNA, 12 bp, Homo sapiens
cgccccctgccc

SEQ ID NO: 6120373 - DNA, 14 bp, Homo sapiens
cgccccctgccctc

SEQ ID NO: 6120374 - DNA, 14 bp, Homo sapiens
cgccccctggtggg

SEQ ID NO: 6120375 - DNA, 13 bp, Homo sapiens
cgccccctgtctc

SEQ ID NO: 6120376 - DNA, 18 bp, Homo sapiens
cgccccgcacccccgcca

SEQ ID NO: 6120377 - DNA, 16 bp, Homo sapiens
cgccccgcccacaccc

SEQ ID NO: 6120378 - DNA, 14 bp, Homo sapiens
cgccccgccccaca

SEQ ID NO: 6120379 - DNA, 13 bp, Homo sapiens
cgccccgccccag

SEQ ID NO: 6120380 - DNA, 13 bp, Homo sapiens
cgccccgccccca

SEQ ID NO: 6120381 - DNA, 16 bp, Homo sapiens
cgccccgcctgacctg

SEQ ID NO: 6120382 - DNA, 18 bp, Homo sapiens
cgccccgctgtgtcctcc

SEQ ID NO: 6120383 - DNA, 20 bp, Homo sapiens
cgccccgctgtgtcctccct

SEQ ID NO: 6120384 - DNA, 18 bp, Homo sapiens
cgccccggacgccgcgat

SEQ ID NO: 6120385 - DNA, 18 bp, Homo sapiens
cgccccgggcaaagggtc

SEQ ID NO: 6120386 - DNA, 13 bp, Homo sapiens
cgccccgggccgc

SEQ ID NO: 6120387 - DNA, 17 bp, Homo sapiens
cgccccgggctggccct

SEQ ID NO: 6120388 - DNA, 23 bp, Homo sapiens
cgccccgggctggccctgtgcag

SEQ ID NO: 6120389 - DNA, 19 bp, Homo sapiens
cgccccggggcgcctagag

SEQ ID NO: 6120390 - DNA, 17 bp, Homo sapiens
cgccccggtcccccaga

SEQ ID NO: 6120391 - DNA, 18 bp, Homo sapiens
cgccccgtgctcctctgc

SEQ ID NO: 6120392 - DNA, 21 bp, Homo sapiens
cgcccctagccggttcctgtc

SEQ ID NO: 6120393 - DNA, 13 bp, Homo sapiens
cgcccctcagagc

SEQ ID NO: 6120394 - DNA, 14 bp, Homo sapiens
cgcccctcagagca

SEQ ID NO: 6120395 - DNA, 16 bp, Homo sapiens
cgcccctcagagcatg

SEQ ID NO: 6120396 - DNA, 18 bp, Homo sapiens
cgcccctccaaacctcca

SEQ ID NO: 6120397 - DNA, 19 bp, Homo sapiens
cgcccctccaaacctccag

SEQ ID NO: 6120398 - DNA, 20 bp, Homo sapiens
cgcccctccaaacctccagc

SEQ ID NO: 6120399 - DNA, 23 bp, Homo sapiens
cgcccctccaaacctccagcctc

SEQ ID NO: 6120400 - DNA, 15 bp, Homo sapiens
cgcccctccacccat

SEQ ID NO: 6120401 - DNA, 21 bp, Homo sapiens
cgcccctcccacagcgctggc

SEQ ID NO: 6120402 - DNA, 16 bp, Homo sapiens
cgcccctcccacgcct

SEQ ID NO: 6120403 - DNA, 18 bp, Homo sapiens
cgcccctcccacgcctca

SEQ ID NO: 6120404 - DNA, 14 bp, Homo sapiens
cgcccctccccagc

SEQ ID NO: 6120405 - DNA, 17 bp, Homo sapiens
cgcccctcccctcagcc

SEQ ID NO: 6120406 - DNA, 18 bp, Homo sapiens
cgcccctcccctcagcct

SEQ ID NO: 6120407 - DNA, 19 bp, Homo sapiens
cgcccctcccctcagcctg

SEQ ID NO: 6120408 - DNA, 12 bp, Homo sapiens
cgcccctcctcg

SEQ ID NO: 6120409 - DNA, 12 bp, Homo sapiens
cgcccctccttt

SEQ ID NO: 6120410 - DNA, 18 bp, Homo sapiens
cgcccctcgctgctgcta

SEQ ID NO: 6120411 - DNA, 12 bp, Homo sapiens
cgcccctctgca

SEQ ID NO: 6120412 - DNA, 12 bp, Homo sapiens
cgcccctgagcc

SEQ ID NO: 6120413 - DNA, 12 bp, Homo sapiens
cgcccctgaggc

SEQ ID NO: 6120414 - DNA, 13 bp, Homo sapiens
cgcccctgcatgc

SEQ ID NO: 6120415 - DNA, 18 bp, Homo sapiens
cgcccctgcatgcctggc

SEQ ID NO: 6120416 - DNA, 21 bp, Homo sapiens
cgcccctgcatgcctggcccc

SEQ ID NO: 6120417 - DNA, 15 bp, Homo sapiens
cgcccctgcccagca

SEQ ID NO: 6120418 - DNA, 12 bp, Homo sapiens
cgcccctgcctg

SEQ ID NO: 6120419 - DNA, 12 bp, Homo sapiens
cgcccctgctgt

SEQ ID NO: 6120420 - DNA, 11 bp, Homo sapiens
cgcccctgggg

SEQ ID NO: 6120421 - DNA, 20 bp, Homo sapiens
cgcccctgtggccaactgca

SEQ ID NO: 6120422 - DNA, 18 bp, Homo sapiens
cgcccctgtggccctggc

SEQ ID NO: 6120423 - DNA, 22 bp, Homo sapiens
cgccccttccctctctccctgc

SEQ ID NO: 6120424 - DNA, 16 bp, Homo sapiens
cgcccctttctcttgc

SEQ ID NO: 6120425 - DNA, 17 bp, Homo sapiens
cgcccctttctcttgct

SEQ ID NO: 6120426 - DNA, 13 bp, Homo sapiens
cgcccgagcccct

SEQ ID NO: 6120427 - DNA, 13 bp, Homo sapiens
cgcccgaggcaga

SEQ ID NO: 6120428 - DNA, 13 bp, Homo sapiens
cgcccgcccaccc

SEQ ID NO: 6120429 - DNA, 22 bp, Homo sapiens
cgcccgcccaccccgctgcctg

SEQ ID NO: 6120430 - DNA, 16 bp, Homo sapiens
cgcccgcccactgtcc

SEQ ID NO: 6120431 - DNA, 21 bp, Homo sapiens
cgcccgcccactgtcctgggc

SEQ ID NO: 6120432 - DNA, 13 bp, Homo sapiens
cgcccgcccccgc

SEQ ID NO: 6120433 - DNA, 14 bp, Homo sapiens
cgcccgcccccgcc

SEQ ID NO: 6120434 - DNA, 23 bp, Homo sapiens
cgcccgcccccgccctcgctccg

SEQ ID NO: 6120435 - DNA, 16 bp, Homo sapiens
cgcccgcccctgcagc

SEQ ID NO: 6120436 - DNA, 18 bp, Homo sapiens
cgcccgcccctgcagcac

SEQ ID NO: 6120437 - DNA, 19 bp, Homo sapiens
cgcccgccctcctctgccc

SEQ ID NO: 6120438 - DNA, 13 bp, Homo sapiens
cgcccgcggccct

SEQ ID NO: 6120439 - DNA, 14 bp, Homo sapiens
cgcccgcggcgcga

SEQ ID NO: 6120440 - DNA, 21 bp, Homo sapiens
cgcccgctcccttcctgccac

SEQ ID NO: 6120441 - DNA, 13 bp, Homo sapiens
cgcccgctcctgc

SEQ ID NO: 6120442 - DNA, 18 bp, Homo sapiens
cgcccgctcctgccgcag

SEQ ID NO: 6120443 - DNA, 18 bp, Homo sapiens
cgcccgctgagctgagtg

SEQ ID NO: 6120444 - DNA, 21 bp, Homo sapiens
ctcaggagggtgacgcccagc

SEQ ID NO: 6120445 - DNA, 22 bp, Homo sapiens
ctcaggagggtgacgcccagct

SEQ ID NO: 6120446 - DNA, 17 bp, Homo sapiens
ctcaggagtctgccact

SEQ ID NO: 6120447 - DNA, 18 bp, Homo sapiens
ctcaggagtttgagacca

SEQ ID NO: 6120448 - DNA, 20 bp, Homo sapiens
ctcaggagtttgagaccagg

SEQ ID NO: 6120449 - DNA, 20 bp, Homo sapiens
ctcaggatatccttatcaga

SEQ ID NO: 6120450 - DNA, 19 bp, Homo sapiens
ctcaggatattcactctgt

SEQ ID NO: 6120451 - DNA, 12 bp, Homo sapiens
ctcaggatccag

SEQ ID NO: 6120452 - DNA, 21 bp, Homo sapiens
ctcaggatgagggaaaagaaa

SEQ ID NO: 6120453 - DNA, 22 bp, Homo sapiens
ctcaggatgagggaaaagaaaa

SEQ ID NO: 6120454 - DNA, 19 bp, Homo sapiens
ctcaggatgcccagggcca

SEQ ID NO: 6120455 - DNA, 16 bp, Homo sapiens
ctcaggatggctcaga

SEQ ID NO: 6120456 - DNA, 15 bp, Homo sapiens
ctcaggatgggaaga

SEQ ID NO: 6120457 - DNA, 21 bp, Homo sapiens
ctcaggatgtcctttgtgtcc

SEQ ID NO: 6120458 - DNA, 20 bp, Homo sapiens
ctcaggatttaaaaactgga

SEQ ID NO: 6120459 - DNA, 15 bp, Homo sapiens
ctcaggcaagcccct

SEQ ID NO: 6120460 - DNA, 18 bp, Homo sapiens
ctcaggcacacagctact

SEQ ID NO: 6120461 - DNA, 19 bp, Homo sapiens
ctcaggcacaccttgcaga

SEQ ID NO: 6120462 - DNA, 14 bp, Homo sapiens
ctcaggcaccagtc

SEQ ID NO: 6120463 - DNA, 13 bp, Homo sapiens
ctcaggcactctc

SEQ ID NO: 6120464 - DNA, 14 bp, Homo sapiens
ctcaggcagacaag

SEQ ID NO: 6120465 - DNA, 17 bp, Homo sapiens
ctcaggcagacaagagc

SEQ ID NO: 6120466 - DNA, 20 bp, Homo sapiens
ctcaggcagaggatgttctg

SEQ ID NO: 6120467 - DNA, 21 bp, Homo sapiens
ctcaggcagcaccacactggg

SEQ ID NO: 6120468 - DNA, 16 bp, Homo sapiens
ctcaggcagcctgtgg

SEQ ID NO: 6120469 - DNA, 23 bp, Homo sapiens
ctcaggcagcgttagggctgctt

SEQ ID NO: 6120470 - DNA, 13 bp, Homo sapiens
ctcaggcagctcg

SEQ ID NO: 6120471 - DNA, 18 bp, Homo sapiens
ctcaggcaggtgggatgg

SEQ ID NO: 6120472 - DNA, 16 bp, Homo sapiens
ctcaggcataggcctg

SEQ ID NO: 6120473 - DNA, 20 bp, Homo sapiens
ctcaggcataggcctgggtg

SEQ ID NO: 6120474 - DNA, 21 bp, Homo sapiens
ctcaggcataggcctgggtgc

SEQ ID NO: 6120475 - DNA, 18 bp, Homo sapiens
ctcaggcatcattccacc

SEQ ID NO: 6120476 - DNA, 22 bp, Homo sapiens
ctcaggcatggatgaataaatg

SEQ ID NO: 6120477 - DNA, 15 bp, Homo sapiens
ctcaggcatttcatt

SEQ ID NO: 6120478 - DNA, 20 bp, Homo sapiens
ctcaggccaaactcacctgc

SEQ ID NO: 6120479 - DNA, 20 bp, Homo sapiens
ctcaggccaaagacctccca

SEQ ID NO: 6120480 - DNA, 14 bp, Homo sapiens
ctcaggccaaggga

SEQ ID NO: 6120481 - DNA, 15 bp, Homo sapiens
ctcaggccacaccgg

SEQ ID NO: 6120482 - DNA, 14 bp, Homo sapiens
ctcaggccaccctc

SEQ ID NO: 6120483 - DNA, 13 bp, Homo sapiens
ctcaggccagagc

SEQ ID NO: 6120484 - DNA, 16 bp, Homo sapiens
ctcaggccagagccaa

SEQ ID NO: 6120485 - DNA, 16 bp, Homo sapiens
ctcaggccagctgctt

SEQ ID NO: 6120486 - DNA, 20 bp, Homo sapiens
ctcaggccagctgcttgggc

SEQ ID NO: 6120487 - DNA, 22 bp, Homo sapiens
ctcaggccagctgcttgggctt

SEQ ID NO: 6120488 - DNA, 15 bp, Homo sapiens
ctcaggccagggctc

SEQ ID NO: 6120489 - DNA, 16 bp, Homo sapiens
ctcaggccagtgccag

SEQ ID NO: 6120490 - DNA, 14 bp, Homo sapiens
ctcaggccattccc

SEQ ID NO: 6120491 - DNA, 17 bp, Homo sapiens
ctcaggcccacattgcc

SEQ ID NO: 6120492 - DNA, 22 bp, Homo sapiens
ctcaggcccacattgcccacac

SEQ ID NO: 6120493 - DNA, 13 bp, Homo sapiens
ctcaggcccagaa

SEQ ID NO: 6120494 - DNA, 17 bp, Homo sapiens
ctcaggcccaggagtcc

SEQ ID NO: 6120495 - DNA, 22 bp, Homo sapiens
ctcaggcccaggagtccaggcc

SEQ ID NO: 6120496 - DNA, 15 bp, Homo sapiens
ctcaggccccgggct

SEQ ID NO: 6120497 - DNA, 21 bp, Homo sapiens
ctcaggccccgggcttccctt

SEQ ID NO: 6120498 - DNA, 23 bp, Homo sapiens
ctcaggccccgggcttcccttct

SEQ ID NO: 6120499 - DNA, 14 bp, Homo sapiens
ctcaggcccggcat

SEQ ID NO: 6120500 - DNA, 20 bp, Homo sapiens
ctcaggccggcagccccagc

SEQ ID NO: 6120501 - DNA, 21 bp, Homo sapiens
ctcaggccggcagccccagcc

SEQ ID NO: 6120502 - DNA, 24 bp, Homo sapiens
ctcaggccggcagccccagcctgc

SEQ ID NO: 6120503 - DNA, 16 bp, Homo sapiens
ctcaggccgggctttc

SEQ ID NO: 6120504 - DNA, 16 bp, Homo sapiens
ctcaggcctaggaggc

SEQ ID NO: 6120505 - DNA, 11 bp, Homo sapiens
ctcaggcctca

SEQ ID NO: 6120506 - DNA, 15 bp, Homo sapiens
ctcaggcctcacctc

SEQ ID NO: 6120507 - DNA, 21 bp, Homo sapiens
ctcaggcctcacctcccaggg

SEQ ID NO: 6120508 - DNA, 23 bp, Homo sapiens
ctcaggcctcacctcccagggct

SEQ ID NO: 6120509 - DNA, 21 bp, Homo sapiens
ctcaggcctcacctggcttcc

SEQ ID NO: 6120510 - DNA, 11 bp, Homo sapiens
ctcaggcctcc

SEQ ID NO: 6120511 - DNA, 12 bp, Homo sapiens
ctcaggcctcca

SEQ ID NO: 6120512 - DNA, 14 bp, Homo sapiens
ctcaggcctccagc

SEQ ID NO: 6120513 - DNA, 12 bp, Homo sapiens
ctcaggcctccc

SEQ ID NO: 6120514 - DNA, 16 bp, Homo sapiens
ctcaggcctccctagc

SEQ ID NO: 6120515 - DNA, 19 bp, Homo sapiens
ctcaggcctctgcagaagc

SEQ ID NO: 6120516 - DNA, 18 bp, Homo sapiens
ctcaggcctctgtgccgc

SEQ ID NO: 6120517 - DNA, 20 bp, Homo sapiens
ctcaggcctgactctcagca

SEQ ID NO: 6120518 - DNA, 13 bp, Homo sapiens
ctcaggcctgcca

SEQ ID NO: 6120519 - DNA, 18 bp, Homo sapiens
ctcaggcctgccaatgcc

SEQ ID NO: 6120520 - DNA, 21 bp, Homo sapiens
ctcaggcctgccaatgccaca

SEQ ID NO: 6120521 - DNA, 22 bp, Homo sapiens
ctcaggcctgccaatgccacag

SEQ ID NO: 6120522 - DNA, 11 bp, Homo sapiens
ctcaggcctgg

SEQ ID NO: 6120523 - DNA, 12 bp, Homo sapiens
ctcaggcctggc

SEQ ID NO: 6120524 - DNA, 21 bp, Homo sapiens
ctcaggcctgggggctgggca

SEQ ID NO: 6120525 - DNA, 22 bp, Homo sapiens
ctcaggcctgggggctgggcag

SEQ ID NO: 6120526 - DNA, 16 bp, Homo sapiens
ctcaggcctgtgccca

SEQ ID NO: 6120527 - DNA, 14 bp, Homo sapiens
ctcaggcgcctggc

SEQ ID NO: 6120528 - DNA, 15 bp, Homo sapiens
ctcaggcgcttctcc

SEQ ID NO: 6120529 - DNA, 18 bp, Homo sapiens
ctcaggctaggccagcag

SEQ ID NO: 6120530 - DNA, 13 bp, Homo sapiens
ctcaggctcccca

SEQ ID NO: 6120531 - DNA, 15 bp, Homo sapiens
ctcaggctctgccct

SEQ ID NO: 6120532 - DNA, 22 bp, Homo sapiens
ctcaggctctgccctgccctag

SEQ ID NO: 6120533 - DNA, 15 bp, Homo sapiens
ctcaggctgagccca

SEQ ID NO: 6120534 - DNA, 20 bp, Homo sapiens
ctcaggctgcagctggacag

SEQ ID NO: 6120535 - DNA, 14 bp, Homo sapiens
ctcaggctgcccag

SEQ ID NO: 6120536 - DNA, 14 bp, Homo sapiens
ctcaggctgcctga

SEQ ID NO: 6120537 - DNA, 16 bp, Homo sapiens
ctcaggctgcctgagt

SEQ ID NO: 6120538 - DNA, 13 bp, Homo sapiens
ctcaggctgctcc

SEQ ID NO: 6120539 - DNA, 14 bp, Homo sapiens
ctcaggctggcatc

SEQ ID NO: 6120540 - DNA, 14 bp, Homo sapiens
ctcaggctgggccc

SEQ ID NO: 6120541 - DNA, 13 bp, Homo sapiens
ctcaggctgtccc

SEQ ID NO: 6120542 - DNA, 22 bp, Homo sapiens
ctcaggctgtcccaagctccca

SEQ ID NO: 6120543 - DNA, 17 bp, Homo sapiens
ctcaggctgtgcttacc

SEQ ID NO: 6120544 - DNA, 17 bp, Homo sapiens
ctcaggcttgagggagg

SEQ ID NO: 6120545 - DNA, 19 bp, Homo sapiens
ctcaggcttgagggagggc

SEQ ID NO: 6120546 - DNA, 20 bp, Homo sapiens
ctcaggcttgagggagggct

SEQ ID NO: 6120547 - DNA, 19 bp, Homo sapiens
ctcaggcttggcggaggga

SEQ ID NO: 6120548 - DNA, 21 bp, Homo sapiens
ctcaggctttcactatttcct

SEQ ID NO: 6120549 - DNA, 15 bp, Homo sapiens
ctcaggctttttcca

SEQ ID NO: 6120550 - DNA, 22 bp, Homo sapiens
ctcagggaaaagcagctctccc

SEQ ID NO: 6120551 - DNA, 19 bp, Homo sapiens
ctcagggacagagacacct

SEQ ID NO: 6120552 - DNA, 20 bp, Homo sapiens
ctcagggacagagacacctg

SEQ ID NO: 6120553 - DNA, 15 bp, Homo sapiens
ctcagggaccacagc

SEQ ID NO: 6120554 - DNA, 16 bp, Homo sapiens
ctcagggaccacagca

SEQ ID NO: 6120555 - DNA, 19 bp, Homo sapiens
ctcagggaccacagcaagg

SEQ ID NO: 6120556 - DNA, 16 bp, Homo sapiens
ctcagggaccatggct

SEQ ID NO: 6120557 - DNA, 17 bp, Homo sapiens
ctcagggaccggtgctg

SEQ ID NO: 6120558 - DNA, 23 bp, Homo sapiens
ctcagggaccggtgctgcaggag

SEQ ID NO: 6120559 - DNA, 22 bp, Homo sapiens
ctcagggagcagggaaggcctg

SEQ ID NO: 6120560 - DNA, 14 bp, Homo sapiens
ctcagggagcctcc

SEQ ID NO: 6120561 - DNA, 17 bp, Homo sapiens
ctcagggagggaagggg

SEQ ID NO: 6120562 - DNA, 22 bp, Homo sapiens
ctcagggagggaaggggatgga

SEQ ID NO: 6120563 - DNA, 22 bp, Homo sapiens
ctcagggagggagggcggtgga

SEQ ID NO: 6120564 - DNA, 15 bp, Homo sapiens
ctcagggatcacact

SEQ ID NO: 6120565 - DNA, 16 bp, Homo sapiens
ctcagggcaaagccag

SEQ ID NO: 6120566 - DNA, 17 bp, Homo sapiens
ctcagggcaaagccagg

SEQ ID NO: 6120567 - DNA, 20 bp, Homo sapiens
ctcagggcagctgcctggcc

SEQ ID NO: 6120568 - DNA, 22 bp, Homo sapiens
ctcagggcagctgcctggccat

SEQ ID NO: 6120569 - DNA, 22 bp, Homo sapiens
ctcagggcattctgttggccta

SEQ ID NO: 6120570 - DNA, 11 bp, Homo sapiens
ctcagggccag

SEQ ID NO: 6120571 - DNA, 13 bp, Homo sapiens
ctcagggccagga

SEQ ID NO: 6120572 - DNA, 14 bp, Homo sapiens
ctcagggccaggcc

SEQ ID NO: 6120573 - DNA, 16 bp, Homo sapiens
ctcagggccaggcctc

SEQ ID NO: 6120574 - DNA, 13 bp, Homo sapiens
ctcagggccaggt

SEQ ID NO: 6120575 - DNA, 15 bp, Homo sapiens
ctcagggccaggtcc

SEQ ID NO: 6120576 - DNA, 16 bp, Homo sapiens
ctcagggccaggtcct

SEQ ID NO: 6120577 - DNA, 17 bp, Homo sapiens
ctcagggccaggtcctc

SEQ ID NO: 6120578 - DNA, 18 bp, Homo sapiens
ctcagggccaggtcctca

SEQ ID NO: 6120579 - DNA, 15 bp, Homo sapiens
ctcagggccatgctg

SEQ ID NO: 6120580 - DNA, 18 bp, Homo sapiens
ctcagggccatgctgagg

SEQ ID NO: 6120581 - DNA, 15 bp, Homo sapiens
ctcagggcccacctc

SEQ ID NO: 6120582 - DNA, 18 bp, Homo sapiens
ctcagggcccacctcctc

SEQ ID NO: 6120583 - DNA, 20 bp, Homo sapiens
ctcagggcccacctcctcca

SEQ ID NO: 6120584 - DNA, 21 bp, Homo sapiens
ctcagggcccacctcctccag

SEQ ID NO: 6120585 - DNA, 22 bp, Homo sapiens
ctcagggcccacctcctccagc

SEQ ID NO: 6120586 - DNA, 16 bp, Homo sapiens
ctcagggcccagcagg

SEQ ID NO: 6120587 - DNA, 17 bp, Homo sapiens
ctcagggcctggcaggc

SEQ ID NO: 6120588 - DNA, 20 bp, Homo sapiens
ctcagggcctggcaggccag

SEQ ID NO: 6120589 - DNA, 15 bp, Homo sapiens
ctcagggcctggctc

SEQ ID NO: 6120590 - DNA, 19 bp, Homo sapiens
ctcagggcctggctcaggt

SEQ ID NO: 6120591 - DNA, 15 bp, Homo sapiens
ctcagggcctggtcg

SEQ ID NO: 6120592 - DNA, 13 bp, Homo sapiens
ctcagggcgctca

SEQ ID NO: 6120593 - DNA, 22 bp, Homo sapiens
ctcagggctaaacgggcattgc

SEQ ID NO: 6120594 - DNA, 15 bp, Homo sapiens
ctcagggctcccagg

SEQ ID NO: 6120595 - DNA, 17 bp, Homo sapiens
ctcagggctcctcccag

SEQ ID NO: 6120596 - DNA, 14 bp, Homo sapiens
ctcagggctcctgc

SEQ ID NO: 6120597 - DNA, 16 bp, Homo sapiens
ctcagggctcctgcct

SEQ ID NO: 6120598 - DNA, 15 bp, Homo sapiens
ctcagggctcctggg

SEQ ID NO: 6120599 - DNA, 15 bp, Homo sapiens
ctcagggctccttgt

SEQ ID NO: 6120600 - DNA, 22 bp, Homo sapiens
ctcagggctccttgtgggcctg

SEQ ID NO: 6120601 - DNA, 18 bp, Homo sapiens
ctcagggctcgggagcca

SEQ ID NO: 6120602 - DNA, 10 bp, Homo sapiens
ctcagggctg

SEQ ID NO: 6120603 - DNA, 14 bp, Homo sapiens
ctcagggctgccac

SEQ ID NO: 6120604 - DNA, 14 bp, Homo sapiens
ctcagggctggagc

SEQ ID NO: 6120605 - DNA, 20 bp, Homo sapiens
ctcagggctggagcctgggg

SEQ ID NO: 6120606 - DNA, 15 bp, Homo sapiens
ctcagggctggagtg

SEQ ID NO: 6120607 - DNA, 16 bp, Homo sapiens
ctcagggctggagtgc

SEQ ID NO: 6120608 - DNA, 22 bp, Homo sapiens
ctcagggctggagtgcgctctt

SEQ ID NO: 6120609 - DNA, 14 bp, Homo sapiens
ctcagggctggatt

SEQ ID NO: 6120610 - DNA, 21 bp, Homo sapiens
ctcagggctggattggcaggt

SEQ ID NO: 6120611 - DNA, 23 bp, Homo sapiens
ctcagggctggggccaagaggaa

SEQ ID NO: 6120612 - DNA, 16 bp, Homo sapiens
ctcagggctgtcccag

SEQ ID NO: 6120613 - DNA, 21 bp, Homo sapiens
ctcagggctgtcccagccccg

SEQ ID NO: 6120614 - DNA, 13 bp, Homo sapiens
ctcagggctgtct

SEQ ID NO: 6120615 - DNA, 14 bp, Homo sapiens
ctcagggcttcctt

SEQ ID NO: 6120616 - DNA, 19 bp, Homo sapiens
ctcaggggaaaactgttac

SEQ ID NO: 6120617 - DNA, 16 bp, Homo sapiens
ctcaggggaagctgct

SEQ ID NO: 6120618 - DNA, 17 bp, Homo sapiens
ctcaggggaagctgcta

SEQ ID NO: 6120619 - DNA, 17 bp, Homo sapiens
ctcaggggacactggcc

SEQ ID NO: 6120620 - DNA, 19 bp, Homo sapiens
ctcaggggacactggcccc

SEQ ID NO: 6120621 - DNA, 20 bp, Homo sapiens
ctcaggggacactggcccca

SEQ ID NO: 6120622 - DNA, 13 bp, Homo sapiens
ctcaggggacccc

SEQ ID NO: 6120623 - DNA, 14 bp, Homo sapiens
cgcccggcctccta

SEQ ID NO: 6120624 - DNA, 20 bp, Homo sapiens
cgcccggctaatgtttgtat

SEQ ID NO: 6120625 - DNA, 17 bp, Homo sapiens
cgcccgggcccagagga

SEQ ID NO: 6120626 - DNA, 18 bp, Homo sapiens
cgcccgggcccagaggag

SEQ ID NO: 6120627 - DNA, 14 bp, Homo sapiens
cgcccggggagttt

SEQ ID NO: 6120628 - DNA, 21 bp, Homo sapiens
cgcccgtagatcatccccgag

SEQ ID NO: 6120629 - DNA, 22 bp, Homo sapiens
cgcccgtagatcatccccgagg

SEQ ID NO: 6120630 - DNA, 14 bp, Homo sapiens
cgcccgtcctgcct

SEQ ID NO: 6120631 - DNA, 17 bp, Homo sapiens
cgcccgtcctgcctgtg

SEQ ID NO: 6120632 - DNA, 16 bp, Homo sapiens
cgcccgtggggtctgc

SEQ ID NO: 6120633 - DNA, 15 bp, Homo sapiens
cgccctactccactg

SEQ ID NO: 6120634 - DNA, 19 bp, Homo sapiens
cgccctactccactgccct

SEQ ID NO: 6120635 - DNA, 23 bp, Homo sapiens
cgccctaggaggagaacttgaac

SEQ ID NO: 6120636 - DNA, 16 bp, Homo sapiens
cgccctatttctatgt

SEQ ID NO: 6120637 - DNA, 14 bp, Homo sapiens
cgccctcacctctg

SEQ ID NO: 6120638 - DNA, 15 bp, Homo sapiens
cgccctcactattct

SEQ ID NO: 6120639 - DNA, 19 bp, Homo sapiens
cgccctcattacggctcct

SEQ ID NO: 6120640 - DNA, 16 bp, Homo sapiens
cgccctcccctcccct

SEQ ID NO: 6120641 - DNA, 22 bp, Homo sapiens
cgccctcccctcccctgctgca

SEQ ID NO: 6120642 - DNA, 12 bp, Homo sapiens
cgccctcccgga

SEQ ID NO: 6120643 - DNA, 13 bp, Homo sapiens
cgccctcccggag

SEQ ID NO: 6120644 - DNA, 23 bp, Homo sapiens
cgccctccctctcccaggcccga

SEQ ID NO: 6120645 - DNA, 17 bp, Homo sapiens
cgccctccctgctagca

SEQ ID NO: 6120646 - DNA, 19 bp, Homo sapiens
cgccctccgacctctctcg

SEQ ID NO: 6120647 - DNA, 10 bp, Homo sapiens
cgccctcctc

SEQ ID NO: 6120648 - DNA, 16 bp, Homo sapiens
cgccctcctccacttg

SEQ ID NO: 6120649 - DNA, 17 bp, Homo sapiens
cgccctcctccacttgg

SEQ ID NO: 6120650 - DNA, 13 bp, Homo sapiens
cgccctcctccct

SEQ ID NO: 6120651 - DNA, 17 bp, Homo sapiens
cgccctcctcgctgtgc

SEQ ID NO: 6120652 - DNA, 20 bp, Homo sapiens
cgccctcctcgggccgaggc

SEQ ID NO: 6120653 - DNA, 21 bp, Homo sapiens
cgccctcctcgggccgaggcc

SEQ ID NO: 6120654 - DNA, 12 bp, Homo sapiens
cgccctcctctg

SEQ ID NO: 6120655 - DNA, 15 bp, Homo sapiens
cgccctcctctgccc

SEQ ID NO: 6120656 - DNA, 21 bp, Homo sapiens
cgccctcctctgccccctccc

SEQ ID NO: 6120657 - DNA, 11 bp, Homo sapiens
cgccctccttt

SEQ ID NO: 6120658 - DNA, 16 bp, Homo sapiens
cgccctctacctccta

SEQ ID NO: 6120659 - DNA, 20 bp, Homo sapiens
cgccctctctcaccagcctt

SEQ ID NO: 6120660 - DNA, 17 bp, Homo sapiens
cgccctctgaaattaaa

SEQ ID NO: 6120661 - DNA, 11 bp, Homo sapiens
cgccctctgcc

SEQ ID NO: 6120662 - DNA, 15 bp, Homo sapiens
cgccctctgccccca

SEQ ID NO: 6120663 - DNA, 20 bp, Homo sapiens
cgccctctgcgtcccccagc

SEQ ID NO: 6120664 - DNA, 14 bp, Homo sapiens
cgccctctgtcctg

SEQ ID NO: 6120665 - DNA, 12 bp, Homo sapiens
cgccctctgtgc

SEQ ID NO: 6120666 - DNA, 13 bp, Homo sapiens
cgccctcttcccc

SEQ ID NO: 6120667 - DNA, 14 bp, Homo sapiens
cgccctcttcctga

SEQ ID NO: 6120668 - DNA, 18 bp, Homo sapiens
cgccctgagcatcctggt

SEQ ID NO: 6120669 - DNA, 20 bp, Homo sapiens
cgccctgcagggccgggcag

SEQ ID NO: 6120670 - DNA, 22 bp, Homo sapiens
cgccctgcagggccgggcaggg

SEQ ID NO: 6120671 - DNA, 12 bp, Homo sapiens
cgccctgccact

SEQ ID NO: 6120672 - DNA, 12 bp, Homo sapiens
cgccctgcccgc

SEQ ID NO: 6120673 - DNA, 12 bp, Homo sapiens
cgccctgccctt

SEQ ID NO: 6120674 - DNA, 15 bp, Homo sapiens
cgccctgcctcctgg

SEQ ID NO: 6120675 - DNA, 9 bp, Homo sapiens
cgccctgcg

SEQ ID NO: 6120676 - DNA, 21 bp, Homo sapiens
cgccctgctcctccctggctg

SEQ ID NO: 6120677 - DNA, 16 bp, Homo sapiens
cgccctggacagatgg

SEQ ID NO: 6120678 - DNA, 12 bp, Homo sapiens
cgccctggactt

SEQ ID NO: 6120679 - DNA, 16 bp, Homo sapiens
cgccctggcaggcagg

SEQ ID NO: 6120680 - DNA, 17 bp, Homo sapiens
cgccctggcccccacat

SEQ ID NO: 6120681 - DNA, 12 bp, Homo sapiens
cgccctgggctc

SEQ ID NO: 6120682 - DNA, 13 bp, Homo sapiens
cgccctgggctct

SEQ ID NO: 6120683 - DNA, 18 bp, Homo sapiens
cgccctgggctctgggtt

SEQ ID NO: 6120684 - DNA, 13 bp, Homo sapiens
cgccctgggctgg

SEQ ID NO: 6120685 - DNA, 17 bp, Homo sapiens
cgccctgggctggactg

SEQ ID NO: 6120686 - DNA, 21 bp, Homo sapiens
cgccctgggctggactggagg

SEQ ID NO: 6120687 - DNA, 15 bp, Homo sapiens
cgccctggtttgttt

SEQ ID NO: 6120688 - DNA, 16 bp, Homo sapiens
cgccctgtgagggcga

SEQ ID NO: 6120689 - DNA, 15 bp, Homo sapiens
cgccctgtgtccaca

SEQ ID NO: 6120690 - DNA, 21 bp, Homo sapiens
cgccctgtgtccacagtgatt

SEQ ID NO: 6120691 - DNA, 22 bp, Homo sapiens
cgccctgttcacgctcacccag

SEQ ID NO: 6120692 - DNA, 17 bp, Homo sapiens
cgccctgttcccttcct

SEQ ID NO: 6120693 - DNA, 18 bp, Homo sapiens
cgccctgttcccttcctg

SEQ ID NO: 6120694 - DNA, 19 bp, Homo sapiens
cgcccttacttcttgccct

SEQ ID NO: 6120695 - DNA, 19 bp, Homo sapiens
cgcccttcaatgctgcagg

SEQ ID NO: 6120696 - DNA, 18 bp, Homo sapiens
cgcccttccatgtgcctt

SEQ ID NO: 6120697 - DNA, 20 bp, Homo sapiens
cgcccttccatgtgcctttc

SEQ ID NO: 6120698 - DNA, 22 bp, Homo sapiens
cgcccttccatgtgcctttctt

SEQ ID NO: 6120699 - DNA, 11 bp, Homo sapiens
cgcccttctcc

SEQ ID NO: 6120700 - DNA, 16 bp, Homo sapiens
cgcccttgaggggccc

SEQ ID NO: 6120701 - DNA, 15 bp, Homo sapiens
cgcccttgcgcgcaa

SEQ ID NO: 6120702 - DNA, 16 bp, Homo sapiens
cgcccttggagccttc

SEQ ID NO: 6120703 - DNA, 17 bp, Homo sapiens
cgcccttggagccttcc

SEQ ID NO: 6120704 - DNA, 17 bp, Homo sapiens
cgcccttggcttctgtg

SEQ ID NO: 6120705 - DNA, 20 bp, Homo sapiens
cgcccttggcttctgtgatg

SEQ ID NO: 6120706 - DNA, 16 bp, Homo sapiens
cgccctttcctcctca

SEQ ID NO: 6120707 - DNA, 19 bp, Homo sapiens
cgccctttcctcctcaggc

SEQ ID NO: 6120708 - DNA, 16 bp, Homo sapiens
cgccctttccttgcct

SEQ ID NO: 6120709 - DNA, 18 bp, Homo sapiens
cgccgaagggcagccccg

SEQ ID NO: 6120710 - DNA, 14 bp, Homo sapiens
cgccgactccctga

SEQ ID NO: 6120711 - DNA, 23 bp, Homo sapiens
cgccgagttaaagaggagaagga

SEQ ID NO: 6120712 - DNA, 20 bp, Homo sapiens
cgccgatagagggacggcca

SEQ ID NO: 6120713 - DNA, 12 bp, Homo sapiens
cgccgatgccac

SEQ ID NO: 6120714 - DNA, 16 bp, Homo sapiens
cgccgatgccaccggc

SEQ ID NO: 6120715 - DNA, 23 bp, Homo sapiens
cgccgcaaaccacactggactcc

SEQ ID NO: 6120716 - DNA, 18 bp, Homo sapiens
cgccgccaccctgcccct

SEQ ID NO: 6120717 - DNA, 15 bp, Homo sapiens
cgccgccaggactgt

SEQ ID NO: 6120718 - DNA, 14 bp, Homo sapiens
cgccgccgccgctg

SEQ ID NO: 6120719 - DNA, 16 bp, Homo sapiens
cgccgccgccgctgcc

SEQ ID NO: 6120720 - DNA, 15 bp, Homo sapiens
cgccgccgctgccct

SEQ ID NO: 6120721 - DNA, 19 bp, Homo sapiens
cgccgccgtggtgacccct

SEQ ID NO: 6120722 - DNA, 16 bp, Homo sapiens
cgccgcctccctcacc

SEQ ID NO: 6120723 - DNA, 20 bp, Homo sapiens
cgccgcctccctcacccggc

SEQ ID NO: 6120724 - DNA, 21 bp, Homo sapiens
cgccgcctccgggacccccag

SEQ ID NO: 6120725 - DNA, 16 bp, Homo sapiens
cgccgcctcgcccacc

SEQ ID NO: 6120726 - DNA, 20 bp, Homo sapiens
cgccgccttggccttgcagc

SEQ ID NO: 6120727 - DNA, 19 bp, Homo sapiens
cgccgcgcctggcctagac

SEQ ID NO: 6120728 - DNA, 17 bp, Homo sapiens
cgccgcgcgcccctgcc

SEQ ID NO: 6120729 - DNA, 20 bp, Homo sapiens
cgccgcgcgcccctgcccga

SEQ ID NO: 6120730 - DNA, 20 bp, Homo sapiens
cgccgcgggccgtctgcact

SEQ ID NO: 6120731 - DNA, 12 bp, Homo sapiens
cgccgcgggtgt

SEQ ID NO: 6120732 - DNA, 18 bp, Homo sapiens
cgccgctgtgctgttgtc

SEQ ID NO: 6120733 - DNA, 22 bp, Homo sapiens
cgccgcttccagcttcctctga

SEQ ID NO: 6120734 - DNA, 16 bp, Homo sapiens
cgccggaggccagcta

SEQ ID NO: 6120735 - DNA, 16 bp, Homo sapiens
cgccggctgtgcagtc

SEQ ID NO: 6120736 - DNA, 13 bp, Homo sapiens
cgccgggcaccaa

SEQ ID NO: 6120737 - DNA, 13 bp, Homo sapiens
cgccgggcaggcc

SEQ ID NO: 6120738 - DNA, 16 bp, Homo sapiens
cgccgggcaggcctgc

SEQ ID NO: 6120739 - DNA, 16 bp, Homo sapiens
cgccggggacagaggc

SEQ ID NO: 6120740 - DNA, 17 bp, Homo sapiens
cgccggggctggccctg

SEQ ID NO: 6120741 - DNA, 17 bp, Homo sapiens
cgccggggtcctgggag

SEQ ID NO: 6120742 - DNA, 19 bp, Homo sapiens
cgccggggtcctgggaggc

SEQ ID NO: 6120743 - DNA, 23 bp, Homo sapiens
cgccggggtcctgggaggctgca

SEQ ID NO: 6120744 - DNA, 19 bp, Homo sapiens
cgccggttggccggctggc

SEQ ID NO: 6120745 - DNA, 23 bp, Homo sapiens
cgccgtaattctttctgtctccc

SEQ ID NO: 6120746 - DNA, 15 bp, Homo sapiens
cgccgtctccagggg

SEQ ID NO: 6120747 - DNA, 14 bp, Homo sapiens
cgccgtctgcaggg

SEQ ID NO: 6120748 - DNA, 16 bp, Homo sapiens
cgccgtctgcaggggc

SEQ ID NO: 6120749 - DNA, 21 bp, Homo sapiens
cgccgtgagttctcagggctc

SEQ ID NO: 6120750 - DNA, 16 bp, Homo sapiens
cgccgtggggctccgg

SEQ ID NO: 6120751 - DNA, 16 bp, Homo sapiens
cgccgtgtctcagcct

SEQ ID NO: 6120752 - DNA, 17 bp, Homo sapiens
cgccgtgtctgtggccc

SEQ ID NO: 6120753 - DNA, 20 bp, Homo sapiens
cgcctaaggtcacagctagt

SEQ ID NO: 6120754 - DNA, 22 bp, Homo sapiens
cgcctacccttcccgcctccct

SEQ ID NO: 6120755 - DNA, 21 bp, Homo sapiens
cgcctactcttcagggtctaa

SEQ ID NO: 6120756 - DNA, 15 bp, Homo sapiens
cgcctactgtccctc

SEQ ID NO: 6120757 - DNA, 18 bp, Homo sapiens
cgcctagaggtcccctca

SEQ ID NO: 6120758 - DNA, 20 bp, Homo sapiens
cgcctagaggtcccctcacg

SEQ ID NO: 6120759 - DNA, 13 bp, Homo sapiens
cgcctagctgctg

SEQ ID NO: 6120760 - DNA, 13 bp, Homo sapiens
cgcctaggatttc

SEQ ID NO: 6120761 - DNA, 15 bp, Homo sapiens
cgcctaggcctgtga

SEQ ID NO: 6120762 - DNA, 16 bp, Homo sapiens
cgcctataatcccagc

SEQ ID NO: 6120763 - DNA, 17 bp, Homo sapiens
cgcctataatcccagct

SEQ ID NO: 6120764 - DNA, 20 bp, Homo sapiens
cgcctataatcccagctact

SEQ ID NO: 6120765 - DNA, 22 bp, Homo sapiens
cgcctatgccctgcccttcctc

SEQ ID NO: 6120766 - DNA, 19 bp, Homo sapiens
cgcctcaaggaagagccag

SEQ ID NO: 6120767 - DNA, 23 bp, Homo sapiens
cgcctcaaggaagagccagccgt

SEQ ID NO: 6120768 - DNA, 17 bp, Homo sapiens
cgcctcaatgtggttgc

SEQ ID NO: 6120769 - DNA, 22 bp, Homo sapiens
cgcctcaatgtggttgcaaggc

SEQ ID NO: 6120770 - DNA, 11 bp, Homo sapiens
cgcctcaccag

SEQ ID NO: 6120771 - DNA, 16 bp, Homo sapiens
cgcctcaccagaacca

SEQ ID NO: 6120772 - DNA, 14 bp, Homo sapiens
cgcctcaccttcct

SEQ ID NO: 6120773 - DNA, 13 bp, Homo sapiens
cgcctcactgggt

SEQ ID NO: 6120774 - DNA, 14 bp, Homo sapiens
cgcctcactgggtg

SEQ ID NO: 6120775 - DNA, 17 bp, Homo sapiens
cgcctcagccctcagtt

SEQ ID NO: 6120776 - DNA, 16 bp, Homo sapiens
cgcctcagcctctcaa

SEQ ID NO: 6120777 - DNA, 22 bp, Homo sapiens
cgcctcagttacacaggaaccc

SEQ ID NO: 6120778 - DNA, 21 bp, Homo sapiens
cgcctccaacccctcgcccag

SEQ ID NO: 6120779 - DNA, 22 bp, Homo sapiens
cgcctccaacccctcgcccagt

SEQ ID NO: 6120780 - DNA, 16 bp, Homo sapiens
cgcctccactctagtt

SEQ ID NO: 6120781 - DNA, 13 bp, Homo sapiens
cgcctccaggagc

SEQ ID NO: 6120782 - DNA, 12 bp, Homo sapiens
cgcctccatcca

SEQ ID NO: 6120783 - DNA, 16 bp, Homo sapiens
cgcctccatccaaggc

SEQ ID NO: 6120784 - DNA, 13 bp, Homo sapiens
cgcctcccatccc

SEQ ID NO: 6120785 - DNA, 14 bp, Homo sapiens
cgcctcccatcccg

SEQ ID NO: 6120786 - DNA, 21 bp, Homo sapiens
cgcctccccatacttcctggg

SEQ ID NO: 6120787 - DNA, 23 bp, Homo sapiens
cgcctccccatacttcctgggat

SEQ ID NO: 6120788 - DNA, 16 bp, Homo sapiens
cgcctcccccctcact

SEQ ID NO: 6120789 - DNA, 22 bp, Homo sapiens
cgcctccccgaaacaggctact

SEQ ID NO: 6120790 - DNA, 14 bp, Homo sapiens
cgcctcccgccacc

SEQ ID NO: 6120791 - DNA, 20 bp, Homo sapiens
cgcctcccgccgcctcgggc

SEQ ID NO: 6120792 - DNA, 21 bp, Homo sapiens
cgcctcccgggaagcatcctc

SEQ ID NO: 6120793 - DNA, 17 bp, Homo sapiens
cgcctcccggggtgccc

SEQ ID NO: 6120794 - DNA, 22 bp, Homo sapiens
cgcctccctctcagaggcctgc

SEQ ID NO: 6120795 - DNA, 14 bp, Homo sapiens
cgcctccgagggac

SEQ ID NO: 6120796 - DNA, 17 bp, Homo sapiens
cgcctccgggaccccca

SEQ ID NO: 6120797 - DNA, 19 bp, Homo sapiens
cgcctccgggacccccagg

SEQ ID NO: 6120798 - DNA, 11 bp, Homo sapiens
cgcctcctccc

SEQ ID NO: 6120799 - DNA, 13 bp, Homo sapiens
cgcctcctcccac

SEQ ID NO: 6120800 - DNA, 16 bp, Homo sapiens
cgcctcctcccactgg

SEQ ID NO: 6120801 - DNA, 18 bp, Homo sapiens
cgcctcctcccactggga

SEQ ID NO: 6120802 - DNA, 16 bp, Homo sapiens
cgcctcctccctgcct

SEQ ID NO: 6120803 - DNA, 11 bp, Homo sapiens
cgcctcctcct

SEQ ID NO: 6120804 - DNA, 14 bp, Homo sapiens
ctcaggggacccca

SEQ ID NO: 6120805 - DNA, 22 bp, Homo sapiens
ctcaggggaccccactcccctc

SEQ ID NO: 6120806 - DNA, 13 bp, Homo sapiens
ctcaggggagact

SEQ ID NO: 6120807 - DNA, 15 bp, Homo sapiens
ctcaggggagcaagc

SEQ ID NO: 6120808 - DNA, 22 bp, Homo sapiens
ctcaggggatcggctgggaact

SEQ ID NO: 6120809 - DNA, 22 bp, Homo sapiens
ctcaggggatgtttacctggtg

SEQ ID NO: 6120810 - DNA, 11 bp, Homo sapiens
ctcaggggcaa

SEQ ID NO: 6120811 - DNA, 15 bp, Homo sapiens
ctcaggggcacctcc

SEQ ID NO: 6120812 - DNA, 14 bp, Homo sapiens
ctcaggggcagctc

SEQ ID NO: 6120813 - DNA, 18 bp, Homo sapiens
ctcaggggccagaggaac

SEQ ID NO: 6120814 - DNA, 23 bp, Homo sapiens
ctcaggggccagtgagggctggg

SEQ ID NO: 6120815 - DNA, 18 bp, Homo sapiens
ctcaggggccctggagca

SEQ ID NO: 6120816 - DNA, 18 bp, Homo sapiens
ctcaggggcctctctcct

SEQ ID NO: 6120817 - DNA, 21 bp, Homo sapiens
ctcaggggcctctctcctgcc

SEQ ID NO: 6120818 - DNA, 15 bp, Homo sapiens
ctcaggggcctggag

SEQ ID NO: 6120819 - DNA, 16 bp, Homo sapiens
ctcaggggcctggagg

SEQ ID NO: 6120820 - DNA, 16 bp, Homo sapiens
ctcaggggctgtttga

SEQ ID NO: 6120821 - DNA, 14 bp, Homo sapiens
ctcagggggccagc

SEQ ID NO: 6120822 - DNA, 21 bp, Homo sapiens
ctcagggggccagctggggag

SEQ ID NO: 6120823 - DNA, 23 bp, Homo sapiens
ctcagggggccagctggggagat

SEQ ID NO: 6120824 - DNA, 23 bp, Homo sapiens
ctcagggggcgcctgtggttctg

SEQ ID NO: 6120825 - DNA, 18 bp, Homo sapiens
ctcagggggtaggagagc

SEQ ID NO: 6120826 - DNA, 19 bp, Homo sapiens
ctcagggggtcagcagagt

SEQ ID NO: 6120827 - DNA, 15 bp, Homo sapiens
ctcaggggtgctggg

SEQ ID NO: 6120828 - DNA, 18 bp, Homo sapiens
ctcaggggtgctggggca

SEQ ID NO: 6120829 - DNA, 17 bp, Homo sapiens
ctcagggtattgcttgc

SEQ ID NO: 6120830 - DNA, 14 bp, Homo sapiens
ctcagggtcactga

SEQ ID NO: 6120831 - DNA, 21 bp, Homo sapiens
ctcagggtcactgaaccactg

SEQ ID NO: 6120832 - DNA, 19 bp, Homo sapiens
ctcagggtcactgtccttg

SEQ ID NO: 6120833 - DNA, 21 bp, Homo sapiens
ctcagggtcactgtccttgaa

SEQ ID NO: 6120834 - DNA, 16 bp, Homo sapiens
ctcagggtccagaccc

SEQ ID NO: 6120835 - DNA, 17 bp, Homo sapiens
ctcagggtccagaccct

SEQ ID NO: 6120836 - DNA, 17 bp, Homo sapiens
ctcagggtccctcagga

SEQ ID NO: 6120837 - DNA, 15 bp, Homo sapiens
ctcagggtccctggt

SEQ ID NO: 6120838 - DNA, 16 bp, Homo sapiens
ctcagggtccctggtg

SEQ ID NO: 6120839 - DNA, 17 bp, Homo sapiens
ctcagggtccctggtgg

SEQ ID NO: 6120840 - DNA, 24 bp, Homo sapiens
ctcagggtccctggtggcagctca

SEQ ID NO: 6120841 - DNA, 18 bp, Homo sapiens
ctcagggtcctgccctcc

SEQ ID NO: 6120842 - DNA, 19 bp, Homo sapiens
ctcagggtctctgctgccg

SEQ ID NO: 6120843 - DNA, 13 bp, Homo sapiens
ctcagggtggggg

SEQ ID NO: 6120844 - DNA, 14 bp, Homo sapiens
ctcagggtgggggg

SEQ ID NO: 6120845 - DNA, 14 bp, Homo sapiens
ctcagggtgtccca

SEQ ID NO: 6120846 - DNA, 22 bp, Homo sapiens
ctcagggttttggggtcctggg

SEQ ID NO: 6120847 - DNA, 20 bp, Homo sapiens
ctcaggtacagcgggctgtg

SEQ ID NO: 6120848 - DNA, 21 bp, Homo sapiens
ctcaggtacagcgggctgtgc

SEQ ID NO: 6120849 - DNA, 20 bp, Homo sapiens
ctcaggtacttctctctcct

SEQ ID NO: 6120850 - DNA, 15 bp, Homo sapiens
ctcaggtacttgtaa

SEQ ID NO: 6120851 - DNA, 21 bp, Homo sapiens
ctcaggtagggagctaaggaa

SEQ ID NO: 6120852 - DNA, 15 bp, Homo sapiens
ctcaggtagtactgg

SEQ ID NO: 6120853 - DNA, 17 bp, Homo sapiens
ctcaggtagtactggga

SEQ ID NO: 6120854 - DNA, 18 bp, Homo sapiens
ctcaggtagtactgggaa

SEQ ID NO: 6120855 - DNA, 15 bp, Homo sapiens
ctcaggtcactccag

SEQ ID NO: 6120856 - DNA, 15 bp, Homo sapiens
ctcaggtcagctcac

SEQ ID NO: 6120857 - DNA, 13 bp, Homo sapiens
ctcaggtcagctg

SEQ ID NO: 6120858 - DNA, 14 bp, Homo sapiens
ctcaggtcagctgg

SEQ ID NO: 6120859 - DNA, 15 bp, Homo sapiens
ctcaggtcagctggg

SEQ ID NO: 6120860 - DNA, 16 bp, Homo sapiens
ctcaggtcagctggga

SEQ ID NO: 6120861 - DNA, 17 bp, Homo sapiens
ctcaggtcagctgggag

SEQ ID NO: 6120862 - DNA, 19 bp, Homo sapiens
ctcaggtcagctgggagcc

SEQ ID NO: 6120863 - DNA, 23 bp, Homo sapiens
ctcaggtcagctgggagccagtg

SEQ ID NO: 6120864 - DNA, 23 bp, Homo sapiens
ctcaggtcccaggctcctatgca

SEQ ID NO: 6120865 - DNA, 20 bp, Homo sapiens
ctcaggtccctggggctagg

SEQ ID NO: 6120866 - DNA, 13 bp, Homo sapiens
ctcaggtctgagt

SEQ ID NO: 6120867 - DNA, 21 bp, Homo sapiens
ctcaggtctgtaactgcccag

SEQ ID NO: 6120868 - DNA, 22 bp, Homo sapiens
ctcaggtctgtaactgcccagc

SEQ ID NO: 6120869 - DNA, 15 bp, Homo sapiens
ctcaggtctgttttc

SEQ ID NO: 6120870 - DNA, 14 bp, Homo sapiens
ctcaggtgaataac

SEQ ID NO: 6120871 - DNA, 23 bp, Homo sapiens
ctcaggtgacggactcagactcc

SEQ ID NO: 6120872 - DNA, 19 bp, Homo sapiens
ctcaggtgatcaaaataaa

SEQ ID NO: 6120873 - DNA, 13 bp, Homo sapiens
ctcaggtgatcca

SEQ ID NO: 6120874 - DNA, 14 bp, Homo sapiens
ctcaggtgatccac

SEQ ID NO: 6120875 - DNA, 20 bp, Homo sapiens
ctcaggtgatccacccacct

SEQ ID NO: 6120876 - DNA, 21 bp, Homo sapiens
ctcaggtgatccgcccacctc

SEQ ID NO: 6120877 - DNA, 16 bp, Homo sapiens
ctcaggtgatctgccc

SEQ ID NO: 6120878 - DNA, 13 bp, Homo sapiens
ctcaggtgccact

SEQ ID NO: 6120879 - DNA, 14 bp, Homo sapiens
ctcaggtgccactc

SEQ ID NO: 6120880 - DNA, 19 bp, Homo sapiens
ctcaggtgccactccctga

SEQ ID NO: 6120881 - DNA, 20 bp, Homo sapiens
ctcaggtgccactccctgag

SEQ ID NO: 6120882 - DNA, 12 bp, Homo sapiens
ctcaggtgcctc

SEQ ID NO: 6120883 - DNA, 13 bp, Homo sapiens
ctcaggtgcctcc

SEQ ID NO: 6120884 - DNA, 14 bp, Homo sapiens
ctcaggtgcctcca

SEQ ID NO: 6120885 - DNA, 12 bp, Homo sapiens
ctcaggtggcca

SEQ ID NO: 6120886 - DNA, 18 bp, Homo sapiens
ctcaggtggccatgcctc

SEQ ID NO: 6120887 - DNA, 19 bp, Homo sapiens
ctcaggtggccatgcctca

SEQ ID NO: 6120888 - DNA, 20 bp, Homo sapiens
ctcaggtggccatgcctcag

SEQ ID NO: 6120889 - DNA, 14 bp, Homo sapiens
ctcaggtgggccct

SEQ ID NO: 6120890 - DNA, 19 bp, Homo sapiens
ctcaggtggggtcactctg

SEQ ID NO: 6120891 - DNA, 22 bp, Homo sapiens
ctcaggtggggtcactctggca

SEQ ID NO: 6120892 - DNA, 18 bp, Homo sapiens
ctcaggtgtccctgcact

SEQ ID NO: 6120893 - DNA, 20 bp, Homo sapiens
ctcaggttcacagcagcttt

SEQ ID NO: 6120894 - DNA, 16 bp, Homo sapiens
ctcaggttccctgcca

SEQ ID NO: 6120895 - DNA, 20 bp, Homo sapiens
ctcaggttccctgccacact

SEQ ID NO: 6120896 - DNA, 21 bp, Homo sapiens
ctcaggttcctaagacttcag

SEQ ID NO: 6120897 - DNA, 13 bp, Homo sapiens
ctcaggttccttt

SEQ ID NO: 6120898 - DNA, 20 bp, Homo sapiens
ctcaggttctattttcttaa

SEQ ID NO: 6120899 - DNA, 22 bp, Homo sapiens
ctcaggttgctggttgctgtgt

SEQ ID NO: 6120900 - DNA, 21 bp, Homo sapiens
ctcaggttggcggcagacaca

SEQ ID NO: 6120901 - DNA, 22 bp, Homo sapiens
ctcaggttgtctgaagtcactg

SEQ ID NO: 6120902 - DNA, 17 bp, Homo sapiens
ctcagtaaaagtcttct

SEQ ID NO: 6120903 - DNA, 21 bp, Homo sapiens
ctcagtaaacgggaacatgcc

SEQ ID NO: 6120904 - DNA, 18 bp, Homo sapiens
ctcagtaacacagtgcag

SEQ ID NO: 6120905 - DNA, 22 bp, Homo sapiens
ctcagtaacataactgcttctt

SEQ ID NO: 6120906 - DNA, 18 bp, Homo sapiens
ctcagtaacatttctgtt

SEQ ID NO: 6120907 - DNA, 13 bp, Homo sapiens
ctcagtaactttt

SEQ ID NO: 6120908 - DNA, 19 bp, Homo sapiens
ctcagtaagacgacaagga

SEQ ID NO: 6120909 - DNA, 21 bp, Homo sapiens
ctcagtaagacgacaaggaaa

SEQ ID NO: 6120910 - DNA, 18 bp, Homo sapiens
ctcagtaatttagaaatc

SEQ ID NO: 6120911 - DNA, 21 bp, Homo sapiens
ctcagtacacttcctgtgcca

SEQ ID NO: 6120912 - DNA, 22 bp, Homo sapiens
ctcagtacacttcctgtgccat

SEQ ID NO: 6120913 - DNA, 15 bp, Homo sapiens
ctcagtacagggcag

SEQ ID NO: 6120914 - DNA, 15 bp, Homo sapiens
ctcagtacctcccct

SEQ ID NO: 6120915 - DNA, 13 bp, Homo sapiens
ctcagtacctgtg

SEQ ID NO: 6120916 - DNA, 16 bp, Homo sapiens
ctcagtagtccctgca

SEQ ID NO: 6120917 - DNA, 14 bp, Homo sapiens
ctcagtatagcatt

SEQ ID NO: 6120918 - DNA, 15 bp, Homo sapiens
ctcagtatcttaaaa

SEQ ID NO: 6120919 - DNA, 17 bp, Homo sapiens
ctcagtatgaattattc

SEQ ID NO: 6120920 - DNA, 19 bp, Homo sapiens
ctcagtatgtgggggcttc

SEQ ID NO: 6120921 - DNA, 22 bp, Homo sapiens
ctcagtatgtgggggcttcatc

SEQ ID NO: 6120922 - DNA, 22 bp, Homo sapiens
ctcagtattactttctgccgct

SEQ ID NO: 6120923 - DNA, 17 bp, Homo sapiens
ctcagtattgacgacct

SEQ ID NO: 6120924 - DNA, 23 bp, Homo sapiens
ctcagtattgagacactgtcaag

SEQ ID NO: 6120925 - DNA, 12 bp, Homo sapiens
ctcagtatttta

SEQ ID NO: 6120926 - DNA, 16 bp, Homo sapiens
ctcagtcactttttcc

SEQ ID NO: 6120927 - DNA, 23 bp, Homo sapiens
ctcagtcactttttcccctgcaa

SEQ ID NO: 6120928 - DNA, 14 bp, Homo sapiens
ctcagtcagcccag

SEQ ID NO: 6120929 - DNA, 16 bp, Homo sapiens
ctcagtcagcccagtg

SEQ ID NO: 6120930 - DNA, 13 bp, Homo sapiens
ctcagtcagtatt

SEQ ID NO: 6120931 - DNA, 16 bp, Homo sapiens
ctcagtcagtgcacta

SEQ ID NO: 6120932 - DNA, 13 bp, Homo sapiens
ctcagtcataatc

SEQ ID NO: 6120933 - DNA, 16 bp, Homo sapiens
ctcagtcatattctta

SEQ ID NO: 6120934 - DNA, 17 bp, Homo sapiens
ctcagtcatcaaagcag

SEQ ID NO: 6120935 - DNA, 18 bp, Homo sapiens
ctcagtcatgcataaata

SEQ ID NO: 6120936 - DNA, 18 bp, Homo sapiens
ctcagtcattagactcct

SEQ ID NO: 6120937 - DNA, 16 bp, Homo sapiens
ctcagtccacctgagc

SEQ ID NO: 6120938 - DNA, 17 bp, Homo sapiens
ctcagtccacctgagct

SEQ ID NO: 6120939 - DNA, 23 bp, Homo sapiens
ctcagtccactgttgagccccag

SEQ ID NO: 6120940 - DNA, 14 bp, Homo sapiens
ctcagtccagatgc

SEQ ID NO: 6120941 - DNA, 15 bp, Homo sapiens
ctcagtccagatgcc

SEQ ID NO: 6120942 - DNA, 20 bp, Homo sapiens
ctcagtccagatgccttcct

SEQ ID NO: 6120943 - DNA, 18 bp, Homo sapiens
ctcagtccagtcctcaca

SEQ ID NO: 6120944 - DNA, 18 bp, Homo sapiens
ctcagtcccacagcccct

SEQ ID NO: 6120945 - DNA, 19 bp, Homo sapiens
ctcagtccctccctcctgg

SEQ ID NO: 6120946 - DNA, 20 bp, Homo sapiens
ctcagtccctccctcctggc

SEQ ID NO: 6120947 - DNA, 21 bp, Homo sapiens
ctcagtccctccctcctggct

SEQ ID NO: 6120948 - DNA, 15 bp, Homo sapiens
ctcagtccctcttct

SEQ ID NO: 6120949 - DNA, 18 bp, Homo sapiens
ctcagtccctcttctggt

SEQ ID NO: 6120950 - DNA, 14 bp, Homo sapiens
ctcagtcctcccct

SEQ ID NO: 6120951 - DNA, 19 bp, Homo sapiens
ctcagtcctttattgtcca

SEQ ID NO: 6120952 - DNA, 18 bp, Homo sapiens
ctcagtcctttgttataa

SEQ ID NO: 6120953 - DNA, 21 bp, Homo sapiens
ctcagtcctttgttataattt

SEQ ID NO: 6120954 - DNA, 12 bp, Homo sapiens
ctcagtcgccct

SEQ ID NO: 6120955 - DNA, 15 bp, Homo sapiens
ctcagtcggggcagg

SEQ ID NO: 6120956 - DNA, 17 bp, Homo sapiens
ctcagtcggggcaggcc

SEQ ID NO: 6120957 - DNA, 21 bp, Homo sapiens
ctcagtctagtgaagatgttg

SEQ ID NO: 6120958 - DNA, 14 bp, Homo sapiens
ctcagtctcacatt

SEQ ID NO: 6120959 - DNA, 23 bp, Homo sapiens
ctcagtctcccagctaattgaga

SEQ ID NO: 6120960 - DNA, 17 bp, Homo sapiens
ctcagtctccctccctt

SEQ ID NO: 6120961 - DNA, 14 bp, Homo sapiens
ctcagtctccttgg

SEQ ID NO: 6120962 - DNA, 18 bp, Homo sapiens
ctcagtctggcccttcct

SEQ ID NO: 6120963 - DNA, 14 bp, Homo sapiens
ctcagtctgtcacc

SEQ ID NO: 6120964 - DNA, 23 bp, Homo sapiens
ctcagtctgtcacccaggctgga

SEQ ID NO: 6120965 - DNA, 19 bp, Homo sapiens
ctcagtgaaggtggtgggg

SEQ ID NO: 6120966 - DNA, 20 bp, Homo sapiens
ctcagtgaaggtggtggggc

SEQ ID NO: 6120967 - DNA, 22 bp, Homo sapiens
ctcagtgaagtacacctgtgtg

SEQ ID NO: 6120968 - DNA, 16 bp, Homo sapiens
ctcagtgaagttgctg

SEQ ID NO: 6120969 - DNA, 20 bp, Homo sapiens
ctcagtgaagttgctgcttc

SEQ ID NO: 6120970 - DNA, 17 bp, Homo sapiens
ctcagtgagcctcctgt

SEQ ID NO: 6120971 - DNA, 21 bp, Homo sapiens
ctcagtgagcctcctgtgcct

SEQ ID NO: 6120972 - DNA, 22 bp, Homo sapiens
ctcagtgagcctcctgtgcctg

SEQ ID NO: 6120973 - DNA, 23 bp, Homo sapiens
ctcagtgagcctcctgtgcctgg

SEQ ID NO: 6120974 - DNA, 22 bp, Homo sapiens
ctcagtgaggccgcccggcaca

SEQ ID NO: 6120975 - DNA, 21 bp, Homo sapiens
ctcagtgattcgcttttggta

SEQ ID NO: 6120976 - DNA, 14 bp, Homo sapiens
ctcagtgatttcct

SEQ ID NO: 6120977 - DNA, 17 bp, Homo sapiens
ctcagtgcaaaatgtct

SEQ ID NO: 6120978 - DNA, 20 bp, Homo sapiens
ctcagtgcaaaatgtcttgt

SEQ ID NO: 6120979 - DNA, 23 bp, Homo sapiens
ctcagtgcaacctctgcttccca

SEQ ID NO: 6120980 - DNA, 10 bp, Homo sapiens
ctcagtgcag

SEQ ID NO: 6120981 - DNA, 15 bp, Homo sapiens
cgcctcctcctcctg

SEQ ID NO: 6120982 - DNA, 15 bp, Homo sapiens
cgcctcctcctgcat

SEQ ID NO: 6120983 - DNA, 12 bp, Homo sapiens
cgcctcctggcc

SEQ ID NO: 6120984 - DNA, 15 bp, Homo sapiens
cgcctcctggccaga

SEQ ID NO: 6120985 - DNA, 20 bp, Homo sapiens
cgcctcgccccagccaagcc

SEQ ID NO: 6120986 - DNA, 22 bp, Homo sapiens
cgcctcgccccagccaagcctg

SEQ ID NO: 6120987 - DNA, 14 bp, Homo sapiens
cgcctcgcctacca

SEQ ID NO: 6120988 - DNA, 17 bp, Homo sapiens
cgcctcggagtgtggcc

SEQ ID NO: 6120989 - DNA, 13 bp, Homo sapiens
cgcctcggcctcc

SEQ ID NO: 6120990 - DNA, 14 bp, Homo sapiens
cgcctcggcctccc

SEQ ID NO: 6120991 - DNA, 16 bp, Homo sapiens
cgcctcggcctcccaa

SEQ ID NO: 6120992 - DNA, 20 bp, Homo sapiens
cgcctcggcctcccaaagtg

SEQ ID NO: 6120993 - DNA, 23 bp, Homo sapiens
cgcctcgggccgcctcctccaga

SEQ ID NO: 6120994 - DNA, 17 bp, Homo sapiens
cgcctcgtgccagcagc

SEQ ID NO: 6120995 - DNA, 15 bp, Homo sapiens
cgcctctcactctgg

SEQ ID NO: 6120996 - DNA, 21 bp, Homo sapiens
cgcctctcactctggcagcct

SEQ ID NO: 6120997 - DNA, 12 bp, Homo sapiens
cgcctctcccca

SEQ ID NO: 6120998 - DNA, 16 bp, Homo sapiens
cgcctctctcagccca

SEQ ID NO: 6120999 - DNA, 19 bp, Homo sapiens
cgcctctctcagcccaggt

SEQ ID NO: 6121000 - DNA, 16 bp, Homo sapiens
cgcctctgagccagga

SEQ ID NO: 6121001 - DNA, 19 bp, Homo sapiens
cgcctctgcccgcagagcc

SEQ ID NO: 6121002 - DNA, 20 bp, Homo sapiens
cgcctctgcccgcagagccc

SEQ ID NO: 6121003 - DNA, 13 bp, Homo sapiens
cgcctctgctggc

SEQ ID NO: 6121004 - DNA, 13 bp, Homo sapiens
cgcctctgggctc

SEQ ID NO: 6121005 - DNA, 23 bp, Homo sapiens
cgcctctgggctcacaccagccc

SEQ ID NO: 6121006 - DNA, 13 bp, Homo sapiens
cgcctcttcctct

SEQ ID NO: 6121007 - DNA, 15 bp, Homo sapiens
cgcctcttcctctgg

SEQ ID NO: 6121008 - DNA, 15 bp, Homo sapiens
cgcctctttgacatt

SEQ ID NO: 6121009 - DNA, 20 bp, Homo sapiens
cgcctcttttccctctctag

SEQ ID NO: 6121010 - DNA, 17 bp, Homo sapiens
cgcctgaaaagggcgga

SEQ ID NO: 6121011 - DNA, 14 bp, Homo sapiens
cgcctgaaactttg

SEQ ID NO: 6121012 - DNA, 13 bp, Homo sapiens
cgcctgaaagtgt

SEQ ID NO: 6121013 - DNA, 14 bp, Homo sapiens
cgcctgaaggcaca

SEQ ID NO: 6121014 - DNA, 20 bp, Homo sapiens
cgcctgacaaccactggtct

SEQ ID NO: 6121015 - DNA, 21 bp, Homo sapiens
cgcctgacaaccactggtctg

SEQ ID NO: 6121016 - DNA, 20 bp, Homo sapiens
cgcctgacaccgtgggtcat

SEQ ID NO: 6121017 - DNA, 15 bp, Homo sapiens
cgcctgagacagcac

SEQ ID NO: 6121018 - DNA, 19 bp, Homo sapiens
cgcctgagacagcaccact

SEQ ID NO: 6121019 - DNA, 22 bp, Homo sapiens
cgcctgagacagcaccactgct

SEQ ID NO: 6121020 - DNA, 14 bp, Homo sapiens
cgcctgagcccagg

SEQ ID NO: 6121021 - DNA, 15 bp, Homo sapiens
cgcctgagcccaggg

SEQ ID NO: 6121022 - DNA, 17 bp, Homo sapiens
cgcctgagcccagggag

SEQ ID NO: 6121023 - DNA, 16 bp, Homo sapiens
cgcctgagctcactcg

SEQ ID NO: 6121024 - DNA, 13 bp, Homo sapiens
cgcctgagtgagt

SEQ ID NO: 6121025 - DNA, 18 bp, Homo sapiens
cgcctgattggggcctca

SEQ ID NO: 6121026 - DNA, 13 bp, Homo sapiens
cgcctgcacctgc

SEQ ID NO: 6121027 - DNA, 15 bp, Homo sapiens
cgcctgcacctgcgc

SEQ ID NO: 6121028 - DNA, 13 bp, Homo sapiens
cgcctgcaggcag

SEQ ID NO: 6121029 - DNA, 19 bp, Homo sapiens
cgcctgcaggctggagact

SEQ ID NO: 6121030 - DNA, 14 bp, Homo sapiens
cgcctgcagtcttc

SEQ ID NO: 6121031 - DNA, 17 bp, Homo sapiens
cgcctgcatgtaaacac

SEQ ID NO: 6121032 - DNA, 22 bp, Homo sapiens
cgcctgcatgtaaacacgcctg

SEQ ID NO: 6121033 - DNA, 15 bp, Homo sapiens
cgcctgccaccggag

SEQ ID NO: 6121034 - DNA, 19 bp, Homo sapiens
cgcctgccacctctcccag

SEQ ID NO: 6121035 - DNA, 15 bp, Homo sapiens
cgcctgccagtccta

SEQ ID NO: 6121036 - DNA, 19 bp, Homo sapiens
cgcctgccataccgctggg

SEQ ID NO: 6121037 - DNA, 13 bp, Homo sapiens
cgcctgcccacct

SEQ ID NO: 6121038 - DNA, 15 bp, Homo sapiens
cgcctgcccagactg

SEQ ID NO: 6121039 - DNA, 16 bp, Homo sapiens
cgcctgcccagactga

SEQ ID NO: 6121040 - DNA, 13 bp, Homo sapiens
cgcctgcccagcc

SEQ ID NO: 6121041 - DNA, 13 bp, Homo sapiens
cgcctgcccccag

SEQ ID NO: 6121042 - DNA, 19 bp, Homo sapiens
cgcctgcccccagcactcc

SEQ ID NO: 6121043 - DNA, 13 bp, Homo sapiens
cgcctgccctccc

SEQ ID NO: 6121044 - DNA, 17 bp, Homo sapiens
cgcctgccctccccaga

SEQ ID NO: 6121045 - DNA, 15 bp, Homo sapiens
cgcctgccctcctct

SEQ ID NO: 6121046 - DNA, 12 bp, Homo sapiens
cgcctgccctgc

SEQ ID NO: 6121047 - DNA, 15 bp, Homo sapiens
cgcctgccctgccca

SEQ ID NO: 6121048 - DNA, 16 bp, Homo sapiens
cgcctgccctgcccag

SEQ ID NO: 6121049 - DNA, 16 bp, Homo sapiens
cgcctgccctgccttg

SEQ ID NO: 6121050 - DNA, 17 bp, Homo sapiens
cgcctgccctgccttgc

SEQ ID NO: 6121051 - DNA, 18 bp, Homo sapiens
cgcctgccctgccttgcc

SEQ ID NO: 6121052 - DNA, 23 bp, Homo sapiens
cgcctgccgtgcatggctcctgt

SEQ ID NO: 6121053 - DNA, 13 bp, Homo sapiens
cgcctgcctcctg

SEQ ID NO: 6121054 - DNA, 14 bp, Homo sapiens
cgcctgcctcctgg

SEQ ID NO: 6121055 - DNA, 13 bp, Homo sapiens
cgcctgcctctgc

SEQ ID NO: 6121056 - DNA, 14 bp, Homo sapiens
cgcctgcctctgcc

SEQ ID NO: 6121057 - DNA, 15 bp, Homo sapiens
cgcctgcctgcagca

SEQ ID NO: 6121058 - DNA, 14 bp, Homo sapiens
cgcctgcctgccac

SEQ ID NO: 6121059 - DNA, 11 bp, Homo sapiens
cgcctgccttt

SEQ ID NO: 6121060 - DNA, 12 bp, Homo sapiens
cgcctgcgcccc

SEQ ID NO: 6121061 - DNA, 12 bp, Homo sapiens
cgcctgcgcctc

SEQ ID NO: 6121062 - DNA, 13 bp, Homo sapiens
cgcctgcgcctcc

SEQ ID NO: 6121063 - DNA, 15 bp, Homo sapiens
cgcctgcgcctcctc

SEQ ID NO: 6121064 - DNA, 17 bp, Homo sapiens
cgcctgcgcctcctcct

SEQ ID NO: 6121065 - DNA, 15 bp, Homo sapiens
cgcctgcgctcctct

SEQ ID NO: 6121066 - DNA, 18 bp, Homo sapiens
cgcctgcgctcctctgca

SEQ ID NO: 6121067 - DNA, 19 bp, Homo sapiens
cgcctgcgctcctctgcag

SEQ ID NO: 6121068 - DNA, 22 bp, Homo sapiens
cgcctgcgctcctctgcagcct

SEQ ID NO: 6121069 - DNA, 15 bp, Homo sapiens
cgcctgcggactcca

SEQ ID NO: 6121070 - DNA, 22 bp, Homo sapiens
cgcctgcggactccatggccct

SEQ ID NO: 6121071 - DNA, 20 bp, Homo sapiens
cgcctgctacacaggcagga

SEQ ID NO: 6121072 - DNA, 16 bp, Homo sapiens
cgcctgctcccatcct

SEQ ID NO: 6121073 - DNA, 15 bp, Homo sapiens
cgcctgctgcatgcc

SEQ ID NO: 6121074 - DNA, 14 bp, Homo sapiens
cgcctgctgcctgc

SEQ ID NO: 6121075 - DNA, 18 bp, Homo sapiens
cgcctgcttcacacccct

SEQ ID NO: 6121076 - DNA, 11 bp, Homo sapiens
cgcctggagag

SEQ ID NO: 6121077 - DNA, 16 bp, Homo sapiens
cgcctggagagcgagg

SEQ ID NO: 6121078 - DNA, 17 bp, Homo sapiens
cgcctggagagcgagga

SEQ ID NO: 6121079 - DNA, 18 bp, Homo sapiens
cgcctggagagcgaggag

SEQ ID NO: 6121080 - DNA, 14 bp, Homo sapiens
cgcctggagggatg

SEQ ID NO: 6121081 - DNA, 20 bp, Homo sapiens
cgcctggagggatgccccca

SEQ ID NO: 6121082 - DNA, 15 bp, Homo sapiens
cgcctggcacccact

SEQ ID NO: 6121083 - DNA, 20 bp, Homo sapiens
cgcctggcagaactgagctc

SEQ ID NO: 6121084 - DNA, 21 bp, Homo sapiens
cgcctggcagtccgtgggacg

SEQ ID NO: 6121085 - DNA, 13 bp, Homo sapiens
cgcctggccagga

SEQ ID NO: 6121086 - DNA, 16 bp, Homo sapiens
cgcctggccagggcag

SEQ ID NO: 6121087 - DNA, 23 bp, Homo sapiens
cgcctggccagggcagggccacc

SEQ ID NO: 6121088 - DNA, 22 bp, Homo sapiens
cgcctggcccaagccctccaca

SEQ ID NO: 6121089 - DNA, 12 bp, Homo sapiens
cgcctggccctc

SEQ ID NO: 6121090 - DNA, 14 bp, Homo sapiens
cgcctggccctccc

SEQ ID NO: 6121091 - DNA, 16 bp, Homo sapiens
cgcctggcctccaggc

SEQ ID NO: 6121092 - DNA, 17 bp, Homo sapiens
cgcctggcctccaggcc

SEQ ID NO: 6121093 - DNA, 13 bp, Homo sapiens
cgcctggctccag

SEQ ID NO: 6121094 - DNA, 19 bp, Homo sapiens
cgcctggctgcagcctgcg

SEQ ID NO: 6121095 - DNA, 23 bp, Homo sapiens
cgcctggctgctgcttcttgctt

SEQ ID NO: 6121096 - DNA, 16 bp, Homo sapiens
cgcctgggcaccggga

SEQ ID NO: 6121097 - DNA, 16 bp, Homo sapiens
cgcctgggcccaggct

SEQ ID NO: 6121098 - DNA, 17 bp, Homo sapiens
cgcctgggcccaggctc

SEQ ID NO: 6121099 - DNA, 17 bp, Homo sapiens
cgcctgggcgactccat

SEQ ID NO: 6121100 - DNA, 16 bp, Homo sapiens
cgcctgggtcatgggc

SEQ ID NO: 6121101 - DNA, 18 bp, Homo sapiens
cgcctgggtcatgggcct

SEQ ID NO: 6121102 - DNA, 19 bp, Homo sapiens
cgcctgggtcatgggcctg

SEQ ID NO: 6121103 - DNA, 21 bp, Homo sapiens
cgcctgggtcatgggcctgtg

SEQ ID NO: 6121104 - DNA, 20 bp, Homo sapiens
cgcctgggtccaatgctcag

SEQ ID NO: 6121105 - DNA, 18 bp, Homo sapiens
cgcctgggtcctcccagc

SEQ ID NO: 6121106 - DNA, 23 bp, Homo sapiens
cgcctggtgatgcgcagttgctg

SEQ ID NO: 6121107 - DNA, 15 bp, Homo sapiens
cgcctgtaaatgtat

SEQ ID NO: 6121108 - DNA, 18 bp, Homo sapiens
cgcctgtaatcccagcac

SEQ ID NO: 6121109 - DNA, 17 bp, Homo sapiens
cgcctgtaatcccagct

SEQ ID NO: 6121110 - DNA, 20 bp, Homo sapiens
cgcctgtaatcccagctact

SEQ ID NO: 6121111 - DNA, 18 bp, Homo sapiens
cgcctgtagtcccagcca

SEQ ID NO: 6121112 - DNA, 14 bp, Homo sapiens
cgcctgtcccctca

SEQ ID NO: 6121113 - DNA, 15 bp, Homo sapiens
cgcctgtcccctcac

SEQ ID NO: 6121114 - DNA, 18 bp, Homo sapiens
cgcctgtcccctcacaga

SEQ ID NO: 6121115 - DNA, 22 bp, Homo sapiens
cgcctgtcccctcacagactct

SEQ ID NO: 6121116 - DNA, 14 bp, Homo sapiens
cgcctgtgcacaca

SEQ ID NO: 6121117 - DNA, 17 bp, Homo sapiens
cgcctgtgcccttgctg

SEQ ID NO: 6121118 - DNA, 18 bp, Homo sapiens
cgcctgtgctgaggactc

SEQ ID NO: 6121119 - DNA, 16 bp, Homo sapiens
cgcctgtgtccatctg

SEQ ID NO: 6121120 - DNA, 22 bp, Homo sapiens
cgccttagcactaccactcctg

SEQ ID NO: 6121121 - DNA, 23 bp, Homo sapiens
cgccttaggtacttattccagat

SEQ ID NO: 6121122 - DNA, 22 bp, Homo sapiens
cgccttcactccggtgtgcctg

SEQ ID NO: 6121123 - DNA, 15 bp, Homo sapiens
cgccttcaggcacca

SEQ ID NO: 6121124 - DNA, 15 bp, Homo sapiens
cgccttcaggttcct

SEQ ID NO: 6121125 - DNA, 20 bp, Homo sapiens
cgccttccaaaacctgcttc

SEQ ID NO: 6121126 - DNA, 22 bp, Homo sapiens
cgccttccctcactcttcctca

SEQ ID NO: 6121127 - DNA, 15 bp, Homo sapiens
cgccttccctcctgc

SEQ ID NO: 6121128 - DNA, 19 bp, Homo sapiens
cgccttccctcctgctttg

SEQ ID NO: 6121129 - DNA, 13 bp, Homo sapiens
cgccttcctcctc

SEQ ID NO: 6121130 - DNA, 16 bp, Homo sapiens
cgccttcctcctccac

SEQ ID NO: 6121131 - DNA, 17 bp, Homo sapiens
cgccttcctctctggat

SEQ ID NO: 6121132 - DNA, 16 bp, Homo sapiens
cgccttcgtgtgctgc

SEQ ID NO: 6121133 - DNA, 17 bp, Homo sapiens
cgccttcgtgtgctgct

SEQ ID NO: 6121134 - DNA, 21 bp, Homo sapiens
cgccttcgtgtgctgctgctg

SEQ ID NO: 6121135 - DNA, 17 bp, Homo sapiens
cgccttctacctgcagg

SEQ ID NO: 6121136 - DNA, 13 bp, Homo sapiens
cgccttctccagg

SEQ ID NO: 6121137 - DNA, 14 bp, Homo sapiens
cgccttctccaggc

SEQ ID NO: 6121138 - DNA, 15 bp, Homo sapiens
cgccttctcccctct

SEQ ID NO: 6121139 - DNA, 19 bp, Homo sapiens
cgccttctcccctctccca

SEQ ID NO: 6121140 - DNA, 21 bp, Homo sapiens
cgccttctcccctctcccagg

SEQ ID NO: 6121141 - DNA, 18 bp, Homo sapiens
cgccttctcggagctggc

SEQ ID NO: 6121142 - DNA, 23 bp, Homo sapiens
cgccttctcggagctggcccagg

SEQ ID NO: 6121143 - DNA, 15 bp, Homo sapiens
cgccttgcccagcct

SEQ ID NO: 6121144 - DNA, 11 bp, Homo sapiens
cgccttggcct

SEQ ID NO: 6121145 - DNA, 16 bp, Homo sapiens
cgccttggcctgtgtt

SEQ ID NO: 6121146 - DNA, 15 bp, Homo sapiens
cgccttggctttctc

SEQ ID NO: 6121147 - DNA, 12 bp, Homo sapiens
cgccttgttctt

SEQ ID NO: 6121148 - DNA, 17 bp, Homo sapiens
cgcctttccgcggagcc

SEQ ID NO: 6121149 - DNA, 18 bp, Homo sapiens
cgcctttgcgctctcggg

SEQ ID NO: 6121150 - DNA, 22 bp, Homo sapiens
cgcctttgctgaagtctccccg

SEQ ID NO: 6121151 - DNA, 17 bp, Homo sapiens
cgcctttgtcttgtact

SEQ ID NO: 6121152 - DNA, 19 bp, Homo sapiens
cgcctttgtcttgtacttc

SEQ ID NO: 6121153 - DNA, 14 bp, Homo sapiens
cgccttttcagccc

SEQ ID NO: 6121154 - DNA, 14 bp, Homo sapiens
cgccttttgtatac

SEQ ID NO: 6121155 - DNA, 15 bp, Homo sapiens
cgcctttttggcctg

SEQ ID NO: 6121156 - DNA, 22 bp, Homo sapiens
cgcgaaagtatcaccagggtgc

SEQ ID NO: 6121157 - DNA, 18 bp, Homo sapiens
cgcgaagtgggcattgca

SEQ ID NO: 6121158 - DNA, 15 bp, Homo sapiens
cgcgacaatgcaaac

SEQ ID NO: 6121159 - DNA, 16 bp, Homo sapiens
cgcgacaatgcaaacc

SEQ ID NO: 6121160 - DNA, 17 bp, Homo sapiens
cgcgacaatgcaaacca

SEQ ID NO: 6121161 - DNA, 12 bp, Homo sapiens
cgcgaccacccc

SEQ ID NO: 6121162 - DNA, 14 bp, Homo sapiens
cgcgaccttggccg

SEQ ID NO: 6121163 - DNA, 12 bp, Homo sapiens
ctcagtgcagat

SEQ ID NO: 6121164 - DNA, 17 bp, Homo sapiens
ctcagtgcagccccctc

SEQ ID NO: 6121165 - DNA, 19 bp, Homo sapiens
ctcagtgcagggacagcct

SEQ ID NO: 6121166 - DNA, 20 bp, Homo sapiens
ctcagtgcagggacagcctg

SEQ ID NO: 6121167 - DNA, 24 bp, Homo sapiens
ctcagtgcagggacagcctgcaca

SEQ ID NO: 6121168 - DNA, 20 bp, Homo sapiens
ctcagtgccacctatgcctg

SEQ ID NO: 6121169 - DNA, 21 bp, Homo sapiens
ctcagtgccggaggccttggg

SEQ ID NO: 6121170 - DNA, 15 bp, Homo sapiens
ctcagtgcctccaca

SEQ ID NO: 6121171 - DNA, 14 bp, Homo sapiens
ctcagtgcctcctg

SEQ ID NO: 6121172 - DNA, 15 bp, Homo sapiens
ctcagtgcctcctgg

SEQ ID NO: 6121173 - DNA, 15 bp, Homo sapiens
ctcagtgccttcctc

SEQ ID NO: 6121174 - DNA, 15 bp, Homo sapiens
ctcagtgccttctct

SEQ ID NO: 6121175 - DNA, 18 bp, Homo sapiens
ctcagtgccttctctcag

SEQ ID NO: 6121176 - DNA, 17 bp, Homo sapiens
ctcagtgctcctggaaa

SEQ ID NO: 6121177 - DNA, 19 bp, Homo sapiens
ctcagtgctcggcagtcat

SEQ ID NO: 6121178 - DNA, 20 bp, Homo sapiens
ctcagtgctcggcagtcata

SEQ ID NO: 6121179 - DNA, 16 bp, Homo sapiens
ctcagtgctctctcca

SEQ ID NO: 6121180 - DNA, 18 bp, Homo sapiens
ctcagtgcttgggctcca

SEQ ID NO: 6121181 - DNA, 17 bp, Homo sapiens
ctcagtggacagtgctg

SEQ ID NO: 6121182 - DNA, 19 bp, Homo sapiens
ctcagtggactttccaccc

SEQ ID NO: 6121183 - DNA, 15 bp, Homo sapiens
ctcagtggctctggg

SEQ ID NO: 6121184 - DNA, 14 bp, Homo sapiens
ctcagtggcttctc

SEQ ID NO: 6121185 - DNA, 16 bp, Homo sapiens
ctcagtggcttctcca

SEQ ID NO: 6121186 - DNA, 22 bp, Homo sapiens
ctcagtgggacaaaccagagca

SEQ ID NO: 6121187 - DNA, 20 bp, Homo sapiens
ctcagtgggctccctggccc

SEQ ID NO: 6121188 - DNA, 18 bp, Homo sapiens
ctcagtgggctgtttctg

SEQ ID NO: 6121189 - DNA, 20 bp, Homo sapiens
ctcagtgggctgtttctgct

SEQ ID NO: 6121190 - DNA, 16 bp, Homo sapiens
ctcagtggggcagagg

SEQ ID NO: 6121191 - DNA, 15 bp, Homo sapiens
ctcagtggggctggc

SEQ ID NO: 6121192 - DNA, 18 bp, Homo sapiens
ctcagtggggctggcatc

SEQ ID NO: 6121193 - DNA, 21 bp, Homo sapiens
ctcagtggtagctctggctta

SEQ ID NO: 6121194 - DNA, 22 bp, Homo sapiens
ctcagtggtcaccttcctcagc

SEQ ID NO: 6121195 - DNA, 18 bp, Homo sapiens
ctcagtgtattttaaatt

SEQ ID NO: 6121196 - DNA, 17 bp, Homo sapiens
ctcagtgtcagcgggtg

SEQ ID NO: 6121197 - DNA, 20 bp, Homo sapiens
ctcagtgtcagcgggtgacg

SEQ ID NO: 6121198 - DNA, 18 bp, Homo sapiens
ctcagtgtcatttatgaa

SEQ ID NO: 6121199 - DNA, 20 bp, Homo sapiens
ctcagtgtctggctgcagag

SEQ ID NO: 6121200 - DNA, 13 bp, Homo sapiens
ctcagtgtgtaat

SEQ ID NO: 6121201 - DNA, 20 bp, Homo sapiens
ctcagtgttagagaaatcct

SEQ ID NO: 6121202 - DNA, 19 bp, Homo sapiens
ctcagtgttggtatatttt

SEQ ID NO: 6121203 - DNA, 22 bp, Homo sapiens
ctcagtgttggtatattttata

SEQ ID NO: 6121204 - DNA, 18 bp, Homo sapiens
ctcagtgttttagctgtt

SEQ ID NO: 6121205 - DNA, 12 bp, Homo sapiens
ctcagtgttttg

SEQ ID NO: 6121206 - DNA, 22 bp, Homo sapiens
ctcagtgttttggactccatct

SEQ ID NO: 6121207 - DNA, 23 bp, Homo sapiens
ctcagtgttttggactccatctc

SEQ ID NO: 6121208 - DNA, 13 bp, Homo sapiens
ctcagttaaaatg

SEQ ID NO: 6121209 - DNA, 14 bp, Homo sapiens
ctcagttaaaatgt

SEQ ID NO: 6121210 - DNA, 22 bp, Homo sapiens
ctcagttaaatctcctgtggag

SEQ ID NO: 6121211 - DNA, 18 bp, Homo sapiens
ctcagttaagtgtttcct

SEQ ID NO: 6121212 - DNA, 23 bp, Homo sapiens
ctcagttacacaaaggacctcag

SEQ ID NO: 6121213 - DNA, 13 bp, Homo sapiens
ctcagttacacag

SEQ ID NO: 6121214 - DNA, 21 bp, Homo sapiens
ctcagttcaacctggtggcac

SEQ ID NO: 6121215 - DNA, 22 bp, Homo sapiens
ctcagttcaacctggtggcacc

SEQ ID NO: 6121216 - DNA, 15 bp, Homo sapiens
ctcagttcagaatca

SEQ ID NO: 6121217 - DNA, 12 bp, Homo sapiens
ctcagttccagg

SEQ ID NO: 6121218 - DNA, 18 bp, Homo sapiens
ctcagttcccagctcccc

SEQ ID NO: 6121219 - DNA, 21 bp, Homo sapiens
ctcagttcccttggcctcaga

SEQ ID NO: 6121220 - DNA, 22 bp, Homo sapiens
ctcagttccgatttcccaggct

SEQ ID NO: 6121221 - DNA, 14 bp, Homo sapiens
ctcagttcctcacc

SEQ ID NO: 6121222 - DNA, 21 bp, Homo sapiens
ctcagttcgaccaaactcagt

SEQ ID NO: 6121223 - DNA, 22 bp, Homo sapiens
ctcagttcgaccaaactcagtt

SEQ ID NO: 6121224 - DNA, 21 bp, Homo sapiens
ctcagttctagtctctctggg

SEQ ID NO: 6121225 - DNA, 15 bp, Homo sapiens
ctcagttctcaaatg

SEQ ID NO: 6121226 - DNA, 17 bp, Homo sapiens
ctcagttctcaaatgtg

SEQ ID NO: 6121227 - DNA, 18 bp, Homo sapiens
ctcagttctcaaatgtgt

SEQ ID NO: 6121228 - DNA, 22 bp, Homo sapiens
ctcagttctctcccttcctctc

SEQ ID NO: 6121229 - DNA, 23 bp, Homo sapiens
ctcagttctctcccttcctctct

SEQ ID NO: 6121230 - DNA, 18 bp, Homo sapiens
ctcagttctcttgctttc

SEQ ID NO: 6121231 - DNA, 14 bp, Homo sapiens
ctcagttctgcctt

SEQ ID NO: 6121232 - DNA, 17 bp, Homo sapiens
ctcagttcttgccactt

SEQ ID NO: 6121233 - DNA, 16 bp, Homo sapiens
ctcagttcttggcctg

SEQ ID NO: 6121234 - DNA, 21 bp, Homo sapiens
ctcagttgaaaatgcaactct

SEQ ID NO: 6121235 - DNA, 15 bp, Homo sapiens
ctcagttgagaaaca

SEQ ID NO: 6121236 - DNA, 18 bp, Homo sapiens
ctcagttgagaaacagtt

SEQ ID NO: 6121237 - DNA, 20 bp, Homo sapiens
ctcagttgagaaacagttcc

SEQ ID NO: 6121238 - DNA, 16 bp, Homo sapiens
ctcagttgcagaaaat

SEQ ID NO: 6121239 - DNA, 17 bp, Homo sapiens
ctcagttgcagaaaatg

SEQ ID NO: 6121240 - DNA, 20 bp, Homo sapiens
ctcagttgcagaaaatgaac

SEQ ID NO: 6121241 - DNA, 18 bp, Homo sapiens
ctcagttgctaaacactg

SEQ ID NO: 6121242 - DNA, 14 bp, Homo sapiens
ctcagttggaatca

SEQ ID NO: 6121243 - DNA, 20 bp, Homo sapiens
ctcagttggcctctgcccct

SEQ ID NO: 6121244 - DNA, 13 bp, Homo sapiens
ctcagttgtactt

SEQ ID NO: 6121245 - DNA, 14 bp, Homo sapiens
ctcagttgtacttt

SEQ ID NO: 6121246 - DNA, 11 bp, Homo sapiens
ctcagttgtag

SEQ ID NO: 6121247 - DNA, 20 bp, Homo sapiens
ctcagttgtgactaactaga

SEQ ID NO: 6121248 - DNA, 12 bp, Homo sapiens
ctcagttgtgca

SEQ ID NO: 6121249 - DNA, 19 bp, Homo sapiens
ctcagttgtttgcttcttg

SEQ ID NO: 6121250 - DNA, 18 bp, Homo sapiens
ctcagtttaatccttcta

SEQ ID NO: 6121251 - DNA, 21 bp, Homo sapiens
ctcagtttaatccttctagtt

SEQ ID NO: 6121252 - DNA, 11 bp, Homo sapiens
ctcagtttccc

SEQ ID NO: 6121253 - DNA, 13 bp, Homo sapiens
ctcagtttcccca

SEQ ID NO: 6121254 - DNA, 16 bp, Homo sapiens
ctcagtttccccattg

SEQ ID NO: 6121255 - DNA, 16 bp, Homo sapiens
ctcagtttccctatct

SEQ ID NO: 6121256 - DNA, 23 bp, Homo sapiens
ctcagtttccctctgtatacaag

SEQ ID NO: 6121257 - DNA, 14 bp, Homo sapiens
ctcagtttcctcat

SEQ ID NO: 6121258 - DNA, 11 bp, Homo sapiens
ctcagtttctc

SEQ ID NO: 6121259 - DNA, 13 bp, Homo sapiens
ctcagtttctgcc

SEQ ID NO: 6121260 - DNA, 19 bp, Homo sapiens
ctcagtttctgcctgggca

SEQ ID NO: 6121261 - DNA, 18 bp, Homo sapiens
ctcagttttatcattttc

SEQ ID NO: 6121262 - DNA, 16 bp, Homo sapiens
ctcagttttatgcccc

SEQ ID NO: 6121263 - DNA, 18 bp, Homo sapiens
ctcagttttatgccccat

SEQ ID NO: 6121264 - DNA, 18 bp, Homo sapiens
ctcagttttccttctgtt

SEQ ID NO: 6121265 - DNA, 17 bp, Homo sapiens
ctcagtttttcggtggg

SEQ ID NO: 6121266 - DNA, 12 bp, Homo sapiens
ctcagtttttct

SEQ ID NO: 6121267 - DNA, 15 bp, Homo sapiens
ctcataaaaataaaa

SEQ ID NO: 6121268 - DNA, 16 bp, Homo sapiens
ctcataaagatgttaa

SEQ ID NO: 6121269 - DNA, 17 bp, Homo sapiens
ctcataaagatgttaaa

SEQ ID NO: 6121270 - DNA, 19 bp, Homo sapiens
ctcataaagatgttaaatg

SEQ ID NO: 6121271 - DNA, 16 bp, Homo sapiens
ctcataaattaatgat

SEQ ID NO: 6121272 - DNA, 21 bp, Homo sapiens
ctcataacggatcagaaatac

SEQ ID NO: 6121273 - DNA, 15 bp, Homo sapiens
ctcataactcattgt

SEQ ID NO: 6121274 - DNA, 14 bp, Homo sapiens
ctcataacttgaga

SEQ ID NO: 6121275 - DNA, 15 bp, Homo sapiens
ctcataagcatatgt

SEQ ID NO: 6121276 - DNA, 18 bp, Homo sapiens
ctcataatagacttccca

SEQ ID NO: 6121277 - DNA, 22 bp, Homo sapiens
ctcataatggaaaaaaagactg

SEQ ID NO: 6121278 - DNA, 15 bp, Homo sapiens
ctcataatttataca

SEQ ID NO: 6121279 - DNA, 15 bp, Homo sapiens
ctcataattttgcaa

SEQ ID NO: 6121280 - DNA, 18 bp, Homo sapiens
ctcatacacagttaaata

SEQ ID NO: 6121281 - DNA, 21 bp, Homo sapiens
ctcatacagtctctatttgat

SEQ ID NO: 6121282 - DNA, 13 bp, Homo sapiens
ctcataccatctg

SEQ ID NO: 6121283 - DNA, 19 bp, Homo sapiens
ctcatacccacccccaccc

SEQ ID NO: 6121284 - DNA, 24 bp, Homo sapiens
ctcatacccatgcacagtacaata

SEQ ID NO: 6121285 - DNA, 16 bp, Homo sapiens
ctcataccctccctcc

SEQ ID NO: 6121286 - DNA, 17 bp, Homo sapiens
ctcataccctccctccc

SEQ ID NO: 6121287 - DNA, 22 bp, Homo sapiens
ctcatactacaggatatttact

SEQ ID NO: 6121288 - DNA, 21 bp, Homo sapiens
ctcatactacattgagtagac

SEQ ID NO: 6121289 - DNA, 15 bp, Homo sapiens
ctcatactgtcatat

SEQ ID NO: 6121290 - DNA, 17 bp, Homo sapiens
ctcatactgtctgggat

SEQ ID NO: 6121291 - DNA, 22 bp, Homo sapiens
ctcatagaacattgatctgttt

SEQ ID NO: 6121292 - DNA, 17 bp, Homo sapiens
ctcatagaggtgagaaa

SEQ ID NO: 6121293 - DNA, 21 bp, Homo sapiens
ctcatagatgacccccaggta

SEQ ID NO: 6121294 - DNA, 16 bp, Homo sapiens
ctcatagattgcaaat

SEQ ID NO: 6121295 - DNA, 18 bp, Homo sapiens
ctcatagcaatacttgga

SEQ ID NO: 6121296 - DNA, 13 bp, Homo sapiens
ctcatagcacatg

SEQ ID NO: 6121297 - DNA, 18 bp, Homo sapiens
ctcatagcatagccagca

SEQ ID NO: 6121298 - DNA, 12 bp, Homo sapiens
ctcatagcatta

SEQ ID NO: 6121299 - DNA, 20 bp, Homo sapiens
ctcatagccccggtgtgcgg

SEQ ID NO: 6121300 - DNA, 13 bp, Homo sapiens
ctcatagccctca

SEQ ID NO: 6121301 - DNA, 21 bp, Homo sapiens
ctcatagccctcaccctgggg

SEQ ID NO: 6121302 - DNA, 12 bp, Homo sapiens
ctcataggacct

SEQ ID NO: 6121303 - DNA, 13 bp, Homo sapiens
ctcatagggtgct

SEQ ID NO: 6121304 - DNA, 16 bp, Homo sapiens
ctcataggttgagcaa

SEQ ID NO: 6121305 - DNA, 21 bp, Homo sapiens
ctcatagtaataagatggctg

SEQ ID NO: 6121306 - DNA, 20 bp, Homo sapiens
ctcatagtatggtggctggg

SEQ ID NO: 6121307 - DNA, 21 bp, Homo sapiens
ctcatagtatggtggctgggt

SEQ ID NO: 6121308 - DNA, 23 bp, Homo sapiens
ctcatagtatggtggctgggttg

SEQ ID NO: 6121309 - DNA, 16 bp, Homo sapiens
ctcatagtgaacacag

SEQ ID NO: 6121310 - DNA, 22 bp, Homo sapiens
ctcatagtgaacacagcagacc

SEQ ID NO: 6121311 - DNA, 21 bp, Homo sapiens
ctcatatccagtattgttcct

SEQ ID NO: 6121312 - DNA, 16 bp, Homo sapiens
ctcatatccataaaat

SEQ ID NO: 6121313 - DNA, 14 bp, Homo sapiens
ctcatatcttcctc

SEQ ID NO: 6121314 - DNA, 17 bp, Homo sapiens
ctcatatgtagccctca

SEQ ID NO: 6121315 - DNA, 20 bp, Homo sapiens
ctcatatgtagccctcatga

SEQ ID NO: 6121316 - DNA, 19 bp, Homo sapiens
ctcatattgtgattctgcc

SEQ ID NO: 6121317 - DNA, 21 bp, Homo sapiens
ctcatattgtgattctgcctt

SEQ ID NO: 6121318 - DNA, 15 bp, Homo sapiens
ctcatatttttacaa

SEQ ID NO: 6121319 - DNA, 19 bp, Homo sapiens
ctcatatttttacaaataa

SEQ ID NO: 6121320 - DNA, 18 bp, Homo sapiens
ctcatcaacttaaaagtc

SEQ ID NO: 6121321 - DNA, 17 bp, Homo sapiens
ctcatcaatcaaataag

SEQ ID NO: 6121322 - DNA, 13 bp, Homo sapiens
ctcatcacacaca

SEQ ID NO: 6121323 - DNA, 17 bp, Homo sapiens
ctcatcacacacatgga

SEQ ID NO: 6121324 - DNA, 18 bp, Homo sapiens
ctcatcacatttgtaaat

SEQ ID NO: 6121325 - DNA, 20 bp, Homo sapiens
ctcatcaccatcgtgtttgc

SEQ ID NO: 6121326 - DNA, 13 bp, Homo sapiens
ctcatcacccagt

SEQ ID NO: 6121327 - DNA, 19 bp, Homo sapiens
ctcatcacccagtcctggc

SEQ ID NO: 6121328 - DNA, 20 bp, Homo sapiens
ctcatcaccccagaggcctt

SEQ ID NO: 6121329 - DNA, 15 bp, Homo sapiens
ctcatcactcccctc

SEQ ID NO: 6121330 - DNA, 12 bp, Homo sapiens
ctcatcactgga

SEQ ID NO: 6121331 - DNA, 19 bp, Homo sapiens
ctcatcactggactgcatg

SEQ ID NO: 6121332 - DNA, 15 bp, Homo sapiens
ctcatcactggatga

SEQ ID NO: 6121333 - DNA, 12 bp, Homo sapiens
ctcatcactgtg

SEQ ID NO: 6121334 - DNA, 15 bp, Homo sapiens
ctcatcactgtgcct

SEQ ID NO: 6121335 - DNA, 16 bp, Homo sapiens
ctcatcactgtggctg

SEQ ID NO: 6121336 - DNA, 13 bp, Homo sapiens
ctcatcagagcag

SEQ ID NO: 6121337 - DNA, 22 bp, Homo sapiens
ctcatcagagcagctagctctt

SEQ ID NO: 6121338 - DNA, 22 bp, Homo sapiens
ctcatcagcccaggtcccagtg

SEQ ID NO: 6121339 - DNA, 16 bp, Homo sapiens
ctcatcagccttggga

SEQ ID NO: 6121340 - DNA, 21 bp, Homo sapiens
ctcatcaggagttccagtgct

SEQ ID NO: 6121341 - DNA, 15 bp, Homo sapiens
cgcgacttctcagga

SEQ ID NO: 6121342 - DNA, 18 bp, Homo sapiens
cgcgagactgagaggcag

SEQ ID NO: 6121343 - DNA, 19 bp, Homo sapiens
cgcgagggctgaaaacccc

SEQ ID NO: 6121344 - DNA, 18 bp, Homo sapiens
cgcgaggggaaaggcctg

SEQ ID NO: 6121345 - DNA, 17 bp, Homo sapiens
cgcgagggtcacgcttg

SEQ ID NO: 6121346 - DNA, 16 bp, Homo sapiens
cgcgatacagacccac

SEQ ID NO: 6121347 - DNA, 18 bp, Homo sapiens
cgcgatgtggaactgctg

SEQ ID NO: 6121348 - DNA, 21 bp, Homo sapiens
cgcgatgtggaactgctgcca

SEQ ID NO: 6121349 - DNA, 18 bp, Homo sapiens
cgcgcacacacacacata

SEQ ID NO: 6121350 - DNA, 14 bp, Homo sapiens
cgcgcaccccacgc

SEQ ID NO: 6121351 - DNA, 15 bp, Homo sapiens
cgcgcaccccacgcc

SEQ ID NO: 6121352 - DNA, 19 bp, Homo sapiens
cgcgcagatgtgcagcaga

SEQ ID NO: 6121353 - DNA, 16 bp, Homo sapiens
cgcgcagctgcctagg

SEQ ID NO: 6121354 - DNA, 12 bp, Homo sapiens
cgcgcatctctt

SEQ ID NO: 6121355 - DNA, 19 bp, Homo sapiens
cgcgccaaataatgtctct

SEQ ID NO: 6121356 - DNA, 21 bp, Homo sapiens
cgcgccaaataatgtctctgt

SEQ ID NO: 6121357 - DNA, 14 bp, Homo sapiens
cgcgccacaggacc

SEQ ID NO: 6121358 - DNA, 23 bp, Homo sapiens
cgcgccactacactccagcctga

SEQ ID NO: 6121359 - DNA, 18 bp, Homo sapiens
cgcgccactcgcttcccc

SEQ ID NO: 6121360 - DNA, 16 bp, Homo sapiens
cgcgccagcgacctct

SEQ ID NO: 6121361 - DNA, 21 bp, Homo sapiens
cgcgccagcgacctctctgcc

SEQ ID NO: 6121362 - DNA, 22 bp, Homo sapiens
cgcgccagcgacctctctgcct

SEQ ID NO: 6121363 - DNA, 16 bp, Homo sapiens
cgcgccagtccccgct

SEQ ID NO: 6121364 - DNA, 13 bp, Homo sapiens
cgcgcccccagga

SEQ ID NO: 6121365 - DNA, 14 bp, Homo sapiens
cgcgcccccaggac

SEQ ID NO: 6121366 - DNA, 16 bp, Homo sapiens
cgcgcccccaggaccc

SEQ ID NO: 6121367 - DNA, 22 bp, Homo sapiens
cgcgcccccaggacccccccag

SEQ ID NO: 6121368 - DNA, 19 bp, Homo sapiens
cgcgcccccctcccagagg

SEQ ID NO: 6121369 - DNA, 21 bp, Homo sapiens
cgcgcccccctcccagaggcg

SEQ ID NO: 6121370 - DNA, 20 bp, Homo sapiens
cgcgccccgaaaggtcacct

SEQ ID NO: 6121371 - DNA, 13 bp, Homo sapiens
cgcgcccctagcc

SEQ ID NO: 6121372 - DNA, 14 bp, Homo sapiens
cgcgcccctctgcg

SEQ ID NO: 6121373 - DNA, 16 bp, Homo sapiens
cgcgcccgcccctgca

SEQ ID NO: 6121374 - DNA, 22 bp, Homo sapiens
cgcgccctccaccccggccccc

SEQ ID NO: 6121375 - DNA, 18 bp, Homo sapiens
cgcgccctcccccatggg

SEQ ID NO: 6121376 - DNA, 13 bp, Homo sapiens
cgcgccctccctc

SEQ ID NO: 6121377 - DNA, 20 bp, Homo sapiens
cgcgcctttccgcggagccc

SEQ ID NO: 6121378 - DNA, 22 bp, Homo sapiens
cgcgcgaagtgggcattgcaaa

SEQ ID NO: 6121379 - DNA, 14 bp, Homo sapiens
cgcgcgcacacaca

SEQ ID NO: 6121380 - DNA, 14 bp, Homo sapiens
cgcgcgccaccacg

SEQ ID NO: 6121381 - DNA, 21 bp, Homo sapiens
cgcgcgccggtccggcgcccc

SEQ ID NO: 6121382 - DNA, 16 bp, Homo sapiens
cgcgcgcgcgcacaca

SEQ ID NO: 6121383 - DNA, 14 bp, Homo sapiens
cgcgcgtctcccat

SEQ ID NO: 6121384 - DNA, 13 bp, Homo sapiens
cgcgcgtgccccc

SEQ ID NO: 6121385 - DNA, 15 bp, Homo sapiens
cgcgcgtgcccccag

SEQ ID NO: 6121386 - DNA, 17 bp, Homo sapiens
cgcgctcgcccagcagg

SEQ ID NO: 6121387 - DNA, 13 bp, Homo sapiens
cgcgctctgcccc

SEQ ID NO: 6121388 - DNA, 16 bp, Homo sapiens
cgcgctctgcccctcc

SEQ ID NO: 6121389 - DNA, 12 bp, Homo sapiens
cgcgctctttct

SEQ ID NO: 6121390 - DNA, 21 bp, Homo sapiens
cgcgctggaatccagaaggaa

SEQ ID NO: 6121391 - DNA, 13 bp, Homo sapiens
cgcgctggacagc

SEQ ID NO: 6121392 - DNA, 23 bp, Homo sapiens
cgcgctgttgattgtgttttcct

SEQ ID NO: 6121393 - DNA, 14 bp, Homo sapiens
cgcgcttgctggcc

SEQ ID NO: 6121394 - DNA, 22 bp, Homo sapiens
cgcggacccttctgggtccagg

SEQ ID NO: 6121395 - DNA, 15 bp, Homo sapiens
cgcggacgtgctggc

SEQ ID NO: 6121396 - DNA, 18 bp, Homo sapiens
cgcggagcccccgcccct

SEQ ID NO: 6121397 - DNA, 17 bp, Homo sapiens
cgcggatcaaccaggca

SEQ ID NO: 6121398 - DNA, 20 bp, Homo sapiens
cgcggatcaaccaggcagag

SEQ ID NO: 6121399 - DNA, 21 bp, Homo sapiens
cgcggatgctactactgcagt

SEQ ID NO: 6121400 - DNA, 12 bp, Homo sapiens
cgcggccagccc

SEQ ID NO: 6121401 - DNA, 13 bp, Homo sapiens
cgcggccaggcac

SEQ ID NO: 6121402 - DNA, 14 bp, Homo sapiens
cgcggccaggcacc

SEQ ID NO: 6121403 - DNA, 21 bp, Homo sapiens
cgcggccaggcacccatgtgg

SEQ ID NO: 6121404 - DNA, 11 bp, Homo sapiens
cgcggcccaga

SEQ ID NO: 6121405 - DNA, 11 bp, Homo sapiens
cgcggcctccc

SEQ ID NO: 6121406 - DNA, 22 bp, Homo sapiens
cgcggcctcccgaggaggggcc

SEQ ID NO: 6121407 - DNA, 13 bp, Homo sapiens
cgcggcctggacc

SEQ ID NO: 6121408 - DNA, 22 bp, Homo sapiens
cgcggcggagctggccccgccg

SEQ ID NO: 6121409 - DNA, 15 bp, Homo sapiens
cgcggcgggccctgc

SEQ ID NO: 6121410 - DNA, 20 bp, Homo sapiens
cgcggctccggtcctgggcg

SEQ ID NO: 6121411 - DNA, 15 bp, Homo sapiens
cgcggctggatgggg

SEQ ID NO: 6121412 - DNA, 14 bp, Homo sapiens
cgcggctggctctg

SEQ ID NO: 6121413 - DNA, 11 bp, Homo sapiens
cgcggctggga

SEQ ID NO: 6121414 - DNA, 15 bp, Homo sapiens
cgcggcttggccgcc

SEQ ID NO: 6121415 - DNA, 17 bp, Homo sapiens
cgcggcttggccgccat

SEQ ID NO: 6121416 - DNA, 11 bp, Homo sapiens
cgcgggagaga

SEQ ID NO: 6121417 - DNA, 13 bp, Homo sapiens
cgcgggagagagt

SEQ ID NO: 6121418 - DNA, 21 bp, Homo sapiens
cgcgggagagagtgagagaga

SEQ ID NO: 6121419 - DNA, 16 bp, Homo sapiens
cgcgggaggcaccagc

SEQ ID NO: 6121420 - DNA, 15 bp, Homo sapiens
cgcgggcagccaccc

SEQ ID NO: 6121421 - DNA, 14 bp, Homo sapiens
cgcgggcagcgggc

SEQ ID NO: 6121422 - DNA, 15 bp, Homo sapiens
cgcgggcagcgggcc

SEQ ID NO: 6121423 - DNA, 18 bp, Homo sapiens
cgcgggccaggaggctgc

SEQ ID NO: 6121424 - DNA, 22 bp, Homo sapiens
cgcgggcgagaagggcgcagga

SEQ ID NO: 6121425 - DNA, 17 bp, Homo sapiens
cgcgggcggccaggcaa

SEQ ID NO: 6121426 - DNA, 17 bp, Homo sapiens
cgcgggctttgttgctg

SEQ ID NO: 6121427 - DNA, 19 bp, Homo sapiens
cgcggggaccctgccgagg

SEQ ID NO: 6121428 - DNA, 14 bp, Homo sapiens
cgcgggtcccggcc

SEQ ID NO: 6121429 - DNA, 18 bp, Homo sapiens
cgcgggtggctggagccc

SEQ ID NO: 6121430 - DNA, 14 bp, Homo sapiens
cgcgggttctagac

SEQ ID NO: 6121431 - DNA, 16 bp, Homo sapiens
cgcggtcttgggcact

SEQ ID NO: 6121432 - DNA, 18 bp, Homo sapiens
cgcggtgctctggcggct

SEQ ID NO: 6121433 - DNA, 23 bp, Homo sapiens
cgcggtgtgtcctctgtgcccac

SEQ ID NO: 6121434 - DNA, 14 bp, Homo sapiens
cgcggttcaggtca

SEQ ID NO: 6121435 - DNA, 13 bp, Homo sapiens
cgcgtccctgccc

SEQ ID NO: 6121436 - DNA, 18 bp, Homo sapiens
cgcgtcctttcctctcct

SEQ ID NO: 6121437 - DNA, 14 bp, Homo sapiens
cgcgtctcccatcc

SEQ ID NO: 6121438 - DNA, 12 bp, Homo sapiens
cgcgtctcctgt

SEQ ID NO: 6121439 - DNA, 14 bp, Homo sapiens
cgcgtctgccccac

SEQ ID NO: 6121440 - DNA, 17 bp, Homo sapiens
cgcgtctgccccaccct

SEQ ID NO: 6121441 - DNA, 14 bp, Homo sapiens
cgcgtctgcctggg

SEQ ID NO: 6121442 - DNA, 16 bp, Homo sapiens
cgcgtcttcctgagtg

SEQ ID NO: 6121443 - DNA, 14 bp, Homo sapiens
cgcgtgacggacat

SEQ ID NO: 6121444 - DNA, 18 bp, Homo sapiens
cgcgtgataaaactgggt

SEQ ID NO: 6121445 - DNA, 19 bp, Homo sapiens
cgcgtgcacacaccagagc

SEQ ID NO: 6121446 - DNA, 12 bp, Homo sapiens
cgcgtgccccca

SEQ ID NO: 6121447 - DNA, 15 bp, Homo sapiens
cgcgtgcccccagcg

SEQ ID NO: 6121448 - DNA, 13 bp, Homo sapiens
cgcgtgccttccc

SEQ ID NO: 6121449 - DNA, 23 bp, Homo sapiens
cgcgtgtgtgggtggatataaat

SEQ ID NO: 6121450 - DNA, 13 bp, Homo sapiens
cgcgtgttctgaa

SEQ ID NO: 6121451 - DNA, 13 bp, Homo sapiens
cgcgttgaaattg

SEQ ID NO: 6121452 - DNA, 21 bp, Homo sapiens
cgcgttgaaattgtaattata

SEQ ID NO: 6121453 - DNA, 16 bp, Homo sapiens
cgcgttgtaaaatata

SEQ ID NO: 6121454 - DNA, 12 bp, Homo sapiens
cgcgttgtgtat

SEQ ID NO: 6121455 - DNA, 19 bp, Homo sapiens
cgctaaacttttctgatag

SEQ ID NO: 6121456 - DNA, 15 bp, Homo sapiens
cgctaaagagccctt

SEQ ID NO: 6121457 - DNA, 19 bp, Homo sapiens
cgctaaagagcccttgcct

SEQ ID NO: 6121458 - DNA, 17 bp, Homo sapiens
cgctaaagttatatttg

SEQ ID NO: 6121459 - DNA, 14 bp, Homo sapiens
cgctaaatatttac

SEQ ID NO: 6121460 - DNA, 19 bp, Homo sapiens
cgctaaatgacttgcagat

SEQ ID NO: 6121461 - DNA, 16 bp, Homo sapiens
cgctaacactgtcctg

SEQ ID NO: 6121462 - DNA, 15 bp, Homo sapiens
cgctaacccccagcc

SEQ ID NO: 6121463 - DNA, 18 bp, Homo sapiens
cgctaacttgcttaaatg

SEQ ID NO: 6121464 - DNA, 21 bp, Homo sapiens
cgctaacttgcttaaatgtga

SEQ ID NO: 6121465 - DNA, 15 bp, Homo sapiens
cgctaagacctcccc

SEQ ID NO: 6121466 - DNA, 21 bp, Homo sapiens
cgctaagagggagggagggct

SEQ ID NO: 6121467 - DNA, 20 bp, Homo sapiens
cgctaagctggctctgtttg

SEQ ID NO: 6121468 - DNA, 24 bp, Homo sapiens
cgctaaggcttccggctgagctgt

SEQ ID NO: 6121469 - DNA, 19 bp, Homo sapiens
cgctaagtaaaaatattaa

SEQ ID NO: 6121470 - DNA, 22 bp, Homo sapiens
cgctaattcatacctccctcct

SEQ ID NO: 6121471 - DNA, 20 bp, Homo sapiens
cgctacaaaacgcgcagatg

SEQ ID NO: 6121472 - DNA, 23 bp, Homo sapiens
cgctacaaaacgcgcagatgtgc

SEQ ID NO: 6121473 - DNA, 21 bp, Homo sapiens
cgctacaagagggcaaagctg

SEQ ID NO: 6121474 - DNA, 22 bp, Homo sapiens
cgctacaagagggcaaagctga

SEQ ID NO: 6121475 - DNA, 17 bp, Homo sapiens
cgctacaattctgcaga

SEQ ID NO: 6121476 - DNA, 17 bp, Homo sapiens
cgctacaccactctggc

SEQ ID NO: 6121477 - DNA, 18 bp, Homo sapiens
cgctacagtttttattta

SEQ ID NO: 6121478 - DNA, 11 bp, Homo sapiens
cgctacccact

SEQ ID NO: 6121479 - DNA, 12 bp, Homo sapiens
cgctacctccct

SEQ ID NO: 6121480 - DNA, 15 bp, Homo sapiens
cgctacctctctgtc

SEQ ID NO: 6121481 - DNA, 20 bp, Homo sapiens
cgctagaaaaaaaaaacact

SEQ ID NO: 6121482 - DNA, 17 bp, Homo sapiens
cgctagagcagcccaaa

SEQ ID NO: 6121483 - DNA, 14 bp, Homo sapiens
cgctagaggcctga

SEQ ID NO: 6121484 - DNA, 17 bp, Homo sapiens
cgctagaggcctgagga

SEQ ID NO: 6121485 - DNA, 15 bp, Homo sapiens
cgctagcacagctcc

SEQ ID NO: 6121486 - DNA, 13 bp, Homo sapiens
cgctagcagccct

SEQ ID NO: 6121487 - DNA, 14 bp, Homo sapiens
cgctagcagtggca

SEQ ID NO: 6121488 - DNA, 20 bp, Homo sapiens
cgctagcagtggcaggcaga

SEQ ID NO: 6121489 - DNA, 22 bp, Homo sapiens
cgctaggctcgccttccctcct

SEQ ID NO: 6121490 - DNA, 22 bp, Homo sapiens
cgctagggctccgaggagctgg

SEQ ID NO: 6121491 - DNA, 20 bp, Homo sapiens
cgctagtcaataaacctggg

SEQ ID NO: 6121492 - DNA, 17 bp, Homo sapiens
cgctatccagttgcagg

SEQ ID NO: 6121493 - DNA, 14 bp, Homo sapiens
cgctattcccaggc

SEQ ID NO: 6121494 - DNA, 18 bp, Homo sapiens
cgctattcccaggcaggg

SEQ ID NO: 6121495 - DNA, 17 bp, Homo sapiens
cgctattgtcaccaggg

SEQ ID NO: 6121496 - DNA, 15 bp, Homo sapiens
cgctcaacctctcag

SEQ ID NO: 6121497 - DNA, 20 bp, Homo sapiens
cgctcaacctctcagatccc

SEQ ID NO: 6121498 - DNA, 15 bp, Homo sapiens
cgctcaccgctggcc

SEQ ID NO: 6121499 - DNA, 17 bp, Homo sapiens
cgctcaccgctggccct

SEQ ID NO: 6121500 - DNA, 13 bp, Homo sapiens
cgctcacctcaga

SEQ ID NO: 6121501 - DNA, 13 bp, Homo sapiens
cgctcacctgcag

SEQ ID NO: 6121502 - DNA, 16 bp, Homo sapiens
cgctcacctgcagccc

SEQ ID NO: 6121503 - DNA, 17 bp, Homo sapiens
cgctcacgctgacagcc

SEQ ID NO: 6121504 - DNA, 23 bp, Homo sapiens
cgctcagaagagggaactaagca

SEQ ID NO: 6121505 - DNA, 13 bp, Homo sapiens
cgctcagacccca

SEQ ID NO: 6121506 - DNA, 20 bp, Homo sapiens
cgctcagaggccgctctggg

SEQ ID NO: 6121507 - DNA, 18 bp, Homo sapiens
cgctcagcatgcatcctt

SEQ ID NO: 6121508 - DNA, 14 bp, Homo sapiens
cgctcagccccagg

SEQ ID NO: 6121509 - DNA, 23 bp, Homo sapiens
cgctcagccccaggccagctgcg

SEQ ID NO: 6121510 - DNA, 12 bp, Homo sapiens
cgctcagccctc

SEQ ID NO: 6121511 - DNA, 15 bp, Homo sapiens
cgctcaggacccagg

SEQ ID NO: 6121512 - DNA, 13 bp, Homo sapiens
cgctcaggccagt

SEQ ID NO: 6121513 - DNA, 15 bp, Homo sapiens
cgctcaggccagtaa

SEQ ID NO: 6121514 - DNA, 20 bp, Homo sapiens
cgctcaggccagtaatccca

SEQ ID NO: 6121515 - DNA, 22 bp, Homo sapiens
cgctcaggcctaggaggccccc

SEQ ID NO: 6121516 - DNA, 21 bp, Homo sapiens
cgctcagggccatgctgaggc

SEQ ID NO: 6121517 - DNA, 15 bp, Homo sapiens
cgctcaggggcctgg

SEQ ID NO: 6121518 - DNA, 22 bp, Homo sapiens
cgctcaggggctccatgctggg

SEQ ID NO: 6121519 - DNA, 21 bp, Homo sapiens
cgctcaggtgatcaaaataaa

SEQ ID NO: 6121520 - DNA, 15 bp, Homo sapiens
cgctcagtaaacggg

SEQ ID NO: 6121521 - DNA, 11 bp, Homo sapiens
cgctcagtgtc

SEQ ID NO: 6121522 - DNA, 16 bp, Homo sapiens
ctcatcaggatgaacc

SEQ ID NO: 6121523 - DNA, 13 bp, Homo sapiens
ctcatcagtagat

SEQ ID NO: 6121524 - DNA, 12 bp, Homo sapiens
ctcatcagtagt

SEQ ID NO: 6121525 - DNA, 24 bp, Homo sapiens
ctcatcagtgtcctcttgctcaaa

SEQ ID NO: 6121526 - DNA, 16 bp, Homo sapiens
ctcatcataaaataaa

SEQ ID NO: 6121527 - DNA, 15 bp, Homo sapiens
ctcatcatattgtat

SEQ ID NO: 6121528 - DNA, 14 bp, Homo sapiens
ctcatcatattttg

SEQ ID NO: 6121529 - DNA, 23 bp, Homo sapiens
ctcatcatccacccgctgcccct

SEQ ID NO: 6121530 - DNA, 13 bp, Homo sapiens
ctcatcattctct

SEQ ID NO: 6121531 - DNA, 14 bp, Homo sapiens
ctcatcattctctg

SEQ ID NO: 6121532 - DNA, 15 bp, Homo sapiens
ctcatcattctctgt

SEQ ID NO: 6121533 - DNA, 23 bp, Homo sapiens
ctcatcattctctgtctcatcca

SEQ ID NO: 6121534 - DNA, 23 bp, Homo sapiens
ctcatcatttgcattgggcatta

SEQ ID NO: 6121535 - DNA, 19 bp, Homo sapiens
ctcatccaaaagtgaccag

SEQ ID NO: 6121536 - DNA, 21 bp, Homo sapiens
ctcatccaaaagtgaccagca

SEQ ID NO: 6121537 - DNA, 20 bp, Homo sapiens
ctcatccaaacaatttaaaa

SEQ ID NO: 6121538 - DNA, 23 bp, Homo sapiens
ctcatccaactccgaaagtctga

SEQ ID NO: 6121539 - DNA, 15 bp, Homo sapiens
ctcatccacacttaa

SEQ ID NO: 6121540 - DNA, 17 bp, Homo sapiens
ctcatccagaactgtct

SEQ ID NO: 6121541 - DNA, 20 bp, Homo sapiens
ctcatccagaactgtcttag

SEQ ID NO: 6121542 - DNA, 22 bp, Homo sapiens
ctcatccagaactgtcttagtc

SEQ ID NO: 6121543 - DNA, 21 bp, Homo sapiens
ctcatccagaccccatgcctg

SEQ ID NO: 6121544 - DNA, 16 bp, Homo sapiens
ctcatccagcctcaga

SEQ ID NO: 6121545 - DNA, 23 bp, Homo sapiens
ctcatccaggtcctttccttctc

SEQ ID NO: 6121546 - DNA, 16 bp, Homo sapiens
ctcatccatcatcatg

SEQ ID NO: 6121547 - DNA, 15 bp, Homo sapiens
ctcatccattcctct

SEQ ID NO: 6121548 - DNA, 19 bp, Homo sapiens
ctcatcccacgcactccat

SEQ ID NO: 6121549 - DNA, 23 bp, Homo sapiens
ctcatcccacttcctttcctact

SEQ ID NO: 6121550 - DNA, 20 bp, Homo sapiens
ctcatcccagtcctgatggc

SEQ ID NO: 6121551 - DNA, 22 bp, Homo sapiens
ctcatcccatgagaccctggtg

SEQ ID NO: 6121552 - DNA, 15 bp, Homo sapiens
ctcatccccaaactg

SEQ ID NO: 6121553 - DNA, 23 bp, Homo sapiens
ctcatccccaggggtcccagcca

SEQ ID NO: 6121554 - DNA, 17 bp, Homo sapiens
ctcatcccccatcagat

SEQ ID NO: 6121555 - DNA, 16 bp, Homo sapiens
ctcatccccccacccg

SEQ ID NO: 6121556 - DNA, 16 bp, Homo sapiens
ctcatcccccctgctg

SEQ ID NO: 6121557 - DNA, 20 bp, Homo sapiens
ctcatcccccctgctgccca

SEQ ID NO: 6121558 - DNA, 15 bp, Homo sapiens
ctcatccccctgtgg

SEQ ID NO: 6121559 - DNA, 22 bp, Homo sapiens
ctcatcccctcgtcctgtccca

SEQ ID NO: 6121560 - DNA, 16 bp, Homo sapiens
ctcatcccgacctctt

SEQ ID NO: 6121561 - DNA, 22 bp, Homo sapiens
ctcatcccgagcacctccacat

SEQ ID NO: 6121562 - DNA, 18 bp, Homo sapiens
ctcatccctaatgctgca

SEQ ID NO: 6121563 - DNA, 18 bp, Homo sapiens
ctcatccctcaactgagg

SEQ ID NO: 6121564 - DNA, 23 bp, Homo sapiens
ctcatccctcaactgagggccag

SEQ ID NO: 6121565 - DNA, 13 bp, Homo sapiens
ctcatccctctca

SEQ ID NO: 6121566 - DNA, 13 bp, Homo sapiens
ctcatccctggac

SEQ ID NO: 6121567 - DNA, 15 bp, Homo sapiens
ctcatcccttgttta

SEQ ID NO: 6121568 - DNA, 22 bp, Homo sapiens
ctcatcctcagatgctcaaagt

SEQ ID NO: 6121569 - DNA, 22 bp, Homo sapiens
ctcatcctccagtaccttgctt

SEQ ID NO: 6121570 - DNA, 16 bp, Homo sapiens
ctcatcctccccagga

SEQ ID NO: 6121571 - DNA, 12 bp, Homo sapiens
ctcatcctcctc

SEQ ID NO: 6121572 - DNA, 22 bp, Homo sapiens
ctcatcctcctggacccagcag

SEQ ID NO: 6121573 - DNA, 18 bp, Homo sapiens
ctcatcctgaacagcatg

SEQ ID NO: 6121574 - DNA, 18 bp, Homo sapiens
ctcatcctgatttttact

SEQ ID NO: 6121575 - DNA, 13 bp, Homo sapiens
ctcatcctgcagg

SEQ ID NO: 6121576 - DNA, 23 bp, Homo sapiens
ctcatcctgctcttttgtgatga

SEQ ID NO: 6121577 - DNA, 18 bp, Homo sapiens
ctcatcctggcacgccct

SEQ ID NO: 6121578 - DNA, 21 bp, Homo sapiens
ctcatcctggcacgccctact

SEQ ID NO: 6121579 - DNA, 21 bp, Homo sapiens
ctcatccttctaaagtgctgg

SEQ ID NO: 6121580 - DNA, 13 bp, Homo sapiens
ctcatcctttccc

SEQ ID NO: 6121581 - DNA, 16 bp, Homo sapiens
ctcatcctttccctct

SEQ ID NO: 6121582 - DNA, 17 bp, Homo sapiens
ctcatcctttccctctc

SEQ ID NO: 6121583 - DNA, 22 bp, Homo sapiens
ctcatcctttccctctcccagt

SEQ ID NO: 6121584 - DNA, 15 bp, Homo sapiens
ctcatccttttctcc

SEQ ID NO: 6121585 - DNA, 23 bp, Homo sapiens
ctcatcgcagggctcatgatttt

SEQ ID NO: 6121586 - DNA, 17 bp, Homo sapiens
ctcatcggaggcccatg

SEQ ID NO: 6121587 - DNA, 18 bp, Homo sapiens
ctcatcggaggcccatgc

SEQ ID NO: 6121588 - DNA, 18 bp, Homo sapiens
ctcatcgggcccagggac

SEQ ID NO: 6121589 - DNA, 19 bp, Homo sapiens
ctcatctactcattgtctc

SEQ ID NO: 6121590 - DNA, 19 bp, Homo sapiens
ctcatctagtcttgacctc

SEQ ID NO: 6121591 - DNA, 22 bp, Homo sapiens
ctcatctagtcttgacctctcc

SEQ ID NO: 6121592 - DNA, 22 bp, Homo sapiens
ctcatctagtttgatgactaaa

SEQ ID NO: 6121593 - DNA, 12 bp, Homo sapiens
ctcatctatgct

SEQ ID NO: 6121594 - DNA, 13 bp, Homo sapiens
ctcatctatggtt

SEQ ID NO: 6121595 - DNA, 19 bp, Homo sapiens
ctcatctatggttctaaat

SEQ ID NO: 6121596 - DNA, 21 bp, Homo sapiens
ctcatctatggttctaaatat

SEQ ID NO: 6121597 - DNA, 14 bp, Homo sapiens
ctcatctatgtcat

SEQ ID NO: 6121598 - DNA, 12 bp, Homo sapiens
ctcatctcacct

SEQ ID NO: 6121599 - DNA, 14 bp, Homo sapiens
ctcatctcagaccc

SEQ ID NO: 6121600 - DNA, 12 bp, Homo sapiens
ctcatctcaggt

SEQ ID NO: 6121601 - DNA, 11 bp, Homo sapiens
ctcatctcagt

SEQ ID NO: 6121602 - DNA, 22 bp, Homo sapiens
ctcatctccaaggatcctctcc

SEQ ID NO: 6121603 - DNA, 23 bp, Homo sapiens
ctcatctccaaggatcctctcca

SEQ ID NO: 6121604 - DNA, 14 bp, Homo sapiens
ctcatctccatgct

SEQ ID NO: 6121605 - DNA, 15 bp, Homo sapiens
ctcatctccatgctc

SEQ ID NO: 6121606 - DNA, 14 bp, Homo sapiens
ctcatctcctgacc

SEQ ID NO: 6121607 - DNA, 16 bp, Homo sapiens
ctcatctcctgaccct

SEQ ID NO: 6121608 - DNA, 22 bp, Homo sapiens
ctcatctccttcctgaggagcc

SEQ ID NO: 6121609 - DNA, 15 bp, Homo sapiens
ctcatctcctttgct

SEQ ID NO: 6121610 - DNA, 16 bp, Homo sapiens
ctcatctcctttgcta

SEQ ID NO: 6121611 - DNA, 23 bp, Homo sapiens
ctcatctctaacagctcaggatc

SEQ ID NO: 6121612 - DNA, 17 bp, Homo sapiens
ctcatctctctgcccaa

SEQ ID NO: 6121613 - DNA, 17 bp, Homo sapiens
ctcatctctcttgggcc

SEQ ID NO: 6121614 - DNA, 22 bp, Homo sapiens
ctcatctctcttgggccaagcc

SEQ ID NO: 6121615 - DNA, 12 bp, Homo sapiens
ctcatctctgaa

SEQ ID NO: 6121616 - DNA, 15 bp, Homo sapiens
ctcatctctgaaaat

SEQ ID NO: 6121617 - DNA, 22 bp, Homo sapiens
ctcatctctggaaggggcagcc

SEQ ID NO: 6121618 - DNA, 19 bp, Homo sapiens
ctcatctcttagctcccct

SEQ ID NO: 6121619 - DNA, 20 bp, Homo sapiens
ctcatctcttagctcccctc

SEQ ID NO: 6121620 - DNA, 22 bp, Homo sapiens
ctcatctcttagctcccctcca

SEQ ID NO: 6121621 - DNA, 17 bp, Homo sapiens
ctcatctgaaaggccca

SEQ ID NO: 6121622 - DNA, 19 bp, Homo sapiens
ctcatctgaaatgttacaa

SEQ ID NO: 6121623 - DNA, 20 bp, Homo sapiens
ctcatctgagccagcaccgc

SEQ ID NO: 6121624 - DNA, 15 bp, Homo sapiens
ctcatctgcaccctt

SEQ ID NO: 6121625 - DNA, 19 bp, Homo sapiens
ctcatctgcacccttcttt

SEQ ID NO: 6121626 - DNA, 16 bp, Homo sapiens
ctcatctgcaggacag

SEQ ID NO: 6121627 - DNA, 18 bp, Homo sapiens
ctcatctgcaggacagag

SEQ ID NO: 6121628 - DNA, 21 bp, Homo sapiens
ctcatctgccggcccccagga

SEQ ID NO: 6121629 - DNA, 18 bp, Homo sapiens
ctcatctgcctggaaagt

SEQ ID NO: 6121630 - DNA, 13 bp, Homo sapiens
ctcatctgctggt

SEQ ID NO: 6121631 - DNA, 20 bp, Homo sapiens
ctcatctgctggtccgtggg

SEQ ID NO: 6121632 - DNA, 21 bp, Homo sapiens
ctcatctgtaaaaccaggctg

SEQ ID NO: 6121633 - DNA, 12 bp, Homo sapiens
ctcatctgtgcc

SEQ ID NO: 6121634 - DNA, 14 bp, Homo sapiens
ctcatctgtgcctg

SEQ ID NO: 6121635 - DNA, 17 bp, Homo sapiens
ctcatctgtggagctgc

SEQ ID NO: 6121636 - DNA, 23 bp, Homo sapiens
ctcatctgtggagctgccacaga

SEQ ID NO: 6121637 - DNA, 13 bp, Homo sapiens
ctcatcttactgt

SEQ ID NO: 6121638 - DNA, 12 bp, Homo sapiens
ctcatcttcccc

SEQ ID NO: 6121639 - DNA, 17 bp, Homo sapiens
ctcatcttccccagccc

SEQ ID NO: 6121640 - DNA, 15 bp, Homo sapiens
ctcatctttaaaatg

SEQ ID NO: 6121641 - DNA, 12 bp, Homo sapiens
ctcatctttatc

SEQ ID NO: 6121642 - DNA, 22 bp, Homo sapiens
ctcatctttcattaaaggcttc

SEQ ID NO: 6121643 - DNA, 14 bp, Homo sapiens
ctcatctttccctc

SEQ ID NO: 6121644 - DNA, 16 bp, Homo sapiens
ctcatctttccctcct

SEQ ID NO: 6121645 - DNA, 19 bp, Homo sapiens
ctcatctttccctccttgg

SEQ ID NO: 6121646 - DNA, 12 bp, Homo sapiens
ctcatctttctt

SEQ ID NO: 6121647 - DNA, 16 bp, Homo sapiens
ctcatctttcttccaa

SEQ ID NO: 6121648 - DNA, 12 bp, Homo sapiens
ctcatcttttga

SEQ ID NO: 6121649 - DNA, 17 bp, Homo sapiens
ctcatgaacactggctg

SEQ ID NO: 6121650 - DNA, 14 bp, Homo sapiens
ctcatgaagcagga

SEQ ID NO: 6121651 - DNA, 16 bp, Homo sapiens
ctcatgaagcaggagg

SEQ ID NO: 6121652 - DNA, 14 bp, Homo sapiens
ctcatgaagccctt

SEQ ID NO: 6121653 - DNA, 12 bp, Homo sapiens
ctcatgaagcta

SEQ ID NO: 6121654 - DNA, 14 bp, Homo sapiens
ctcatgaataaatg

SEQ ID NO: 6121655 - DNA, 15 bp, Homo sapiens
ctcatgaatgaaaat

SEQ ID NO: 6121656 - DNA, 13 bp, Homo sapiens
ctcatgaatgtaa

SEQ ID NO: 6121657 - DNA, 16 bp, Homo sapiens
ctcatgaatgtaaatt

SEQ ID NO: 6121658 - DNA, 21 bp, Homo sapiens
ctcatgacactgtttggcctt

SEQ ID NO: 6121659 - DNA, 21 bp, Homo sapiens
ctcatgaccctcctgtccagc

SEQ ID NO: 6121660 - DNA, 14 bp, Homo sapiens
ctcatgactgcatg

SEQ ID NO: 6121661 - DNA, 16 bp, Homo sapiens
ctcatgactttatagt

SEQ ID NO: 6121662 - DNA, 20 bp, Homo sapiens
ctcatgagctgtgttcacag

SEQ ID NO: 6121663 - DNA, 16 bp, Homo sapiens
ctcatgaggaccaggg

SEQ ID NO: 6121664 - DNA, 17 bp, Homo sapiens
ctcatgaggaggggccc

SEQ ID NO: 6121665 - DNA, 23 bp, Homo sapiens
ctcatgaggaggggcccccctgc

SEQ ID NO: 6121666 - DNA, 22 bp, Homo sapiens
ctcatgagtggaaagtcaccta

SEQ ID NO: 6121667 - DNA, 20 bp, Homo sapiens
ctcatgatccacccacctca

SEQ ID NO: 6121668 - DNA, 18 bp, Homo sapiens
ctcatgcatagtcccagc

SEQ ID NO: 6121669 - DNA, 20 bp, Homo sapiens
ctcatgcatagtcccagcta

SEQ ID NO: 6121670 - DNA, 14 bp, Homo sapiens
ctcatgcatctcca

SEQ ID NO: 6121671 - DNA, 17 bp, Homo sapiens
ctcatgcatctccacct

SEQ ID NO: 6121672 - DNA, 16 bp, Homo sapiens
ctcatgcattcttttg

SEQ ID NO: 6121673 - DNA, 17 bp, Homo sapiens
ctcatgccacaccttct

SEQ ID NO: 6121674 - DNA, 13 bp, Homo sapiens
ctcatgccagcag

SEQ ID NO: 6121675 - DNA, 22 bp, Homo sapiens
ctcatgccagtaacaggctcaa

SEQ ID NO: 6121676 - DNA, 17 bp, Homo sapiens
ctcatgccagtgcctta

SEQ ID NO: 6121677 - DNA, 22 bp, Homo sapiens
ctcatgccatggtctttgctag

SEQ ID NO: 6121678 - DNA, 21 bp, Homo sapiens
ctcatgccattccgaccttca

SEQ ID NO: 6121679 - DNA, 16 bp, Homo sapiens
ctcatgcccaccccct

SEQ ID NO: 6121680 - DNA, 19 bp, Homo sapiens
ctcatgcccaccccctgcc

SEQ ID NO: 6121681 - DNA, 12 bp, Homo sapiens
ctcatgcccact

SEQ ID NO: 6121682 - DNA, 21 bp, Homo sapiens
ctcatgcccactcccccagga

SEQ ID NO: 6121683 - DNA, 22 bp, Homo sapiens
ctcatgcccactcccccaggag

SEQ ID NO: 6121684 - DNA, 15 bp, Homo sapiens
ctcatgcccagctct

SEQ ID NO: 6121685 - DNA, 16 bp, Homo sapiens
ctcatgccccaggcct

SEQ ID NO: 6121686 - DNA, 17 bp, Homo sapiens
ctcatgccccctttcag

SEQ ID NO: 6121687 - DNA, 17 bp, Homo sapiens
ctcatgcccctggctgg

SEQ ID NO: 6121688 - DNA, 15 bp, Homo sapiens
ctcatgcccgccagt

SEQ ID NO: 6121689 - DNA, 16 bp, Homo sapiens
ctcatgcccgccagtg

SEQ ID NO: 6121690 - DNA, 22 bp, Homo sapiens
ctcatgcccgccagtgcacagg

SEQ ID NO: 6121691 - DNA, 16 bp, Homo sapiens
ctcatgcctcagcctc

SEQ ID NO: 6121692 - DNA, 15 bp, Homo sapiens
ctcatgcctgcctga

SEQ ID NO: 6121693 - DNA, 21 bp, Homo sapiens
ctcatgcctgcctgataccct

SEQ ID NO: 6121694 - DNA, 12 bp, Homo sapiens
ctcatgcctgct

SEQ ID NO: 6121695 - DNA, 14 bp, Homo sapiens
ctcatgcctggccc

SEQ ID NO: 6121696 - DNA, 23 bp, Homo sapiens
ctcatgcctggcccccctccagg

SEQ ID NO: 6121697 - DNA, 23 bp, Homo sapiens
ctcatgcctgtaatcccagcact

SEQ ID NO: 6121698 - DNA, 19 bp, Homo sapiens
ctcatgcctttatactttg

SEQ ID NO: 6121699 - DNA, 14 bp, Homo sapiens
ctcatgcggcccag

SEQ ID NO: 6121700 - DNA, 11 bp, Homo sapiens
cgctcatctgg

SEQ ID NO: 6121701 - DNA, 11 bp, Homo sapiens
cgctcatcttg

SEQ ID NO: 6121702 - DNA, 22 bp, Homo sapiens
cgctcatgggcccctctgactc

SEQ ID NO: 6121703 - DNA, 15 bp, Homo sapiens
cgctccagctgcccc

SEQ ID NO: 6121704 - DNA, 12 bp, Homo sapiens
cgctccagggcc

SEQ ID NO: 6121705 - DNA, 20 bp, Homo sapiens
cgctcccaacccccctcctg

SEQ ID NO: 6121706 - DNA, 15 bp, Homo sapiens
cgctcccaccgcccc

SEQ ID NO: 6121707 - DNA, 18 bp, Homo sapiens
cgctcccaccgcccccac

SEQ ID NO: 6121708 - DNA, 16 bp, Homo sapiens
cgctcccacctagtgc

SEQ ID NO: 6121709 - DNA, 18 bp, Homo sapiens
cgctcccacctagtgccc

SEQ ID NO: 6121710 - DNA, 13 bp, Homo sapiens
cgctcccactcag

SEQ ID NO: 6121711 - DNA, 23 bp, Homo sapiens
cgctcccaggttcccccagcaag

SEQ ID NO: 6121712 - DNA, 21 bp, Homo sapiens
cgctcccagtgtcttcctgtg

SEQ ID NO: 6121713 - DNA, 20 bp, Homo sapiens
cgctccccacctacccagct

SEQ ID NO: 6121714 - DNA, 18 bp, Homo sapiens
cgctcccccgcagtcccc

SEQ ID NO: 6121715 - DNA, 12 bp, Homo sapiens
cgctcccctcca

SEQ ID NO: 6121716 - DNA, 18 bp, Homo sapiens
cgctcccctctcctccgc

SEQ ID NO: 6121717 - DNA, 14 bp, Homo sapiens
cgctcccctctgga

SEQ ID NO: 6121718 - DNA, 16 bp, Homo sapiens
cgctcccctctggaat

SEQ ID NO: 6121719 - DNA, 16 bp, Homo sapiens
cgctcccctgagaggt

SEQ ID NO: 6121720 - DNA, 18 bp, Homo sapiens
cgctcccctgagaggttt

SEQ ID NO: 6121721 - DNA, 16 bp, Homo sapiens
cgctcccctggaagcg

SEQ ID NO: 6121722 - DNA, 13 bp, Homo sapiens
cgctccccttgga

SEQ ID NO: 6121723 - DNA, 20 bp, Homo sapiens
cgctccccttggacctccag

SEQ ID NO: 6121724 - DNA, 16 bp, Homo sapiens
cgctcccctttcccat

SEQ ID NO: 6121725 - DNA, 20 bp, Homo sapiens
cgctcccgcatttctcatgc

SEQ ID NO: 6121726 - DNA, 21 bp, Homo sapiens
cgctcccgcatttctcatgct

SEQ ID NO: 6121727 - DNA, 20 bp, Homo sapiens
cgctcccgggccgcgcgtct

SEQ ID NO: 6121728 - DNA, 23 bp, Homo sapiens
cgctcccgggcctcagggtcctg

SEQ ID NO: 6121729 - DNA, 22 bp, Homo sapiens
cgctcccggttccctccccagc

SEQ ID NO: 6121730 - DNA, 18 bp, Homo sapiens
cgctccctgacttctccc

SEQ ID NO: 6121731 - DNA, 20 bp, Homo sapiens
cgctccctgacttctccccc

SEQ ID NO: 6121732 - DNA, 13 bp, Homo sapiens
cgctccctggaag

SEQ ID NO: 6121733 - DNA, 13 bp, Homo sapiens
cgctccctggata

SEQ ID NO: 6121734 - DNA, 18 bp, Homo sapiens
cgctccgaaccccgggcc

SEQ ID NO: 6121735 - DNA, 20 bp, Homo sapiens
cgctccggcagaggcagggc

SEQ ID NO: 6121736 - DNA, 21 bp, Homo sapiens
cgctccggcagaggcagggcc

SEQ ID NO: 6121737 - DNA, 22 bp, Homo sapiens
cgctccggcagaggcagggccc

SEQ ID NO: 6121738 - DNA, 24 bp, Homo sapiens
cgctccggcagaggcagggccctg

SEQ ID NO: 6121739 - DNA, 20 bp, Homo sapiens
cgctccgggacgtggcacct

SEQ ID NO: 6121740 - DNA, 23 bp, Homo sapiens
cgctccgggctttcacggaaact

SEQ ID NO: 6121741 - DNA, 14 bp, Homo sapiens
cgctccgtctctgt

SEQ ID NO: 6121742 - DNA, 15 bp, Homo sapiens
cgctcctcccagatg

SEQ ID NO: 6121743 - DNA, 17 bp, Homo sapiens
cgctcctcccctcttga

SEQ ID NO: 6121744 - DNA, 12 bp, Homo sapiens
cgctcctccttc

SEQ ID NO: 6121745 - DNA, 15 bp, Homo sapiens
cgctcctccttccca

SEQ ID NO: 6121746 - DNA, 20 bp, Homo sapiens
cgctcctccttcccagggac

SEQ ID NO: 6121747 - DNA, 23 bp, Homo sapiens
cgctcctcgggaaacacacaagc

SEQ ID NO: 6121748 - DNA, 12 bp, Homo sapiens
cgctcctctgca

SEQ ID NO: 6121749 - DNA, 13 bp, Homo sapiens
cgctcctctgcag

SEQ ID NO: 6121750 - DNA, 14 bp, Homo sapiens
cgctcctctgcagc

SEQ ID NO: 6121751 - DNA, 18 bp, Homo sapiens
cgctcctctgcagcctga

SEQ ID NO: 6121752 - DNA, 14 bp, Homo sapiens
cgctcctctgcctt

SEQ ID NO: 6121753 - DNA, 15 bp, Homo sapiens
cgctcctctgttcag

SEQ ID NO: 6121754 - DNA, 22 bp, Homo sapiens
cgctcctgacccctccctgcag

SEQ ID NO: 6121755 - DNA, 13 bp, Homo sapiens
cgctcctgccctc

SEQ ID NO: 6121756 - DNA, 16 bp, Homo sapiens
cgctcctgccgcagac

SEQ ID NO: 6121757 - DNA, 18 bp, Homo sapiens
cgctcctgccgcagacgg

SEQ ID NO: 6121758 - DNA, 18 bp, Homo sapiens
cgctcctgccgcagagct

SEQ ID NO: 6121759 - DNA, 23 bp, Homo sapiens
cgctcctgctaacggtgctcagg

SEQ ID NO: 6121760 - DNA, 12 bp, Homo sapiens
cgctcctggctt

SEQ ID NO: 6121761 - DNA, 13 bp, Homo sapiens
cgctcctggcttt

SEQ ID NO: 6121762 - DNA, 20 bp, Homo sapiens
cgctcctgtctgccagccag

SEQ ID NO: 6121763 - DNA, 13 bp, Homo sapiens
cgctcctttacct

SEQ ID NO: 6121764 - DNA, 21 bp, Homo sapiens
cgctcctttacctaccacctt

SEQ ID NO: 6121765 - DNA, 22 bp, Homo sapiens
cgctcctttacctaccaccttc

SEQ ID NO: 6121766 - DNA, 20 bp, Homo sapiens
cgctcctttgtgtgtgtgtc

SEQ ID NO: 6121767 - DNA, 17 bp, Homo sapiens
cgctcgatggacctcag

SEQ ID NO: 6121768 - DNA, 18 bp, Homo sapiens
cgctcgccacgctcagtg

SEQ ID NO: 6121769 - DNA, 13 bp, Homo sapiens
cgctcgcccagca

SEQ ID NO: 6121770 - DNA, 18 bp, Homo sapiens
cgctcgcccagcaggaga

SEQ ID NO: 6121771 - DNA, 13 bp, Homo sapiens
cgctcgcgggcag

SEQ ID NO: 6121772 - DNA, 21 bp, Homo sapiens
cgctcgcgggcagcgggccag

SEQ ID NO: 6121773 - DNA, 12 bp, Homo sapiens
cgctcggaggcc

SEQ ID NO: 6121774 - DNA, 19 bp, Homo sapiens
cgctcggaggccccaaagg

SEQ ID NO: 6121775 - DNA, 17 bp, Homo sapiens
cgctcggcaggaaggag

SEQ ID NO: 6121776 - DNA, 17 bp, Homo sapiens
cgctcggcccggagcag

SEQ ID NO: 6121777 - DNA, 17 bp, Homo sapiens
cgctcggggctgggcag

SEQ ID NO: 6121778 - DNA, 19 bp, Homo sapiens
cgctcggtctccaccccag

SEQ ID NO: 6121779 - DNA, 22 bp, Homo sapiens
cgctcggtctccaccccagggt

SEQ ID NO: 6121780 - DNA, 24 bp, Homo sapiens
cgctcggtctccaccccagggtca

SEQ ID NO: 6121781 - DNA, 23 bp, Homo sapiens
cgctcgtgtgttctatccaaaca

SEQ ID NO: 6121782 - DNA, 22 bp, Homo sapiens
cgctcgttccggtccccacaga

SEQ ID NO: 6121783 - DNA, 22 bp, Homo sapiens
cgctctaggcagaagaagctgg

SEQ ID NO: 6121784 - DNA, 12 bp, Homo sapiens
cgctctccacca

SEQ ID NO: 6121785 - DNA, 17 bp, Homo sapiens
cgctctccccctgcagc

SEQ ID NO: 6121786 - DNA, 16 bp, Homo sapiens
cgctctccctaccttg

SEQ ID NO: 6121787 - DNA, 21 bp, Homo sapiens
cgctctccctaccttgcctcc

SEQ ID NO: 6121788 - DNA, 12 bp, Homo sapiens
cgctctccctgt

SEQ ID NO: 6121789 - DNA, 17 bp, Homo sapiens
cgctctccgccccccgg

SEQ ID NO: 6121790 - DNA, 13 bp, Homo sapiens
cgctctcctaagt

SEQ ID NO: 6121791 - DNA, 13 bp, Homo sapiens
cgctctcctggac

SEQ ID NO: 6121792 - DNA, 17 bp, Homo sapiens
cgctctcgggtcaccct

SEQ ID NO: 6121793 - DNA, 15 bp, Homo sapiens
cgctctctcatgtgg

SEQ ID NO: 6121794 - DNA, 11 bp, Homo sapiens
cgctctctctc

SEQ ID NO: 6121795 - DNA, 21 bp, Homo sapiens
cgctctctctcgctgcgtcct

SEQ ID NO: 6121796 - DNA, 18 bp, Homo sapiens
cgctctctggccttcggc

SEQ ID NO: 6121797 - DNA, 16 bp, Homo sapiens
cgctctcttcctgccc

SEQ ID NO: 6121798 - DNA, 19 bp, Homo sapiens
cgctctcttttctgtactt

SEQ ID NO: 6121799 - DNA, 16 bp, Homo sapiens
cgctctgcatgctcct

SEQ ID NO: 6121800 - DNA, 17 bp, Homo sapiens
cgctctgcatgctcctc

SEQ ID NO: 6121801 - DNA, 20 bp, Homo sapiens
cgctctgcatgctcctctgc

SEQ ID NO: 6121802 - DNA, 18 bp, Homo sapiens
cgctctgccatcagcccc

SEQ ID NO: 6121803 - DNA, 20 bp, Homo sapiens
cgctctgccctccctggcct

SEQ ID NO: 6121804 - DNA, 21 bp, Homo sapiens
cgctctgcctcaccgcttccc

SEQ ID NO: 6121805 - DNA, 15 bp, Homo sapiens
cgctctgctcagtgg

SEQ ID NO: 6121806 - DNA, 16 bp, Homo sapiens
cgctctgctgcccagg

SEQ ID NO: 6121807 - DNA, 11 bp, Homo sapiens
cgctctgctgg

SEQ ID NO: 6121808 - DNA, 18 bp, Homo sapiens
cgctctgctggcctggcc

SEQ ID NO: 6121809 - DNA, 20 bp, Homo sapiens
cgctctgctggcctggccgg

SEQ ID NO: 6121810 - DNA, 12 bp, Homo sapiens
cgctctggacat

SEQ ID NO: 6121811 - DNA, 21 bp, Homo sapiens
cgctctggggggttgcctcga

SEQ ID NO: 6121812 - DNA, 16 bp, Homo sapiens
cgctctgtcgcccagg

SEQ ID NO: 6121813 - DNA, 19 bp, Homo sapiens
cgctctgtcgcccaggctg

SEQ ID NO: 6121814 - DNA, 21 bp, Homo sapiens
cgctctgtggatgccagggcc

SEQ ID NO: 6121815 - DNA, 13 bp, Homo sapiens
cgctcttcaccag

SEQ ID NO: 6121816 - DNA, 15 bp, Homo sapiens
cgctcttcaccagga

SEQ ID NO: 6121817 - DNA, 22 bp, Homo sapiens
cgctcttgaggaagcccaggct

SEQ ID NO: 6121818 - DNA, 21 bp, Homo sapiens
cgctcttggcaggtactcagc

SEQ ID NO: 6121819 - DNA, 18 bp, Homo sapiens
cgctctttaatttgttgt

SEQ ID NO: 6121820 - DNA, 23 bp, Homo sapiens
cgctcttttctaagtggcgtgtg

SEQ ID NO: 6121821 - DNA, 17 bp, Homo sapiens
cgctgaacccacccggc

SEQ ID NO: 6121822 - DNA, 15 bp, Homo sapiens
cgctgaacctgtctc

SEQ ID NO: 6121823 - DNA, 22 bp, Homo sapiens
cgctgaagcggtcagactggag

SEQ ID NO: 6121824 - DNA, 14 bp, Homo sapiens
cgctgacagcctcc

SEQ ID NO: 6121825 - DNA, 18 bp, Homo sapiens
cgctgaccctgggcctgg

SEQ ID NO: 6121826 - DNA, 15 bp, Homo sapiens
cgctgactacagggc

SEQ ID NO: 6121827 - DNA, 21 bp, Homo sapiens
cgctgagcgcccccgagccct

SEQ ID NO: 6121828 - DNA, 23 bp, Homo sapiens
cgctgagcgcccccgagccctga

SEQ ID NO: 6121829 - DNA, 16 bp, Homo sapiens
cgctgagctgagtggc

SEQ ID NO: 6121830 - DNA, 14 bp, Homo sapiens
cgctgagggcaggg

SEQ ID NO: 6121831 - DNA, 22 bp, Homo sapiens
cgctgagggcagggttctagaa

SEQ ID NO: 6121832 - DNA, 23 bp, Homo sapiens
cgctgagggcagggttctagaag

SEQ ID NO: 6121833 - DNA, 18 bp, Homo sapiens
cgctgaggggtctcggat

SEQ ID NO: 6121834 - DNA, 19 bp, Homo sapiens
cgctgaggtgtctggcctg

SEQ ID NO: 6121835 - DNA, 20 bp, Homo sapiens
cgctgagtatggagcagcct

SEQ ID NO: 6121836 - DNA, 17 bp, Homo sapiens
cgctgagtggactggag

SEQ ID NO: 6121837 - DNA, 13 bp, Homo sapiens
cgctgagtggcag

SEQ ID NO: 6121838 - DNA, 12 bp, Homo sapiens
cgctgatgcaga

SEQ ID NO: 6121839 - DNA, 22 bp, Homo sapiens
cgctgattcctaaggcccagct

SEQ ID NO: 6121840 - DNA, 17 bp, Homo sapiens
cgctgcacacagacggc

SEQ ID NO: 6121841 - DNA, 17 bp, Homo sapiens
cgctgcacatggcctga

SEQ ID NO: 6121842 - DNA, 14 bp, Homo sapiens
cgctgcaccacggc

SEQ ID NO: 6121843 - DNA, 12 bp, Homo sapiens
cgctgcagcctc

SEQ ID NO: 6121844 - DNA, 19 bp, Homo sapiens
cgctgcagcctcccttcca

SEQ ID NO: 6121845 - DNA, 16 bp, Homo sapiens
cgctgcagcctctgcc

SEQ ID NO: 6121846 - DNA, 23 bp, Homo sapiens
cgctgcagggagcaccacggcca

SEQ ID NO: 6121847 - DNA, 12 bp, Homo sapiens
cgctgcagggcc

SEQ ID NO: 6121848 - DNA, 16 bp, Homo sapiens
cgctgcagggctccca

SEQ ID NO: 6121849 - DNA, 17 bp, Homo sapiens
cgctgcatacaggggag

SEQ ID NO: 6121850 - DNA, 21 bp, Homo sapiens
cgctgcatacaggggaggggc

SEQ ID NO: 6121851 - DNA, 17 bp, Homo sapiens
cgctgccaccacgtctg

SEQ ID NO: 6121852 - DNA, 20 bp, Homo sapiens
cgctgccaccacgtctgcca

SEQ ID NO: 6121853 - DNA, 22 bp, Homo sapiens
cgctgccaccacgtctgccagg

SEQ ID NO: 6121854 - DNA, 23 bp, Homo sapiens
cgctgccaccacgtctgccaggc

SEQ ID NO: 6121855 - DNA, 21 bp, Homo sapiens
cgctgccagccttgagccctg

SEQ ID NO: 6121856 - DNA, 14 bp, Homo sapiens
cgctgccaggacac

SEQ ID NO: 6121857 - DNA, 17 bp, Homo sapiens
cgctgccaggacacctg

SEQ ID NO: 6121858 - DNA, 19 bp, Homo sapiens
cgctgccatcaccgctggg

SEQ ID NO: 6121859 - DNA, 17 bp, Homo sapiens
cgctgccatttccctga

SEQ ID NO: 6121860 - DNA, 18 bp, Homo sapiens
cgctgcccacctgccggc

SEQ ID NO: 6121861 - DNA, 15 bp, Homo sapiens
cgctgcccagccctc

SEQ ID NO: 6121862 - DNA, 16 bp, Homo sapiens
cgctgcccagccctcc

SEQ ID NO: 6121863 - DNA, 15 bp, Homo sapiens
cgctgcccaggctct

SEQ ID NO: 6121864 - DNA, 18 bp, Homo sapiens
cgctgcccaggctctgct

SEQ ID NO: 6121865 - DNA, 20 bp, Homo sapiens
cgctgcccaggctctgctga

SEQ ID NO: 6121866 - DNA, 14 bp, Homo sapiens
cgctgccccatctc

SEQ ID NO: 6121867 - DNA, 19 bp, Homo sapiens
cgctgcccccacagatcca

SEQ ID NO: 6121868 - DNA, 14 bp, Homo sapiens
cgctgcccccaccc

SEQ ID NO: 6121869 - DNA, 16 bp, Homo sapiens
cgctgcccctccccgt

SEQ ID NO: 6121870 - DNA, 19 bp, Homo sapiens
cgctgcccctggcagcccc

SEQ ID NO: 6121871 - DNA, 21 bp, Homo sapiens
cgctgcccggcgccctctgtc

SEQ ID NO: 6121872 - DNA, 12 bp, Homo sapiens
cgctgccctgca

SEQ ID NO: 6121873 - DNA, 13 bp, Homo sapiens
cgctgccctgcaa

SEQ ID NO: 6121874 - DNA, 14 bp, Homo sapiens
cgctgccctgcaaa

SEQ ID NO: 6121875 - DNA, 14 bp, Homo sapiens
cgctgccctgcatg

SEQ ID NO: 6121876 - DNA, 17 bp, Homo sapiens
cgctgccctgtggacag

SEQ ID NO: 6121877 - DNA, 18 bp, Homo sapiens
cgctgcccttgggtcccc

SEQ ID NO: 6121878 - DNA, 20 bp, Homo sapiens
cgctgcccttgggtcccccc

SEQ ID NO: 6121879 - DNA, 17 bp, Homo sapiens
ctcatgcggcccagcca

SEQ ID NO: 6121880 - DNA, 12 bp, Homo sapiens
ctcatgctgaaa

SEQ ID NO: 6121881 - DNA, 13 bp, Homo sapiens
ctcatgctgaaag

SEQ ID NO: 6121882 - DNA, 12 bp, Homo sapiens
ctcatgctgccc

SEQ ID NO: 6121883 - DNA, 20 bp, Homo sapiens
ctcatgctgcccctgccttg

SEQ ID NO: 6121884 - DNA, 20 bp, Homo sapiens
ctcatgctgctcccctaaag

SEQ ID NO: 6121885 - DNA, 14 bp, Homo sapiens
ctcatgctggatga

SEQ ID NO: 6121886 - DNA, 19 bp, Homo sapiens
ctcatgctggatgacccca

SEQ ID NO: 6121887 - DNA, 19 bp, Homo sapiens
ctcatgctgtgtttgtttt

SEQ ID NO: 6121888 - DNA, 23 bp, Homo sapiens
ctcatgcttcttctcatggggtg

SEQ ID NO: 6121889 - DNA, 21 bp, Homo sapiens
ctcatggaaactggccagggg

SEQ ID NO: 6121890 - DNA, 16 bp, Homo sapiens
ctcatggaccagtggc

SEQ ID NO: 6121891 - DNA, 14 bp, Homo sapiens
ctcatggactccag

SEQ ID NO: 6121892 - DNA, 20 bp, Homo sapiens
ctcatggactccaggatcct

SEQ ID NO: 6121893 - DNA, 16 bp, Homo sapiens
ctcatggattgccaca

SEQ ID NO: 6121894 - DNA, 14 bp, Homo sapiens
ctcatggcaagatt

SEQ ID NO: 6121895 - DNA, 17 bp, Homo sapiens
ctcatggcaggcatctg

SEQ ID NO: 6121896 - DNA, 20 bp, Homo sapiens
ctcatggcccccaggggcag

SEQ ID NO: 6121897 - DNA, 17 bp, Homo sapiens
ctcatggcccctctgac

SEQ ID NO: 6121898 - DNA, 15 bp, Homo sapiens
ctcatggcgggactg

SEQ ID NO: 6121899 - DNA, 19 bp, Homo sapiens
ctcatggcgtaatgggcct

SEQ ID NO: 6121900 - DNA, 21 bp, Homo sapiens
ctcatggcgtaatgggcctgc

SEQ ID NO: 6121901 - DNA, 12 bp, Homo sapiens
ctcatggctgtt

SEQ ID NO: 6121902 - DNA, 23 bp, Homo sapiens
ctcatggctgttatctgtcttta

SEQ ID NO: 6121903 - DNA, 21 bp, Homo sapiens
ctcatggcttttgctttccct

SEQ ID NO: 6121904 - DNA, 20 bp, Homo sapiens
ctcatgggaagatgtctcag

SEQ ID NO: 6121905 - DNA, 22 bp, Homo sapiens
ctcatgggaagcatgtggatga

SEQ ID NO: 6121906 - DNA, 16 bp, Homo sapiens
ctcatgggaaggggag

SEQ ID NO: 6121907 - DNA, 22 bp, Homo sapiens
ctcatgggagtcagggagccct

SEQ ID NO: 6121908 - DNA, 15 bp, Homo sapiens
ctcatgggcccctct

SEQ ID NO: 6121909 - DNA, 16 bp, Homo sapiens
ctcatgggcccctctg

SEQ ID NO: 6121910 - DNA, 17 bp, Homo sapiens
ctcatgggcccctctga

SEQ ID NO: 6121911 - DNA, 20 bp, Homo sapiens
ctcatgggcccctctgactc

SEQ ID NO: 6121912 - DNA, 18 bp, Homo sapiens
ctcatggggaagcttcca

SEQ ID NO: 6121913 - DNA, 16 bp, Homo sapiens
ctcatggggtccaagt

SEQ ID NO: 6121914 - DNA, 12 bp, Homo sapiens
ctcatgggtacc

SEQ ID NO: 6121915 - DNA, 16 bp, Homo sapiens
ctcatgggtacccaga

SEQ ID NO: 6121916 - DNA, 15 bp, Homo sapiens
ctcatgggtggcact

SEQ ID NO: 6121917 - DNA, 13 bp, Homo sapiens
ctcatgggtggga

SEQ ID NO: 6121918 - DNA, 16 bp, Homo sapiens
ctcatggtacttcctc

SEQ ID NO: 6121919 - DNA, 22 bp, Homo sapiens
ctcatggtcatgggtctgccct

SEQ ID NO: 6121920 - DNA, 20 bp, Homo sapiens
ctcatggtgcatataaatat

SEQ ID NO: 6121921 - DNA, 17 bp, Homo sapiens
ctcatgtaaaataagaa

SEQ ID NO: 6121922 - DNA, 19 bp, Homo sapiens
ctcatgtaacacataaaca

SEQ ID NO: 6121923 - DNA, 12 bp, Homo sapiens
ctcatgtaacat

SEQ ID NO: 6121924 - DNA, 13 bp, Homo sapiens
ctcatgtaacatt

SEQ ID NO: 6121925 - DNA, 15 bp, Homo sapiens
ctcatgtaatttgca

SEQ ID NO: 6121926 - DNA, 16 bp, Homo sapiens
ctcatgtacataccct

SEQ ID NO: 6121927 - DNA, 22 bp, Homo sapiens
ctcatgtacattggtctttcta

SEQ ID NO: 6121928 - DNA, 21 bp, Homo sapiens
ctcatgtacttaataacactt

SEQ ID NO: 6121929 - DNA, 21 bp, Homo sapiens
ctcatgtagaacaagaaatct

SEQ ID NO: 6121930 - DNA, 17 bp, Homo sapiens
ctcatgtaggtgagcct

SEQ ID NO: 6121931 - DNA, 19 bp, Homo sapiens
ctcatgtaggtgagcctgg

SEQ ID NO: 6121932 - DNA, 18 bp, Homo sapiens
ctcatgtatttaaagaac

SEQ ID NO: 6121933 - DNA, 17 bp, Homo sapiens
ctcatgtcattatgaca

SEQ ID NO: 6121934 - DNA, 21 bp, Homo sapiens
ctcatgtcatttctcatggat

SEQ ID NO: 6121935 - DNA, 22 bp, Homo sapiens
ctcatgtccccttcctgttctt

SEQ ID NO: 6121936 - DNA, 17 bp, Homo sapiens
ctcatgtccctccaggg

SEQ ID NO: 6121937 - DNA, 18 bp, Homo sapiens
ctcatgtcctgctggctt

SEQ ID NO: 6121938 - DNA, 22 bp, Homo sapiens
ctcatgtcctgctggcttccag

SEQ ID NO: 6121939 - DNA, 16 bp, Homo sapiens
ctcatgtcctgtcctg

SEQ ID NO: 6121940 - DNA, 17 bp, Homo sapiens
ctcatgtctcagcctcc

SEQ ID NO: 6121941 - DNA, 14 bp, Homo sapiens
ctcatgtgactctt

SEQ ID NO: 6121942 - DNA, 12 bp, Homo sapiens
ctcatgtgatcc

SEQ ID NO: 6121943 - DNA, 20 bp, Homo sapiens
ctcatgtgcaataggtgaga

SEQ ID NO: 6121944 - DNA, 16 bp, Homo sapiens
ctcatgtgctttgtag

SEQ ID NO: 6121945 - DNA, 15 bp, Homo sapiens
ctcatgtggactggg

SEQ ID NO: 6121946 - DNA, 14 bp, Homo sapiens
ctcatgtggctgga

SEQ ID NO: 6121947 - DNA, 21 bp, Homo sapiens
ctcatgtggggatgtttgtgc

SEQ ID NO: 6121948 - DNA, 9 bp, Homo sapiens
ctcatgtgt

SEQ ID NO: 6121949 - DNA, 12 bp, Homo sapiens
ctcatgtgtccc

SEQ ID NO: 6121950 - DNA, 16 bp, Homo sapiens
ctcatgtgtgcaacag

SEQ ID NO: 6121951 - DNA, 13 bp, Homo sapiens
ctcatgtgtgtgg

SEQ ID NO: 6121952 - DNA, 17 bp, Homo sapiens
ctcatgttactcagtgt

SEQ ID NO: 6121953 - DNA, 16 bp, Homo sapiens
ctcatgttcaggcaga

SEQ ID NO: 6121954 - DNA, 12 bp, Homo sapiens
ctcatgttctca

SEQ ID NO: 6121955 - DNA, 12 bp, Homo sapiens
ctcatgttctta

SEQ ID NO: 6121956 - DNA, 17 bp, Homo sapiens
ctcatgttgaaacttta

SEQ ID NO: 6121957 - DNA, 20 bp, Homo sapiens
ctcatgttgctgaatttgta

SEQ ID NO: 6121958 - DNA, 19 bp, Homo sapiens
ctcatgttgttcccacaca

SEQ ID NO: 6121959 - DNA, 21 bp, Homo sapiens
ctcatgttgttcccacacaca

SEQ ID NO: 6121960 - DNA, 17 bp, Homo sapiens
ctcatgtttacaggggt

SEQ ID NO: 6121961 - DNA, 19 bp, Homo sapiens
ctcatgtttacaggggttg

SEQ ID NO: 6121962 - DNA, 18 bp, Homo sapiens
ctcatgtttatgaaaata

SEQ ID NO: 6121963 - DNA, 13 bp, Homo sapiens
ctcatgtttgtgc

SEQ ID NO: 6121964 - DNA, 17 bp, Homo sapiens
ctcatgtttgtgcatgt

SEQ ID NO: 6121965 - DNA, 21 bp, Homo sapiens
ctcatgttttatatgattaaa

SEQ ID NO: 6121966 - DNA, 20 bp, Homo sapiens
ctcatgttttcaactgccaa

SEQ ID NO: 6121967 - DNA, 18 bp, Homo sapiens
ctcatgttttccattgtt

SEQ ID NO: 6121968 - DNA, 20 bp, Homo sapiens
ctcatgtttttaacttttaa

SEQ ID NO: 6121969 - DNA, 13 bp, Homo sapiens
ctcattaaaaaaa

SEQ ID NO: 6121970 - DNA, 17 bp, Homo sapiens
ctcattaaaatccagta

SEQ ID NO: 6121971 - DNA, 19 bp, Homo sapiens
ctcattaaactctaaagat

SEQ ID NO: 6121972 - DNA, 20 bp, Homo sapiens
ctcattaaactctaaagatt

SEQ ID NO: 6121973 - DNA, 20 bp, Homo sapiens
ctcattaaatggtgatttct

SEQ ID NO: 6121974 - DNA, 22 bp, Homo sapiens
ctcattaacaactcattctgat

SEQ ID NO: 6121975 - DNA, 17 bp, Homo sapiens
ctcattaattcaatgaa

SEQ ID NO: 6121976 - DNA, 18 bp, Homo sapiens
ctcattaattcaatgaaa

SEQ ID NO: 6121977 - DNA, 22 bp, Homo sapiens
ctcattaattcaattaaaacca

SEQ ID NO: 6121978 - DNA, 23 bp, Homo sapiens
ctcattaattcaattaaaaccat

SEQ ID NO: 6121979 - DNA, 19 bp, Homo sapiens
ctcattaccagtaaaggct

SEQ ID NO: 6121980 - DNA, 22 bp, Homo sapiens
ctcattacccacccgacctggc

SEQ ID NO: 6121981 - DNA, 13 bp, Homo sapiens
ctcattacccagg

SEQ ID NO: 6121982 - DNA, 18 bp, Homo sapiens
ctcattaccgtctgtgat

SEQ ID NO: 6121983 - DNA, 17 bp, Homo sapiens
ctcattacggctcctct

SEQ ID NO: 6121984 - DNA, 16 bp, Homo sapiens
ctcattactgggcctt

SEQ ID NO: 6121985 - DNA, 12 bp, Homo sapiens
ctcattagactg

SEQ ID NO: 6121986 - DNA, 13 bp, Homo sapiens
ctcattagactgg

SEQ ID NO: 6121987 - DNA, 14 bp, Homo sapiens
ctcattagactgga

SEQ ID NO: 6121988 - DNA, 13 bp, Homo sapiens
ctcattagctctc

SEQ ID NO: 6121989 - DNA, 17 bp, Homo sapiens
ctcattaggttttgctt

SEQ ID NO: 6121990 - DNA, 14 bp, Homo sapiens
ctcattagtggtac

SEQ ID NO: 6121991 - DNA, 21 bp, Homo sapiens
ctcattatcgccttttgacag

SEQ ID NO: 6121992 - DNA, 13 bp, Homo sapiens
ctcattatgaaaa

SEQ ID NO: 6121993 - DNA, 16 bp, Homo sapiens
ctcattatgaaaaaca

SEQ ID NO: 6121994 - DNA, 20 bp, Homo sapiens
ctcattatgaagatgttttt

SEQ ID NO: 6121995 - DNA, 16 bp, Homo sapiens
ctcattatttcaaaat

SEQ ID NO: 6121996 - DNA, 12 bp, Homo sapiens
ctcattcactgt

SEQ ID NO: 6121997 - DNA, 15 bp, Homo sapiens
ctcattcactgtcct

SEQ ID NO: 6121998 - DNA, 13 bp, Homo sapiens
ctcattcagcatg

SEQ ID NO: 6121999 - DNA, 18 bp, Homo sapiens
ctcattcagggaagctca

SEQ ID NO: 6122000 - DNA, 19 bp, Homo sapiens
ctcattcagtaagttctgt

SEQ ID NO: 6122001 - DNA, 23 bp, Homo sapiens
ctcattcagtaagttctgtggtt

SEQ ID NO: 6122002 - DNA, 22 bp, Homo sapiens
ctcattcatcttgcaagcaaat

SEQ ID NO: 6122003 - DNA, 19 bp, Homo sapiens
ctcattcattcattcagta

SEQ ID NO: 6122004 - DNA, 17 bp, Homo sapiens
ctcattccaacagtgag

SEQ ID NO: 6122005 - DNA, 14 bp, Homo sapiens
ctcattccagatcc

SEQ ID NO: 6122006 - DNA, 18 bp, Homo sapiens
ctcattccatgactctgc

SEQ ID NO: 6122007 - DNA, 18 bp, Homo sapiens
ctcattcccatgtggaac

SEQ ID NO: 6122008 - DNA, 12 bp, Homo sapiens
ctcattccccag

SEQ ID NO: 6122009 - DNA, 13 bp, Homo sapiens
ctcattccccagg

SEQ ID NO: 6122010 - DNA, 13 bp, Homo sapiens
ctcattcccctcg

SEQ ID NO: 6122011 - DNA, 21 bp, Homo sapiens
ctcattccctcgggaccctcc

SEQ ID NO: 6122012 - DNA, 21 bp, Homo sapiens
ctcattcctccacctgccgtg

SEQ ID NO: 6122013 - DNA, 13 bp, Homo sapiens
ctcattcctgcct

SEQ ID NO: 6122014 - DNA, 18 bp, Homo sapiens
ctcattcctgcctgtctc

SEQ ID NO: 6122015 - DNA, 12 bp, Homo sapiens
ctcattcctgta

SEQ ID NO: 6122016 - DNA, 15 bp, Homo sapiens
ctcattcgcctttgt

SEQ ID NO: 6122017 - DNA, 17 bp, Homo sapiens
ctcattcgcctttgtct

SEQ ID NO: 6122018 - DNA, 22 bp, Homo sapiens
ctcattcgcctttgtcttgtac

SEQ ID NO: 6122019 - DNA, 14 bp, Homo sapiens
ctcattctaatgat

SEQ ID NO: 6122020 - DNA, 21 bp, Homo sapiens
ctcattctaatgatggcccat

SEQ ID NO: 6122021 - DNA, 21 bp, Homo sapiens
ctcattctatccccaatcagc

SEQ ID NO: 6122022 - DNA, 15 bp, Homo sapiens
ctcattctcagagta

SEQ ID NO: 6122023 - DNA, 18 bp, Homo sapiens
ctcattctcttcttgcta

SEQ ID NO: 6122024 - DNA, 17 bp, Homo sapiens
ctcattctctttctttt

SEQ ID NO: 6122025 - DNA, 11 bp, Homo sapiens
ctcattctgaa

SEQ ID NO: 6122026 - DNA, 17 bp, Homo sapiens
ctcattctgaaggagcc

SEQ ID NO: 6122027 - DNA, 15 bp, Homo sapiens
ctcattctgcacctt

SEQ ID NO: 6122028 - DNA, 20 bp, Homo sapiens
ctcattctgcaccttgccag

SEQ ID NO: 6122029 - DNA, 16 bp, Homo sapiens
ctcattctgcattaat

SEQ ID NO: 6122030 - DNA, 14 bp, Homo sapiens
ctcattcttctaaa

SEQ ID NO: 6122031 - DNA, 12 bp, Homo sapiens
ctcattcttctg

SEQ ID NO: 6122032 - DNA, 14 bp, Homo sapiens
ctcattcttctgta

SEQ ID NO: 6122033 - DNA, 14 bp, Homo sapiens
ctcattcttgtttt

SEQ ID NO: 6122034 - DNA, 12 bp, Homo sapiens
ctcattctttag

SEQ ID NO: 6122035 - DNA, 15 bp, Homo sapiens
ctcattgaaatgtca

SEQ ID NO: 6122036 - DNA, 16 bp, Homo sapiens
ctcattgaaatgtcac

SEQ ID NO: 6122037 - DNA, 17 bp, Homo sapiens
ctcattgacaagaactg

SEQ ID NO: 6122038 - DNA, 15 bp, Homo sapiens
ctcattgacatgata

SEQ ID NO: 6122039 - DNA, 15 bp, Homo sapiens
ctcattgacctgagg

SEQ ID NO: 6122040 - DNA, 19 bp, Homo sapiens
ctcattgacctgaggccct

SEQ ID NO: 6122041 - DNA, 21 bp, Homo sapiens
ctcattgacctgaggcccttc

SEQ ID NO: 6122042 - DNA, 14 bp, Homo sapiens
ctcattgactttta

SEQ ID NO: 6122043 - DNA, 22 bp, Homo sapiens
ctcattgacttttataaagcat

SEQ ID NO: 6122044 - DNA, 16 bp, Homo sapiens
ctcattgccaaggcat

SEQ ID NO: 6122045 - DNA, 20 bp, Homo sapiens
ctcattgccaaggcatcccc

SEQ ID NO: 6122046 - DNA, 13 bp, Homo sapiens
ctcattgccagtg

SEQ ID NO: 6122047 - DNA, 16 bp, Homo sapiens
ctcattgcccccacct

SEQ ID NO: 6122048 - DNA, 17 bp, Homo sapiens
ctcattgcccccacctc

SEQ ID NO: 6122049 - DNA, 15 bp, Homo sapiens
ctcattgcctcctgt

SEQ ID NO: 6122050 - DNA, 22 bp, Homo sapiens
ctcattgctaccacagacttgc

SEQ ID NO: 6122051 - DNA, 20 bp, Homo sapiens
ctcattgctgtcttgcccca

SEQ ID NO: 6122052 - DNA, 20 bp, Homo sapiens
ctcattgctgttttaatttg

SEQ ID NO: 6122053 - DNA, 19 bp, Homo sapiens
ctcattgcttacaagccta

SEQ ID NO: 6122054 - DNA, 22 bp, Homo sapiens
ctcattgcttcacaacccatct

SEQ ID NO: 6122055 - DNA, 20 bp, Homo sapiens
ctcattgcttggaattcagc

SEQ ID NO: 6122056 - DNA, 22 bp, Homo sapiens
ctcattggaaatttagcattgt

SEQ ID NO: 6122057 - DNA, 18 bp, Homo sapiens
ctcattggacccttccat

SEQ ID NO: 6122058 - DNA, 12 bp, Homo sapiens
ctcattggccag

SEQ ID NO: 6122059 - DNA, 14 bp, Homo sapiens
cgctgccctttggc

SEQ ID NO: 6122060 - DNA, 18 bp, Homo sapiens
cgctgccctttggccaac

SEQ ID NO: 6122061 - DNA, 18 bp, Homo sapiens
cgctgccgcaccccagag

SEQ ID NO: 6122062 - DNA, 21 bp, Homo sapiens
cgctgccgcaccccagagtgt

SEQ ID NO: 6122063 - DNA, 18 bp, Homo sapiens
cgctgccgctgccgctgc

SEQ ID NO: 6122064 - DNA, 17 bp, Homo sapiens
cgctgcctaagtggctg

SEQ ID NO: 6122065 - DNA, 14 bp, Homo sapiens
cgctgcctcctgct

SEQ ID NO: 6122066 - DNA, 13 bp, Homo sapiens
cgctgcctcttgg

SEQ ID NO: 6122067 - DNA, 20 bp, Homo sapiens
cgctgcctcttggcttctca

SEQ ID NO: 6122068 - DNA, 13 bp, Homo sapiens
cgctgcctggcca

SEQ ID NO: 6122069 - DNA, 15 bp, Homo sapiens
cgctgcctggccagg

SEQ ID NO: 6122070 - DNA, 12 bp, Homo sapiens
cgctgcctggcg

SEQ ID NO: 6122071 - DNA, 22 bp, Homo sapiens
cgctgcctggtctgtctggatc

SEQ ID NO: 6122072 - DNA, 20 bp, Homo sapiens
cgctgcgcagcctccagggc

SEQ ID NO: 6122073 - DNA, 21 bp, Homo sapiens
cgctgcgcagcctccagggcc

SEQ ID NO: 6122074 - DNA, 19 bp, Homo sapiens
cgctgcggacaccgtggcc

SEQ ID NO: 6122075 - DNA, 23 bp, Homo sapiens
cgctgcggacaccgtggcctggg

SEQ ID NO: 6122076 - DNA, 15 bp, Homo sapiens
cgctgcgggcccagc

SEQ ID NO: 6122077 - DNA, 15 bp, Homo sapiens
cgctgcgtgccatga

SEQ ID NO: 6122078 - DNA, 19 bp, Homo sapiens
cgctgcgtgccatgagtcc

SEQ ID NO: 6122079 - DNA, 18 bp, Homo sapiens
cgctgctacatcagactc

SEQ ID NO: 6122080 - DNA, 14 bp, Homo sapiens
cgctgctctagctg

SEQ ID NO: 6122081 - DNA, 17 bp, Homo sapiens
cgctgctctagctggca

SEQ ID NO: 6122082 - DNA, 16 bp, Homo sapiens
cgctgctctcctgaca

SEQ ID NO: 6122083 - DNA, 17 bp, Homo sapiens
cgctgctctcctgacag

SEQ ID NO: 6122084 - DNA, 20 bp, Homo sapiens
cgctgctgctgctgcgccct

SEQ ID NO: 6122085 - DNA, 12 bp, Homo sapiens
cgctgctgtgct

SEQ ID NO: 6122086 - DNA, 14 bp, Homo sapiens
cgctgctgtgctct

SEQ ID NO: 6122087 - DNA, 14 bp, Homo sapiens
cgctgcttccagga

SEQ ID NO: 6122088 - DNA, 21 bp, Homo sapiens
cgctgcttgagtggacagcag

SEQ ID NO: 6122089 - DNA, 21 bp, Homo sapiens
cgctggaagaacccttctcag

SEQ ID NO: 6122090 - DNA, 22 bp, Homo sapiens
cgctggaatcaatttcccagaa

SEQ ID NO: 6122091 - DNA, 17 bp, Homo sapiens
cgctggacacctacagc

SEQ ID NO: 6122092 - DNA, 20 bp, Homo sapiens
cgctggacacctacagcagc

SEQ ID NO: 6122093 - DNA, 20 bp, Homo sapiens
cgctggactctcagtctctg

SEQ ID NO: 6122094 - DNA, 16 bp, Homo sapiens
cgctggagaccctgcg

SEQ ID NO: 6122095 - DNA, 18 bp, Homo sapiens
cgctggagaccctgcgcc

SEQ ID NO: 6122096 - DNA, 20 bp, Homo sapiens
cgctggagcatgagctctgt

SEQ ID NO: 6122097 - DNA, 16 bp, Homo sapiens
cgctggagcccacagc

SEQ ID NO: 6122098 - DNA, 20 bp, Homo sapiens
cgctggagcccacagcgagc

SEQ ID NO: 6122099 - DNA, 19 bp, Homo sapiens
cgctggaggatgtgggcag

SEQ ID NO: 6122100 - DNA, 21 bp, Homo sapiens
cgctggaggatgtgggcagct

SEQ ID NO: 6122101 - DNA, 12 bp, Homo sapiens
cgctggcccagc

SEQ ID NO: 6122102 - DNA, 24 bp, Homo sapiens
cgctggcccagccggcctctctgg

SEQ ID NO: 6122103 - DNA, 14 bp, Homo sapiens
cgctggcccagggt

SEQ ID NO: 6122104 - DNA, 10 bp, Homo sapiens
cgctggcccc

SEQ ID NO: 6122105 - DNA, 17 bp, Homo sapiens
cgctggcccccactggc

SEQ ID NO: 6122106 - DNA, 22 bp, Homo sapiens
cgctggcccctttgggccctgc

SEQ ID NO: 6122107 - DNA, 14 bp, Homo sapiens
cgctggccctgccg

SEQ ID NO: 6122108 - DNA, 19 bp, Homo sapiens
cgctggccgggggaggtgg

SEQ ID NO: 6122109 - DNA, 11 bp, Homo sapiens
cgctggctact

SEQ ID NO: 6122110 - DNA, 12 bp, Homo sapiens
cgctggctcagg

SEQ ID NO: 6122111 - DNA, 13 bp, Homo sapiens
cgctggctcagga

SEQ ID NO: 6122112 - DNA, 14 bp, Homo sapiens
cgctggctcaggaa

SEQ ID NO: 6122113 - DNA, 13 bp, Homo sapiens
cgctggctcccca

SEQ ID NO: 6122114 - DNA, 16 bp, Homo sapiens
cgctggctccccaaag

SEQ ID NO: 6122115 - DNA, 11 bp, Homo sapiens
cgctggctgat

SEQ ID NO: 6122116 - DNA, 14 bp, Homo sapiens
cgctggctgggggc

SEQ ID NO: 6122117 - DNA, 14 bp, Homo sapiens
cgctggcttccagc

SEQ ID NO: 6122118 - DNA, 22 bp, Homo sapiens
cgctggctttgggaaagcccag

SEQ ID NO: 6122119 - DNA, 13 bp, Homo sapiens
cgctgggacacag

SEQ ID NO: 6122120 - DNA, 23 bp, Homo sapiens
cgctgggacggcccatcttggca

SEQ ID NO: 6122121 - DNA, 20 bp, Homo sapiens
cgctgggagaaaagccagat

SEQ ID NO: 6122122 - DNA, 23 bp, Homo sapiens
cgctgggagaaaagccagatgac

SEQ ID NO: 6122123 - DNA, 18 bp, Homo sapiens
cgctgggcggtgcggagc

SEQ ID NO: 6122124 - DNA, 12 bp, Homo sapiens
cgctgggctcaa

SEQ ID NO: 6122125 - DNA, 18 bp, Homo sapiens
cgctgggcttcattccgg

SEQ ID NO: 6122126 - DNA, 21 bp, Homo sapiens
cgctgggcttcattccggact

SEQ ID NO: 6122127 - DNA, 14 bp, Homo sapiens
cgctggggaacaga

SEQ ID NO: 6122128 - DNA, 23 bp, Homo sapiens
cgctggggaacagagcgggcctc

SEQ ID NO: 6122129 - DNA, 21 bp, Homo sapiens
cgctggggaagtacgtcccag

SEQ ID NO: 6122130 - DNA, 23 bp, Homo sapiens
cgctggggaagtacgtcccagcg

SEQ ID NO: 6122131 - DNA, 22 bp, Homo sapiens
cgctggggaccggttcccacaa

SEQ ID NO: 6122132 - DNA, 20 bp, Homo sapiens
cgctggggccagttggtccc

SEQ ID NO: 6122133 - DNA, 20 bp, Homo sapiens
cgctggggctctctgagact

SEQ ID NO: 6122134 - DNA, 21 bp, Homo sapiens
cgctgggggagcctcgccccc

SEQ ID NO: 6122135 - DNA, 13 bp, Homo sapiens
cgctgggggctgg

SEQ ID NO: 6122136 - DNA, 20 bp, Homo sapiens
cgctgggggctggacctgct

SEQ ID NO: 6122137 - DNA, 12 bp, Homo sapiens
cgctgggtgcct

SEQ ID NO: 6122138 - DNA, 16 bp, Homo sapiens
cgctgggtgcctgcag

SEQ ID NO: 6122139 - DNA, 14 bp, Homo sapiens
cgctgggtggtacc

SEQ ID NO: 6122140 - DNA, 18 bp, Homo sapiens
cgctgggttctgactctg

SEQ ID NO: 6122141 - DNA, 20 bp, Homo sapiens
cgctgggttctgactctgga

SEQ ID NO: 6122142 - DNA, 22 bp, Homo sapiens
cgctgggttctgactctggacc

SEQ ID NO: 6122143 - DNA, 16 bp, Homo sapiens
cgctggtccctgccct

SEQ ID NO: 6122144 - DNA, 18 bp, Homo sapiens
cgctggtgaccctctgct

SEQ ID NO: 6122145 - DNA, 20 bp, Homo sapiens
cgctggtgcattctgtttcc

SEQ ID NO: 6122146 - DNA, 17 bp, Homo sapiens
cgctggttggaaagagt

SEQ ID NO: 6122147 - DNA, 21 bp, Homo sapiens
cgctgtaccctttaagatatc

SEQ ID NO: 6122148 - DNA, 14 bp, Homo sapiens
cgctgtatgattta

SEQ ID NO: 6122149 - DNA, 18 bp, Homo sapiens
cgctgtattttgagtttc

SEQ ID NO: 6122150 - DNA, 23 bp, Homo sapiens
cgctgtattttgagtttcagctg

SEQ ID NO: 6122151 - DNA, 21 bp, Homo sapiens
cgctgtcaaggccgagggcca

SEQ ID NO: 6122152 - DNA, 23 bp, Homo sapiens
cgctgtcaaggccgagggccagg

SEQ ID NO: 6122153 - DNA, 13 bp, Homo sapiens
cgctgtcacaggc

SEQ ID NO: 6122154 - DNA, 15 bp, Homo sapiens
cgctgtcactggctg

SEQ ID NO: 6122155 - DNA, 18 bp, Homo sapiens
cgctgtcactggctggct

SEQ ID NO: 6122156 - DNA, 23 bp, Homo sapiens
cgctgtcccccaacactgagcaa

SEQ ID NO: 6122157 - DNA, 15 bp, Homo sapiens
cgctgtcccctcagc

SEQ ID NO: 6122158 - DNA, 17 bp, Homo sapiens
cgctgtccgtcctgctc

SEQ ID NO: 6122159 - DNA, 23 bp, Homo sapiens
cgctgtcctgcgttcagcccctg

SEQ ID NO: 6122160 - DNA, 14 bp, Homo sapiens
cgctgtcctgctgt

SEQ ID NO: 6122161 - DNA, 18 bp, Homo sapiens
cgctgtcgccccaggccc

SEQ ID NO: 6122162 - DNA, 14 bp, Homo sapiens
cgctgtcggtgttt

SEQ ID NO: 6122163 - DNA, 22 bp, Homo sapiens
cgctgtcggtgtttggaggctg

SEQ ID NO: 6122164 - DNA, 16 bp, Homo sapiens
cgctgtctccagaccc

SEQ ID NO: 6122165 - DNA, 18 bp, Homo sapiens
cgctgtgaaaatgaggag

SEQ ID NO: 6122166 - DNA, 21 bp, Homo sapiens
cgctgtgaaaatgaggaggat

SEQ ID NO: 6122167 - DNA, 19 bp, Homo sapiens
cgctgtgagcccctggtcc

SEQ ID NO: 6122168 - DNA, 19 bp, Homo sapiens
cgctgtgattggcaggagg

SEQ ID NO: 6122169 - DNA, 21 bp, Homo sapiens
cgctgtgctccagcagtgctg

SEQ ID NO: 6122170 - DNA, 23 bp, Homo sapiens
cgctgtgctccagcagtgctggg

SEQ ID NO: 6122171 - DNA, 11 bp, Homo sapiens
cgctgtgctgc

SEQ ID NO: 6122172 - DNA, 13 bp, Homo sapiens
cgctgtgctgccc

SEQ ID NO: 6122173 - DNA, 19 bp, Homo sapiens
cgctgtgctgccctgccca

SEQ ID NO: 6122174 - DNA, 14 bp, Homo sapiens
cgctgtgctggttc

SEQ ID NO: 6122175 - DNA, 18 bp, Homo sapiens
cgctgtggactgtcctga

SEQ ID NO: 6122176 - DNA, 21 bp, Homo sapiens
cgctgtgtaaatgctccagca

SEQ ID NO: 6122177 - DNA, 22 bp, Homo sapiens
cgctgtgtaaatgctccagcac

SEQ ID NO: 6122178 - DNA, 14 bp, Homo sapiens
cgctgtgtccccgc

SEQ ID NO: 6122179 - DNA, 21 bp, Homo sapiens
cgctgtgttactaatgatcac

SEQ ID NO: 6122180 - DNA, 14 bp, Homo sapiens
cgctgttcacccac

SEQ ID NO: 6122181 - DNA, 22 bp, Homo sapiens
cgctgttgcccgccctccaccc

SEQ ID NO: 6122182 - DNA, 21 bp, Homo sapiens
cgctgtttttgttgtgtgtgc

SEQ ID NO: 6122183 - DNA, 23 bp, Homo sapiens
cgcttaaacatttccctgctgag

SEQ ID NO: 6122184 - DNA, 17 bp, Homo sapiens
cgcttaaggtggaaagt

SEQ ID NO: 6122185 - DNA, 23 bp, Homo sapiens
cgcttagccccgctgagcttgga

SEQ ID NO: 6122186 - DNA, 18 bp, Homo sapiens
cgcttagcctgcctcacc

SEQ ID NO: 6122187 - DNA, 17 bp, Homo sapiens
cgcttagcgctctggac

SEQ ID NO: 6122188 - DNA, 13 bp, Homo sapiens
cgcttagtgctgc

SEQ ID NO: 6122189 - DNA, 15 bp, Homo sapiens
cgcttatatgtcctt

SEQ ID NO: 6122190 - DNA, 20 bp, Homo sapiens
cgcttatcaactaatgattt

SEQ ID NO: 6122191 - DNA, 15 bp, Homo sapiens
cgcttattgcccagg

SEQ ID NO: 6122192 - DNA, 19 bp, Homo sapiens
cgcttattgcccaggctgg

SEQ ID NO: 6122193 - DNA, 13 bp, Homo sapiens
cgcttatttggaa

SEQ ID NO: 6122194 - DNA, 21 bp, Homo sapiens
cgcttatttggaaattttagt

SEQ ID NO: 6122195 - DNA, 23 bp, Homo sapiens
cgcttatttggaaattttagtta

SEQ ID NO: 6122196 - DNA, 15 bp, Homo sapiens
cgcttcacccctgca

SEQ ID NO: 6122197 - DNA, 16 bp, Homo sapiens
cgcttcacccctgcac

SEQ ID NO: 6122198 - DNA, 16 bp, Homo sapiens
cgcttcataggcagag

SEQ ID NO: 6122199 - DNA, 15 bp, Homo sapiens
cgcttccagaccacc

SEQ ID NO: 6122200 - DNA, 18 bp, Homo sapiens
cgcttccagaccacctgc

SEQ ID NO: 6122201 - DNA, 19 bp, Homo sapiens
cgcttccagaccacctgcc

SEQ ID NO: 6122202 - DNA, 21 bp, Homo sapiens
cgcttccagaccacctgccag

SEQ ID NO: 6122203 - DNA, 22 bp, Homo sapiens
cgcttccagaccacctgccagc

SEQ ID NO: 6122204 - DNA, 15 bp, Homo sapiens
cgcttcccagaggcc

SEQ ID NO: 6122205 - DNA, 13 bp, Homo sapiens
cgcttccccacag

SEQ ID NO: 6122206 - DNA, 13 bp, Homo sapiens
cgcttccccagct

SEQ ID NO: 6122207 - DNA, 15 bp, Homo sapiens
cgcttccccagctca

SEQ ID NO: 6122208 - DNA, 16 bp, Homo sapiens
cgcttcccccatagcc

SEQ ID NO: 6122209 - DNA, 18 bp, Homo sapiens
cgcttcccccatagccac

SEQ ID NO: 6122210 - DNA, 22 bp, Homo sapiens
cgcttccctggttcaagcgatt

SEQ ID NO: 6122211 - DNA, 14 bp, Homo sapiens
cgcttcctcagcct

SEQ ID NO: 6122212 - DNA, 12 bp, Homo sapiens
cgcttcctggcc

SEQ ID NO: 6122213 - DNA, 14 bp, Homo sapiens
cgcttcctggcctc

SEQ ID NO: 6122214 - DNA, 15 bp, Homo sapiens
cgcttcctggcctcc

SEQ ID NO: 6122215 - DNA, 16 bp, Homo sapiens
cgcttcctggcctccc

SEQ ID NO: 6122216 - DNA, 17 bp, Homo sapiens
cgcttcctggcctccct

SEQ ID NO: 6122217 - DNA, 16 bp, Homo sapiens
cgcttcgacttttctt

SEQ ID NO: 6122218 - DNA, 22 bp, Homo sapiens
cgcttcgccatgtgctgtgcac

SEQ ID NO: 6122219 - DNA, 16 bp, Homo sapiens
cgcttcgggaaaatat

SEQ ID NO: 6122220 - DNA, 19 bp, Homo sapiens
cgcttctccaatgctctgg

SEQ ID NO: 6122221 - DNA, 21 bp, Homo sapiens
cgcttctccaatgctctggag

SEQ ID NO: 6122222 - DNA, 23 bp, Homo sapiens
cgcttctgaagctgctgcagctc

SEQ ID NO: 6122223 - DNA, 17 bp, Homo sapiens
cgcttctgagcaggggc

SEQ ID NO: 6122224 - DNA, 15 bp, Homo sapiens
cgcttctgccttttc

SEQ ID NO: 6122225 - DNA, 13 bp, Homo sapiens
cgcttctgctgga

SEQ ID NO: 6122226 - DNA, 20 bp, Homo sapiens
cgcttctgtgtatctctttc

SEQ ID NO: 6122227 - DNA, 17 bp, Homo sapiens
cgcttcttgcctctgtg

SEQ ID NO: 6122228 - DNA, 21 bp, Homo sapiens
cgcttgaacctgggaggcaga

SEQ ID NO: 6122229 - DNA, 16 bp, Homo sapiens
cgcttgaagcctgaac

SEQ ID NO: 6122230 - DNA, 18 bp, Homo sapiens
cgcttgagcccaggagtt

SEQ ID NO: 6122231 - DNA, 17 bp, Homo sapiens
cgcttgccactagggct

SEQ ID NO: 6122232 - DNA, 20 bp, Homo sapiens
cgcttgccgggcctgggcct

SEQ ID NO: 6122233 - DNA, 14 bp, Homo sapiens
cgcttgcctcggct

SEQ ID NO: 6122234 - DNA, 21 bp, Homo sapiens
cgcttgcctggtcaccctggg

SEQ ID NO: 6122235 - DNA, 17 bp, Homo sapiens
cgcttgctcgcttgctg

SEQ ID NO: 6122236 - DNA, 20 bp, Homo sapiens
cgcttgctcgcttgctggaa

SEQ ID NO: 6122237 - DNA, 20 bp, Homo sapiens
ctcattgtaaccatttctca

SEQ ID NO: 6122238 - DNA, 20 bp, Homo sapiens
ctcattgtagagcacattta

SEQ ID NO: 6122239 - DNA, 21 bp, Homo sapiens
ctcattgtagagcacatttag

SEQ ID NO: 6122240 - DNA, 12 bp, Homo sapiens
ctcattgtctca

SEQ ID NO: 6122241 - DNA, 19 bp, Homo sapiens
ctcattgtctcagtgctgg

SEQ ID NO: 6122242 - DNA, 13 bp, Homo sapiens
ctcattgtcttgt

SEQ ID NO: 6122243 - DNA, 13 bp, Homo sapiens
ctcattgtgccaa

SEQ ID NO: 6122244 - DNA, 17 bp, Homo sapiens
ctcattgtgccaagcct

SEQ ID NO: 6122245 - DNA, 15 bp, Homo sapiens
ctcattgtgtctccc

SEQ ID NO: 6122246 - DNA, 15 bp, Homo sapiens
ctcattgttcagaaa

SEQ ID NO: 6122247 - DNA, 22 bp, Homo sapiens
ctcattgttcagaaaagcacct

SEQ ID NO: 6122248 - DNA, 21 bp, Homo sapiens
ctcatttaaagctaaattttg

SEQ ID NO: 6122249 - DNA, 19 bp, Homo sapiens
ctcatttaaagtattttat

SEQ ID NO: 6122250 - DNA, 14 bp, Homo sapiens
ctcatttaaatatc

SEQ ID NO: 6122251 - DNA, 21 bp, Homo sapiens
ctcatttaatatttttcaaaa

SEQ ID NO: 6122252 - DNA, 16 bp, Homo sapiens
ctcatttaatttgtta

SEQ ID NO: 6122253 - DNA, 22 bp, Homo sapiens
ctcatttagcattgaaataata

SEQ ID NO: 6122254 - DNA, 14 bp, Homo sapiens
ctcatttagcctgt

SEQ ID NO: 6122255 - DNA, 22 bp, Homo sapiens
ctcatttcacccctccctttct

SEQ ID NO: 6122256 - DNA, 16 bp, Homo sapiens
ctcatttcaggagcag

SEQ ID NO: 6122257 - DNA, 15 bp, Homo sapiens
ctcatttcatctcat

SEQ ID NO: 6122258 - DNA, 19 bp, Homo sapiens
ctcatttccaaaccatcag

SEQ ID NO: 6122259 - DNA, 21 bp, Homo sapiens
ctcatttccaaaccatcagct

SEQ ID NO: 6122260 - DNA, 12 bp, Homo sapiens
ctcatttccaag

SEQ ID NO: 6122261 - DNA, 17 bp, Homo sapiens
ctcatttccaagcaagt

SEQ ID NO: 6122262 - DNA, 15 bp, Homo sapiens
ctcatttccagcttc

SEQ ID NO: 6122263 - DNA, 18 bp, Homo sapiens
ctcatttccagcttctca

SEQ ID NO: 6122264 - DNA, 23 bp, Homo sapiens
ctcatttccataccattgtggaa

SEQ ID NO: 6122265 - DNA, 17 bp, Homo sapiens
ctcatttctcaacagtt

SEQ ID NO: 6122266 - DNA, 13 bp, Homo sapiens
ctcatttctcagg

SEQ ID NO: 6122267 - DNA, 15 bp, Homo sapiens
ctcatttctgccagc

SEQ ID NO: 6122268 - DNA, 19 bp, Homo sapiens
ctcatttcttcctctgcat

SEQ ID NO: 6122269 - DNA, 13 bp, Homo sapiens
ctcatttctttct

SEQ ID NO: 6122270 - DNA, 19 bp, Homo sapiens
ctcatttgagataaagtca

SEQ ID NO: 6122271 - DNA, 18 bp, Homo sapiens
ctcatttgatattgtgta

SEQ ID NO: 6122272 - DNA, 15 bp, Homo sapiens
ctcatttgcatccta

SEQ ID NO: 6122273 - DNA, 20 bp, Homo sapiens
ctcatttgcttttgtcacta

SEQ ID NO: 6122274 - DNA, 18 bp, Homo sapiens
ctcatttggggaccacag

SEQ ID NO: 6122275 - DNA, 21 bp, Homo sapiens
ctcatttggggaccacagagg

SEQ ID NO: 6122276 - DNA, 14 bp, Homo sapiens
ctcatttgggggcg

SEQ ID NO: 6122277 - DNA, 15 bp, Homo sapiens
ctcatttgggggcgt

SEQ ID NO: 6122278 - DNA, 20 bp, Homo sapiens
ctcatttggtctgccagaat

SEQ ID NO: 6122279 - DNA, 22 bp, Homo sapiens
ctcatttggtttgattttccct

SEQ ID NO: 6122280 - DNA, 18 bp, Homo sapiens
ctcatttgtcacacactt

SEQ ID NO: 6122281 - DNA, 14 bp, Homo sapiens
ctcattttaaacaa

SEQ ID NO: 6122282 - DNA, 15 bp, Homo sapiens
ctcattttaaacaac

SEQ ID NO: 6122283 - DNA, 18 bp, Homo sapiens
ctcattttaatgattgtt

SEQ ID NO: 6122284 - DNA, 21 bp, Homo sapiens
ctcattttaatgattgtttaa

SEQ ID NO: 6122285 - DNA, 15 bp, Homo sapiens
ctcattttaatgtaa

SEQ ID NO: 6122286 - DNA, 21 bp, Homo sapiens
ctcattttaatgtaaagattt

SEQ ID NO: 6122287 - DNA, 16 bp, Homo sapiens
ctcattttactaaaat

SEQ ID NO: 6122288 - DNA, 12 bp, Homo sapiens
ctcattttattc

SEQ ID NO: 6122289 - DNA, 20 bp, Homo sapiens
ctcattttatttacagctgt

SEQ ID NO: 6122290 - DNA, 18 bp, Homo sapiens
ctcattttcaatgcacat

SEQ ID NO: 6122291 - DNA, 20 bp, Homo sapiens
ctcattttctacgtcatgta

SEQ ID NO: 6122292 - DNA, 20 bp, Homo sapiens
ctcattttgacaaagtgcct

SEQ ID NO: 6122293 - DNA, 21 bp, Homo sapiens
ctcattttgacaaagtgcctc

SEQ ID NO: 6122294 - DNA, 19 bp, Homo sapiens
ctcattttgcaattttatc

SEQ ID NO: 6122295 - DNA, 19 bp, Homo sapiens
ctcattttgggggtcatct

SEQ ID NO: 6122296 - DNA, 12 bp, Homo sapiens
ctcattttggtt

SEQ ID NO: 6122297 - DNA, 15 bp, Homo sapiens
ctcattttgtatgta

SEQ ID NO: 6122298 - DNA, 20 bp, Homo sapiens
ctcattttgtatgtatgtgt

SEQ ID NO: 6122299 - DNA, 13 bp, Homo sapiens
ctcatttttcata

SEQ ID NO: 6122300 - DNA, 20 bp, Homo sapiens
ctcatttttcatactgaaaa

SEQ ID NO: 6122301 - DNA, 14 bp, Homo sapiens
ctcatttttcatta

SEQ ID NO: 6122302 - DNA, 17 bp, Homo sapiens
ctcatttttcattagat

SEQ ID NO: 6122303 - DNA, 22 bp, Homo sapiens
ctcatttttccgtaaaaatgat

SEQ ID NO: 6122304 - DNA, 15 bp, Homo sapiens
ctcatttttccttta

SEQ ID NO: 6122305 - DNA, 14 bp, Homo sapiens
ctcatttttgcact

SEQ ID NO: 6122306 - DNA, 13 bp, Homo sapiens
ctcattttttcct

SEQ ID NO: 6122307 - DNA, 13 bp, Homo sapiens
ctccaaaaaagaa

SEQ ID NO: 6122308 - DNA, 14 bp, Homo sapiens
ctccaaaaaagaaa

SEQ ID NO: 6122309 - DNA, 19 bp, Homo sapiens
ctccaaaaagaaaagtgtt

SEQ ID NO: 6122310 - DNA, 18 bp, Homo sapiens
ctccaaaaatctgcctgg

SEQ ID NO: 6122311 - DNA, 20 bp, Homo sapiens
ctccaaaaatctgcctgggt

SEQ ID NO: 6122312 - DNA, 21 bp, Homo sapiens
ctccaaaaatctgcctgggtt

SEQ ID NO: 6122313 - DNA, 12 bp, Homo sapiens
ctccaaaacaca

SEQ ID NO: 6122314 - DNA, 17 bp, Homo sapiens
ctccaaaacatttctaa

SEQ ID NO: 6122315 - DNA, 18 bp, Homo sapiens
ctccaaaacatttctaag

SEQ ID NO: 6122316 - DNA, 17 bp, Homo sapiens
ctccaaaacccatgtgg

SEQ ID NO: 6122317 - DNA, 16 bp, Homo sapiens
ctccaaaagcacttac

SEQ ID NO: 6122318 - DNA, 16 bp, Homo sapiens
ctccaaaataaaactt

SEQ ID NO: 6122319 - DNA, 16 bp, Homo sapiens
ctccaaaatattaaca

SEQ ID NO: 6122320 - DNA, 16 bp, Homo sapiens
ctccaaaatctggctt

SEQ ID NO: 6122321 - DNA, 22 bp, Homo sapiens
ctccaaaatgttggtcatttta

SEQ ID NO: 6122322 - DNA, 23 bp, Homo sapiens
ctccaaacactgggctctgagga

SEQ ID NO: 6122323 - DNA, 22 bp, Homo sapiens
ctccaaaccactttttgcagct

SEQ ID NO: 6122324 - DNA, 20 bp, Homo sapiens
ctccaaaccagacggtgacg

SEQ ID NO: 6122325 - DNA, 19 bp, Homo sapiens
ctccaaaccttactctgag

SEQ ID NO: 6122326 - DNA, 14 bp, Homo sapiens
ctccaaaccttcac

SEQ ID NO: 6122327 - DNA, 16 bp, Homo sapiens
ctccaaactaaaccct

SEQ ID NO: 6122328 - DNA, 13 bp, Homo sapiens
ctccaaactcctg

SEQ ID NO: 6122329 - DNA, 15 bp, Homo sapiens
ctccaaactcctgcc

SEQ ID NO: 6122330 - DNA, 23 bp, Homo sapiens
ctccaaactcgcttaggtagaaa

SEQ ID NO: 6122331 - DNA, 22 bp, Homo sapiens
ctccaaactgaagcagcctctc

SEQ ID NO: 6122332 - DNA, 23 bp, Homo sapiens
ctccaaactgaagcagcctctcc

SEQ ID NO: 6122333 - DNA, 14 bp, Homo sapiens
ctccaaactgatta

SEQ ID NO: 6122334 - DNA, 20 bp, Homo sapiens
ctccaaagagccttcagaat

SEQ ID NO: 6122335 - DNA, 15 bp, Homo sapiens
ctccaaagatgactt

SEQ ID NO: 6122336 - DNA, 18 bp, Homo sapiens
ctccaaagatgacttccc

SEQ ID NO: 6122337 - DNA, 17 bp, Homo sapiens
ctccaaaggcactgacc

SEQ ID NO: 6122338 - DNA, 14 bp, Homo sapiens
ctccaaaggccccc

SEQ ID NO: 6122339 - DNA, 15 bp, Homo sapiens
ctccaaaggccccct

SEQ ID NO: 6122340 - DNA, 20 bp, Homo sapiens
ctccaaaggccctaccagag

SEQ ID NO: 6122341 - DNA, 14 bp, Homo sapiens
ctccaaaggggctg

SEQ ID NO: 6122342 - DNA, 18 bp, Homo sapiens
ctccaaaggggctgctgg

SEQ ID NO: 6122343 - DNA, 19 bp, Homo sapiens
ctccaaaggggctgctggg

SEQ ID NO: 6122344 - DNA, 19 bp, Homo sapiens
ctccaaagtcataattgca

SEQ ID NO: 6122345 - DNA, 12 bp, Homo sapiens
ctccaaagtcca

SEQ ID NO: 6122346 - DNA, 18 bp, Homo sapiens
ctccaaagtggagctggg

SEQ ID NO: 6122347 - DNA, 19 bp, Homo sapiens
ctccaaagtggagctggga

SEQ ID NO: 6122348 - DNA, 14 bp, Homo sapiens
ctccaaatcaagga

SEQ ID NO: 6122349 - DNA, 23 bp, Homo sapiens
ctccaaatctcaatgaagccagc

SEQ ID NO: 6122350 - DNA, 15 bp, Homo sapiens
ctccaaatctgattt

SEQ ID NO: 6122351 - DNA, 21 bp, Homo sapiens
ctccaaatgtcctttctcaga

SEQ ID NO: 6122352 - DNA, 23 bp, Homo sapiens
ctccaaatgtcctttctcagagg

SEQ ID NO: 6122353 - DNA, 13 bp, Homo sapiens
ctccaaatttaac

SEQ ID NO: 6122354 - DNA, 12 bp, Homo sapiens
ctccaacaataa

SEQ ID NO: 6122355 - DNA, 21 bp, Homo sapiens
ctccaacacaaggctccaaga

SEQ ID NO: 6122356 - DNA, 16 bp, Homo sapiens
ctccaacaccaagcac

SEQ ID NO: 6122357 - DNA, 18 bp, Homo sapiens
ctccaacaccaagcacag

SEQ ID NO: 6122358 - DNA, 16 bp, Homo sapiens
ctccaacagacaccct

SEQ ID NO: 6122359 - DNA, 17 bp, Homo sapiens
ctccaacagacaccctc

SEQ ID NO: 6122360 - DNA, 14 bp, Homo sapiens
ctccaacagagtgg

SEQ ID NO: 6122361 - DNA, 14 bp, Homo sapiens
ctccaacagcttga

SEQ ID NO: 6122362 - DNA, 18 bp, Homo sapiens
ctccaaccaaataagact

SEQ ID NO: 6122363 - DNA, 22 bp, Homo sapiens
ctccaaccaaataagacttcca

SEQ ID NO: 6122364 - DNA, 18 bp, Homo sapiens
ctccaaccactgtgccac

SEQ ID NO: 6122365 - DNA, 19 bp, Homo sapiens
ctccaaccactgtgccact

SEQ ID NO: 6122366 - DNA, 21 bp, Homo sapiens
ctccaaccactgtgccactga

SEQ ID NO: 6122367 - DNA, 22 bp, Homo sapiens
ctccaaccccccagcactgagg

SEQ ID NO: 6122368 - DNA, 22 bp, Homo sapiens
ctccaacccccgccacctcagg

SEQ ID NO: 6122369 - DNA, 23 bp, Homo sapiens
ctccaacccgttgggtcccttgc

SEQ ID NO: 6122370 - DNA, 23 bp, Homo sapiens
ctccaaccctgccgtcaccacca

SEQ ID NO: 6122371 - DNA, 19 bp, Homo sapiens
ctccaaccgggatgggagc

SEQ ID NO: 6122372 - DNA, 22 bp, Homo sapiens
ctccaaccgggatgggagccgg

SEQ ID NO: 6122373 - DNA, 15 bp, Homo sapiens
ctccaacctaacctg

SEQ ID NO: 6122374 - DNA, 20 bp, Homo sapiens
ctccaacctaacctgtgtct

SEQ ID NO: 6122375 - DNA, 13 bp, Homo sapiens
ctccaacctctcg

SEQ ID NO: 6122376 - DNA, 15 bp, Homo sapiens
ctccaacctgaaggt

SEQ ID NO: 6122377 - DNA, 13 bp, Homo sapiens
ctccaacctgcaa

SEQ ID NO: 6122378 - DNA, 21 bp, Homo sapiens
ctccaacctgcaaagatctgt

SEQ ID NO: 6122379 - DNA, 15 bp, Homo sapiens
ctccaacctggaggc

SEQ ID NO: 6122380 - DNA, 19 bp, Homo sapiens
ctccaaccttctgccctcc

SEQ ID NO: 6122381 - DNA, 20 bp, Homo sapiens
ctccaaccttctgccctcct

SEQ ID NO: 6122382 - DNA, 17 bp, Homo sapiens
ctccaacgcccctgtgg

SEQ ID NO: 6122383 - DNA, 21 bp, Homo sapiens
ctccaacgcccctgtggccaa

SEQ ID NO: 6122384 - DNA, 22 bp, Homo sapiens
ctccaacgcccctgtggccaac

SEQ ID NO: 6122385 - DNA, 21 bp, Homo sapiens
ctccaactccagctgagtcct

SEQ ID NO: 6122386 - DNA, 19 bp, Homo sapiens
ctccaacttagtgtctcta

SEQ ID NO: 6122387 - DNA, 22 bp, Homo sapiens
ctccaacttagtgtctctattt

SEQ ID NO: 6122388 - DNA, 12 bp, Homo sapiens
ctccaagaaact

SEQ ID NO: 6122389 - DNA, 14 bp, Homo sapiens
ctccaagaagccct

SEQ ID NO: 6122390 - DNA, 16 bp, Homo sapiens
ctccaagaagccctcc

SEQ ID NO: 6122391 - DNA, 23 bp, Homo sapiens
ctccaagaagccctccttgccac

SEQ ID NO: 6122392 - DNA, 14 bp, Homo sapiens
ctccaagaatgctg

SEQ ID NO: 6122393 - DNA, 20 bp, Homo sapiens
ctccaagaatgctgaaacca

SEQ ID NO: 6122394 - DNA, 19 bp, Homo sapiens
ctccaagaatggaagcctg

SEQ ID NO: 6122395 - DNA, 23 bp, Homo sapiens
ctccaagaatggaagcctgaact

SEQ ID NO: 6122396 - DNA, 16 bp, Homo sapiens
ctccaagaatgttttg

SEQ ID NO: 6122397 - DNA, 14 bp, Homo sapiens
ctccaagaatttct

SEQ ID NO: 6122398 - DNA, 15 bp, Homo sapiens
ctccaagacagcagc

SEQ ID NO: 6122399 - DNA, 18 bp, Homo sapiens
ctccaagacagcagcagc

SEQ ID NO: 6122400 - DNA, 22 bp, Homo sapiens
ctccaagacagcagcagcctgc

SEQ ID NO: 6122401 - DNA, 16 bp, Homo sapiens
ctccaagacctaggct

SEQ ID NO: 6122402 - DNA, 15 bp, Homo sapiens
ctccaagaccttctc

SEQ ID NO: 6122403 - DNA, 18 bp, Homo sapiens
ctccaagaccttctcctt

SEQ ID NO: 6122404 - DNA, 20 bp, Homo sapiens
ctccaagaggctccctcctg

SEQ ID NO: 6122405 - DNA, 21 bp, Homo sapiens
ctccaagaggctccctcctgt

SEQ ID NO: 6122406 - DNA, 14 bp, Homo sapiens
ctccaagaggctgg

SEQ ID NO: 6122407 - DNA, 22 bp, Homo sapiens
ctccaagataagcctgagcctt

SEQ ID NO: 6122408 - DNA, 23 bp, Homo sapiens
ctccaagataagcctgagcctta

SEQ ID NO: 6122409 - DNA, 23 bp, Homo sapiens
ctccaagcaagtagctttccaca

SEQ ID NO: 6122410 - DNA, 19 bp, Homo sapiens
ctccaagcacagagcctgg

SEQ ID NO: 6122411 - DNA, 13 bp, Homo sapiens
ctccaagcagact

SEQ ID NO: 6122412 - DNA, 14 bp, Homo sapiens
ctccaagcagactc

SEQ ID NO: 6122413 - DNA, 16 bp, Homo sapiens
ctccaagcagactcca

SEQ ID NO: 6122414 - DNA, 18 bp, Homo sapiens
cgcttgctctcctggagc

SEQ ID NO: 6122415 - DNA, 18 bp, Homo sapiens
cgcttgctggaacacagg

SEQ ID NO: 6122416 - DNA, 22 bp, Homo sapiens
cgcttgctggaacacaggggcc

SEQ ID NO: 6122417 - DNA, 22 bp, Homo sapiens
cgcttgcttctgcagcaactcc

SEQ ID NO: 6122418 - DNA, 12 bp, Homo sapiens
cgcttggctcca

SEQ ID NO: 6122419 - DNA, 16 bp, Homo sapiens
cgcttggctccatgct

SEQ ID NO: 6122420 - DNA, 20 bp, Homo sapiens
cgcttgggaggggccggagg

SEQ ID NO: 6122421 - DNA, 20 bp, Homo sapiens
cgcttgtagaactcactctg

SEQ ID NO: 6122422 - DNA, 21 bp, Homo sapiens
cgcttgtagaactcactctgg

SEQ ID NO: 6122423 - DNA, 17 bp, Homo sapiens
cgcttgtgcagaaaaca

SEQ ID NO: 6122424 - DNA, 19 bp, Homo sapiens
cgcttgtggggacccaggc

SEQ ID NO: 6122425 - DNA, 14 bp, Homo sapiens
cgcttgttttaaaa

SEQ ID NO: 6122426 - DNA, 22 bp, Homo sapiens
cgctttattgcccatgggatat

SEQ ID NO: 6122427 - DNA, 20 bp, Homo sapiens
cgctttcatgaacacagcct

SEQ ID NO: 6122428 - DNA, 15 bp, Homo sapiens
cgctttcccctcctc

SEQ ID NO: 6122429 - DNA, 14 bp, Homo sapiens
cgctttcctgaatc

SEQ ID NO: 6122430 - DNA, 14 bp, Homo sapiens
cgctttcctggagc

SEQ ID NO: 6122431 - DNA, 21 bp, Homo sapiens
cgctttccttcctcccctttt

SEQ ID NO: 6122432 - DNA, 14 bp, Homo sapiens
cgctttctacccag

SEQ ID NO: 6122433 - DNA, 16 bp, Homo sapiens
cgctttctagctgttg

SEQ ID NO: 6122434 - DNA, 13 bp, Homo sapiens
cgctttctcagtg

SEQ ID NO: 6122435 - DNA, 14 bp, Homo sapiens
cgctttctcagtgt

SEQ ID NO: 6122436 - DNA, 10 bp, Homo sapiens
cgctttctcc

SEQ ID NO: 6122437 - DNA, 14 bp, Homo sapiens
cgctttgaaagaag

SEQ ID NO: 6122438 - DNA, 16 bp, Homo sapiens
cgctttgaacgtgcca

SEQ ID NO: 6122439 - DNA, 22 bp, Homo sapiens
cgctttgaacgtgccagcagcc

SEQ ID NO: 6122440 - DNA, 11 bp, Homo sapiens
cgctttggcct

SEQ ID NO: 6122441 - DNA, 15 bp, Homo sapiens
cgctttggcctgagt

SEQ ID NO: 6122442 - DNA, 15 bp, Homo sapiens
cgctttgtctgtcca

SEQ ID NO: 6122443 - DNA, 17 bp, Homo sapiens
cgctttgtctgtccagc

SEQ ID NO: 6122444 - DNA, 16 bp, Homo sapiens
cgcttttccttggcat

SEQ ID NO: 6122445 - DNA, 22 bp, Homo sapiens
cgcttttccttggcattccgca

SEQ ID NO: 6122446 - DNA, 19 bp, Homo sapiens
cgcttttgctggtcactgc

SEQ ID NO: 6122447 - DNA, 15 bp, Homo sapiens
cgcttttggtgcctg

SEQ ID NO: 6122448 - DNA, 18 bp, Homo sapiens
cggaaaaaaaaaaagaaa

SEQ ID NO: 6122449 - DNA, 15 bp, Homo sapiens
cggaaaacatgctac

SEQ ID NO: 6122450 - DNA, 20 bp, Homo sapiens
cggaaaagcgtctttaagag

SEQ ID NO: 6122451 - DNA, 20 bp, Homo sapiens
cggaaaaggttttattttgt

SEQ ID NO: 6122452 - DNA, 17 bp, Homo sapiens
cggaaaccttggtgtag

SEQ ID NO: 6122453 - DNA, 16 bp, Homo sapiens
cggaaagactgaaaga

SEQ ID NO: 6122454 - DNA, 13 bp, Homo sapiens
cggaaagctcttc

SEQ ID NO: 6122455 - DNA, 21 bp, Homo sapiens
cggaaaggtatttgggaaact

SEQ ID NO: 6122456 - DNA, 20 bp, Homo sapiens
cggaaagtgaagagtcagaa

SEQ ID NO: 6122457 - DNA, 13 bp, Homo sapiens
cggaaagtgagag

SEQ ID NO: 6122458 - DNA, 22 bp, Homo sapiens
cggaaagtgagagccagcagca

SEQ ID NO: 6122459 - DNA, 13 bp, Homo sapiens
cggaaattaaagt

SEQ ID NO: 6122460 - DNA, 16 bp, Homo sapiens
cggaacagccaaagaa

SEQ ID NO: 6122461 - DNA, 15 bp, Homo sapiens
cggaaccacagggcc

SEQ ID NO: 6122462 - DNA, 21 bp, Homo sapiens
cggaaccacagggccagaggg

SEQ ID NO: 6122463 - DNA, 14 bp, Homo sapiens
cggaacctggctgc

SEQ ID NO: 6122464 - DNA, 18 bp, Homo sapiens
cggaacctgtgagctgca

SEQ ID NO: 6122465 - DNA, 16 bp, Homo sapiens
cggaacgttggacttt

SEQ ID NO: 6122466 - DNA, 12 bp, Homo sapiens
cggaactgggct

SEQ ID NO: 6122467 - DNA, 13 bp, Homo sapiens
cggaactgggctg

SEQ ID NO: 6122468 - DNA, 18 bp, Homo sapiens
cggaagagagggctgagc

SEQ ID NO: 6122469 - DNA, 20 bp, Homo sapiens
cggaagagagggctgagcca

SEQ ID NO: 6122470 - DNA, 17 bp, Homo sapiens
cggaagccaaaggcagc

SEQ ID NO: 6122471 - DNA, 14 bp, Homo sapiens
cggaagccacaggg

SEQ ID NO: 6122472 - DNA, 22 bp, Homo sapiens
cggaagccgtctgactccagag

SEQ ID NO: 6122473 - DNA, 20 bp, Homo sapiens
cggaagcctttttccccaaa

SEQ ID NO: 6122474 - DNA, 20 bp, Homo sapiens
cggaaggacacagtcagggg

SEQ ID NO: 6122475 - DNA, 18 bp, Homo sapiens
cggaaggacctatgtttg

SEQ ID NO: 6122476 - DNA, 21 bp, Homo sapiens
cggaaggacgcggaacctggg

SEQ ID NO: 6122477 - DNA, 22 bp, Homo sapiens
cggaaggaggccaaccagcccg

SEQ ID NO: 6122478 - DNA, 16 bp, Homo sapiens
cggaagggactctggg

SEQ ID NO: 6122479 - DNA, 17 bp, Homo sapiens
cggaagggactctgggc

SEQ ID NO: 6122480 - DNA, 21 bp, Homo sapiens
cggaagggctttggttccttc

SEQ ID NO: 6122481 - DNA, 20 bp, Homo sapiens
cggaaggggcgctcctccca

SEQ ID NO: 6122482 - DNA, 19 bp, Homo sapiens
cggaagggtaaacaatata

SEQ ID NO: 6122483 - DNA, 14 bp, Homo sapiens
cggaagtctgttct

SEQ ID NO: 6122484 - DNA, 16 bp, Homo sapiens
cggaagtctgttctca

SEQ ID NO: 6122485 - DNA, 15 bp, Homo sapiens
cggaagtggtgggga

SEQ ID NO: 6122486 - DNA, 13 bp, Homo sapiens
cggaagttttcaa

SEQ ID NO: 6122487 - DNA, 16 bp, Homo sapiens
cggaatagttggctag

SEQ ID NO: 6122488 - DNA, 13 bp, Homo sapiens
cggaatatatttt

SEQ ID NO: 6122489 - DNA, 15 bp, Homo sapiens
cggaatcctgtcctc

SEQ ID NO: 6122490 - DNA, 11 bp, Homo sapiens
cggaatgaact

SEQ ID NO: 6122491 - DNA, 14 bp, Homo sapiens
cggaatggtcaaat

SEQ ID NO: 6122492 - DNA, 16 bp, Homo sapiens
cggaatgttacaatgg

SEQ ID NO: 6122493 - DNA, 19 bp, Homo sapiens
cggaattcaccagtgttcc

SEQ ID NO: 6122494 - DNA, 16 bp, Homo sapiens
cggaattccaatattt

SEQ ID NO: 6122495 - DNA, 16 bp, Homo sapiens
cggaattgagaggtgg

SEQ ID NO: 6122496 - DNA, 21 bp, Homo sapiens
cggaatttttaaaataaactg

SEQ ID NO: 6122497 - DNA, 23 bp, Homo sapiens
cggaatttttaaaataaactgta

SEQ ID NO: 6122498 - DNA, 13 bp, Homo sapiens
cggacaaagttca

SEQ ID NO: 6122499 - DNA, 18 bp, Homo sapiens
cggacaaagttcagtgtc

SEQ ID NO: 6122500 - DNA, 20 bp, Homo sapiens
cggacaagacccccagcact

SEQ ID NO: 6122501 - DNA, 20 bp, Homo sapiens
cggacaataaacctccgcca

SEQ ID NO: 6122502 - DNA, 18 bp, Homo sapiens
cggacaccgtggcctggg

SEQ ID NO: 6122503 - DNA, 15 bp, Homo sapiens
cggacacggcttcac

SEQ ID NO: 6122504 - DNA, 23 bp, Homo sapiens
cggacacggcttcactgaccagc

SEQ ID NO: 6122505 - DNA, 14 bp, Homo sapiens
cggacactcctaga

SEQ ID NO: 6122506 - DNA, 15 bp, Homo sapiens
cggacactcctagag

SEQ ID NO: 6122507 - DNA, 16 bp, Homo sapiens
cggacactcctagaga

SEQ ID NO: 6122508 - DNA, 19 bp, Homo sapiens
cggacacttctcaggaaat

SEQ ID NO: 6122509 - DNA, 20 bp, Homo sapiens
cggacagaggggctgttagg

SEQ ID NO: 6122510 - DNA, 12 bp, Homo sapiens
cggacagagtgg

SEQ ID NO: 6122511 - DNA, 16 bp, Homo sapiens
cggacagccacggcca

SEQ ID NO: 6122512 - DNA, 20 bp, Homo sapiens
cggacagccacggccaggcc

SEQ ID NO: 6122513 - DNA, 13 bp, Homo sapiens
cggacagctgccc

SEQ ID NO: 6122514 - DNA, 14 bp, Homo sapiens
cggacagctgccca

SEQ ID NO: 6122515 - DNA, 13 bp, Homo sapiens
cggacaggaggat

SEQ ID NO: 6122516 - DNA, 20 bp, Homo sapiens
cggacagggtggcacccacc

SEQ ID NO: 6122517 - DNA, 22 bp, Homo sapiens
cggacagtccgcagttgtagca

SEQ ID NO: 6122518 - DNA, 17 bp, Homo sapiens
cggacagtcggaaaagc

SEQ ID NO: 6122519 - DNA, 17 bp, Homo sapiens
cggacatactctctgcc

SEQ ID NO: 6122520 - DNA, 16 bp, Homo sapiens
cggacattctaatgca

SEQ ID NO: 6122521 - DNA, 23 bp, Homo sapiens
cggaccaaagggagtctgccagg

SEQ ID NO: 6122522 - DNA, 15 bp, Homo sapiens
cggaccaagatgggc

SEQ ID NO: 6122523 - DNA, 12 bp, Homo sapiens
cggaccatcttt

SEQ ID NO: 6122524 - DNA, 12 bp, Homo sapiens
cggacccacccc

SEQ ID NO: 6122525 - DNA, 20 bp, Homo sapiens
cggacccaccccaactctcc

SEQ ID NO: 6122526 - DNA, 21 bp, Homo sapiens
cggacccaccccaactctccc

SEQ ID NO: 6122527 - DNA, 22 bp, Homo sapiens
cggacccaccccaactctcccc

SEQ ID NO: 6122528 - DNA, 24 bp, Homo sapiens
cggacccaccccaactctccccag

SEQ ID NO: 6122529 - DNA, 17 bp, Homo sapiens
cggaccccactccggcc

SEQ ID NO: 6122530 - DNA, 21 bp, Homo sapiens
cggaccccactccggccctcc

SEQ ID NO: 6122531 - DNA, 15 bp, Homo sapiens
cggaccccagccatc

SEQ ID NO: 6122532 - DNA, 12 bp, Homo sapiens
cggaccccagct

SEQ ID NO: 6122533 - DNA, 14 bp, Homo sapiens
cggaccccagctgt

SEQ ID NO: 6122534 - DNA, 16 bp, Homo sapiens
cggaccctctaacctc

SEQ ID NO: 6122535 - DNA, 19 bp, Homo sapiens
cggacccttctgggtccag

SEQ ID NO: 6122536 - DNA, 16 bp, Homo sapiens
cggaccgaaggtgaca

SEQ ID NO: 6122537 - DNA, 17 bp, Homo sapiens
cggaccgcgtagagagc

SEQ ID NO: 6122538 - DNA, 22 bp, Homo sapiens
cggaccgcttgtggggacccag

SEQ ID NO: 6122539 - DNA, 23 bp, Homo sapiens
cggaccgcttgtggggacccagg

SEQ ID NO: 6122540 - DNA, 15 bp, Homo sapiens
cggaccggagcggct

SEQ ID NO: 6122541 - DNA, 18 bp, Homo sapiens
cggaccggagcggctgag

SEQ ID NO: 6122542 - DNA, 16 bp, Homo sapiens
cggacctacctccctc

SEQ ID NO: 6122543 - DNA, 17 bp, Homo sapiens
cggacctacctccctcc

SEQ ID NO: 6122544 - DNA, 23 bp, Homo sapiens
cggacgacgcgagggccccacgt

SEQ ID NO: 6122545 - DNA, 14 bp, Homo sapiens
cggacgccccccgg

SEQ ID NO: 6122546 - DNA, 13 bp, Homo sapiens
cggacgctggctc

SEQ ID NO: 6122547 - DNA, 14 bp, Homo sapiens
cggacgctggctcc

SEQ ID NO: 6122548 - DNA, 22 bp, Homo sapiens
cggacggccaatggtgcttccc

SEQ ID NO: 6122549 - DNA, 18 bp, Homo sapiens
cggacggggcaggcgctg

SEQ ID NO: 6122550 - DNA, 16 bp, Homo sapiens
cggacgtcctgctggc

SEQ ID NO: 6122551 - DNA, 20 bp, Homo sapiens
cggacgtcctgctggcacct

SEQ ID NO: 6122552 - DNA, 21 bp, Homo sapiens
cggacgtcctgctggcacctc

SEQ ID NO: 6122553 - DNA, 14 bp, Homo sapiens
cggacgttccagcc

SEQ ID NO: 6122554 - DNA, 21 bp, Homo sapiens
cggactaaactatctgtattt

SEQ ID NO: 6122555 - DNA, 20 bp, Homo sapiens
cggactaagcctacctgctc

SEQ ID NO: 6122556 - DNA, 22 bp, Homo sapiens
cggactcaccaacttgccacat

SEQ ID NO: 6122557 - DNA, 23 bp, Homo sapiens
cggactcacttgatgtttcctgg

SEQ ID NO: 6122558 - DNA, 21 bp, Homo sapiens
cggactccatggcccttcctg

SEQ ID NO: 6122559 - DNA, 19 bp, Homo sapiens
cggactcccgggccacgcc

SEQ ID NO: 6122560 - DNA, 14 bp, Homo sapiens
cggactctgcccct

SEQ ID NO: 6122561 - DNA, 12 bp, Homo sapiens
cggactctggat

SEQ ID NO: 6122562 - DNA, 15 bp, Homo sapiens
cggactgaggtgcct

SEQ ID NO: 6122563 - DNA, 16 bp, Homo sapiens
cggactgaggtgcctg

SEQ ID NO: 6122564 - DNA, 12 bp, Homo sapiens
cggactgccaaa

SEQ ID NO: 6122565 - DNA, 15 bp, Homo sapiens
cggactgcccccaga

SEQ ID NO: 6122566 - DNA, 15 bp, Homo sapiens
cggactggtgccctc

SEQ ID NO: 6122567 - DNA, 17 bp, Homo sapiens
cggacttactgcctgac

SEQ ID NO: 6122568 - DNA, 21 bp, Homo sapiens
cggacttagaaaaccagctca

SEQ ID NO: 6122569 - DNA, 22 bp, Homo sapiens
cggacttagaaaaccagctcag

SEQ ID NO: 6122570 - DNA, 23 bp, Homo sapiens
cggacttagaaaaccagctcagc

SEQ ID NO: 6122571 - DNA, 14 bp, Homo sapiens
cggacttttctgca

SEQ ID NO: 6122572 - DNA, 16 bp, Homo sapiens
cggacttttctgcaaa

SEQ ID NO: 6122573 - DNA, 22 bp, Homo sapiens
cggagaaactcatcatttttat

SEQ ID NO: 6122574 - DNA, 16 bp, Homo sapiens
cggagaaactgaggta

SEQ ID NO: 6122575 - DNA, 17 bp, Homo sapiens
cggagaaaggaagggct

SEQ ID NO: 6122576 - DNA, 19 bp, Homo sapiens
cggagaacatctgccttgc

SEQ ID NO: 6122577 - DNA, 22 bp, Homo sapiens
cggagaacatctgccttgctgc

SEQ ID NO: 6122578 - DNA, 18 bp, Homo sapiens
cggagaaggccgctgccc

SEQ ID NO: 6122579 - DNA, 15 bp, Homo sapiens
cggagaattgcctct

SEQ ID NO: 6122580 - DNA, 12 bp, Homo sapiens
cggagacagggt

SEQ ID NO: 6122581 - DNA, 14 bp, Homo sapiens
cggagacccacagc

SEQ ID NO: 6122582 - DNA, 16 bp, Homo sapiens
cggagacccacagccc

SEQ ID NO: 6122583 - DNA, 14 bp, Homo sapiens
cggagaccctgagt

SEQ ID NO: 6122584 - DNA, 20 bp, Homo sapiens
cggagacggagtcccacctt

SEQ ID NO: 6122585 - DNA, 16 bp, Homo sapiens
cggagacgggaccctg

SEQ ID NO: 6122586 - DNA, 15 bp, Homo sapiens
cggagacgggaccgg

SEQ ID NO: 6122587 - DNA, 18 bp, Homo sapiens
cggagactatggcctcgc

SEQ ID NO: 6122588 - DNA, 17 bp, Homo sapiens
cggagagagccaagacg

SEQ ID NO: 6122589 - DNA, 23 bp, Homo sapiens
cggagagcgcctgcccctcccag

SEQ ID NO: 6122590 - DNA, 14 bp, Homo sapiens
cggagagctggtga

SEQ ID NO: 6122591 - DNA, 18 bp, Homo sapiens
cggagaggaagccagctg

SEQ ID NO: 6122592 - DNA, 19 bp, Homo sapiens
cggagaggaagccagctgg

SEQ ID NO: 6122593 - DNA, 22 bp, Homo sapiens
ctccaagcagactccagcccct

SEQ ID NO: 6122594 - DNA, 24 bp, Homo sapiens
ctccaagcagactccagcccctgg

SEQ ID NO: 6122595 - DNA, 16 bp, Homo sapiens
ctccaagcagcttaga

SEQ ID NO: 6122596 - DNA, 14 bp, Homo sapiens
ctccaagcaggaca

SEQ ID NO: 6122597 - DNA, 22 bp, Homo sapiens
ctccaagcaggacatggacaag

SEQ ID NO: 6122598 - DNA, 13 bp, Homo sapiens
ctccaagcatcac

SEQ ID NO: 6122599 - DNA, 15 bp, Homo sapiens
ctccaagcatttcat

SEQ ID NO: 6122600 - DNA, 16 bp, Homo sapiens
ctccaagcatttcatg

SEQ ID NO: 6122601 - DNA, 15 bp, Homo sapiens
ctccaagccccatct

SEQ ID NO: 6122602 - DNA, 18 bp, Homo sapiens
ctccaagccccatcttct

SEQ ID NO: 6122603 - DNA, 21 bp, Homo sapiens
ctccaagccccctggcagctg

SEQ ID NO: 6122604 - DNA, 22 bp, Homo sapiens
ctccaagccccctggcagctgc

SEQ ID NO: 6122605 - DNA, 13 bp, Homo sapiens
ctccaagccctgg

SEQ ID NO: 6122606 - DNA, 15 bp, Homo sapiens
ctccaagcctgcctc

SEQ ID NO: 6122607 - DNA, 17 bp, Homo sapiens
ctccaagcctgcctccc

SEQ ID NO: 6122608 - DNA, 22 bp, Homo sapiens
ctccaagcctggcacccaccgt

SEQ ID NO: 6122609 - DNA, 14 bp, Homo sapiens
ctccaagctccatc

SEQ ID NO: 6122610 - DNA, 13 bp, Homo sapiens
ctccaagctccca

SEQ ID NO: 6122611 - DNA, 15 bp, Homo sapiens
ctccaagctcccagg

SEQ ID NO: 6122612 - DNA, 20 bp, Homo sapiens
ctccaaggacagaaggctcc

SEQ ID NO: 6122613 - DNA, 14 bp, Homo sapiens
ctccaaggaccagg

SEQ ID NO: 6122614 - DNA, 23 bp, Homo sapiens
ctccaaggacggtccccacccct

SEQ ID NO: 6122615 - DNA, 22 bp, Homo sapiens
ctccaaggaggggctgtaaaat

SEQ ID NO: 6122616 - DNA, 18 bp, Homo sapiens
ctccaaggcaaatgtcca

SEQ ID NO: 6122617 - DNA, 20 bp, Homo sapiens
ctccaaggcaaatgtccaag

SEQ ID NO: 6122618 - DNA, 22 bp, Homo sapiens
ctccaaggcaaatgtccaagca

SEQ ID NO: 6122619 - DNA, 14 bp, Homo sapiens
ctccaaggccaggc

SEQ ID NO: 6122620 - DNA, 20 bp, Homo sapiens
ctccaaggccaggccttggg

SEQ ID NO: 6122621 - DNA, 14 bp, Homo sapiens
ctccaaggctgtct

SEQ ID NO: 6122622 - DNA, 22 bp, Homo sapiens
ctccaagggagggtgcagccct

SEQ ID NO: 6122623 - DNA, 18 bp, Homo sapiens
ctccaagggcttctgcac

SEQ ID NO: 6122624 - DNA, 22 bp, Homo sapiens
ctccaagggcttctgcaccctc

SEQ ID NO: 6122625 - DNA, 23 bp, Homo sapiens
ctccaagggcttctgcaccctcc

SEQ ID NO: 6122626 - DNA, 21 bp, Homo sapiens
ctccaaggggctttgtcctgg

SEQ ID NO: 6122627 - DNA, 23 bp, Homo sapiens
ctccaagggtttcgactggtcca

SEQ ID NO: 6122628 - DNA, 16 bp, Homo sapiens
ctccaaggtcctctta

SEQ ID NO: 6122629 - DNA, 15 bp, Homo sapiens
ctccaaggtggggtc

SEQ ID NO: 6122630 - DNA, 14 bp, Homo sapiens
ctccaagtcatggg

SEQ ID NO: 6122631 - DNA, 19 bp, Homo sapiens
ctccaagtcatgggagaag

SEQ ID NO: 6122632 - DNA, 22 bp, Homo sapiens
ctccaagtccacagtggaacca

SEQ ID NO: 6122633 - DNA, 16 bp, Homo sapiens
ctccaagtctcagtgg

SEQ ID NO: 6122634 - DNA, 13 bp, Homo sapiens
ctccaagtctctc

SEQ ID NO: 6122635 - DNA, 16 bp, Homo sapiens
ctccaagtctctctgt

SEQ ID NO: 6122636 - DNA, 18 bp, Homo sapiens
ctccaagtctctctgtga

SEQ ID NO: 6122637 - DNA, 21 bp, Homo sapiens
ctccaagtgccagaggtgggc

SEQ ID NO: 6122638 - DNA, 22 bp, Homo sapiens
ctccaagtgccagaggtgggca

SEQ ID NO: 6122639 - DNA, 17 bp, Homo sapiens
ctccaagtgccccacca

SEQ ID NO: 6122640 - DNA, 21 bp, Homo sapiens
ctccaagtgggtcaattcctt

SEQ ID NO: 6122641 - DNA, 19 bp, Homo sapiens
ctccaataaagtgccttct

SEQ ID NO: 6122642 - DNA, 20 bp, Homo sapiens
ctccaataaagtgccttctg

SEQ ID NO: 6122643 - DNA, 17 bp, Homo sapiens
ctccaatatcagtgctc

SEQ ID NO: 6122644 - DNA, 18 bp, Homo sapiens
ctccaatccacacatatt

SEQ ID NO: 6122645 - DNA, 23 bp, Homo sapiens
ctccaatccgttcccttctgcca

SEQ ID NO: 6122646 - DNA, 21 bp, Homo sapiens
ctccaatgcattggcctctgt

SEQ ID NO: 6122647 - DNA, 13 bp, Homo sapiens
ctccaatgctctg

SEQ ID NO: 6122648 - DNA, 16 bp, Homo sapiens
ctccaatggggccagc

SEQ ID NO: 6122649 - DNA, 21 bp, Homo sapiens
ctccaatggggcggggcttct

SEQ ID NO: 6122650 - DNA, 18 bp, Homo sapiens
ctccaattggtgcttcag

SEQ ID NO: 6122651 - DNA, 12 bp, Homo sapiens
ctccacaacact

SEQ ID NO: 6122652 - DNA, 17 bp, Homo sapiens
ctccacaacagcctggg

SEQ ID NO: 6122653 - DNA, 20 bp, Homo sapiens
ctccacaacagcctggggtt

SEQ ID NO: 6122654 - DNA, 16 bp, Homo sapiens
ctccacaacccaagca

SEQ ID NO: 6122655 - DNA, 23 bp, Homo sapiens
ctccacacacagctgggctgtgg

SEQ ID NO: 6122656 - DNA, 20 bp, Homo sapiens
ctccacacacataatggcag

SEQ ID NO: 6122657 - DNA, 14 bp, Homo sapiens
ctccacacagcagt

SEQ ID NO: 6122658 - DNA, 15 bp, Homo sapiens
ctccacacatctttc

SEQ ID NO: 6122659 - DNA, 17 bp, Homo sapiens
ctccacacatctttctt

SEQ ID NO: 6122660 - DNA, 20 bp, Homo sapiens
ctccacacattccagccagg

SEQ ID NO: 6122661 - DNA, 17 bp, Homo sapiens
ctccacaccagtggcct

SEQ ID NO: 6122662 - DNA, 18 bp, Homo sapiens
ctccacaccattcaggtc

SEQ ID NO: 6122663 - DNA, 20 bp, Homo sapiens
ctccacaccattcaggtctt

SEQ ID NO: 6122664 - DNA, 22 bp, Homo sapiens
ctccacacccaccccctctgga

SEQ ID NO: 6122665 - DNA, 23 bp, Homo sapiens
ctccacacccaccccctctggag

SEQ ID NO: 6122666 - DNA, 20 bp, Homo sapiens
ctccacacccatgactgccc

SEQ ID NO: 6122667 - DNA, 23 bp, Homo sapiens
ctccacacccatgactgcccctt

SEQ ID NO: 6122668 - DNA, 14 bp, Homo sapiens
ctccacacctccac

SEQ ID NO: 6122669 - DNA, 16 bp, Homo sapiens
ctccacacgccccggt

SEQ ID NO: 6122670 - DNA, 17 bp, Homo sapiens
ctccacacgccccggtc

SEQ ID NO: 6122671 - DNA, 19 bp, Homo sapiens
ctccacacggagctcctgg

SEQ ID NO: 6122672 - DNA, 18 bp, Homo sapiens
ctccacagaaaccctgtt

SEQ ID NO: 6122673 - DNA, 14 bp, Homo sapiens
ctccacagagagga

SEQ ID NO: 6122674 - DNA, 18 bp, Homo sapiens
ctccacagataccagacc

SEQ ID NO: 6122675 - DNA, 23 bp, Homo sapiens
ctccacagatgtaattatgtttt

SEQ ID NO: 6122676 - DNA, 23 bp, Homo sapiens
ctccacagccatcccagccttgg

SEQ ID NO: 6122677 - DNA, 15 bp, Homo sapiens
ctccacagcggagga

SEQ ID NO: 6122678 - DNA, 12 bp, Homo sapiens
ctccacaggagc

SEQ ID NO: 6122679 - DNA, 12 bp, Homo sapiens
ctccacagggcc

SEQ ID NO: 6122680 - DNA, 22 bp, Homo sapiens
ctccacagggcttgttttccaa

SEQ ID NO: 6122681 - DNA, 24 bp, Homo sapiens
ctccacagggtgggatgagcctct

SEQ ID NO: 6122682 - DNA, 14 bp, Homo sapiens
ctccacagtagcat

SEQ ID NO: 6122683 - DNA, 23 bp, Homo sapiens
ctccacagtcccccacccacctc

SEQ ID NO: 6122684 - DNA, 14 bp, Homo sapiens
ctccacagtgctgc

SEQ ID NO: 6122685 - DNA, 13 bp, Homo sapiens
ctccacagtgttg

SEQ ID NO: 6122686 - DNA, 14 bp, Homo sapiens
ctccacagtgttgt

SEQ ID NO: 6122687 - DNA, 18 bp, Homo sapiens
ctccacagtgttgtgccc

SEQ ID NO: 6122688 - DNA, 21 bp, Homo sapiens
ctccacagtgttgtgcccctt

SEQ ID NO: 6122689 - DNA, 15 bp, Homo sapiens
ctccacagttcagtg

SEQ ID NO: 6122690 - DNA, 17 bp, Homo sapiens
ctccacagttcagtggc

SEQ ID NO: 6122691 - DNA, 20 bp, Homo sapiens
ctccacatatttcagtgagg

SEQ ID NO: 6122692 - DNA, 21 bp, Homo sapiens
ctccacatcaacattccaggg

SEQ ID NO: 6122693 - DNA, 14 bp, Homo sapiens
ctccacatcccagc

SEQ ID NO: 6122694 - DNA, 17 bp, Homo sapiens
ctccacatcccagcagc

SEQ ID NO: 6122695 - DNA, 13 bp, Homo sapiens
ctccacatcctcc

SEQ ID NO: 6122696 - DNA, 15 bp, Homo sapiens
ctccacatcctgtgt

SEQ ID NO: 6122697 - DNA, 19 bp, Homo sapiens
ctccacatctgcatcactc

SEQ ID NO: 6122698 - DNA, 20 bp, Homo sapiens
ctccacatctgcatcactca

SEQ ID NO: 6122699 - DNA, 15 bp, Homo sapiens
ctccacatctgcctt

SEQ ID NO: 6122700 - DNA, 15 bp, Homo sapiens
ctccacatgctgcct

SEQ ID NO: 6122701 - DNA, 17 bp, Homo sapiens
ctccacatgctgcctgg

SEQ ID NO: 6122702 - DNA, 21 bp, Homo sapiens
ctccacattcatgtacaatga

SEQ ID NO: 6122703 - DNA, 13 bp, Homo sapiens
ctccacattttct

SEQ ID NO: 6122704 - DNA, 12 bp, Homo sapiens
ctccaccaaccc

SEQ ID NO: 6122705 - DNA, 20 bp, Homo sapiens
ctccaccaacccatcagaag

SEQ ID NO: 6122706 - DNA, 23 bp, Homo sapiens
ctccaccaagcctggtcagccca

SEQ ID NO: 6122707 - DNA, 17 bp, Homo sapiens
ctccaccacatctgcca

SEQ ID NO: 6122708 - DNA, 21 bp, Homo sapiens
ctccaccacatctgccagacc

SEQ ID NO: 6122709 - DNA, 19 bp, Homo sapiens
ctccaccaccactggccac

SEQ ID NO: 6122710 - DNA, 23 bp, Homo sapiens
ctccaccaccactggccaccagg

SEQ ID NO: 6122711 - DNA, 16 bp, Homo sapiens
ctccaccacccaaaag

SEQ ID NO: 6122712 - DNA, 20 bp, Homo sapiens
ctccaccagcatcacctgcc

SEQ ID NO: 6122713 - DNA, 23 bp, Homo sapiens
ctccaccagcatcacctgcctgt

SEQ ID NO: 6122714 - DNA, 13 bp, Homo sapiens
ctccaccagcccc

SEQ ID NO: 6122715 - DNA, 18 bp, Homo sapiens
ctccaccagcctgctgac

SEQ ID NO: 6122716 - DNA, 15 bp, Homo sapiens
ctccaccaggaacct

SEQ ID NO: 6122717 - DNA, 17 bp, Homo sapiens
ctccaccatccccaccc

SEQ ID NO: 6122718 - DNA, 23 bp, Homo sapiens
ctccacccaaaccccttcccacg

SEQ ID NO: 6122719 - DNA, 12 bp, Homo sapiens
ctccacccacta

SEQ ID NO: 6122720 - DNA, 21 bp, Homo sapiens
ctccacccagagtagagccag

SEQ ID NO: 6122721 - DNA, 12 bp, Homo sapiens
ctccacccagcc

SEQ ID NO: 6122722 - DNA, 16 bp, Homo sapiens
ctccacccagcccctg

SEQ ID NO: 6122723 - DNA, 15 bp, Homo sapiens
ctccacccatccagt

SEQ ID NO: 6122724 - DNA, 17 bp, Homo sapiens
ctccaccccacagaacc

SEQ ID NO: 6122725 - DNA, 18 bp, Homo sapiens
ctccaccccacagaacct

SEQ ID NO: 6122726 - DNA, 15 bp, Homo sapiens
ctccaccccactcac

SEQ ID NO: 6122727 - DNA, 18 bp, Homo sapiens
ctccaccccactcacaga

SEQ ID NO: 6122728 - DNA, 17 bp, Homo sapiens
ctccaccccagccccca

SEQ ID NO: 6122729 - DNA, 12 bp, Homo sapiens
ctccaccccagg

SEQ ID NO: 6122730 - DNA, 13 bp, Homo sapiens
ctccaccccagga

SEQ ID NO: 6122731 - DNA, 14 bp, Homo sapiens
ctccaccccagggt

SEQ ID NO: 6122732 - DNA, 13 bp, Homo sapiens
ctccacccccagc

SEQ ID NO: 6122733 - DNA, 15 bp, Homo sapiens
ctccacccccagctg

SEQ ID NO: 6122734 - DNA, 19 bp, Homo sapiens
ctccacccccagctgcttg

SEQ ID NO: 6122735 - DNA, 20 bp, Homo sapiens
ctccacccccatgtggcagc

SEQ ID NO: 6122736 - DNA, 18 bp, Homo sapiens
ctccacccccgccacggc

SEQ ID NO: 6122737 - DNA, 15 bp, Homo sapiens
ctccaccccctccag

SEQ ID NO: 6122738 - DNA, 16 bp, Homo sapiens
ctccaccccctccagc

SEQ ID NO: 6122739 - DNA, 22 bp, Homo sapiens
ctccaccccctccagctccagt

SEQ ID NO: 6122740 - DNA, 15 bp, Homo sapiens
ctccaccccctcctg

SEQ ID NO: 6122741 - DNA, 16 bp, Homo sapiens
ctccaccccctcctgt

SEQ ID NO: 6122742 - DNA, 18 bp, Homo sapiens
ctccacccctcaagccag

SEQ ID NO: 6122743 - DNA, 21 bp, Homo sapiens
ctccacccctcaagccaggag

SEQ ID NO: 6122744 - DNA, 19 bp, Homo sapiens
ctccaccctaaagtctcag

SEQ ID NO: 6122745 - DNA, 20 bp, Homo sapiens
ctccaccctaaagtctcagg

SEQ ID NO: 6122746 - DNA, 14 bp, Homo sapiens
ctccaccctccacc

SEQ ID NO: 6122747 - DNA, 14 bp, Homo sapiens
ctccaccctcccag

SEQ ID NO: 6122748 - DNA, 16 bp, Homo sapiens
ctccaccctcccccag

SEQ ID NO: 6122749 - DNA, 16 bp, Homo sapiens
ctccaccctcctcctc

SEQ ID NO: 6122750 - DNA, 23 bp, Homo sapiens
ctccaccctcctcctcttcacca

SEQ ID NO: 6122751 - DNA, 16 bp, Homo sapiens
ctccaccctctgagct

SEQ ID NO: 6122752 - DNA, 17 bp, Homo sapiens
ctccaccctctgagctt

SEQ ID NO: 6122753 - DNA, 14 bp, Homo sapiens
ctccaccctgagcc

SEQ ID NO: 6122754 - DNA, 15 bp, Homo sapiens
ctccaccctgagcct

SEQ ID NO: 6122755 - DNA, 19 bp, Homo sapiens
ctccaccctgagcctgacc

SEQ ID NO: 6122756 - DNA, 19 bp, Homo sapiens
ctccaccctgcattttcct

SEQ ID NO: 6122757 - DNA, 15 bp, Homo sapiens
ctccaccctgccctg

SEQ ID NO: 6122758 - DNA, 23 bp, Homo sapiens
ctccaccctgtcccccagctctg

SEQ ID NO: 6122759 - DNA, 13 bp, Homo sapiens
ctccaccctgtta

SEQ ID NO: 6122760 - DNA, 22 bp, Homo sapiens
ctccaccctgttagttttgtaa

SEQ ID NO: 6122761 - DNA, 21 bp, Homo sapiens
ctccacccttggcctgtctca

SEQ ID NO: 6122762 - DNA, 18 bp, Homo sapiens
ctccaccgaccaactgcc

SEQ ID NO: 6122763 - DNA, 19 bp, Homo sapiens
ctccaccgaccaactgccc

SEQ ID NO: 6122764 - DNA, 21 bp, Homo sapiens
ctccaccgaccaactgcccta

SEQ ID NO: 6122765 - DNA, 17 bp, Homo sapiens
ctccaccgcagaaggaa

SEQ ID NO: 6122766 - DNA, 16 bp, Homo sapiens
ctccaccgccatggct

SEQ ID NO: 6122767 - DNA, 15 bp, Homo sapiens
ctccaccgcctatcc

SEQ ID NO: 6122768 - DNA, 16 bp, Homo sapiens
ctccaccgctgcctaa

SEQ ID NO: 6122769 - DNA, 15 bp, Homo sapiens
ctccaccggtgcctc

SEQ ID NO: 6122770 - DNA, 13 bp, Homo sapiens
cggagaggacagt

SEQ ID NO: 6122771 - DNA, 14 bp, Homo sapiens
cggagaggagttca

SEQ ID NO: 6122772 - DNA, 19 bp, Homo sapiens
cggagaggctgtctggggc

SEQ ID NO: 6122773 - DNA, 15 bp, Homo sapiens
cggagagggagtcag

SEQ ID NO: 6122774 - DNA, 21 bp, Homo sapiens
cggagagggagtcagtcttca

SEQ ID NO: 6122775 - DNA, 21 bp, Homo sapiens
cggagaggtggccgccatgct

SEQ ID NO: 6122776 - DNA, 20 bp, Homo sapiens
cggagatgcatctgtggcct

SEQ ID NO: 6122777 - DNA, 17 bp, Homo sapiens
cggagcacactggctca

SEQ ID NO: 6122778 - DNA, 18 bp, Homo sapiens
cggagcactgtgcagccg

SEQ ID NO: 6122779 - DNA, 22 bp, Homo sapiens
cggagcagggagagctcaccat

SEQ ID NO: 6122780 - DNA, 18 bp, Homo sapiens
cggagcagttggcctgtg

SEQ ID NO: 6122781 - DNA, 19 bp, Homo sapiens
cggagcagttggcctgtgc

SEQ ID NO: 6122782 - DNA, 20 bp, Homo sapiens
cggagcagttggcctgtgct

SEQ ID NO: 6122783 - DNA, 15 bp, Homo sapiens
cggagcatcccggag

SEQ ID NO: 6122784 - DNA, 22 bp, Homo sapiens
cggagcatcccggaggaaatct

SEQ ID NO: 6122785 - DNA, 13 bp, Homo sapiens
cggagccactcct

SEQ ID NO: 6122786 - DNA, 19 bp, Homo sapiens
cggagccagcgcctgcccg

SEQ ID NO: 6122787 - DNA, 20 bp, Homo sapiens
cggagccagcgcctgcccga

SEQ ID NO: 6122788 - DNA, 17 bp, Homo sapiens
cggagccatcaccctca

SEQ ID NO: 6122789 - DNA, 11 bp, Homo sapiens
cggagcccaga

SEQ ID NO: 6122790 - DNA, 21 bp, Homo sapiens
cggagcccagcctgggagccc

SEQ ID NO: 6122791 - DNA, 21 bp, Homo sapiens
cggagccccaagactctgctc

SEQ ID NO: 6122792 - DNA, 12 bp, Homo sapiens
cggagccccagg

SEQ ID NO: 6122793 - DNA, 14 bp, Homo sapiens
cggagccccaggcc

SEQ ID NO: 6122794 - DNA, 15 bp, Homo sapiens
cggagccccccactc

SEQ ID NO: 6122795 - DNA, 15 bp, Homo sapiens
cggagcccccgcccc

SEQ ID NO: 6122796 - DNA, 16 bp, Homo sapiens
cggagcccccgcccct

SEQ ID NO: 6122797 - DNA, 21 bp, Homo sapiens
cggagcccgatattctccctg

SEQ ID NO: 6122798 - DNA, 15 bp, Homo sapiens
cggagcccttggccc

SEQ ID NO: 6122799 - DNA, 19 bp, Homo sapiens
cggagcccttggcccctcg

SEQ ID NO: 6122800 - DNA, 20 bp, Homo sapiens
cggagcctcatccgaggcag

SEQ ID NO: 6122801 - DNA, 22 bp, Homo sapiens
cggagcctcatccgaggcaggg

SEQ ID NO: 6122802 - DNA, 15 bp, Homo sapiens
cggagcctgcctcct

SEQ ID NO: 6122803 - DNA, 18 bp, Homo sapiens
cggagcctgtgcagcctt

SEQ ID NO: 6122804 - DNA, 15 bp, Homo sapiens
cggagcgcacctgct

SEQ ID NO: 6122805 - DNA, 13 bp, Homo sapiens
cggagcggctgag

SEQ ID NO: 6122806 - DNA, 15 bp, Homo sapiens
cggagcggctgagga

SEQ ID NO: 6122807 - DNA, 12 bp, Homo sapiens
cggagctccggc

SEQ ID NO: 6122808 - DNA, 17 bp, Homo sapiens
cggagctgcccctctct

SEQ ID NO: 6122809 - DNA, 22 bp, Homo sapiens
cggagctgcccctctctgggcc

SEQ ID NO: 6122810 - DNA, 11 bp, Homo sapiens
cggagctgcct

SEQ ID NO: 6122811 - DNA, 14 bp, Homo sapiens
cggagctgcctgca

SEQ ID NO: 6122812 - DNA, 13 bp, Homo sapiens
cggagctggccca

SEQ ID NO: 6122813 - DNA, 15 bp, Homo sapiens
cggagctggcccagg

SEQ ID NO: 6122814 - DNA, 21 bp, Homo sapiens
cggagctggccccgccgcctg

SEQ ID NO: 6122815 - DNA, 19 bp, Homo sapiens
cggagctggctgtgcctgc

SEQ ID NO: 6122816 - DNA, 18 bp, Homo sapiens
cggagctggggtctgggc

SEQ ID NO: 6122817 - DNA, 22 bp, Homo sapiens
cggagctggttcctctctccca

SEQ ID NO: 6122818 - DNA, 19 bp, Homo sapiens
cggagcttcggggcctcct

SEQ ID NO: 6122819 - DNA, 18 bp, Homo sapiens
cggagcttctccagccac

SEQ ID NO: 6122820 - DNA, 16 bp, Homo sapiens
cggagcttgcctgcct

SEQ ID NO: 6122821 - DNA, 12 bp, Homo sapiens
cggagcttggcc

SEQ ID NO: 6122822 - DNA, 14 bp, Homo sapiens
cggagcttggccct

SEQ ID NO: 6122823 - DNA, 17 bp, Homo sapiens
cggagcttggccctgcg

SEQ ID NO: 6122824 - DNA, 21 bp, Homo sapiens
cggagcttggccctgcgccct

SEQ ID NO: 6122825 - DNA, 19 bp, Homo sapiens
cggaggaaagacaacacaa

SEQ ID NO: 6122826 - DNA, 16 bp, Homo sapiens
cggaggaagcccacat

SEQ ID NO: 6122827 - DNA, 21 bp, Homo sapiens
cggaggaaggaggacccagga

SEQ ID NO: 6122828 - DNA, 22 bp, Homo sapiens
cggaggaaggtcccatggcctg

SEQ ID NO: 6122829 - DNA, 14 bp, Homo sapiens
cggaggactcacca

SEQ ID NO: 6122830 - DNA, 23 bp, Homo sapiens
cggaggagaaactctagactgca

SEQ ID NO: 6122831 - DNA, 13 bp, Homo sapiens
cggaggagaccag

SEQ ID NO: 6122832 - DNA, 21 bp, Homo sapiens
cggaggagaccagctcagagg

SEQ ID NO: 6122833 - DNA, 13 bp, Homo sapiens
cggaggagcagcc

SEQ ID NO: 6122834 - DNA, 14 bp, Homo sapiens
cggaggagcagcct

SEQ ID NO: 6122835 - DNA, 15 bp, Homo sapiens
cggaggagcagcctc

SEQ ID NO: 6122836 - DNA, 22 bp, Homo sapiens
cggaggagcagcctcgaggctg

SEQ ID NO: 6122837 - DNA, 21 bp, Homo sapiens
cggaggagctagcctgaagga

SEQ ID NO: 6122838 - DNA, 14 bp, Homo sapiens
cggaggagcttccc

SEQ ID NO: 6122839 - DNA, 13 bp, Homo sapiens
cggaggaggggaa

SEQ ID NO: 6122840 - DNA, 17 bp, Homo sapiens
cggaggaggggaagggg

SEQ ID NO: 6122841 - DNA, 12 bp, Homo sapiens
cggaggaggtgg

SEQ ID NO: 6122842 - DNA, 19 bp, Homo sapiens
cggaggagttttctgtgtg

SEQ ID NO: 6122843 - DNA, 18 bp, Homo sapiens
cggaggatagtatgagcc

SEQ ID NO: 6122844 - DNA, 15 bp, Homo sapiens
cggaggcaggaccag

SEQ ID NO: 6122845 - DNA, 14 bp, Homo sapiens
cggaggccagacac

SEQ ID NO: 6122846 - DNA, 11 bp, Homo sapiens
cggaggccagg

SEQ ID NO: 6122847 - DNA, 22 bp, Homo sapiens
cggaggccaggccctcctgctg

SEQ ID NO: 6122848 - DNA, 18 bp, Homo sapiens
cggaggcctgcgaccctg

SEQ ID NO: 6122849 - DNA, 14 bp, Homo sapiens
cggaggcgcccacc

SEQ ID NO: 6122850 - DNA, 15 bp, Homo sapiens
cggaggcgcccacct

SEQ ID NO: 6122851 - DNA, 19 bp, Homo sapiens
cggaggcgcccacctgccc

SEQ ID NO: 6122852 - DNA, 22 bp, Homo sapiens
cggaggcgcccacctgcccagt

SEQ ID NO: 6122853 - DNA, 17 bp, Homo sapiens
cggaggcgtggaggaga

SEQ ID NO: 6122854 - DNA, 22 bp, Homo sapiens
cggaggctacccgctgtggccg

SEQ ID NO: 6122855 - DNA, 20 bp, Homo sapiens
cggaggctcctccctctgcc

SEQ ID NO: 6122856 - DNA, 21 bp, Homo sapiens
cggaggctcctccctctgcct

SEQ ID NO: 6122857 - DNA, 23 bp, Homo sapiens
cggaggctcctccctctgcctca

SEQ ID NO: 6122858 - DNA, 13 bp, Homo sapiens
cggaggctgctcg

SEQ ID NO: 6122859 - DNA, 14 bp, Homo sapiens
cggaggctgggccc

SEQ ID NO: 6122860 - DNA, 18 bp, Homo sapiens
cggaggctgggcccctgg

SEQ ID NO: 6122861 - DNA, 22 bp, Homo sapiens
cggaggctgggcccctgggatg

SEQ ID NO: 6122862 - DNA, 14 bp, Homo sapiens
cggaggctgtgctc

SEQ ID NO: 6122863 - DNA, 15 bp, Homo sapiens
cggaggcttgggacc

SEQ ID NO: 6122864 - DNA, 19 bp, Homo sapiens
cggagggaaactgtgaatg

SEQ ID NO: 6122865 - DNA, 18 bp, Homo sapiens
cggagggaaccctgacta

SEQ ID NO: 6122866 - DNA, 19 bp, Homo sapiens
cggagggaattgaggtctg

SEQ ID NO: 6122867 - DNA, 19 bp, Homo sapiens
cggagggacgcggaggagg

SEQ ID NO: 6122868 - DNA, 17 bp, Homo sapiens
cggagggagcggcatgg

SEQ ID NO: 6122869 - DNA, 12 bp, Homo sapiens
cggagggagggg

SEQ ID NO: 6122870 - DNA, 19 bp, Homo sapiens
cggagggagtcccagagcc

SEQ ID NO: 6122871 - DNA, 15 bp, Homo sapiens
cggagggcaggaccc

SEQ ID NO: 6122872 - DNA, 17 bp, Homo sapiens
cggagggccgcagggcc

SEQ ID NO: 6122873 - DNA, 19 bp, Homo sapiens
cggagggccgcagggccca

SEQ ID NO: 6122874 - DNA, 15 bp, Homo sapiens
cggaggggacccagc

SEQ ID NO: 6122875 - DNA, 11 bp, Homo sapiens
cggaggggagt

SEQ ID NO: 6122876 - DNA, 14 bp, Homo sapiens
cggaggggatccag

SEQ ID NO: 6122877 - DNA, 15 bp, Homo sapiens
cggaggggatccagc

SEQ ID NO: 6122878 - DNA, 18 bp, Homo sapiens
cggaggggcctggcagcc

SEQ ID NO: 6122879 - DNA, 15 bp, Homo sapiens
cggaggggcttggag

SEQ ID NO: 6122880 - DNA, 17 bp, Homo sapiens
cggaggggcttggagca

SEQ ID NO: 6122881 - DNA, 18 bp, Homo sapiens
cggaggggcttggagcag

SEQ ID NO: 6122882 - DNA, 22 bp, Homo sapiens
cggagggggtcctcctcgctcc

SEQ ID NO: 6122883 - DNA, 21 bp, Homo sapiens
cggagggtctccctgggcacc

SEQ ID NO: 6122884 - DNA, 23 bp, Homo sapiens
cggagggtgccgtgcgggcgagg

SEQ ID NO: 6122885 - DNA, 23 bp, Homo sapiens
cggagggtgggggccacctgcct

SEQ ID NO: 6122886 - DNA, 19 bp, Homo sapiens
cggaggtccagctgggcct

SEQ ID NO: 6122887 - DNA, 21 bp, Homo sapiens
cggaggtccagctgggcctcc

SEQ ID NO: 6122888 - DNA, 18 bp, Homo sapiens
cggaggtctctgggagcc

SEQ ID NO: 6122889 - DNA, 21 bp, Homo sapiens
cggaggtctctgggagcccag

SEQ ID NO: 6122890 - DNA, 13 bp, Homo sapiens
cggaggtggcagc

SEQ ID NO: 6122891 - DNA, 21 bp, Homo sapiens
cggaggtgttcccaggctgcc

SEQ ID NO: 6122892 - DNA, 19 bp, Homo sapiens
cggaggttccagtgagccg

SEQ ID NO: 6122893 - DNA, 16 bp, Homo sapiens
cggagtaatcaggcag

SEQ ID NO: 6122894 - DNA, 19 bp, Homo sapiens
cggagtaatcaggcagcct

SEQ ID NO: 6122895 - DNA, 18 bp, Homo sapiens
cggagtacagacgtctca

SEQ ID NO: 6122896 - DNA, 21 bp, Homo sapiens
cggagtagaaattgttcctga

SEQ ID NO: 6122897 - DNA, 16 bp, Homo sapiens
cggagtatgtgcagtg

SEQ ID NO: 6122898 - DNA, 23 bp, Homo sapiens
cggagtcattttgtgttgaagag

SEQ ID NO: 6122899 - DNA, 22 bp, Homo sapiens
cggagtcccaccttggctgcag

SEQ ID NO: 6122900 - DNA, 23 bp, Homo sapiens
cggagtcctgtgtttgtgagtcg

SEQ ID NO: 6122901 - DNA, 15 bp, Homo sapiens
cggagtcgtggggtg

SEQ ID NO: 6122902 - DNA, 14 bp, Homo sapiens
cggagtctcgctct

SEQ ID NO: 6122903 - DNA, 20 bp, Homo sapiens
cggagtgaagaggggcagcc

SEQ ID NO: 6122904 - DNA, 22 bp, Homo sapiens
cggagtgaagaggggcagccct

SEQ ID NO: 6122905 - DNA, 17 bp, Homo sapiens
cggagtgaatgtggcag

SEQ ID NO: 6122906 - DNA, 15 bp, Homo sapiens
cggagtgacagagta

SEQ ID NO: 6122907 - DNA, 19 bp, Homo sapiens
cggagtgagaagctttgcc

SEQ ID NO: 6122908 - DNA, 14 bp, Homo sapiens
cggagtgcggacca

SEQ ID NO: 6122909 - DNA, 20 bp, Homo sapiens
cggagtggacaccgctcagt

SEQ ID NO: 6122910 - DNA, 18 bp, Homo sapiens
cggagtggggggacagag

SEQ ID NO: 6122911 - DNA, 18 bp, Homo sapiens
cggagtgtctggaattgt

SEQ ID NO: 6122912 - DNA, 16 bp, Homo sapiens
cggagtgtggcctgga

SEQ ID NO: 6122913 - DNA, 17 bp, Homo sapiens
cggagtgtggcctggat

SEQ ID NO: 6122914 - DNA, 18 bp, Homo sapiens
cggagtgtggcctggatc

SEQ ID NO: 6122915 - DNA, 19 bp, Homo sapiens
cggagtgtgtatgccaaga

SEQ ID NO: 6122916 - DNA, 16 bp, Homo sapiens
cggagtgttggggctg

SEQ ID NO: 6122917 - DNA, 21 bp, Homo sapiens
cggagtgttggggctgggggc

SEQ ID NO: 6122918 - DNA, 23 bp, Homo sapiens
cggagttcggaaaccgtcctgtg

SEQ ID NO: 6122919 - DNA, 21 bp, Homo sapiens
cggagttgacagtgaaacaaa

SEQ ID NO: 6122920 - DNA, 23 bp, Homo sapiens
cggataggcaggaacatacagac

SEQ ID NO: 6122921 - DNA, 15 bp, Homo sapiens
cggatagttgctatt

SEQ ID NO: 6122922 - DNA, 17 bp, Homo sapiens
cggatagttgctatttt

SEQ ID NO: 6122923 - DNA, 20 bp, Homo sapiens
cggatagttgctatttttgt

SEQ ID NO: 6122924 - DNA, 15 bp, Homo sapiens
cggatcaaccaggca

SEQ ID NO: 6122925 - DNA, 23 bp, Homo sapiens
cggatcaccgagagtagccgaga

SEQ ID NO: 6122926 - DNA, 16 bp, Homo sapiens
cggatcaggctcccag

SEQ ID NO: 6122927 - DNA, 21 bp, Homo sapiens
cggatcatatggagctcatgt

SEQ ID NO: 6122928 - DNA, 15 bp, Homo sapiens
cggatcatcaacaag

SEQ ID NO: 6122929 - DNA, 14 bp, Homo sapiens
cggatccccttcct

SEQ ID NO: 6122930 - DNA, 14 bp, Homo sapiens
cggatcctaagcat

SEQ ID NO: 6122931 - DNA, 19 bp, Homo sapiens
cggatcctgtgagtaggct

SEQ ID NO: 6122932 - DNA, 15 bp, Homo sapiens
cggatctagccatgg

SEQ ID NO: 6122933 - DNA, 16 bp, Homo sapiens
cggatctcactcagcc

SEQ ID NO: 6122934 - DNA, 14 bp, Homo sapiens
cggatctccaggcc

SEQ ID NO: 6122935 - DNA, 20 bp, Homo sapiens
cggatgaactcaatgcatga

SEQ ID NO: 6122936 - DNA, 15 bp, Homo sapiens
cggatgacaccctgg

SEQ ID NO: 6122937 - DNA, 22 bp, Homo sapiens
cggatgataactactgacgaaa

SEQ ID NO: 6122938 - DNA, 13 bp, Homo sapiens
cggatgatttcta

SEQ ID NO: 6122939 - DNA, 14 bp, Homo sapiens
cggatgatttctat

SEQ ID NO: 6122940 - DNA, 18 bp, Homo sapiens
cggatgcacacacagatg

SEQ ID NO: 6122941 - DNA, 13 bp, Homo sapiens
cggatgcagaggc

SEQ ID NO: 6122942 - DNA, 13 bp, Homo sapiens
cggatgcccaccc

SEQ ID NO: 6122943 - DNA, 17 bp, Homo sapiens
cggatgcccattcctgc

SEQ ID NO: 6122944 - DNA, 16 bp, Homo sapiens
cggatgcgtgggcaga

SEQ ID NO: 6122945 - DNA, 19 bp, Homo sapiens
cggatgctactactgcagt

SEQ ID NO: 6122946 - DNA, 23 bp, Homo sapiens
cggatgctactactgcagtcttt

SEQ ID NO: 6122947 - DNA, 12 bp, Homo sapiens
cggatgctccga

SEQ ID NO: 6122948 - DNA, 19 bp, Homo sapiens
ctccaccgttcaagcgcca

SEQ ID NO: 6122949 - DNA, 21 bp, Homo sapiens
ctccaccgttcaagcgccaga

SEQ ID NO: 6122950 - DNA, 18 bp, Homo sapiens
ctccacctcactagctcc

SEQ ID NO: 6122951 - DNA, 19 bp, Homo sapiens
ctccacctcactagctccc

SEQ ID NO: 6122952 - DNA, 18 bp, Homo sapiens
ctccacctcagccttgga

SEQ ID NO: 6122953 - DNA, 13 bp, Homo sapiens
ctccacctcaggg

SEQ ID NO: 6122954 - DNA, 16 bp, Homo sapiens
ctccacctccctgcaa

SEQ ID NO: 6122955 - DNA, 16 bp, Homo sapiens
ctccacctcctctctt

SEQ ID NO: 6122956 - DNA, 17 bp, Homo sapiens
ctccacctcctctcttg

SEQ ID NO: 6122957 - DNA, 14 bp, Homo sapiens
ctccacctcctgag

SEQ ID NO: 6122958 - DNA, 16 bp, Homo sapiens
ctccacctcctgggtt

SEQ ID NO: 6122959 - DNA, 22 bp, Homo sapiens
ctccacctctcacgggccctgc

SEQ ID NO: 6122960 - DNA, 18 bp, Homo sapiens
ctccacctctccttggaa

SEQ ID NO: 6122961 - DNA, 14 bp, Homo sapiens
ctccacctctggtg

SEQ ID NO: 6122962 - DNA, 13 bp, Homo sapiens
ctccacctctgtg

SEQ ID NO: 6122963 - DNA, 20 bp, Homo sapiens
ctccacctctgtgcagggca

SEQ ID NO: 6122964 - DNA, 22 bp, Homo sapiens
ctccacctcttcaccccccact

SEQ ID NO: 6122965 - DNA, 13 bp, Homo sapiens
ctccacctgcagc

SEQ ID NO: 6122966 - DNA, 18 bp, Homo sapiens
ctccacctgcagccccag

SEQ ID NO: 6122967 - DNA, 19 bp, Homo sapiens
ctccacctgcagccccagg

SEQ ID NO: 6122968 - DNA, 17 bp, Homo sapiens
ctccacctgccagggac

SEQ ID NO: 6122969 - DNA, 18 bp, Homo sapiens
ctccacctgctcccaggc

SEQ ID NO: 6122970 - DNA, 13 bp, Homo sapiens
ctccacctgggag

SEQ ID NO: 6122971 - DNA, 18 bp, Homo sapiens
ctccacctgttcaggagc

SEQ ID NO: 6122972 - DNA, 23 bp, Homo sapiens
ctccacctgttcaggagctgaag

SEQ ID NO: 6122973 - DNA, 18 bp, Homo sapiens
ctccaccttccaggctta

SEQ ID NO: 6122974 - DNA, 19 bp, Homo sapiens
ctccaccttgagcactatt

SEQ ID NO: 6122975 - DNA, 15 bp, Homo sapiens
ctccaccttgcgggg

SEQ ID NO: 6122976 - DNA, 20 bp, Homo sapiens
ctccacgatcctgccaccct

SEQ ID NO: 6122977 - DNA, 23 bp, Homo sapiens
ctccacgatcctgccaccctgta

SEQ ID NO: 6122978 - DNA, 18 bp, Homo sapiens
ctccacgatgcctttgag

SEQ ID NO: 6122979 - DNA, 23 bp, Homo sapiens
ctccacgattacgtgaataaaat

SEQ ID NO: 6122980 - DNA, 20 bp, Homo sapiens
ctccacgcagctggcagaga

SEQ ID NO: 6122981 - DNA, 13 bp, Homo sapiens
ctccacgccctgg

SEQ ID NO: 6122982 - DNA, 14 bp, Homo sapiens
ctccacgccctggg

SEQ ID NO: 6122983 - DNA, 15 bp, Homo sapiens
ctccacgccctgggg

SEQ ID NO: 6122984 - DNA, 21 bp, Homo sapiens
ctccacgcctcctggccagac

SEQ ID NO: 6122985 - DNA, 15 bp, Homo sapiens
ctccacgcgcttcga

SEQ ID NO: 6122986 - DNA, 20 bp, Homo sapiens
ctccacggatgcgtgggcag

SEQ ID NO: 6122987 - DNA, 21 bp, Homo sapiens
ctccacggatgcgtgggcaga

SEQ ID NO: 6122988 - DNA, 14 bp, Homo sapiens
ctccacgggcaggg

SEQ ID NO: 6122989 - DNA, 21 bp, Homo sapiens
ctccacggtagcacttgacct

SEQ ID NO: 6122990 - DNA, 18 bp, Homo sapiens
ctccacggtccgcggcct

SEQ ID NO: 6122991 - DNA, 17 bp, Homo sapiens
ctccacggtgcgtggct

SEQ ID NO: 6122992 - DNA, 19 bp, Homo sapiens
ctccacggtgcgtggctgt

SEQ ID NO: 6122993 - DNA, 21 bp, Homo sapiens
ctccacggtgcgtggctgtgg

SEQ ID NO: 6122994 - DNA, 14 bp, Homo sapiens
ctccacgtctttcc

SEQ ID NO: 6122995 - DNA, 20 bp, Homo sapiens
ctccacgtgtccgtccaccc

SEQ ID NO: 6122996 - DNA, 24 bp, Homo sapiens
ctccacgtgtccgtccacccttcc

SEQ ID NO: 6122997 - DNA, 20 bp, Homo sapiens
ctccacgttcacccctccac

SEQ ID NO: 6122998 - DNA, 15 bp, Homo sapiens
ctccacgttctgctc

SEQ ID NO: 6122999 - DNA, 17 bp, Homo sapiens
ctccacgttctgctcat

SEQ ID NO: 6123000 - DNA, 20 bp, Homo sapiens
ctccactaaatgagctcctg

SEQ ID NO: 6123001 - DNA, 18 bp, Homo sapiens
ctccactactctcttcct

SEQ ID NO: 6123002 - DNA, 17 bp, Homo sapiens
ctccactactttactgt

SEQ ID NO: 6123003 - DNA, 22 bp, Homo sapiens
ctccactattttattaaaaata

SEQ ID NO: 6123004 - DNA, 18 bp, Homo sapiens
ctccactcactccagccc

SEQ ID NO: 6123005 - DNA, 19 bp, Homo sapiens
ctccactcactccagccca

SEQ ID NO: 6123006 - DNA, 15 bp, Homo sapiens
ctccactcactgcat

SEQ ID NO: 6123007 - DNA, 11 bp, Homo sapiens
ctccactcagc

SEQ ID NO: 6123008 - DNA, 12 bp, Homo sapiens
ctccactcagca

SEQ ID NO: 6123009 - DNA, 18 bp, Homo sapiens
ctccactcagggctggcc

SEQ ID NO: 6123010 - DNA, 19 bp, Homo sapiens
ctccactcagggctggccc

SEQ ID NO: 6123011 - DNA, 14 bp, Homo sapiens
ctccactcaggtgc

SEQ ID NO: 6123012 - DNA, 16 bp, Homo sapiens
ctccactcatgtgact

SEQ ID NO: 6123013 - DNA, 15 bp, Homo sapiens
ctccactccacctcc

SEQ ID NO: 6123014 - DNA, 19 bp, Homo sapiens
ctccactccagctctgaga

SEQ ID NO: 6123015 - DNA, 13 bp, Homo sapiens
ctccactcccact

SEQ ID NO: 6123016 - DNA, 17 bp, Homo sapiens
ctccactcccagcagct

SEQ ID NO: 6123017 - DNA, 16 bp, Homo sapiens
ctccactcccccacct

SEQ ID NO: 6123018 - DNA, 14 bp, Homo sapiens
ctccactcccctca

SEQ ID NO: 6123019 - DNA, 18 bp, Homo sapiens
ctccactcctcatcccca

SEQ ID NO: 6123020 - DNA, 13 bp, Homo sapiens
ctccactcctccc

SEQ ID NO: 6123021 - DNA, 13 bp, Homo sapiens
ctccactcctctc

SEQ ID NO: 6123022 - DNA, 12 bp, Homo sapiens
ctccactccttc

SEQ ID NO: 6123023 - DNA, 16 bp, Homo sapiens
ctccactccttccatc

SEQ ID NO: 6123024 - DNA, 16 bp, Homo sapiens
ctccactctcccccac

SEQ ID NO: 6123025 - DNA, 14 bp, Homo sapiens
ctccactctctacc

SEQ ID NO: 6123026 - DNA, 18 bp, Homo sapiens
ctccactctgaagtccct

SEQ ID NO: 6123027 - DNA, 19 bp, Homo sapiens
ctccactctgactggcaca

SEQ ID NO: 6123028 - DNA, 17 bp, Homo sapiens
ctccactctgaggtctc

SEQ ID NO: 6123029 - DNA, 18 bp, Homo sapiens
ctccactctgattcacct

SEQ ID NO: 6123030 - DNA, 19 bp, Homo sapiens
ctccactctgattcacctc

SEQ ID NO: 6123031 - DNA, 13 bp, Homo sapiens
ctccactctgctt

SEQ ID NO: 6123032 - DNA, 13 bp, Homo sapiens
ctccactcttctc

SEQ ID NO: 6123033 - DNA, 20 bp, Homo sapiens
ctccactcttgatctctctt

SEQ ID NO: 6123034 - DNA, 23 bp, Homo sapiens
ctccactcttgatctctcttgtc

SEQ ID NO: 6123035 - DNA, 24 bp, Homo sapiens
ctccactcttgatctctcttgtcc

SEQ ID NO: 6123036 - DNA, 22 bp, Homo sapiens
ctccactgacctggttgtccag

SEQ ID NO: 6123037 - DNA, 13 bp, Homo sapiens
ctccactgccctc

SEQ ID NO: 6123038 - DNA, 15 bp, Homo sapiens
ctccactgccctctg

SEQ ID NO: 6123039 - DNA, 14 bp, Homo sapiens
ctccactgccctgg

SEQ ID NO: 6123040 - DNA, 14 bp, Homo sapiens
ctccactgccttcg

SEQ ID NO: 6123041 - DNA, 18 bp, Homo sapiens
ctccactgctctcagcct

SEQ ID NO: 6123042 - DNA, 13 bp, Homo sapiens
ctccactgctgga

SEQ ID NO: 6123043 - DNA, 16 bp, Homo sapiens
ctccactgctggacat

SEQ ID NO: 6123044 - DNA, 15 bp, Homo sapiens
ctccactggacagac

SEQ ID NO: 6123045 - DNA, 18 bp, Homo sapiens
ctccactggacagaccca

SEQ ID NO: 6123046 - DNA, 20 bp, Homo sapiens
ctccactggacagacccagg

SEQ ID NO: 6123047 - DNA, 14 bp, Homo sapiens
ctccactggaccct

SEQ ID NO: 6123048 - DNA, 13 bp, Homo sapiens
ctccactggatgg

SEQ ID NO: 6123049 - DNA, 12 bp, Homo sapiens
ctccactggcct

SEQ ID NO: 6123050 - DNA, 17 bp, Homo sapiens
ctccactggggaatgct

SEQ ID NO: 6123051 - DNA, 9 bp, Homo sapiens
ctccactgt

SEQ ID NO: 6123052 - DNA, 11 bp, Homo sapiens
ctccactgtca

SEQ ID NO: 6123053 - DNA, 13 bp, Homo sapiens
ctccactgtcttt

SEQ ID NO: 6123054 - DNA, 13 bp, Homo sapiens
ctccactgtgcac

SEQ ID NO: 6123055 - DNA, 16 bp, Homo sapiens
ctccacttcatccaga

SEQ ID NO: 6123056 - DNA, 12 bp, Homo sapiens
ctccacttctcc

SEQ ID NO: 6123057 - DNA, 19 bp, Homo sapiens
ctccacttctggtcccctg

SEQ ID NO: 6123058 - DNA, 20 bp, Homo sapiens
ctccacttctggtcccctgt

SEQ ID NO: 6123059 - DNA, 17 bp, Homo sapiens
ctccacttggcattagc

SEQ ID NO: 6123060 - DNA, 13 bp, Homo sapiens
ctccacttggtct

SEQ ID NO: 6123061 - DNA, 21 bp, Homo sapiens
ctccacttggtctgtgagatg

SEQ ID NO: 6123062 - DNA, 13 bp, Homo sapiens
ctccacttgtata

SEQ ID NO: 6123063 - DNA, 14 bp, Homo sapiens
ctccactttcagct

SEQ ID NO: 6123064 - DNA, 18 bp, Homo sapiens
ctccactttcagctgtct

SEQ ID NO: 6123065 - DNA, 21 bp, Homo sapiens
ctccactttctcaatgcttag

SEQ ID NO: 6123066 - DNA, 20 bp, Homo sapiens
ctccagaaacagctgcttct

SEQ ID NO: 6123067 - DNA, 21 bp, Homo sapiens
ctccagaaacagctgcttctc

SEQ ID NO: 6123068 - DNA, 19 bp, Homo sapiens
ctccagaaatgtccctttc

SEQ ID NO: 6123069 - DNA, 19 bp, Homo sapiens
ctccagaaccgcagaagcc

SEQ ID NO: 6123070 - DNA, 20 bp, Homo sapiens
ctccagaaccgcagaagcct

SEQ ID NO: 6123071 - DNA, 11 bp, Homo sapiens
ctccagaacct

SEQ ID NO: 6123072 - DNA, 19 bp, Homo sapiens
ctccagaaccttactggca

SEQ ID NO: 6123073 - DNA, 17 bp, Homo sapiens
ctccagaactcttcctc

SEQ ID NO: 6123074 - DNA, 13 bp, Homo sapiens
ctccagaagaaaa

SEQ ID NO: 6123075 - DNA, 14 bp, Homo sapiens
ctccagaagatgcc

SEQ ID NO: 6123076 - DNA, 23 bp, Homo sapiens
ctccagaagatgccagcttctct

SEQ ID NO: 6123077 - DNA, 16 bp, Homo sapiens
ctccagaagcactggg

SEQ ID NO: 6123078 - DNA, 12 bp, Homo sapiens
ctccagaagcag

SEQ ID NO: 6123079 - DNA, 13 bp, Homo sapiens
ctccagaagcagc

SEQ ID NO: 6123080 - DNA, 22 bp, Homo sapiens
ctccagaagcagcagctagaaa

SEQ ID NO: 6123081 - DNA, 12 bp, Homo sapiens
ctccagaagcct

SEQ ID NO: 6123082 - DNA, 13 bp, Homo sapiens
ctccagaagcctc

SEQ ID NO: 6123083 - DNA, 18 bp, Homo sapiens
ctccagaagcctctggct

SEQ ID NO: 6123084 - DNA, 19 bp, Homo sapiens
ctccagaagcctctggcta

SEQ ID NO: 6123085 - DNA, 20 bp, Homo sapiens
ctccagaagcctctggctag

SEQ ID NO: 6123086 - DNA, 21 bp, Homo sapiens
ctccagaagcctctggctaga

SEQ ID NO: 6123087 - DNA, 14 bp, Homo sapiens
ctccagaagctgct

SEQ ID NO: 6123088 - DNA, 20 bp, Homo sapiens
ctccagaagtggggctctgg

SEQ ID NO: 6123089 - DNA, 14 bp, Homo sapiens
ctccagaatctgct

SEQ ID NO: 6123090 - DNA, 15 bp, Homo sapiens
ctccagaatctgctg

SEQ ID NO: 6123091 - DNA, 16 bp, Homo sapiens
ctccagaatctgctgt

SEQ ID NO: 6123092 - DNA, 18 bp, Homo sapiens
ctccagaatctgctgttg

SEQ ID NO: 6123093 - DNA, 19 bp, Homo sapiens
ctccagaatctgctgttgc

SEQ ID NO: 6123094 - DNA, 20 bp, Homo sapiens
ctccagaatctgctgttgcc

SEQ ID NO: 6123095 - DNA, 14 bp, Homo sapiens
ctccagaatgtaag

SEQ ID NO: 6123096 - DNA, 19 bp, Homo sapiens
ctccagaatgtgctgcctt

SEQ ID NO: 6123097 - DNA, 22 bp, Homo sapiens
ctccagaattacccttcctcat

SEQ ID NO: 6123098 - DNA, 22 bp, Homo sapiens
ctccagaatttcccaaagcagt

SEQ ID NO: 6123099 - DNA, 17 bp, Homo sapiens
ctccagaatttggaaat

SEQ ID NO: 6123100 - DNA, 11 bp, Homo sapiens
ctccagacaca

SEQ ID NO: 6123101 - DNA, 16 bp, Homo sapiens
ctccagacacatgtcc

SEQ ID NO: 6123102 - DNA, 15 bp, Homo sapiens
ctccagacagataca

SEQ ID NO: 6123103 - DNA, 11 bp, Homo sapiens
ctccagacagg

SEQ ID NO: 6123104 - DNA, 18 bp, Homo sapiens
ctccagacaggaggagtg

SEQ ID NO: 6123105 - DNA, 18 bp, Homo sapiens
ctccagacatggagggga

SEQ ID NO: 6123106 - DNA, 17 bp, Homo sapiens
ctccagacccaccacac

SEQ ID NO: 6123107 - DNA, 13 bp, Homo sapiens
ctccagacccaga

SEQ ID NO: 6123108 - DNA, 21 bp, Homo sapiens
ctccagacccagaggccctga

SEQ ID NO: 6123109 - DNA, 12 bp, Homo sapiens
ctccagaccccc

SEQ ID NO: 6123110 - DNA, 16 bp, Homo sapiens
ctccagacccccagca

SEQ ID NO: 6123111 - DNA, 22 bp, Homo sapiens
ctccagacccctaccctttccc

SEQ ID NO: 6123112 - DNA, 23 bp, Homo sapiens
ctccagacccctaccctttccca

SEQ ID NO: 6123113 - DNA, 18 bp, Homo sapiens
ctccagacccctgtggca

SEQ ID NO: 6123114 - DNA, 13 bp, Homo sapiens
ctccagaccctgc

SEQ ID NO: 6123115 - DNA, 17 bp, Homo sapiens
ctccagaccctgcctga

SEQ ID NO: 6123116 - DNA, 19 bp, Homo sapiens
ctccagaccctgcctgagc

SEQ ID NO: 6123117 - DNA, 11 bp, Homo sapiens
ctccagacctg

SEQ ID NO: 6123118 - DNA, 19 bp, Homo sapiens
ctccagacctgatcctgga

SEQ ID NO: 6123119 - DNA, 19 bp, Homo sapiens
ctccagacctgcccctccc

SEQ ID NO: 6123120 - DNA, 21 bp, Homo sapiens
ctccagacctgcccctccctc

SEQ ID NO: 6123121 - DNA, 13 bp, Homo sapiens
ctccagactcagc

SEQ ID NO: 6123122 - DNA, 14 bp, Homo sapiens
ctccagactcagca

SEQ ID NO: 6123123 - DNA, 16 bp, Homo sapiens
ctccagactcagcaga

SEQ ID NO: 6123124 - DNA, 11 bp, Homo sapiens
ctccagactct

SEQ ID NO: 6123125 - DNA, 14 bp, Homo sapiens
ctccagactctctg

SEQ ID NO: 6123126 - DNA, 22 bp, Homo sapiens
ctccagactctgggggtggaca

SEQ ID NO: 6123127 - DNA, 20 bp, Homo sapiens
ctccagactgcggagcagcc

SEQ ID NO: 6123128 - DNA, 13 bp, Homo sapiens
ctccagacttcaa

SEQ ID NO: 6123129 - DNA, 13 bp, Homo sapiens
cggatgctgcttc

SEQ ID NO: 6123130 - DNA, 16 bp, Homo sapiens
cggatggaaggagaga

SEQ ID NO: 6123131 - DNA, 19 bp, Homo sapiens
cggatggaatcacagccaa

SEQ ID NO: 6123132 - DNA, 18 bp, Homo sapiens
cggatggaccaacctgct

SEQ ID NO: 6123133 - DNA, 16 bp, Homo sapiens
cggatggggcacggac

SEQ ID NO: 6123134 - DNA, 14 bp, Homo sapiens
cggatgtataaatg

SEQ ID NO: 6123135 - DNA, 13 bp, Homo sapiens
cggatgtgctttt

SEQ ID NO: 6123136 - DNA, 20 bp, Homo sapiens
cggatgtgtcctttctgaac

SEQ ID NO: 6123137 - DNA, 18 bp, Homo sapiens
cggattattatttgtact

SEQ ID NO: 6123138 - DNA, 16 bp, Homo sapiens
cggattattttttcag

SEQ ID NO: 6123139 - DNA, 20 bp, Homo sapiens
cggattattttttcagaccg

SEQ ID NO: 6123140 - DNA, 22 bp, Homo sapiens
cggattattttttcagaccgaa

SEQ ID NO: 6123141 - DNA, 20 bp, Homo sapiens
cggattgctctggagcagcc

SEQ ID NO: 6123142 - DNA, 12 bp, Homo sapiens
cggattggccct

SEQ ID NO: 6123143 - DNA, 18 bp, Homo sapiens
cggattggccctgcccct

SEQ ID NO: 6123144 - DNA, 23 bp, Homo sapiens
cggattggccctgcccctccccc

SEQ ID NO: 6123145 - DNA, 21 bp, Homo sapiens
cggatttattatataaatata

SEQ ID NO: 6123146 - DNA, 22 bp, Homo sapiens
cggatttattcccttttaaaga

SEQ ID NO: 6123147 - DNA, 13 bp, Homo sapiens
cggattttttcca

SEQ ID NO: 6123148 - DNA, 16 bp, Homo sapiens
cggattttttccaaaa

SEQ ID NO: 6123149 - DNA, 15 bp, Homo sapiens
cggcaaaagcccatt

SEQ ID NO: 6123150 - DNA, 18 bp, Homo sapiens
cggcaaaattacctctct

SEQ ID NO: 6123151 - DNA, 19 bp, Homo sapiens
cggcaacagggcttctctt

SEQ ID NO: 6123152 - DNA, 17 bp, Homo sapiens
cggcaaccccagttctg

SEQ ID NO: 6123153 - DNA, 19 bp, Homo sapiens
cggcaaccccagttctgct

SEQ ID NO: 6123154 - DNA, 22 bp, Homo sapiens
cggcaaccccagttctgctcct

SEQ ID NO: 6123155 - DNA, 16 bp, Homo sapiens
cggcaacccctgcagc

SEQ ID NO: 6123156 - DNA, 19 bp, Homo sapiens
cggcaacccctgcagctcc

SEQ ID NO: 6123157 - DNA, 17 bp, Homo sapiens
cggcaacctgtaactgc

SEQ ID NO: 6123158 - DNA, 17 bp, Homo sapiens
cggcaagcagcgggcta

SEQ ID NO: 6123159 - DNA, 13 bp, Homo sapiens
cggcaagccacag

SEQ ID NO: 6123160 - DNA, 20 bp, Homo sapiens
cggcaataaaagcccaggag

SEQ ID NO: 6123161 - DNA, 11 bp, Homo sapiens
cggcacagagc

SEQ ID NO: 6123162 - DNA, 20 bp, Homo sapiens
cggcacagagtcgatgctca

SEQ ID NO: 6123163 - DNA, 21 bp, Homo sapiens
cggcacagagtcgatgctcaa

SEQ ID NO: 6123164 - DNA, 19 bp, Homo sapiens
cggcacattggcagtgtgt

SEQ ID NO: 6123165 - DNA, 16 bp, Homo sapiens
cggcaccagtgcctca

SEQ ID NO: 6123166 - DNA, 13 bp, Homo sapiens
cggcacccaggcc

SEQ ID NO: 6123167 - DNA, 18 bp, Homo sapiens
cggcacccaggcctccct

SEQ ID NO: 6123168 - DNA, 19 bp, Homo sapiens
cggcaccccctgcagcttg

SEQ ID NO: 6123169 - DNA, 13 bp, Homo sapiens
cggcaccctctgg

SEQ ID NO: 6123170 - DNA, 15 bp, Homo sapiens
cggcaccctctggcc

SEQ ID NO: 6123171 - DNA, 16 bp, Homo sapiens
cggcaccctctggccg

SEQ ID NO: 6123172 - DNA, 20 bp, Homo sapiens
cggcaccctggtctgtggag

SEQ ID NO: 6123173 - DNA, 15 bp, Homo sapiens
cggcaccgcccaccc

SEQ ID NO: 6123174 - DNA, 21 bp, Homo sapiens
cggcacctacatccccaggtc

SEQ ID NO: 6123175 - DNA, 15 bp, Homo sapiens
cggcacctcccttgg

SEQ ID NO: 6123176 - DNA, 16 bp, Homo sapiens
cggcacctcccttggg

SEQ ID NO: 6123177 - DNA, 17 bp, Homo sapiens
cggcacctgggccctgg

SEQ ID NO: 6123178 - DNA, 19 bp, Homo sapiens
cggcacctgggccctgggg

SEQ ID NO: 6123179 - DNA, 23 bp, Homo sapiens
cggcacctgggccctggggcctg

SEQ ID NO: 6123180 - DNA, 13 bp, Homo sapiens
cggcaccttcccc

SEQ ID NO: 6123181 - DNA, 14 bp, Homo sapiens
cggcactatttctg

SEQ ID NO: 6123182 - DNA, 13 bp, Homo sapiens
cggcactccagcc

SEQ ID NO: 6123183 - DNA, 16 bp, Homo sapiens
cggcactccagcctgg

SEQ ID NO: 6123184 - DNA, 19 bp, Homo sapiens
cggcactgcaaagagacgc

SEQ ID NO: 6123185 - DNA, 18 bp, Homo sapiens
cggcactgcagtctgcag

SEQ ID NO: 6123186 - DNA, 21 bp, Homo sapiens
cggcactgggtttgctccctg

SEQ ID NO: 6123187 - DNA, 16 bp, Homo sapiens
cggcacttcaagcaaa

SEQ ID NO: 6123188 - DNA, 22 bp, Homo sapiens
cggcacttttcattactttctg

SEQ ID NO: 6123189 - DNA, 17 bp, Homo sapiens
cggcagaaaacagagcc

SEQ ID NO: 6123190 - DNA, 21 bp, Homo sapiens
cggcagaaaacagagcctgcc

SEQ ID NO: 6123191 - DNA, 16 bp, Homo sapiens
cggcagaactctctgt

SEQ ID NO: 6123192 - DNA, 13 bp, Homo sapiens
cggcagagaggac

SEQ ID NO: 6123193 - DNA, 14 bp, Homo sapiens
cggcagagctctac

SEQ ID NO: 6123194 - DNA, 20 bp, Homo sapiens
cggcagaggaacccccacca

SEQ ID NO: 6123195 - DNA, 21 bp, Homo sapiens
cggcagaggaacccccaccag

SEQ ID NO: 6123196 - DNA, 14 bp, Homo sapiens
cggcagaggcaggg

SEQ ID NO: 6123197 - DNA, 15 bp, Homo sapiens
cggcagaggcagggc

SEQ ID NO: 6123198 - DNA, 16 bp, Homo sapiens
cggcagaggcagggcc

SEQ ID NO: 6123199 - DNA, 17 bp, Homo sapiens
cggcagaggcagggccc

SEQ ID NO: 6123200 - DNA, 21 bp, Homo sapiens
cggcagagtccttagtggagg

SEQ ID NO: 6123201 - DNA, 14 bp, Homo sapiens
cggcagatgatgct

SEQ ID NO: 6123202 - DNA, 20 bp, Homo sapiens
cggcagatgatgctttggaa

SEQ ID NO: 6123203 - DNA, 15 bp, Homo sapiens
cggcagcatggagct

SEQ ID NO: 6123204 - DNA, 11 bp, Homo sapiens
cggcagcccca

SEQ ID NO: 6123205 - DNA, 13 bp, Homo sapiens
cggcagccccact

SEQ ID NO: 6123206 - DNA, 14 bp, Homo sapiens
cggcagccccactt

SEQ ID NO: 6123207 - DNA, 15 bp, Homo sapiens
cggcagccccacttc

SEQ ID NO: 6123208 - DNA, 15 bp, Homo sapiens
cggcagccccatcct

SEQ ID NO: 6123209 - DNA, 18 bp, Homo sapiens
cggcagccccccagtgtc

SEQ ID NO: 6123210 - DNA, 19 bp, Homo sapiens
cggcagcccccccctcaag

SEQ ID NO: 6123211 - DNA, 20 bp, Homo sapiens
cggcagcccccccctcaagg

SEQ ID NO: 6123212 - DNA, 20 bp, Homo sapiens
cggcagcccctcccagccta

SEQ ID NO: 6123213 - DNA, 22 bp, Homo sapiens
cggcagcctcaacctccctggc

SEQ ID NO: 6123214 - DNA, 15 bp, Homo sapiens
cggcagcgaggctgg

SEQ ID NO: 6123215 - DNA, 14 bp, Homo sapiens
cggcagctcttctg

SEQ ID NO: 6123216 - DNA, 16 bp, Homo sapiens
cggcagctcttctggg

SEQ ID NO: 6123217 - DNA, 18 bp, Homo sapiens
cggcagcttgagcctgtc

SEQ ID NO: 6123218 - DNA, 16 bp, Homo sapiens
cggcaggaaggagcgg

SEQ ID NO: 6123219 - DNA, 18 bp, Homo sapiens
cggcaggaaggagcggcg

SEQ ID NO: 6123220 - DNA, 19 bp, Homo sapiens
cggcaggaaggagcggcgc

SEQ ID NO: 6123221 - DNA, 21 bp, Homo sapiens
cggcaggacaacgaggaagcc

SEQ ID NO: 6123222 - DNA, 11 bp, Homo sapiens
cggcaggacac

SEQ ID NO: 6123223 - DNA, 15 bp, Homo sapiens
cggcaggactgcaga

SEQ ID NO: 6123224 - DNA, 16 bp, Homo sapiens
cggcaggagcaggaac

SEQ ID NO: 6123225 - DNA, 11 bp, Homo sapiens
cggcaggccct

SEQ ID NO: 6123226 - DNA, 16 bp, Homo sapiens
cggcaggcctgagaat

SEQ ID NO: 6123227 - DNA, 19 bp, Homo sapiens
cggcaggcctgagaatgag

SEQ ID NO: 6123228 - DNA, 21 bp, Homo sapiens
cggcaggcctgagaatgagtg

SEQ ID NO: 6123229 - DNA, 19 bp, Homo sapiens
cggcaggctcactgccagg

SEQ ID NO: 6123230 - DNA, 20 bp, Homo sapiens
cggcaggctgggttcattcc

SEQ ID NO: 6123231 - DNA, 12 bp, Homo sapiens
cggcagggcagg

SEQ ID NO: 6123232 - DNA, 15 bp, Homo sapiens
cggcagggccaggct

SEQ ID NO: 6123233 - DNA, 19 bp, Homo sapiens
cggcagggcccccaataaa

SEQ ID NO: 6123234 - DNA, 23 bp, Homo sapiens
cggcagggcccccaataaaccag

SEQ ID NO: 6123235 - DNA, 22 bp, Homo sapiens
cggcagggcgggcagagggctg

SEQ ID NO: 6123236 - DNA, 15 bp, Homo sapiens
cggcaggggcctgga

SEQ ID NO: 6123237 - DNA, 17 bp, Homo sapiens
cggcaggttcacaggcg

SEQ ID NO: 6123238 - DNA, 21 bp, Homo sapiens
cggcagtattgaagctcgtga

SEQ ID NO: 6123239 - DNA, 15 bp, Homo sapiens
cggcagtattttctg

SEQ ID NO: 6123240 - DNA, 13 bp, Homo sapiens
cggcagtggctgg

SEQ ID NO: 6123241 - DNA, 15 bp, Homo sapiens
cggcatccctgcaga

SEQ ID NO: 6123242 - DNA, 17 bp, Homo sapiens
cggcatccgagcccctg

SEQ ID NO: 6123243 - DNA, 12 bp, Homo sapiens
cggcatctcccc

SEQ ID NO: 6123244 - DNA, 19 bp, Homo sapiens
cggcatctcccctagctca

SEQ ID NO: 6123245 - DNA, 13 bp, Homo sapiens
cggcatgaggccc

SEQ ID NO: 6123246 - DNA, 14 bp, Homo sapiens
cggcatgaggcccc

SEQ ID NO: 6123247 - DNA, 13 bp, Homo sapiens
cggcatgccagga

SEQ ID NO: 6123248 - DNA, 15 bp, Homo sapiens
cggcatgccaggacc

SEQ ID NO: 6123249 - DNA, 11 bp, Homo sapiens
cggcatgctgg

SEQ ID NO: 6123250 - DNA, 15 bp, Homo sapiens
cggcatgctggcctg

SEQ ID NO: 6123251 - DNA, 22 bp, Homo sapiens
cggcatgggaaagccacctctc

SEQ ID NO: 6123252 - DNA, 12 bp, Homo sapiens
cggcatgggcga

SEQ ID NO: 6123253 - DNA, 16 bp, Homo sapiens
cggcattcacacacag

SEQ ID NO: 6123254 - DNA, 22 bp, Homo sapiens
cggcatttaacttacatttgta

SEQ ID NO: 6123255 - DNA, 16 bp, Homo sapiens
cggcattttattaaac

SEQ ID NO: 6123256 - DNA, 12 bp, Homo sapiens
cggccaagaatg

SEQ ID NO: 6123257 - DNA, 13 bp, Homo sapiens
cggccaagaatgt

SEQ ID NO: 6123258 - DNA, 14 bp, Homo sapiens
cggccaagaatgta

SEQ ID NO: 6123259 - DNA, 20 bp, Homo sapiens
cggccaagatgcttttcaaa

SEQ ID NO: 6123260 - DNA, 16 bp, Homo sapiens
cggccaaggacactga

SEQ ID NO: 6123261 - DNA, 19 bp, Homo sapiens
cggccaaggacactgatgg

SEQ ID NO: 6123262 - DNA, 20 bp, Homo sapiens
cggccaaggacccaggcgct

SEQ ID NO: 6123263 - DNA, 23 bp, Homo sapiens
cggccaagtaaaatgttttttaa

SEQ ID NO: 6123264 - DNA, 14 bp, Homo sapiens
cggccaatggaaac

SEQ ID NO: 6123265 - DNA, 21 bp, Homo sapiens
cggccaatggtgcttccccca

SEQ ID NO: 6123266 - DNA, 16 bp, Homo sapiens
cggccacacagctgcc

SEQ ID NO: 6123267 - DNA, 14 bp, Homo sapiens
cggccacacatcct

SEQ ID NO: 6123268 - DNA, 13 bp, Homo sapiens
cggccacacccca

SEQ ID NO: 6123269 - DNA, 14 bp, Homo sapiens
cggccacacccctc

SEQ ID NO: 6123270 - DNA, 14 bp, Homo sapiens
cggccacagctgct

SEQ ID NO: 6123271 - DNA, 16 bp, Homo sapiens
cggccacagctgctgg

SEQ ID NO: 6123272 - DNA, 17 bp, Homo sapiens
cggccacagctgctgga

SEQ ID NO: 6123273 - DNA, 21 bp, Homo sapiens
cggccacagggcggtaccttg

SEQ ID NO: 6123274 - DNA, 11 bp, Homo sapiens
cggccacatgc

SEQ ID NO: 6123275 - DNA, 14 bp, Homo sapiens
cggccacatgccgc

SEQ ID NO: 6123276 - DNA, 16 bp, Homo sapiens
cggccaccagatgctg

SEQ ID NO: 6123277 - DNA, 12 bp, Homo sapiens
cggccacctctg

SEQ ID NO: 6123278 - DNA, 17 bp, Homo sapiens
cggccacgcactgggcc

SEQ ID NO: 6123279 - DNA, 18 bp, Homo sapiens
cggccacgcactgggcca

SEQ ID NO: 6123280 - DNA, 20 bp, Homo sapiens
cggccacgtctgtgctctgt

SEQ ID NO: 6123281 - DNA, 15 bp, Homo sapiens
cggccactctgtttg

SEQ ID NO: 6123282 - DNA, 23 bp, Homo sapiens
cggccactctgtttgctcaccca

SEQ ID NO: 6123283 - DNA, 16 bp, Homo sapiens
cggccactggccatct

SEQ ID NO: 6123284 - DNA, 12 bp, Homo sapiens
cggccactgtgt

SEQ ID NO: 6123285 - DNA, 17 bp, Homo sapiens
cggccactgtgtctctg

SEQ ID NO: 6123286 - DNA, 14 bp, Homo sapiens
cggccagagctccc

SEQ ID NO: 6123287 - DNA, 16 bp, Homo sapiens
cggccagagctcccag

SEQ ID NO: 6123288 - DNA, 21 bp, Homo sapiens
cggccagaggggctgctccag

SEQ ID NO: 6123289 - DNA, 14 bp, Homo sapiens
cggccagccagcca

SEQ ID NO: 6123290 - DNA, 20 bp, Homo sapiens
cggccagccccggccctggg

SEQ ID NO: 6123291 - DNA, 14 bp, Homo sapiens
cggccagccctccc

SEQ ID NO: 6123292 - DNA, 17 bp, Homo sapiens
cggccagcgggcacagg

SEQ ID NO: 6123293 - DNA, 17 bp, Homo sapiens
cggccagcgtcccaggg

SEQ ID NO: 6123294 - DNA, 15 bp, Homo sapiens
cggccagctctggag

SEQ ID NO: 6123295 - DNA, 15 bp, Homo sapiens
cggccaggcacaggg

SEQ ID NO: 6123296 - DNA, 17 bp, Homo sapiens
cggccaggcacagggcc

SEQ ID NO: 6123297 - DNA, 23 bp, Homo sapiens
cggccaggcacccatgtgggcgc

SEQ ID NO: 6123298 - DNA, 19 bp, Homo sapiens
cggccaggcacggaggctc

SEQ ID NO: 6123299 - DNA, 21 bp, Homo sapiens
cggccaggcattggctcagcc

SEQ ID NO: 6123300 - DNA, 11 bp, Homo sapiens
cggccaggcca

SEQ ID NO: 6123301 - DNA, 12 bp, Homo sapiens
cggccaggccag

SEQ ID NO: 6123302 - DNA, 22 bp, Homo sapiens
cggccaggccgcgcccagcaga

SEQ ID NO: 6123303 - DNA, 15 bp, Homo sapiens
cggccaggcctgcgg

SEQ ID NO: 6123304 - DNA, 15 bp, Homo sapiens
cggccaggctccctg

SEQ ID NO: 6123305 - DNA, 16 bp, Homo sapiens
cggccaggctccctga

SEQ ID NO: 6123306 - DNA, 16 bp, Homo sapiens
cggccaggctggagtg

SEQ ID NO: 6123307 - DNA, 20 bp, Homo sapiens
cggccaggctgggctctggg

SEQ ID NO: 6123308 - DNA, 14 bp, Homo sapiens
cggccagggacccc

SEQ ID NO: 6123309 - DNA, 19 bp, Homo sapiens
cggccagggacccccgagg

SEQ ID NO: 6123310 - DNA, 18 bp, Homo sapiens
ctccagagaaacccaggg

SEQ ID NO: 6123311 - DNA, 12 bp, Homo sapiens
ctccagagacac

SEQ ID NO: 6123312 - DNA, 13 bp, Homo sapiens
ctccagagacact

SEQ ID NO: 6123313 - DNA, 17 bp, Homo sapiens
ctccagagacactgagc

SEQ ID NO: 6123314 - DNA, 19 bp, Homo sapiens
ctccagagcaacgaccagg

SEQ ID NO: 6123315 - DNA, 11 bp, Homo sapiens
ctccagagcca

SEQ ID NO: 6123316 - DNA, 14 bp, Homo sapiens
ctccagagccagcc

SEQ ID NO: 6123317 - DNA, 17 bp, Homo sapiens
ctccagagccagcctgg

SEQ ID NO: 6123318 - DNA, 20 bp, Homo sapiens
ctccagagccagcctgggac

SEQ ID NO: 6123319 - DNA, 15 bp, Homo sapiens
ctccagagcctgggc

SEQ ID NO: 6123320 - DNA, 21 bp, Homo sapiens
ctccagagctgtcctcctggc

SEQ ID NO: 6123321 - DNA, 13 bp, Homo sapiens
ctccagaggacct

SEQ ID NO: 6123322 - DNA, 14 bp, Homo sapiens
ctccagagggacag

SEQ ID NO: 6123323 - DNA, 19 bp, Homo sapiens
ctccagagggcactcagaa

SEQ ID NO: 6123324 - DNA, 23 bp, Homo sapiens
ctccagagggcactcagaagttg

SEQ ID NO: 6123325 - DNA, 20 bp, Homo sapiens
ctccagagggcactctgctt

SEQ ID NO: 6123326 - DNA, 14 bp, Homo sapiens
ctccagaggtcctc

SEQ ID NO: 6123327 - DNA, 17 bp, Homo sapiens
ctccagaggtggaggtg

SEQ ID NO: 6123328 - DNA, 15 bp, Homo sapiens
ctccagagtaggtgg

SEQ ID NO: 6123329 - DNA, 21 bp, Homo sapiens
ctccagagtaggtgggtcttg

SEQ ID NO: 6123330 - DNA, 15 bp, Homo sapiens
ctccagagtctgagc

SEQ ID NO: 6123331 - DNA, 18 bp, Homo sapiens
ctccagataactctcttt

SEQ ID NO: 6123332 - DNA, 20 bp, Homo sapiens
ctccagataactctctttcc

SEQ ID NO: 6123333 - DNA, 21 bp, Homo sapiens
ctccagatagctcatttcatt

SEQ ID NO: 6123334 - DNA, 16 bp, Homo sapiens
ctccagatcctctttc

SEQ ID NO: 6123335 - DNA, 18 bp, Homo sapiens
ctccagatcctctttccc

SEQ ID NO: 6123336 - DNA, 22 bp, Homo sapiens
ctccagatcctctttccccact

SEQ ID NO: 6123337 - DNA, 13 bp, Homo sapiens
ctccagatctgca

SEQ ID NO: 6123338 - DNA, 18 bp, Homo sapiens
ctccagatctgcactggg

SEQ ID NO: 6123339 - DNA, 21 bp, Homo sapiens
ctccagatctgcactgggtgt

SEQ ID NO: 6123340 - DNA, 17 bp, Homo sapiens
ctccagatgcagggcag

SEQ ID NO: 6123341 - DNA, 21 bp, Homo sapiens
ctccagatgtttctcatttta

SEQ ID NO: 6123342 - DNA, 15 bp, Homo sapiens
ctccagattattttc

SEQ ID NO: 6123343 - DNA, 13 bp, Homo sapiens
ctccagattctga

SEQ ID NO: 6123344 - DNA, 16 bp, Homo sapiens
ctccagattctgatgc

SEQ ID NO: 6123345 - DNA, 17 bp, Homo sapiens
ctccagattctgatgca

SEQ ID NO: 6123346 - DNA, 16 bp, Homo sapiens
ctccagatttttaata

SEQ ID NO: 6123347 - DNA, 17 bp, Homo sapiens
ctccagcaaagctcccg

SEQ ID NO: 6123348 - DNA, 17 bp, Homo sapiens
ctccagcaacacagcct

SEQ ID NO: 6123349 - DNA, 18 bp, Homo sapiens
ctccagcaactgcccttc

SEQ ID NO: 6123350 - DNA, 22 bp, Homo sapiens
ctccagcaactgcccttccagg

SEQ ID NO: 6123351 - DNA, 23 bp, Homo sapiens
ctccagcaactgcccttccaggt

SEQ ID NO: 6123352 - DNA, 21 bp, Homo sapiens
ctccagcaacttcttctccat

SEQ ID NO: 6123353 - DNA, 22 bp, Homo sapiens
ctccagcaagcaaacagggtgg

SEQ ID NO: 6123354 - DNA, 16 bp, Homo sapiens
ctccagcacaaacaca

SEQ ID NO: 6123355 - DNA, 19 bp, Homo sapiens
ctccagcacaaacacaagg

SEQ ID NO: 6123356 - DNA, 21 bp, Homo sapiens
ctccagcacagactgttccct

SEQ ID NO: 6123357 - DNA, 14 bp, Homo sapiens
ctccagcaccttct

SEQ ID NO: 6123358 - DNA, 22 bp, Homo sapiens
ctccagcacgcgacttctcagg

SEQ ID NO: 6123359 - DNA, 20 bp, Homo sapiens
ctccagcagataaggccgag

SEQ ID NO: 6123360 - DNA, 14 bp, Homo sapiens
ctccagcagcacac

SEQ ID NO: 6123361 - DNA, 16 bp, Homo sapiens
ctccagcagcacacct

SEQ ID NO: 6123362 - DNA, 20 bp, Homo sapiens
ctccagcagcacacctcagc

SEQ ID NO: 6123363 - DNA, 22 bp, Homo sapiens
ctccagcagcacacctcagccc

SEQ ID NO: 6123364 - DNA, 22 bp, Homo sapiens
ctccagcaggcccatgggaggc

SEQ ID NO: 6123365 - DNA, 22 bp, Homo sapiens
ctccagcaggtaggggcacagt

SEQ ID NO: 6123366 - DNA, 16 bp, Homo sapiens
ctccagcagtgctggg

SEQ ID NO: 6123367 - DNA, 20 bp, Homo sapiens
ctccagcagtgctgggccca

SEQ ID NO: 6123368 - DNA, 19 bp, Homo sapiens
ctccagcagttaggcacct

SEQ ID NO: 6123369 - DNA, 17 bp, Homo sapiens
ctccagcatccagcctg

SEQ ID NO: 6123370 - DNA, 21 bp, Homo sapiens
ctccagcatccagcctgtgtg

SEQ ID NO: 6123371 - DNA, 16 bp, Homo sapiens
ctccagcatcccagcc

SEQ ID NO: 6123372 - DNA, 13 bp, Homo sapiens
ctccagcatcctg

SEQ ID NO: 6123373 - DNA, 16 bp, Homo sapiens
ctccagcatcctgctt

SEQ ID NO: 6123374 - DNA, 22 bp, Homo sapiens
ctccagcatcttttccatcctg

SEQ ID NO: 6123375 - DNA, 20 bp, Homo sapiens
ctccagcatttagataatct

SEQ ID NO: 6123376 - DNA, 17 bp, Homo sapiens
ctccagccaacccctgt

SEQ ID NO: 6123377 - DNA, 19 bp, Homo sapiens
ctccagccaacccctgtgg

SEQ ID NO: 6123378 - DNA, 20 bp, Homo sapiens
ctccagccaacccctgtgga

SEQ ID NO: 6123379 - DNA, 12 bp, Homo sapiens
ctccagccaaga

SEQ ID NO: 6123380 - DNA, 18 bp, Homo sapiens
ctccagccacccagccag

SEQ ID NO: 6123381 - DNA, 12 bp, Homo sapiens
ctccagccagca

SEQ ID NO: 6123382 - DNA, 23 bp, Homo sapiens
ctccagccagcaatgatgtccag

SEQ ID NO: 6123383 - DNA, 20 bp, Homo sapiens
ctccagccagcgcctccctc

SEQ ID NO: 6123384 - DNA, 23 bp, Homo sapiens
ctccagccatcaagagactgagt

SEQ ID NO: 6123385 - DNA, 15 bp, Homo sapiens
ctccagccattgtaa

SEQ ID NO: 6123386 - DNA, 19 bp, Homo sapiens
ctccagcccacacccctcc

SEQ ID NO: 6123387 - DNA, 20 bp, Homo sapiens
ctccagcccacacccctcca

SEQ ID NO: 6123388 - DNA, 19 bp, Homo sapiens
ctccagcccacagtgctca

SEQ ID NO: 6123389 - DNA, 20 bp, Homo sapiens
ctccagcccacagtgctcag

SEQ ID NO: 6123390 - DNA, 13 bp, Homo sapiens
ctccagcccacgt

SEQ ID NO: 6123391 - DNA, 11 bp, Homo sapiens
ctccagcccag

SEQ ID NO: 6123392 - DNA, 13 bp, Homo sapiens
ctccagccccatg

SEQ ID NO: 6123393 - DNA, 14 bp, Homo sapiens
ctccagccccatgt

SEQ ID NO: 6123394 - DNA, 11 bp, Homo sapiens
ctccagcccct

SEQ ID NO: 6123395 - DNA, 21 bp, Homo sapiens
ctccagcccctcttggagaag

SEQ ID NO: 6123396 - DNA, 22 bp, Homo sapiens
ctccagcccctcttggagaagt

SEQ ID NO: 6123397 - DNA, 13 bp, Homo sapiens
ctccagcccctgg

SEQ ID NO: 6123398 - DNA, 15 bp, Homo sapiens
ctccagcccctggac

SEQ ID NO: 6123399 - DNA, 22 bp, Homo sapiens
ctccagcccctggacccctggg

SEQ ID NO: 6123400 - DNA, 16 bp, Homo sapiens
ctccagcccctggatg

SEQ ID NO: 6123401 - DNA, 17 bp, Homo sapiens
ctccagcccctggatgc

SEQ ID NO: 6123402 - DNA, 14 bp, Homo sapiens
ctccagcccctgtc

SEQ ID NO: 6123403 - DNA, 16 bp, Homo sapiens
ctccagcccctgtccc

SEQ ID NO: 6123404 - DNA, 21 bp, Homo sapiens
ctccagccccttctcagaatc

SEQ ID NO: 6123405 - DNA, 14 bp, Homo sapiens
ctccagcccctttc

SEQ ID NO: 6123406 - DNA, 17 bp, Homo sapiens
ctccagcccctttccaa

SEQ ID NO: 6123407 - DNA, 14 bp, Homo sapiens
ctccagcccgcagc

SEQ ID NO: 6123408 - DNA, 14 bp, Homo sapiens
ctccagcccgggag

SEQ ID NO: 6123409 - DNA, 16 bp, Homo sapiens
ctccagcccgggagcc

SEQ ID NO: 6123410 - DNA, 19 bp, Homo sapiens
ctccagcccgggagcctag

SEQ ID NO: 6123411 - DNA, 22 bp, Homo sapiens
ctccagcccgggagcctaggac

SEQ ID NO: 6123412 - DNA, 23 bp, Homo sapiens
ctccagcccgggagcctaggacc

SEQ ID NO: 6123413 - DNA, 11 bp, Homo sapiens
ctccagccctg

SEQ ID NO: 6123414 - DNA, 13 bp, Homo sapiens
ctccagccctgcc

SEQ ID NO: 6123415 - DNA, 20 bp, Homo sapiens
ctccagccctgcccaccctc

SEQ ID NO: 6123416 - DNA, 21 bp, Homo sapiens
ctccagccctgcccaccctcc

SEQ ID NO: 6123417 - DNA, 13 bp, Homo sapiens
ctccagccctgtc

SEQ ID NO: 6123418 - DNA, 18 bp, Homo sapiens
ctccagcccttcagacga

SEQ ID NO: 6123419 - DNA, 15 bp, Homo sapiens
ctccagcctcacaga

SEQ ID NO: 6123420 - DNA, 23 bp, Homo sapiens
ctccagcctcacagatgctggcc

SEQ ID NO: 6123421 - DNA, 12 bp, Homo sapiens
ctccagcctcag

SEQ ID NO: 6123422 - DNA, 13 bp, Homo sapiens
ctccagcctcccc

SEQ ID NO: 6123423 - DNA, 14 bp, Homo sapiens
ctccagcctcccct

SEQ ID NO: 6123424 - DNA, 15 bp, Homo sapiens
ctccagcctcccctc

SEQ ID NO: 6123425 - DNA, 20 bp, Homo sapiens
ctccagcctccctgtctcca

SEQ ID NO: 6123426 - DNA, 21 bp, Homo sapiens
ctccagcctccctgtctccag

SEQ ID NO: 6123427 - DNA, 23 bp, Homo sapiens
ctccagcctccctgtctccagct

SEQ ID NO: 6123428 - DNA, 11 bp, Homo sapiens
ctccagcctct

SEQ ID NO: 6123429 - DNA, 12 bp, Homo sapiens
ctccagcctctc

SEQ ID NO: 6123430 - DNA, 14 bp, Homo sapiens
ctccagcctctccc

SEQ ID NO: 6123431 - DNA, 19 bp, Homo sapiens
ctccagcctctcccggctg

SEQ ID NO: 6123432 - DNA, 20 bp, Homo sapiens
ctccagcctctcccggctgc

SEQ ID NO: 6123433 - DNA, 23 bp, Homo sapiens
ctccagcctctcccggctgcctg

SEQ ID NO: 6123434 - DNA, 16 bp, Homo sapiens
ctccagcctctgccgc

SEQ ID NO: 6123435 - DNA, 19 bp, Homo sapiens
ctccagcctctgccgctgc

SEQ ID NO: 6123436 - DNA, 23 bp, Homo sapiens
ctccagcctctgccgctgccatg

SEQ ID NO: 6123437 - DNA, 12 bp, Homo sapiens
ctccagcctgaa

SEQ ID NO: 6123438 - DNA, 23 bp, Homo sapiens
ctccagcctgaatgttatttcct

SEQ ID NO: 6123439 - DNA, 12 bp, Homo sapiens
ctccagcctgac

SEQ ID NO: 6123440 - DNA, 13 bp, Homo sapiens
ctccagcctgaca

SEQ ID NO: 6123441 - DNA, 23 bp, Homo sapiens
ctccagcctgacaacagcctgag

SEQ ID NO: 6123442 - DNA, 19 bp, Homo sapiens
ctccagcctgcctggcagg

SEQ ID NO: 6123443 - DNA, 19 bp, Homo sapiens
ctccagcctggacccccag

SEQ ID NO: 6123444 - DNA, 22 bp, Homo sapiens
ctccagcctggacccccagctt

SEQ ID NO: 6123445 - DNA, 13 bp, Homo sapiens
ctccagcctggct

SEQ ID NO: 6123446 - DNA, 12 bp, Homo sapiens
ctccagcctggg

SEQ ID NO: 6123447 - DNA, 20 bp, Homo sapiens
ctccagcctgggaggcacag

SEQ ID NO: 6123448 - DNA, 23 bp, Homo sapiens
ctccagcctgggcaacaagagca

SEQ ID NO: 6123449 - DNA, 18 bp, Homo sapiens
ctccagcctgggcgacag

SEQ ID NO: 6123450 - DNA, 13 bp, Homo sapiens
ctccagcctgggt

SEQ ID NO: 6123451 - DNA, 21 bp, Homo sapiens
ctccagcctgggtgacagagc

SEQ ID NO: 6123452 - DNA, 18 bp, Homo sapiens
ctccagcctgtcggccac

SEQ ID NO: 6123453 - DNA, 19 bp, Homo sapiens
ctccagcctttgctccctc

SEQ ID NO: 6123454 - DNA, 21 bp, Homo sapiens
ctccagcctttggccttggct

SEQ ID NO: 6123455 - DNA, 16 bp, Homo sapiens
ctccagcgagtacccc

SEQ ID NO: 6123456 - DNA, 22 bp, Homo sapiens
ctccagcgggacaccctggttc

SEQ ID NO: 6123457 - DNA, 23 bp, Homo sapiens
ctccagcggttgccttttttatc

SEQ ID NO: 6123458 - DNA, 14 bp, Homo sapiens
ctccagcgtcctca

SEQ ID NO: 6123459 - DNA, 15 bp, Homo sapiens
ctccagcgtcctcag

SEQ ID NO: 6123460 - DNA, 23 bp, Homo sapiens
ctccagcgtcctcagcaccccac

SEQ ID NO: 6123461 - DNA, 10 bp, Homo sapiens
ctccagctca

SEQ ID NO: 6123462 - DNA, 15 bp, Homo sapiens
ctccagctcaccagc

SEQ ID NO: 6123463 - DNA, 17 bp, Homo sapiens
ctccagctcagaaccca

SEQ ID NO: 6123464 - DNA, 13 bp, Homo sapiens
ctccagctccagt

SEQ ID NO: 6123465 - DNA, 14 bp, Homo sapiens
ctccagctccagtt

SEQ ID NO: 6123466 - DNA, 11 bp, Homo sapiens
ctccagctccc

SEQ ID NO: 6123467 - DNA, 17 bp, Homo sapiens
ctccagctccctgtgcc

SEQ ID NO: 6123468 - DNA, 22 bp, Homo sapiens
ctccagctcctctccagacaca

SEQ ID NO: 6123469 - DNA, 18 bp, Homo sapiens
ctccagctcctgccccgc

SEQ ID NO: 6123470 - DNA, 19 bp, Homo sapiens
ctccagctcctgccccgcc

SEQ ID NO: 6123471 - DNA, 16 bp, Homo sapiens
ctccagctcctttggg

SEQ ID NO: 6123472 - DNA, 14 bp, Homo sapiens
ctccagctctggca

SEQ ID NO: 6123473 - DNA, 21 bp, Homo sapiens
ctccagctctggcttcctgct

SEQ ID NO: 6123474 - DNA, 20 bp, Homo sapiens
ctccagctgactaaactttt

SEQ ID NO: 6123475 - DNA, 19 bp, Homo sapiens
ctccagctgagtcctgggg

SEQ ID NO: 6123476 - DNA, 13 bp, Homo sapiens
ctccagctgcccc

SEQ ID NO: 6123477 - DNA, 12 bp, Homo sapiens
ctccagctgcct

SEQ ID NO: 6123478 - DNA, 15 bp, Homo sapiens
ctccagctgcctggg

SEQ ID NO: 6123479 - DNA, 20 bp, Homo sapiens
ctccagctgctgagatcctg

SEQ ID NO: 6123480 - DNA, 21 bp, Homo sapiens
ctccagctgctgagatcctgg

SEQ ID NO: 6123481 - DNA, 23 bp, Homo sapiens
ctccagctgctgagatcctggac

SEQ ID NO: 6123482 - DNA, 21 bp, Homo sapiens
ctccagctgctgctctcccct

SEQ ID NO: 6123483 - DNA, 11 bp, Homo sapiens
ctccagctgga

SEQ ID NO: 6123484 - DNA, 13 bp, Homo sapiens
ctccagctgggat

SEQ ID NO: 6123485 - DNA, 19 bp, Homo sapiens
ctccagctgggctctgcaa

SEQ ID NO: 6123486 - DNA, 19 bp, Homo sapiens
ctccagctgggttggaaaa

SEQ ID NO: 6123487 - DNA, 19 bp, Homo sapiens
ctccagctggtgcccccag

SEQ ID NO: 6123488 - DNA, 13 bp, Homo sapiens
cggccagggcctg

SEQ ID NO: 6123489 - DNA, 16 bp, Homo sapiens
cggccagggcctggtg

SEQ ID NO: 6123490 - DNA, 21 bp, Homo sapiens
cggccagtgcggctgccaggt

SEQ ID NO: 6123491 - DNA, 22 bp, Homo sapiens
cggccatgaccactttccccgt

SEQ ID NO: 6123492 - DNA, 19 bp, Homo sapiens
cggccatgagactgatccc

SEQ ID NO: 6123493 - DNA, 22 bp, Homo sapiens
cggccattgaacactgcaccct

SEQ ID NO: 6123494 - DNA, 20 bp, Homo sapiens
cggcccaacccaaccactcg

SEQ ID NO: 6123495 - DNA, 15 bp, Homo sapiens
cggcccaagcccgac

SEQ ID NO: 6123496 - DNA, 15 bp, Homo sapiens
cggcccaatccaagg

SEQ ID NO: 6123497 - DNA, 17 bp, Homo sapiens
cggcccacaattaattt

SEQ ID NO: 6123498 - DNA, 15 bp, Homo sapiens
cggcccacgcagagc

SEQ ID NO: 6123499 - DNA, 17 bp, Homo sapiens
cggcccacgcagagccc

SEQ ID NO: 6123500 - DNA, 14 bp, Homo sapiens
cggcccacgccagc

SEQ ID NO: 6123501 - DNA, 18 bp, Homo sapiens
cggcccacgccagctggc

SEQ ID NO: 6123502 - DNA, 15 bp, Homo sapiens
cggcccacgtcctgg

SEQ ID NO: 6123503 - DNA, 18 bp, Homo sapiens
cggcccacgtcctgggtg

SEQ ID NO: 6123504 - DNA, 19 bp, Homo sapiens
cggcccactttcctgagct

SEQ ID NO: 6123505 - DNA, 18 bp, Homo sapiens
cggcccagatgtgtcccc

SEQ ID NO: 6123506 - DNA, 12 bp, Homo sapiens
cggcccagccat

SEQ ID NO: 6123507 - DNA, 17 bp, Homo sapiens
cggcccagcccggctcc

SEQ ID NO: 6123508 - DNA, 11 bp, Homo sapiens
cggcccaggcc

SEQ ID NO: 6123509 - DNA, 12 bp, Homo sapiens
cggcccaggcca

SEQ ID NO: 6123510 - DNA, 18 bp, Homo sapiens
cggcccaggccaggtgcc

SEQ ID NO: 6123511 - DNA, 22 bp, Homo sapiens
cggcccagggagggtgagctgg

SEQ ID NO: 6123512 - DNA, 12 bp, Homo sapiens
cggcccagggcc

SEQ ID NO: 6123513 - DNA, 20 bp, Homo sapiens
cggcccagtgccactgcccc

SEQ ID NO: 6123514 - DNA, 18 bp, Homo sapiens
cggcccagtgccagctcc

SEQ ID NO: 6123515 - DNA, 19 bp, Homo sapiens
cggcccagtgccagctcca

SEQ ID NO: 6123516 - DNA, 18 bp, Homo sapiens
cggcccatatccctggtt

SEQ ID NO: 6123517 - DNA, 15 bp, Homo sapiens
cggccccaccagtgc

SEQ ID NO: 6123518 - DNA, 16 bp, Homo sapiens
cggccccaccagtgcc

SEQ ID NO: 6123519 - DNA, 17 bp, Homo sapiens
cggccccaccagtgcct

SEQ ID NO: 6123520 - DNA, 21 bp, Homo sapiens
cggccccacccaccctctggt

SEQ ID NO: 6123521 - DNA, 14 bp, Homo sapiens
cggccccaccccct

SEQ ID NO: 6123522 - DNA, 21 bp, Homo sapiens
cggccccaccccctgggcaga

SEQ ID NO: 6123523 - DNA, 14 bp, Homo sapiens
cggccccagccaga

SEQ ID NO: 6123524 - DNA, 13 bp, Homo sapiens
cggccccaggagg

SEQ ID NO: 6123525 - DNA, 16 bp, Homo sapiens
cggccccaggagggga

SEQ ID NO: 6123526 - DNA, 17 bp, Homo sapiens
cggccccaggaggggaa

SEQ ID NO: 6123527 - DNA, 12 bp, Homo sapiens
cggccccaggct

SEQ ID NO: 6123528 - DNA, 13 bp, Homo sapiens
cggccccaggctc

SEQ ID NO: 6123529 - DNA, 19 bp, Homo sapiens
cggccccaggctcccctgg

SEQ ID NO: 6123530 - DNA, 14 bp, Homo sapiens
cggccccatcagag

SEQ ID NO: 6123531 - DNA, 20 bp, Homo sapiens
cggccccatcagaggctggg

SEQ ID NO: 6123532 - DNA, 17 bp, Homo sapiens
cggccccatcgccccac

SEQ ID NO: 6123533 - DNA, 23 bp, Homo sapiens
cggccccccctcttttggccttg

SEQ ID NO: 6123534 - DNA, 17 bp, Homo sapiens
cggccccccgcacagcc

SEQ ID NO: 6123535 - DNA, 21 bp, Homo sapiens
cggccccccgcacagccaccc

SEQ ID NO: 6123536 - DNA, 15 bp, Homo sapiens
cggcccccggccaag

SEQ ID NO: 6123537 - DNA, 16 bp, Homo sapiens
cggcccccggccaagg

SEQ ID NO: 6123538 - DNA, 21 bp, Homo sapiens
cggcccccggccaaggaccca

SEQ ID NO: 6123539 - DNA, 17 bp, Homo sapiens
cggccccctccatcggg

SEQ ID NO: 6123540 - DNA, 12 bp, Homo sapiens
cggccccctgcc

SEQ ID NO: 6123541 - DNA, 18 bp, Homo sapiens
cggccccctggtctctgg

SEQ ID NO: 6123542 - DNA, 15 bp, Homo sapiens
cggccccgcacccct

SEQ ID NO: 6123543 - DNA, 22 bp, Homo sapiens
cggccccgcacccctcctcctt

SEQ ID NO: 6123544 - DNA, 16 bp, Homo sapiens
cggccccgcgcgtgcc

SEQ ID NO: 6123545 - DNA, 15 bp, Homo sapiens
cggccccggccccag

SEQ ID NO: 6123546 - DNA, 14 bp, Homo sapiens
cggcccctcaccct

SEQ ID NO: 6123547 - DNA, 18 bp, Homo sapiens
cggcccctcaccctctgt

SEQ ID NO: 6123548 - DNA, 21 bp, Homo sapiens
cggcccctcaccctctgtccc

SEQ ID NO: 6123549 - DNA, 15 bp, Homo sapiens
cggcccctcccgccc

SEQ ID NO: 6123550 - DNA, 14 bp, Homo sapiens
cggcccctcctgac

SEQ ID NO: 6123551 - DNA, 11 bp, Homo sapiens
cggcccctgcc

SEQ ID NO: 6123552 - DNA, 15 bp, Homo sapiens
cggcccgcctgccca

SEQ ID NO: 6123553 - DNA, 14 bp, Homo sapiens
cggcccggcccacg

SEQ ID NO: 6123554 - DNA, 16 bp, Homo sapiens
cggcccggcccacgca

SEQ ID NO: 6123555 - DNA, 12 bp, Homo sapiens
cggcccggcccc

SEQ ID NO: 6123556 - DNA, 16 bp, Homo sapiens
cggcccggctgagccc

SEQ ID NO: 6123557 - DNA, 15 bp, Homo sapiens
cggcccgtgcgcagc

SEQ ID NO: 6123558 - DNA, 17 bp, Homo sapiens
cggcccgtgcgcagccg

SEQ ID NO: 6123559 - DNA, 19 bp, Homo sapiens
cggcccgtggacaccccag

SEQ ID NO: 6123560 - DNA, 21 bp, Homo sapiens
cggcccgtggacaccccagac

SEQ ID NO: 6123561 - DNA, 16 bp, Homo sapiens
cggcccgtggctgttg

SEQ ID NO: 6123562 - DNA, 18 bp, Homo sapiens
cggccctaccagcgcccg

SEQ ID NO: 6123563 - DNA, 18 bp, Homo sapiens
cggccctagcccagcgct

SEQ ID NO: 6123564 - DNA, 15 bp, Homo sapiens
cggccctcagtgcat

SEQ ID NO: 6123565 - DNA, 14 bp, Homo sapiens
cggccctcccaggc

SEQ ID NO: 6123566 - DNA, 15 bp, Homo sapiens
cggccctcccaggcg

SEQ ID NO: 6123567 - DNA, 17 bp, Homo sapiens
cggccctcccccagctc

SEQ ID NO: 6123568 - DNA, 18 bp, Homo sapiens
cggccctcccccagctcc

SEQ ID NO: 6123569 - DNA, 13 bp, Homo sapiens
cggccctccctgc

SEQ ID NO: 6123570 - DNA, 12 bp, Homo sapiens
cggccctcctgg

SEQ ID NO: 6123571 - DNA, 21 bp, Homo sapiens
cggccctgaaccacgaggctg

SEQ ID NO: 6123572 - DNA, 22 bp, Homo sapiens
cggccctgaaccacgaggctgc

SEQ ID NO: 6123573 - DNA, 19 bp, Homo sapiens
cggccctgcagccagctca

SEQ ID NO: 6123574 - DNA, 15 bp, Homo sapiens
cggccctgcaggagc

SEQ ID NO: 6123575 - DNA, 17 bp, Homo sapiens
cggccctgcaggagcag

SEQ ID NO: 6123576 - DNA, 10 bp, Homo sapiens
cggccctgcc

SEQ ID NO: 6123577 - DNA, 13 bp, Homo sapiens
cggccctgcccca

SEQ ID NO: 6123578 - DNA, 14 bp, Homo sapiens
cggccctgccccac

SEQ ID NO: 6123579 - DNA, 21 bp, Homo sapiens
cggccctgccccatcctgggc

SEQ ID NO: 6123580 - DNA, 13 bp, Homo sapiens
cggccctgcccct

SEQ ID NO: 6123581 - DNA, 14 bp, Homo sapiens
cggccctgcccctc

SEQ ID NO: 6123582 - DNA, 15 bp, Homo sapiens
cggccctgcctgcct

SEQ ID NO: 6123583 - DNA, 23 bp, Homo sapiens
cggccctgcctgcctcttggcct

SEQ ID NO: 6123584 - DNA, 17 bp, Homo sapiens
cggccctgctgaagctg

SEQ ID NO: 6123585 - DNA, 19 bp, Homo sapiens
cggccctgctgaagctgct

SEQ ID NO: 6123586 - DNA, 13 bp, Homo sapiens
cggccctggagga

SEQ ID NO: 6123587 - DNA, 14 bp, Homo sapiens
cggccctggaggat

SEQ ID NO: 6123588 - DNA, 12 bp, Homo sapiens
cggccctggctg

SEQ ID NO: 6123589 - DNA, 13 bp, Homo sapiens
cggccctggggag

SEQ ID NO: 6123590 - DNA, 13 bp, Homo sapiens
cggccctgtagcc

SEQ ID NO: 6123591 - DNA, 17 bp, Homo sapiens
cggccctgtagccctgg

SEQ ID NO: 6123592 - DNA, 19 bp, Homo sapiens
cggccctgtagccctggcc

SEQ ID NO: 6123593 - DNA, 20 bp, Homo sapiens
cggcccttcctgcagcgcct

SEQ ID NO: 6123594 - DNA, 17 bp, Homo sapiens
cggcccttctgactgtt

SEQ ID NO: 6123595 - DNA, 14 bp, Homo sapiens
cggccgagctgcct

SEQ ID NO: 6123596 - DNA, 15 bp, Homo sapiens
cggccgagctgcctg

SEQ ID NO: 6123597 - DNA, 14 bp, Homo sapiens
cggccgcagccccc

SEQ ID NO: 6123598 - DNA, 21 bp, Homo sapiens
cggccgcagcccccactgacc

SEQ ID NO: 6123599 - DNA, 24 bp, Homo sapiens
cggccgcagcccccactgacctgc

SEQ ID NO: 6123600 - DNA, 18 bp, Homo sapiens
cggccgcattccctgagt

SEQ ID NO: 6123601 - DNA, 14 bp, Homo sapiens
cggccgcccagaca

SEQ ID NO: 6123602 - DNA, 15 bp, Homo sapiens
cggccgcccagacac

SEQ ID NO: 6123603 - DNA, 18 bp, Homo sapiens
cggccgcccagacaccac

SEQ ID NO: 6123604 - DNA, 18 bp, Homo sapiens
cggccgccccgccccaga

SEQ ID NO: 6123605 - DNA, 22 bp, Homo sapiens
cggccgccccgccccagagctc

SEQ ID NO: 6123606 - DNA, 15 bp, Homo sapiens
cggccgcccggcagt

SEQ ID NO: 6123607 - DNA, 15 bp, Homo sapiens
cggccgccttctccc

SEQ ID NO: 6123608 - DNA, 23 bp, Homo sapiens
cggccgccttctcccctctccca

SEQ ID NO: 6123609 - DNA, 18 bp, Homo sapiens
cggccgcgcaccgccatg

SEQ ID NO: 6123610 - DNA, 19 bp, Homo sapiens
cggccgcgcaccgccatgc

SEQ ID NO: 6123611 - DNA, 13 bp, Homo sapiens
cggccgcgccacc

SEQ ID NO: 6123612 - DNA, 14 bp, Homo sapiens
cggccgcgccaccc

SEQ ID NO: 6123613 - DNA, 12 bp, Homo sapiens
cggccgctccag

SEQ ID NO: 6123614 - DNA, 15 bp, Homo sapiens
cggccgctccagggg

SEQ ID NO: 6123615 - DNA, 17 bp, Homo sapiens
cggccgctctccgcccc

SEQ ID NO: 6123616 - DNA, 18 bp, Homo sapiens
cggccgctctccgccccc

SEQ ID NO: 6123617 - DNA, 16 bp, Homo sapiens
cggccggagggcagga

SEQ ID NO: 6123618 - DNA, 16 bp, Homo sapiens
cggccggccagcccct

SEQ ID NO: 6123619 - DNA, 15 bp, Homo sapiens
cggccggccctggct

SEQ ID NO: 6123620 - DNA, 13 bp, Homo sapiens
cggccgggctgcc

SEQ ID NO: 6123621 - DNA, 24 bp, Homo sapiens
cggccgggctgcccttcgctgcca

SEQ ID NO: 6123622 - DNA, 19 bp, Homo sapiens
cggccgtacatctctgtga

SEQ ID NO: 6123623 - DNA, 18 bp, Homo sapiens
cggccgtcaccccgccag

SEQ ID NO: 6123624 - DNA, 22 bp, Homo sapiens
cggccgtcaccccgccagccta

SEQ ID NO: 6123625 - DNA, 13 bp, Homo sapiens
cggccgtccctga

SEQ ID NO: 6123626 - DNA, 19 bp, Homo sapiens
cggccgtcttcactcgccc

SEQ ID NO: 6123627 - DNA, 19 bp, Homo sapiens
cggccgtgggccgggaggc

SEQ ID NO: 6123628 - DNA, 20 bp, Homo sapiens
cggcctaggcacctccccgc

SEQ ID NO: 6123629 - DNA, 22 bp, Homo sapiens
cggcctaggggtggcgctcaga

SEQ ID NO: 6123630 - DNA, 23 bp, Homo sapiens
cggcctaggtcacgttggccctc

SEQ ID NO: 6123631 - DNA, 17 bp, Homo sapiens
cggcctattgcttgggt

SEQ ID NO: 6123632 - DNA, 14 bp, Homo sapiens
cggcctcaccaggc

SEQ ID NO: 6123633 - DNA, 12 bp, Homo sapiens
cggcctcagagt

SEQ ID NO: 6123634 - DNA, 12 bp, Homo sapiens
cggcctcagggc

SEQ ID NO: 6123635 - DNA, 10 bp, Homo sapiens
cggcctccac

SEQ ID NO: 6123636 - DNA, 16 bp, Homo sapiens
cggcctccacacctga

SEQ ID NO: 6123637 - DNA, 12 bp, Homo sapiens
cggcctccactc

SEQ ID NO: 6123638 - DNA, 14 bp, Homo sapiens
cggcctccactccc

SEQ ID NO: 6123639 - DNA, 18 bp, Homo sapiens
cggcctccaggaggggcc

SEQ ID NO: 6123640 - DNA, 12 bp, Homo sapiens
cggcctccaggc

SEQ ID NO: 6123641 - DNA, 17 bp, Homo sapiens
cggcctccaggctgggg

SEQ ID NO: 6123642 - DNA, 19 bp, Homo sapiens
cggcctccaggctggggcc

SEQ ID NO: 6123643 - DNA, 13 bp, Homo sapiens
cggcctccatgca

SEQ ID NO: 6123644 - DNA, 13 bp, Homo sapiens
cggcctcccagag

SEQ ID NO: 6123645 - DNA, 14 bp, Homo sapiens
cggcctcccaggtc

SEQ ID NO: 6123646 - DNA, 16 bp, Homo sapiens
cggcctcccaggtccc

SEQ ID NO: 6123647 - DNA, 13 bp, Homo sapiens
cggcctccccgag

SEQ ID NO: 6123648 - DNA, 14 bp, Homo sapiens
cggcctcccgagga

SEQ ID NO: 6123649 - DNA, 17 bp, Homo sapiens
cggcctcccgaggaggg

SEQ ID NO: 6123650 - DNA, 19 bp, Homo sapiens
cggcctccctagtagctgg

SEQ ID NO: 6123651 - DNA, 15 bp, Homo sapiens
cggcctccgaggctc

SEQ ID NO: 6123652 - DNA, 21 bp, Homo sapiens
cggcctccgtccaggagcctg

SEQ ID NO: 6123653 - DNA, 19 bp, Homo sapiens
cggcctcctaaagtgctgg

SEQ ID NO: 6123654 - DNA, 13 bp, Homo sapiens
cggcctcctagcc

SEQ ID NO: 6123655 - DNA, 18 bp, Homo sapiens
cggcctcctagcctctcc

SEQ ID NO: 6123656 - DNA, 14 bp, Homo sapiens
cggcctcctcctca

SEQ ID NO: 6123657 - DNA, 18 bp, Homo sapiens
cggcctcctcctcaccct

SEQ ID NO: 6123658 - DNA, 18 bp, Homo sapiens
cggcctcctcggagagca

SEQ ID NO: 6123659 - DNA, 12 bp, Homo sapiens
cggcctccttct

SEQ ID NO: 6123660 - DNA, 19 bp, Homo sapiens
cggcctcgtgccatgatct

SEQ ID NO: 6123661 - DNA, 13 bp, Homo sapiens
cggcctctaaccc

SEQ ID NO: 6123662 - DNA, 19 bp, Homo sapiens
cggcctctaaccccaggcc

SEQ ID NO: 6123663 - DNA, 20 bp, Homo sapiens
cggcctctaaccccaggccc

SEQ ID NO: 6123664 - DNA, 13 bp, Homo sapiens
cggcctctccctg

SEQ ID NO: 6123665 - DNA, 14 bp, Homo sapiens
cggcctctccctgc

SEQ ID NO: 6123666 - DNA, 15 bp, Homo sapiens
cggcctctccctgcc

SEQ ID NO: 6123667 - DNA, 18 bp, Homo sapiens
cggcctctccctgcctgt

SEQ ID NO: 6123668 - DNA, 14 bp, Homo sapiens
cggcctctctgccc

SEQ ID NO: 6123669 - DNA, 19 bp, Homo sapiens
cggcctctctgccccaccc

SEQ ID NO: 6123670 - DNA, 18 bp, Homo sapiens
cggcctctctggcctccc

SEQ ID NO: 6123671 - DNA, 20 bp, Homo sapiens
ctccagctggtgcccccaga

SEQ ID NO: 6123672 - DNA, 16 bp, Homo sapiens
ctccagctgtcagcct

SEQ ID NO: 6123673 - DNA, 15 bp, Homo sapiens
ctccagctgtcgtct

SEQ ID NO: 6123674 - DNA, 19 bp, Homo sapiens
ctccagctgttacctgaga

SEQ ID NO: 6123675 - DNA, 20 bp, Homo sapiens
ctccagctgttacctgagat

SEQ ID NO: 6123676 - DNA, 18 bp, Homo sapiens
ctccagctgttcagctgg

SEQ ID NO: 6123677 - DNA, 19 bp, Homo sapiens
ctccagctgttcagctggt

SEQ ID NO: 6123678 - DNA, 20 bp, Homo sapiens
ctccagcttcccctcgctgt

SEQ ID NO: 6123679 - DNA, 13 bp, Homo sapiens
ctccagcttcccg

SEQ ID NO: 6123680 - DNA, 20 bp, Homo sapiens
ctccagcttctggtactctc

SEQ ID NO: 6123681 - DNA, 21 bp, Homo sapiens
ctccagcttctggtactctcc

SEQ ID NO: 6123682 - DNA, 21 bp, Homo sapiens
ctccagcttgtggagccccac

SEQ ID NO: 6123683 - DNA, 18 bp, Homo sapiens
ctccagcttttcctcagg

SEQ ID NO: 6123684 - DNA, 20 bp, Homo sapiens
ctccaggaaagagcagtcag

SEQ ID NO: 6123685 - DNA, 21 bp, Homo sapiens
ctccaggaacattcccacata

SEQ ID NO: 6123686 - DNA, 18 bp, Homo sapiens
ctccaggaaccacaccac

SEQ ID NO: 6123687 - DNA, 14 bp, Homo sapiens
ctccaggaagaagg

SEQ ID NO: 6123688 - DNA, 17 bp, Homo sapiens
ctccaggaagcccaggg

SEQ ID NO: 6123689 - DNA, 20 bp, Homo sapiens
ctccaggaaggtagcccagc

SEQ ID NO: 6123690 - DNA, 21 bp, Homo sapiens
ctccaggaaggtagcccagca

SEQ ID NO: 6123691 - DNA, 23 bp, Homo sapiens
ctccaggaaggtagcccagcact

SEQ ID NO: 6123692 - DNA, 11 bp, Homo sapiens
ctccaggacca

SEQ ID NO: 6123693 - DNA, 16 bp, Homo sapiens
ctccaggacgaggagg

SEQ ID NO: 6123694 - DNA, 13 bp, Homo sapiens
ctccaggactcca

SEQ ID NO: 6123695 - DNA, 14 bp, Homo sapiens
ctccaggactccac

SEQ ID NO: 6123696 - DNA, 20 bp, Homo sapiens
ctccaggacttgcttccaag

SEQ ID NO: 6123697 - DNA, 14 bp, Homo sapiens
ctccaggagaggag

SEQ ID NO: 6123698 - DNA, 22 bp, Homo sapiens
ctccaggagaggagcgggacct

SEQ ID NO: 6123699 - DNA, 14 bp, Homo sapiens
ctccaggagcagcc

SEQ ID NO: 6123700 - DNA, 17 bp, Homo sapiens
ctccaggagcagccaca

SEQ ID NO: 6123701 - DNA, 15 bp, Homo sapiens
ctccaggagcctcat

SEQ ID NO: 6123702 - DNA, 22 bp, Homo sapiens
ctccaggagcctcatccagcct

SEQ ID NO: 6123703 - DNA, 16 bp, Homo sapiens
ctccaggagggcttga

SEQ ID NO: 6123704 - DNA, 19 bp, Homo sapiens
ctccaggagggcttgagag

SEQ ID NO: 6123705 - DNA, 13 bp, Homo sapiens
ctccaggaggggc

SEQ ID NO: 6123706 - DNA, 20 bp, Homo sapiens
ctccaggaggggcctgggca

SEQ ID NO: 6123707 - DNA, 21 bp, Homo sapiens
ctccaggaggggcctgggcag

SEQ ID NO: 6123708 - DNA, 14 bp, Homo sapiens
ctccaggatcctcc

SEQ ID NO: 6123709 - DNA, 18 bp, Homo sapiens
ctccaggatcctcctgga

SEQ ID NO: 6123710 - DNA, 15 bp, Homo sapiens
ctccaggatctttga

SEQ ID NO: 6123711 - DNA, 18 bp, Homo sapiens
ctccaggatggggagggg

SEQ ID NO: 6123712 - DNA, 23 bp, Homo sapiens
ctccaggatggggaggggctctg

SEQ ID NO: 6123713 - DNA, 17 bp, Homo sapiens
ctccaggatggtgcagg

SEQ ID NO: 6123714 - DNA, 22 bp, Homo sapiens
ctccaggatggtgcaggatggc

SEQ ID NO: 6123715 - DNA, 19 bp, Homo sapiens
ctccaggatttataaagca

SEQ ID NO: 6123716 - DNA, 20 bp, Homo sapiens
ctccaggatttataaagcaa

SEQ ID NO: 6123717 - DNA, 20 bp, Homo sapiens
ctccaggcacccttctttcc

SEQ ID NO: 6123718 - DNA, 14 bp, Homo sapiens
ctccaggcaccgcc

SEQ ID NO: 6123719 - DNA, 15 bp, Homo sapiens
ctccaggcaccgcct

SEQ ID NO: 6123720 - DNA, 21 bp, Homo sapiens
ctccaggcaccgcctgccccc

SEQ ID NO: 6123721 - DNA, 20 bp, Homo sapiens
ctccaggcaggaaaccccga

SEQ ID NO: 6123722 - DNA, 14 bp, Homo sapiens
ctccaggcaggcca

SEQ ID NO: 6123723 - DNA, 21 bp, Homo sapiens
ctccaggcatatgtttcccca

SEQ ID NO: 6123724 - DNA, 16 bp, Homo sapiens
ctccaggcatgtgtct

SEQ ID NO: 6123725 - DNA, 14 bp, Homo sapiens
ctccaggccagctc

SEQ ID NO: 6123726 - DNA, 18 bp, Homo sapiens
ctccaggccagctccttt

SEQ ID NO: 6123727 - DNA, 20 bp, Homo sapiens
ctccaggccagctccttttc

SEQ ID NO: 6123728 - DNA, 14 bp, Homo sapiens
ctccaggccaggtg

SEQ ID NO: 6123729 - DNA, 10 bp, Homo sapiens
ctccaggccc

SEQ ID NO: 6123730 - DNA, 11 bp, Homo sapiens
ctccaggccca

SEQ ID NO: 6123731 - DNA, 17 bp, Homo sapiens
ctccaggcccaaggctc

SEQ ID NO: 6123732 - DNA, 19 bp, Homo sapiens
ctccaggcccagcctggcc

SEQ ID NO: 6123733 - DNA, 15 bp, Homo sapiens
ctccaggcccatctc

SEQ ID NO: 6123734 - DNA, 16 bp, Homo sapiens
ctccaggccccaggtc

SEQ ID NO: 6123735 - DNA, 16 bp, Homo sapiens
ctccaggcccccaact

SEQ ID NO: 6123736 - DNA, 23 bp, Homo sapiens
ctccaggcccgtctgtccatctg

SEQ ID NO: 6123737 - DNA, 13 bp, Homo sapiens
ctccaggcctgac

SEQ ID NO: 6123738 - DNA, 15 bp, Homo sapiens
ctccaggcctgacca

SEQ ID NO: 6123739 - DNA, 18 bp, Homo sapiens
ctccaggcctgaccaggg

SEQ ID NO: 6123740 - DNA, 22 bp, Homo sapiens
ctccaggcctgcagcaggagtg

SEQ ID NO: 6123741 - DNA, 14 bp, Homo sapiens
ctccaggcctgcct

SEQ ID NO: 6123742 - DNA, 19 bp, Homo sapiens
ctccaggcctgcctcccac

SEQ ID NO: 6123743 - DNA, 20 bp, Homo sapiens
ctccaggcctgcctcccact

SEQ ID NO: 6123744 - DNA, 12 bp, Homo sapiens
ctccaggcctgt

SEQ ID NO: 6123745 - DNA, 14 bp, Homo sapiens
ctccaggcctgtca

SEQ ID NO: 6123746 - DNA, 22 bp, Homo sapiens
ctccaggcgacgcggttttttc

SEQ ID NO: 6123747 - DNA, 14 bp, Homo sapiens
ctccaggcgccggc

SEQ ID NO: 6123748 - DNA, 11 bp, Homo sapiens
ctccaggctcc

SEQ ID NO: 6123749 - DNA, 22 bp, Homo sapiens
ctccaggctccctccctcccag

SEQ ID NO: 6123750 - DNA, 17 bp, Homo sapiens
ctccaggctggggcctg

SEQ ID NO: 6123751 - DNA, 23 bp, Homo sapiens
ctccaggctggggcctggcctat

SEQ ID NO: 6123752 - DNA, 15 bp, Homo sapiens
ctccaggctgtttct

SEQ ID NO: 6123753 - DNA, 17 bp, Homo sapiens
ctccaggcttcacagtc

SEQ ID NO: 6123754 - DNA, 18 bp, Homo sapiens
ctccaggcttcacagtct

SEQ ID NO: 6123755 - DNA, 12 bp, Homo sapiens
ctccaggcttcc

SEQ ID NO: 6123756 - DNA, 15 bp, Homo sapiens
ctccaggcttccaca

SEQ ID NO: 6123757 - DNA, 17 bp, Homo sapiens
ctccaggcttccacact

SEQ ID NO: 6123758 - DNA, 16 bp, Homo sapiens
ctccaggcttcccctc

SEQ ID NO: 6123759 - DNA, 22 bp, Homo sapiens
ctccaggcttcctgccctagca

SEQ ID NO: 6123760 - DNA, 16 bp, Homo sapiens
ctccaggctttctgga

SEQ ID NO: 6123761 - DNA, 10 bp, Homo sapiens
ctccagggaa

SEQ ID NO: 6123762 - DNA, 22 bp, Homo sapiens
ctccagggaatccaagcctcca

SEQ ID NO: 6123763 - DNA, 14 bp, Homo sapiens
ctccagggacacac

SEQ ID NO: 6123764 - DNA, 20 bp, Homo sapiens
ctccagggacacacagccta

SEQ ID NO: 6123765 - DNA, 18 bp, Homo sapiens
ctccagggagattttgag

SEQ ID NO: 6123766 - DNA, 22 bp, Homo sapiens
ctccagggagcaagacagagac

SEQ ID NO: 6123767 - DNA, 14 bp, Homo sapiens
ctccagggagtccc

SEQ ID NO: 6123768 - DNA, 23 bp, Homo sapiens
ctccagggagtggggaggagaga

SEQ ID NO: 6123769 - DNA, 18 bp, Homo sapiens
ctccagggccacgtgcca

SEQ ID NO: 6123770 - DNA, 19 bp, Homo sapiens
ctccagggccacgtgccag

SEQ ID NO: 6123771 - DNA, 14 bp, Homo sapiens
ctccagggccagga

SEQ ID NO: 6123772 - DNA, 23 bp, Homo sapiens
ctccagggccaggattcaggcct

SEQ ID NO: 6123773 - DNA, 17 bp, Homo sapiens
ctccagggcccccaccg

SEQ ID NO: 6123774 - DNA, 15 bp, Homo sapiens
ctccagggcccccca

SEQ ID NO: 6123775 - DNA, 16 bp, Homo sapiens
ctccagggccccccaa

SEQ ID NO: 6123776 - DNA, 10 bp, Homo sapiens
ctccagggct

SEQ ID NO: 6123777 - DNA, 16 bp, Homo sapiens
ctccagggctggactg

SEQ ID NO: 6123778 - DNA, 14 bp, Homo sapiens
ctccaggggcctgc

SEQ ID NO: 6123779 - DNA, 19 bp, Homo sapiens
ctccaggggcctgcagaag

SEQ ID NO: 6123780 - DNA, 21 bp, Homo sapiens
ctccaggggcctgcagaagga

SEQ ID NO: 6123781 - DNA, 15 bp, Homo sapiens
ctccaggggctcctg

SEQ ID NO: 6123782 - DNA, 18 bp, Homo sapiens
ctccaggggctcctgggt

SEQ ID NO: 6123783 - DNA, 14 bp, Homo sapiens
ctccaggggctgct

SEQ ID NO: 6123784 - DNA, 18 bp, Homo sapiens
ctccaggggctgcttcct

SEQ ID NO: 6123785 - DNA, 19 bp, Homo sapiens
ctccagggggcctgcaggc

SEQ ID NO: 6123786 - DNA, 17 bp, Homo sapiens
ctccagggggtgccctc

SEQ ID NO: 6123787 - DNA, 22 bp, Homo sapiens
ctccaggggtcctaggcctcaa

SEQ ID NO: 6123788 - DNA, 17 bp, Homo sapiens
ctccaggggtttacagt

SEQ ID NO: 6123789 - DNA, 21 bp, Homo sapiens
ctccagggtcagaaacaggac

SEQ ID NO: 6123790 - DNA, 20 bp, Homo sapiens
ctccagggtcccctgccacc

SEQ ID NO: 6123791 - DNA, 17 bp, Homo sapiens
ctccagggtcttgggct

SEQ ID NO: 6123792 - DNA, 18 bp, Homo sapiens
ctccagggtgacaaggcc

SEQ ID NO: 6123793 - DNA, 20 bp, Homo sapiens
ctccagggtgacaaggcctg

SEQ ID NO: 6123794 - DNA, 16 bp, Homo sapiens
ctccagggtgtgtgct

SEQ ID NO: 6123795 - DNA, 14 bp, Homo sapiens
ctccaggtaacttt

SEQ ID NO: 6123796 - DNA, 18 bp, Homo sapiens
ctccaggtaccttgacct

SEQ ID NO: 6123797 - DNA, 19 bp, Homo sapiens
ctccaggtaccttgacctt

SEQ ID NO: 6123798 - DNA, 17 bp, Homo sapiens
ctccaggtcagctgccc

SEQ ID NO: 6123799 - DNA, 19 bp, Homo sapiens
ctccaggtgcacaagctcc

SEQ ID NO: 6123800 - DNA, 20 bp, Homo sapiens
ctccaggtgcacaagctcca

SEQ ID NO: 6123801 - DNA, 15 bp, Homo sapiens
ctccaggtgcagagg

SEQ ID NO: 6123802 - DNA, 16 bp, Homo sapiens
ctccaggtgcagaggt

SEQ ID NO: 6123803 - DNA, 17 bp, Homo sapiens
ctccaggtgccctgtgg

SEQ ID NO: 6123804 - DNA, 17 bp, Homo sapiens
ctccaggtgctcattgt

SEQ ID NO: 6123805 - DNA, 16 bp, Homo sapiens
ctccaggtgtggaccg

SEQ ID NO: 6123806 - DNA, 19 bp, Homo sapiens
ctccaggtgtggaccggcc

SEQ ID NO: 6123807 - DNA, 24 bp, Homo sapiens
ctccaggtgtggaccggccgcagc

SEQ ID NO: 6123808 - DNA, 14 bp, Homo sapiens
ctccaggttgcctc

SEQ ID NO: 6123809 - DNA, 23 bp, Homo sapiens
ctccaggttgcctcaacagcagg

SEQ ID NO: 6123810 - DNA, 22 bp, Homo sapiens
ctccaggtttgctgtgtctcac

SEQ ID NO: 6123811 - DNA, 12 bp, Homo sapiens
ctccaggttttt

SEQ ID NO: 6123812 - DNA, 13 bp, Homo sapiens
ctccaggtttttc

SEQ ID NO: 6123813 - DNA, 16 bp, Homo sapiens
ctccaggtttttcaat

SEQ ID NO: 6123814 - DNA, 20 bp, Homo sapiens
ctccaggtttttcaattaaa

SEQ ID NO: 6123815 - DNA, 12 bp, Homo sapiens
ctccagtaccat

SEQ ID NO: 6123816 - DNA, 22 bp, Homo sapiens
ctccagtaccataatcttagag

SEQ ID NO: 6123817 - DNA, 20 bp, Homo sapiens
ctccagtaccttctgccaga

SEQ ID NO: 6123818 - DNA, 18 bp, Homo sapiens
ctccagtacgtcccgctg

SEQ ID NO: 6123819 - DNA, 21 bp, Homo sapiens
ctccagtacgtcccgctgctg

SEQ ID NO: 6123820 - DNA, 15 bp, Homo sapiens
ctccagtagctcctg

SEQ ID NO: 6123821 - DNA, 16 bp, Homo sapiens
ctccagtagctcctgg

SEQ ID NO: 6123822 - DNA, 19 bp, Homo sapiens
ctccagtataaattacatg

SEQ ID NO: 6123823 - DNA, 18 bp, Homo sapiens
ctccagtataatctcctc

SEQ ID NO: 6123824 - DNA, 18 bp, Homo sapiens
ctccagtatgacagagga

SEQ ID NO: 6123825 - DNA, 18 bp, Homo sapiens
ctccagtcaacagattca

SEQ ID NO: 6123826 - DNA, 15 bp, Homo sapiens
ctccagtcacactcc

SEQ ID NO: 6123827 - DNA, 16 bp, Homo sapiens
ctccagtcacactccc

SEQ ID NO: 6123828 - DNA, 15 bp, Homo sapiens
ctccagtcaggaggc

SEQ ID NO: 6123829 - DNA, 16 bp, Homo sapiens
ctccagtcatggtact

SEQ ID NO: 6123830 - DNA, 15 bp, Homo sapiens
ctccagtccccagaa

SEQ ID NO: 6123831 - DNA, 21 bp, Homo sapiens
ctccagtccccctatccttgg

SEQ ID NO: 6123832 - DNA, 18 bp, Homo sapiens
ctccagtccctgggagca

SEQ ID NO: 6123833 - DNA, 20 bp, Homo sapiens
ctccagtccctgggagcaag

SEQ ID NO: 6123834 - DNA, 13 bp, Homo sapiens
ctccagtcctgct

SEQ ID NO: 6123835 - DNA, 15 bp, Homo sapiens
ctccagtcctgctgg

SEQ ID NO: 6123836 - DNA, 19 bp, Homo sapiens
ctccagtcctgctggcctg

SEQ ID NO: 6123837 - DNA, 20 bp, Homo sapiens
ctccagtcctgctggcctgc

SEQ ID NO: 6123838 - DNA, 21 bp, Homo sapiens
ctccagtcctgctggcctgct

SEQ ID NO: 6123839 - DNA, 23 bp, Homo sapiens
ctccagtctcatctatgtcatat

SEQ ID NO: 6123840 - DNA, 17 bp, Homo sapiens
ctccagtctcctgacat

SEQ ID NO: 6123841 - DNA, 20 bp, Homo sapiens
ctccagtctcctgacattaa

SEQ ID NO: 6123842 - DNA, 19 bp, Homo sapiens
ctccagtctgatctgtgaa

SEQ ID NO: 6123843 - DNA, 13 bp, Homo sapiens
ctccagtctgctc

SEQ ID NO: 6123844 - DNA, 15 bp, Homo sapiens
ctccagtctgctctc

SEQ ID NO: 6123845 - DNA, 24 bp, Homo sapiens
ctccagtctgctctcagcttgtgc

SEQ ID NO: 6123846 - DNA, 15 bp, Homo sapiens
ctccagtctgctgcc

SEQ ID NO: 6123847 - DNA, 16 bp, Homo sapiens
ctccagtcttccacct

SEQ ID NO: 6123848 - DNA, 20 bp, Homo sapiens
ctccagtcttccacctggaa

SEQ ID NO: 6123849 - DNA, 14 bp, Homo sapiens
cggcctctcttgga

SEQ ID NO: 6123850 - DNA, 15 bp, Homo sapiens
cggcctctgctgccc

SEQ ID NO: 6123851 - DNA, 13 bp, Homo sapiens
cggcctcttccac

SEQ ID NO: 6123852 - DNA, 13 bp, Homo sapiens
cggcctcttctct

SEQ ID NO: 6123853 - DNA, 18 bp, Homo sapiens
cggcctcttctctcagac

SEQ ID NO: 6123854 - DNA, 19 bp, Homo sapiens
cggcctcttctctcagacc

SEQ ID NO: 6123855 - DNA, 23 bp, Homo sapiens
cggcctgagaggagcgtgtccta

SEQ ID NO: 6123856 - DNA, 23 bp, Homo sapiens
cggcctgcaccgaccccgggccg

SEQ ID NO: 6123857 - DNA, 13 bp, Homo sapiens
cggcctgctccca

SEQ ID NO: 6123858 - DNA, 14 bp, Homo sapiens
cggcctgctcccag

SEQ ID NO: 6123859 - DNA, 16 bp, Homo sapiens
cggcctggcatgcagc

SEQ ID NO: 6123860 - DNA, 14 bp, Homo sapiens
cggcctggccccct

SEQ ID NO: 6123861 - DNA, 16 bp, Homo sapiens
cggcctggctgcagct

SEQ ID NO: 6123862 - DNA, 17 bp, Homo sapiens
cggcctggctggccagg

SEQ ID NO: 6123863 - DNA, 16 bp, Homo sapiens
cggcctgggagggtgg

SEQ ID NO: 6123864 - DNA, 12 bp, Homo sapiens
cggcctgggcac

SEQ ID NO: 6123865 - DNA, 14 bp, Homo sapiens
cggcctgtaacata

SEQ ID NO: 6123866 - DNA, 23 bp, Homo sapiens
cggcctgtaatcagctctcctgg

SEQ ID NO: 6123867 - DNA, 15 bp, Homo sapiens
cggcctgtcctccaa

SEQ ID NO: 6123868 - DNA, 21 bp, Homo sapiens
cggcctgtgcgttcccttcag

SEQ ID NO: 6123869 - DNA, 20 bp, Homo sapiens
cggcctgtgggtttgggtgc

SEQ ID NO: 6123870 - DNA, 15 bp, Homo sapiens
cggcctgtgtccccc

SEQ ID NO: 6123871 - DNA, 15 bp, Homo sapiens
cggccttccaccggg

SEQ ID NO: 6123872 - DNA, 20 bp, Homo sapiens
cggccttccgggtctcgcag

SEQ ID NO: 6123873 - DNA, 15 bp, Homo sapiens
cggccttgaagaggc

SEQ ID NO: 6123874 - DNA, 16 bp, Homo sapiens
cggccttgctgggggc

SEQ ID NO: 6123875 - DNA, 16 bp, Homo sapiens
cggccttgctttgtct

SEQ ID NO: 6123876 - DNA, 22 bp, Homo sapiens
cggccttgctttgtctggcctc

SEQ ID NO: 6123877 - DNA, 15 bp, Homo sapiens
cggcctttctagcct

SEQ ID NO: 6123878 - DNA, 17 bp, Homo sapiens
cggcctttgttgctcag

SEQ ID NO: 6123879 - DNA, 18 bp, Homo sapiens
cggccttttccaaatgcc

SEQ ID NO: 6123880 - DNA, 18 bp, Homo sapiens
cggcgaagaagagaaaga

SEQ ID NO: 6123881 - DNA, 15 bp, Homo sapiens
cggcgatttttgtat

SEQ ID NO: 6123882 - DNA, 18 bp, Homo sapiens
cggcgcccccacccctgg

SEQ ID NO: 6123883 - DNA, 15 bp, Homo sapiens
cggcgcccccagtgt

SEQ ID NO: 6123884 - DNA, 15 bp, Homo sapiens
cggcgccccgcaccc

SEQ ID NO: 6123885 - DNA, 20 bp, Homo sapiens
cggcgccccgcacccccgcc

SEQ ID NO: 6123886 - DNA, 17 bp, Homo sapiens
cggcgccctctgtcctg

SEQ ID NO: 6123887 - DNA, 12 bp, Homo sapiens
cggcgccctgga

SEQ ID NO: 6123888 - DNA, 14 bp, Homo sapiens
cggcgccctggact

SEQ ID NO: 6123889 - DNA, 15 bp, Homo sapiens
cggcgccctggactt

SEQ ID NO: 6123890 - DNA, 16 bp, Homo sapiens
cggcgccctggacttg

SEQ ID NO: 6123891 - DNA, 12 bp, Homo sapiens
cggcgcctgccc

SEQ ID NO: 6123892 - DNA, 17 bp, Homo sapiens
cggcgcctggcctccag

SEQ ID NO: 6123893 - DNA, 21 bp, Homo sapiens
cggcgccttctacctgcagga

SEQ ID NO: 6123894 - DNA, 15 bp, Homo sapiens
cggcgctgcctcagg

SEQ ID NO: 6123895 - DNA, 15 bp, Homo sapiens
cggcggaaagcctgt

SEQ ID NO: 6123896 - DNA, 20 bp, Homo sapiens
cggcggcacccaggcctccc

SEQ ID NO: 6123897 - DNA, 12 bp, Homo sapiens
cggcggccacgc

SEQ ID NO: 6123898 - DNA, 17 bp, Homo sapiens
cggcggccaggcacagg

SEQ ID NO: 6123899 - DNA, 18 bp, Homo sapiens
cggcggccaggcacaggg

SEQ ID NO: 6123900 - DNA, 20 bp, Homo sapiens
cggcggccctcaaaagcact

SEQ ID NO: 6123901 - DNA, 16 bp, Homo sapiens
cggcggcggccaggga

SEQ ID NO: 6123902 - DNA, 14 bp, Homo sapiens
cggcggctctgagc

SEQ ID NO: 6123903 - DNA, 17 bp, Homo sapiens
cggcggctctgagcagg

SEQ ID NO: 6123904 - DNA, 17 bp, Homo sapiens
cggcggctctgcccacc

SEQ ID NO: 6123905 - DNA, 22 bp, Homo sapiens
cggcggggcctgggtccccctc

SEQ ID NO: 6123906 - DNA, 16 bp, Homo sapiens
cggcggtcccagctcc

SEQ ID NO: 6123907 - DNA, 19 bp, Homo sapiens
cggcggtcccagctccctg

SEQ ID NO: 6123908 - DNA, 21 bp, Homo sapiens
cggcggtggactgcgctggac

SEQ ID NO: 6123909 - DNA, 14 bp, Homo sapiens
cggcgtcagcctcc

SEQ ID NO: 6123910 - DNA, 17 bp, Homo sapiens
cggcgtcagcctccagc

SEQ ID NO: 6123911 - DNA, 18 bp, Homo sapiens
cggcgtcagcctccagcc

SEQ ID NO: 6123912 - DNA, 19 bp, Homo sapiens
cggcgtcagcctccagcct

SEQ ID NO: 6123913 - DNA, 20 bp, Homo sapiens
cggcgtcagcctccagcctc

SEQ ID NO: 6123914 - DNA, 16 bp, Homo sapiens
cggcgtgggcgaggcc

SEQ ID NO: 6123915 - DNA, 15 bp, Homo sapiens
cggcgtgggggcact

SEQ ID NO: 6123916 - DNA, 22 bp, Homo sapiens
cggcgtggtgtgtccctggaca

SEQ ID NO: 6123917 - DNA, 23 bp, Homo sapiens
cggcgtggtgtgtccctggacac

SEQ ID NO: 6123918 - DNA, 12 bp, Homo sapiens
cggctaacttat

SEQ ID NO: 6123919 - DNA, 13 bp, Homo sapiens
cggctaagcaggc

SEQ ID NO: 6123920 - DNA, 22 bp, Homo sapiens
cggctaatgtttgtatttttag

SEQ ID NO: 6123921 - DNA, 19 bp, Homo sapiens
cggctaatttttatatttt

SEQ ID NO: 6123922 - DNA, 12 bp, Homo sapiens
cggctactcagc

SEQ ID NO: 6123923 - DNA, 16 bp, Homo sapiens
cggctactcagcagcc

SEQ ID NO: 6123924 - DNA, 20 bp, Homo sapiens
cggctactcagcagccctcc

SEQ ID NO: 6123925 - DNA, 21 bp, Homo sapiens
cggctactcagcagccctcct

SEQ ID NO: 6123926 - DNA, 17 bp, Homo sapiens
cggctcactgcaacctc

SEQ ID NO: 6123927 - DNA, 16 bp, Homo sapiens
cggctcactgcagcct

SEQ ID NO: 6123928 - DNA, 14 bp, Homo sapiens
cggctcagccttgc

SEQ ID NO: 6123929 - DNA, 15 bp, Homo sapiens
cggctcagccttgca

SEQ ID NO: 6123930 - DNA, 17 bp, Homo sapiens
cggctcagccttgcaca

SEQ ID NO: 6123931 - DNA, 20 bp, Homo sapiens
cggctcagtgcaacctctgc

SEQ ID NO: 6123932 - DNA, 21 bp, Homo sapiens
cggctcagtgcaacctctgct

SEQ ID NO: 6123933 - DNA, 12 bp, Homo sapiens
cggctccaactc

SEQ ID NO: 6123934 - DNA, 14 bp, Homo sapiens
cggctccagagcag

SEQ ID NO: 6123935 - DNA, 14 bp, Homo sapiens
cggctccagcccag

SEQ ID NO: 6123936 - DNA, 14 bp, Homo sapiens
cggctccaggctcc

SEQ ID NO: 6123937 - DNA, 15 bp, Homo sapiens
cggctccaggctcct

SEQ ID NO: 6123938 - DNA, 16 bp, Homo sapiens
cggctccaggctcctt

SEQ ID NO: 6123939 - DNA, 18 bp, Homo sapiens
cggctccaggtccggagg

SEQ ID NO: 6123940 - DNA, 22 bp, Homo sapiens
cggctccagtttccccatgggg

SEQ ID NO: 6123941 - DNA, 12 bp, Homo sapiens
cggctcccaccg

SEQ ID NO: 6123942 - DNA, 14 bp, Homo sapiens
cggctcccaccggt

SEQ ID NO: 6123943 - DNA, 15 bp, Homo sapiens
cggctcccagcctca

SEQ ID NO: 6123944 - DNA, 17 bp, Homo sapiens
cggctccccatgtgtcc

SEQ ID NO: 6123945 - DNA, 22 bp, Homo sapiens
cggctccccattttataccaaa

SEQ ID NO: 6123946 - DNA, 23 bp, Homo sapiens
cggctccccattttataccaaag

SEQ ID NO: 6123947 - DNA, 16 bp, Homo sapiens
cggctcccccaggcct

SEQ ID NO: 6123948 - DNA, 17 bp, Homo sapiens
cggctcccccaggcctg

SEQ ID NO: 6123949 - DNA, 14 bp, Homo sapiens
cggctccccctgct

SEQ ID NO: 6123950 - DNA, 14 bp, Homo sapiens
cggctccccctgga

SEQ ID NO: 6123951 - DNA, 14 bp, Homo sapiens
cggctcccgcttgc

SEQ ID NO: 6123952 - DNA, 23 bp, Homo sapiens
cggctcccgcttgctctcctgga

SEQ ID NO: 6123953 - DNA, 11 bp, Homo sapiens
cggctcccggg

SEQ ID NO: 6123954 - DNA, 14 bp, Homo sapiens
cggctccctggagc

SEQ ID NO: 6123955 - DNA, 19 bp, Homo sapiens
cggctccgagggcggccag

SEQ ID NO: 6123956 - DNA, 14 bp, Homo sapiens
cggctcctcagagc

SEQ ID NO: 6123957 - DNA, 13 bp, Homo sapiens
cggctcctcaggg

SEQ ID NO: 6123958 - DNA, 14 bp, Homo sapiens
cggctcctcctcac

SEQ ID NO: 6123959 - DNA, 24 bp, Homo sapiens
cggctcctcctcacccacctctgg

SEQ ID NO: 6123960 - DNA, 13 bp, Homo sapiens
cggctcctcgccc

SEQ ID NO: 6123961 - DNA, 12 bp, Homo sapiens
cggctcctgatg

SEQ ID NO: 6123962 - DNA, 11 bp, Homo sapiens
cggctcctgca

SEQ ID NO: 6123963 - DNA, 23 bp, Homo sapiens
cggctcctgcttttggggctctt

SEQ ID NO: 6123964 - DNA, 13 bp, Homo sapiens
cggctcctggtca

SEQ ID NO: 6123965 - DNA, 13 bp, Homo sapiens
cggctcctggtgc

SEQ ID NO: 6123966 - DNA, 13 bp, Homo sapiens
cggctcctgtgct

SEQ ID NO: 6123967 - DNA, 18 bp, Homo sapiens
cggctcggcccagcaccc

SEQ ID NO: 6123968 - DNA, 24 bp, Homo sapiens
cggctcggcctcttgagagcccca

SEQ ID NO: 6123969 - DNA, 20 bp, Homo sapiens
cggctcgtgtatttattacc

SEQ ID NO: 6123970 - DNA, 17 bp, Homo sapiens
cggctcgttcccccagg

SEQ ID NO: 6123971 - DNA, 17 bp, Homo sapiens
cggctctagccccagcg

SEQ ID NO: 6123972 - DNA, 16 bp, Homo sapiens
cggctctcacctggcc

SEQ ID NO: 6123973 - DNA, 23 bp, Homo sapiens
cggctctccagacctgagctttc

SEQ ID NO: 6123974 - DNA, 20 bp, Homo sapiens
cggctctcgtccctctgctc

SEQ ID NO: 6123975 - DNA, 23 bp, Homo sapiens
cggctctctatagcaccagggct

SEQ ID NO: 6123976 - DNA, 17 bp, Homo sapiens
cggctctgagcaggggc

SEQ ID NO: 6123977 - DNA, 18 bp, Homo sapiens
cggctctgagcaggggca

SEQ ID NO: 6123978 - DNA, 20 bp, Homo sapiens
cggctctgagcaggggcagg

SEQ ID NO: 6123979 - DNA, 21 bp, Homo sapiens
cggctctgagcaggggcaggc

SEQ ID NO: 6123980 - DNA, 11 bp, Homo sapiens
cggctctgccc

SEQ ID NO: 6123981 - DNA, 11 bp, Homo sapiens
cggctctggag

SEQ ID NO: 6123982 - DNA, 13 bp, Homo sapiens
cggctctggaggc

SEQ ID NO: 6123983 - DNA, 19 bp, Homo sapiens
cggctctgggcctgagggt

SEQ ID NO: 6123984 - DNA, 13 bp, Homo sapiens
cggctctggtcct

SEQ ID NO: 6123985 - DNA, 17 bp, Homo sapiens
cggctctgtccccagcc

SEQ ID NO: 6123986 - DNA, 22 bp, Homo sapiens
cggctctgtgcccggtgccatc

SEQ ID NO: 6123987 - DNA, 20 bp, Homo sapiens
cggctctgtgggtgatgggg

SEQ ID NO: 6123988 - DNA, 22 bp, Homo sapiens
cggctgaccatgctcatctgct

SEQ ID NO: 6123989 - DNA, 23 bp, Homo sapiens
cggctgaccatgctcatctgctg

SEQ ID NO: 6123990 - DNA, 17 bp, Homo sapiens
cggctgagagccccagc

SEQ ID NO: 6123991 - DNA, 19 bp, Homo sapiens
cggctgagagccccagctg

SEQ ID NO: 6123992 - DNA, 11 bp, Homo sapiens
cggctgagcat

SEQ ID NO: 6123993 - DNA, 22 bp, Homo sapiens
cggctgagctgtgccagctgct

SEQ ID NO: 6123994 - DNA, 16 bp, Homo sapiens
cggctgaggacggggc

SEQ ID NO: 6123995 - DNA, 22 bp, Homo sapiens
cggctgaggacggggcagagct

SEQ ID NO: 6123996 - DNA, 23 bp, Homo sapiens
cggctgagtcatgatctccctgc

SEQ ID NO: 6123997 - DNA, 18 bp, Homo sapiens
cggctgagtggcagcagc

SEQ ID NO: 6123998 - DNA, 20 bp, Homo sapiens
cggctgcacctgcagggagc

SEQ ID NO: 6123999 - DNA, 13 bp, Homo sapiens
cggctgccagggg

SEQ ID NO: 6124000 - DNA, 12 bp, Homo sapiens
cggctgccccca

SEQ ID NO: 6124001 - DNA, 15 bp, Homo sapiens
cggctgccgggcggg

SEQ ID NO: 6124002 - DNA, 13 bp, Homo sapiens
cggctgcctccat

SEQ ID NO: 6124003 - DNA, 15 bp, Homo sapiens
cggctgcctgacact

SEQ ID NO: 6124004 - DNA, 19 bp, Homo sapiens
cggctgcctgacactgagc

SEQ ID NO: 6124005 - DNA, 21 bp, Homo sapiens
cggctgcctgacactgagccc

SEQ ID NO: 6124006 - DNA, 17 bp, Homo sapiens
cggctgcctgcccccca

SEQ ID NO: 6124007 - DNA, 18 bp, Homo sapiens
cggctgctcctccagccc

SEQ ID NO: 6124008 - DNA, 21 bp, Homo sapiens
cggctgctcctccagcccttc

SEQ ID NO: 6124009 - DNA, 20 bp, Homo sapiens
cggctgctcgcccaggaagg

SEQ ID NO: 6124010 - DNA, 11 bp, Homo sapiens
cggctgctgag

SEQ ID NO: 6124011 - DNA, 11 bp, Homo sapiens
cggctgctgct

SEQ ID NO: 6124012 - DNA, 19 bp, Homo sapiens
cggctgctggcacagactt

SEQ ID NO: 6124013 - DNA, 21 bp, Homo sapiens
cggctgcttggcagttgcagt

SEQ ID NO: 6124014 - DNA, 20 bp, Homo sapiens
cggctggaaatgctgggctg

SEQ ID NO: 6124015 - DNA, 18 bp, Homo sapiens
cggctggaccacgtctcc

SEQ ID NO: 6124016 - DNA, 15 bp, Homo sapiens
cggctggacttggag

SEQ ID NO: 6124017 - DNA, 22 bp, Homo sapiens
cggctggcatggtggctcccgc

SEQ ID NO: 6124018 - DNA, 20 bp, Homo sapiens
cggctggccatggagaaagc

SEQ ID NO: 6124019 - DNA, 14 bp, Homo sapiens
cggctggccgggaa

SEQ ID NO: 6124020 - DNA, 14 bp, Homo sapiens
cggctggccggtcc

SEQ ID NO: 6124021 - DNA, 20 bp, Homo sapiens
cggctggccggtccaccccg

SEQ ID NO: 6124022 - DNA, 16 bp, Homo sapiens
cggctggcctggcccc

SEQ ID NO: 6124023 - DNA, 21 bp, Homo sapiens
cggctgggaactgggccagca

SEQ ID NO: 6124024 - DNA, 22 bp, Homo sapiens
cggctgggaactgggccagcag

SEQ ID NO: 6124025 - DNA, 22 bp, Homo sapiens
cggctgggaggagggcaggcat

SEQ ID NO: 6124026 - DNA, 23 bp, Homo sapiens
cggctgggaggagggcaggcatc

SEQ ID NO: 6124027 - DNA, 12 bp, Homo sapiens
cggctgggcaca

SEQ ID NO: 6124028 - DNA, 12 bp, Homo sapiens
cggctgggcagg

SEQ ID NO: 6124029 - DNA, 21 bp, Homo sapiens
ctccagtgagacagctctgca

SEQ ID NO: 6124030 - DNA, 15 bp, Homo sapiens
ctccagtgagctgga

SEQ ID NO: 6124031 - DNA, 17 bp, Homo sapiens
ctccagtgagctggaat

SEQ ID NO: 6124032 - DNA, 20 bp, Homo sapiens
ctccagtgagtacctgcaaa

SEQ ID NO: 6124033 - DNA, 12 bp, Homo sapiens
ctccagtgcagt

SEQ ID NO: 6124034 - DNA, 15 bp, Homo sapiens
ctccagtgcagtcca

SEQ ID NO: 6124035 - DNA, 16 bp, Homo sapiens
ctccagtgctcagctg

SEQ ID NO: 6124036 - DNA, 19 bp, Homo sapiens
ctccagtgctcagctgtgg

SEQ ID NO: 6124037 - DNA, 17 bp, Homo sapiens
ctccagtgctggatttg

SEQ ID NO: 6124038 - DNA, 18 bp, Homo sapiens
ctccagtgctggatttga

SEQ ID NO: 6124039 - DNA, 13 bp, Homo sapiens
ctccagtgctggc

SEQ ID NO: 6124040 - DNA, 22 bp, Homo sapiens
ctccagtgctggctgctggccc

SEQ ID NO: 6124041 - DNA, 22 bp, Homo sapiens
ctccagtgctgtccatgcttct

SEQ ID NO: 6124042 - DNA, 13 bp, Homo sapiens
ctccagtgcttgg

SEQ ID NO: 6124043 - DNA, 16 bp, Homo sapiens
ctccagtgcttggctg

SEQ ID NO: 6124044 - DNA, 17 bp, Homo sapiens
ctccagtgcttggctgc

SEQ ID NO: 6124045 - DNA, 20 bp, Homo sapiens
ctccagtgcttggctgcccc

SEQ ID NO: 6124046 - DNA, 21 bp, Homo sapiens
ctccagtgcttggctgcccca

SEQ ID NO: 6124047 - DNA, 21 bp, Homo sapiens
ctccagtgctttatccacatt

SEQ ID NO: 6124048 - DNA, 19 bp, Homo sapiens
ctccagtggaagaagaaaa

SEQ ID NO: 6124049 - DNA, 20 bp, Homo sapiens
ctccagtgggaggacagagc

SEQ ID NO: 6124050 - DNA, 23 bp, Homo sapiens
ctccagtgggaggacagagccgg

SEQ ID NO: 6124051 - DNA, 20 bp, Homo sapiens
ctccagtgggctgatgctgg

SEQ ID NO: 6124052 - DNA, 15 bp, Homo sapiens
ctccagtggttgctg

SEQ ID NO: 6124053 - DNA, 13 bp, Homo sapiens
ctccagtgtcctg

SEQ ID NO: 6124054 - DNA, 18 bp, Homo sapiens
ctccagtgtcctgagctc

SEQ ID NO: 6124055 - DNA, 21 bp, Homo sapiens
ctccagtgtcctgagctcagc

SEQ ID NO: 6124056 - DNA, 12 bp, Homo sapiens
ctccagtgttgc

SEQ ID NO: 6124057 - DNA, 17 bp, Homo sapiens
ctccagtgttttcttgt

SEQ ID NO: 6124058 - DNA, 22 bp, Homo sapiens
ctccagttggatgaacattcaa

SEQ ID NO: 6124059 - DNA, 17 bp, Homo sapiens
ctccagtttcagaagca

SEQ ID NO: 6124060 - DNA, 22 bp, Homo sapiens
ctccagtttccaagttcctgca

SEQ ID NO: 6124061 - DNA, 14 bp, Homo sapiens
ctccagtttctctt

SEQ ID NO: 6124062 - DNA, 20 bp, Homo sapiens
ctccagtttgcacctgtccc

SEQ ID NO: 6124063 - DNA, 19 bp, Homo sapiens
ctccagtttgcccaccaca

SEQ ID NO: 6124064 - DNA, 17 bp, Homo sapiens
ctccagttttcagttga

SEQ ID NO: 6124065 - DNA, 16 bp, Homo sapiens
ctccagttttgcctga

SEQ ID NO: 6124066 - DNA, 20 bp, Homo sapiens
ctccataaagtacaaatgaa

SEQ ID NO: 6124067 - DNA, 14 bp, Homo sapiens
ctccataagtttaa

SEQ ID NO: 6124068 - DNA, 17 bp, Homo sapiens
ctccataatgccactgg

SEQ ID NO: 6124069 - DNA, 20 bp, Homo sapiens
ctccatacacacgctgcctt

SEQ ID NO: 6124070 - DNA, 17 bp, Homo sapiens
ctccataccttttctct

SEQ ID NO: 6124071 - DNA, 23 bp, Homo sapiens
ctccataccttttctcttttctt

SEQ ID NO: 6124072 - DNA, 15 bp, Homo sapiens
ctccatactcaagct

SEQ ID NO: 6124073 - DNA, 14 bp, Homo sapiens
ctccatactcagga

SEQ ID NO: 6124074 - DNA, 15 bp, Homo sapiens
ctccatactccactc

SEQ ID NO: 6124075 - DNA, 13 bp, Homo sapiens
ctccatactttga

SEQ ID NO: 6124076 - DNA, 17 bp, Homo sapiens
ctccatactttggatga

SEQ ID NO: 6124077 - DNA, 17 bp, Homo sapiens
ctccatagctccttccc

SEQ ID NO: 6124078 - DNA, 23 bp, Homo sapiens
ctccataggagggaaggagcagt

SEQ ID NO: 6124079 - DNA, 22 bp, Homo sapiens
ctccatagttctgactcctgaa

SEQ ID NO: 6124080 - DNA, 20 bp, Homo sapiens
ctccatagtttggcatttgc

SEQ ID NO: 6124081 - DNA, 20 bp, Homo sapiens
ctccatatcagctctctgca

SEQ ID NO: 6124082 - DNA, 19 bp, Homo sapiens
ctccatatcccgggagcag

SEQ ID NO: 6124083 - DNA, 19 bp, Homo sapiens
ctccatatttgatttctaa

SEQ ID NO: 6124084 - DNA, 20 bp, Homo sapiens
ctccatatttgatttctaat

SEQ ID NO: 6124085 - DNA, 12 bp, Homo sapiens
ctccatcacccc

SEQ ID NO: 6124086 - DNA, 14 bp, Homo sapiens
ctccatcacccctg

SEQ ID NO: 6124087 - DNA, 16 bp, Homo sapiens
ctccatcacccctggt

SEQ ID NO: 6124088 - DNA, 22 bp, Homo sapiens
ctccatcacccctggtggctgc

SEQ ID NO: 6124089 - DNA, 19 bp, Homo sapiens
ctccatcacctgaaacact

SEQ ID NO: 6124090 - DNA, 16 bp, Homo sapiens
ctccatcagaaaacca

SEQ ID NO: 6124091 - DNA, 17 bp, Homo sapiens
ctccatcagaaaaccaa

SEQ ID NO: 6124092 - DNA, 21 bp, Homo sapiens
ctccatcatatgcctgacccc

SEQ ID NO: 6124093 - DNA, 21 bp, Homo sapiens
ctccatccacacacagcagct

SEQ ID NO: 6124094 - DNA, 22 bp, Homo sapiens
ctccatccacacacagcagctc

SEQ ID NO: 6124095 - DNA, 18 bp, Homo sapiens
ctccatccacccctctgg

SEQ ID NO: 6124096 - DNA, 16 bp, Homo sapiens
ctccatccatctgtcc

SEQ ID NO: 6124097 - DNA, 22 bp, Homo sapiens
ctccatcccaacagccatgccc

SEQ ID NO: 6124098 - DNA, 15 bp, Homo sapiens
ctccatccccatcgg

SEQ ID NO: 6124099 - DNA, 18 bp, Homo sapiens
ctccatccccctctgtct

SEQ ID NO: 6124100 - DNA, 12 bp, Homo sapiens
ctccatcccctc

SEQ ID NO: 6124101 - DNA, 15 bp, Homo sapiens
ctccatcccctccct

SEQ ID NO: 6124102 - DNA, 19 bp, Homo sapiens
ctccatcccgcccttccca

SEQ ID NO: 6124103 - DNA, 11 bp, Homo sapiens
ctccatccctc

SEQ ID NO: 6124104 - DNA, 20 bp, Homo sapiens
ctccatccctccctcccgtc

SEQ ID NO: 6124105 - DNA, 18 bp, Homo sapiens
ctccatccctctcctctg

SEQ ID NO: 6124106 - DNA, 19 bp, Homo sapiens
ctccatccctctcctctgc

SEQ ID NO: 6124107 - DNA, 22 bp, Homo sapiens
ctccatccctctcctctgccct

SEQ ID NO: 6124108 - DNA, 13 bp, Homo sapiens
ctccatccctgct

SEQ ID NO: 6124109 - DNA, 14 bp, Homo sapiens
ctccatccctgctc

SEQ ID NO: 6124110 - DNA, 16 bp, Homo sapiens
ctccatccctgctctg

SEQ ID NO: 6124111 - DNA, 14 bp, Homo sapiens
ctccatccctggcc

SEQ ID NO: 6124112 - DNA, 15 bp, Homo sapiens
ctccatccctggccc

SEQ ID NO: 6124113 - DNA, 24 bp, Homo sapiens
ctccatccctggccccctccctgg

SEQ ID NO: 6124114 - DNA, 15 bp, Homo sapiens
ctccatcccttcccc

SEQ ID NO: 6124115 - DNA, 17 bp, Homo sapiens
ctccatcccttccccag

SEQ ID NO: 6124116 - DNA, 17 bp, Homo sapiens
ctccatccggctcctgt

SEQ ID NO: 6124117 - DNA, 19 bp, Homo sapiens
ctccatcctcatctctctt

SEQ ID NO: 6124118 - DNA, 16 bp, Homo sapiens
ctccatcctcctcctt

SEQ ID NO: 6124119 - DNA, 17 bp, Homo sapiens
ctccatcctcctccttc

SEQ ID NO: 6124120 - DNA, 19 bp, Homo sapiens
ctccatcctcctccttcct

SEQ ID NO: 6124121 - DNA, 18 bp, Homo sapiens
ctccatcctgaggctcca

SEQ ID NO: 6124122 - DNA, 16 bp, Homo sapiens
ctccatcctgccagga

SEQ ID NO: 6124123 - DNA, 18 bp, Homo sapiens
ctccatcctgccaggagc

SEQ ID NO: 6124124 - DNA, 23 bp, Homo sapiens
ctccatcctgccaggagcagcct

SEQ ID NO: 6124125 - DNA, 17 bp, Homo sapiens
ctccatccttaactgtc

SEQ ID NO: 6124126 - DNA, 20 bp, Homo sapiens
ctccatccttgcatcactgg

SEQ ID NO: 6124127 - DNA, 19 bp, Homo sapiens
ctccatcctttctgcctct

SEQ ID NO: 6124128 - DNA, 21 bp, Homo sapiens
ctccatcctttctgcctctca

SEQ ID NO: 6124129 - DNA, 22 bp, Homo sapiens
ctccatcctttctgcctctcaa

SEQ ID NO: 6124130 - DNA, 18 bp, Homo sapiens
ctccatcctttgtcttgg

SEQ ID NO: 6124131 - DNA, 23 bp, Homo sapiens
ctccatcctttgtcttggaacca

SEQ ID NO: 6124132 - DNA, 21 bp, Homo sapiens
ctccatcgcgccagcgacctc

SEQ ID NO: 6124133 - DNA, 20 bp, Homo sapiens
ctccatcgctgtcatctcag

SEQ ID NO: 6124134 - DNA, 21 bp, Homo sapiens
ctccatcgtctcatcctcctt

SEQ ID NO: 6124135 - DNA, 22 bp, Homo sapiens
ctccatcgtctcatcctccttt

SEQ ID NO: 6124136 - DNA, 18 bp, Homo sapiens
ctccatctaaactgcccc

SEQ ID NO: 6124137 - DNA, 9 bp, Homo sapiens
ctccatctc

SEQ ID NO: 6124138 - DNA, 17 bp, Homo sapiens
ctccatctcaaaacaaa

SEQ ID NO: 6124139 - DNA, 15 bp, Homo sapiens
ctccatctcccaagg

SEQ ID NO: 6124140 - DNA, 22 bp, Homo sapiens
ctccatctcccaaggctgccag

SEQ ID NO: 6124141 - DNA, 18 bp, Homo sapiens
ctccatctccgcctccac

SEQ ID NO: 6124142 - DNA, 13 bp, Homo sapiens
ctccatctcctgc

SEQ ID NO: 6124143 - DNA, 17 bp, Homo sapiens
ctccatctcctgctcac

SEQ ID NO: 6124144 - DNA, 19 bp, Homo sapiens
ctccatctctcatcctcca

SEQ ID NO: 6124145 - DNA, 15 bp, Homo sapiens
ctccatctctctggc

SEQ ID NO: 6124146 - DNA, 16 bp, Homo sapiens
ctccatctctctggcc

SEQ ID NO: 6124147 - DNA, 21 bp, Homo sapiens
ctccatctcttgtaccagccc

SEQ ID NO: 6124148 - DNA, 16 bp, Homo sapiens
ctccatctggcagggt

SEQ ID NO: 6124149 - DNA, 15 bp, Homo sapiens
ctccatctggtagaa

SEQ ID NO: 6124150 - DNA, 16 bp, Homo sapiens
ctccatctttatagaa

SEQ ID NO: 6124151 - DNA, 18 bp, Homo sapiens
ctccatctttttcttggg

SEQ ID NO: 6124152 - DNA, 14 bp, Homo sapiens
ctccatgaccaggc

SEQ ID NO: 6124153 - DNA, 16 bp, Homo sapiens
ctccatgaccaggcca

SEQ ID NO: 6124154 - DNA, 17 bp, Homo sapiens
ctccatgaccaggccac

SEQ ID NO: 6124155 - DNA, 18 bp, Homo sapiens
ctccatgaccaggccacc

SEQ ID NO: 6124156 - DNA, 15 bp, Homo sapiens
ctccatgactggctg

SEQ ID NO: 6124157 - DNA, 21 bp, Homo sapiens
ctccatgactggctgtctgcc

SEQ ID NO: 6124158 - DNA, 21 bp, Homo sapiens
ctccatgagacacatctcctc

SEQ ID NO: 6124159 - DNA, 21 bp, Homo sapiens
ctccatgatgcaagccagctt

SEQ ID NO: 6124160 - DNA, 23 bp, Homo sapiens
ctccatgatgcaagccagcttcc

SEQ ID NO: 6124161 - DNA, 22 bp, Homo sapiens
ctccatgattccaagggcccag

SEQ ID NO: 6124162 - DNA, 16 bp, Homo sapiens
ctccatgattctctga

SEQ ID NO: 6124163 - DNA, 21 bp, Homo sapiens
ctccatgattctctgagtggt

SEQ ID NO: 6124164 - DNA, 16 bp, Homo sapiens
ctccatgcaagtgctg

SEQ ID NO: 6124165 - DNA, 14 bp, Homo sapiens
ctccatgcacctcc

SEQ ID NO: 6124166 - DNA, 20 bp, Homo sapiens
ctccatgcacctcccttccc

SEQ ID NO: 6124167 - DNA, 20 bp, Homo sapiens
ctccatgccccagctctgga

SEQ ID NO: 6124168 - DNA, 23 bp, Homo sapiens
ctccatgcctatttactggaaac

SEQ ID NO: 6124169 - DNA, 14 bp, Homo sapiens
ctccatgctcctca

SEQ ID NO: 6124170 - DNA, 17 bp, Homo sapiens
ctccatgctcctcacct

SEQ ID NO: 6124171 - DNA, 21 bp, Homo sapiens
ctccatgctgaaggctcccat

SEQ ID NO: 6124172 - DNA, 13 bp, Homo sapiens
ctccatgctgcaa

SEQ ID NO: 6124173 - DNA, 18 bp, Homo sapiens
ctccatgctgcaaaggag

SEQ ID NO: 6124174 - DNA, 14 bp, Homo sapiens
ctccatgctgcctc

SEQ ID NO: 6124175 - DNA, 15 bp, Homo sapiens
ctccatgctgggtct

SEQ ID NO: 6124176 - DNA, 12 bp, Homo sapiens
ctccatgctggt

SEQ ID NO: 6124177 - DNA, 19 bp, Homo sapiens
ctccatgctggtgtggcca

SEQ ID NO: 6124178 - DNA, 14 bp, Homo sapiens
ctccatgctgtccc

SEQ ID NO: 6124179 - DNA, 17 bp, Homo sapiens
ctccatgctgtccctgt

SEQ ID NO: 6124180 - DNA, 20 bp, Homo sapiens
ctccatgcttagtcactgcc

SEQ ID NO: 6124181 - DNA, 16 bp, Homo sapiens
ctccatgctttcacct

SEQ ID NO: 6124182 - DNA, 14 bp, Homo sapiens
ctccatggaaaagc

SEQ ID NO: 6124183 - DNA, 10 bp, Homo sapiens
ctccatggag

SEQ ID NO: 6124184 - DNA, 13 bp, Homo sapiens
ctccatggagcct

SEQ ID NO: 6124185 - DNA, 14 bp, Homo sapiens
ctccatggagccta

SEQ ID NO: 6124186 - DNA, 14 bp, Homo sapiens
ctccatggaggagg

SEQ ID NO: 6124187 - DNA, 17 bp, Homo sapiens
ctccatggcagcagcca

SEQ ID NO: 6124188 - DNA, 12 bp, Homo sapiens
ctccatggccac

SEQ ID NO: 6124189 - DNA, 16 bp, Homo sapiens
ctccatggccaccccg

SEQ ID NO: 6124190 - DNA, 20 bp, Homo sapiens
ctccatggccctgccatgct

SEQ ID NO: 6124191 - DNA, 18 bp, Homo sapiens
ctccatggccctgtccca

SEQ ID NO: 6124192 - DNA, 20 bp, Homo sapiens
ctccatggccctgtcccagg

SEQ ID NO: 6124193 - DNA, 18 bp, Homo sapiens
ctccatggcttcctcctc

SEQ ID NO: 6124194 - DNA, 20 bp, Homo sapiens
ctccatggcttcctcctccc

SEQ ID NO: 6124195 - DNA, 22 bp, Homo sapiens
ctccatgggccaccgcccagct

SEQ ID NO: 6124196 - DNA, 23 bp, Homo sapiens
ctccatgggccaccgcccagctc

SEQ ID NO: 6124197 - DNA, 21 bp, Homo sapiens
ctccatggggaagtgctcccc

SEQ ID NO: 6124198 - DNA, 19 bp, Homo sapiens
ctccatggggaggcctcac

SEQ ID NO: 6124199 - DNA, 20 bp, Homo sapiens
ctccatgggggctcagccag

SEQ ID NO: 6124200 - DNA, 22 bp, Homo sapiens
ctccatggggttcgagactcca

SEQ ID NO: 6124201 - DNA, 13 bp, Homo sapiens
ctccatggtcctg

SEQ ID NO: 6124202 - DNA, 14 bp, Homo sapiens
ctccatggtcctgt

SEQ ID NO: 6124203 - DNA, 22 bp, Homo sapiens
ctccatggtgaactgaagcaga

SEQ ID NO: 6124204 - DNA, 23 bp, Homo sapiens
ctccatggtgaactgaagcagag

SEQ ID NO: 6124205 - DNA, 16 bp, Homo sapiens
ctccatggtgcctctg

SEQ ID NO: 6124206 - DNA, 20 bp, Homo sapiens
cggctgggcagggccgcagg

SEQ ID NO: 6124207 - DNA, 11 bp, Homo sapiens
cggctgggcct

SEQ ID NO: 6124208 - DNA, 16 bp, Homo sapiens
cggctggggacccacc

SEQ ID NO: 6124209 - DNA, 15 bp, Homo sapiens
cggctggggactgct

SEQ ID NO: 6124210 - DNA, 16 bp, Homo sapiens
cggctggggactgcta

SEQ ID NO: 6124211 - DNA, 18 bp, Homo sapiens
cggctggggactgctacc

SEQ ID NO: 6124212 - DNA, 18 bp, Homo sapiens
cggctggggtcccagcag

SEQ ID NO: 6124213 - DNA, 20 bp, Homo sapiens
cggctgggtcggccctgccc

SEQ ID NO: 6124214 - DNA, 20 bp, Homo sapiens
cggctggtcactctgccctc

SEQ ID NO: 6124215 - DNA, 19 bp, Homo sapiens
cggctggttgtgggcactg

SEQ ID NO: 6124216 - DNA, 16 bp, Homo sapiens
cggctgtctcagactc

SEQ ID NO: 6124217 - DNA, 14 bp, Homo sapiens
cggctgtctcctgt

SEQ ID NO: 6124218 - DNA, 11 bp, Homo sapiens
cggctgtgagg

SEQ ID NO: 6124219 - DNA, 15 bp, Homo sapiens
cggctgtgcagtcct

SEQ ID NO: 6124220 - DNA, 14 bp, Homo sapiens
cggctgtgctggga

SEQ ID NO: 6124221 - DNA, 23 bp, Homo sapiens
cggctgtggaccgtggacaggcc

SEQ ID NO: 6124222 - DNA, 13 bp, Homo sapiens
cggctgtgggtgg

SEQ ID NO: 6124223 - DNA, 11 bp, Homo sapiens
cggctgtgtgt

SEQ ID NO: 6124224 - DNA, 13 bp, Homo sapiens
cggctgtgtgtgc

SEQ ID NO: 6124225 - DNA, 21 bp, Homo sapiens
cggctgttccccctgccgcag

SEQ ID NO: 6124226 - DNA, 14 bp, Homo sapiens
cggctgttcctccc

SEQ ID NO: 6124227 - DNA, 19 bp, Homo sapiens
cggcttcatgccagctact

SEQ ID NO: 6124228 - DNA, 21 bp, Homo sapiens
cggcttccccattgccttctg

SEQ ID NO: 6124229 - DNA, 12 bp, Homo sapiens
cggcttccctgc

SEQ ID NO: 6124230 - DNA, 14 bp, Homo sapiens
cggcttcctgtcca

SEQ ID NO: 6124231 - DNA, 17 bp, Homo sapiens
cggcttcgcgctggaat

SEQ ID NO: 6124232 - DNA, 21 bp, Homo sapiens
cggcttctcacgctttgttta

SEQ ID NO: 6124233 - DNA, 16 bp, Homo sapiens
cggcttgccacacccc

SEQ ID NO: 6124234 - DNA, 22 bp, Homo sapiens
cggcttgcctgtaatcccagca

SEQ ID NO: 6124235 - DNA, 19 bp, Homo sapiens
cggcttggatcctgggctg

SEQ ID NO: 6124236 - DNA, 17 bp, Homo sapiens
cggcttggccgccatcc

SEQ ID NO: 6124237 - DNA, 22 bp, Homo sapiens
cggcttgtcttcgctggctcct

SEQ ID NO: 6124238 - DNA, 19 bp, Homo sapiens
cggcttgtgggctggtgcc

SEQ ID NO: 6124239 - DNA, 18 bp, Homo sapiens
cggcttgttcttgcagca

SEQ ID NO: 6124240 - DNA, 13 bp, Homo sapiens
cggctttcctccg

SEQ ID NO: 6124241 - DNA, 16 bp, Homo sapiens
cggctttcctccggag

SEQ ID NO: 6124242 - DNA, 15 bp, Homo sapiens
cggctttgcagggag

SEQ ID NO: 6124243 - DNA, 14 bp, Homo sapiens
cggctttgcagtgc

SEQ ID NO: 6124244 - DNA, 18 bp, Homo sapiens
cggctttttgccatctgt

SEQ ID NO: 6124245 - DNA, 23 bp, Homo sapiens
cgggaaaaaactttgctccaggc

SEQ ID NO: 6124246 - DNA, 15 bp, Homo sapiens
cgggaaaaagcccac

SEQ ID NO: 6124247 - DNA, 22 bp, Homo sapiens
cgggaaaagcagcccttggcca

SEQ ID NO: 6124248 - DNA, 14 bp, Homo sapiens
cgggaaagaagaaa

SEQ ID NO: 6124249 - DNA, 19 bp, Homo sapiens
cgggaaaggaaacgccccg

SEQ ID NO: 6124250 - DNA, 20 bp, Homo sapiens
cgggaaaggccggtgggaag

SEQ ID NO: 6124251 - DNA, 15 bp, Homo sapiens
cgggaacagacaaca

SEQ ID NO: 6124252 - DNA, 14 bp, Homo sapiens
cgggaaccaagcag

SEQ ID NO: 6124253 - DNA, 20 bp, Homo sapiens
cgggaacctcactcttgcca

SEQ ID NO: 6124254 - DNA, 21 bp, Homo sapiens
cgggaacctccccagcctgcg

SEQ ID NO: 6124255 - DNA, 22 bp, Homo sapiens
cgggaacctccccagcctgcgc

SEQ ID NO: 6124256 - DNA, 17 bp, Homo sapiens
cgggaacgcttgctctt

SEQ ID NO: 6124257 - DNA, 18 bp, Homo sapiens
cgggaacgcttgctctta

SEQ ID NO: 6124258 - DNA, 17 bp, Homo sapiens
cgggaactcctgccaca

SEQ ID NO: 6124259 - DNA, 20 bp, Homo sapiens
cgggaactttgcagcatacc

SEQ ID NO: 6124260 - DNA, 18 bp, Homo sapiens
cgggaagagaggagttca

SEQ ID NO: 6124261 - DNA, 23 bp, Homo sapiens
cgggaagatcctccttccaggcc

SEQ ID NO: 6124262 - DNA, 19 bp, Homo sapiens
cgggaagcatcctccccac

SEQ ID NO: 6124263 - DNA, 22 bp, Homo sapiens
cgggaagcatcctccccaccag

SEQ ID NO: 6124264 - DNA, 16 bp, Homo sapiens
cgggaagccaccctcc

SEQ ID NO: 6124265 - DNA, 23 bp, Homo sapiens
cgggaagccaccctcccagctct

SEQ ID NO: 6124266 - DNA, 12 bp, Homo sapiens
cgggaaggatgg

SEQ ID NO: 6124267 - DNA, 14 bp, Homo sapiens
cgggaaggcctgag

SEQ ID NO: 6124268 - DNA, 13 bp, Homo sapiens
cgggaagggaggg

SEQ ID NO: 6124269 - DNA, 16 bp, Homo sapiens
cgggaagggaggggaa

SEQ ID NO: 6124270 - DNA, 16 bp, Homo sapiens
cgggaagggggctggg

SEQ ID NO: 6124271 - DNA, 15 bp, Homo sapiens
cgggaagggtgggcc

SEQ ID NO: 6124272 - DNA, 16 bp, Homo sapiens
cgggaagggtgggccc

SEQ ID NO: 6124273 - DNA, 22 bp, Homo sapiens
cgggaagggtgggccctggagg

SEQ ID NO: 6124274 - DNA, 20 bp, Homo sapiens
cgggaaggtcaccagcacca

SEQ ID NO: 6124275 - DNA, 10 bp, Homo sapiens
cgggaatatt

SEQ ID NO: 6124276 - DNA, 17 bp, Homo sapiens
cgggaatattgtttctt

SEQ ID NO: 6124277 - DNA, 17 bp, Homo sapiens
cgggaatgcctaggtcc

SEQ ID NO: 6124278 - DNA, 18 bp, Homo sapiens
cgggaattttcatctagg

SEQ ID NO: 6124279 - DNA, 19 bp, Homo sapiens
cgggacaccgtggggaagg

SEQ ID NO: 6124280 - DNA, 19 bp, Homo sapiens
cgggacacctaggctaggg

SEQ ID NO: 6124281 - DNA, 15 bp, Homo sapiens
cgggacacctgccct

SEQ ID NO: 6124282 - DNA, 12 bp, Homo sapiens
cgggacagacct

SEQ ID NO: 6124283 - DNA, 14 bp, Homo sapiens
cgggacagacctgg

SEQ ID NO: 6124284 - DNA, 18 bp, Homo sapiens
cgggacagtgctgcagct

SEQ ID NO: 6124285 - DNA, 14 bp, Homo sapiens
cgggacagttgctg

SEQ ID NO: 6124286 - DNA, 18 bp, Homo sapiens
cgggaccacatctgtcct

SEQ ID NO: 6124287 - DNA, 16 bp, Homo sapiens
cgggaccaccctgagc

SEQ ID NO: 6124288 - DNA, 13 bp, Homo sapiens
cgggaccagaaac

SEQ ID NO: 6124289 - DNA, 15 bp, Homo sapiens
cgggacccacggagc

SEQ ID NO: 6124290 - DNA, 17 bp, Homo sapiens
cgggacccccggcctcc

SEQ ID NO: 6124291 - DNA, 20 bp, Homo sapiens
cgggaccccctcaccatcca

SEQ ID NO: 6124292 - DNA, 23 bp, Homo sapiens
cgggaccccgagcctggctccaa

SEQ ID NO: 6124293 - DNA, 18 bp, Homo sapiens
cgggacccggcggccctg

SEQ ID NO: 6124294 - DNA, 14 bp, Homo sapiens
cgggaccctgccca

SEQ ID NO: 6124295 - DNA, 22 bp, Homo sapiens
cgggaccctgcccagagctgag

SEQ ID NO: 6124296 - DNA, 20 bp, Homo sapiens
cgggaccctgctcacaggca

SEQ ID NO: 6124297 - DNA, 18 bp, Homo sapiens
cgggacctcccaggacaa

SEQ ID NO: 6124298 - DNA, 13 bp, Homo sapiens
cgggacctgtggc

SEQ ID NO: 6124299 - DNA, 14 bp, Homo sapiens
cgggacgcttccag

SEQ ID NO: 6124300 - DNA, 19 bp, Homo sapiens
cgggacgcttccagaccac

SEQ ID NO: 6124301 - DNA, 20 bp, Homo sapiens
cgggacgcttccagaccacc

SEQ ID NO: 6124302 - DNA, 18 bp, Homo sapiens
cgggacgtggcacctcct

SEQ ID NO: 6124303 - DNA, 19 bp, Homo sapiens
cgggacgtggcacctcctc

SEQ ID NO: 6124304 - DNA, 16 bp, Homo sapiens
cgggactcaggcggga

SEQ ID NO: 6124305 - DNA, 13 bp, Homo sapiens
cgggactgcggag

SEQ ID NO: 6124306 - DNA, 19 bp, Homo sapiens
cgggactgctgctctccca

SEQ ID NO: 6124307 - DNA, 23 bp, Homo sapiens
cgggactgctgctctcccaaggg

SEQ ID NO: 6124308 - DNA, 17 bp, Homo sapiens
cgggactgggggcggga

SEQ ID NO: 6124309 - DNA, 21 bp, Homo sapiens
cgggactgggggcggggcctg

SEQ ID NO: 6124310 - DNA, 22 bp, Homo sapiens
cgggactgtcttcaaccctgcc

SEQ ID NO: 6124311 - DNA, 16 bp, Homo sapiens
cgggagaagccacctt

SEQ ID NO: 6124312 - DNA, 16 bp, Homo sapiens
cgggagaaggcatgag

SEQ ID NO: 6124313 - DNA, 16 bp, Homo sapiens
cgggagaatcatgtga

SEQ ID NO: 6124314 - DNA, 18 bp, Homo sapiens
cgggagacagcttctctg

SEQ ID NO: 6124315 - DNA, 22 bp, Homo sapiens
cgggagacagcttctctgcagt

SEQ ID NO: 6124316 - DNA, 14 bp, Homo sapiens
cgggagaccccttg

SEQ ID NO: 6124317 - DNA, 16 bp, Homo sapiens
cgggagacctgtgcta

SEQ ID NO: 6124318 - DNA, 17 bp, Homo sapiens
cgggagaggggacgcag

SEQ ID NO: 6124319 - DNA, 23 bp, Homo sapiens
cgggagaggggacgcaggcccct

SEQ ID NO: 6124320 - DNA, 16 bp, Homo sapiens
cgggagcacccagagc

SEQ ID NO: 6124321 - DNA, 18 bp, Homo sapiens
cgggagcacccagagcac

SEQ ID NO: 6124322 - DNA, 15 bp, Homo sapiens
cgggagcagtgtctt

SEQ ID NO: 6124323 - DNA, 22 bp, Homo sapiens
cgggagcatctcttgaggccag

SEQ ID NO: 6124324 - DNA, 20 bp, Homo sapiens
cgggagcattggcccctgag

SEQ ID NO: 6124325 - DNA, 13 bp, Homo sapiens
cgggagccagact

SEQ ID NO: 6124326 - DNA, 19 bp, Homo sapiens
cgggagccctagccctgct

SEQ ID NO: 6124327 - DNA, 12 bp, Homo sapiens
cgggagcctccc

SEQ ID NO: 6124328 - DNA, 14 bp, Homo sapiens
cgggagcctccccc

SEQ ID NO: 6124329 - DNA, 14 bp, Homo sapiens
cgggagcctcctct

SEQ ID NO: 6124330 - DNA, 15 bp, Homo sapiens
cgggagcctcctctg

SEQ ID NO: 6124331 - DNA, 15 bp, Homo sapiens
cgggagcctgcgtgg

SEQ ID NO: 6124332 - DNA, 20 bp, Homo sapiens
cgggagcggtggccctgtcc

SEQ ID NO: 6124333 - DNA, 16 bp, Homo sapiens
cgggagctcaggaacc

SEQ ID NO: 6124334 - DNA, 15 bp, Homo sapiens
cgggagctgggagcc

SEQ ID NO: 6124335 - DNA, 19 bp, Homo sapiens
cgggagctgggagccaggc

SEQ ID NO: 6124336 - DNA, 16 bp, Homo sapiens
cgggagctgggccctg

SEQ ID NO: 6124337 - DNA, 19 bp, Homo sapiens
cgggagctgggccctgcct

SEQ ID NO: 6124338 - DNA, 23 bp, Homo sapiens
cgggagctgggccctgcctgcag

SEQ ID NO: 6124339 - DNA, 21 bp, Homo sapiens
cgggagcttttggtgagaagg

SEQ ID NO: 6124340 - DNA, 21 bp, Homo sapiens
cgggaggaaaaggcccctgca

SEQ ID NO: 6124341 - DNA, 21 bp, Homo sapiens
cgggaggaagccggtgtccct

SEQ ID NO: 6124342 - DNA, 18 bp, Homo sapiens
cgggaggagcagcccggg

SEQ ID NO: 6124343 - DNA, 23 bp, Homo sapiens
cgggaggatgttctgggacacag

SEQ ID NO: 6124344 - DNA, 20 bp, Homo sapiens
cgggaggcagaggttgtagt

SEQ ID NO: 6124345 - DNA, 14 bp, Homo sapiens
cgggaggcagagtt

SEQ ID NO: 6124346 - DNA, 18 bp, Homo sapiens
cgggaggcagcgccccac

SEQ ID NO: 6124347 - DNA, 20 bp, Homo sapiens
cgggaggccacgggggaggc

SEQ ID NO: 6124348 - DNA, 23 bp, Homo sapiens
cgggaggccacgggggaggccga

SEQ ID NO: 6124349 - DNA, 13 bp, Homo sapiens
cgggaggccccag

SEQ ID NO: 6124350 - DNA, 11 bp, Homo sapiens
cgggaggccct

SEQ ID NO: 6124351 - DNA, 12 bp, Homo sapiens
cgggaggccctg

SEQ ID NO: 6124352 - DNA, 15 bp, Homo sapiens
cgggaggccctggcc

SEQ ID NO: 6124353 - DNA, 14 bp, Homo sapiens
cgggaggcctcagt

SEQ ID NO: 6124354 - DNA, 15 bp, Homo sapiens
cgggaggcctcagtt

SEQ ID NO: 6124355 - DNA, 13 bp, Homo sapiens
cgggaggctgaga

SEQ ID NO: 6124356 - DNA, 20 bp, Homo sapiens
cgggaggctgagacaggaga

SEQ ID NO: 6124357 - DNA, 15 bp, Homo sapiens
cgggaggctgggcac

SEQ ID NO: 6124358 - DNA, 11 bp, Homo sapiens
cgggagggagt

SEQ ID NO: 6124359 - DNA, 12 bp, Homo sapiens
cgggaggggagg

SEQ ID NO: 6124360 - DNA, 14 bp, Homo sapiens
cgggaggggcccgc

SEQ ID NO: 6124361 - DNA, 19 bp, Homo sapiens
cgggaggggcccgcttgcc

SEQ ID NO: 6124362 - DNA, 20 bp, Homo sapiens
cgggagggtttggggacaga

SEQ ID NO: 6124363 - DNA, 17 bp, Homo sapiens
cgggaggtcgaggcagg

SEQ ID NO: 6124364 - DNA, 17 bp, Homo sapiens
cgggagtctcctcactg

SEQ ID NO: 6124365 - DNA, 15 bp, Homo sapiens
cgggagtgacccagc

SEQ ID NO: 6124366 - DNA, 14 bp, Homo sapiens
cgggagtggccatc

SEQ ID NO: 6124367 - DNA, 20 bp, Homo sapiens
cgggagtgtgggggtgccat

SEQ ID NO: 6124368 - DNA, 16 bp, Homo sapiens
cgggataaactgagcc

SEQ ID NO: 6124369 - DNA, 14 bp, Homo sapiens
cgggatacagctga

SEQ ID NO: 6124370 - DNA, 18 bp, Homo sapiens
cgggatattaaacctctt

SEQ ID NO: 6124371 - DNA, 15 bp, Homo sapiens
cgggatattatagaa

SEQ ID NO: 6124372 - DNA, 19 bp, Homo sapiens
cgggatcctccacagagag

SEQ ID NO: 6124373 - DNA, 20 bp, Homo sapiens
cgggatcctccacagagagg

SEQ ID NO: 6124374 - DNA, 19 bp, Homo sapiens
cgggatgccgttctgttcc

SEQ ID NO: 6124375 - DNA, 23 bp, Homo sapiens
cgggatggagacacggggcagga

SEQ ID NO: 6124376 - DNA, 22 bp, Homo sapiens
cgggatgtcagcagacacacat

SEQ ID NO: 6124377 - DNA, 14 bp, Homo sapiens
cgggattacagaaa

SEQ ID NO: 6124378 - DNA, 17 bp, Homo sapiens
cgggattagtacacact

SEQ ID NO: 6124379 - DNA, 14 bp, Homo sapiens
cgggattccctggt

SEQ ID NO: 6124380 - DNA, 20 bp, Homo sapiens
cgggcaaagagctcccgagg

SEQ ID NO: 6124381 - DNA, 20 bp, Homo sapiens
cgggcaaatgccagggcccg

SEQ ID NO: 6124382 - DNA, 19 bp, Homo sapiens
cgggcaacactcactgcct

SEQ ID NO: 6124383 - DNA, 16 bp, Homo sapiens
cgggcaagaagctgct

SEQ ID NO: 6124384 - DNA, 20 bp, Homo sapiens
cgggcaagtcatcctcctgg

SEQ ID NO: 6124385 - DNA, 12 bp, Homo sapiens
ctccatggttct

SEQ ID NO: 6124386 - DNA, 17 bp, Homo sapiens
ctccatggttctcaatt

SEQ ID NO: 6124387 - DNA, 16 bp, Homo sapiens
ctccatgtagaagagg

SEQ ID NO: 6124388 - DNA, 19 bp, Homo sapiens
ctccatgtagaagagggag

SEQ ID NO: 6124389 - DNA, 21 bp, Homo sapiens
ctccatgtagaataaatgaag

SEQ ID NO: 6124390 - DNA, 13 bp, Homo sapiens
ctccatgtcatcc

SEQ ID NO: 6124391 - DNA, 13 bp, Homo sapiens
ctccatgtggccc

SEQ ID NO: 6124392 - DNA, 16 bp, Homo sapiens
ctccatgtggccccag

SEQ ID NO: 6124393 - DNA, 21 bp, Homo sapiens
ctccatgtggccccaggtgcc

SEQ ID NO: 6124394 - DNA, 14 bp, Homo sapiens
ctccatgtgggcta

SEQ ID NO: 6124395 - DNA, 13 bp, Homo sapiens
ctccatgtgtgct

SEQ ID NO: 6124396 - DNA, 19 bp, Homo sapiens
ctccatgtgtgtgccaagc

SEQ ID NO: 6124397 - DNA, 22 bp, Homo sapiens
ctccatgtgtgtgccaagccct

SEQ ID NO: 6124398 - DNA, 23 bp, Homo sapiens
ctccatgttagtaatggcagagc

SEQ ID NO: 6124399 - DNA, 21 bp, Homo sapiens
ctccatgttggtcaggctggt

SEQ ID NO: 6124400 - DNA, 14 bp, Homo sapiens
ctccatgtttagaa

SEQ ID NO: 6124401 - DNA, 23 bp, Homo sapiens
ctccatgtttagaaataaatgaa

SEQ ID NO: 6124402 - DNA, 22 bp, Homo sapiens
ctccattaaacttctactgagc

SEQ ID NO: 6124403 - DNA, 23 bp, Homo sapiens
ctccattaaacttctactgagca

SEQ ID NO: 6124404 - DNA, 15 bp, Homo sapiens
ctccattactgtgat

SEQ ID NO: 6124405 - DNA, 21 bp, Homo sapiens
ctccattagaaaattttgtaa

SEQ ID NO: 6124406 - DNA, 19 bp, Homo sapiens
ctccattatccattcccaa

SEQ ID NO: 6124407 - DNA, 18 bp, Homo sapiens
ctccattattcctctcac

SEQ ID NO: 6124408 - DNA, 20 bp, Homo sapiens
ctccattattcctctcaccc

SEQ ID NO: 6124409 - DNA, 17 bp, Homo sapiens
ctccattcaatttcagg

SEQ ID NO: 6124410 - DNA, 18 bp, Homo sapiens
ctccattcaatttcaggc

SEQ ID NO: 6124411 - DNA, 16 bp, Homo sapiens
ctccattcatgtttaa

SEQ ID NO: 6124412 - DNA, 15 bp, Homo sapiens
ctccattccagtctc

SEQ ID NO: 6124413 - DNA, 16 bp, Homo sapiens
ctccattcccacccct

SEQ ID NO: 6124414 - DNA, 24 bp, Homo sapiens
ctccattcccgtggaacgtttttc

SEQ ID NO: 6124415 - DNA, 16 bp, Homo sapiens
ctccattccctagcag

SEQ ID NO: 6124416 - DNA, 13 bp, Homo sapiens
ctccattcctgag

SEQ ID NO: 6124417 - DNA, 14 bp, Homo sapiens
ctccattcctgctc

SEQ ID NO: 6124418 - DNA, 16 bp, Homo sapiens
ctccattcctggagcc

SEQ ID NO: 6124419 - DNA, 19 bp, Homo sapiens
ctccattcctggagcccga

SEQ ID NO: 6124420 - DNA, 13 bp, Homo sapiens
ctccattctattt

SEQ ID NO: 6124421 - DNA, 14 bp, Homo sapiens
ctccattggcttcc

SEQ ID NO: 6124422 - DNA, 13 bp, Homo sapiens
ctccattgtgtga

SEQ ID NO: 6124423 - DNA, 15 bp, Homo sapiens
ctccattgtgtgatc

SEQ ID NO: 6124424 - DNA, 16 bp, Homo sapiens
ctccatttaagacaca

SEQ ID NO: 6124425 - DNA, 20 bp, Homo sapiens
ctccatttaagacacattga

SEQ ID NO: 6124426 - DNA, 20 bp, Homo sapiens
ctccatttaataattatatg

SEQ ID NO: 6124427 - DNA, 18 bp, Homo sapiens
ctccatttataaccccag

SEQ ID NO: 6124428 - DNA, 21 bp, Homo sapiens
ctccatttataaccccagcct

SEQ ID NO: 6124429 - DNA, 22 bp, Homo sapiens
ctccatttataaccccagcctg

SEQ ID NO: 6124430 - DNA, 23 bp, Homo sapiens
ctccatttataaccccagcctga

SEQ ID NO: 6124431 - DNA, 21 bp, Homo sapiens
ctccatttcaactccagaagt

SEQ ID NO: 6124432 - DNA, 13 bp, Homo sapiens
ctccatttcacac

SEQ ID NO: 6124433 - DNA, 16 bp, Homo sapiens
ctccatttcactggct

SEQ ID NO: 6124434 - DNA, 18 bp, Homo sapiens
ctccatttcccacttcca

SEQ ID NO: 6124435 - DNA, 18 bp, Homo sapiens
ctccatttctgctcagat

SEQ ID NO: 6124436 - DNA, 14 bp, Homo sapiens
ctccatttctggct

SEQ ID NO: 6124437 - DNA, 15 bp, Homo sapiens
ctccatttctttctt

SEQ ID NO: 6124438 - DNA, 18 bp, Homo sapiens
ctccatttgctcttcaga

SEQ ID NO: 6124439 - DNA, 17 bp, Homo sapiens
ctccatttggtcctttc

SEQ ID NO: 6124440 - DNA, 21 bp, Homo sapiens
ctccatttgtaccgaaacacc

SEQ ID NO: 6124441 - DNA, 23 bp, Homo sapiens
ctccatttgtcatcgttccccac

SEQ ID NO: 6124442 - DNA, 15 bp, Homo sapiens
ctccattttagccca

SEQ ID NO: 6124443 - DNA, 21 bp, Homo sapiens
ctccattttagcccagtgttt

SEQ ID NO: 6124444 - DNA, 17 bp, Homo sapiens
ctccatttttatttctt

SEQ ID NO: 6124445 - DNA, 16 bp, Homo sapiens
ctccatttttcccagg

SEQ ID NO: 6124446 - DNA, 15 bp, Homo sapiens
ctcccaaactcaggc

SEQ ID NO: 6124447 - DNA, 12 bp, Homo sapiens
ctcccaaactga

SEQ ID NO: 6124448 - DNA, 18 bp, Homo sapiens
ctcccaaactgacaattt

SEQ ID NO: 6124449 - DNA, 14 bp, Homo sapiens
ctcccaaagagctg

SEQ ID NO: 6124450 - DNA, 17 bp, Homo sapiens
ctcccaaagagctgcct

SEQ ID NO: 6124451 - DNA, 15 bp, Homo sapiens
ctcccaaagaggccc

SEQ ID NO: 6124452 - DNA, 17 bp, Homo sapiens
ctcccaaagctcagact

SEQ ID NO: 6124453 - DNA, 14 bp, Homo sapiens
ctcccaaaggaaag

SEQ ID NO: 6124454 - DNA, 15 bp, Homo sapiens
ctcccaaagtgctga

SEQ ID NO: 6124455 - DNA, 20 bp, Homo sapiens
ctcccaaagtgctgagatta

SEQ ID NO: 6124456 - DNA, 20 bp, Homo sapiens
ctcccaaagtgctgggatga

SEQ ID NO: 6124457 - DNA, 21 bp, Homo sapiens
ctcccaaagtgctgggattaa

SEQ ID NO: 6124458 - DNA, 20 bp, Homo sapiens
ctcccaaataaactccttaa

SEQ ID NO: 6124459 - DNA, 23 bp, Homo sapiens
ctcccaaataaactccttaacca

SEQ ID NO: 6124460 - DNA, 21 bp, Homo sapiens
ctcccaaatgcagcttcaggt

SEQ ID NO: 6124461 - DNA, 21 bp, Homo sapiens
ctcccaaatgtctattttctt

SEQ ID NO: 6124462 - DNA, 15 bp, Homo sapiens
ctcccaacagcgctt

SEQ ID NO: 6124463 - DNA, 21 bp, Homo sapiens
ctcccaacatgcttgatgttt

SEQ ID NO: 6124464 - DNA, 21 bp, Homo sapiens
ctcccaaccaaccagcagggt

SEQ ID NO: 6124465 - DNA, 22 bp, Homo sapiens
ctcccaacccattcactacagg

SEQ ID NO: 6124466 - DNA, 14 bp, Homo sapiens
ctcccaacccccct

SEQ ID NO: 6124467 - DNA, 22 bp, Homo sapiens
ctcccaacccccctcctgctcc

SEQ ID NO: 6124468 - DNA, 23 bp, Homo sapiens
ctcccaacccccctcctgctcct

SEQ ID NO: 6124469 - DNA, 12 bp, Homo sapiens
ctcccaacctca

SEQ ID NO: 6124470 - DNA, 17 bp, Homo sapiens
ctcccaacgagcctcct

SEQ ID NO: 6124471 - DNA, 22 bp, Homo sapiens
ctcccaacgagcctcctcaggg

SEQ ID NO: 6124472 - DNA, 22 bp, Homo sapiens
ctcccaacgctgaagcggtcag

SEQ ID NO: 6124473 - DNA, 16 bp, Homo sapiens
ctcccaactcacccca

SEQ ID NO: 6124474 - DNA, 17 bp, Homo sapiens
ctcccaactcagcctgt

SEQ ID NO: 6124475 - DNA, 13 bp, Homo sapiens
ctcccaactccct

SEQ ID NO: 6124476 - DNA, 20 bp, Homo sapiens
ctcccaactcccttctgctt

SEQ ID NO: 6124477 - DNA, 14 bp, Homo sapiens
ctcccaagaaacct

SEQ ID NO: 6124478 - DNA, 19 bp, Homo sapiens
ctcccaagactgctccctt

SEQ ID NO: 6124479 - DNA, 21 bp, Homo sapiens
ctcccaagacttcattgtccc

SEQ ID NO: 6124480 - DNA, 19 bp, Homo sapiens
ctcccaagaggccagggtg

SEQ ID NO: 6124481 - DNA, 20 bp, Homo sapiens
ctcccaagaggccagggtgg

SEQ ID NO: 6124482 - DNA, 14 bp, Homo sapiens
ctcccaagcagctg

SEQ ID NO: 6124483 - DNA, 17 bp, Homo sapiens
ctcccaagcccctgacc

SEQ ID NO: 6124484 - DNA, 18 bp, Homo sapiens
ctcccaagcccctgaccc

SEQ ID NO: 6124485 - DNA, 19 bp, Homo sapiens
ctcccaagcccctgacccg

SEQ ID NO: 6124486 - DNA, 20 bp, Homo sapiens
ctcccaagctatctaaagtt

SEQ ID NO: 6124487 - DNA, 18 bp, Homo sapiens
ctcccaagctgtgctggg

SEQ ID NO: 6124488 - DNA, 22 bp, Homo sapiens
ctcccaaggactttccagtgag

SEQ ID NO: 6124489 - DNA, 16 bp, Homo sapiens
ctcccaaggagaacaa

SEQ ID NO: 6124490 - DNA, 14 bp, Homo sapiens
ctcccaaggagcca

SEQ ID NO: 6124491 - DNA, 22 bp, Homo sapiens
ctcccaaggagccattctgtgt

SEQ ID NO: 6124492 - DNA, 14 bp, Homo sapiens
ctcccaaggctgcc

SEQ ID NO: 6124493 - DNA, 15 bp, Homo sapiens
ctcccaaggctgcca

SEQ ID NO: 6124494 - DNA, 19 bp, Homo sapiens
ctcccaaggctgccagaca

SEQ ID NO: 6124495 - DNA, 21 bp, Homo sapiens
ctcccaaggctgccagacatg

SEQ ID NO: 6124496 - DNA, 18 bp, Homo sapiens
ctcccaaggggcctgagc

SEQ ID NO: 6124497 - DNA, 21 bp, Homo sapiens
ctcccaagggtgccctttggg

SEQ ID NO: 6124498 - DNA, 13 bp, Homo sapiens
ctcccaaggttcc

SEQ ID NO: 6124499 - DNA, 18 bp, Homo sapiens
ctcccaaggttggagccc

SEQ ID NO: 6124500 - DNA, 21 bp, Homo sapiens
ctcccaaggttggagcccagg

SEQ ID NO: 6124501 - DNA, 18 bp, Homo sapiens
ctcccaagtagctgggat

SEQ ID NO: 6124502 - DNA, 14 bp, Homo sapiens
ctcccaagtcacac

SEQ ID NO: 6124503 - DNA, 19 bp, Homo sapiens
ctcccaagtcccaccctct

SEQ ID NO: 6124504 - DNA, 18 bp, Homo sapiens
ctcccaatggtgcttgga

SEQ ID NO: 6124505 - DNA, 22 bp, Homo sapiens
ctcccaattcacctcgttactc

SEQ ID NO: 6124506 - DNA, 17 bp, Homo sapiens
ctcccacaaccacatgt

SEQ ID NO: 6124507 - DNA, 23 bp, Homo sapiens
ctcccacaagcctctgcccaggc

SEQ ID NO: 6124508 - DNA, 16 bp, Homo sapiens
ctcccacaagcctgag

SEQ ID NO: 6124509 - DNA, 17 bp, Homo sapiens
ctcccacaagcctgagg

SEQ ID NO: 6124510 - DNA, 21 bp, Homo sapiens
ctcccacaattggccagggca

SEQ ID NO: 6124511 - DNA, 21 bp, Homo sapiens
ctcccacacccaaagctgagc

SEQ ID NO: 6124512 - DNA, 16 bp, Homo sapiens
ctcccacacccaccct

SEQ ID NO: 6124513 - DNA, 17 bp, Homo sapiens
ctcccacacccaccctt

SEQ ID NO: 6124514 - DNA, 20 bp, Homo sapiens
ctcccacacccacccttttt

SEQ ID NO: 6124515 - DNA, 13 bp, Homo sapiens
ctcccacacccct

SEQ ID NO: 6124516 - DNA, 15 bp, Homo sapiens
ctcccacacttgctg

SEQ ID NO: 6124517 - DNA, 19 bp, Homo sapiens
ctcccacacttgctggggc

SEQ ID NO: 6124518 - DNA, 19 bp, Homo sapiens
ctcccacacttgtgccagc

SEQ ID NO: 6124519 - DNA, 20 bp, Homo sapiens
ctcccacacttgtgccagcc

SEQ ID NO: 6124520 - DNA, 18 bp, Homo sapiens
ctcccacagacctgcagt

SEQ ID NO: 6124521 - DNA, 19 bp, Homo sapiens
ctcccacagacctgcagtg

SEQ ID NO: 6124522 - DNA, 20 bp, Homo sapiens
ctcccacagacctgcagtga

SEQ ID NO: 6124523 - DNA, 13 bp, Homo sapiens
ctcccacagagac

SEQ ID NO: 6124524 - DNA, 17 bp, Homo sapiens
ctcccacagagtgctgg

SEQ ID NO: 6124525 - DNA, 15 bp, Homo sapiens
ctcccacagcagccc

SEQ ID NO: 6124526 - DNA, 18 bp, Homo sapiens
ctcccacagcagccccag

SEQ ID NO: 6124527 - DNA, 22 bp, Homo sapiens
ctcccacagcagccccaggaga

SEQ ID NO: 6124528 - DNA, 15 bp, Homo sapiens
ctcccacagcttcct

SEQ ID NO: 6124529 - DNA, 18 bp, Homo sapiens
ctcccacaggcagcttta

SEQ ID NO: 6124530 - DNA, 15 bp, Homo sapiens
ctcccacaggccctt

SEQ ID NO: 6124531 - DNA, 12 bp, Homo sapiens
ctcccacagtga

SEQ ID NO: 6124532 - DNA, 20 bp, Homo sapiens
ctcccacagtgactcgggct

SEQ ID NO: 6124533 - DNA, 22 bp, Homo sapiens
ctcccacagtgactcgggctcc

SEQ ID NO: 6124534 - DNA, 18 bp, Homo sapiens
ctcccacataagcactag

SEQ ID NO: 6124535 - DNA, 18 bp, Homo sapiens
ctcccacatcccactgga

SEQ ID NO: 6124536 - DNA, 21 bp, Homo sapiens
ctcccacatcccactggatct

SEQ ID NO: 6124537 - DNA, 21 bp, Homo sapiens
ctcccacatgaggccatctca

SEQ ID NO: 6124538 - DNA, 13 bp, Homo sapiens
ctcccaccacagc

SEQ ID NO: 6124539 - DNA, 15 bp, Homo sapiens
ctcccaccaccccat

SEQ ID NO: 6124540 - DNA, 14 bp, Homo sapiens
ctcccaccagagcc

SEQ ID NO: 6124541 - DNA, 15 bp, Homo sapiens
ctcccaccaggaatg

SEQ ID NO: 6124542 - DNA, 17 bp, Homo sapiens
ctcccacccacagccat

SEQ ID NO: 6124543 - DNA, 13 bp, Homo sapiens
ctcccacccaccg

SEQ ID NO: 6124544 - DNA, 17 bp, Homo sapiens
ctcccacccaccgccac

SEQ ID NO: 6124545 - DNA, 19 bp, Homo sapiens
ctcccaccccacccccttc

SEQ ID NO: 6124546 - DNA, 23 bp, Homo sapiens
ctcccaccccacccccttcagtg

SEQ ID NO: 6124547 - DNA, 20 bp, Homo sapiens
ctcccaccccactcagggga

SEQ ID NO: 6124548 - DNA, 18 bp, Homo sapiens
ctcccaccccactccagc

SEQ ID NO: 6124549 - DNA, 21 bp, Homo sapiens
ctcccaccccactccagccct

SEQ ID NO: 6124550 - DNA, 23 bp, Homo sapiens
ctcccaccccactccagccctgt

SEQ ID NO: 6124551 - DNA, 13 bp, Homo sapiens
ctcccaccccaga

SEQ ID NO: 6124552 - DNA, 18 bp, Homo sapiens
ctcccaccccatgcatta

SEQ ID NO: 6124553 - DNA, 14 bp, Homo sapiens
ctcccacccccagc

SEQ ID NO: 6124554 - DNA, 16 bp, Homo sapiens
ctcccacccccagccc

SEQ ID NO: 6124555 - DNA, 19 bp, Homo sapiens
ctcccacccccatctctcc

SEQ ID NO: 6124556 - DNA, 15 bp, Homo sapiens
ctcccaccccctccc

SEQ ID NO: 6124557 - DNA, 11 bp, Homo sapiens
ctcccaccccg

SEQ ID NO: 6124558 - DNA, 19 bp, Homo sapiens
ctcccaccccgccgttccc

SEQ ID NO: 6124559 - DNA, 20 bp, Homo sapiens
ctcccaccccgccgttccct

SEQ ID NO: 6124560 - DNA, 12 bp, Homo sapiens
ctcccacccctt

SEQ ID NO: 6124561 - DNA, 15 bp, Homo sapiens
ctcccaccccttggc

SEQ ID NO: 6124562 - DNA, 15 bp, Homo sapiens
cgggcaatcatgagc

SEQ ID NO: 6124563 - DNA, 15 bp, Homo sapiens
cgggcacacagactg

SEQ ID NO: 6124564 - DNA, 15 bp, Homo sapiens
cgggcacacctcctc

SEQ ID NO: 6124565 - DNA, 14 bp, Homo sapiens
cgggcacagacacg

SEQ ID NO: 6124566 - DNA, 16 bp, Homo sapiens
cgggcacagggcacca

SEQ ID NO: 6124567 - DNA, 19 bp, Homo sapiens
cgggcacagggcaccagag

SEQ ID NO: 6124568 - DNA, 21 bp, Homo sapiens
cgggcacagggcaccagaggc

SEQ ID NO: 6124569 - DNA, 22 bp, Homo sapiens
cgggcacagggcaccagaggcc

SEQ ID NO: 6124570 - DNA, 14 bp, Homo sapiens
cgggcacagtggct

SEQ ID NO: 6124571 - DNA, 19 bp, Homo sapiens
cgggcaccacccccagtcc

SEQ ID NO: 6124572 - DNA, 14 bp, Homo sapiens
cgggcaccagccag

SEQ ID NO: 6124573 - DNA, 15 bp, Homo sapiens
cgggcaccagccagc

SEQ ID NO: 6124574 - DNA, 21 bp, Homo sapiens
cgggcacctatagtcccagct

SEQ ID NO: 6124575 - DNA, 14 bp, Homo sapiens
cgggcacctgtagt

SEQ ID NO: 6124576 - DNA, 21 bp, Homo sapiens
cgggcacgggtgtcacggcca

SEQ ID NO: 6124577 - DNA, 21 bp, Homo sapiens
cgggcacggtcacacggccac

SEQ ID NO: 6124578 - DNA, 13 bp, Homo sapiens
cgggcactggcac

SEQ ID NO: 6124579 - DNA, 15 bp, Homo sapiens
cgggcagagaccacc

SEQ ID NO: 6124580 - DNA, 12 bp, Homo sapiens
cgggcagagcac

SEQ ID NO: 6124581 - DNA, 12 bp, Homo sapiens
cgggcagatggg

SEQ ID NO: 6124582 - DNA, 13 bp, Homo sapiens
cgggcagatgggc

SEQ ID NO: 6124583 - DNA, 20 bp, Homo sapiens
cgggcagatgggcggacggc

SEQ ID NO: 6124584 - DNA, 14 bp, Homo sapiens
cgggcagcacagca

SEQ ID NO: 6124585 - DNA, 14 bp, Homo sapiens
cgggcagcagagag

SEQ ID NO: 6124586 - DNA, 16 bp, Homo sapiens
cgggcagcagagagag

SEQ ID NO: 6124587 - DNA, 14 bp, Homo sapiens
cgggcagccacagg

SEQ ID NO: 6124588 - DNA, 15 bp, Homo sapiens
cgggcagccacagga

SEQ ID NO: 6124589 - DNA, 16 bp, Homo sapiens
cgggcagccacaggac

SEQ ID NO: 6124590 - DNA, 15 bp, Homo sapiens
cgggcagccacccaa

SEQ ID NO: 6124591 - DNA, 23 bp, Homo sapiens
cgggcagccacccaagcctgctg

SEQ ID NO: 6124592 - DNA, 13 bp, Homo sapiens
cgggcagccagca

SEQ ID NO: 6124593 - DNA, 20 bp, Homo sapiens
cgggcagccaggctgggccg

SEQ ID NO: 6124594 - DNA, 16 bp, Homo sapiens
cgggcagcccagcctc

SEQ ID NO: 6124595 - DNA, 12 bp, Homo sapiens
cgggcagccccg

SEQ ID NO: 6124596 - DNA, 14 bp, Homo sapiens
cgggcagcctggct

SEQ ID NO: 6124597 - DNA, 22 bp, Homo sapiens
cgggcagcctggctcccaggac

SEQ ID NO: 6124598 - DNA, 16 bp, Homo sapiens
cgggcagcgggccagg

SEQ ID NO: 6124599 - DNA, 18 bp, Homo sapiens
cgggcagcgggccaggcc

SEQ ID NO: 6124600 - DNA, 10 bp, Homo sapiens
cgggcagggg

SEQ ID NO: 6124601 - DNA, 22 bp, Homo sapiens
cgggcaggggccgcttcgccat

SEQ ID NO: 6124602 - DNA, 21 bp, Homo sapiens
cgggcaggtcctgcccatgtg

SEQ ID NO: 6124603 - DNA, 23 bp, Homo sapiens
cgggcaggtgaccgcccgcctct

SEQ ID NO: 6124604 - DNA, 16 bp, Homo sapiens
cgggcagtctgctctg

SEQ ID NO: 6124605 - DNA, 12 bp, Homo sapiens
cgggcatgacac

SEQ ID NO: 6124606 - DNA, 18 bp, Homo sapiens
cgggcatgcacacggctg

SEQ ID NO: 6124607 - DNA, 23 bp, Homo sapiens
cgggcatgcacacggctggtcac

SEQ ID NO: 6124608 - DNA, 15 bp, Homo sapiens
cgggcatgggcactc

SEQ ID NO: 6124609 - DNA, 14 bp, Homo sapiens
cgggcatgggcctc

SEQ ID NO: 6124610 - DNA, 23 bp, Homo sapiens
cgggcatgggcctctctggggga

SEQ ID NO: 6124611 - DNA, 17 bp, Homo sapiens
cgggcatggtggcaggc

SEQ ID NO: 6124612 - DNA, 12 bp, Homo sapiens
cgggcattttga

SEQ ID NO: 6124613 - DNA, 12 bp, Homo sapiens
cgggccaaggac

SEQ ID NO: 6124614 - DNA, 15 bp, Homo sapiens
cgggccaaggacctg

SEQ ID NO: 6124615 - DNA, 18 bp, Homo sapiens
cgggccaaggacctgaga

SEQ ID NO: 6124616 - DNA, 16 bp, Homo sapiens
cgggccaagtgaagaa

SEQ ID NO: 6124617 - DNA, 20 bp, Homo sapiens
cgggccacacgtggctggcg

SEQ ID NO: 6124618 - DNA, 16 bp, Homo sapiens
cgggccacgccccagc

SEQ ID NO: 6124619 - DNA, 23 bp, Homo sapiens
cgggccacgccccagcccgacaa

SEQ ID NO: 6124620 - DNA, 19 bp, Homo sapiens
cgggccactccttcctgcc

SEQ ID NO: 6124621 - DNA, 21 bp, Homo sapiens
cgggccactccttcctgcccc

SEQ ID NO: 6124622 - DNA, 22 bp, Homo sapiens
cgggccactccttcctgcccca

SEQ ID NO: 6124623 - DNA, 14 bp, Homo sapiens
cgggccagccaggc

SEQ ID NO: 6124624 - DNA, 23 bp, Homo sapiens
cgggccagccaggcgggctcaag

SEQ ID NO: 6124625 - DNA, 17 bp, Homo sapiens
cgggccaggagaatctc

SEQ ID NO: 6124626 - DNA, 13 bp, Homo sapiens
cgggccaggcagg

SEQ ID NO: 6124627 - DNA, 13 bp, Homo sapiens
cgggccaggcccg

SEQ ID NO: 6124628 - DNA, 14 bp, Homo sapiens
cgggccaggcccgc

SEQ ID NO: 6124629 - DNA, 18 bp, Homo sapiens
cgggccaggcccgcaccc

SEQ ID NO: 6124630 - DNA, 22 bp, Homo sapiens
cgggccaggccctggagggcag

SEQ ID NO: 6124631 - DNA, 10 bp, Homo sapiens
cgggccaggg

SEQ ID NO: 6124632 - DNA, 18 bp, Homo sapiens
cgggccagggctgcccct

SEQ ID NO: 6124633 - DNA, 12 bp, Homo sapiens
cgggccagggtc

SEQ ID NO: 6124634 - DNA, 18 bp, Homo sapiens
cgggccagtgctccagcc

SEQ ID NO: 6124635 - DNA, 18 bp, Homo sapiens
cgggccatgagggacagg

SEQ ID NO: 6124636 - DNA, 20 bp, Homo sapiens
cgggccatgctttccttttc

SEQ ID NO: 6124637 - DNA, 22 bp, Homo sapiens
cgggccatttcacattcctgac

SEQ ID NO: 6124638 - DNA, 15 bp, Homo sapiens
cgggcccacctggcc

SEQ ID NO: 6124639 - DNA, 15 bp, Homo sapiens
cgggcccagaggagc

SEQ ID NO: 6124640 - DNA, 18 bp, Homo sapiens
cgggcccagcccccacag

SEQ ID NO: 6124641 - DNA, 23 bp, Homo sapiens
cgggcccagcccccacagtgctg

SEQ ID NO: 6124642 - DNA, 15 bp, Homo sapiens
cgggcccaggccatc

SEQ ID NO: 6124643 - DNA, 12 bp, Homo sapiens
cgggcccaggga

SEQ ID NO: 6124644 - DNA, 14 bp, Homo sapiens
cgggcccagggaca

SEQ ID NO: 6124645 - DNA, 15 bp, Homo sapiens
cgggcccagggacat

SEQ ID NO: 6124646 - DNA, 18 bp, Homo sapiens
cgggcccagggcctctgg

SEQ ID NO: 6124647 - DNA, 19 bp, Homo sapiens
cgggccccacctgcagctc

SEQ ID NO: 6124648 - DNA, 19 bp, Homo sapiens
cgggccccatcctcatccc

SEQ ID NO: 6124649 - DNA, 13 bp, Homo sapiens
cgggcccccaccg

SEQ ID NO: 6124650 - DNA, 16 bp, Homo sapiens
cgggcccccgccccgc

SEQ ID NO: 6124651 - DNA, 19 bp, Homo sapiens
cgggcccctctctagggac

SEQ ID NO: 6124652 - DNA, 12 bp, Homo sapiens
cgggcccctgag

SEQ ID NO: 6124653 - DNA, 16 bp, Homo sapiens
cgggcccctgagcctg

SEQ ID NO: 6124654 - DNA, 15 bp, Homo sapiens
cgggcccctggtgat

SEQ ID NO: 6124655 - DNA, 11 bp, Homo sapiens
cgggccctccc

SEQ ID NO: 6124656 - DNA, 18 bp, Homo sapiens
cgggccctccctcccagc

SEQ ID NO: 6124657 - DNA, 21 bp, Homo sapiens
cgggccctccttccctcctgt

SEQ ID NO: 6124658 - DNA, 17 bp, Homo sapiens
cgggccctctgccgacc

SEQ ID NO: 6124659 - DNA, 15 bp, Homo sapiens
cgggccctctgtagc

SEQ ID NO: 6124660 - DNA, 18 bp, Homo sapiens
cgggccctctgtagctcc

SEQ ID NO: 6124661 - DNA, 12 bp, Homo sapiens
cgggccctgccc

SEQ ID NO: 6124662 - DNA, 13 bp, Homo sapiens
cgggccctgcctg

SEQ ID NO: 6124663 - DNA, 17 bp, Homo sapiens
cgggccctgcctgaggg

SEQ ID NO: 6124664 - DNA, 13 bp, Homo sapiens
cgggccctgtggt

SEQ ID NO: 6124665 - DNA, 13 bp, Homo sapiens
cgggcccttcagt

SEQ ID NO: 6124666 - DNA, 21 bp, Homo sapiens
cgggcccttcccacaggacat

SEQ ID NO: 6124667 - DNA, 19 bp, Homo sapiens
cgggcccttcttgctgccc

SEQ ID NO: 6124668 - DNA, 19 bp, Homo sapiens
cgggccgacggagccggga

SEQ ID NO: 6124669 - DNA, 15 bp, Homo sapiens
cgggccgcaggaggg

SEQ ID NO: 6124670 - DNA, 14 bp, Homo sapiens
cgggccgcctcctc

SEQ ID NO: 6124671 - DNA, 15 bp, Homo sapiens
cgggccgcctcctcc

SEQ ID NO: 6124672 - DNA, 16 bp, Homo sapiens
cgggccgcctcctcca

SEQ ID NO: 6124673 - DNA, 20 bp, Homo sapiens
cgggccgcctcctccagact

SEQ ID NO: 6124674 - DNA, 21 bp, Homo sapiens
cgggccggacctgagcccgca

SEQ ID NO: 6124675 - DNA, 13 bp, Homo sapiens
cgggccggccagc

SEQ ID NO: 6124676 - DNA, 12 bp, Homo sapiens
cgggccggcctt

SEQ ID NO: 6124677 - DNA, 15 bp, Homo sapiens
cgggccggggcaggg

SEQ ID NO: 6124678 - DNA, 14 bp, Homo sapiens
cgggcctcagtgcc

SEQ ID NO: 6124679 - DNA, 18 bp, Homo sapiens
cgggcctcagtgccccat

SEQ ID NO: 6124680 - DNA, 14 bp, Homo sapiens
cgggcctcagtttc

SEQ ID NO: 6124681 - DNA, 18 bp, Homo sapiens
cgggcctcccaccgcagc

SEQ ID NO: 6124682 - DNA, 14 bp, Homo sapiens
cgggcctccccggg

SEQ ID NO: 6124683 - DNA, 23 bp, Homo sapiens
cgggcctccccgggggtccccgg

SEQ ID NO: 6124684 - DNA, 18 bp, Homo sapiens
cgggcctctgcttgccag

SEQ ID NO: 6124685 - DNA, 23 bp, Homo sapiens
cgggcctctgcttgccagccagg

SEQ ID NO: 6124686 - DNA, 16 bp, Homo sapiens
cgggcctcttccctca

SEQ ID NO: 6124687 - DNA, 12 bp, Homo sapiens
cgggcctggact

SEQ ID NO: 6124688 - DNA, 18 bp, Homo sapiens
cgggcctgtacagtctgt

SEQ ID NO: 6124689 - DNA, 17 bp, Homo sapiens
cgggcctgtccacaggc

SEQ ID NO: 6124690 - DNA, 19 bp, Homo sapiens
cgggcctgtttggtgagga

SEQ ID NO: 6124691 - DNA, 23 bp, Homo sapiens
cgggcgagaagggcgcaggaacc

SEQ ID NO: 6124692 - DNA, 18 bp, Homo sapiens
cgggcgcactgcctctca

SEQ ID NO: 6124693 - DNA, 14 bp, Homo sapiens
cgggcgcagccctc

SEQ ID NO: 6124694 - DNA, 21 bp, Homo sapiens
cgggcgcatgcctcccaggcc

SEQ ID NO: 6124695 - DNA, 14 bp, Homo sapiens
cgggcgccaggaca

SEQ ID NO: 6124696 - DNA, 15 bp, Homo sapiens
cgggcgccaggacag

SEQ ID NO: 6124697 - DNA, 18 bp, Homo sapiens
cgggcgccaggacagcag

SEQ ID NO: 6124698 - DNA, 24 bp, Homo sapiens
cgggcgcccgcggcgcgaccctcc

SEQ ID NO: 6124699 - DNA, 15 bp, Homo sapiens
cgggcgcccggactg

SEQ ID NO: 6124700 - DNA, 12 bp, Homo sapiens
cgggcgcctgcg

SEQ ID NO: 6124701 - DNA, 16 bp, Homo sapiens
cgggcgcggccagccc

SEQ ID NO: 6124702 - DNA, 14 bp, Homo sapiens
cgggcgcggtggct

SEQ ID NO: 6124703 - DNA, 15 bp, Homo sapiens
cgggcgctgcagcct

SEQ ID NO: 6124704 - DNA, 22 bp, Homo sapiens
cgggcgctgtggctcctgcctt

SEQ ID NO: 6124705 - DNA, 14 bp, Homo sapiens
cgggcggagggagg

SEQ ID NO: 6124706 - DNA, 15 bp, Homo sapiens
cgggcggccaggcaa

SEQ ID NO: 6124707 - DNA, 12 bp, Homo sapiens
cgggcgggcgtg

SEQ ID NO: 6124708 - DNA, 17 bp, Homo sapiens
cgggcgggtggcgctgc

SEQ ID NO: 6124709 - DNA, 20 bp, Homo sapiens
cgggcgtcaggggtgcacag

SEQ ID NO: 6124710 - DNA, 17 bp, Homo sapiens
cgggcgtggtggcgggc

SEQ ID NO: 6124711 - DNA, 18 bp, Homo sapiens
cgggctaaggtccctggg

SEQ ID NO: 6124712 - DNA, 10 bp, Homo sapiens
cgggctcaga

SEQ ID NO: 6124713 - DNA, 13 bp, Homo sapiens
cgggctcagagct

SEQ ID NO: 6124714 - DNA, 17 bp, Homo sapiens
cgggctcagagctttgt

SEQ ID NO: 6124715 - DNA, 13 bp, Homo sapiens
cgggctccagcca

SEQ ID NO: 6124716 - DNA, 12 bp, Homo sapiens
cgggctccaggg

SEQ ID NO: 6124717 - DNA, 13 bp, Homo sapiens
cgggctccaggga

SEQ ID NO: 6124718 - DNA, 16 bp, Homo sapiens
cgggctccagggagtg

SEQ ID NO: 6124719 - DNA, 23 bp, Homo sapiens
cgggctccagggagtggggagga

SEQ ID NO: 6124720 - DNA, 15 bp, Homo sapiens
cgggctccctcctct

SEQ ID NO: 6124721 - DNA, 16 bp, Homo sapiens
cgggctccctggcagg

SEQ ID NO: 6124722 - DNA, 16 bp, Homo sapiens
cgggctcctgtgccct

SEQ ID NO: 6124723 - DNA, 15 bp, Homo sapiens
cgggctccttcccct

SEQ ID NO: 6124724 - DNA, 17 bp, Homo sapiens
cgggctccttcccctgc

SEQ ID NO: 6124725 - DNA, 23 bp, Homo sapiens
cgggctccttcccctgcacctgg

SEQ ID NO: 6124726 - DNA, 13 bp, Homo sapiens
cgggctcgcccat

SEQ ID NO: 6124727 - DNA, 19 bp, Homo sapiens
cgggctcgggtctgggcag

SEQ ID NO: 6124728 - DNA, 17 bp, Homo sapiens
cgggctctctcacccag

SEQ ID NO: 6124729 - DNA, 21 bp, Homo sapiens
cgggctctctcacccagcctg

SEQ ID NO: 6124730 - DNA, 14 bp, Homo sapiens
cgggctctgcctcc

SEQ ID NO: 6124731 - DNA, 17 bp, Homo sapiens
cgggctctgcctcccat

SEQ ID NO: 6124732 - DNA, 17 bp, Homo sapiens
cgggctctggccaccct

SEQ ID NO: 6124733 - DNA, 17 bp, Homo sapiens
cgggctgactgggccac

SEQ ID NO: 6124734 - DNA, 15 bp, Homo sapiens
cgggctgagggcatc

SEQ ID NO: 6124735 - DNA, 17 bp, Homo sapiens
cgggctgagggcatctc

SEQ ID NO: 6124736 - DNA, 18 bp, Homo sapiens
cgggctgccagcccagct

SEQ ID NO: 6124737 - DNA, 20 bp, Homo sapiens
cgggctgccagcccagctgg

SEQ ID NO: 6124738 - DNA, 14 bp, Homo sapiens
cgggctgccctgcc

SEQ ID NO: 6124739 - DNA, 19 bp, Homo sapiens
cgggctgcccttcgctgcc

SEQ ID NO: 6124740 - DNA, 22 bp, Homo sapiens
cgggctgcctgcccctgctgct

SEQ ID NO: 6124741 - DNA, 14 bp, Homo sapiens
cgggctgcctgggc

SEQ ID NO: 6124742 - DNA, 12 bp, Homo sapiens
cgggctgctgct

SEQ ID NO: 6124743 - DNA, 14 bp, Homo sapiens
cgggctggagaaag

SEQ ID NO: 6124744 - DNA, 19 bp, Homo sapiens
ctcccaccccttggcccct

SEQ ID NO: 6124745 - DNA, 15 bp, Homo sapiens
ctcccacccgatgct

SEQ ID NO: 6124746 - DNA, 18 bp, Homo sapiens
ctcccacccgatgctgct

SEQ ID NO: 6124747 - DNA, 15 bp, Homo sapiens
ctcccacccggccac

SEQ ID NO: 6124748 - DNA, 21 bp, Homo sapiens
ctcccacccggccacagctgc

SEQ ID NO: 6124749 - DNA, 12 bp, Homo sapiens
ctcccaccctct

SEQ ID NO: 6124750 - DNA, 16 bp, Homo sapiens
ctcccaccctcttcct

SEQ ID NO: 6124751 - DNA, 14 bp, Homo sapiens
ctcccaccctttct

SEQ ID NO: 6124752 - DNA, 20 bp, Homo sapiens
ctcccaccctttctgccagg

SEQ ID NO: 6124753 - DNA, 22 bp, Homo sapiens
ctcccaccgcagcgtcccccgc

SEQ ID NO: 6124754 - DNA, 16 bp, Homo sapiens
ctcccaccgcccccac

SEQ ID NO: 6124755 - DNA, 16 bp, Homo sapiens
ctcccaccgctgcctc

SEQ ID NO: 6124756 - DNA, 18 bp, Homo sapiens
ctcccacctagtgcccca

SEQ ID NO: 6124757 - DNA, 19 bp, Homo sapiens
ctcccacctagtgccccag

SEQ ID NO: 6124758 - DNA, 23 bp, Homo sapiens
ctcccacctatccgccctgcagc

SEQ ID NO: 6124759 - DNA, 18 bp, Homo sapiens
ctcccacctcacccggcc

SEQ ID NO: 6124760 - DNA, 13 bp, Homo sapiens
ctcccacctcagc

SEQ ID NO: 6124761 - DNA, 13 bp, Homo sapiens
ctcccacctccag

SEQ ID NO: 6124762 - DNA, 15 bp, Homo sapiens
ctcccacctccagtc

SEQ ID NO: 6124763 - DNA, 18 bp, Homo sapiens
ctcccacctcccttccca

SEQ ID NO: 6124764 - DNA, 13 bp, Homo sapiens
ctcccacctcctg

SEQ ID NO: 6124765 - DNA, 14 bp, Homo sapiens
ctcccacctcctga

SEQ ID NO: 6124766 - DNA, 21 bp, Homo sapiens
ctcccacctcctgacaccctt

SEQ ID NO: 6124767 - DNA, 23 bp, Homo sapiens
ctcccacctctccttttgaggct

SEQ ID NO: 6124768 - DNA, 14 bp, Homo sapiens
ctcccacctctgtg

SEQ ID NO: 6124769 - DNA, 19 bp, Homo sapiens
ctcccacctctgtgacctc

SEQ ID NO: 6124770 - DNA, 15 bp, Homo sapiens
ctcccacctctttct

SEQ ID NO: 6124771 - DNA, 18 bp, Homo sapiens
ctcccacctctttcttca

SEQ ID NO: 6124772 - DNA, 15 bp, Homo sapiens
ctcccacctgacaca

SEQ ID NO: 6124773 - DNA, 13 bp, Homo sapiens
ctcccacctggct

SEQ ID NO: 6124774 - DNA, 12 bp, Homo sapiens
ctcccacgccct

SEQ ID NO: 6124775 - DNA, 18 bp, Homo sapiens
ctcccacgccctcctccc

SEQ ID NO: 6124776 - DNA, 21 bp, Homo sapiens
ctcccacgccctcctccctcc

SEQ ID NO: 6124777 - DNA, 14 bp, Homo sapiens
ctcccacgcctgct

SEQ ID NO: 6124778 - DNA, 17 bp, Homo sapiens
ctcccacgcctgcttct

SEQ ID NO: 6124779 - DNA, 21 bp, Homo sapiens
ctcccacgctgggacacagac

SEQ ID NO: 6124780 - DNA, 18 bp, Homo sapiens
ctcccacggagcatctca

SEQ ID NO: 6124781 - DNA, 22 bp, Homo sapiens
ctcccacgggacctggggcttt

SEQ ID NO: 6124782 - DNA, 14 bp, Homo sapiens
ctcccacggggacc

SEQ ID NO: 6124783 - DNA, 19 bp, Homo sapiens
ctcccacggggaccactgg

SEQ ID NO: 6124784 - DNA, 15 bp, Homo sapiens
ctcccacgtgggaga

SEQ ID NO: 6124785 - DNA, 14 bp, Homo sapiens
ctcccactcccatc

SEQ ID NO: 6124786 - DNA, 17 bp, Homo sapiens
ctcccactcccatctcc

SEQ ID NO: 6124787 - DNA, 18 bp, Homo sapiens
ctcccactcccatctcct

SEQ ID NO: 6124788 - DNA, 14 bp, Homo sapiens
ctcccactccctgg

SEQ ID NO: 6124789 - DNA, 15 bp, Homo sapiens
ctcccactccctttc

SEQ ID NO: 6124790 - DNA, 12 bp, Homo sapiens
ctcccactccta

SEQ ID NO: 6124791 - DNA, 14 bp, Homo sapiens
ctcccactcctaat

SEQ ID NO: 6124792 - DNA, 14 bp, Homo sapiens
ctcccactcctgct

SEQ ID NO: 6124793 - DNA, 14 bp, Homo sapiens
ctcccactcctgtt

SEQ ID NO: 6124794 - DNA, 13 bp, Homo sapiens
ctcccactgcagc

SEQ ID NO: 6124795 - DNA, 19 bp, Homo sapiens
ctcccactggaacagccca

SEQ ID NO: 6124796 - DNA, 20 bp, Homo sapiens
ctcccactggaacagcccat

SEQ ID NO: 6124797 - DNA, 14 bp, Homo sapiens
ctcccactggatcc

SEQ ID NO: 6124798 - DNA, 12 bp, Homo sapiens
ctcccactggga

SEQ ID NO: 6124799 - DNA, 20 bp, Homo sapiens
ctcccactgggactcccagc

SEQ ID NO: 6124800 - DNA, 13 bp, Homo sapiens
ctcccacttccca

SEQ ID NO: 6124801 - DNA, 13 bp, Homo sapiens
ctcccacttcctc

SEQ ID NO: 6124802 - DNA, 15 bp, Homo sapiens
ctcccacttctgcca

SEQ ID NO: 6124803 - DNA, 20 bp, Homo sapiens
ctcccactttgctgttcctt

SEQ ID NO: 6124804 - DNA, 21 bp, Homo sapiens
ctcccactttgtctgtacata

SEQ ID NO: 6124805 - DNA, 21 bp, Homo sapiens
ctcccagaaaaactggctctg

SEQ ID NO: 6124806 - DNA, 20 bp, Homo sapiens
ctcccagaaacatctctggc

SEQ ID NO: 6124807 - DNA, 24 bp, Homo sapiens
ctcccagaacctctaagtgctgct

SEQ ID NO: 6124808 - DNA, 13 bp, Homo sapiens
ctcccagaatccc

SEQ ID NO: 6124809 - DNA, 16 bp, Homo sapiens
ctcccagaatgctggg

SEQ ID NO: 6124810 - DNA, 15 bp, Homo sapiens
ctcccagacaggccc

SEQ ID NO: 6124811 - DNA, 17 bp, Homo sapiens
ctcccagacaggccctc

SEQ ID NO: 6124812 - DNA, 22 bp, Homo sapiens
ctcccagacaggccctccctgt

SEQ ID NO: 6124813 - DNA, 23 bp, Homo sapiens
ctcccagacaggccctccctgtc

SEQ ID NO: 6124814 - DNA, 12 bp, Homo sapiens
ctcccagaccca

SEQ ID NO: 6124815 - DNA, 17 bp, Homo sapiens
ctcccagacccagggca

SEQ ID NO: 6124816 - DNA, 18 bp, Homo sapiens
ctcccagacccagggcag

SEQ ID NO: 6124817 - DNA, 21 bp, Homo sapiens
ctcccagacccagggcagtgt

SEQ ID NO: 6124818 - DNA, 16 bp, Homo sapiens
ctcccagacccccttg

SEQ ID NO: 6124819 - DNA, 17 bp, Homo sapiens
ctcccagacctgcctct

SEQ ID NO: 6124820 - DNA, 18 bp, Homo sapiens
ctcccagacttgtttcct

SEQ ID NO: 6124821 - DNA, 15 bp, Homo sapiens
ctcccagagcacctg

SEQ ID NO: 6124822 - DNA, 18 bp, Homo sapiens
ctcccagagcacctgctg

SEQ ID NO: 6124823 - DNA, 19 bp, Homo sapiens
ctcccagagcacctgctgt

SEQ ID NO: 6124824 - DNA, 22 bp, Homo sapiens
ctcccagagctggtggacccag

SEQ ID NO: 6124825 - DNA, 23 bp, Homo sapiens
ctcccagaggagccaccagttct

SEQ ID NO: 6124826 - DNA, 12 bp, Homo sapiens
ctcccagaggcg

SEQ ID NO: 6124827 - DNA, 19 bp, Homo sapiens
ctcccagaggctcctggag

SEQ ID NO: 6124828 - DNA, 21 bp, Homo sapiens
ctcccagaggctcctggagcc

SEQ ID NO: 6124829 - DNA, 14 bp, Homo sapiens
ctcccagaggtcca

SEQ ID NO: 6124830 - DNA, 17 bp, Homo sapiens
ctcccagaggtccagcc

SEQ ID NO: 6124831 - DNA, 19 bp, Homo sapiens
ctcccagaggtccagccca

SEQ ID NO: 6124832 - DNA, 21 bp, Homo sapiens
ctcccagaggtccagcccatc

SEQ ID NO: 6124833 - DNA, 21 bp, Homo sapiens
ctcccagatcagtcagagccc

SEQ ID NO: 6124834 - DNA, 21 bp, Homo sapiens
ctcccagatccaggaacacat

SEQ ID NO: 6124835 - DNA, 14 bp, Homo sapiens
ctcccagatcctgg

SEQ ID NO: 6124836 - DNA, 21 bp, Homo sapiens
ctcccagatcgctcccttggc

SEQ ID NO: 6124837 - DNA, 22 bp, Homo sapiens
ctcccagatcgctcccttggct

SEQ ID NO: 6124838 - DNA, 22 bp, Homo sapiens
ctcccagcaagtttcaccttgg

SEQ ID NO: 6124839 - DNA, 15 bp, Homo sapiens
ctcccagcacaggca

SEQ ID NO: 6124840 - DNA, 17 bp, Homo sapiens
ctcccagcactcccctt

SEQ ID NO: 6124841 - DNA, 21 bp, Homo sapiens
ctcccagcactccccttgcct

SEQ ID NO: 6124842 - DNA, 15 bp, Homo sapiens
ctcccagcactgcct

SEQ ID NO: 6124843 - DNA, 16 bp, Homo sapiens
ctcccagcactgcctc

SEQ ID NO: 6124844 - DNA, 21 bp, Homo sapiens
ctcccagcagagcccaccagc

SEQ ID NO: 6124845 - DNA, 17 bp, Homo sapiens
ctcccagcagctcaacc

SEQ ID NO: 6124846 - DNA, 14 bp, Homo sapiens
ctcccagccaccac

SEQ ID NO: 6124847 - DNA, 13 bp, Homo sapiens
ctcccagccaggc

SEQ ID NO: 6124848 - DNA, 16 bp, Homo sapiens
ctcccagccaggccct

SEQ ID NO: 6124849 - DNA, 14 bp, Homo sapiens
ctcccagccccagg

SEQ ID NO: 6124850 - DNA, 16 bp, Homo sapiens
ctcccagccccagggg

SEQ ID NO: 6124851 - DNA, 19 bp, Homo sapiens
ctcccagccctatggatgt

SEQ ID NO: 6124852 - DNA, 12 bp, Homo sapiens
ctcccagccctc

SEQ ID NO: 6124853 - DNA, 14 bp, Homo sapiens
ctcccagccctcag

SEQ ID NO: 6124854 - DNA, 15 bp, Homo sapiens
ctcccagcctcttgc

SEQ ID NO: 6124855 - DNA, 12 bp, Homo sapiens
ctcccagcctgc

SEQ ID NO: 6124856 - DNA, 13 bp, Homo sapiens
ctcccagcctgcc

SEQ ID NO: 6124857 - DNA, 19 bp, Homo sapiens
ctcccagcctgccctccag

SEQ ID NO: 6124858 - DNA, 24 bp, Homo sapiens
ctcccagcctgccctccagctgct

SEQ ID NO: 6124859 - DNA, 15 bp, Homo sapiens
ctcccagcctgctga

SEQ ID NO: 6124860 - DNA, 16 bp, Homo sapiens
ctcccagcctgctgag

SEQ ID NO: 6124861 - DNA, 20 bp, Homo sapiens
ctcccagcctgctgagagcc

SEQ ID NO: 6124862 - DNA, 18 bp, Homo sapiens
ctcccagcggcctccggc

SEQ ID NO: 6124863 - DNA, 17 bp, Homo sapiens
ctcccagctaattgaga

SEQ ID NO: 6124864 - DNA, 13 bp, Homo sapiens
ctcccagctaggg

SEQ ID NO: 6124865 - DNA, 14 bp, Homo sapiens
ctcccagctccttt

SEQ ID NO: 6124866 - DNA, 15 bp, Homo sapiens
ctcccagctcctttc

SEQ ID NO: 6124867 - DNA, 15 bp, Homo sapiens
ctcccagctctagac

SEQ ID NO: 6124868 - DNA, 20 bp, Homo sapiens
ctcccagctctagacaaccc

SEQ ID NO: 6124869 - DNA, 21 bp, Homo sapiens
ctcccagctctctctcctgga

SEQ ID NO: 6124870 - DNA, 14 bp, Homo sapiens
ctcccagctctggg

SEQ ID NO: 6124871 - DNA, 11 bp, Homo sapiens
ctcccagctga

SEQ ID NO: 6124872 - DNA, 18 bp, Homo sapiens
ctcccagctgacagtcct

SEQ ID NO: 6124873 - DNA, 13 bp, Homo sapiens
ctcccagctgctt

SEQ ID NO: 6124874 - DNA, 15 bp, Homo sapiens
ctcccagctgcttta

SEQ ID NO: 6124875 - DNA, 17 bp, Homo sapiens
ctcccagctgctttact

SEQ ID NO: 6124876 - DNA, 15 bp, Homo sapiens
ctcccagctggtgtc

SEQ ID NO: 6124877 - DNA, 21 bp, Homo sapiens
ctcccagctggtgtcactctg

SEQ ID NO: 6124878 - DNA, 22 bp, Homo sapiens
ctcccagctgtaccggccactg

SEQ ID NO: 6124879 - DNA, 23 bp, Homo sapiens
ctcccagctgtaccggccactgc

SEQ ID NO: 6124880 - DNA, 20 bp, Homo sapiens
ctcccagcttaaatcctagc

SEQ ID NO: 6124881 - DNA, 11 bp, Homo sapiens
ctcccaggaac

SEQ ID NO: 6124882 - DNA, 17 bp, Homo sapiens
ctcccaggaaccaaaaa

SEQ ID NO: 6124883 - DNA, 11 bp, Homo sapiens
ctcccaggaca

SEQ ID NO: 6124884 - DNA, 14 bp, Homo sapiens
ctcccaggacacat

SEQ ID NO: 6124885 - DNA, 18 bp, Homo sapiens
ctcccaggaccctccact

SEQ ID NO: 6124886 - DNA, 20 bp, Homo sapiens
ctcccaggaccctccactca

SEQ ID NO: 6124887 - DNA, 16 bp, Homo sapiens
ctcccaggagacagtt

SEQ ID NO: 6124888 - DNA, 19 bp, Homo sapiens
ctcccaggagcctgcccag

SEQ ID NO: 6124889 - DNA, 22 bp, Homo sapiens
ctcccaggatgacgtgctccgt

SEQ ID NO: 6124890 - DNA, 12 bp, Homo sapiens
ctcccaggcaag

SEQ ID NO: 6124891 - DNA, 17 bp, Homo sapiens
ctcccaggcaagcagct

SEQ ID NO: 6124892 - DNA, 21 bp, Homo sapiens
ctcccaggcattccccaggag

SEQ ID NO: 6124893 - DNA, 22 bp, Homo sapiens
ctcccaggcattccccaggagg

SEQ ID NO: 6124894 - DNA, 22 bp, Homo sapiens
ctcccaggccaggctccttcct

SEQ ID NO: 6124895 - DNA, 22 bp, Homo sapiens
ctcccaggccagtaagggaaat

SEQ ID NO: 6124896 - DNA, 18 bp, Homo sapiens
ctcccaggccccaggcct

SEQ ID NO: 6124897 - DNA, 21 bp, Homo sapiens
ctcccaggccgagaagccagt

SEQ ID NO: 6124898 - DNA, 19 bp, Homo sapiens
ctcccaggcgccccttccc

SEQ ID NO: 6124899 - DNA, 12 bp, Homo sapiens
ctcccaggctct

SEQ ID NO: 6124900 - DNA, 23 bp, Homo sapiens
ctcccaggctgctggagtgcagt

SEQ ID NO: 6124901 - DNA, 15 bp, Homo sapiens
ctcccaggctggaga

SEQ ID NO: 6124902 - DNA, 12 bp, Homo sapiens
ctcccagggaca

SEQ ID NO: 6124903 - DNA, 22 bp, Homo sapiens
ctcccagggagcaagggcaggg

SEQ ID NO: 6124904 - DNA, 15 bp, Homo sapiens
ctcccagggagtgag

SEQ ID NO: 6124905 - DNA, 19 bp, Homo sapiens
ctcccagggagtgagcagc

SEQ ID NO: 6124906 - DNA, 22 bp, Homo sapiens
ctcccagggagtgagcagctac

SEQ ID NO: 6124907 - DNA, 16 bp, Homo sapiens
ctcccagggccagggc

SEQ ID NO: 6124908 - DNA, 19 bp, Homo sapiens
ctcccagggccagggccct

SEQ ID NO: 6124909 - DNA, 23 bp, Homo sapiens
ctcccagggcccgagcgcgtgcc

SEQ ID NO: 6124910 - DNA, 17 bp, Homo sapiens
ctcccagggcctcctgg

SEQ ID NO: 6124911 - DNA, 12 bp, Homo sapiens
ctcccagggcta

SEQ ID NO: 6124912 - DNA, 21 bp, Homo sapiens
ctcccagggctacacagaccc

SEQ ID NO: 6124913 - DNA, 18 bp, Homo sapiens
ctcccagggctctctgga

SEQ ID NO: 6124914 - DNA, 18 bp, Homo sapiens
ctcccaggggagccagct

SEQ ID NO: 6124915 - DNA, 20 bp, Homo sapiens
ctcccaggggagccagctgc

SEQ ID NO: 6124916 - DNA, 21 bp, Homo sapiens
ctcccaggggctccctccgcc

SEQ ID NO: 6124917 - DNA, 22 bp, Homo sapiens
ctcccaggggctccctccgccc

SEQ ID NO: 6124918 - DNA, 19 bp, Homo sapiens
ctcccaggggctggcttca

SEQ ID NO: 6124919 - DNA, 16 bp, Homo sapiens
ctcccaggggtctccc

SEQ ID NO: 6124920 - DNA, 19 bp, Homo sapiens
ctcccaggggtctccctgg

SEQ ID NO: 6124921 - DNA, 20 bp, Homo sapiens
ctcccaggggtctccctggc

SEQ ID NO: 6124922 - DNA, 21 bp, Homo sapiens
ctcccaggggtctccctggct

SEQ ID NO: 6124923 - DNA, 21 bp, Homo sapiens
cgggctggccctgtgcagacc

SEQ ID NO: 6124924 - DNA, 16 bp, Homo sapiens
cgggctggcctgtgcc

SEQ ID NO: 6124925 - DNA, 15 bp, Homo sapiens
cgggctggcgggcct

SEQ ID NO: 6124926 - DNA, 19 bp, Homo sapiens
cgggctggctgcttgcagc

SEQ ID NO: 6124927 - DNA, 19 bp, Homo sapiens
cgggctgggggggctgcct

SEQ ID NO: 6124928 - DNA, 18 bp, Homo sapiens
cgggctgggggtagcctg

SEQ ID NO: 6124929 - DNA, 20 bp, Homo sapiens
cgggctgggggtagcctgga

SEQ ID NO: 6124930 - DNA, 15 bp, Homo sapiens
cgggctgtccgtgtg

SEQ ID NO: 6124931 - DNA, 21 bp, Homo sapiens
cgggctgtccgtgtgcctcct

SEQ ID NO: 6124932 - DNA, 12 bp, Homo sapiens
cgggctgtgccc

SEQ ID NO: 6124933 - DNA, 17 bp, Homo sapiens
cgggctgttctggtggc

SEQ ID NO: 6124934 - DNA, 14 bp, Homo sapiens
cgggcttccctggc

SEQ ID NO: 6124935 - DNA, 14 bp, Homo sapiens
cgggcttcccttct

SEQ ID NO: 6124936 - DNA, 16 bp, Homo sapiens
cgggcttcccttctcc

SEQ ID NO: 6124937 - DNA, 22 bp, Homo sapiens
cgggcttcccttctccccagcc

SEQ ID NO: 6124938 - DNA, 19 bp, Homo sapiens
cgggcttggcggctctagc

SEQ ID NO: 6124939 - DNA, 20 bp, Homo sapiens
cgggcttgggccctgcacag

SEQ ID NO: 6124940 - DNA, 20 bp, Homo sapiens
cgggctttgtgtgaaggcag

SEQ ID NO: 6124941 - DNA, 15 bp, Homo sapiens
cgggcttttccccgg

SEQ ID NO: 6124942 - DNA, 21 bp, Homo sapiens
cgggcttttctggggcccagg

SEQ ID NO: 6124943 - DNA, 24 bp, Homo sapiens
cgggcttttctggggcccaggaag

SEQ ID NO: 6124944 - DNA, 15 bp, Homo sapiens
cggggaactcctgga

SEQ ID NO: 6124945 - DNA, 16 bp, Homo sapiens
cggggaactcctggaa

SEQ ID NO: 6124946 - DNA, 15 bp, Homo sapiens
cggggaactggccaa

SEQ ID NO: 6124947 - DNA, 19 bp, Homo sapiens
cggggaagagatccaaaga

SEQ ID NO: 6124948 - DNA, 14 bp, Homo sapiens
cggggaagccagac

SEQ ID NO: 6124949 - DNA, 17 bp, Homo sapiens
cggggaagctgcacatg

SEQ ID NO: 6124950 - DNA, 16 bp, Homo sapiens
cggggaagctgccagc

SEQ ID NO: 6124951 - DNA, 19 bp, Homo sapiens
cggggaagctgccagccca

SEQ ID NO: 6124952 - DNA, 19 bp, Homo sapiens
cggggaagggtgcatagct

SEQ ID NO: 6124953 - DNA, 13 bp, Homo sapiens
cggggacacaggc

SEQ ID NO: 6124954 - DNA, 14 bp, Homo sapiens
cggggacacggcct

SEQ ID NO: 6124955 - DNA, 17 bp, Homo sapiens
cggggacacggcctctg

SEQ ID NO: 6124956 - DNA, 18 bp, Homo sapiens
cggggacagaggcctgcc

SEQ ID NO: 6124957 - DNA, 22 bp, Homo sapiens
cggggacagctccttctgtcct

SEQ ID NO: 6124958 - DNA, 16 bp, Homo sapiens
cggggacaggtgacag

SEQ ID NO: 6124959 - DNA, 21 bp, Homo sapiens
cggggacaggtgacagtggct

SEQ ID NO: 6124960 - DNA, 22 bp, Homo sapiens
cggggacaggtgacagtggctg

SEQ ID NO: 6124961 - DNA, 17 bp, Homo sapiens
cggggaccactgggccc

SEQ ID NO: 6124962 - DNA, 16 bp, Homo sapiens
cggggaccctgccgag

SEQ ID NO: 6124963 - DNA, 14 bp, Homo sapiens
cggggaccctgtga

SEQ ID NO: 6124964 - DNA, 13 bp, Homo sapiens
cggggacctggat

SEQ ID NO: 6124965 - DNA, 22 bp, Homo sapiens
cggggaccttgtgggaccagtc

SEQ ID NO: 6124966 - DNA, 19 bp, Homo sapiens
cggggagaagaagcggcca

SEQ ID NO: 6124967 - DNA, 17 bp, Homo sapiens
cggggagagaggaggag

SEQ ID NO: 6124968 - DNA, 15 bp, Homo sapiens
cggggagagggggag

SEQ ID NO: 6124969 - DNA, 17 bp, Homo sapiens
cggggagcgtgtggctg

SEQ ID NO: 6124970 - DNA, 14 bp, Homo sapiens
cggggagctgaggg

SEQ ID NO: 6124971 - DNA, 16 bp, Homo sapiens
cggggagctgaggggc

SEQ ID NO: 6124972 - DNA, 19 bp, Homo sapiens
cggggagctgaggggcagg

SEQ ID NO: 6124973 - DNA, 13 bp, Homo sapiens
cggggagctgcag

SEQ ID NO: 6124974 - DNA, 22 bp, Homo sapiens
cggggaggagagagcagcttct

SEQ ID NO: 6124975 - DNA, 17 bp, Homo sapiens
cggggaggagccttgga

SEQ ID NO: 6124976 - DNA, 18 bp, Homo sapiens
cggggaggagccttggag

SEQ ID NO: 6124977 - DNA, 14 bp, Homo sapiens
cggggaggccaagt

SEQ ID NO: 6124978 - DNA, 21 bp, Homo sapiens
cggggaggggcagagaggaag

SEQ ID NO: 6124979 - DNA, 22 bp, Homo sapiens
cggggagggtgacagtggccgc

SEQ ID NO: 6124980 - DNA, 12 bp, Homo sapiens
cggggagtgaga

SEQ ID NO: 6124981 - DNA, 17 bp, Homo sapiens
cggggagtttctttcct

SEQ ID NO: 6124982 - DNA, 18 bp, Homo sapiens
cggggagtttctttcctg

SEQ ID NO: 6124983 - DNA, 18 bp, Homo sapiens
cggggatggatcttttct

SEQ ID NO: 6124984 - DNA, 22 bp, Homo sapiens
cggggatggattggcctccagg

SEQ ID NO: 6124985 - DNA, 20 bp, Homo sapiens
cggggatggttccccaggag

SEQ ID NO: 6124986 - DNA, 21 bp, Homo sapiens
cggggatggttccccaggagg

SEQ ID NO: 6124987 - DNA, 23 bp, Homo sapiens
cggggatgtgtcctgacactgca

SEQ ID NO: 6124988 - DNA, 17 bp, Homo sapiens
cggggcaaagctgctgg

SEQ ID NO: 6124989 - DNA, 17 bp, Homo sapiens
cggggcaagagggaagg

SEQ ID NO: 6124990 - DNA, 20 bp, Homo sapiens
cggggcagcagcagccctgc

SEQ ID NO: 6124991 - DNA, 13 bp, Homo sapiens
cggggcagcaggg

SEQ ID NO: 6124992 - DNA, 17 bp, Homo sapiens
cggggcagcggggctgg

SEQ ID NO: 6124993 - DNA, 19 bp, Homo sapiens
cggggcagctgccagagaa

SEQ ID NO: 6124994 - DNA, 18 bp, Homo sapiens
cggggcaggaggcctggc

SEQ ID NO: 6124995 - DNA, 15 bp, Homo sapiens
cggggcagggccttc

SEQ ID NO: 6124996 - DNA, 20 bp, Homo sapiens
cggggcagggggtatgcaga

SEQ ID NO: 6124997 - DNA, 21 bp, Homo sapiens
cggggcagtactcctccctgg

SEQ ID NO: 6124998 - DNA, 17 bp, Homo sapiens
cggggcagtatgtgatg

SEQ ID NO: 6124999 - DNA, 22 bp, Homo sapiens
cggggcagttagagcagcctcg

SEQ ID NO: 6125000 - DNA, 22 bp, Homo sapiens
cggggcagttcgggaaccccct

SEQ ID NO: 6125001 - DNA, 15 bp, Homo sapiens
cggggcatctggcct

SEQ ID NO: 6125002 - DNA, 20 bp, Homo sapiens
cggggcatggacagggccag

SEQ ID NO: 6125003 - DNA, 21 bp, Homo sapiens
cggggcatggacagggccagg

SEQ ID NO: 6125004 - DNA, 15 bp, Homo sapiens
cggggccagagacat

SEQ ID NO: 6125005 - DNA, 21 bp, Homo sapiens
cggggccatttggccggctct

SEQ ID NO: 6125006 - DNA, 22 bp, Homo sapiens
cggggccatttggccggctctg

SEQ ID NO: 6125007 - DNA, 23 bp, Homo sapiens
cggggcccagcgctctcctggac

SEQ ID NO: 6125008 - DNA, 15 bp, Homo sapiens
cggggcccaggactc

SEQ ID NO: 6125009 - DNA, 16 bp, Homo sapiens
cggggccccactggct

SEQ ID NO: 6125010 - DNA, 20 bp, Homo sapiens
cggggcccccatcttggggg

SEQ ID NO: 6125011 - DNA, 12 bp, Homo sapiens
cggggccccctg

SEQ ID NO: 6125012 - DNA, 12 bp, Homo sapiens
cggggcccctgc

SEQ ID NO: 6125013 - DNA, 21 bp, Homo sapiens
cggggcccttggggcctggct

SEQ ID NO: 6125014 - DNA, 16 bp, Homo sapiens
cggggccgcagccaca

SEQ ID NO: 6125015 - DNA, 17 bp, Homo sapiens
cggggccgcagccacac

SEQ ID NO: 6125016 - DNA, 14 bp, Homo sapiens
cggggccgggactg

SEQ ID NO: 6125017 - DNA, 21 bp, Homo sapiens
cggggccggtgaggggagggg

SEQ ID NO: 6125018 - DNA, 13 bp, Homo sapiens
cggggcctgcagg

SEQ ID NO: 6125019 - DNA, 18 bp, Homo sapiens
cggggcctgcaggccagt

SEQ ID NO: 6125020 - DNA, 16 bp, Homo sapiens
cggggcctgcctagca

SEQ ID NO: 6125021 - DNA, 12 bp, Homo sapiens
cggggcctgctg

SEQ ID NO: 6125022 - DNA, 19 bp, Homo sapiens
cggggcctgggcaggaggg

SEQ ID NO: 6125023 - DNA, 19 bp, Homo sapiens
cggggcctgtctgaagcca

SEQ ID NO: 6125024 - DNA, 21 bp, Homo sapiens
cggggccttatcgggctccag

SEQ ID NO: 6125025 - DNA, 22 bp, Homo sapiens
cggggccttatcgggctccagc

SEQ ID NO: 6125026 - DNA, 21 bp, Homo sapiens
cggggccttccttttgaggag

SEQ ID NO: 6125027 - DNA, 22 bp, Homo sapiens
cggggccttgcggtatccgccc

SEQ ID NO: 6125028 - DNA, 23 bp, Homo sapiens
cggggccttggtcccagacagct

SEQ ID NO: 6125029 - DNA, 18 bp, Homo sapiens
cggggcgacccctcagtg

SEQ ID NO: 6125030 - DNA, 19 bp, Homo sapiens
cggggcgacccctcagtgc

SEQ ID NO: 6125031 - DNA, 20 bp, Homo sapiens
cggggcgatgctccctcagc

SEQ ID NO: 6125032 - DNA, 20 bp, Homo sapiens
cggggcggcatccgagcccc

SEQ ID NO: 6125033 - DNA, 21 bp, Homo sapiens
cggggcggcatccgagcccct

SEQ ID NO: 6125034 - DNA, 22 bp, Homo sapiens
cggggcggcatccgagcccctg

SEQ ID NO: 6125035 - DNA, 14 bp, Homo sapiens
cggggcgggccctg

SEQ ID NO: 6125036 - DNA, 18 bp, Homo sapiens
cggggcgggccctgcctg

SEQ ID NO: 6125037 - DNA, 17 bp, Homo sapiens
cggggcgtttctttgcc

SEQ ID NO: 6125038 - DNA, 13 bp, Homo sapiens
cggggctcagccc

SEQ ID NO: 6125039 - DNA, 17 bp, Homo sapiens
cggggctccaggctggc

SEQ ID NO: 6125040 - DNA, 19 bp, Homo sapiens
cggggctccaggctggctt

SEQ ID NO: 6125041 - DNA, 15 bp, Homo sapiens
cggggctccccacgc

SEQ ID NO: 6125042 - DNA, 17 bp, Homo sapiens
cggggctcccctggaca

SEQ ID NO: 6125043 - DNA, 19 bp, Homo sapiens
cggggctccccttcgcgta

SEQ ID NO: 6125044 - DNA, 14 bp, Homo sapiens
cggggctcctcctg

SEQ ID NO: 6125045 - DNA, 21 bp, Homo sapiens
cggggctctgggtgctgccct

SEQ ID NO: 6125046 - DNA, 16 bp, Homo sapiens
cggggctcttctcatt

SEQ ID NO: 6125047 - DNA, 23 bp, Homo sapiens
cggggctcttctcatttcacccc

SEQ ID NO: 6125048 - DNA, 17 bp, Homo sapiens
cggggctgccgcatctg

SEQ ID NO: 6125049 - DNA, 14 bp, Homo sapiens
cggggctggcaggg

SEQ ID NO: 6125050 - DNA, 11 bp, Homo sapiens
cggggctggcc

SEQ ID NO: 6125051 - DNA, 16 bp, Homo sapiens
cggggctggccagctg

SEQ ID NO: 6125052 - DNA, 17 bp, Homo sapiens
cggggctggccagctgt

SEQ ID NO: 6125053 - DNA, 17 bp, Homo sapiens
cggggctggccctgccc

SEQ ID NO: 6125054 - DNA, 23 bp, Homo sapiens
cggggctggccctgccctccccc

SEQ ID NO: 6125055 - DNA, 18 bp, Homo sapiens
cggggctgggaggaaggg

SEQ ID NO: 6125056 - DNA, 19 bp, Homo sapiens
cggggctgggggctgcagg

SEQ ID NO: 6125057 - DNA, 12 bp, Homo sapiens
cggggctgggtt

SEQ ID NO: 6125058 - DNA, 14 bp, Homo sapiens
cggggctgtcggcg

SEQ ID NO: 6125059 - DNA, 21 bp, Homo sapiens
cggggctgtcggcgctgcccc

SEQ ID NO: 6125060 - DNA, 23 bp, Homo sapiens
cggggcttcaaccttgagacagc

SEQ ID NO: 6125061 - DNA, 15 bp, Homo sapiens
cggggcttctcttgg

SEQ ID NO: 6125062 - DNA, 16 bp, Homo sapiens
cggggcttctcttggg

SEQ ID NO: 6125063 - DNA, 21 bp, Homo sapiens
cggggcttctcttgggtggga

SEQ ID NO: 6125064 - DNA, 17 bp, Homo sapiens
cggggcttctgggcgcc

SEQ ID NO: 6125065 - DNA, 14 bp, Homo sapiens
cggggcttctgggt

SEQ ID NO: 6125066 - DNA, 19 bp, Homo sapiens
cggggcttctgggtggctc

SEQ ID NO: 6125067 - DNA, 20 bp, Homo sapiens
cggggcttctgggtggctcc

SEQ ID NO: 6125068 - DNA, 15 bp, Homo sapiens
cggggcttgccttct

SEQ ID NO: 6125069 - DNA, 15 bp, Homo sapiens
cggggcttggctgag

SEQ ID NO: 6125070 - DNA, 15 bp, Homo sapiens
cggggcttggggctc

SEQ ID NO: 6125071 - DNA, 19 bp, Homo sapiens
cggggcttttaaaaggaaa

SEQ ID NO: 6125072 - DNA, 16 bp, Homo sapiens
cgggggaagctgagcc

SEQ ID NO: 6125073 - DNA, 17 bp, Homo sapiens
cgggggaagctgagccc

SEQ ID NO: 6125074 - DNA, 14 bp, Homo sapiens
cgggggagagagtt

SEQ ID NO: 6125075 - DNA, 18 bp, Homo sapiens
cgggggagagggacactc

SEQ ID NO: 6125076 - DNA, 13 bp, Homo sapiens
cgggggagcctgg

SEQ ID NO: 6125077 - DNA, 14 bp, Homo sapiens
cgggggagcctgga

SEQ ID NO: 6125078 - DNA, 13 bp, Homo sapiens
cgggggagctgga

SEQ ID NO: 6125079 - DNA, 19 bp, Homo sapiens
cgggggagctttcccagag

SEQ ID NO: 6125080 - DNA, 15 bp, Homo sapiens
cgggggaggagcacc

SEQ ID NO: 6125081 - DNA, 16 bp, Homo sapiens
cgggggaggagcaccc

SEQ ID NO: 6125082 - DNA, 19 bp, Homo sapiens
cgggggaggagcaccccca

SEQ ID NO: 6125083 - DNA, 22 bp, Homo sapiens
cgggggaggagcacccccagcc

SEQ ID NO: 6125084 - DNA, 23 bp, Homo sapiens
cgggggaggagcacccccagcct

SEQ ID NO: 6125085 - DNA, 24 bp, Homo sapiens
cgggggaggagcacccccagcctc

SEQ ID NO: 6125086 - DNA, 18 bp, Homo sapiens
cgggggaggccgaggcag

SEQ ID NO: 6125087 - DNA, 20 bp, Homo sapiens
cgggggaggggccctcaggc

SEQ ID NO: 6125088 - DNA, 16 bp, Homo sapiens
cgggggaggggcgcgg

SEQ ID NO: 6125089 - DNA, 19 bp, Homo sapiens
cgggggagggtaggcagga

SEQ ID NO: 6125090 - DNA, 15 bp, Homo sapiens
cgggggaggtgggtg

SEQ ID NO: 6125091 - DNA, 17 bp, Homo sapiens
cgggggagtgagacagg

SEQ ID NO: 6125092 - DNA, 17 bp, Homo sapiens
cgggggatcctggagcc

SEQ ID NO: 6125093 - DNA, 20 bp, Homo sapiens
cgggggcaacgattcacagc

SEQ ID NO: 6125094 - DNA, 13 bp, Homo sapiens
cgggggcaggccg

SEQ ID NO: 6125095 - DNA, 19 bp, Homo sapiens
cgggggcaggccgggcctg

SEQ ID NO: 6125096 - DNA, 23 bp, Homo sapiens
cgggggcaggggaggccatctgg

SEQ ID NO: 6125097 - DNA, 21 bp, Homo sapiens
cgggggcagtctgagagaggc

SEQ ID NO: 6125098 - DNA, 22 bp, Homo sapiens
cgggggcatctgagtccagctc

SEQ ID NO: 6125099 - DNA, 19 bp, Homo sapiens
cgggggccccacctcggca

SEQ ID NO: 6125100 - DNA, 22 bp, Homo sapiens
ctcccaggggtctccctggctc

SEQ ID NO: 6125101 - DNA, 23 bp, Homo sapiens
ctcccaggggtctccctggctcc

SEQ ID NO: 6125102 - DNA, 13 bp, Homo sapiens
ctcccagggtgga

SEQ ID NO: 6125103 - DNA, 17 bp, Homo sapiens
ctcccaggtaccagctg

SEQ ID NO: 6125104 - DNA, 19 bp, Homo sapiens
ctcccaggtaccagctgcg

SEQ ID NO: 6125105 - DNA, 22 bp, Homo sapiens
ctcccaggtaccagctgcgctt

SEQ ID NO: 6125106 - DNA, 24 bp, Homo sapiens
ctcccaggtaccagctgcgcttgc

SEQ ID NO: 6125107 - DNA, 22 bp, Homo sapiens
ctcccaggtagctgggattaca

SEQ ID NO: 6125108 - DNA, 22 bp, Homo sapiens
ctcccaggtcgggcagtggagg

SEQ ID NO: 6125109 - DNA, 18 bp, Homo sapiens
ctcccaggtgcagccaga

SEQ ID NO: 6125110 - DNA, 18 bp, Homo sapiens
ctcccaggtgcatttctt

SEQ ID NO: 6125111 - DNA, 22 bp, Homo sapiens
ctcccaggtgtttgtggggctg

SEQ ID NO: 6125112 - DNA, 19 bp, Homo sapiens
ctcccaggtttcccactgc

SEQ ID NO: 6125113 - DNA, 18 bp, Homo sapiens
ctcccagtaagggcgtgg

SEQ ID NO: 6125114 - DNA, 22 bp, Homo sapiens
ctcccagtaagggcgtggctct

SEQ ID NO: 6125115 - DNA, 19 bp, Homo sapiens
ctcccagtaatttttctta

SEQ ID NO: 6125116 - DNA, 15 bp, Homo sapiens
ctcccagtccatttc

SEQ ID NO: 6125117 - DNA, 18 bp, Homo sapiens
ctcccagtccatttccaa

SEQ ID NO: 6125118 - DNA, 20 bp, Homo sapiens
ctcccagtccccagcccttc

SEQ ID NO: 6125119 - DNA, 15 bp, Homo sapiens
ctcccagtctctgtc

SEQ ID NO: 6125120 - DNA, 18 bp, Homo sapiens
ctcccagtgaactcctgc

SEQ ID NO: 6125121 - DNA, 21 bp, Homo sapiens
ctcccagtgagaagggcctgc

SEQ ID NO: 6125122 - DNA, 23 bp, Homo sapiens
ctcccagtgagaagggcctgctc

SEQ ID NO: 6125123 - DNA, 14 bp, Homo sapiens
ctcccagtgccaaa

SEQ ID NO: 6125124 - DNA, 15 bp, Homo sapiens
ctcccagtgccttct

SEQ ID NO: 6125125 - DNA, 17 bp, Homo sapiens
ctcccagtgccttctgg

SEQ ID NO: 6125126 - DNA, 14 bp, Homo sapiens
ctcccagtggcctg

SEQ ID NO: 6125127 - DNA, 15 bp, Homo sapiens
ctcccagtggcctgg

SEQ ID NO: 6125128 - DNA, 18 bp, Homo sapiens
ctcccagtggcctggctt

SEQ ID NO: 6125129 - DNA, 20 bp, Homo sapiens
ctcccagtgggagcttcccg

SEQ ID NO: 6125130 - DNA, 21 bp, Homo sapiens
ctcccagtgtcttcctgtggg

SEQ ID NO: 6125131 - DNA, 20 bp, Homo sapiens
ctcccagttctctagggaag

SEQ ID NO: 6125132 - DNA, 17 bp, Homo sapiens
ctcccataaccgctgat

SEQ ID NO: 6125133 - DNA, 23 bp, Homo sapiens
ctcccatagatactctcttcttc

SEQ ID NO: 6125134 - DNA, 16 bp, Homo sapiens
ctcccatagcgctggc

SEQ ID NO: 6125135 - DNA, 18 bp, Homo sapiens
ctcccatagcgctggctc

SEQ ID NO: 6125136 - DNA, 22 bp, Homo sapiens
ctcccatagcgctggctcagga

SEQ ID NO: 6125137 - DNA, 23 bp, Homo sapiens
ctcccatagcgctggctcaggaa

SEQ ID NO: 6125138 - DNA, 16 bp, Homo sapiens
ctcccatagctgggac

SEQ ID NO: 6125139 - DNA, 19 bp, Homo sapiens
ctcccataggctgtgttta

SEQ ID NO: 6125140 - DNA, 15 bp, Homo sapiens
ctcccatagtgctgg

SEQ ID NO: 6125141 - DNA, 19 bp, Homo sapiens
ctcccatcatgcccggtcc

SEQ ID NO: 6125142 - DNA, 17 bp, Homo sapiens
ctcccatccagcgtctg

SEQ ID NO: 6125143 - DNA, 14 bp, Homo sapiens
ctcccatccagggc

SEQ ID NO: 6125144 - DNA, 15 bp, Homo sapiens
ctcccatccagggcc

SEQ ID NO: 6125145 - DNA, 11 bp, Homo sapiens
ctcccatccca

SEQ ID NO: 6125146 - DNA, 14 bp, Homo sapiens
ctcccatccccctg

SEQ ID NO: 6125147 - DNA, 23 bp, Homo sapiens
ctcccatcccctggactgggagg

SEQ ID NO: 6125148 - DNA, 14 bp, Homo sapiens
ctcccatcccgctt

SEQ ID NO: 6125149 - DNA, 21 bp, Homo sapiens
ctcccatcccttcaaccccac

SEQ ID NO: 6125150 - DNA, 14 bp, Homo sapiens
ctcccatcctcacc

SEQ ID NO: 6125151 - DNA, 14 bp, Homo sapiens
ctcccatcctgatc

SEQ ID NO: 6125152 - DNA, 19 bp, Homo sapiens
ctcccatcctgatcccaga

SEQ ID NO: 6125153 - DNA, 16 bp, Homo sapiens
ctcccatcctggggca

SEQ ID NO: 6125154 - DNA, 18 bp, Homo sapiens
ctcccatcctggggcagc

SEQ ID NO: 6125155 - DNA, 16 bp, Homo sapiens
ctcccatcctgtgtgt

SEQ ID NO: 6125156 - DNA, 19 bp, Homo sapiens
ctcccatcctgtgtgttaa

SEQ ID NO: 6125157 - DNA, 15 bp, Homo sapiens
ctcccatctcacaca

SEQ ID NO: 6125158 - DNA, 14 bp, Homo sapiens
ctcccatctccttc

SEQ ID NO: 6125159 - DNA, 17 bp, Homo sapiens
ctcccatctccttcccc

SEQ ID NO: 6125160 - DNA, 19 bp, Homo sapiens
ctcccatctccttccccca

SEQ ID NO: 6125161 - DNA, 13 bp, Homo sapiens
ctcccatctgatt

SEQ ID NO: 6125162 - DNA, 21 bp, Homo sapiens
ctcccatctgatttacttaat

SEQ ID NO: 6125163 - DNA, 11 bp, Homo sapiens
ctcccatctgg

SEQ ID NO: 6125164 - DNA, 15 bp, Homo sapiens
ctcccatctgggagt

SEQ ID NO: 6125165 - DNA, 20 bp, Homo sapiens
ctcccatctgggagtcccct

SEQ ID NO: 6125166 - DNA, 20 bp, Homo sapiens
ctcccatcttaactctttgc

SEQ ID NO: 6125167 - DNA, 19 bp, Homo sapiens
ctcccatcttggcctccca

SEQ ID NO: 6125168 - DNA, 20 bp, Homo sapiens
ctcccatcttttgttactct

SEQ ID NO: 6125169 - DNA, 24 bp, Homo sapiens
ctcccatgagggagatgccatgag

SEQ ID NO: 6125170 - DNA, 22 bp, Homo sapiens
ctcccatgcacaactctccaaa

SEQ ID NO: 6125171 - DNA, 16 bp, Homo sapiens
ctcccatgcctggtcc

SEQ ID NO: 6125172 - DNA, 18 bp, Homo sapiens
ctcccatggagccccagc

SEQ ID NO: 6125173 - DNA, 20 bp, Homo sapiens
ctcccatggagccccagccc

SEQ ID NO: 6125174 - DNA, 23 bp, Homo sapiens
ctcccatggagccccagccccct

SEQ ID NO: 6125175 - DNA, 16 bp, Homo sapiens
ctcccatggcccagca

SEQ ID NO: 6125176 - DNA, 17 bp, Homo sapiens
ctcccatggcccagcag

SEQ ID NO: 6125177 - DNA, 14 bp, Homo sapiens
ctcccatggccttc

SEQ ID NO: 6125178 - DNA, 17 bp, Homo sapiens
ctcccatggccttccct

SEQ ID NO: 6125179 - DNA, 17 bp, Homo sapiens
ctcccatggctctgggc

SEQ ID NO: 6125180 - DNA, 20 bp, Homo sapiens
ctcccatggcttaatgcttc

SEQ ID NO: 6125181 - DNA, 21 bp, Homo sapiens
ctcccatggcttaatgcttct

SEQ ID NO: 6125182 - DNA, 18 bp, Homo sapiens
ctcccatggctttgtgct

SEQ ID NO: 6125183 - DNA, 21 bp, Homo sapiens
ctcccatggctttgtgctgct

SEQ ID NO: 6125184 - DNA, 22 bp, Homo sapiens
ctcccatggtgcccgtgcctct

SEQ ID NO: 6125185 - DNA, 22 bp, Homo sapiens
ctcccatgtgtgatgctgacac

SEQ ID NO: 6125186 - DNA, 21 bp, Homo sapiens
ctcccatgttgcatgcctatg

SEQ ID NO: 6125187 - DNA, 19 bp, Homo sapiens
ctcccattcactcttccag

SEQ ID NO: 6125188 - DNA, 14 bp, Homo sapiens
ctcccattgcccag

SEQ ID NO: 6125189 - DNA, 15 bp, Homo sapiens
ctcccattgcccagt

SEQ ID NO: 6125190 - DNA, 17 bp, Homo sapiens
ctcccattgcccagtga

SEQ ID NO: 6125191 - DNA, 22 bp, Homo sapiens
ctcccattgcccagtgagccct

SEQ ID NO: 6125192 - DNA, 14 bp, Homo sapiens
ctcccatttcctga

SEQ ID NO: 6125193 - DNA, 16 bp, Homo sapiens
ctcccatttcctgatc

SEQ ID NO: 6125194 - DNA, 16 bp, Homo sapiens
ctcccatttctactct

SEQ ID NO: 6125195 - DNA, 22 bp, Homo sapiens
ctcccattttcagttccctcct

SEQ ID NO: 6125196 - DNA, 16 bp, Homo sapiens
ctcccattttggaatt

SEQ ID NO: 6125197 - DNA, 15 bp, Homo sapiens
ctcccatttttactt

SEQ ID NO: 6125198 - DNA, 12 bp, Homo sapiens
ctccccaaaaac

SEQ ID NO: 6125199 - DNA, 20 bp, Homo sapiens
ctccccaaaacctttcccca

SEQ ID NO: 6125200 - DNA, 17 bp, Homo sapiens
ctccccaaacccatcag

SEQ ID NO: 6125201 - DNA, 20 bp, Homo sapiens
ctccccaaagccactggaag

SEQ ID NO: 6125202 - DNA, 21 bp, Homo sapiens
ctccccaaagccactggaagg

SEQ ID NO: 6125203 - DNA, 23 bp, Homo sapiens
ctccccaaagccactggaaggag

SEQ ID NO: 6125204 - DNA, 15 bp, Homo sapiens
ctccccaaatggctg

SEQ ID NO: 6125205 - DNA, 23 bp, Homo sapiens
ctccccaacacctgcctctgacc

SEQ ID NO: 6125206 - DNA, 22 bp, Homo sapiens
ctccccaacccccattctcatc

SEQ ID NO: 6125207 - DNA, 15 bp, Homo sapiens
ctccccaaccctgcc

SEQ ID NO: 6125208 - DNA, 13 bp, Homo sapiens
ctccccaactccc

SEQ ID NO: 6125209 - DNA, 23 bp, Homo sapiens
ctccccaactgaccacctttgtt

SEQ ID NO: 6125210 - DNA, 15 bp, Homo sapiens
ctccccaagacttga

SEQ ID NO: 6125211 - DNA, 21 bp, Homo sapiens
ctccccaaggccccctgcctg

SEQ ID NO: 6125212 - DNA, 15 bp, Homo sapiens
ctccccaatccaggc

SEQ ID NO: 6125213 - DNA, 13 bp, Homo sapiens
ctccccaatccat

SEQ ID NO: 6125214 - DNA, 20 bp, Homo sapiens
ctccccaatgagacttgcct

SEQ ID NO: 6125215 - DNA, 21 bp, Homo sapiens
ctccccaatgagacttgcctt

SEQ ID NO: 6125216 - DNA, 18 bp, Homo sapiens
ctccccacacacaggcct

SEQ ID NO: 6125217 - DNA, 18 bp, Homo sapiens
ctccccacactccactct

SEQ ID NO: 6125218 - DNA, 14 bp, Homo sapiens
ctccccacagcctc

SEQ ID NO: 6125219 - DNA, 15 bp, Homo sapiens
ctccccacagcgtcc

SEQ ID NO: 6125220 - DNA, 19 bp, Homo sapiens
ctccccacagctttgcacc

SEQ ID NO: 6125221 - DNA, 18 bp, Homo sapiens
ctccccacaggagccctg

SEQ ID NO: 6125222 - DNA, 14 bp, Homo sapiens
ctccccacagtcct

SEQ ID NO: 6125223 - DNA, 20 bp, Homo sapiens
ctccccacatcgcacactgg

SEQ ID NO: 6125224 - DNA, 12 bp, Homo sapiens
ctccccaccaga

SEQ ID NO: 6125225 - DNA, 19 bp, Homo sapiens
ctccccaccagagctgcct

SEQ ID NO: 6125226 - DNA, 13 bp, Homo sapiens
ctccccacccaag

SEQ ID NO: 6125227 - DNA, 19 bp, Homo sapiens
ctccccacccaagagagga

SEQ ID NO: 6125228 - DNA, 13 bp, Homo sapiens
ctccccacccacc

SEQ ID NO: 6125229 - DNA, 15 bp, Homo sapiens
ctccccacccacccc

SEQ ID NO: 6125230 - DNA, 21 bp, Homo sapiens
ctccccacccaccccacgccc

SEQ ID NO: 6125231 - DNA, 18 bp, Homo sapiens
ctccccacccattttccc

SEQ ID NO: 6125232 - DNA, 14 bp, Homo sapiens
ctccccacccgccc

SEQ ID NO: 6125233 - DNA, 16 bp, Homo sapiens
ctccccaccctcctgg

SEQ ID NO: 6125234 - DNA, 15 bp, Homo sapiens
ctccccacctccagg

SEQ ID NO: 6125235 - DNA, 13 bp, Homo sapiens
ctccccacctgct

SEQ ID NO: 6125236 - DNA, 21 bp, Homo sapiens
ctccccaccttcaattcctgg

SEQ ID NO: 6125237 - DNA, 23 bp, Homo sapiens
ctccccaccttcaattcctgggc

SEQ ID NO: 6125238 - DNA, 18 bp, Homo sapiens
ctccccacgagggctggc

SEQ ID NO: 6125239 - DNA, 21 bp, Homo sapiens
ctccccacgagtcacctgcaa

SEQ ID NO: 6125240 - DNA, 24 bp, Homo sapiens
ctccccacgagtcacctgcaagcc

SEQ ID NO: 6125241 - DNA, 20 bp, Homo sapiens
ctccccacgcccccatgcag

SEQ ID NO: 6125242 - DNA, 18 bp, Homo sapiens
ctccccacgcccgtctct

SEQ ID NO: 6125243 - DNA, 20 bp, Homo sapiens
ctccccacggccgctccagg

SEQ ID NO: 6125244 - DNA, 23 bp, Homo sapiens
ctccccacggggcctcgggacct

SEQ ID NO: 6125245 - DNA, 20 bp, Homo sapiens
ctccccacgtcagctgggac

SEQ ID NO: 6125246 - DNA, 14 bp, Homo sapiens
ctccccactccacc

SEQ ID NO: 6125247 - DNA, 15 bp, Homo sapiens
ctccccactccagca

SEQ ID NO: 6125248 - DNA, 13 bp, Homo sapiens
ctccccactctgc

SEQ ID NO: 6125249 - DNA, 19 bp, Homo sapiens
ctccccactctgctctgat

SEQ ID NO: 6125250 - DNA, 20 bp, Homo sapiens
ctccccactctgctctgatg

SEQ ID NO: 6125251 - DNA, 16 bp, Homo sapiens
ctccccacttcacttt

SEQ ID NO: 6125252 - DNA, 20 bp, Homo sapiens
ctccccacttcactttcttc

SEQ ID NO: 6125253 - DNA, 23 bp, Homo sapiens
ctccccacttcactttcttcaaa

SEQ ID NO: 6125254 - DNA, 17 bp, Homo sapiens
ctccccagaactggctg

SEQ ID NO: 6125255 - DNA, 22 bp, Homo sapiens
ctccccagaactggctgggccc

SEQ ID NO: 6125256 - DNA, 14 bp, Homo sapiens
ctccccagaattca

SEQ ID NO: 6125257 - DNA, 20 bp, Homo sapiens
ctccccagacagggctccag

SEQ ID NO: 6125258 - DNA, 13 bp, Homo sapiens
ctccccagactct

SEQ ID NO: 6125259 - DNA, 21 bp, Homo sapiens
ctccccagagccctgcagtca

SEQ ID NO: 6125260 - DNA, 16 bp, Homo sapiens
ctccccagagctgcct

SEQ ID NO: 6125261 - DNA, 20 bp, Homo sapiens
ctccccagatctgtcctggg

SEQ ID NO: 6125262 - DNA, 23 bp, Homo sapiens
ctccccagcattccagcccctct

SEQ ID NO: 6125263 - DNA, 12 bp, Homo sapiens
ctccccagccag

SEQ ID NO: 6125264 - DNA, 23 bp, Homo sapiens
ctccccagccagaggtggagcca

SEQ ID NO: 6125265 - DNA, 14 bp, Homo sapiens
ctccccagccagcc

SEQ ID NO: 6125266 - DNA, 18 bp, Homo sapiens
ctccccagccagcccttc

SEQ ID NO: 6125267 - DNA, 21 bp, Homo sapiens
ctccccagccagcccttccct

SEQ ID NO: 6125268 - DNA, 15 bp, Homo sapiens
ctccccagccagcct

SEQ ID NO: 6125269 - DNA, 17 bp, Homo sapiens
ctccccagccagcctgg

SEQ ID NO: 6125270 - DNA, 11 bp, Homo sapiens
ctccccagccc

SEQ ID NO: 6125271 - DNA, 16 bp, Homo sapiens
ctccccagcccacctg

SEQ ID NO: 6125272 - DNA, 15 bp, Homo sapiens
ctccccagcccagca

SEQ ID NO: 6125273 - DNA, 18 bp, Homo sapiens
ctccccagcccaggaaaa

SEQ ID NO: 6125274 - DNA, 16 bp, Homo sapiens
ctccccagccccaccc

SEQ ID NO: 6125275 - DNA, 14 bp, Homo sapiens
ctccccagccccag

SEQ ID NO: 6125276 - DNA, 15 bp, Homo sapiens
cgggggcctagtggc

SEQ ID NO: 6125277 - DNA, 19 bp, Homo sapiens
cgggggccttgaagactcc

SEQ ID NO: 6125278 - DNA, 15 bp, Homo sapiens
cgggggcgcctggag

SEQ ID NO: 6125279 - DNA, 13 bp, Homo sapiens
cgggggcggccca

SEQ ID NO: 6125280 - DNA, 16 bp, Homo sapiens
cgggggcggcccagcc

SEQ ID NO: 6125281 - DNA, 16 bp, Homo sapiens
cgggggcggctctggg

SEQ ID NO: 6125282 - DNA, 20 bp, Homo sapiens
cgggggcggctctgggaagc

SEQ ID NO: 6125283 - DNA, 16 bp, Homo sapiens
cgggggctgaggggca

SEQ ID NO: 6125284 - DNA, 20 bp, Homo sapiens
cgggggctgcccttgggcca

SEQ ID NO: 6125285 - DNA, 15 bp, Homo sapiens
cgggggctggcctag

SEQ ID NO: 6125286 - DNA, 13 bp, Homo sapiens
cgggggctggggc

SEQ ID NO: 6125287 - DNA, 14 bp, Homo sapiens
cgggggctggggca

SEQ ID NO: 6125288 - DNA, 23 bp, Homo sapiens
cgggggctgtgactctgggcagg

SEQ ID NO: 6125289 - DNA, 17 bp, Homo sapiens
cgggggctgtggctctg

SEQ ID NO: 6125290 - DNA, 11 bp, Homo sapiens
cggggggaggg

SEQ ID NO: 6125291 - DNA, 12 bp, Homo sapiens
cggggggaggga

SEQ ID NO: 6125292 - DNA, 13 bp, Homo sapiens
cggggggagggag

SEQ ID NO: 6125293 - DNA, 22 bp, Homo sapiens
cggggggaggggacagagctga

SEQ ID NO: 6125294 - DNA, 13 bp, Homo sapiens
cggggggagggtt

SEQ ID NO: 6125295 - DNA, 23 bp, Homo sapiens
cggggggccccagtcagcctctc

SEQ ID NO: 6125296 - DNA, 13 bp, Homo sapiens
cggggggctcctg

SEQ ID NO: 6125297 - DNA, 14 bp, Homo sapiens
cggggggctcctgc

SEQ ID NO: 6125298 - DNA, 15 bp, Homo sapiens
cggggggctcctgcc

SEQ ID NO: 6125299 - DNA, 19 bp, Homo sapiens
cggggggctcctgcccagg

SEQ ID NO: 6125300 - DNA, 12 bp, Homo sapiens
cggggggctggg

SEQ ID NO: 6125301 - DNA, 22 bp, Homo sapiens
cggggggggcgcctggagagcg

SEQ ID NO: 6125302 - DNA, 21 bp, Homo sapiens
cggggggggtaggagaggaga

SEQ ID NO: 6125303 - DNA, 18 bp, Homo sapiens
cggggggtcacaggccca

SEQ ID NO: 6125304 - DNA, 20 bp, Homo sapiens
cggggggtcacaggcccaga

SEQ ID NO: 6125305 - DNA, 11 bp, Homo sapiens
cggggggtgga

SEQ ID NO: 6125306 - DNA, 23 bp, Homo sapiens
cggggggtgtcttccctgcctgt

SEQ ID NO: 6125307 - DNA, 18 bp, Homo sapiens
cgggggtgcggcaggagc

SEQ ID NO: 6125308 - DNA, 19 bp, Homo sapiens
cgggggtgcggcaggagca

SEQ ID NO: 6125309 - DNA, 17 bp, Homo sapiens
cgggggtgctggggcca

SEQ ID NO: 6125310 - DNA, 15 bp, Homo sapiens
cgggggtgtgtctgt

SEQ ID NO: 6125311 - DNA, 22 bp, Homo sapiens
cgggggttccgtgtccaccccc

SEQ ID NO: 6125312 - DNA, 15 bp, Homo sapiens
cggggtaaaaagtgg

SEQ ID NO: 6125313 - DNA, 19 bp, Homo sapiens
cggggtaaaaagtggctgc

SEQ ID NO: 6125314 - DNA, 14 bp, Homo sapiens
cggggtagaggctg

SEQ ID NO: 6125315 - DNA, 21 bp, Homo sapiens
cggggtatcctgggggaccca

SEQ ID NO: 6125316 - DNA, 14 bp, Homo sapiens
cggggtcaggttct

SEQ ID NO: 6125317 - DNA, 19 bp, Homo sapiens
cggggtccaccagtgtgtg

SEQ ID NO: 6125318 - DNA, 21 bp, Homo sapiens
cggggtccaccagtgtgtggg

SEQ ID NO: 6125319 - DNA, 23 bp, Homo sapiens
cggggtcccaggacctgagcctg

SEQ ID NO: 6125320 - DNA, 16 bp, Homo sapiens
cggggtcctgaggctg

SEQ ID NO: 6125321 - DNA, 19 bp, Homo sapiens
cggggtcctgaggctgggg

SEQ ID NO: 6125322 - DNA, 13 bp, Homo sapiens
cggggtcctggga

SEQ ID NO: 6125323 - DNA, 14 bp, Homo sapiens
cggggtcctgggag

SEQ ID NO: 6125324 - DNA, 19 bp, Homo sapiens
cggggtcctgggaggctgc

SEQ ID NO: 6125325 - DNA, 22 bp, Homo sapiens
cggggtcctgggaggctgcagc

SEQ ID NO: 6125326 - DNA, 15 bp, Homo sapiens
cggggtcgggggagg

SEQ ID NO: 6125327 - DNA, 14 bp, Homo sapiens
cggggtctgtgctg

SEQ ID NO: 6125328 - DNA, 19 bp, Homo sapiens
cggggtctgtgctgtgcct

SEQ ID NO: 6125329 - DNA, 18 bp, Homo sapiens
cggggtcttgctctgtct

SEQ ID NO: 6125330 - DNA, 18 bp, Homo sapiens
cggggtgcacaggagggg

SEQ ID NO: 6125331 - DNA, 16 bp, Homo sapiens
cggggtgcccgtgtgg

SEQ ID NO: 6125332 - DNA, 20 bp, Homo sapiens
cggggtgcccgtgtggcctg

SEQ ID NO: 6125333 - DNA, 21 bp, Homo sapiens
cggggtgcccgtgtggcctgg

SEQ ID NO: 6125334 - DNA, 15 bp, Homo sapiens
cggggtgcttccttg

SEQ ID NO: 6125335 - DNA, 19 bp, Homo sapiens
cggggtggacgagggagtg

SEQ ID NO: 6125336 - DNA, 19 bp, Homo sapiens
cggggtggagtcagggctg

SEQ ID NO: 6125337 - DNA, 16 bp, Homo sapiens
cggggtggattggatt

SEQ ID NO: 6125338 - DNA, 14 bp, Homo sapiens
cggggtggcggtgg

SEQ ID NO: 6125339 - DNA, 14 bp, Homo sapiens
cggggtggggaggg

SEQ ID NO: 6125340 - DNA, 15 bp, Homo sapiens
cggggtggggagggt

SEQ ID NO: 6125341 - DNA, 16 bp, Homo sapiens
cggggtggggagggtg

SEQ ID NO: 6125342 - DNA, 16 bp, Homo sapiens
cggggtgggggcagca

SEQ ID NO: 6125343 - DNA, 22 bp, Homo sapiens
cggggtggggtgcctgagcccg

SEQ ID NO: 6125344 - DNA, 19 bp, Homo sapiens
cggggtgtaacttcctgct

SEQ ID NO: 6125345 - DNA, 22 bp, Homo sapiens
cggggtgtaacttcctgctgca

SEQ ID NO: 6125346 - DNA, 19 bp, Homo sapiens
cggggtgtctgtcttcctt

SEQ ID NO: 6125347 - DNA, 21 bp, Homo sapiens
cggggtgtctgtcttcctttg

SEQ ID NO: 6125348 - DNA, 12 bp, Homo sapiens
cggggttacact

SEQ ID NO: 6125349 - DNA, 14 bp, Homo sapiens
cggggttggggtgg

SEQ ID NO: 6125350 - DNA, 18 bp, Homo sapiens
cggggttggggtgggagg

SEQ ID NO: 6125351 - DNA, 16 bp, Homo sapiens
cggggtttcaccatgt

SEQ ID NO: 6125352 - DNA, 19 bp, Homo sapiens
cgggtcacaggagggaggg

SEQ ID NO: 6125353 - DNA, 13 bp, Homo sapiens
cgggtcactgctg

SEQ ID NO: 6125354 - DNA, 23 bp, Homo sapiens
cgggtcacttttgttcccaggta

SEQ ID NO: 6125355 - DNA, 20 bp, Homo sapiens
cgggtccccagctccccagg

SEQ ID NO: 6125356 - DNA, 19 bp, Homo sapiens
cgggtccggcctctccctg

SEQ ID NO: 6125357 - DNA, 20 bp, Homo sapiens
cgggtccggcctctccctgc

SEQ ID NO: 6125358 - DNA, 22 bp, Homo sapiens
cgggtccggcctctccctgcct

SEQ ID NO: 6125359 - DNA, 23 bp, Homo sapiens
cgggtccggcctctccctgcctg

SEQ ID NO: 6125360 - DNA, 19 bp, Homo sapiens
cgggtcctcagctgctccc

SEQ ID NO: 6125361 - DNA, 16 bp, Homo sapiens
cgggtctagtggaaag

SEQ ID NO: 6125362 - DNA, 22 bp, Homo sapiens
cgggtctcacttataccaaagg

SEQ ID NO: 6125363 - DNA, 17 bp, Homo sapiens
cgggtctccccacctgc

SEQ ID NO: 6125364 - DNA, 21 bp, Homo sapiens
cgggtctcctcccagcggcct

SEQ ID NO: 6125365 - DNA, 20 bp, Homo sapiens
cgggtctccttggctgtctg

SEQ ID NO: 6125366 - DNA, 17 bp, Homo sapiens
cgggtctcgcagcctga

SEQ ID NO: 6125367 - DNA, 18 bp, Homo sapiens
cgggtctgccatgctctg

SEQ ID NO: 6125368 - DNA, 13 bp, Homo sapiens
cgggtctgctccc

SEQ ID NO: 6125369 - DNA, 22 bp, Homo sapiens
cgggtctgtgggactggcccac

SEQ ID NO: 6125370 - DNA, 16 bp, Homo sapiens
cgggtcttcctactct

SEQ ID NO: 6125371 - DNA, 22 bp, Homo sapiens
cgggtgacgcccaccttcgggc

SEQ ID NO: 6125372 - DNA, 18 bp, Homo sapiens
cgggtgacgtgtgttctt

SEQ ID NO: 6125373 - DNA, 17 bp, Homo sapiens
cgggtgatgagacctgg

SEQ ID NO: 6125374 - DNA, 14 bp, Homo sapiens
cgggtgcaagcact

SEQ ID NO: 6125375 - DNA, 22 bp, Homo sapiens
cgggtgcagacaatcttctgtt

SEQ ID NO: 6125376 - DNA, 22 bp, Homo sapiens
cgggtgcatttgagagaagcca

SEQ ID NO: 6125377 - DNA, 20 bp, Homo sapiens
cgggtgcccaggacggtctg

SEQ ID NO: 6125378 - DNA, 24 bp, Homo sapiens
cgggtgcccgtaatcccagctact

SEQ ID NO: 6125379 - DNA, 18 bp, Homo sapiens
cgggtgctcagggctgac

SEQ ID NO: 6125380 - DNA, 19 bp, Homo sapiens
cgggtggatcacctgaggt

SEQ ID NO: 6125381 - DNA, 17 bp, Homo sapiens
cgggtggctggagcccc

SEQ ID NO: 6125382 - DNA, 20 bp, Homo sapiens
cgggtggctggagccccatc

SEQ ID NO: 6125383 - DNA, 21 bp, Homo sapiens
cgggtgggagggatggggcca

SEQ ID NO: 6125384 - DNA, 22 bp, Homo sapiens
cgggtgggcctggcctgagctg

SEQ ID NO: 6125385 - DNA, 12 bp, Homo sapiens
cgggtggggcct

SEQ ID NO: 6125386 - DNA, 17 bp, Homo sapiens
cgggtggggctggtggg

SEQ ID NO: 6125387 - DNA, 16 bp, Homo sapiens
cgggtggggcttgggg

SEQ ID NO: 6125388 - DNA, 15 bp, Homo sapiens
cgggtgggggagcca

SEQ ID NO: 6125389 - DNA, 20 bp, Homo sapiens
cgggtgggggagggaaaggg

SEQ ID NO: 6125390 - DNA, 18 bp, Homo sapiens
cgggtggggggagggcac

SEQ ID NO: 6125391 - DNA, 17 bp, Homo sapiens
cgggtggggtgcttgct

SEQ ID NO: 6125392 - DNA, 16 bp, Homo sapiens
cgggtgggtatcccac

SEQ ID NO: 6125393 - DNA, 21 bp, Homo sapiens
cgggtgggtatcccacctcca

SEQ ID NO: 6125394 - DNA, 17 bp, Homo sapiens
cgggtgtcacattcctg

SEQ ID NO: 6125395 - DNA, 22 bp, Homo sapiens
cgggtgtgcaatgtctgagtga

SEQ ID NO: 6125396 - DNA, 17 bp, Homo sapiens
cgggtgtgcctgccctg

SEQ ID NO: 6125397 - DNA, 19 bp, Homo sapiens
cgggtgtgcctgccctgga

SEQ ID NO: 6125398 - DNA, 12 bp, Homo sapiens
cgggtgtggaga

SEQ ID NO: 6125399 - DNA, 21 bp, Homo sapiens
cgggtgtggcacgcacctgta

SEQ ID NO: 6125400 - DNA, 18 bp, Homo sapiens
cgggttaagaaatacctt

SEQ ID NO: 6125401 - DNA, 13 bp, Homo sapiens
cgggttagcctgg

SEQ ID NO: 6125402 - DNA, 23 bp, Homo sapiens
cgggttagcctggtgacaggcag

SEQ ID NO: 6125403 - DNA, 21 bp, Homo sapiens
cgggttcaagccattctgcct

SEQ ID NO: 6125404 - DNA, 20 bp, Homo sapiens
cgggttcacgccattctcct

SEQ ID NO: 6125405 - DNA, 19 bp, Homo sapiens
cgggttcagcctggcctgc

SEQ ID NO: 6125406 - DNA, 19 bp, Homo sapiens
cgggttctagacgcccctc

SEQ ID NO: 6125407 - DNA, 21 bp, Homo sapiens
cgggttctgcagcggcagagc

SEQ ID NO: 6125408 - DNA, 22 bp, Homo sapiens
cgggttctgcagcggcagagca

SEQ ID NO: 6125409 - DNA, 18 bp, Homo sapiens
cgggttgaaagacatcaa

SEQ ID NO: 6125410 - DNA, 21 bp, Homo sapiens
cgggttgaaagacatcaatga

SEQ ID NO: 6125411 - DNA, 15 bp, Homo sapiens
cgggttggaggcctc

SEQ ID NO: 6125412 - DNA, 19 bp, Homo sapiens
cgggttggaggcctcaccc

SEQ ID NO: 6125413 - DNA, 16 bp, Homo sapiens
cgggttgtgtgtctgt

SEQ ID NO: 6125414 - DNA, 20 bp, Homo sapiens
cggtaaaccgaggacccatg

SEQ ID NO: 6125415 - DNA, 23 bp, Homo sapiens
cggtaaccccatactctcctttt

SEQ ID NO: 6125416 - DNA, 20 bp, Homo sapiens
cggtaagtgttctcatgaag

SEQ ID NO: 6125417 - DNA, 16 bp, Homo sapiens
cggtaataagccaagg

SEQ ID NO: 6125418 - DNA, 24 bp, Homo sapiens
cggtacaagttctggcaagagcag

SEQ ID NO: 6125419 - DNA, 16 bp, Homo sapiens
cggtacacagccagta

SEQ ID NO: 6125420 - DNA, 23 bp, Homo sapiens
cggtacactacgcactggacagc

SEQ ID NO: 6125421 - DNA, 17 bp, Homo sapiens
cggtaccagcctgacta

SEQ ID NO: 6125422 - DNA, 18 bp, Homo sapiens
cggtagaggctccccagg

SEQ ID NO: 6125423 - DNA, 18 bp, Homo sapiens
cggtaggcgaccaccgcc

SEQ ID NO: 6125424 - DNA, 17 bp, Homo sapiens
cggtaggctgctggcgc

SEQ ID NO: 6125425 - DNA, 12 bp, Homo sapiens
cggtaggtgctg

SEQ ID NO: 6125426 - DNA, 17 bp, Homo sapiens
cggtatccacctgcagc

SEQ ID NO: 6125427 - DNA, 19 bp, Homo sapiens
cggtatcctccctgcccat

SEQ ID NO: 6125428 - DNA, 23 bp, Homo sapiens
cggtatctggcttccctggaagc

SEQ ID NO: 6125429 - DNA, 17 bp, Homo sapiens
cggtattatgcttcttg

SEQ ID NO: 6125430 - DNA, 15 bp, Homo sapiens
cggtcacacggccac

SEQ ID NO: 6125431 - DNA, 23 bp, Homo sapiens
cggtcaccgagacggctggacct

SEQ ID NO: 6125432 - DNA, 21 bp, Homo sapiens
cggtcacctgtgctacctcta

SEQ ID NO: 6125433 - DNA, 14 bp, Homo sapiens
cggtcacctgttgg

SEQ ID NO: 6125434 - DNA, 16 bp, Homo sapiens
cggtcagaggagcgca

SEQ ID NO: 6125435 - DNA, 18 bp, Homo sapiens
cggtcagaggagcgcagg

SEQ ID NO: 6125436 - DNA, 13 bp, Homo sapiens
cggtcagccaagt

SEQ ID NO: 6125437 - DNA, 20 bp, Homo sapiens
cggtcaggctgggcagcccc

SEQ ID NO: 6125438 - DNA, 14 bp, Homo sapiens
cggtcaggtttaac

SEQ ID NO: 6125439 - DNA, 16 bp, Homo sapiens
cggtcaggtttaacat

SEQ ID NO: 6125440 - DNA, 21 bp, Homo sapiens
cggtcaggtttaacatttgcc

SEQ ID NO: 6125441 - DNA, 14 bp, Homo sapiens
cggtcatgaaggag

SEQ ID NO: 6125442 - DNA, 17 bp, Homo sapiens
cggtcatgtgtgtattt

SEQ ID NO: 6125443 - DNA, 19 bp, Homo sapiens
cggtcattcctgtcaacaa

SEQ ID NO: 6125444 - DNA, 13 bp, Homo sapiens
cggtccaaagtta

SEQ ID NO: 6125445 - DNA, 23 bp, Homo sapiens
cggtccaatgccacctagactct

SEQ ID NO: 6125446 - DNA, 22 bp, Homo sapiens
cggtccaccccgtcccggcccc

SEQ ID NO: 6125447 - DNA, 20 bp, Homo sapiens
cggtccagaaggagcaggcc

SEQ ID NO: 6125448 - DNA, 13 bp, Homo sapiens
cggtccagctggc

SEQ ID NO: 6125449 - DNA, 21 bp, Homo sapiens
cggtccagctggcctggacag

SEQ ID NO: 6125450 - DNA, 16 bp, Homo sapiens
cggtcccacccctccc

SEQ ID NO: 6125451 - DNA, 17 bp, Homo sapiens
cggtcccagcctgggct

SEQ ID NO: 6125452 - DNA, 12 bp, Homo sapiens
cggtcccaggcc

SEQ ID NO: 6125453 - DNA, 18 bp, Homo sapiens
ctccccagccccctggca

SEQ ID NO: 6125454 - DNA, 19 bp, Homo sapiens
ctccccagcccctagccca

SEQ ID NO: 6125455 - DNA, 12 bp, Homo sapiens
ctccccagccct

SEQ ID NO: 6125456 - DNA, 12 bp, Homo sapiens
ctccccagcctg

SEQ ID NO: 6125457 - DNA, 14 bp, Homo sapiens
ctccccagcctgcg

SEQ ID NO: 6125458 - DNA, 16 bp, Homo sapiens
ctccccagcctgggcc

SEQ ID NO: 6125459 - DNA, 12 bp, Homo sapiens
ctccccagctcc

SEQ ID NO: 6125460 - DNA, 13 bp, Homo sapiens
ctccccagctccc

SEQ ID NO: 6125461 - DNA, 14 bp, Homo sapiens
ctccccagctccca

SEQ ID NO: 6125462 - DNA, 17 bp, Homo sapiens
ctccccagctcccttgg

SEQ ID NO: 6125463 - DNA, 14 bp, Homo sapiens
ctccccagctcttc

SEQ ID NO: 6125464 - DNA, 20 bp, Homo sapiens
ctccccagctcttctcttcc

SEQ ID NO: 6125465 - DNA, 22 bp, Homo sapiens
ctccccaggactcaccctcata

SEQ ID NO: 6125466 - DNA, 14 bp, Homo sapiens
ctccccaggccacc

SEQ ID NO: 6125467 - DNA, 15 bp, Homo sapiens
ctccccaggccaggc

SEQ ID NO: 6125468 - DNA, 17 bp, Homo sapiens
ctccccaggccaggcca

SEQ ID NO: 6125469 - DNA, 21 bp, Homo sapiens
ctccccaggccaggccaccag

SEQ ID NO: 6125470 - DNA, 14 bp, Homo sapiens
ctccccaggcctcc

SEQ ID NO: 6125471 - DNA, 16 bp, Homo sapiens
ctccccaggctggaga

SEQ ID NO: 6125472 - DNA, 11 bp, Homo sapiens
ctccccaggga

SEQ ID NO: 6125473 - DNA, 21 bp, Homo sapiens
ctccccagggagctctgggga

SEQ ID NO: 6125474 - DNA, 11 bp, Homo sapiens
ctccccagggc

SEQ ID NO: 6125475 - DNA, 13 bp, Homo sapiens
ctccccagggctc

SEQ ID NO: 6125476 - DNA, 18 bp, Homo sapiens
ctccccaggtccagctct

SEQ ID NO: 6125477 - DNA, 19 bp, Homo sapiens
ctccccaggtccagctctg

SEQ ID NO: 6125478 - DNA, 20 bp, Homo sapiens
ctccccaggtccagctctgg

SEQ ID NO: 6125479 - DNA, 12 bp, Homo sapiens
ctccccagtgcc

SEQ ID NO: 6125480 - DNA, 13 bp, Homo sapiens
ctccccagtgcct

SEQ ID NO: 6125481 - DNA, 15 bp, Homo sapiens
ctccccagtgcctgc

SEQ ID NO: 6125482 - DNA, 16 bp, Homo sapiens
ctccccagtgcctgcc

SEQ ID NO: 6125483 - DNA, 22 bp, Homo sapiens
ctccccagtgcctgccactctc

SEQ ID NO: 6125484 - DNA, 20 bp, Homo sapiens
ctccccagtgctacctctct

SEQ ID NO: 6125485 - DNA, 11 bp, Homo sapiens
ctccccagtgt

SEQ ID NO: 6125486 - DNA, 21 bp, Homo sapiens
ctccccagttccacagcagtg

SEQ ID NO: 6125487 - DNA, 17 bp, Homo sapiens
ctccccatacacacaca

SEQ ID NO: 6125488 - DNA, 21 bp, Homo sapiens
ctccccatacacacacaaacc

SEQ ID NO: 6125489 - DNA, 18 bp, Homo sapiens
ctccccatacttcctggg

SEQ ID NO: 6125490 - DNA, 15 bp, Homo sapiens
ctccccatatataaa

SEQ ID NO: 6125491 - DNA, 16 bp, Homo sapiens
ctccccatcaccatgg

SEQ ID NO: 6125492 - DNA, 14 bp, Homo sapiens
ctccccatcccatg

SEQ ID NO: 6125493 - DNA, 15 bp, Homo sapiens
ctccccatcccatgt

SEQ ID NO: 6125494 - DNA, 16 bp, Homo sapiens
ctccccatccccattc

SEQ ID NO: 6125495 - DNA, 21 bp, Homo sapiens
ctccccatctcggggctgctg

SEQ ID NO: 6125496 - DNA, 22 bp, Homo sapiens
ctccccatctcggggctgctgt

SEQ ID NO: 6125497 - DNA, 15 bp, Homo sapiens
ctccccatctgtcca

SEQ ID NO: 6125498 - DNA, 16 bp, Homo sapiens
ctccccatctgtccag

SEQ ID NO: 6125499 - DNA, 14 bp, Homo sapiens
ctccccatctgtgt

SEQ ID NO: 6125500 - DNA, 17 bp, Homo sapiens
ctccccatctgtgttct

SEQ ID NO: 6125501 - DNA, 15 bp, Homo sapiens
ctccccatgccacgt

SEQ ID NO: 6125502 - DNA, 14 bp, Homo sapiens
ctccccatgctggg

SEQ ID NO: 6125503 - DNA, 12 bp, Homo sapiens
ctccccatggag

SEQ ID NO: 6125504 - DNA, 15 bp, Homo sapiens
ctccccatggtgcag

SEQ ID NO: 6125505 - DNA, 16 bp, Homo sapiens
ctccccatgtgcctgc

SEQ ID NO: 6125506 - DNA, 20 bp, Homo sapiens
ctccccatgtgtcctggttc

SEQ ID NO: 6125507 - DNA, 21 bp, Homo sapiens
ctccccatgtgtcctggttcc

SEQ ID NO: 6125508 - DNA, 21 bp, Homo sapiens
ctccccattagagtcagcctt

SEQ ID NO: 6125509 - DNA, 18 bp, Homo sapiens
ctccccatttcccatctg

SEQ ID NO: 6125510 - DNA, 19 bp, Homo sapiens
ctccccattttataccaaa

SEQ ID NO: 6125511 - DNA, 21 bp, Homo sapiens
ctcccccaacagctggaccct

SEQ ID NO: 6125512 - DNA, 20 bp, Homo sapiens
ctcccccaaccaaggaagga

SEQ ID NO: 6125513 - DNA, 16 bp, Homo sapiens
ctcccccaacccacct

SEQ ID NO: 6125514 - DNA, 19 bp, Homo sapiens
ctcccccaaggccactgcg

SEQ ID NO: 6125515 - DNA, 13 bp, Homo sapiens
ctcccccacccct

SEQ ID NO: 6125516 - DNA, 13 bp, Homo sapiens
ctcccccaccctg

SEQ ID NO: 6125517 - DNA, 14 bp, Homo sapiens
ctcccccaccctgt

SEQ ID NO: 6125518 - DNA, 16 bp, Homo sapiens
ctcccccaccctgtgc

SEQ ID NO: 6125519 - DNA, 18 bp, Homo sapiens
ctcccccaccgcccactc

SEQ ID NO: 6125520 - DNA, 19 bp, Homo sapiens
ctcccccaccgcccactct

SEQ ID NO: 6125521 - DNA, 22 bp, Homo sapiens
ctcccccaccgttgtctcatgc

SEQ ID NO: 6125522 - DNA, 17 bp, Homo sapiens
ctcccccacgtctctct

SEQ ID NO: 6125523 - DNA, 19 bp, Homo sapiens
ctcccccacgtctctctgc

SEQ ID NO: 6125524 - DNA, 22 bp, Homo sapiens
ctcccccacgtctctctgcctg

SEQ ID NO: 6125525 - DNA, 23 bp, Homo sapiens
ctcccccacgtctctctgcctgc

SEQ ID NO: 6125526 - DNA, 16 bp, Homo sapiens
ctcccccactcctcta

SEQ ID NO: 6125527 - DNA, 19 bp, Homo sapiens
ctcccccactttctttctt

SEQ ID NO: 6125528 - DNA, 15 bp, Homo sapiens
ctcccccagagcccc

SEQ ID NO: 6125529 - DNA, 14 bp, Homo sapiens
ctcccccagaggtg

SEQ ID NO: 6125530 - DNA, 15 bp, Homo sapiens
ctcccccagaggtgg

SEQ ID NO: 6125531 - DNA, 21 bp, Homo sapiens
ctcccccagcaaagcccccag

SEQ ID NO: 6125532 - DNA, 22 bp, Homo sapiens
ctcccccagcaaagcccccaga

SEQ ID NO: 6125533 - DNA, 13 bp, Homo sapiens
ctcccccagccac

SEQ ID NO: 6125534 - DNA, 22 bp, Homo sapiens
ctcccccagccatgccagctgg

SEQ ID NO: 6125535 - DNA, 15 bp, Homo sapiens
ctcccccagccccat

SEQ ID NO: 6125536 - DNA, 23 bp, Homo sapiens
ctcccccaggagcagctggcact

SEQ ID NO: 6125537 - DNA, 13 bp, Homo sapiens
ctcccccaggcct

SEQ ID NO: 6125538 - DNA, 19 bp, Homo sapiens
ctcccccaggcctgagctg

SEQ ID NO: 6125539 - DNA, 22 bp, Homo sapiens
ctcccccaggctgcgcctgccc

SEQ ID NO: 6125540 - DNA, 22 bp, Homo sapiens
ctcccccagttcctcccaggaa

SEQ ID NO: 6125541 - DNA, 13 bp, Homo sapiens
ctcccccatccta

SEQ ID NO: 6125542 - DNA, 13 bp, Homo sapiens
ctcccccatctct

SEQ ID NO: 6125543 - DNA, 15 bp, Homo sapiens
ctcccccatgggctg

SEQ ID NO: 6125544 - DNA, 23 bp, Homo sapiens
ctcccccatgggggtgagaccct

SEQ ID NO: 6125545 - DNA, 14 bp, Homo sapiens
ctcccccattttaa

SEQ ID NO: 6125546 - DNA, 14 bp, Homo sapiens
ctccccccagaccc

SEQ ID NO: 6125547 - DNA, 21 bp, Homo sapiens
ctccccccagcccctcctccc

SEQ ID NO: 6125548 - DNA, 14 bp, Homo sapiens
ctccccccagtggg

SEQ ID NO: 6125549 - DNA, 18 bp, Homo sapiens
ctcccccccatgcactgt

SEQ ID NO: 6125550 - DNA, 14 bp, Homo sapiens
ctcccccccggggc

SEQ ID NO: 6125551 - DNA, 15 bp, Homo sapiens
ctcccccccggggct

SEQ ID NO: 6125552 - DNA, 19 bp, Homo sapiens
ctcccccccggggctgggt

SEQ ID NO: 6125553 - DNA, 21 bp, Homo sapiens
ctcccccccggggctgggttg

SEQ ID NO: 6125554 - DNA, 23 bp, Homo sapiens
ctcccccctcctctgaaacagct

SEQ ID NO: 6125555 - DNA, 19 bp, Homo sapiens
ctcccccgacactgctgca

SEQ ID NO: 6125556 - DNA, 15 bp, Homo sapiens
ctcccccgcagacag

SEQ ID NO: 6125557 - DNA, 13 bp, Homo sapiens
ctcccccgccacc

SEQ ID NO: 6125558 - DNA, 15 bp, Homo sapiens
ctcccccgccactcc

SEQ ID NO: 6125559 - DNA, 13 bp, Homo sapiens
ctcccccgggagg

SEQ ID NO: 6125560 - DNA, 17 bp, Homo sapiens
ctcccccgtcctggagg

SEQ ID NO: 6125561 - DNA, 14 bp, Homo sapiens
ctccccctcagatg

SEQ ID NO: 6125562 - DNA, 13 bp, Homo sapiens
ctccccctcagct

SEQ ID NO: 6125563 - DNA, 23 bp, Homo sapiens
ctccccctcagctctccctcaca

SEQ ID NO: 6125564 - DNA, 14 bp, Homo sapiens
ctccccctccccag

SEQ ID NO: 6125565 - DNA, 15 bp, Homo sapiens
ctccccctccccagg

SEQ ID NO: 6125566 - DNA, 16 bp, Homo sapiens
ctccccctcctccagg

SEQ ID NO: 6125567 - DNA, 14 bp, Homo sapiens
ctccccctcctgct

SEQ ID NO: 6125568 - DNA, 16 bp, Homo sapiens
ctccccctcctgctgt

SEQ ID NO: 6125569 - DNA, 16 bp, Homo sapiens
ctccccctctgcttct

SEQ ID NO: 6125570 - DNA, 17 bp, Homo sapiens
ctccccctctgcttctc

SEQ ID NO: 6125571 - DNA, 13 bp, Homo sapiens
ctccccctgcaac

SEQ ID NO: 6125572 - DNA, 13 bp, Homo sapiens
ctccccctgccag

SEQ ID NO: 6125573 - DNA, 22 bp, Homo sapiens
ctccccctgccagaggcctggt

SEQ ID NO: 6125574 - DNA, 14 bp, Homo sapiens
ctccccctgccagc

SEQ ID NO: 6125575 - DNA, 15 bp, Homo sapiens
ctccccctgccagca

SEQ ID NO: 6125576 - DNA, 13 bp, Homo sapiens
ctccccctggacg

SEQ ID NO: 6125577 - DNA, 13 bp, Homo sapiens
ctccccctgggct

SEQ ID NO: 6125578 - DNA, 12 bp, Homo sapiens
ctccccctgtcc

SEQ ID NO: 6125579 - DNA, 18 bp, Homo sapiens
ctcccccttcccttggag

SEQ ID NO: 6125580 - DNA, 11 bp, Homo sapiens
ctcccccttct

SEQ ID NO: 6125581 - DNA, 12 bp, Homo sapiens
ctcccccttgtc

SEQ ID NO: 6125582 - DNA, 18 bp, Homo sapiens
ctcccccttgtcttcccc

SEQ ID NO: 6125583 - DNA, 22 bp, Homo sapiens
ctccccctttcacactggatcc

SEQ ID NO: 6125584 - DNA, 13 bp, Homo sapiens
ctccccctttggg

SEQ ID NO: 6125585 - DNA, 14 bp, Homo sapiens
ctccccgaggctgc

SEQ ID NO: 6125586 - DNA, 19 bp, Homo sapiens
ctccccgaggctgccccag

SEQ ID NO: 6125587 - DNA, 20 bp, Homo sapiens
ctccccgagggctcagaaga

SEQ ID NO: 6125588 - DNA, 17 bp, Homo sapiens
ctccccgataaagaatg

SEQ ID NO: 6125589 - DNA, 17 bp, Homo sapiens
ctccccgatccccgaca

SEQ ID NO: 6125590 - DNA, 24 bp, Homo sapiens
ctccccgatccccgacagtggctc

SEQ ID NO: 6125591 - DNA, 15 bp, Homo sapiens
ctccccgcagagctc

SEQ ID NO: 6125592 - DNA, 16 bp, Homo sapiens
ctccccgcagagctcc

SEQ ID NO: 6125593 - DNA, 21 bp, Homo sapiens
ctccccgcagagctcccttcc

SEQ ID NO: 6125594 - DNA, 22 bp, Homo sapiens
ctccccgcagcccgcctgccgt

SEQ ID NO: 6125595 - DNA, 19 bp, Homo sapiens
ctccccgcagccctctcca

SEQ ID NO: 6125596 - DNA, 15 bp, Homo sapiens
ctccccgccccctga

SEQ ID NO: 6125597 - DNA, 18 bp, Homo sapiens
ctccccgccccctgaaac

SEQ ID NO: 6125598 - DNA, 14 bp, Homo sapiens
ctccccgcctccac

SEQ ID NO: 6125599 - DNA, 15 bp, Homo sapiens
ctccccgcctccact

SEQ ID NO: 6125600 - DNA, 20 bp, Homo sapiens
ctccccgcctccactctagt

SEQ ID NO: 6125601 - DNA, 17 bp, Homo sapiens
ctccccgcctcctccct

SEQ ID NO: 6125602 - DNA, 19 bp, Homo sapiens
ctccccgcctcctccctgc

SEQ ID NO: 6125603 - DNA, 20 bp, Homo sapiens
ctccccgcctggccagggca

SEQ ID NO: 6125604 - DNA, 18 bp, Homo sapiens
ctccccgcctgttccccc

SEQ ID NO: 6125605 - DNA, 19 bp, Homo sapiens
ctccccgccttagagcctc

SEQ ID NO: 6125606 - DNA, 20 bp, Homo sapiens
ctccccgccttagagcctcg

SEQ ID NO: 6125607 - DNA, 18 bp, Homo sapiens
ctccccgcgccccagtca

SEQ ID NO: 6125608 - DNA, 14 bp, Homo sapiens
ctccccgctcaggg

SEQ ID NO: 6125609 - DNA, 18 bp, Homo sapiens
ctccccgctccgtctctg

SEQ ID NO: 6125610 - DNA, 20 bp, Homo sapiens
ctccccgctccgtctctgtc

SEQ ID NO: 6125611 - DNA, 18 bp, Homo sapiens
ctccccgctctccctgtc

SEQ ID NO: 6125612 - DNA, 18 bp, Homo sapiens
ctccccggacaagcccag

SEQ ID NO: 6125613 - DNA, 20 bp, Homo sapiens
ctccccggacatactctctg

SEQ ID NO: 6125614 - DNA, 15 bp, Homo sapiens
ctccccggcaccctc

SEQ ID NO: 6125615 - DNA, 22 bp, Homo sapiens
ctccccggcaggcctgagaatg

SEQ ID NO: 6125616 - DNA, 23 bp, Homo sapiens
ctccccggcatgagactcagtgc

SEQ ID NO: 6125617 - DNA, 13 bp, Homo sapiens
ctccccggccaca

SEQ ID NO: 6125618 - DNA, 14 bp, Homo sapiens
ctccccggccctac

SEQ ID NO: 6125619 - DNA, 21 bp, Homo sapiens
ctccccggcggtgccgcgctc

SEQ ID NO: 6125620 - DNA, 16 bp, Homo sapiens
ctccccgggcagcaga

SEQ ID NO: 6125621 - DNA, 17 bp, Homo sapiens
ctccccgggcagcagag

SEQ ID NO: 6125622 - DNA, 21 bp, Homo sapiens
ctccccgggcagcagagagag

SEQ ID NO: 6125623 - DNA, 13 bp, Homo sapiens
ctccccgggggcc

SEQ ID NO: 6125624 - DNA, 14 bp, Homo sapiens
ctccccgtccctgt

SEQ ID NO: 6125625 - DNA, 15 bp, Homo sapiens
ctccccgtccctgtc

SEQ ID NO: 6125626 - DNA, 20 bp, Homo sapiens
ctcccctaaagccaggctca

SEQ ID NO: 6125627 - DNA, 21 bp, Homo sapiens
ctcccctaaagccaggctcag

SEQ ID NO: 6125628 - DNA, 22 bp, Homo sapiens
ctcccctaaagccaggctcagg

SEQ ID NO: 6125629 - DNA, 16 bp, Homo sapiens
ctcccctaaagcctca

SEQ ID NO: 6125630 - DNA, 23 bp, Homo sapiens
ctcccctaaagcctcaaaacaaa

SEQ ID NO: 6125631 - DNA, 18 bp, Homo sapiens
ctcccctaaccctacttt

SEQ ID NO: 6125632 - DNA, 12 bp, Homo sapiens
ctcccctagctc

SEQ ID NO: 6125633 - DNA, 23 bp, Homo sapiens
ctcccctatccacccagcccatt

SEQ ID NO: 6125634 - DNA, 22 bp, Homo sapiens
cggtcccaggccgcatggcccc

SEQ ID NO: 6125635 - DNA, 21 bp, Homo sapiens
cggtcccagttttgttgcccc

SEQ ID NO: 6125636 - DNA, 22 bp, Homo sapiens
cggtccccacagactgccccag

SEQ ID NO: 6125637 - DNA, 23 bp, Homo sapiens
cggtccccatccccaccagctcg

SEQ ID NO: 6125638 - DNA, 21 bp, Homo sapiens
cggtcccccagagcatctgcc

SEQ ID NO: 6125639 - DNA, 18 bp, Homo sapiens
cggtcccccatgccacca

SEQ ID NO: 6125640 - DNA, 18 bp, Homo sapiens
cggtcccctccgccaggc

SEQ ID NO: 6125641 - DNA, 20 bp, Homo sapiens
cggtcccctctgccccaccc

SEQ ID NO: 6125642 - DNA, 21 bp, Homo sapiens
cggtcccttgagacctcagcc

SEQ ID NO: 6125643 - DNA, 23 bp, Homo sapiens
cggtcccttgagacctcagccat

SEQ ID NO: 6125644 - DNA, 22 bp, Homo sapiens
cggtccgcccgcttccctcctt

SEQ ID NO: 6125645 - DNA, 15 bp, Homo sapiens
cggtccgcggcctgc

SEQ ID NO: 6125646 - DNA, 14 bp, Homo sapiens
cggtcctgcacaga

SEQ ID NO: 6125647 - DNA, 21 bp, Homo sapiens
cggtcctggccccagccccca

SEQ ID NO: 6125648 - DNA, 16 bp, Homo sapiens
cggtcctgggcgcttc

SEQ ID NO: 6125649 - DNA, 19 bp, Homo sapiens
cggtcctttaggcagcctg

SEQ ID NO: 6125650 - DNA, 20 bp, Homo sapiens
cggtcctttaggcagcctgc

SEQ ID NO: 6125651 - DNA, 21 bp, Homo sapiens
cggtcctttaggcagcctgcc

SEQ ID NO: 6125652 - DNA, 23 bp, Homo sapiens
cggtcgggggggaccctccaagg

SEQ ID NO: 6125653 - DNA, 21 bp, Homo sapiens
cggtctaaagtgagctctatg

SEQ ID NO: 6125654 - DNA, 21 bp, Homo sapiens
cggtctaggtgggagagagtg

SEQ ID NO: 6125655 - DNA, 11 bp, Homo sapiens
cggtctcaggc

SEQ ID NO: 6125656 - DNA, 16 bp, Homo sapiens
cggtctccaccccagg

SEQ ID NO: 6125657 - DNA, 17 bp, Homo sapiens
cggtctccaccccaggg

SEQ ID NO: 6125658 - DNA, 19 bp, Homo sapiens
cggtctcccaaagtgctgg

SEQ ID NO: 6125659 - DNA, 18 bp, Homo sapiens
cggtctcccttccgtcca

SEQ ID NO: 6125660 - DNA, 19 bp, Homo sapiens
cggtctgcaagtcagagga

SEQ ID NO: 6125661 - DNA, 21 bp, Homo sapiens
cggtcttcaacatcctgccag

SEQ ID NO: 6125662 - DNA, 21 bp, Homo sapiens
cggtgaaagtgctgctctagg

SEQ ID NO: 6125663 - DNA, 18 bp, Homo sapiens
cggtgaaggtgacagcag

SEQ ID NO: 6125664 - DNA, 18 bp, Homo sapiens
cggtgaatggctttgtat

SEQ ID NO: 6125665 - DNA, 22 bp, Homo sapiens
cggtgaatggctttgtatagaa

SEQ ID NO: 6125666 - DNA, 14 bp, Homo sapiens
cggtgacacaggtc

SEQ ID NO: 6125667 - DNA, 19 bp, Homo sapiens
cggtgacacaggtcagggc

SEQ ID NO: 6125668 - DNA, 23 bp, Homo sapiens
cggtgacacaggtcagggctcag

SEQ ID NO: 6125669 - DNA, 15 bp, Homo sapiens
cggtgacacatccat

SEQ ID NO: 6125670 - DNA, 21 bp, Homo sapiens
cggtgacctccgtcctctccc

SEQ ID NO: 6125671 - DNA, 19 bp, Homo sapiens
cggtgacctctagccctgc

SEQ ID NO: 6125672 - DNA, 14 bp, Homo sapiens
cggtgagactctga

SEQ ID NO: 6125673 - DNA, 20 bp, Homo sapiens
cggtgagaggggaacagact

SEQ ID NO: 6125674 - DNA, 17 bp, Homo sapiens
cggtgagctacaaatgc

SEQ ID NO: 6125675 - DNA, 12 bp, Homo sapiens
cggtgaggcagg

SEQ ID NO: 6125676 - DNA, 13 bp, Homo sapiens
cggtgaggggagg

SEQ ID NO: 6125677 - DNA, 17 bp, Homo sapiens
cggtgaggtgggggcag

SEQ ID NO: 6125678 - DNA, 17 bp, Homo sapiens
cggtgatcagcagagag

SEQ ID NO: 6125679 - DNA, 14 bp, Homo sapiens
cggtgcaacagaag

SEQ ID NO: 6125680 - DNA, 15 bp, Homo sapiens
cggtgcacaggcctc

SEQ ID NO: 6125681 - DNA, 21 bp, Homo sapiens
cggtgcacaggcctctgcctg

SEQ ID NO: 6125682 - DNA, 19 bp, Homo sapiens
cggtgcagagtgcagaggc

SEQ ID NO: 6125683 - DNA, 17 bp, Homo sapiens
cggtgcagcggtggaag

SEQ ID NO: 6125684 - DNA, 22 bp, Homo sapiens
cggtgcagcggtggaaggagcc

SEQ ID NO: 6125685 - DNA, 10 bp, Homo sapiens
cggtgcagct

SEQ ID NO: 6125686 - DNA, 16 bp, Homo sapiens
cggtgcagggcctggc

SEQ ID NO: 6125687 - DNA, 22 bp, Homo sapiens
cggtgcatccacgcacacatgg

SEQ ID NO: 6125688 - DNA, 14 bp, Homo sapiens
cggtgcatctggca

SEQ ID NO: 6125689 - DNA, 15 bp, Homo sapiens
cggtgccagctgccc

SEQ ID NO: 6125690 - DNA, 12 bp, Homo sapiens
cggtgccatctt

SEQ ID NO: 6125691 - DNA, 19 bp, Homo sapiens
cggtgccatgtctgcagtg

SEQ ID NO: 6125692 - DNA, 18 bp, Homo sapiens
cggtgcccaagccagagg

SEQ ID NO: 6125693 - DNA, 15 bp, Homo sapiens
cggtgccgcgctccg

SEQ ID NO: 6125694 - DNA, 15 bp, Homo sapiens
cggtgcctccgaggt

SEQ ID NO: 6125695 - DNA, 15 bp, Homo sapiens
cggtgccttccaccc

SEQ ID NO: 6125696 - DNA, 18 bp, Homo sapiens
cggtgccttccaccctgc

SEQ ID NO: 6125697 - DNA, 21 bp, Homo sapiens
cggtgcctttatttccactgt

SEQ ID NO: 6125698 - DNA, 19 bp, Homo sapiens
cggtgcgtggctgtggcac

SEQ ID NO: 6125699 - DNA, 17 bp, Homo sapiens
cggtgctagcttgacac

SEQ ID NO: 6125700 - DNA, 21 bp, Homo sapiens
cggtgctatatccagttcctg

SEQ ID NO: 6125701 - DNA, 22 bp, Homo sapiens
cggtgctatatccagttcctgc

SEQ ID NO: 6125702 - DNA, 21 bp, Homo sapiens
cggtgctatctcccccagccc

SEQ ID NO: 6125703 - DNA, 21 bp, Homo sapiens
cggtgctatttctattcctta

SEQ ID NO: 6125704 - DNA, 22 bp, Homo sapiens
cggtgctatttctattccttat

SEQ ID NO: 6125705 - DNA, 22 bp, Homo sapiens
cggtgctccatctccgcctcca

SEQ ID NO: 6125706 - DNA, 20 bp, Homo sapiens
cggtgctcgcttctcctcca

SEQ ID NO: 6125707 - DNA, 11 bp, Homo sapiens
cggtgctctgg

SEQ ID NO: 6125708 - DNA, 14 bp, Homo sapiens
cggtgctctggcgg

SEQ ID NO: 6125709 - DNA, 14 bp, Homo sapiens
cggtgctgactgag

SEQ ID NO: 6125710 - DNA, 19 bp, Homo sapiens
cggtgctgactgaggcctg

SEQ ID NO: 6125711 - DNA, 15 bp, Homo sapiens
cggtgctgcaggagt

SEQ ID NO: 6125712 - DNA, 16 bp, Homo sapiens
cggtgctgcaggagtg

SEQ ID NO: 6125713 - DNA, 22 bp, Homo sapiens
cggtgctgggttcccactcccg

SEQ ID NO: 6125714 - DNA, 16 bp, Homo sapiens
cggtgctgtgagggag

SEQ ID NO: 6125715 - DNA, 23 bp, Homo sapiens
cggtgcttccctttcactgaagt

SEQ ID NO: 6125716 - DNA, 15 bp, Homo sapiens
cggtggaaggagcct

SEQ ID NO: 6125717 - DNA, 16 bp, Homo sapiens
cggtggaaggagcctg

SEQ ID NO: 6125718 - DNA, 17 bp, Homo sapiens
cggtggaaggagcctgc

SEQ ID NO: 6125719 - DNA, 14 bp, Homo sapiens
cggtggaccaaagg

SEQ ID NO: 6125720 - DNA, 22 bp, Homo sapiens
cggtggagaagatcgcatggca

SEQ ID NO: 6125721 - DNA, 12 bp, Homo sapiens
cggtggaggaag

SEQ ID NO: 6125722 - DNA, 13 bp, Homo sapiens
cggtggaggccag

SEQ ID NO: 6125723 - DNA, 13 bp, Homo sapiens
cggtggcagtgga

SEQ ID NO: 6125724 - DNA, 17 bp, Homo sapiens
cggtggcatttgctgaa

SEQ ID NO: 6125725 - DNA, 12 bp, Homo sapiens
cggtggccatgc

SEQ ID NO: 6125726 - DNA, 15 bp, Homo sapiens
cggtggccatgcttc

SEQ ID NO: 6125727 - DNA, 11 bp, Homo sapiens
cggtggcctct

SEQ ID NO: 6125728 - DNA, 13 bp, Homo sapiens
cggtggcggcagg

SEQ ID NO: 6125729 - DNA, 20 bp, Homo sapiens
cggtggcggctgcacaacag

SEQ ID NO: 6125730 - DNA, 20 bp, Homo sapiens
cggtggctagtcaagctcct

SEQ ID NO: 6125731 - DNA, 21 bp, Homo sapiens
cggtggctagtcaagctcctc

SEQ ID NO: 6125732 - DNA, 11 bp, Homo sapiens
cggtggctcac

SEQ ID NO: 6125733 - DNA, 20 bp, Homo sapiens
cggtggctcacgcctgtaat

SEQ ID NO: 6125734 - DNA, 20 bp, Homo sapiens
cggtggctcatgcctgtaat

SEQ ID NO: 6125735 - DNA, 16 bp, Homo sapiens
cggtggctctggggta

SEQ ID NO: 6125736 - DNA, 20 bp, Homo sapiens
cggtggctgacacctgtaat

SEQ ID NO: 6125737 - DNA, 16 bp, Homo sapiens
cggtggctgccccggc

SEQ ID NO: 6125738 - DNA, 12 bp, Homo sapiens
cggtggctgggc

SEQ ID NO: 6125739 - DNA, 21 bp, Homo sapiens
cggtggctgggcagagctgca

SEQ ID NO: 6125740 - DNA, 20 bp, Homo sapiens
cggtgggaaggaaaggcaga

SEQ ID NO: 6125741 - DNA, 14 bp, Homo sapiens
cggtgggacagccc

SEQ ID NO: 6125742 - DNA, 15 bp, Homo sapiens
cggtgggacagcccc

SEQ ID NO: 6125743 - DNA, 19 bp, Homo sapiens
cggtgggacagccccaggg

SEQ ID NO: 6125744 - DNA, 19 bp, Homo sapiens
cggtgggcacccaccctgg

SEQ ID NO: 6125745 - DNA, 15 bp, Homo sapiens
cggtgggcagccatg

SEQ ID NO: 6125746 - DNA, 18 bp, Homo sapiens
cggtgggccttgctgggg

SEQ ID NO: 6125747 - DNA, 16 bp, Homo sapiens
cggtgggcgcctgtcg

SEQ ID NO: 6125748 - DNA, 17 bp, Homo sapiens
cggtggggccagcgctg

SEQ ID NO: 6125749 - DNA, 19 bp, Homo sapiens
cggtggggggatgagatta

SEQ ID NO: 6125750 - DNA, 23 bp, Homo sapiens
cggtgggggggagaaggcctccc

SEQ ID NO: 6125751 - DNA, 19 bp, Homo sapiens
cggtgggtccgcatccctg

SEQ ID NO: 6125752 - DNA, 17 bp, Homo sapiens
cggtggtaccaggtctc

SEQ ID NO: 6125753 - DNA, 15 bp, Homo sapiens
cggtggttcttcctg

SEQ ID NO: 6125754 - DNA, 20 bp, Homo sapiens
cggtggtttgccatgtcgct

SEQ ID NO: 6125755 - DNA, 14 bp, Homo sapiens
cggtgtaaaaccat

SEQ ID NO: 6125756 - DNA, 17 bp, Homo sapiens
cggtgtatcctggccct

SEQ ID NO: 6125757 - DNA, 21 bp, Homo sapiens
cggtgtatcctggccctgggg

SEQ ID NO: 6125758 - DNA, 22 bp, Homo sapiens
cggtgtatcctggccctggggg

SEQ ID NO: 6125759 - DNA, 17 bp, Homo sapiens
cggtgtcaggtcccagc

SEQ ID NO: 6125760 - DNA, 20 bp, Homo sapiens
cggtgtccaccatccccagc

SEQ ID NO: 6125761 - DNA, 18 bp, Homo sapiens
cggtgtctggaaaagcac

SEQ ID NO: 6125762 - DNA, 20 bp, Homo sapiens
cggtgtctggaaaagcactt

SEQ ID NO: 6125763 - DNA, 17 bp, Homo sapiens
cggtgtgcctgcagccc

SEQ ID NO: 6125764 - DNA, 20 bp, Homo sapiens
cggtgtgcctgcagccccgc

SEQ ID NO: 6125765 - DNA, 16 bp, Homo sapiens
cggtgtggaccgagga

SEQ ID NO: 6125766 - DNA, 13 bp, Homo sapiens
cggtgtggagaag

SEQ ID NO: 6125767 - DNA, 16 bp, Homo sapiens
cggtgtgggctgtgtc

SEQ ID NO: 6125768 - DNA, 13 bp, Homo sapiens
cggtgtggggggt

SEQ ID NO: 6125769 - DNA, 21 bp, Homo sapiens
cggtgtggggggtgccccaca

SEQ ID NO: 6125770 - DNA, 20 bp, Homo sapiens
cggtgtgtggccgcctggca

SEQ ID NO: 6125771 - DNA, 15 bp, Homo sapiens
cggtgttacttccct

SEQ ID NO: 6125772 - DNA, 23 bp, Homo sapiens
cggtgtttaagacatttttggaa

SEQ ID NO: 6125773 - DNA, 18 bp, Homo sapiens
cggtgtttggaggctgct

SEQ ID NO: 6125774 - DNA, 20 bp, Homo sapiens
cggtgtttggaggctgctgc

SEQ ID NO: 6125775 - DNA, 19 bp, Homo sapiens
cggttaacaaataacaact

SEQ ID NO: 6125776 - DNA, 18 bp, Homo sapiens
cggttataaaaaatggtt

SEQ ID NO: 6125777 - DNA, 21 bp, Homo sapiens
cggttataaaaaatggttcag

SEQ ID NO: 6125778 - DNA, 14 bp, Homo sapiens
cggttatttaagca

SEQ ID NO: 6125779 - DNA, 20 bp, Homo sapiens
cggttcaaggtcactgtttc

SEQ ID NO: 6125780 - DNA, 14 bp, Homo sapiens
cggttcaccagcct

SEQ ID NO: 6125781 - DNA, 17 bp, Homo sapiens
cggttcagacccctgcc

SEQ ID NO: 6125782 - DNA, 17 bp, Homo sapiens
cggttcaggtcagggct

SEQ ID NO: 6125783 - DNA, 18 bp, Homo sapiens
cggttccacgtccccctg

SEQ ID NO: 6125784 - DNA, 14 bp, Homo sapiens
cggttccagacact

SEQ ID NO: 6125785 - DNA, 19 bp, Homo sapiens
cggttcccacaagcctgcc

SEQ ID NO: 6125786 - DNA, 20 bp, Homo sapiens
cggttccctccccagctcct

SEQ ID NO: 6125787 - DNA, 18 bp, Homo sapiens
cggttcctcatctgagag

SEQ ID NO: 6125788 - DNA, 21 bp, Homo sapiens
cggttcctcgttctccctggg

SEQ ID NO: 6125789 - DNA, 13 bp, Homo sapiens
cggttgcagggct

SEQ ID NO: 6125790 - DNA, 16 bp, Homo sapiens
cggttgcagtcactgt

SEQ ID NO: 6125791 - DNA, 21 bp, Homo sapiens
cggttggagcgagcatccccc

SEQ ID NO: 6125792 - DNA, 14 bp, Homo sapiens
cggttgggaggcag

SEQ ID NO: 6125793 - DNA, 15 bp, Homo sapiens
cggttgggaggcagg

SEQ ID NO: 6125794 - DNA, 14 bp, Homo sapiens
cggttgttctttcc

SEQ ID NO: 6125795 - DNA, 23 bp, Homo sapiens
cggttgttgatattgtttgctgt

SEQ ID NO: 6125796 - DNA, 21 bp, Homo sapiens
cggtttaaccacattaattaa

SEQ ID NO: 6125797 - DNA, 18 bp, Homo sapiens
cggtttagtcatccaaca

SEQ ID NO: 6125798 - DNA, 20 bp, Homo sapiens
cggtttatcgccctggcagg

SEQ ID NO: 6125799 - DNA, 22 bp, Homo sapiens
cggtttatcgccctggcaggca

SEQ ID NO: 6125800 - DNA, 19 bp, Homo sapiens
cggtttcaaaccaggattt

SEQ ID NO: 6125801 - DNA, 13 bp, Homo sapiens
cggtttcagaagc

SEQ ID NO: 6125802 - DNA, 15 bp, Homo sapiens
cggtttccaggaaga

SEQ ID NO: 6125803 - DNA, 16 bp, Homo sapiens
cggtttcccggccctt

SEQ ID NO: 6125804 - DNA, 18 bp, Homo sapiens
cggtttccgtggcaaccc

SEQ ID NO: 6125805 - DNA, 18 bp, Homo sapiens
cggtttcgaagtcattaa

SEQ ID NO: 6125806 - DNA, 11 bp, Homo sapiens
cggtttctcca

SEQ ID NO: 6125807 - DNA, 20 bp, Homo sapiens
cggtttctgagcataatgct

SEQ ID NO: 6125808 - DNA, 18 bp, Homo sapiens
cggtttctttgttacttt

SEQ ID NO: 6125809 - DNA, 13 bp, Homo sapiens
cggtttcttttta

SEQ ID NO: 6125810 - DNA, 16 bp, Homo sapiens
cggtttctttttaagt

SEQ ID NO: 6125811 - DNA, 14 bp, Homo sapiens
ctcccctattttaa

SEQ ID NO: 6125812 - DNA, 18 bp, Homo sapiens
ctcccctcaaagtctgca

SEQ ID NO: 6125813 - DNA, 21 bp, Homo sapiens
ctcccctcaaccgcacatgtg

SEQ ID NO: 6125814 - DNA, 21 bp, Homo sapiens
ctcccctcaagaaattttcaa

SEQ ID NO: 6125815 - DNA, 17 bp, Homo sapiens
ctcccctcacagcctct

SEQ ID NO: 6125816 - DNA, 19 bp, Homo sapiens
ctcccctcacagcctctga

SEQ ID NO: 6125817 - DNA, 16 bp, Homo sapiens
ctcccctcacatcctc

SEQ ID NO: 6125818 - DNA, 23 bp, Homo sapiens
ctcccctcacccgctgcccagcc

SEQ ID NO: 6125819 - DNA, 13 bp, Homo sapiens
ctcccctcagagc

SEQ ID NO: 6125820 - DNA, 14 bp, Homo sapiens
ctcccctcagagcc

SEQ ID NO: 6125821 - DNA, 15 bp, Homo sapiens
ctcccctcagcctct

SEQ ID NO: 6125822 - DNA, 21 bp, Homo sapiens
ctcccctcagcctctcccctg

SEQ ID NO: 6125823 - DNA, 14 bp, Homo sapiens
ctcccctcagcctg

SEQ ID NO: 6125824 - DNA, 15 bp, Homo sapiens
ctcccctcagcctgc

SEQ ID NO: 6125825 - DNA, 15 bp, Homo sapiens
ctcccctcagcgcag

SEQ ID NO: 6125826 - DNA, 16 bp, Homo sapiens
ctcccctcagcgcagg

SEQ ID NO: 6125827 - DNA, 19 bp, Homo sapiens
ctcccctcagcgcaggctg

SEQ ID NO: 6125828 - DNA, 12 bp, Homo sapiens
ctcccctccaca

SEQ ID NO: 6125829 - DNA, 15 bp, Homo sapiens
ctcccctccagaccc

SEQ ID NO: 6125830 - DNA, 16 bp, Homo sapiens
ctcccctccagacccc

SEQ ID NO: 6125831 - DNA, 12 bp, Homo sapiens
ctcccctccagc

SEQ ID NO: 6125832 - DNA, 13 bp, Homo sapiens
ctcccctccagct

SEQ ID NO: 6125833 - DNA, 19 bp, Homo sapiens
ctcccctccatccctggcc

SEQ ID NO: 6125834 - DNA, 13 bp, Homo sapiens
ctcccctcccacc

SEQ ID NO: 6125835 - DNA, 20 bp, Homo sapiens
ctcccctcccacccacagcc

SEQ ID NO: 6125836 - DNA, 13 bp, Homo sapiens
ctcccctcccagt

SEQ ID NO: 6125837 - DNA, 22 bp, Homo sapiens
ctcccctcccagtcctccagac

SEQ ID NO: 6125838 - DNA, 15 bp, Homo sapiens
ctcccctccccaact

SEQ ID NO: 6125839 - DNA, 16 bp, Homo sapiens
ctcccctccccaactg

SEQ ID NO: 6125840 - DNA, 16 bp, Homo sapiens
ctcccctccccatctg

SEQ ID NO: 6125841 - DNA, 20 bp, Homo sapiens
ctcccctccccatctgtgtt

SEQ ID NO: 6125842 - DNA, 14 bp, Homo sapiens
ctcccctcccctgc

SEQ ID NO: 6125843 - DNA, 16 bp, Homo sapiens
ctcccctcccctgctg

SEQ ID NO: 6125844 - DNA, 16 bp, Homo sapiens
ctcccctcccctgggg

SEQ ID NO: 6125845 - DNA, 16 bp, Homo sapiens
ctcccctccctcttcc

SEQ ID NO: 6125846 - DNA, 19 bp, Homo sapiens
ctcccctccctcttccttc

SEQ ID NO: 6125847 - DNA, 13 bp, Homo sapiens
ctcccctcctcta

SEQ ID NO: 6125848 - DNA, 16 bp, Homo sapiens
ctcccctcctctcctg

SEQ ID NO: 6125849 - DNA, 16 bp, Homo sapiens
ctcccctcctcttccc

SEQ ID NO: 6125850 - DNA, 12 bp, Homo sapiens
ctcccctcctgc

SEQ ID NO: 6125851 - DNA, 14 bp, Homo sapiens
ctcccctcctgcac

SEQ ID NO: 6125852 - DNA, 17 bp, Homo sapiens
ctcccctcctgcacaca

SEQ ID NO: 6125853 - DNA, 16 bp, Homo sapiens
ctcccctcctgctggg

SEQ ID NO: 6125854 - DNA, 15 bp, Homo sapiens
ctcccctccttgcct

SEQ ID NO: 6125855 - DNA, 13 bp, Homo sapiens
ctcccctccttgt

SEQ ID NO: 6125856 - DNA, 13 bp, Homo sapiens
ctcccctccttta

SEQ ID NO: 6125857 - DNA, 20 bp, Homo sapiens
ctcccctcgacagctctctg

SEQ ID NO: 6125858 - DNA, 14 bp, Homo sapiens
ctcccctctcagca

SEQ ID NO: 6125859 - DNA, 15 bp, Homo sapiens
ctcccctctcccagg

SEQ ID NO: 6125860 - DNA, 16 bp, Homo sapiens
ctcccctctcctccgc

SEQ ID NO: 6125861 - DNA, 15 bp, Homo sapiens
ctcccctctcctgag

SEQ ID NO: 6125862 - DNA, 16 bp, Homo sapiens
ctcccctctccttcct

SEQ ID NO: 6125863 - DNA, 19 bp, Homo sapiens
ctcccctctcgccccatcc

SEQ ID NO: 6125864 - DNA, 13 bp, Homo sapiens
ctcccctctgctg

SEQ ID NO: 6125865 - DNA, 16 bp, Homo sapiens
ctcccctctgctggcc

SEQ ID NO: 6125866 - DNA, 16 bp, Homo sapiens
ctcccctcttcctctt

SEQ ID NO: 6125867 - DNA, 17 bp, Homo sapiens
ctcccctcttcctcttg

SEQ ID NO: 6125868 - DNA, 14 bp, Homo sapiens
ctcccctcttctga

SEQ ID NO: 6125869 - DNA, 18 bp, Homo sapiens
ctcccctcttctgagcta

SEQ ID NO: 6125870 - DNA, 19 bp, Homo sapiens
ctcccctcttcttgcggca

SEQ ID NO: 6125871 - DNA, 11 bp, Homo sapiens
ctcccctgagg

SEQ ID NO: 6125872 - DNA, 13 bp, Homo sapiens
ctcccctgaggct

SEQ ID NO: 6125873 - DNA, 15 bp, Homo sapiens
ctcccctgaggctgg

SEQ ID NO: 6125874 - DNA, 12 bp, Homo sapiens
ctcccctgcact

SEQ ID NO: 6125875 - DNA, 13 bp, Homo sapiens
ctcccctgcactg

SEQ ID NO: 6125876 - DNA, 14 bp, Homo sapiens
ctcccctgcactgt

SEQ ID NO: 6125877 - DNA, 17 bp, Homo sapiens
ctcccctgcactgtaaa

SEQ ID NO: 6125878 - DNA, 18 bp, Homo sapiens
ctcccctgcactgtaaaa

SEQ ID NO: 6125879 - DNA, 18 bp, Homo sapiens
ctcccctgccaccaggcc

SEQ ID NO: 6125880 - DNA, 14 bp, Homo sapiens
ctcccctgccaggg

SEQ ID NO: 6125881 - DNA, 16 bp, Homo sapiens
ctcccctgccagggca

SEQ ID NO: 6125882 - DNA, 21 bp, Homo sapiens
ctcccctgccagggcagggcc

SEQ ID NO: 6125883 - DNA, 16 bp, Homo sapiens
ctcccctgccagggct

SEQ ID NO: 6125884 - DNA, 13 bp, Homo sapiens
ctcccctgccccc

SEQ ID NO: 6125885 - DNA, 19 bp, Homo sapiens
ctcccctgcccccaggact

SEQ ID NO: 6125886 - DNA, 20 bp, Homo sapiens
ctcccctgcccccaggactg

SEQ ID NO: 6125887 - DNA, 22 bp, Homo sapiens
ctcccctgcccccatcccacat

SEQ ID NO: 6125888 - DNA, 18 bp, Homo sapiens
ctcccctgccccctgcag

SEQ ID NO: 6125889 - DNA, 19 bp, Homo sapiens
ctcccctgccccctgcagg

SEQ ID NO: 6125890 - DNA, 13 bp, Homo sapiens
ctcccctgccctc

SEQ ID NO: 6125891 - DNA, 15 bp, Homo sapiens
ctcccctgcccttcc

SEQ ID NO: 6125892 - DNA, 12 bp, Homo sapiens
ctcccctgcctt

SEQ ID NO: 6125893 - DNA, 21 bp, Homo sapiens
ctcccctgccttaacctggga

SEQ ID NO: 6125894 - DNA, 13 bp, Homo sapiens
ctcccctgccttg

SEQ ID NO: 6125895 - DNA, 23 bp, Homo sapiens
ctcccctgcggagctgcatggac

SEQ ID NO: 6125896 - DNA, 14 bp, Homo sapiens
ctcccctgctcaga

SEQ ID NO: 6125897 - DNA, 13 bp, Homo sapiens
ctcccctgctgca

SEQ ID NO: 6125898 - DNA, 16 bp, Homo sapiens
ctcccctgctgcaggg

SEQ ID NO: 6125899 - DNA, 14 bp, Homo sapiens
ctcccctgctgggt

SEQ ID NO: 6125900 - DNA, 13 bp, Homo sapiens
ctcccctggaagt

SEQ ID NO: 6125901 - DNA, 12 bp, Homo sapiens
ctcccctggaca

SEQ ID NO: 6125902 - DNA, 20 bp, Homo sapiens
ctcccctggacagaggcggg

SEQ ID NO: 6125903 - DNA, 16 bp, Homo sapiens
ctcccctggagccagc

SEQ ID NO: 6125904 - DNA, 21 bp, Homo sapiens
ctcccctggagggggaatggc

SEQ ID NO: 6125905 - DNA, 14 bp, Homo sapiens
ctcccctggctggc

SEQ ID NO: 6125906 - DNA, 12 bp, Homo sapiens
ctcccctgggac

SEQ ID NO: 6125907 - DNA, 13 bp, Homo sapiens
ctcccctgggcag

SEQ ID NO: 6125908 - DNA, 23 bp, Homo sapiens
ctcccctgggcatcttctggctt

SEQ ID NO: 6125909 - DNA, 23 bp, Homo sapiens
ctcccctggggacagcaagggct

SEQ ID NO: 6125910 - DNA, 20 bp, Homo sapiens
ctcccctgggttaacaaatg

SEQ ID NO: 6125911 - DNA, 15 bp, Homo sapiens
ctcccctggtcctgc

SEQ ID NO: 6125912 - DNA, 16 bp, Homo sapiens
ctcccctggtcctgca

SEQ ID NO: 6125913 - DNA, 14 bp, Homo sapiens
ctcccctgtgccag

SEQ ID NO: 6125914 - DNA, 21 bp, Homo sapiens
ctcccctgttcccctctccct

SEQ ID NO: 6125915 - DNA, 16 bp, Homo sapiens
ctccccttcccagacc

SEQ ID NO: 6125916 - DNA, 19 bp, Homo sapiens
ctccccttccccttccttc

SEQ ID NO: 6125917 - DNA, 22 bp, Homo sapiens
ctccccttcccctttactcagc

SEQ ID NO: 6125918 - DNA, 15 bp, Homo sapiens
ctccccttccctgca

SEQ ID NO: 6125919 - DNA, 18 bp, Homo sapiens
ctccccttccctggggag

SEQ ID NO: 6125920 - DNA, 13 bp, Homo sapiens
ctccccttcctgg

SEQ ID NO: 6125921 - DNA, 18 bp, Homo sapiens
ctccccttcctggacaca

SEQ ID NO: 6125922 - DNA, 14 bp, Homo sapiens
ctccccttcctggc

SEQ ID NO: 6125923 - DNA, 13 bp, Homo sapiens
ctccccttcctgt

SEQ ID NO: 6125924 - DNA, 15 bp, Homo sapiens
ctccccttgcagcct

SEQ ID NO: 6125925 - DNA, 13 bp, Homo sapiens
ctccccttgccag

SEQ ID NO: 6125926 - DNA, 17 bp, Homo sapiens
ctccccttgccagctgc

SEQ ID NO: 6125927 - DNA, 12 bp, Homo sapiens
ctccccttgccc

SEQ ID NO: 6125928 - DNA, 20 bp, Homo sapiens
ctccccttgccttcccctgt

SEQ ID NO: 6125929 - DNA, 21 bp, Homo sapiens
ctccccttgccttcccctgtc

SEQ ID NO: 6125930 - DNA, 16 bp, Homo sapiens
ctccccttggacctcc

SEQ ID NO: 6125931 - DNA, 12 bp, Homo sapiens
ctccccttgggc

SEQ ID NO: 6125932 - DNA, 13 bp, Homo sapiens
ctccccttgggcg

SEQ ID NO: 6125933 - DNA, 18 bp, Homo sapiens
ctccccttgggcggctga

SEQ ID NO: 6125934 - DNA, 22 bp, Homo sapiens
ctcccctttccctcgctatgtg

SEQ ID NO: 6125935 - DNA, 20 bp, Homo sapiens
ctccccttttctatgttgct

SEQ ID NO: 6125936 - DNA, 22 bp, Homo sapiens
ctcccgaaaaatgtgtggttct

SEQ ID NO: 6125937 - DNA, 16 bp, Homo sapiens
ctcccgaaagcctttc

SEQ ID NO: 6125938 - DNA, 22 bp, Homo sapiens
ctcccgaagaatgaacccaaga

SEQ ID NO: 6125939 - DNA, 18 bp, Homo sapiens
ctcccgaatagctgggac

SEQ ID NO: 6125940 - DNA, 19 bp, Homo sapiens
ctcccgaatagctgggact

SEQ ID NO: 6125941 - DNA, 23 bp, Homo sapiens
ctcccgaatagctgggactacag

SEQ ID NO: 6125942 - DNA, 16 bp, Homo sapiens
ctcccgaatcctgagg

SEQ ID NO: 6125943 - DNA, 12 bp, Homo sapiens
ctcccgacccca

SEQ ID NO: 6125944 - DNA, 13 bp, Homo sapiens
ctcccgaccccat

SEQ ID NO: 6125945 - DNA, 16 bp, Homo sapiens
ctcccgacctcaggtg

SEQ ID NO: 6125946 - DNA, 20 bp, Homo sapiens
ctcccgagacggcactgaga

SEQ ID NO: 6125947 - DNA, 17 bp, Homo sapiens
ctcccgagtagctggga

SEQ ID NO: 6125948 - DNA, 18 bp, Homo sapiens
ctcccgagtagctgggac

SEQ ID NO: 6125949 - DNA, 22 bp, Homo sapiens
ctcccgagtagctgggactaga

SEQ ID NO: 6125950 - DNA, 22 bp, Homo sapiens
ctcccgagtagctgggattaca

SEQ ID NO: 6125951 - DNA, 17 bp, Homo sapiens
ctcccgattcccaactg

SEQ ID NO: 6125952 - DNA, 18 bp, Homo sapiens
ctcccgcaccaggccggg

SEQ ID NO: 6125953 - DNA, 18 bp, Homo sapiens
ctcccgcaccttcctcct

SEQ ID NO: 6125954 - DNA, 21 bp, Homo sapiens
ctcccgcaccttcctcctccc

SEQ ID NO: 6125955 - DNA, 16 bp, Homo sapiens
ctcccgcatgctgcct

SEQ ID NO: 6125956 - DNA, 21 bp, Homo sapiens
ctcccgcatgctgcctgcctc

SEQ ID NO: 6125957 - DNA, 22 bp, Homo sapiens
ctcccgcatgctgcctgcctcc

SEQ ID NO: 6125958 - DNA, 16 bp, Homo sapiens
ctcccgccaccctcaa

SEQ ID NO: 6125959 - DNA, 19 bp, Homo sapiens
ctcccgccactcgccttct

SEQ ID NO: 6125960 - DNA, 23 bp, Homo sapiens
ctcccgccactcgccttcttaga

SEQ ID NO: 6125961 - DNA, 14 bp, Homo sapiens
ctcccgccattggc

SEQ ID NO: 6125962 - DNA, 16 bp, Homo sapiens
ctcccgccattggcct

SEQ ID NO: 6125963 - DNA, 17 bp, Homo sapiens
ctcccgccattggcctt

SEQ ID NO: 6125964 - DNA, 16 bp, Homo sapiens
ctcccgccccagcctc

SEQ ID NO: 6125965 - DNA, 18 bp, Homo sapiens
ctcccgccccagcctcct

SEQ ID NO: 6125966 - DNA, 21 bp, Homo sapiens
ctcccgccccagcctcctgag

SEQ ID NO: 6125967 - DNA, 16 bp, Homo sapiens
ctcccgccccagggtc

SEQ ID NO: 6125968 - DNA, 22 bp, Homo sapiens
ctcccgccccagggtctgaaag

SEQ ID NO: 6125969 - DNA, 13 bp, Homo sapiens
ctcccgcccccca

SEQ ID NO: 6125970 - DNA, 22 bp, Homo sapiens
ctcccgccccccacacttccct

SEQ ID NO: 6125971 - DNA, 23 bp, Homo sapiens
ctcccgccccccacacttccctg

SEQ ID NO: 6125972 - DNA, 21 bp, Homo sapiens
ctcccgccccgggctggccct

SEQ ID NO: 6125973 - DNA, 21 bp, Homo sapiens
ctcccgccccttccccgaggg

SEQ ID NO: 6125974 - DNA, 15 bp, Homo sapiens
ctcccgcccttccat

SEQ ID NO: 6125975 - DNA, 22 bp, Homo sapiens
ctcccgccgcctcgggccgcct

SEQ ID NO: 6125976 - DNA, 14 bp, Homo sapiens
ctcccgcctcagcc

SEQ ID NO: 6125977 - DNA, 16 bp, Homo sapiens
ctcccgcctcagcctc

SEQ ID NO: 6125978 - DNA, 20 bp, Homo sapiens
ctcccgcctcagggccaggc

SEQ ID NO: 6125979 - DNA, 20 bp, Homo sapiens
ctcccgcctgtaatcccagt

SEQ ID NO: 6125980 - DNA, 13 bp, Homo sapiens
ctcccgcctttga

SEQ ID NO: 6125981 - DNA, 11 bp, Homo sapiens
ctcccgcggtg

SEQ ID NO: 6125982 - DNA, 17 bp, Homo sapiens
ctcccgctgagcccact

SEQ ID NO: 6125983 - DNA, 16 bp, Homo sapiens
ctcccgctgcacacag

SEQ ID NO: 6125984 - DNA, 19 bp, Homo sapiens
ctcccgctgcacacagacg

SEQ ID NO: 6125985 - DNA, 17 bp, Homo sapiens
ctcccgctgctgctgct

SEQ ID NO: 6125986 - DNA, 12 bp, Homo sapiens
ctcccgcttcct

SEQ ID NO: 6125987 - DNA, 14 bp, Homo sapiens
ctcccgcttcctcc

SEQ ID NO: 6125988 - DNA, 16 bp, Homo sapiens
ctcccgcttcctccgg

SEQ ID NO: 6125989 - DNA, 18 bp, Homo sapiens
ctcccgcttcctggcctc

SEQ ID NO: 6125990 - DNA, 20 bp, Homo sapiens
ctcccgcttcctggcctccc

SEQ ID NO: 6125991 - DNA, 19 bp, Homo sapiens
ctcccgcttgctctcctgg

SEQ ID NO: 6125992 - DNA, 23 bp, Homo sapiens
ctcccggacctggactagggcct

SEQ ID NO: 6125993 - DNA, 20 bp, Homo sapiens
cggtttgccatgttgccaga

SEQ ID NO: 6125994 - DNA, 15 bp, Homo sapiens
cggtttgctcagccc

SEQ ID NO: 6125995 - DNA, 18 bp, Homo sapiens
cggtttgtcagttcttgg

SEQ ID NO: 6125996 - DNA, 13 bp, Homo sapiens
cggttttgttgtt

SEQ ID NO: 6125997 - DNA, 20 bp, Homo sapiens
cggtttttttctttggctgc

SEQ ID NO: 6125998 - DNA, 21 bp, Homo sapiens
cggtttttttctttggctgca

SEQ ID NO: 6125999 - DNA, 22 bp, Homo sapiens
cggtttttttctttggctgcag

SEQ ID NO: 6126000 - DNA, 23 bp, Homo sapiens
cgtaaaaaaatagaaaaaaagaa

SEQ ID NO: 6126001 - DNA, 16 bp, Homo sapiens
cgtaaaaactgaagtt

SEQ ID NO: 6126002 - DNA, 14 bp, Homo sapiens
cgtaaaagaaatgt

SEQ ID NO: 6126003 - DNA, 12 bp, Homo sapiens
cgtaaaatggtg

SEQ ID NO: 6126004 - DNA, 13 bp, Homo sapiens
cgtaaaatttaca

SEQ ID NO: 6126005 - DNA, 14 bp, Homo sapiens
cgtaaagaattttc

SEQ ID NO: 6126006 - DNA, 20 bp, Homo sapiens
cgtaaagccttgttttctct

SEQ ID NO: 6126007 - DNA, 21 bp, Homo sapiens
cgtaaaggtgcagttgctcat

SEQ ID NO: 6126008 - DNA, 23 bp, Homo sapiens
cgtaaaggtttatttttctgtta

SEQ ID NO: 6126009 - DNA, 20 bp, Homo sapiens
cgtaaatcatattttagctg

SEQ ID NO: 6126010 - DNA, 12 bp, Homo sapiens
cgtaaatgtttt

SEQ ID NO: 6126011 - DNA, 12 bp, Homo sapiens
cgtaaccagcca

SEQ ID NO: 6126012 - DNA, 20 bp, Homo sapiens
cgtaaccctcgccctgtccc

SEQ ID NO: 6126013 - DNA, 22 bp, Homo sapiens
cgtaagaccaaatgtagttttg

SEQ ID NO: 6126014 - DNA, 16 bp, Homo sapiens
cgtaagaccaccttcc

SEQ ID NO: 6126015 - DNA, 17 bp, Homo sapiens
cgtaagaccaccttccc

SEQ ID NO: 6126016 - DNA, 18 bp, Homo sapiens
cgtaagaccaccttccct

SEQ ID NO: 6126017 - DNA, 19 bp, Homo sapiens
cgtaagactttttggtttg

SEQ ID NO: 6126018 - DNA, 17 bp, Homo sapiens
cgtaagatggcttattt

SEQ ID NO: 6126019 - DNA, 15 bp, Homo sapiens
cgtaagcactgtttt

SEQ ID NO: 6126020 - DNA, 23 bp, Homo sapiens
cgtaagcagtatattagtattat

SEQ ID NO: 6126021 - DNA, 16 bp, Homo sapiens
cgtaaggctgtacata

SEQ ID NO: 6126022 - DNA, 13 bp, Homo sapiens
cgtaagtacagag

SEQ ID NO: 6126023 - DNA, 21 bp, Homo sapiens
cgtaagtacagagaagccatc

SEQ ID NO: 6126024 - DNA, 16 bp, Homo sapiens
cgtaagtttaaaggat

SEQ ID NO: 6126025 - DNA, 13 bp, Homo sapiens
cgtaataaggttt

SEQ ID NO: 6126026 - DNA, 23 bp, Homo sapiens
cgtaataaggttttaatttagta

SEQ ID NO: 6126027 - DNA, 14 bp, Homo sapiens
cgtaataattatta

SEQ ID NO: 6126028 - DNA, 14 bp, Homo sapiens
cgtaatagctcaga

SEQ ID NO: 6126029 - DNA, 18 bp, Homo sapiens
cgtaatagcttctgtgtg

SEQ ID NO: 6126030 - DNA, 19 bp, Homo sapiens
cgtaatagcttctgtgtgt

SEQ ID NO: 6126031 - DNA, 19 bp, Homo sapiens
cgtaataggaatcaccctc

SEQ ID NO: 6126032 - DNA, 21 bp, Homo sapiens
cgtaataggaatcaccctcct

SEQ ID NO: 6126033 - DNA, 13 bp, Homo sapiens
cgtaatcaaatat

SEQ ID NO: 6126034 - DNA, 18 bp, Homo sapiens
cgtaatcatccccatcct

SEQ ID NO: 6126035 - DNA, 16 bp, Homo sapiens
cgtaatcctcctgagt

SEQ ID NO: 6126036 - DNA, 17 bp, Homo sapiens
cgtaatgacttattgtg

SEQ ID NO: 6126037 - DNA, 17 bp, Homo sapiens
cgtaatgcgccaataaa

SEQ ID NO: 6126038 - DNA, 21 bp, Homo sapiens
cgtaatgcttagagaatgttc

SEQ ID NO: 6126039 - DNA, 13 bp, Homo sapiens
cgtaatggggact

SEQ ID NO: 6126040 - DNA, 20 bp, Homo sapiens
cgtaatggggactctccagg

SEQ ID NO: 6126041 - DNA, 16 bp, Homo sapiens
cgtaattaaaagaatt

SEQ ID NO: 6126042 - DNA, 14 bp, Homo sapiens
cgtaattctttctg

SEQ ID NO: 6126043 - DNA, 17 bp, Homo sapiens
cgtaattctttctgtct

SEQ ID NO: 6126044 - DNA, 18 bp, Homo sapiens
cgtaattctttctgtctc

SEQ ID NO: 6126045 - DNA, 14 bp, Homo sapiens
cgtaatttaatggg

SEQ ID NO: 6126046 - DNA, 16 bp, Homo sapiens
cgtaattttgccaaat

SEQ ID NO: 6126047 - DNA, 23 bp, Homo sapiens
cgtacaaaactctgtataagttg

SEQ ID NO: 6126048 - DNA, 18 bp, Homo sapiens
cgtacaagtagttctgta

SEQ ID NO: 6126049 - DNA, 23 bp, Homo sapiens
cgtacacagagaaggctatgtaa

SEQ ID NO: 6126050 - DNA, 19 bp, Homo sapiens
cgtacacagagggacttga

SEQ ID NO: 6126051 - DNA, 14 bp, Homo sapiens
cgtacatctgcaat

SEQ ID NO: 6126052 - DNA, 20 bp, Homo sapiens
cgtacatctgcaatatgaat

SEQ ID NO: 6126053 - DNA, 14 bp, Homo sapiens
cgtacatgtgaggc

SEQ ID NO: 6126054 - DNA, 15 bp, Homo sapiens
cgtaccaagccaccg

SEQ ID NO: 6126055 - DNA, 22 bp, Homo sapiens
cgtaccaagccaccgcagctgc

SEQ ID NO: 6126056 - DNA, 14 bp, Homo sapiens
cgtacccaaggtca

SEQ ID NO: 6126057 - DNA, 13 bp, Homo sapiens
cgtaccccaccct

SEQ ID NO: 6126058 - DNA, 14 bp, Homo sapiens
cgtaccccaccctc

SEQ ID NO: 6126059 - DNA, 15 bp, Homo sapiens
cgtaccccaccctca

SEQ ID NO: 6126060 - DNA, 14 bp, Homo sapiens
cgtaccccactggg

SEQ ID NO: 6126061 - DNA, 19 bp, Homo sapiens
cgtacccccgtggtctttg

SEQ ID NO: 6126062 - DNA, 15 bp, Homo sapiens
cgtaccgcttcctta

SEQ ID NO: 6126063 - DNA, 14 bp, Homo sapiens
cgtacctgtcatga

SEQ ID NO: 6126064 - DNA, 13 bp, Homo sapiens
cgtaccttcccac

SEQ ID NO: 6126065 - DNA, 17 bp, Homo sapiens
cgtacgtaataaggttt

SEQ ID NO: 6126066 - DNA, 14 bp, Homo sapiens
cgtactaaggatac

SEQ ID NO: 6126067 - DNA, 15 bp, Homo sapiens
cgtactgcagcctcc

SEQ ID NO: 6126068 - DNA, 12 bp, Homo sapiens
cgtactgtaact

SEQ ID NO: 6126069 - DNA, 14 bp, Homo sapiens
cgtactgtaactgc

SEQ ID NO: 6126070 - DNA, 16 bp, Homo sapiens
cgtactgtaactgctc

SEQ ID NO: 6126071 - DNA, 18 bp, Homo sapiens
cgtactgtctgtgtcctt

SEQ ID NO: 6126072 - DNA, 14 bp, Homo sapiens
cgtacttaactgtg

SEQ ID NO: 6126073 - DNA, 22 bp, Homo sapiens
cgtacttagcagctatctctca

SEQ ID NO: 6126074 - DNA, 20 bp, Homo sapiens
cgtactttcacatctctgta

SEQ ID NO: 6126075 - DNA, 13 bp, Homo sapiens
cgtagaaacaaga

SEQ ID NO: 6126076 - DNA, 15 bp, Homo sapiens
cgtagaacctgcgca

SEQ ID NO: 6126077 - DNA, 18 bp, Homo sapiens
cgtagaagtttttgtact

SEQ ID NO: 6126078 - DNA, 22 bp, Homo sapiens
cgtagaatctgtgtagacgaag

SEQ ID NO: 6126079 - DNA, 13 bp, Homo sapiens
cgtagagaatgtg

SEQ ID NO: 6126080 - DNA, 22 bp, Homo sapiens
cgtagagccctccacattttct

SEQ ID NO: 6126081 - DNA, 18 bp, Homo sapiens
cgtagagttggccttttt

SEQ ID NO: 6126082 - DNA, 19 bp, Homo sapiens
cgtagatcaccagaataaa

SEQ ID NO: 6126083 - DNA, 19 bp, Homo sapiens
cgtagatgctgcctagggt

SEQ ID NO: 6126084 - DNA, 20 bp, Homo sapiens
cgtagccaaggtgggctgag

SEQ ID NO: 6126085 - DNA, 18 bp, Homo sapiens
cgtagccacaggagccct

SEQ ID NO: 6126086 - DNA, 19 bp, Homo sapiens
cgtagccacaggagccctg

SEQ ID NO: 6126087 - DNA, 15 bp, Homo sapiens
cgtagcctgggctca

SEQ ID NO: 6126088 - DNA, 22 bp, Homo sapiens
cgtagcctgggctcactgtgct

SEQ ID NO: 6126089 - DNA, 23 bp, Homo sapiens
cgtagcctgggctcactgtgctg

SEQ ID NO: 6126090 - DNA, 19 bp, Homo sapiens
cgtagctatccggacagag

SEQ ID NO: 6126091 - DNA, 14 bp, Homo sapiens
cgtagctcccctgg

SEQ ID NO: 6126092 - DNA, 17 bp, Homo sapiens
cgtagctcccctggctg

SEQ ID NO: 6126093 - DNA, 18 bp, Homo sapiens
cgtagctcccctggctgg

SEQ ID NO: 6126094 - DNA, 16 bp, Homo sapiens
cgtagctgcaaaggac

SEQ ID NO: 6126095 - DNA, 17 bp, Homo sapiens
cgtagcttcagccaggc

SEQ ID NO: 6126096 - DNA, 17 bp, Homo sapiens
cgtagcttctagtctgg

SEQ ID NO: 6126097 - DNA, 18 bp, Homo sapiens
cgtaggacgcatgaaggt

SEQ ID NO: 6126098 - DNA, 15 bp, Homo sapiens
cgtaggctacagaga

SEQ ID NO: 6126099 - DNA, 21 bp, Homo sapiens
cgtaggctacagagaagcctt

SEQ ID NO: 6126100 - DNA, 20 bp, Homo sapiens
cgtagggagtacctgctgcc

SEQ ID NO: 6126101 - DNA, 13 bp, Homo sapiens
cgtagggccaggg

SEQ ID NO: 6126102 - DNA, 16 bp, Homo sapiens
cgtagggccagggctc

SEQ ID NO: 6126103 - DNA, 17 bp, Homo sapiens
cgtaggggaggggttgc

SEQ ID NO: 6126104 - DNA, 15 bp, Homo sapiens
cgtaggggctcctga

SEQ ID NO: 6126105 - DNA, 20 bp, Homo sapiens
cgtagggtggcactgggagg

SEQ ID NO: 6126106 - DNA, 12 bp, Homo sapiens
cgtaggtaaact

SEQ ID NO: 6126107 - DNA, 18 bp, Homo sapiens
cgtaggttccccagagag

SEQ ID NO: 6126108 - DNA, 20 bp, Homo sapiens
cgtagtccatcaccatttct

SEQ ID NO: 6126109 - DNA, 18 bp, Homo sapiens
cgtagtcggcacagcctg

SEQ ID NO: 6126110 - DNA, 21 bp, Homo sapiens
cgtagtcggcacagcctggtc

SEQ ID NO: 6126111 - DNA, 15 bp, Homo sapiens
cgtagtctcctgggt

SEQ ID NO: 6126112 - DNA, 20 bp, Homo sapiens
cgtagtgtagatttgttttg

SEQ ID NO: 6126113 - DNA, 18 bp, Homo sapiens
cgtagttaacttgaagaa

SEQ ID NO: 6126114 - DNA, 14 bp, Homo sapiens
cgtataaatatcag

SEQ ID NO: 6126115 - DNA, 16 bp, Homo sapiens
cgtataataaaaccaa

SEQ ID NO: 6126116 - DNA, 14 bp, Homo sapiens
cgtataatgctttc

SEQ ID NO: 6126117 - DNA, 14 bp, Homo sapiens
cgtatagaagtctt

SEQ ID NO: 6126118 - DNA, 12 bp, Homo sapiens
cgtatagctgta

SEQ ID NO: 6126119 - DNA, 13 bp, Homo sapiens
cgtatagtcaata

SEQ ID NO: 6126120 - DNA, 14 bp, Homo sapiens
cgtatatataaaca

SEQ ID NO: 6126121 - DNA, 17 bp, Homo sapiens
cgtatatataagaaaga

SEQ ID NO: 6126122 - DNA, 23 bp, Homo sapiens
cgtatatataagaaagacatctt

SEQ ID NO: 6126123 - DNA, 18 bp, Homo sapiens
cgtatattgtatcatttg

SEQ ID NO: 6126124 - DNA, 13 bp, Homo sapiens
cgtatcatttcta

SEQ ID NO: 6126125 - DNA, 16 bp, Homo sapiens
cgtatcccgagtctgg

SEQ ID NO: 6126126 - DNA, 16 bp, Homo sapiens
cgtatctccctggaga

SEQ ID NO: 6126127 - DNA, 21 bp, Homo sapiens
cgtatctccggctcccagcct

SEQ ID NO: 6126128 - DNA, 22 bp, Homo sapiens
cgtatctccggctcccagcctc

SEQ ID NO: 6126129 - DNA, 16 bp, Homo sapiens
cgtatctgagggctgc

SEQ ID NO: 6126130 - DNA, 23 bp, Homo sapiens
cgtatctttaaaaagcagtcctc

SEQ ID NO: 6126131 - DNA, 17 bp, Homo sapiens
cgtatgaatgatatctt

SEQ ID NO: 6126132 - DNA, 20 bp, Homo sapiens
cgtatgagttagaataataa

SEQ ID NO: 6126133 - DNA, 18 bp, Homo sapiens
cgtatgcaagtctgtgag

SEQ ID NO: 6126134 - DNA, 19 bp, Homo sapiens
cgtatgtaacatgatgtta

SEQ ID NO: 6126135 - DNA, 19 bp, Homo sapiens
cgtatgtctggttctcaat

SEQ ID NO: 6126136 - DNA, 15 bp, Homo sapiens
cgtatgtgtgcagga

SEQ ID NO: 6126137 - DNA, 23 bp, Homo sapiens
cgtattacaagagaaacaaataa

SEQ ID NO: 6126138 - DNA, 12 bp, Homo sapiens
cgtattcattca

SEQ ID NO: 6126139 - DNA, 20 bp, Homo sapiens
cgtattctaattcttcatta

SEQ ID NO: 6126140 - DNA, 15 bp, Homo sapiens
cgtattgtgaaattt

SEQ ID NO: 6126141 - DNA, 15 bp, Homo sapiens
cgtatttaatagcaa

SEQ ID NO: 6126142 - DNA, 13 bp, Homo sapiens
cgtatttataata

SEQ ID NO: 6126143 - DNA, 14 bp, Homo sapiens
cgtatttataatag

SEQ ID NO: 6126144 - DNA, 21 bp, Homo sapiens
cgtatttatatttggaaagag

SEQ ID NO: 6126145 - DNA, 21 bp, Homo sapiens
cgtatttcttttttttaataa

SEQ ID NO: 6126146 - DNA, 14 bp, Homo sapiens
cgtcaaagaaaatg

SEQ ID NO: 6126147 - DNA, 19 bp, Homo sapiens
cgtcaacccaagctctggg

SEQ ID NO: 6126148 - DNA, 16 bp, Homo sapiens
cgtcaacgttgtactg

SEQ ID NO: 6126149 - DNA, 20 bp, Homo sapiens
cgtcaactcatattttcatg

SEQ ID NO: 6126150 - DNA, 15 bp, Homo sapiens
cgtcaccaccacccc

SEQ ID NO: 6126151 - DNA, 17 bp, Homo sapiens
cgtcaccagaattagtc

SEQ ID NO: 6126152 - DNA, 16 bp, Homo sapiens
cgtcaccatctcaggc

SEQ ID NO: 6126153 - DNA, 20 bp, Homo sapiens
cgtcaccatctcaggccacc

SEQ ID NO: 6126154 - DNA, 16 bp, Homo sapiens
cgtcacccaaaagcac

SEQ ID NO: 6126155 - DNA, 18 bp, Homo sapiens
cgtcaccccgccagccta

SEQ ID NO: 6126156 - DNA, 18 bp, Homo sapiens
cgtcaccctcctgagcct

SEQ ID NO: 6126157 - DNA, 14 bp, Homo sapiens
cgtcaccctgggag

SEQ ID NO: 6126158 - DNA, 15 bp, Homo sapiens
cgtcaccctgggagc

SEQ ID NO: 6126159 - DNA, 14 bp, Homo sapiens
cgtcacccttggta

SEQ ID NO: 6126160 - DNA, 18 bp, Homo sapiens
cgtcacccttggtagagt

SEQ ID NO: 6126161 - DNA, 21 bp, Homo sapiens
cgtcacccttggtagagttta

SEQ ID NO: 6126162 - DNA, 14 bp, Homo sapiens
cgtcacgctccctg

SEQ ID NO: 6126163 - DNA, 15 bp, Homo sapiens
cgtcacgctccctga

SEQ ID NO: 6126164 - DNA, 19 bp, Homo sapiens
cgtcacgtgcgctgggcac

SEQ ID NO: 6126165 - DNA, 20 bp, Homo sapiens
cgtcacgtgcgctgggcact

SEQ ID NO: 6126166 - DNA, 15 bp, Homo sapiens
cgtcactattcatca

SEQ ID NO: 6126167 - DNA, 19 bp, Homo sapiens
cgtcactccagtgctcagc

SEQ ID NO: 6126168 - DNA, 13 bp, Homo sapiens
cgtcactccattc

SEQ ID NO: 6126169 - DNA, 16 bp, Homo sapiens
cgtcactgccagagct

SEQ ID NO: 6126170 - DNA, 12 bp, Homo sapiens
cgtcactgccca

SEQ ID NO: 6126171 - DNA, 18 bp, Homo sapiens
cgtcactttttggccatg

SEQ ID NO: 6126172 - DNA, 21 bp, Homo sapiens
cgtcagacagcaaggaactgt

SEQ ID NO: 6126173 - DNA, 14 bp, Homo sapiens
ctcccggagcctgt

SEQ ID NO: 6126174 - DNA, 15 bp, Homo sapiens
ctcccggagcctgtg

SEQ ID NO: 6126175 - DNA, 20 bp, Homo sapiens
ctcccggaggttgggtgggc

SEQ ID NO: 6126176 - DNA, 23 bp, Homo sapiens
ctcccggcaagcgcttctgctga

SEQ ID NO: 6126177 - DNA, 18 bp, Homo sapiens
ctcccggcactccatgct

SEQ ID NO: 6126178 - DNA, 13 bp, Homo sapiens
ctcccggcatcct

SEQ ID NO: 6126179 - DNA, 15 bp, Homo sapiens
ctcccggcatcctga

SEQ ID NO: 6126180 - DNA, 17 bp, Homo sapiens
ctcccggcatcctgaaa

SEQ ID NO: 6126181 - DNA, 16 bp, Homo sapiens
ctcccggcccgcctgc

SEQ ID NO: 6126182 - DNA, 20 bp, Homo sapiens
ctcccggcccgcctgcccag

SEQ ID NO: 6126183 - DNA, 19 bp, Homo sapiens
ctcccggcgggtgctctga

SEQ ID NO: 6126184 - DNA, 13 bp, Homo sapiens
ctcccggctgcct

SEQ ID NO: 6126185 - DNA, 17 bp, Homo sapiens
ctcccggctgcctgccg

SEQ ID NO: 6126186 - DNA, 23 bp, Homo sapiens
ctcccggctttgcagggagacca

SEQ ID NO: 6126187 - DNA, 22 bp, Homo sapiens
ctcccgggaagcatcctcccca

SEQ ID NO: 6126188 - DNA, 22 bp, Homo sapiens
ctcccgggactcactggcagcc

SEQ ID NO: 6126189 - DNA, 16 bp, Homo sapiens
ctcccgggccacgccc

SEQ ID NO: 6126190 - DNA, 19 bp, Homo sapiens
ctcccgggccacgccccag

SEQ ID NO: 6126191 - DNA, 23 bp, Homo sapiens
ctcccgggccacgccccagcccg

SEQ ID NO: 6126192 - DNA, 18 bp, Homo sapiens
ctcccgggccccacagac

SEQ ID NO: 6126193 - DNA, 22 bp, Homo sapiens
ctcccgggccctcccttggaaa

SEQ ID NO: 6126194 - DNA, 14 bp, Homo sapiens
ctcccggggacgct

SEQ ID NO: 6126195 - DNA, 20 bp, Homo sapiens
ctcccggggactcaagagga

SEQ ID NO: 6126196 - DNA, 16 bp, Homo sapiens
ctcccggggcccagga

SEQ ID NO: 6126197 - DNA, 17 bp, Homo sapiens
ctcccggggcctggaca

SEQ ID NO: 6126198 - DNA, 18 bp, Homo sapiens
ctcccggggcctggacag

SEQ ID NO: 6126199 - DNA, 15 bp, Homo sapiens
ctcccggggccttcc

SEQ ID NO: 6126200 - DNA, 16 bp, Homo sapiens
ctcccgggtccttggc

SEQ ID NO: 6126201 - DNA, 15 bp, Homo sapiens
ctcccggtgcccaag

SEQ ID NO: 6126202 - DNA, 14 bp, Homo sapiens
ctcccggtgtgcag

SEQ ID NO: 6126203 - DNA, 15 bp, Homo sapiens
ctcccggttcttcca

SEQ ID NO: 6126204 - DNA, 23 bp, Homo sapiens
ctcccgtactgtctgtgtccttg

SEQ ID NO: 6126205 - DNA, 18 bp, Homo sapiens
ctcccgtagtctcctggg

SEQ ID NO: 6126206 - DNA, 13 bp, Homo sapiens
ctcccgtcactcc

SEQ ID NO: 6126207 - DNA, 15 bp, Homo sapiens
ctcccgtctcgcctg

SEQ ID NO: 6126208 - DNA, 14 bp, Homo sapiens
ctcccgtcttcctc

SEQ ID NO: 6126209 - DNA, 17 bp, Homo sapiens
ctcccgtcttcctcctc

SEQ ID NO: 6126210 - DNA, 15 bp, Homo sapiens
ctccctaaaataaaa

SEQ ID NO: 6126211 - DNA, 17 bp, Homo sapiens
ctccctaaaataaaaac

SEQ ID NO: 6126212 - DNA, 14 bp, Homo sapiens
ctccctaaactgta

SEQ ID NO: 6126213 - DNA, 19 bp, Homo sapiens
ctccctaaactttggcctt

SEQ ID NO: 6126214 - DNA, 20 bp, Homo sapiens
ctccctaaagccctcttcag

SEQ ID NO: 6126215 - DNA, 17 bp, Homo sapiens
ctccctaagccagcctg

SEQ ID NO: 6126216 - DNA, 19 bp, Homo sapiens
ctccctaatttatgtgcta

SEQ ID NO: 6126217 - DNA, 14 bp, Homo sapiens
ctccctacattccc

SEQ ID NO: 6126218 - DNA, 16 bp, Homo sapiens
ctccctacattcccca

SEQ ID NO: 6126219 - DNA, 19 bp, Homo sapiens
ctccctaccccagggccct

SEQ ID NO: 6126220 - DNA, 20 bp, Homo sapiens
ctccctaccccagggccctg

SEQ ID NO: 6126221 - DNA, 13 bp, Homo sapiens
ctccctaccctaa

SEQ ID NO: 6126222 - DNA, 16 bp, Homo sapiens
ctccctaccctcggaa

SEQ ID NO: 6126223 - DNA, 11 bp, Homo sapiens
ctccctacctc

SEQ ID NO: 6126224 - DNA, 16 bp, Homo sapiens
ctccctacctcaacct

SEQ ID NO: 6126225 - DNA, 16 bp, Homo sapiens
ctccctaccttgcctc

SEQ ID NO: 6126226 - DNA, 19 bp, Homo sapiens
ctccctagagcgggatggg

SEQ ID NO: 6126227 - DNA, 14 bp, Homo sapiens
ctccctagatccag

SEQ ID NO: 6126228 - DNA, 22 bp, Homo sapiens
ctccctagatccaggcttctcc

SEQ ID NO: 6126229 - DNA, 15 bp, Homo sapiens
ctccctagcccttcc

SEQ ID NO: 6126230 - DNA, 16 bp, Homo sapiens
ctccctagcccttcca

SEQ ID NO: 6126231 - DNA, 23 bp, Homo sapiens
ctccctagcccttctaccccacc

SEQ ID NO: 6126232 - DNA, 18 bp, Homo sapiens
ctccctagctcttcccca

SEQ ID NO: 6126233 - DNA, 19 bp, Homo sapiens
ctccctagctcttccccat

SEQ ID NO: 6126234 - DNA, 12 bp, Homo sapiens
ctccctaggccc

SEQ ID NO: 6126235 - DNA, 16 bp, Homo sapiens
ctccctaggcccaagt

SEQ ID NO: 6126236 - DNA, 17 bp, Homo sapiens
ctccctaggcccaagtc

SEQ ID NO: 6126237 - DNA, 17 bp, Homo sapiens
ctccctagttacccacc

SEQ ID NO: 6126238 - DNA, 22 bp, Homo sapiens
ctccctagttagcatccaggct

SEQ ID NO: 6126239 - DNA, 16 bp, Homo sapiens
ctccctataatgctgg

SEQ ID NO: 6126240 - DNA, 20 bp, Homo sapiens
ctccctataatgctggagcg

SEQ ID NO: 6126241 - DNA, 16 bp, Homo sapiens
ctccctataccgagac

SEQ ID NO: 6126242 - DNA, 23 bp, Homo sapiens
ctccctataccgagacccaccat

SEQ ID NO: 6126243 - DNA, 18 bp, Homo sapiens
ctccctatccctcacaca

SEQ ID NO: 6126244 - DNA, 23 bp, Homo sapiens
ctccctatctaaccctcccatgg

SEQ ID NO: 6126245 - DNA, 19 bp, Homo sapiens
ctccctatgttgcccaggc

SEQ ID NO: 6126246 - DNA, 12 bp, Homo sapiens
ctccctcaaacc

SEQ ID NO: 6126247 - DNA, 21 bp, Homo sapiens
ctccctcaaatgacagaccta

SEQ ID NO: 6126248 - DNA, 18 bp, Homo sapiens
ctccctcaccccctcctt

SEQ ID NO: 6126249 - DNA, 18 bp, Homo sapiens
ctccctcaccctgagccc

SEQ ID NO: 6126250 - DNA, 15 bp, Homo sapiens
ctccctcactctcag

SEQ ID NO: 6126251 - DNA, 16 bp, Homo sapiens
ctccctcactctcagg

SEQ ID NO: 6126252 - DNA, 12 bp, Homo sapiens
ctccctcagacc

SEQ ID NO: 6126253 - DNA, 17 bp, Homo sapiens
ctccctcagacccagga

SEQ ID NO: 6126254 - DNA, 18 bp, Homo sapiens
ctccctcagacccaggag

SEQ ID NO: 6126255 - DNA, 14 bp, Homo sapiens
ctccctcagactca

SEQ ID NO: 6126256 - DNA, 15 bp, Homo sapiens
ctccctcagactcag

SEQ ID NO: 6126257 - DNA, 17 bp, Homo sapiens
ctccctcagactcagag

SEQ ID NO: 6126258 - DNA, 21 bp, Homo sapiens
ctccctcagatcccagttcct

SEQ ID NO: 6126259 - DNA, 14 bp, Homo sapiens
ctccctcagccacg

SEQ ID NO: 6126260 - DNA, 15 bp, Homo sapiens
ctccctcagccacgc

SEQ ID NO: 6126261 - DNA, 16 bp, Homo sapiens
ctccctcagccacgcc

SEQ ID NO: 6126262 - DNA, 13 bp, Homo sapiens
ctccctcagcccc

SEQ ID NO: 6126263 - DNA, 14 bp, Homo sapiens
ctccctcagcccct

SEQ ID NO: 6126264 - DNA, 16 bp, Homo sapiens
ctccctcagcccctct

SEQ ID NO: 6126265 - DNA, 13 bp, Homo sapiens
ctccctcagcctc

SEQ ID NO: 6126266 - DNA, 15 bp, Homo sapiens
ctccctcagcctccc

SEQ ID NO: 6126267 - DNA, 14 bp, Homo sapiens
ctccctcagcggag

SEQ ID NO: 6126268 - DNA, 14 bp, Homo sapiens
ctccctcaggctct

SEQ ID NO: 6126269 - DNA, 16 bp, Homo sapiens
ctccctcaggctctgt

SEQ ID NO: 6126270 - DNA, 14 bp, Homo sapiens
ctccctcatggctc

SEQ ID NO: 6126271 - DNA, 19 bp, Homo sapiens
ctccctcatggctctggca

SEQ ID NO: 6126272 - DNA, 13 bp, Homo sapiens
ctccctcattcca

SEQ ID NO: 6126273 - DNA, 22 bp, Homo sapiens
ctccctcatttcaggagcagcc

SEQ ID NO: 6126274 - DNA, 15 bp, Homo sapiens
ctccctccacacctc

SEQ ID NO: 6126275 - DNA, 15 bp, Homo sapiens
ctccctccaccccag

SEQ ID NO: 6126276 - DNA, 16 bp, Homo sapiens
ctccctccaccccagg

SEQ ID NO: 6126277 - DNA, 15 bp, Homo sapiens
ctccctccacctcaa

SEQ ID NO: 6126278 - DNA, 15 bp, Homo sapiens
ctccctccacctccc

SEQ ID NO: 6126279 - DNA, 14 bp, Homo sapiens
ctccctccactcct

SEQ ID NO: 6126280 - DNA, 22 bp, Homo sapiens
ctccctccagaatggaactcaa

SEQ ID NO: 6126281 - DNA, 14 bp, Homo sapiens
ctccctccagcaca

SEQ ID NO: 6126282 - DNA, 15 bp, Homo sapiens
ctccctccagctgcg

SEQ ID NO: 6126283 - DNA, 22 bp, Homo sapiens
ctccctccagggaatccgcctg

SEQ ID NO: 6126284 - DNA, 14 bp, Homo sapiens
ctccctccagggtc

SEQ ID NO: 6126285 - DNA, 15 bp, Homo sapiens
ctccctccagggtcc

SEQ ID NO: 6126286 - DNA, 18 bp, Homo sapiens
ctccctccagggtcctct

SEQ ID NO: 6126287 - DNA, 16 bp, Homo sapiens
ctccctccagtaccat

SEQ ID NO: 6126288 - DNA, 15 bp, Homo sapiens
ctccctccatggcag

SEQ ID NO: 6126289 - DNA, 20 bp, Homo sapiens
ctccctccatggcaggaagg

SEQ ID NO: 6126290 - DNA, 18 bp, Homo sapiens
ctccctcccacactcgcc

SEQ ID NO: 6126291 - DNA, 11 bp, Homo sapiens
ctccctcccag

SEQ ID NO: 6126292 - DNA, 16 bp, Homo sapiens
ctccctcccagatcca

SEQ ID NO: 6126293 - DNA, 16 bp, Homo sapiens
ctccctcccagctcca

SEQ ID NO: 6126294 - DNA, 14 bp, Homo sapiens
ctccctcccagctg

SEQ ID NO: 6126295 - DNA, 15 bp, Homo sapiens
ctccctcccagctgc

SEQ ID NO: 6126296 - DNA, 18 bp, Homo sapiens
ctccctcccagctgcact

SEQ ID NO: 6126297 - DNA, 14 bp, Homo sapiens
ctccctcccaggac

SEQ ID NO: 6126298 - DNA, 18 bp, Homo sapiens
ctccctcccatttgcaga

SEQ ID NO: 6126299 - DNA, 19 bp, Homo sapiens
ctccctcccatttgcagac

SEQ ID NO: 6126300 - DNA, 21 bp, Homo sapiens
ctccctccccaaatggctgct

SEQ ID NO: 6126301 - DNA, 14 bp, Homo sapiens
ctccctccccaccc

SEQ ID NO: 6126302 - DNA, 15 bp, Homo sapiens
ctccctccccaccca

SEQ ID NO: 6126303 - DNA, 22 bp, Homo sapiens
ctccctccccagatctgtcctg

SEQ ID NO: 6126304 - DNA, 20 bp, Homo sapiens
ctccctccccagctccggag

SEQ ID NO: 6126305 - DNA, 22 bp, Homo sapiens
ctccctcccccggggtctccac

SEQ ID NO: 6126306 - DNA, 13 bp, Homo sapiens
ctccctcccctgc

SEQ ID NO: 6126307 - DNA, 14 bp, Homo sapiens
ctccctcccctgcc

SEQ ID NO: 6126308 - DNA, 21 bp, Homo sapiens
ctccctcccctgccctggtcc

SEQ ID NO: 6126309 - DNA, 23 bp, Homo sapiens
ctccctcccctgccctggtccag

SEQ ID NO: 6126310 - DNA, 18 bp, Homo sapiens
ctccctccccttgcctgt

SEQ ID NO: 6126311 - DNA, 21 bp, Homo sapiens
ctccctccccttgcctgtgcc

SEQ ID NO: 6126312 - DNA, 18 bp, Homo sapiens
ctccctccctaacagtga

SEQ ID NO: 6126313 - DNA, 13 bp, Homo sapiens
ctccctccctagc

SEQ ID NO: 6126314 - DNA, 15 bp, Homo sapiens
ctccctccctccaca

SEQ ID NO: 6126315 - DNA, 15 bp, Homo sapiens
ctccctccctccacc

SEQ ID NO: 6126316 - DNA, 12 bp, Homo sapiens
ctccctccctct

SEQ ID NO: 6126317 - DNA, 14 bp, Homo sapiens
ctccctccctctcc

SEQ ID NO: 6126318 - DNA, 13 bp, Homo sapiens
ctccctccctctt

SEQ ID NO: 6126319 - DNA, 13 bp, Homo sapiens
ctccctcccttcc

SEQ ID NO: 6126320 - DNA, 20 bp, Homo sapiens
ctccctcccttccttgggca

SEQ ID NO: 6126321 - DNA, 16 bp, Homo sapiens
ctccctcccttctttc

SEQ ID NO: 6126322 - DNA, 21 bp, Homo sapiens
ctccctccgatccttcctccc

SEQ ID NO: 6126323 - DNA, 15 bp, Homo sapiens
ctccctccgccccca

SEQ ID NO: 6126324 - DNA, 16 bp, Homo sapiens
ctccctccgcctccca

SEQ ID NO: 6126325 - DNA, 19 bp, Homo sapiens
ctccctccgggtcttccta

SEQ ID NO: 6126326 - DNA, 19 bp, Homo sapiens
ctccctcctaacctagaga

SEQ ID NO: 6126327 - DNA, 17 bp, Homo sapiens
ctccctcctcacctctg

SEQ ID NO: 6126328 - DNA, 15 bp, Homo sapiens
ctccctcctcagggg

SEQ ID NO: 6126329 - DNA, 12 bp, Homo sapiens
ctccctcctcca

SEQ ID NO: 6126330 - DNA, 13 bp, Homo sapiens
ctccctcctcctg

SEQ ID NO: 6126331 - DNA, 13 bp, Homo sapiens
ctccctcctctgc

SEQ ID NO: 6126332 - DNA, 15 bp, Homo sapiens
ctccctcctctggca

SEQ ID NO: 6126333 - DNA, 14 bp, Homo sapiens
ctccctcctgcaca

SEQ ID NO: 6126334 - DNA, 14 bp, Homo sapiens
ctccctcctgcagg

SEQ ID NO: 6126335 - DNA, 17 bp, Homo sapiens
ctccctcctgccgactc

SEQ ID NO: 6126336 - DNA, 20 bp, Homo sapiens
ctccctcctggagctctgtg

SEQ ID NO: 6126337 - DNA, 15 bp, Homo sapiens
ctccctcctggctca

SEQ ID NO: 6126338 - DNA, 16 bp, Homo sapiens
ctccctcctggctcac

SEQ ID NO: 6126339 - DNA, 17 bp, Homo sapiens
ctccctcctggctcaca

SEQ ID NO: 6126340 - DNA, 12 bp, Homo sapiens
ctccctccttgg

SEQ ID NO: 6126341 - DNA, 13 bp, Homo sapiens
ctccctcctttcc

SEQ ID NO: 6126342 - DNA, 20 bp, Homo sapiens
ctccctcgaacccacactgc

SEQ ID NO: 6126343 - DNA, 22 bp, Homo sapiens
ctccctcgaacccacactgcaa

SEQ ID NO: 6126344 - DNA, 17 bp, Homo sapiens
ctccctcgacagcgccc

SEQ ID NO: 6126345 - DNA, 16 bp, Homo sapiens
ctccctcgccctgtga

SEQ ID NO: 6126346 - DNA, 19 bp, Homo sapiens
ctccctcgggggctcttcc

SEQ ID NO: 6126347 - DNA, 18 bp, Homo sapiens
ctccctcggtcacctgtg

SEQ ID NO: 6126348 - DNA, 11 bp, Homo sapiens
ctccctcgtgg

SEQ ID NO: 6126349 - DNA, 14 bp, Homo sapiens
ctccctcgtgggct

SEQ ID NO: 6126350 - DNA, 15 bp, Homo sapiens
ctccctcgtgggctt

SEQ ID NO: 6126351 - DNA, 20 bp, Homo sapiens
ctccctcgtgggcttgtgct

SEQ ID NO: 6126352 - DNA, 16 bp, Homo sapiens
ctccctctactcttcc

SEQ ID NO: 6126353 - DNA, 20 bp, Homo sapiens
ctccctctaggctctgcctt

SEQ ID NO: 6126354 - DNA, 18 bp, Homo sapiens
ctccctctcaacacccag

SEQ ID NO: 6126355 - DNA, 16 bp, Homo sapiens
cgtcagcctccagcct

SEQ ID NO: 6126356 - DNA, 20 bp, Homo sapiens
cgtcagcctccagcctctgt

SEQ ID NO: 6126357 - DNA, 19 bp, Homo sapiens
cgtcagcgggcgctgctgg

SEQ ID NO: 6126358 - DNA, 13 bp, Homo sapiens
cgtcagctccagc

SEQ ID NO: 6126359 - DNA, 11 bp, Homo sapiens
cgtcagctgct

SEQ ID NO: 6126360 - DNA, 19 bp, Homo sapiens
cgtcagctggcactgtctc

SEQ ID NO: 6126361 - DNA, 16 bp, Homo sapiens
cgtcaggaggtgcctg

SEQ ID NO: 6126362 - DNA, 20 bp, Homo sapiens
cgtcaggcacgtctcctgct

SEQ ID NO: 6126363 - DNA, 21 bp, Homo sapiens
cgtcaggcacgtctcctgctg

SEQ ID NO: 6126364 - DNA, 23 bp, Homo sapiens
cgtcaggcacgtctcctgctgcg

SEQ ID NO: 6126365 - DNA, 14 bp, Homo sapiens
cgtcaggccctgac

SEQ ID NO: 6126366 - DNA, 22 bp, Homo sapiens
cgtcagggagaggtcaccagct

SEQ ID NO: 6126367 - DNA, 20 bp, Homo sapiens
cgtcagggcccaagtccctg

SEQ ID NO: 6126368 - DNA, 17 bp, Homo sapiens
cgtcaggggtgcacagt

SEQ ID NO: 6126369 - DNA, 18 bp, Homo sapiens
cgtcagggttggtgtgct

SEQ ID NO: 6126370 - DNA, 24 bp, Homo sapiens
cgtcagtagtttgagaccagcctg

SEQ ID NO: 6126371 - DNA, 22 bp, Homo sapiens
cgtcagtctctcaaagacccca

SEQ ID NO: 6126372 - DNA, 14 bp, Homo sapiens
cgtcagtgttcatg

SEQ ID NO: 6126373 - DNA, 15 bp, Homo sapiens
cgtcagtttcactcc

SEQ ID NO: 6126374 - DNA, 20 bp, Homo sapiens
cgtcatcatttttccttccc

SEQ ID NO: 6126375 - DNA, 22 bp, Homo sapiens
cgtcatccatgccctcccagga

SEQ ID NO: 6126376 - DNA, 18 bp, Homo sapiens
cgtcatcggaggctgggc

SEQ ID NO: 6126377 - DNA, 12 bp, Homo sapiens
cgtcatctcagg

SEQ ID NO: 6126378 - DNA, 16 bp, Homo sapiens
cgtcatctcagggtcc

SEQ ID NO: 6126379 - DNA, 19 bp, Homo sapiens
cgtcatctgcggggcttct

SEQ ID NO: 6126380 - DNA, 20 bp, Homo sapiens
cgtcatgcacagtatttgta

SEQ ID NO: 6126381 - DNA, 18 bp, Homo sapiens
cgtcatgctgtccgtgct

SEQ ID NO: 6126382 - DNA, 15 bp, Homo sapiens
cgtcatgcttgtgtt

SEQ ID NO: 6126383 - DNA, 20 bp, Homo sapiens
cgtcatggctcaaggattca

SEQ ID NO: 6126384 - DNA, 15 bp, Homo sapiens
cgtcatgttcctcaa

SEQ ID NO: 6126385 - DNA, 19 bp, Homo sapiens
cgtcattacagggcacagg

SEQ ID NO: 6126386 - DNA, 16 bp, Homo sapiens
cgtcattgctgctgct

SEQ ID NO: 6126387 - DNA, 20 bp, Homo sapiens
cgtcattgctgctgctacca

SEQ ID NO: 6126388 - DNA, 22 bp, Homo sapiens
cgtcattgctgctgctaccagc

SEQ ID NO: 6126389 - DNA, 14 bp, Homo sapiens
cgtcattgtgtaag

SEQ ID NO: 6126390 - DNA, 19 bp, Homo sapiens
cgtccaagggacagcccac

SEQ ID NO: 6126391 - DNA, 19 bp, Homo sapiens
cgtccaattgactgccctc

SEQ ID NO: 6126392 - DNA, 15 bp, Homo sapiens
cgtccacaggggcag

SEQ ID NO: 6126393 - DNA, 22 bp, Homo sapiens
cgtccacaggggcaggcctggg

SEQ ID NO: 6126394 - DNA, 12 bp, Homo sapiens
cgtccaccccag

SEQ ID NO: 6126395 - DNA, 14 bp, Homo sapiens
cgtccaccctgagc

SEQ ID NO: 6126396 - DNA, 15 bp, Homo sapiens
cgtccacccttccat

SEQ ID NO: 6126397 - DNA, 16 bp, Homo sapiens
cgtccacccttccatc

SEQ ID NO: 6126398 - DNA, 14 bp, Homo sapiens
cgtccactgtcaag

SEQ ID NO: 6126399 - DNA, 13 bp, Homo sapiens
cgtccactttccc

SEQ ID NO: 6126400 - DNA, 22 bp, Homo sapiens
cgtccactttcccttcccctgt

SEQ ID NO: 6126401 - DNA, 15 bp, Homo sapiens
cgtccagccaagagc

SEQ ID NO: 6126402 - DNA, 13 bp, Homo sapiens
cgtccagctcagc

SEQ ID NO: 6126403 - DNA, 16 bp, Homo sapiens
cgtccagctgcccttc

SEQ ID NO: 6126404 - DNA, 22 bp, Homo sapiens
cgtccaggccgcgccctttccc

SEQ ID NO: 6126405 - DNA, 11 bp, Homo sapiens
cgtccagggag

SEQ ID NO: 6126406 - DNA, 23 bp, Homo sapiens
cgtccatcacgttagctgtccca

SEQ ID NO: 6126407 - DNA, 18 bp, Homo sapiens
cgtccatccgactgcccc

SEQ ID NO: 6126408 - DNA, 12 bp, Homo sapiens
cgtccatctctc

SEQ ID NO: 6126409 - DNA, 19 bp, Homo sapiens
cgtccatctctctccctta

SEQ ID NO: 6126410 - DNA, 17 bp, Homo sapiens
cgtccatggcaccagcc

SEQ ID NO: 6126411 - DNA, 19 bp, Homo sapiens
cgtccatggcaccagcccc

SEQ ID NO: 6126412 - DNA, 15 bp, Homo sapiens
cgtccatggtgctaa

SEQ ID NO: 6126413 - DNA, 16 bp, Homo sapiens
cgtccatgtttctcac

SEQ ID NO: 6126414 - DNA, 18 bp, Homo sapiens
cgtcccaaccctgcccag

SEQ ID NO: 6126415 - DNA, 12 bp, Homo sapiens
cgtcccagaggc

SEQ ID NO: 6126416 - DNA, 13 bp, Homo sapiens
cgtcccagaggcc

SEQ ID NO: 6126417 - DNA, 17 bp, Homo sapiens
cgtcccagcatccctgg

SEQ ID NO: 6126418 - DNA, 14 bp, Homo sapiens
cgtcccagcggcct

SEQ ID NO: 6126419 - DNA, 16 bp, Homo sapiens
cgtcccagcggcctca

SEQ ID NO: 6126420 - DNA, 17 bp, Homo sapiens
cgtcccagcggcctcag

SEQ ID NO: 6126421 - DNA, 20 bp, Homo sapiens
cgtcccagcggcctcagggt

SEQ ID NO: 6126422 - DNA, 12 bp, Homo sapiens
cgtcccagctcc

SEQ ID NO: 6126423 - DNA, 19 bp, Homo sapiens
cgtcccagctgaaggcagt

SEQ ID NO: 6126424 - DNA, 12 bp, Homo sapiens
cgtcccagggct

SEQ ID NO: 6126425 - DNA, 15 bp, Homo sapiens
cgtcccagggctctg

SEQ ID NO: 6126426 - DNA, 17 bp, Homo sapiens
cgtcccatatcctgcct

SEQ ID NO: 6126427 - DNA, 19 bp, Homo sapiens
cgtcccatgaggtcttccc

SEQ ID NO: 6126428 - DNA, 13 bp, Homo sapiens
cgtccccagacca

SEQ ID NO: 6126429 - DNA, 12 bp, Homo sapiens
cgtccccagggt

SEQ ID NO: 6126430 - DNA, 21 bp, Homo sapiens
cgtccccagttgccgtctagg

SEQ ID NO: 6126431 - DNA, 22 bp, Homo sapiens
cgtcccccagccctcaggccag

SEQ ID NO: 6126432 - DNA, 15 bp, Homo sapiens
cgtccccccccaggc

SEQ ID NO: 6126433 - DNA, 19 bp, Homo sapiens
cgtcccccgttgtgcctgg

SEQ ID NO: 6126434 - DNA, 17 bp, Homo sapiens
cgtccccctagagactc

SEQ ID NO: 6126435 - DNA, 13 bp, Homo sapiens
cgtccccctccct

SEQ ID NO: 6126436 - DNA, 19 bp, Homo sapiens
cgtccccctccctgcccaa

SEQ ID NO: 6126437 - DNA, 22 bp, Homo sapiens
cgtcccccttccgccttctccc

SEQ ID NO: 6126438 - DNA, 22 bp, Homo sapiens
cgtccccggccacgtctgtgct

SEQ ID NO: 6126439 - DNA, 18 bp, Homo sapiens
cgtccccggcccctgccc

SEQ ID NO: 6126440 - DNA, 23 bp, Homo sapiens
cgtcccctaacccccagtcctca

SEQ ID NO: 6126441 - DNA, 15 bp, Homo sapiens
cgtcccctcaagccc

SEQ ID NO: 6126442 - DNA, 16 bp, Homo sapiens
cgtcccctcaagcccc

SEQ ID NO: 6126443 - DNA, 10 bp, Homo sapiens
cgtcccctcc

SEQ ID NO: 6126444 - DNA, 13 bp, Homo sapiens
cgtcccctccccc

SEQ ID NO: 6126445 - DNA, 13 bp, Homo sapiens
cgtcccctctccc

SEQ ID NO: 6126446 - DNA, 14 bp, Homo sapiens
cgtcccctgcccac

SEQ ID NO: 6126447 - DNA, 18 bp, Homo sapiens
cgtcccctgggccaccct

SEQ ID NO: 6126448 - DNA, 21 bp, Homo sapiens
cgtcccctgggccacccttca

SEQ ID NO: 6126449 - DNA, 15 bp, Homo sapiens
cgtcccgcacagtgg

SEQ ID NO: 6126450 - DNA, 19 bp, Homo sapiens
cgtcccgcgttcaagactt

SEQ ID NO: 6126451 - DNA, 12 bp, Homo sapiens
cgtcccgctatg

SEQ ID NO: 6126452 - DNA, 13 bp, Homo sapiens
cgtcccgctgcct

SEQ ID NO: 6126453 - DNA, 15 bp, Homo sapiens
cgtcccgctgcctcc

SEQ ID NO: 6126454 - DNA, 16 bp, Homo sapiens
cgtcccgctgcctcct

SEQ ID NO: 6126455 - DNA, 19 bp, Homo sapiens
cgtcccgctgcctcctgct

SEQ ID NO: 6126456 - DNA, 12 bp, Homo sapiens
cgtcccggcccc

SEQ ID NO: 6126457 - DNA, 14 bp, Homo sapiens
cgtcccgttctcca

SEQ ID NO: 6126458 - DNA, 22 bp, Homo sapiens
cgtccctcgagctctgtagcct

SEQ ID NO: 6126459 - DNA, 16 bp, Homo sapiens
cgtccctctccccgga

SEQ ID NO: 6126460 - DNA, 22 bp, Homo sapiens
cgtccctgacttcccagctggc

SEQ ID NO: 6126461 - DNA, 18 bp, Homo sapiens
cgtccctgagggcccttc

SEQ ID NO: 6126462 - DNA, 20 bp, Homo sapiens
cgtccctgagggcccttccc

SEQ ID NO: 6126463 - DNA, 22 bp, Homo sapiens
cgtccctgagggcccttcccaa

SEQ ID NO: 6126464 - DNA, 23 bp, Homo sapiens
cgtccctgagggcccttcccaac

SEQ ID NO: 6126465 - DNA, 13 bp, Homo sapiens
cgtccctgctcag

SEQ ID NO: 6126466 - DNA, 15 bp, Homo sapiens
cgtccctgctcagcc

SEQ ID NO: 6126467 - DNA, 19 bp, Homo sapiens
cgtccctgctcagcccatc

SEQ ID NO: 6126468 - DNA, 14 bp, Homo sapiens
cgtccctggcgcag

SEQ ID NO: 6126469 - DNA, 14 bp, Homo sapiens
cgtccctgtccccc

SEQ ID NO: 6126470 - DNA, 22 bp, Homo sapiens
cgtcccttggaaagttcagcca

SEQ ID NO: 6126471 - DNA, 17 bp, Homo sapiens
cgtccctttccctgcat

SEQ ID NO: 6126472 - DNA, 16 bp, Homo sapiens
cgtccctttttctcca

SEQ ID NO: 6126473 - DNA, 23 bp, Homo sapiens
cgtccctttttctccacactcca

SEQ ID NO: 6126474 - DNA, 13 bp, Homo sapiens
cgtccgcacgcgg

SEQ ID NO: 6126475 - DNA, 12 bp, Homo sapiens
cgtccgccctgc

SEQ ID NO: 6126476 - DNA, 19 bp, Homo sapiens
cgtccgccctgctcctccc

SEQ ID NO: 6126477 - DNA, 23 bp, Homo sapiens
cgtccgcgggtcccggccgcgcc

SEQ ID NO: 6126478 - DNA, 13 bp, Homo sapiens
cgtccgctcagcc

SEQ ID NO: 6126479 - DNA, 14 bp, Homo sapiens
cgtccggcctgcag

SEQ ID NO: 6126480 - DNA, 15 bp, Homo sapiens
cgtccggcctgcagc

SEQ ID NO: 6126481 - DNA, 17 bp, Homo sapiens
cgtccggcctgcagccc

SEQ ID NO: 6126482 - DNA, 21 bp, Homo sapiens
cgtccggggtggtggacaggg

SEQ ID NO: 6126483 - DNA, 16 bp, Homo sapiens
cgtccgtccgcccgcc

SEQ ID NO: 6126484 - DNA, 23 bp, Homo sapiens
cgtccgtgggttgctaactgaac

SEQ ID NO: 6126485 - DNA, 16 bp, Homo sapiens
cgtcctatctccccca

SEQ ID NO: 6126486 - DNA, 14 bp, Homo sapiens
cgtcctcacccctg

SEQ ID NO: 6126487 - DNA, 11 bp, Homo sapiens
cgtcctcagca

SEQ ID NO: 6126488 - DNA, 15 bp, Homo sapiens
cgtcctccaagctca

SEQ ID NO: 6126489 - DNA, 22 bp, Homo sapiens
cgtcctccccctgccagtgcct

SEQ ID NO: 6126490 - DNA, 13 bp, Homo sapiens
cgtcctccctcag

SEQ ID NO: 6126491 - DNA, 19 bp, Homo sapiens
cgtcctccctcagcctccc

SEQ ID NO: 6126492 - DNA, 23 bp, Homo sapiens
cgtcctccctcagcctccccttc

SEQ ID NO: 6126493 - DNA, 21 bp, Homo sapiens
cgtcctccctgatcccacccc

SEQ ID NO: 6126494 - DNA, 18 bp, Homo sapiens
cgtcctccgtccatatca

SEQ ID NO: 6126495 - DNA, 12 bp, Homo sapiens
cgtcctcctctg

SEQ ID NO: 6126496 - DNA, 15 bp, Homo sapiens
cgtcctcctctgtga

SEQ ID NO: 6126497 - DNA, 22 bp, Homo sapiens
cgtcctcgttcaaaacattcca

SEQ ID NO: 6126498 - DNA, 15 bp, Homo sapiens
cgtcctctccccagc

SEQ ID NO: 6126499 - DNA, 20 bp, Homo sapiens
cgtcctctccccagcctggc

SEQ ID NO: 6126500 - DNA, 20 bp, Homo sapiens
cgtcctctccctcctggcca

SEQ ID NO: 6126501 - DNA, 13 bp, Homo sapiens
cgtcctctcggct

SEQ ID NO: 6126502 - DNA, 17 bp, Homo sapiens
cgtcctgacgccctgcg

SEQ ID NO: 6126503 - DNA, 18 bp, Homo sapiens
cgtcctgaggagtgtcct

SEQ ID NO: 6126504 - DNA, 19 bp, Homo sapiens
cgtcctgaggagtgtcctg

SEQ ID NO: 6126505 - DNA, 19 bp, Homo sapiens
cgtcctgcagaggaccaca

SEQ ID NO: 6126506 - DNA, 16 bp, Homo sapiens
cgtcctgccacctggg

SEQ ID NO: 6126507 - DNA, 23 bp, Homo sapiens
cgtcctgcccttgctccagcctg

SEQ ID NO: 6126508 - DNA, 13 bp, Homo sapiens
cgtcctgcctggc

SEQ ID NO: 6126509 - DNA, 15 bp, Homo sapiens
cgtcctgcctggcac

SEQ ID NO: 6126510 - DNA, 15 bp, Homo sapiens
cgtcctgcctgtggc

SEQ ID NO: 6126511 - DNA, 19 bp, Homo sapiens
cgtcctgctcgccctgtgc

SEQ ID NO: 6126512 - DNA, 12 bp, Homo sapiens
cgtcctgctggc

SEQ ID NO: 6126513 - DNA, 14 bp, Homo sapiens
cgtcctgctgtccc

SEQ ID NO: 6126514 - DNA, 20 bp, Homo sapiens
cgtcctgctgtccctgtcag

SEQ ID NO: 6126515 - DNA, 18 bp, Homo sapiens
cgtcctgctttggcagtg

SEQ ID NO: 6126516 - DNA, 14 bp, Homo sapiens
cgtcctggactctg

SEQ ID NO: 6126517 - DNA, 16 bp, Homo sapiens
cgtcctgtcccagagg

SEQ ID NO: 6126518 - DNA, 16 bp, Homo sapiens
cgtccttactcctgtg

SEQ ID NO: 6126519 - DNA, 20 bp, Homo sapiens
cgtccttactcctgtgggag

SEQ ID NO: 6126520 - DNA, 21 bp, Homo sapiens
cgtccttccatatccctgccc

SEQ ID NO: 6126521 - DNA, 22 bp, Homo sapiens
cgtcgaaaggtgcagctgcgtt

SEQ ID NO: 6126522 - DNA, 16 bp, Homo sapiens
cgtcgcacagtctctc

SEQ ID NO: 6126523 - DNA, 15 bp, Homo sapiens
cgtcgccctcccagg

SEQ ID NO: 6126524 - DNA, 21 bp, Homo sapiens
cgtcgctggacaacccagaac

SEQ ID NO: 6126525 - DNA, 19 bp, Homo sapiens
cgtcggactgcccccagaa

SEQ ID NO: 6126526 - DNA, 17 bp, Homo sapiens
cgtcggagctgcctgca

SEQ ID NO: 6126527 - DNA, 13 bp, Homo sapiens
cgtcggccctgcg

SEQ ID NO: 6126528 - DNA, 16 bp, Homo sapiens
cgtcgggcccctgcct

SEQ ID NO: 6126529 - DNA, 17 bp, Homo sapiens
cgtcgggcccctgcctg

SEQ ID NO: 6126530 - DNA, 21 bp, Homo sapiens
cgtcgggcccctgcctgcctt

SEQ ID NO: 6126531 - DNA, 19 bp, Homo sapiens
cgtcgggggctgaggggca

SEQ ID NO: 6126532 - DNA, 14 bp, Homo sapiens
cgtctaaactgttt

SEQ ID NO: 6126533 - DNA, 19 bp, Homo sapiens
cgtctaagtcatgagctga

SEQ ID NO: 6126534 - DNA, 22 bp, Homo sapiens
cgtctaatgggggcagtctccc

SEQ ID NO: 6126535 - DNA, 22 bp, Homo sapiens
ctccctctcactgtctgagagt

SEQ ID NO: 6126536 - DNA, 23 bp, Homo sapiens
ctccctctcatgtccctccaggg

SEQ ID NO: 6126537 - DNA, 19 bp, Homo sapiens
ctccctctccaagacagca

SEQ ID NO: 6126538 - DNA, 22 bp, Homo sapiens
ctccctctccaagacagcagca

SEQ ID NO: 6126539 - DNA, 17 bp, Homo sapiens
ctccctctccctcccta

SEQ ID NO: 6126540 - DNA, 14 bp, Homo sapiens
ctccctctcctctg

SEQ ID NO: 6126541 - DNA, 14 bp, Homo sapiens
ctccctctcctgcc

SEQ ID NO: 6126542 - DNA, 17 bp, Homo sapiens
ctccctctcctgcctac

SEQ ID NO: 6126543 - DNA, 16 bp, Homo sapiens
ctccctctctcctgga

SEQ ID NO: 6126544 - DNA, 22 bp, Homo sapiens
ctccctctctcctggactggtt

SEQ ID NO: 6126545 - DNA, 20 bp, Homo sapiens
ctccctctctcttctgctcc

SEQ ID NO: 6126546 - DNA, 12 bp, Homo sapiens
ctccctctctgc

SEQ ID NO: 6126547 - DNA, 15 bp, Homo sapiens
ctccctctctgtgca

SEQ ID NO: 6126548 - DNA, 14 bp, Homo sapiens
ctccctctcttccg

SEQ ID NO: 6126549 - DNA, 20 bp, Homo sapiens
ctccctctcttccgggagct

SEQ ID NO: 6126550 - DNA, 14 bp, Homo sapiens
ctccctctgaccca

SEQ ID NO: 6126551 - DNA, 13 bp, Homo sapiens
ctccctctgacct

SEQ ID NO: 6126552 - DNA, 17 bp, Homo sapiens
ctccctctgacctgcag

SEQ ID NO: 6126553 - DNA, 16 bp, Homo sapiens
ctccctctgaggctgt

SEQ ID NO: 6126554 - DNA, 17 bp, Homo sapiens
ctccctctgaggctgta

SEQ ID NO: 6126555 - DNA, 11 bp, Homo sapiens
ctccctctgat

SEQ ID NO: 6126556 - DNA, 12 bp, Homo sapiens
ctccctctgccc

SEQ ID NO: 6126557 - DNA, 14 bp, Homo sapiens
ctccctctgccggc

SEQ ID NO: 6126558 - DNA, 19 bp, Homo sapiens
ctccctctgcctcatcctc

SEQ ID NO: 6126559 - DNA, 16 bp, Homo sapiens
ctccctctgctctcat

SEQ ID NO: 6126560 - DNA, 11 bp, Homo sapiens
ctccctctgga

SEQ ID NO: 6126561 - DNA, 13 bp, Homo sapiens
ctccctctggatc

SEQ ID NO: 6126562 - DNA, 14 bp, Homo sapiens
ctccctctggccct

SEQ ID NO: 6126563 - DNA, 14 bp, Homo sapiens
ctccctctggtccc

SEQ ID NO: 6126564 - DNA, 21 bp, Homo sapiens
ctccctctggtctactctaga

SEQ ID NO: 6126565 - DNA, 18 bp, Homo sapiens
ctccctctgtccaccagc

SEQ ID NO: 6126566 - DNA, 13 bp, Homo sapiens
ctccctctgtctt

SEQ ID NO: 6126567 - DNA, 12 bp, Homo sapiens
ctccctcttccc

SEQ ID NO: 6126568 - DNA, 13 bp, Homo sapiens
ctccctcttggtt

SEQ ID NO: 6126569 - DNA, 11 bp, Homo sapiens
ctccctcttgt

SEQ ID NO: 6126570 - DNA, 12 bp, Homo sapiens
ctccctcttgtt

SEQ ID NO: 6126571 - DNA, 13 bp, Homo sapiens
ctccctctttcta

SEQ ID NO: 6126572 - DNA, 22 bp, Homo sapiens
ctccctctttctagcctggggc

SEQ ID NO: 6126573 - DNA, 16 bp, Homo sapiens
ctccctctttttctct

SEQ ID NO: 6126574 - DNA, 21 bp, Homo sapiens
ctccctgaaaatgtttttctg

SEQ ID NO: 6126575 - DNA, 18 bp, Homo sapiens
ctccctgaaacactgctt

SEQ ID NO: 6126576 - DNA, 16 bp, Homo sapiens
ctccctgaacctcagt

SEQ ID NO: 6126577 - DNA, 17 bp, Homo sapiens
ctccctgaacctcagtt

SEQ ID NO: 6126578 - DNA, 16 bp, Homo sapiens
ctccctgaagccagcc

SEQ ID NO: 6126579 - DNA, 18 bp, Homo sapiens
ctccctgaagccagcctt

SEQ ID NO: 6126580 - DNA, 19 bp, Homo sapiens
ctccctgaagccagccttc

SEQ ID NO: 6126581 - DNA, 18 bp, Homo sapiens
ctccctgaagcctttgca

SEQ ID NO: 6126582 - DNA, 20 bp, Homo sapiens
ctccctgaagtaagcaaaga

SEQ ID NO: 6126583 - DNA, 19 bp, Homo sapiens
ctccctgaatctgaccaca

SEQ ID NO: 6126584 - DNA, 18 bp, Homo sapiens
ctccctgaccaccctgcc

SEQ ID NO: 6126585 - DNA, 19 bp, Homo sapiens
ctccctgaccaccctgcct

SEQ ID NO: 6126586 - DNA, 23 bp, Homo sapiens
ctccctgaccaccctgcctgtgg

SEQ ID NO: 6126587 - DNA, 16 bp, Homo sapiens
ctccctgaccccctgt

SEQ ID NO: 6126588 - DNA, 16 bp, Homo sapiens
ctccctgaccctgcag

SEQ ID NO: 6126589 - DNA, 19 bp, Homo sapiens
ctccctgaccctgctccta

SEQ ID NO: 6126590 - DNA, 14 bp, Homo sapiens
ctccctgaccctgt

SEQ ID NO: 6126591 - DNA, 16 bp, Homo sapiens
ctccctgaccctgtat

SEQ ID NO: 6126592 - DNA, 19 bp, Homo sapiens
ctccctgaccttctccagg

SEQ ID NO: 6126593 - DNA, 17 bp, Homo sapiens
ctccctgacggtggaat

SEQ ID NO: 6126594 - DNA, 19 bp, Homo sapiens
ctccctgactccctgtggg

SEQ ID NO: 6126595 - DNA, 15 bp, Homo sapiens
ctccctgactggcct

SEQ ID NO: 6126596 - DNA, 24 bp, Homo sapiens
ctccctgactgggggcagacatgg

SEQ ID NO: 6126597 - DNA, 14 bp, Homo sapiens
ctccctgacttttc

SEQ ID NO: 6126598 - DNA, 16 bp, Homo sapiens
ctccctgacttttctg

SEQ ID NO: 6126599 - DNA, 12 bp, Homo sapiens
ctccctgagatg

SEQ ID NO: 6126600 - DNA, 23 bp, Homo sapiens
ctccctgagcctgccccagctgg

SEQ ID NO: 6126601 - DNA, 12 bp, Homo sapiens
ctccctgagctt

SEQ ID NO: 6126602 - DNA, 13 bp, Homo sapiens
ctccctgagggcg

SEQ ID NO: 6126603 - DNA, 22 bp, Homo sapiens
ctccctgaggtacctttccacc

SEQ ID NO: 6126604 - DNA, 23 bp, Homo sapiens
ctccctgaggtacctttccaccc

SEQ ID NO: 6126605 - DNA, 19 bp, Homo sapiens
ctccctgagtctggacctc

SEQ ID NO: 6126606 - DNA, 23 bp, Homo sapiens
ctccctgagtctggacctccatc

SEQ ID NO: 6126607 - DNA, 12 bp, Homo sapiens
ctccctgatgta

SEQ ID NO: 6126608 - DNA, 11 bp, Homo sapiens
ctccctgatta

SEQ ID NO: 6126609 - DNA, 19 bp, Homo sapiens
ctccctgattaaagtgcct

SEQ ID NO: 6126610 - DNA, 16 bp, Homo sapiens
ctccctgcaataaaat

SEQ ID NO: 6126611 - DNA, 15 bp, Homo sapiens
ctccctgcacagcct

SEQ ID NO: 6126612 - DNA, 16 bp, Homo sapiens
ctccctgcacagcctc

SEQ ID NO: 6126613 - DNA, 18 bp, Homo sapiens
ctccctgcacagcctcta

SEQ ID NO: 6126614 - DNA, 13 bp, Homo sapiens
ctccctgcagcca

SEQ ID NO: 6126615 - DNA, 18 bp, Homo sapiens
ctccctgcagccaccaga

SEQ ID NO: 6126616 - DNA, 14 bp, Homo sapiens
ctccctgcaggggc

SEQ ID NO: 6126617 - DNA, 15 bp, Homo sapiens
ctccctgcaggggct

SEQ ID NO: 6126618 - DNA, 16 bp, Homo sapiens
ctccctgcatcctgag

SEQ ID NO: 6126619 - DNA, 19 bp, Homo sapiens
ctccctgcatcctgaggcc

SEQ ID NO: 6126620 - DNA, 20 bp, Homo sapiens
ctccctgcatctgaccagca

SEQ ID NO: 6126621 - DNA, 22 bp, Homo sapiens
ctccctgcatggcatcctccag

SEQ ID NO: 6126622 - DNA, 23 bp, Homo sapiens
ctccctgcatggcatcctccagc

SEQ ID NO: 6126623 - DNA, 16 bp, Homo sapiens
ctccctgccaactcca

SEQ ID NO: 6126624 - DNA, 21 bp, Homo sapiens
ctccctgccaagtctcagaag

SEQ ID NO: 6126625 - DNA, 13 bp, Homo sapiens
ctccctgccagag

SEQ ID NO: 6126626 - DNA, 13 bp, Homo sapiens
ctccctgcccccc

SEQ ID NO: 6126627 - DNA, 17 bp, Homo sapiens
ctccctgccccccagcc

SEQ ID NO: 6126628 - DNA, 13 bp, Homo sapiens
ctccctgcccctc

SEQ ID NO: 6126629 - DNA, 14 bp, Homo sapiens
ctccctgcccctcc

SEQ ID NO: 6126630 - DNA, 20 bp, Homo sapiens
ctccctgccctcgggtctcc

SEQ ID NO: 6126631 - DNA, 15 bp, Homo sapiens
ctccctgccctgtcc

SEQ ID NO: 6126632 - DNA, 15 bp, Homo sapiens
ctccctgccgcctca

SEQ ID NO: 6126633 - DNA, 19 bp, Homo sapiens
ctccctgccgcctcaatgt

SEQ ID NO: 6126634 - DNA, 21 bp, Homo sapiens
ctccctgcctacacacacagc

SEQ ID NO: 6126635 - DNA, 12 bp, Homo sapiens
ctccctgcctca

SEQ ID NO: 6126636 - DNA, 18 bp, Homo sapiens
ctccctgcctcacatctc

SEQ ID NO: 6126637 - DNA, 14 bp, Homo sapiens
ctccctgcctcagc

SEQ ID NO: 6126638 - DNA, 18 bp, Homo sapiens
ctccctgcctcaggcctc

SEQ ID NO: 6126639 - DNA, 18 bp, Homo sapiens
ctccctgcctccacccac

SEQ ID NO: 6126640 - DNA, 15 bp, Homo sapiens
ctccctgcctccagg

SEQ ID NO: 6126641 - DNA, 17 bp, Homo sapiens
ctccctgcctcctgcct

SEQ ID NO: 6126642 - DNA, 18 bp, Homo sapiens
ctccctgcctcctgccta

SEQ ID NO: 6126643 - DNA, 13 bp, Homo sapiens
ctccctgcctgag

SEQ ID NO: 6126644 - DNA, 14 bp, Homo sapiens
ctccctgcctgctc

SEQ ID NO: 6126645 - DNA, 15 bp, Homo sapiens
ctccctgcctggccc

SEQ ID NO: 6126646 - DNA, 19 bp, Homo sapiens
ctccctgcctggcggcagg

SEQ ID NO: 6126647 - DNA, 20 bp, Homo sapiens
ctccctgcgcttcctgagca

SEQ ID NO: 6126648 - DNA, 17 bp, Homo sapiens
ctccctgctagcacaga

SEQ ID NO: 6126649 - DNA, 19 bp, Homo sapiens
ctccctgctagcacagagg

SEQ ID NO: 6126650 - DNA, 12 bp, Homo sapiens
ctccctgctcag

SEQ ID NO: 6126651 - DNA, 14 bp, Homo sapiens
ctccctgctcagct

SEQ ID NO: 6126652 - DNA, 23 bp, Homo sapiens
ctccctgctcagctggccgggtt

SEQ ID NO: 6126653 - DNA, 14 bp, Homo sapiens
ctccctgctccacg

SEQ ID NO: 6126654 - DNA, 15 bp, Homo sapiens
ctccctgctcccagg

SEQ ID NO: 6126655 - DNA, 18 bp, Homo sapiens
ctccctgctcccagggac

SEQ ID NO: 6126656 - DNA, 13 bp, Homo sapiens
ctccctgctcctc

SEQ ID NO: 6126657 - DNA, 15 bp, Homo sapiens
ctccctgctcctcat

SEQ ID NO: 6126658 - DNA, 13 bp, Homo sapiens
ctccctgctgcca

SEQ ID NO: 6126659 - DNA, 15 bp, Homo sapiens
ctccctgctgtgcca

SEQ ID NO: 6126660 - DNA, 23 bp, Homo sapiens
ctccctgctgtgccatgctgggc

SEQ ID NO: 6126661 - DNA, 13 bp, Homo sapiens
ctccctgcttcat

SEQ ID NO: 6126662 - DNA, 18 bp, Homo sapiens
ctccctgcttgcacactt

SEQ ID NO: 6126663 - DNA, 21 bp, Homo sapiens
ctccctgcttgcaggaggcca

SEQ ID NO: 6126664 - DNA, 22 bp, Homo sapiens
ctccctgcttggcttatgaaaa

SEQ ID NO: 6126665 - DNA, 20 bp, Homo sapiens
ctccctgctttggctgaggg

SEQ ID NO: 6126666 - DNA, 18 bp, Homo sapiens
ctccctggaagctggaag

SEQ ID NO: 6126667 - DNA, 12 bp, Homo sapiens
ctccctggaatg

SEQ ID NO: 6126668 - DNA, 16 bp, Homo sapiens
ctccctggagaagcac

SEQ ID NO: 6126669 - DNA, 23 bp, Homo sapiens
ctccctggagaagggacatggga

SEQ ID NO: 6126670 - DNA, 13 bp, Homo sapiens
ctccctggagccc

SEQ ID NO: 6126671 - DNA, 12 bp, Homo sapiens
ctccctggagct

SEQ ID NO: 6126672 - DNA, 14 bp, Homo sapiens
ctccctggagctag

SEQ ID NO: 6126673 - DNA, 22 bp, Homo sapiens
ctccctggagctagtgtctcct

SEQ ID NO: 6126674 - DNA, 16 bp, Homo sapiens
ctccctggaggcacgc

SEQ ID NO: 6126675 - DNA, 20 bp, Homo sapiens
ctccctggaggcacgcacca

SEQ ID NO: 6126676 - DNA, 11 bp, Homo sapiens
ctccctggagt

SEQ ID NO: 6126677 - DNA, 18 bp, Homo sapiens
ctccctggatcagaacag

SEQ ID NO: 6126678 - DNA, 23 bp, Homo sapiens
ctccctggatcagaacaggagct

SEQ ID NO: 6126679 - DNA, 12 bp, Homo sapiens
ctccctggatga

SEQ ID NO: 6126680 - DNA, 19 bp, Homo sapiens
ctccctggatgtgtggggc

SEQ ID NO: 6126681 - DNA, 19 bp, Homo sapiens
ctccctggatttttaccag

SEQ ID NO: 6126682 - DNA, 16 bp, Homo sapiens
ctccctggcaggatgc

SEQ ID NO: 6126683 - DNA, 14 bp, Homo sapiens
ctccctggcatgtc

SEQ ID NO: 6126684 - DNA, 14 bp, Homo sapiens
ctccctggcccagc

SEQ ID NO: 6126685 - DNA, 14 bp, Homo sapiens
ctccctggccctca

SEQ ID NO: 6126686 - DNA, 15 bp, Homo sapiens
ctccctggccctcaa

SEQ ID NO: 6126687 - DNA, 18 bp, Homo sapiens
ctccctggcctcacgccc

SEQ ID NO: 6126688 - DNA, 15 bp, Homo sapiens
ctccctggctcaagc

SEQ ID NO: 6126689 - DNA, 14 bp, Homo sapiens
ctccctggctcact

SEQ ID NO: 6126690 - DNA, 15 bp, Homo sapiens
ctccctggctcccat

SEQ ID NO: 6126691 - DNA, 16 bp, Homo sapiens
ctccctggctccctcc

SEQ ID NO: 6126692 - DNA, 20 bp, Homo sapiens
ctccctggctctcagaaggt

SEQ ID NO: 6126693 - DNA, 15 bp, Homo sapiens
ctccctggctgcagc

SEQ ID NO: 6126694 - DNA, 18 bp, Homo sapiens
ctccctggctgccctggc

SEQ ID NO: 6126695 - DNA, 22 bp, Homo sapiens
ctccctggctgccctggccctg

SEQ ID NO: 6126696 - DNA, 17 bp, Homo sapiens
ctccctggctgtgagca

SEQ ID NO: 6126697 - DNA, 17 bp, Homo sapiens
ctccctggcttgagtga

SEQ ID NO: 6126698 - DNA, 22 bp, Homo sapiens
ctccctgggcaccctgcaggca

SEQ ID NO: 6126699 - DNA, 18 bp, Homo sapiens
ctccctgggccacctcct

SEQ ID NO: 6126700 - DNA, 12 bp, Homo sapiens
ctccctgggcct

SEQ ID NO: 6126701 - DNA, 15 bp, Homo sapiens
ctccctgggcctgtc

SEQ ID NO: 6126702 - DNA, 17 bp, Homo sapiens
ctccctgggcctgtctc

SEQ ID NO: 6126703 - DNA, 19 bp, Homo sapiens
ctccctgggcctgtctcag

SEQ ID NO: 6126704 - DNA, 12 bp, Homo sapiens
ctccctgggctg

SEQ ID NO: 6126705 - DNA, 15 bp, Homo sapiens
ctccctgggctggca

SEQ ID NO: 6126706 - DNA, 17 bp, Homo sapiens
ctccctgggctggcatg

SEQ ID NO: 6126707 - DNA, 10 bp, Homo sapiens
ctccctgggg

SEQ ID NO: 6126708 - DNA, 22 bp, Homo sapiens
ctccctggggaccaggagctag

SEQ ID NO: 6126709 - DNA, 13 bp, Homo sapiens
ctccctggggacg

SEQ ID NO: 6126710 - DNA, 19 bp, Homo sapiens
ctccctggggacggggctc

SEQ ID NO: 6126711 - DNA, 20 bp, Homo sapiens
ctccctggggacggggctcc

SEQ ID NO: 6126712 - DNA, 21 bp, Homo sapiens
ctccctggggacggggctccc

SEQ ID NO: 6126713 - DNA, 17 bp, Homo sapiens
ctccctggggaggaccc

SEQ ID NO: 6126714 - DNA, 18 bp, Homo sapiens
ctccctggggaggacccc

SEQ ID NO: 6126715 - DNA, 19 bp, Homo sapiens
ctccctggggaggacccct

SEQ ID NO: 6126716 - DNA, 13 bp, Homo sapiens
ctccctgggggcg

SEQ ID NO: 6126717 - DNA, 16 bp, Homo sapiens
cgtctacctgaggggc

SEQ ID NO: 6126718 - DNA, 15 bp, Homo sapiens
cgtctagcttagttt

SEQ ID NO: 6126719 - DNA, 17 bp, Homo sapiens
cgtctcaacccctcaca

SEQ ID NO: 6126720 - DNA, 14 bp, Homo sapiens
cgtctcagaaggct

SEQ ID NO: 6126721 - DNA, 16 bp, Homo sapiens
cgtctcatcctccttt

SEQ ID NO: 6126722 - DNA, 18 bp, Homo sapiens
cgtctcatcctcctttca

SEQ ID NO: 6126723 - DNA, 14 bp, Homo sapiens
cgtctcatgtaaaa

SEQ ID NO: 6126724 - DNA, 18 bp, Homo sapiens
cgtctcatgtaaaataag

SEQ ID NO: 6126725 - DNA, 20 bp, Homo sapiens
cgtctccaggggctgcttcc

SEQ ID NO: 6126726 - DNA, 15 bp, Homo sapiens
cgtctccatctctgg

SEQ ID NO: 6126727 - DNA, 17 bp, Homo sapiens
cgtctcccatcttaact

SEQ ID NO: 6126728 - DNA, 19 bp, Homo sapiens
cgtctccccatgctgggct

SEQ ID NO: 6126729 - DNA, 20 bp, Homo sapiens
cgtctcccccaacagctgga

SEQ ID NO: 6126730 - DNA, 24 bp, Homo sapiens
cgtctcccccaacagctggaccct

SEQ ID NO: 6126731 - DNA, 14 bp, Homo sapiens
cgtctcccccagag

SEQ ID NO: 6126732 - DNA, 20 bp, Homo sapiens
cgtctcccccagagtgctgt

SEQ ID NO: 6126733 - DNA, 22 bp, Homo sapiens
cgtctcccccagagtgctgtcg

SEQ ID NO: 6126734 - DNA, 15 bp, Homo sapiens
cgtctccccttctct

SEQ ID NO: 6126735 - DNA, 14 bp, Homo sapiens
cgtctccctcgaca

SEQ ID NO: 6126736 - DNA, 18 bp, Homo sapiens
cgtctccctcgacagcgc

SEQ ID NO: 6126737 - DNA, 17 bp, Homo sapiens
cgtctccctggtgcctc

SEQ ID NO: 6126738 - DNA, 21 bp, Homo sapiens
cgtctccctggtgcctctgtg

SEQ ID NO: 6126739 - DNA, 13 bp, Homo sapiens
cgtctcctccctc

SEQ ID NO: 6126740 - DNA, 15 bp, Homo sapiens
cgtctcctttgacat

SEQ ID NO: 6126741 - DNA, 14 bp, Homo sapiens
cgtctcggcccctc

SEQ ID NO: 6126742 - DNA, 19 bp, Homo sapiens
cgtctctactaaaaatgca

SEQ ID NO: 6126743 - DNA, 22 bp, Homo sapiens
cgtctctccctccctttgaaat

SEQ ID NO: 6126744 - DNA, 16 bp, Homo sapiens
cgtctctcctgctctc

SEQ ID NO: 6126745 - DNA, 14 bp, Homo sapiens
cgtctctctcccat

SEQ ID NO: 6126746 - DNA, 11 bp, Homo sapiens
cgtctctctgc

SEQ ID NO: 6126747 - DNA, 14 bp, Homo sapiens
cgtctctcttgctt

SEQ ID NO: 6126748 - DNA, 13 bp, Homo sapiens
cgtctctgccctg

SEQ ID NO: 6126749 - DNA, 16 bp, Homo sapiens
cgtctctgccgcctgc

SEQ ID NO: 6126750 - DNA, 13 bp, Homo sapiens
cgtctctgctctg

SEQ ID NO: 6126751 - DNA, 13 bp, Homo sapiens
cgtctctggcccc

SEQ ID NO: 6126752 - DNA, 22 bp, Homo sapiens
cgtctctgtccgcgtcctttcc

SEQ ID NO: 6126753 - DNA, 14 bp, Homo sapiens
cgtctctgtcctcg

SEQ ID NO: 6126754 - DNA, 18 bp, Homo sapiens
cgtctgacaaatgtgtat

SEQ ID NO: 6126755 - DNA, 21 bp, Homo sapiens
cgtctgacaggcaatgctggc

SEQ ID NO: 6126756 - DNA, 14 bp, Homo sapiens
cgtctgaccccagc

SEQ ID NO: 6126757 - DNA, 22 bp, Homo sapiens
cgtctgaccccagcccagacag

SEQ ID NO: 6126758 - DNA, 15 bp, Homo sapiens
cgtctgaccctctcc

SEQ ID NO: 6126759 - DNA, 16 bp, Homo sapiens
cgtctgaccctctcca

SEQ ID NO: 6126760 - DNA, 15 bp, Homo sapiens
cgtctgactccagag

SEQ ID NO: 6126761 - DNA, 18 bp, Homo sapiens
cgtctgactccagagtct

SEQ ID NO: 6126762 - DNA, 20 bp, Homo sapiens
cgtctgactccctccccacc

SEQ ID NO: 6126763 - DNA, 13 bp, Homo sapiens
cgtctgagctggg

SEQ ID NO: 6126764 - DNA, 16 bp, Homo sapiens
cgtctgatgttttgat

SEQ ID NO: 6126765 - DNA, 17 bp, Homo sapiens
cgtctgcaggggcctgg

SEQ ID NO: 6126766 - DNA, 23 bp, Homo sapiens
cgtctgcagggtgacgcctgaga

SEQ ID NO: 6126767 - DNA, 14 bp, Homo sapiens
cgtctgccaccagc

SEQ ID NO: 6126768 - DNA, 13 bp, Homo sapiens
cgtctgccaggcc

SEQ ID NO: 6126769 - DNA, 14 bp, Homo sapiens
cgtctgccaggccc

SEQ ID NO: 6126770 - DNA, 18 bp, Homo sapiens
cgtctgccaggcccatct

SEQ ID NO: 6126771 - DNA, 23 bp, Homo sapiens
cgtctgccaggggtaacctggcc

SEQ ID NO: 6126772 - DNA, 18 bp, Homo sapiens
cgtctgccggacccggag

SEQ ID NO: 6126773 - DNA, 20 bp, Homo sapiens
cgtctgcctaggagctggct

SEQ ID NO: 6126774 - DNA, 13 bp, Homo sapiens
cgtctgcctgggc

SEQ ID NO: 6126775 - DNA, 14 bp, Homo sapiens
cgtctgcctgggcc

SEQ ID NO: 6126776 - DNA, 18 bp, Homo sapiens
cgtctgccttggcatcct

SEQ ID NO: 6126777 - DNA, 12 bp, Homo sapiens
cgtctgctctgg

SEQ ID NO: 6126778 - DNA, 23 bp, Homo sapiens
cgtctgctgttgattccactgaa

SEQ ID NO: 6126779 - DNA, 14 bp, Homo sapiens
cgtctggaggggcc

SEQ ID NO: 6126780 - DNA, 18 bp, Homo sapiens
cgtctggcgagcccttag

SEQ ID NO: 6126781 - DNA, 14 bp, Homo sapiens
cgtctgggagaaat

SEQ ID NO: 6126782 - DNA, 21 bp, Homo sapiens
cgtctgggagaaattgacaga

SEQ ID NO: 6126783 - DNA, 18 bp, Homo sapiens
cgtctggggttcagcccc

SEQ ID NO: 6126784 - DNA, 14 bp, Homo sapiens
cgtctgtccatctg

SEQ ID NO: 6126785 - DNA, 21 bp, Homo sapiens
cgtctgtcccaagtcctgctc

SEQ ID NO: 6126786 - DNA, 19 bp, Homo sapiens
cgtctgtctgtcgcccttc

SEQ ID NO: 6126787 - DNA, 13 bp, Homo sapiens
cgtctgtctgtct

SEQ ID NO: 6126788 - DNA, 11 bp, Homo sapiens
cgtctgtgaat

SEQ ID NO: 6126789 - DNA, 12 bp, Homo sapiens
cgtctgtgaatg

SEQ ID NO: 6126790 - DNA, 14 bp, Homo sapiens
cgtctgtgaatgct

SEQ ID NO: 6126791 - DNA, 14 bp, Homo sapiens
cgtctgtgctctgt

SEQ ID NO: 6126792 - DNA, 21 bp, Homo sapiens
cgtctgtggctttcagcctct

SEQ ID NO: 6126793 - DNA, 22 bp, Homo sapiens
cgtctgtgtggggttctcagtg

SEQ ID NO: 6126794 - DNA, 21 bp, Homo sapiens
cgtctgtgtgtgacccctcct

SEQ ID NO: 6126795 - DNA, 17 bp, Homo sapiens
cgtctgtttataaacat

SEQ ID NO: 6126796 - DNA, 20 bp, Homo sapiens
cgtcttagcaagaagtaaaa

SEQ ID NO: 6126797 - DNA, 21 bp, Homo sapiens
cgtcttagcagtgatttttat

SEQ ID NO: 6126798 - DNA, 14 bp, Homo sapiens
cgtcttcaaattaa

SEQ ID NO: 6126799 - DNA, 17 bp, Homo sapiens
cgtcttcaagaacttct

SEQ ID NO: 6126800 - DNA, 16 bp, Homo sapiens
cgtcttcaatctctgt

SEQ ID NO: 6126801 - DNA, 19 bp, Homo sapiens
cgtcttcaatctctgttct

SEQ ID NO: 6126802 - DNA, 16 bp, Homo sapiens
cgtcttcagctgcatt

SEQ ID NO: 6126803 - DNA, 18 bp, Homo sapiens
cgtcttcatctccctgcc

SEQ ID NO: 6126804 - DNA, 23 bp, Homo sapiens
cgtcttccagagaacctgtgggc

SEQ ID NO: 6126805 - DNA, 13 bp, Homo sapiens
cgtcttccctgct

SEQ ID NO: 6126806 - DNA, 17 bp, Homo sapiens
cgtcttccgcccctgcc

SEQ ID NO: 6126807 - DNA, 18 bp, Homo sapiens
cgtcttccgcccctgcct

SEQ ID NO: 6126808 - DNA, 16 bp, Homo sapiens
cgtcttccgtctcccc

SEQ ID NO: 6126809 - DNA, 11 bp, Homo sapiens
cgtcttccttc

SEQ ID NO: 6126810 - DNA, 13 bp, Homo sapiens
cgtcttccttctt

SEQ ID NO: 6126811 - DNA, 19 bp, Homo sapiens
cgtcttcgccctctgaaat

SEQ ID NO: 6126812 - DNA, 17 bp, Homo sapiens
cgtcttctccctattcc

SEQ ID NO: 6126813 - DNA, 21 bp, Homo sapiens
cgtcttgaacgagcagcccag

SEQ ID NO: 6126814 - DNA, 13 bp, Homo sapiens
cgtcttgcccagc

SEQ ID NO: 6126815 - DNA, 18 bp, Homo sapiens
cgtcttgctatttgagca

SEQ ID NO: 6126816 - DNA, 16 bp, Homo sapiens
cgtcttggtgtaattt

SEQ ID NO: 6126817 - DNA, 13 bp, Homo sapiens
cgtcttgtgaaat

SEQ ID NO: 6126818 - DNA, 16 bp, Homo sapiens
cgtcttgtgaaattgt

SEQ ID NO: 6126819 - DNA, 20 bp, Homo sapiens
cgtcttgtgaaattgtgtag

SEQ ID NO: 6126820 - DNA, 18 bp, Homo sapiens
cgtcttgtgtttgctgca

SEQ ID NO: 6126821 - DNA, 13 bp, Homo sapiens
cgtctttaagaga

SEQ ID NO: 6126822 - DNA, 14 bp, Homo sapiens
cgtctttaagagac

SEQ ID NO: 6126823 - DNA, 15 bp, Homo sapiens
cgtctttaagagact

SEQ ID NO: 6126824 - DNA, 14 bp, Homo sapiens
cgtctttacccctg

SEQ ID NO: 6126825 - DNA, 20 bp, Homo sapiens
cgtctttgcttgtcctgctc

SEQ ID NO: 6126826 - DNA, 19 bp, Homo sapiens
cgtctttggttcctcatgg

SEQ ID NO: 6126827 - DNA, 14 bp, Homo sapiens
cgtctttgtgtatg

SEQ ID NO: 6126828 - DNA, 18 bp, Homo sapiens
cgtcttttcctgtttcct

SEQ ID NO: 6126829 - DNA, 14 bp, Homo sapiens
cgtctttttccaaa

SEQ ID NO: 6126830 - DNA, 14 bp, Homo sapiens
cgtctttttgtttg

SEQ ID NO: 6126831 - DNA, 20 bp, Homo sapiens
cgtgaaaaccaaccctgtgg

SEQ ID NO: 6126832 - DNA, 23 bp, Homo sapiens
cgtgaaaaccaaccctgtgggct

SEQ ID NO: 6126833 - DNA, 14 bp, Homo sapiens
cgtgaaacacaata

SEQ ID NO: 6126834 - DNA, 22 bp, Homo sapiens
cgtgaaacacaccaggctgtgg

SEQ ID NO: 6126835 - DNA, 17 bp, Homo sapiens
cgtgaaaccccgtctct

SEQ ID NO: 6126836 - DNA, 19 bp, Homo sapiens
cgtgaaagaattatttttg

SEQ ID NO: 6126837 - DNA, 18 bp, Homo sapiens
cgtgaaaggctgtggcat

SEQ ID NO: 6126838 - DNA, 17 bp, Homo sapiens
cgtgaaagtgcattttt

SEQ ID NO: 6126839 - DNA, 18 bp, Homo sapiens
cgtgaaatttgcctctgt

SEQ ID NO: 6126840 - DNA, 14 bp, Homo sapiens
cgtgaactcctgag

SEQ ID NO: 6126841 - DNA, 17 bp, Homo sapiens
cgtgaactgcagtgatg

SEQ ID NO: 6126842 - DNA, 18 bp, Homo sapiens
cgtgaactgcgtgccagt

SEQ ID NO: 6126843 - DNA, 14 bp, Homo sapiens
cgtgaagaagcctg

SEQ ID NO: 6126844 - DNA, 16 bp, Homo sapiens
cgtgaagcagtgcctc

SEQ ID NO: 6126845 - DNA, 17 bp, Homo sapiens
cgtgaagcagtgcctcg

SEQ ID NO: 6126846 - DNA, 20 bp, Homo sapiens
cgtgaagcagtgcctcgagg

SEQ ID NO: 6126847 - DNA, 21 bp, Homo sapiens
cgtgaagcagtgcctcgaggc

SEQ ID NO: 6126848 - DNA, 13 bp, Homo sapiens
cgtgaagcatcca

SEQ ID NO: 6126849 - DNA, 13 bp, Homo sapiens
cgtgaaggacctg

SEQ ID NO: 6126850 - DNA, 13 bp, Homo sapiens
cgtgaagggattt

SEQ ID NO: 6126851 - DNA, 15 bp, Homo sapiens
cgtgaagggcaccga

SEQ ID NO: 6126852 - DNA, 17 bp, Homo sapiens
cgtgaagtatactgtat

SEQ ID NO: 6126853 - DNA, 18 bp, Homo sapiens
cgtgaagtcacattccac

SEQ ID NO: 6126854 - DNA, 16 bp, Homo sapiens
cgtgaattgctttatg

SEQ ID NO: 6126855 - DNA, 15 bp, Homo sapiens
cgtgacaacacaaat

SEQ ID NO: 6126856 - DNA, 12 bp, Homo sapiens
cgtgacaacact

SEQ ID NO: 6126857 - DNA, 16 bp, Homo sapiens
cgtgacactctccttg

SEQ ID NO: 6126858 - DNA, 17 bp, Homo sapiens
cgtgacagactcctgag

SEQ ID NO: 6126859 - DNA, 18 bp, Homo sapiens
cgtgacagactcctgagg

SEQ ID NO: 6126860 - DNA, 19 bp, Homo sapiens
cgtgacagcctctgactca

SEQ ID NO: 6126861 - DNA, 13 bp, Homo sapiens
cgtgacaggctcg

SEQ ID NO: 6126862 - DNA, 16 bp, Homo sapiens
cgtgacagtgcctggg

SEQ ID NO: 6126863 - DNA, 13 bp, Homo sapiens
cgtgacagtggct

SEQ ID NO: 6126864 - DNA, 18 bp, Homo sapiens
cgtgacatccccaccctt

SEQ ID NO: 6126865 - DNA, 23 bp, Homo sapiens
cgtgaccaactagacattctgtc

SEQ ID NO: 6126866 - DNA, 19 bp, Homo sapiens
cgtgaccaattgccctgcc

SEQ ID NO: 6126867 - DNA, 18 bp, Homo sapiens
cgtgaccagccccgtgta

SEQ ID NO: 6126868 - DNA, 14 bp, Homo sapiens
cgtgacccagtggc

SEQ ID NO: 6126869 - DNA, 18 bp, Homo sapiens
cgtgacccgacctggccg

SEQ ID NO: 6126870 - DNA, 17 bp, Homo sapiens
cgtgaccctatgaccaa

SEQ ID NO: 6126871 - DNA, 15 bp, Homo sapiens
cgtgaccctgtgccc

SEQ ID NO: 6126872 - DNA, 18 bp, Homo sapiens
cgtgaccctgtgccccgc

SEQ ID NO: 6126873 - DNA, 16 bp, Homo sapiens
cgtgacccttcagggc

SEQ ID NO: 6126874 - DNA, 18 bp, Homo sapiens
cgtgacccttcagggcca

SEQ ID NO: 6126875 - DNA, 15 bp, Homo sapiens
cgtgaccggcccgcc

SEQ ID NO: 6126876 - DNA, 13 bp, Homo sapiens
cgtgacctattca

SEQ ID NO: 6126877 - DNA, 20 bp, Homo sapiens
cgtgacctattcaccctcca

SEQ ID NO: 6126878 - DNA, 16 bp, Homo sapiens
cgtgacctggtcaggg

SEQ ID NO: 6126879 - DNA, 16 bp, Homo sapiens
cgtgacgctgaataaa

SEQ ID NO: 6126880 - DNA, 19 bp, Homo sapiens
cgtgacgctgaataaatgt

SEQ ID NO: 6126881 - DNA, 18 bp, Homo sapiens
cgtgacggacatccaggc

SEQ ID NO: 6126882 - DNA, 22 bp, Homo sapiens
cgtgacggagcccacactgcca

SEQ ID NO: 6126883 - DNA, 15 bp, Homo sapiens
cgtgacgtctgggtg

SEQ ID NO: 6126884 - DNA, 14 bp, Homo sapiens
cgtgactcacccaa

SEQ ID NO: 6126885 - DNA, 15 bp, Homo sapiens
cgtgactcagagctt

SEQ ID NO: 6126886 - DNA, 18 bp, Homo sapiens
cgtgactcagcagcctgc

SEQ ID NO: 6126887 - DNA, 19 bp, Homo sapiens
cgtgacttcagactctctc

SEQ ID NO: 6126888 - DNA, 22 bp, Homo sapiens
cgtgacttcagactctctcctc

SEQ ID NO: 6126889 - DNA, 12 bp, Homo sapiens
cgtgagaagcat

SEQ ID NO: 6126890 - DNA, 23 bp, Homo sapiens
cgtgagacgccaccattcctgga

SEQ ID NO: 6126891 - DNA, 18 bp, Homo sapiens
cgtgagagaaagagagaa

SEQ ID NO: 6126892 - DNA, 20 bp, Homo sapiens
cgtgagagaaagagagaagc

SEQ ID NO: 6126893 - DNA, 18 bp, Homo sapiens
cgtgagagaatctgcctg

SEQ ID NO: 6126894 - DNA, 12 bp, Homo sapiens
cgtgagcatgca

SEQ ID NO: 6126895 - DNA, 22 bp, Homo sapiens
cgtgagcatgcacactgagaat

SEQ ID NO: 6126896 - DNA, 23 bp, Homo sapiens
cgtgagcatgcacactgagaatg

SEQ ID NO: 6126897 - DNA, 20 bp, Homo sapiens
cgtgagcatgtttggaaggg

SEQ ID NO: 6126898 - DNA, 20 bp, Homo sapiens
ctccctgggggcgggactcc

SEQ ID NO: 6126899 - DNA, 22 bp, Homo sapiens
ctccctgggggcgggactcctc

SEQ ID NO: 6126900 - DNA, 20 bp, Homo sapiens
ctccctggggttctctacag

SEQ ID NO: 6126901 - DNA, 19 bp, Homo sapiens
ctccctggtgagagggccg

SEQ ID NO: 6126902 - DNA, 21 bp, Homo sapiens
ctccctggtgagggagcctcg

SEQ ID NO: 6126903 - DNA, 14 bp, Homo sapiens
ctccctggtgcctc

SEQ ID NO: 6126904 - DNA, 17 bp, Homo sapiens
ctccctggtgcctctgt

SEQ ID NO: 6126905 - DNA, 12 bp, Homo sapiens
ctccctggtgct

SEQ ID NO: 6126906 - DNA, 20 bp, Homo sapiens
ctccctggttttaccccagc

SEQ ID NO: 6126907 - DNA, 19 bp, Homo sapiens
ctccctgtaacctcttcag

SEQ ID NO: 6126908 - DNA, 19 bp, Homo sapiens
ctccctgtagctctgcctc

SEQ ID NO: 6126909 - DNA, 22 bp, Homo sapiens
ctccctgtagtgaatcctctgt

SEQ ID NO: 6126910 - DNA, 21 bp, Homo sapiens
ctccctgtcacacactggacc

SEQ ID NO: 6126911 - DNA, 22 bp, Homo sapiens
ctccctgtcacgctcatgtcct

SEQ ID NO: 6126912 - DNA, 18 bp, Homo sapiens
ctccctgtcactcagctg

SEQ ID NO: 6126913 - DNA, 20 bp, Homo sapiens
ctccctgtcactcagctgag

SEQ ID NO: 6126914 - DNA, 18 bp, Homo sapiens
ctccctgtccatccccag

SEQ ID NO: 6126915 - DNA, 12 bp, Homo sapiens
ctccctgtccca

SEQ ID NO: 6126916 - DNA, 15 bp, Homo sapiens
ctccctgtcccaggg

SEQ ID NO: 6126917 - DNA, 20 bp, Homo sapiens
ctccctgtcccttcctttct

SEQ ID NO: 6126918 - DNA, 11 bp, Homo sapiens
ctccctgtcct

SEQ ID NO: 6126919 - DNA, 15 bp, Homo sapiens
ctccctgtcctcctc

SEQ ID NO: 6126920 - DNA, 21 bp, Homo sapiens
ctccctgtctccagctgcctg

SEQ ID NO: 6126921 - DNA, 19 bp, Homo sapiens
ctccctgtctccagggccc

SEQ ID NO: 6126922 - DNA, 22 bp, Homo sapiens
ctccctgtctccagggccccca

SEQ ID NO: 6126923 - DNA, 15 bp, Homo sapiens
ctccctgtctgaaac

SEQ ID NO: 6126924 - DNA, 21 bp, Homo sapiens
ctccctgtctgtgtcccagcc

SEQ ID NO: 6126925 - DNA, 13 bp, Homo sapiens
ctccctgtgcccc

SEQ ID NO: 6126926 - DNA, 14 bp, Homo sapiens
ctccctgtgccccc

SEQ ID NO: 6126927 - DNA, 21 bp, Homo sapiens
ctccctgtgcccccagcctca

SEQ ID NO: 6126928 - DNA, 21 bp, Homo sapiens
ctccctgtggggcaggagtgc

SEQ ID NO: 6126929 - DNA, 23 bp, Homo sapiens
ctccctgtgggggtggccatccc

SEQ ID NO: 6126930 - DNA, 17 bp, Homo sapiens
ctccctgtgttctgggc

SEQ ID NO: 6126931 - DNA, 20 bp, Homo sapiens
ctccctgtgttctgggctgg

SEQ ID NO: 6126932 - DNA, 20 bp, Homo sapiens
ctccctgttatctgctagat

SEQ ID NO: 6126933 - DNA, 21 bp, Homo sapiens
ctccctgttatttttctgccc

SEQ ID NO: 6126934 - DNA, 22 bp, Homo sapiens
ctccctgttatttttctgccct

SEQ ID NO: 6126935 - DNA, 23 bp, Homo sapiens
ctccctgttatttttctgccctg

SEQ ID NO: 6126936 - DNA, 22 bp, Homo sapiens
ctccctgttcacggtgacacag

SEQ ID NO: 6126937 - DNA, 19 bp, Homo sapiens
ctccctgttccccacaggt

SEQ ID NO: 6126938 - DNA, 22 bp, Homo sapiens
ctccctgttccccacaggtcct

SEQ ID NO: 6126939 - DNA, 23 bp, Homo sapiens
ctccctgttccccacaggtcctc

SEQ ID NO: 6126940 - DNA, 21 bp, Homo sapiens
ctccctgttgacgaagtctct

SEQ ID NO: 6126941 - DNA, 22 bp, Homo sapiens
ctccctgttgacgaagtctctt

SEQ ID NO: 6126942 - DNA, 17 bp, Homo sapiens
ctccctgtttctccaca

SEQ ID NO: 6126943 - DNA, 22 bp, Homo sapiens
ctccctgtttgaagcctgccct

SEQ ID NO: 6126944 - DNA, 23 bp, Homo sapiens
ctccctgtttgaagcctgccctt

SEQ ID NO: 6126945 - DNA, 17 bp, Homo sapiens
ctcccttacccatcttg

SEQ ID NO: 6126946 - DNA, 22 bp, Homo sapiens
ctcccttacccatcttgcttcc

SEQ ID NO: 6126947 - DNA, 19 bp, Homo sapiens
ctcccttaccctcctctgc

SEQ ID NO: 6126948 - DNA, 22 bp, Homo sapiens
ctcccttaccctcctctgctgg

SEQ ID NO: 6126949 - DNA, 19 bp, Homo sapiens
ctcccttaggcattattta

SEQ ID NO: 6126950 - DNA, 18 bp, Homo sapiens
ctcccttcaaccattccc

SEQ ID NO: 6126951 - DNA, 19 bp, Homo sapiens
ctcccttcaaccattcccc

SEQ ID NO: 6126952 - DNA, 14 bp, Homo sapiens
ctcccttcacaggg

SEQ ID NO: 6126953 - DNA, 16 bp, Homo sapiens
ctcccttcagccccca

SEQ ID NO: 6126954 - DNA, 18 bp, Homo sapiens
ctcccttccatgccccag

SEQ ID NO: 6126955 - DNA, 20 bp, Homo sapiens
ctcccttccatgccccagga

SEQ ID NO: 6126956 - DNA, 16 bp, Homo sapiens
ctcccttcccagtggg

SEQ ID NO: 6126957 - DNA, 19 bp, Homo sapiens
ctcccttccccactctgct

SEQ ID NO: 6126958 - DNA, 11 bp, Homo sapiens
ctcccttccct

SEQ ID NO: 6126959 - DNA, 16 bp, Homo sapiens
ctcccttccctcctcc

SEQ ID NO: 6126960 - DNA, 23 bp, Homo sapiens
ctcccttccgaccctctgggaac

SEQ ID NO: 6126961 - DNA, 18 bp, Homo sapiens
ctcccttccgctgcgggc

SEQ ID NO: 6126962 - DNA, 15 bp, Homo sapiens
ctcccttccgtccat

SEQ ID NO: 6126963 - DNA, 22 bp, Homo sapiens
ctcccttcctatgctgttcact

SEQ ID NO: 6126964 - DNA, 14 bp, Homo sapiens
ctcccttcctccca

SEQ ID NO: 6126965 - DNA, 13 bp, Homo sapiens
ctcccttcctccg

SEQ ID NO: 6126966 - DNA, 14 bp, Homo sapiens
ctcccttcctccgc

SEQ ID NO: 6126967 - DNA, 20 bp, Homo sapiens
ctcccttcctccgctcccct

SEQ ID NO: 6126968 - DNA, 13 bp, Homo sapiens
ctcccttcctctt

SEQ ID NO: 6126969 - DNA, 12 bp, Homo sapiens
ctcccttcctga

SEQ ID NO: 6126970 - DNA, 15 bp, Homo sapiens
ctcccttcctgccac

SEQ ID NO: 6126971 - DNA, 14 bp, Homo sapiens
ctcccttcctggcc

SEQ ID NO: 6126972 - DNA, 13 bp, Homo sapiens
ctcccttccttat

SEQ ID NO: 6126973 - DNA, 22 bp, Homo sapiens
ctcccttccttgggcagaatga

SEQ ID NO: 6126974 - DNA, 16 bp, Homo sapiens
ctcccttcgctctgct

SEQ ID NO: 6126975 - DNA, 17 bp, Homo sapiens
ctcccttcgtgtgtgcg

SEQ ID NO: 6126976 - DNA, 19 bp, Homo sapiens
ctcccttctcccctcagcc

SEQ ID NO: 6126977 - DNA, 14 bp, Homo sapiens
ctcccttctccctg

SEQ ID NO: 6126978 - DNA, 16 bp, Homo sapiens
ctcccttctccctgga

SEQ ID NO: 6126979 - DNA, 17 bp, Homo sapiens
ctcccttctccctggat

SEQ ID NO: 6126980 - DNA, 15 bp, Homo sapiens
ctcccttctcctttc

SEQ ID NO: 6126981 - DNA, 11 bp, Homo sapiens
ctcccttctct

SEQ ID NO: 6126982 - DNA, 16 bp, Homo sapiens
ctcccttctctcaccc

SEQ ID NO: 6126983 - DNA, 16 bp, Homo sapiens
ctcccttctcttcaca

SEQ ID NO: 6126984 - DNA, 13 bp, Homo sapiens
ctcccttctgtag

SEQ ID NO: 6126985 - DNA, 14 bp, Homo sapiens
ctcccttcttccct

SEQ ID NO: 6126986 - DNA, 20 bp, Homo sapiens
ctcccttcttctgagtgaat

SEQ ID NO: 6126987 - DNA, 22 bp, Homo sapiens
ctcccttcttgggtagggcaga

SEQ ID NO: 6126988 - DNA, 15 bp, Homo sapiens
ctcccttcttgggtc

SEQ ID NO: 6126989 - DNA, 14 bp, Homo sapiens
ctcccttctttacc

SEQ ID NO: 6126990 - DNA, 19 bp, Homo sapiens
ctcccttctttccttcctt

SEQ ID NO: 6126991 - DNA, 23 bp, Homo sapiens
ctcccttctttgcttctttttct

SEQ ID NO: 6126992 - DNA, 21 bp, Homo sapiens
ctcccttgaagttgtggagga

SEQ ID NO: 6126993 - DNA, 23 bp, Homo sapiens
ctcccttgactttgctcctcaca

SEQ ID NO: 6126994 - DNA, 21 bp, Homo sapiens
ctcccttgagaattccctgtg

SEQ ID NO: 6126995 - DNA, 23 bp, Homo sapiens
ctcccttgaggatggagagcagc

SEQ ID NO: 6126996 - DNA, 18 bp, Homo sapiens
ctcccttgagtaggccct

SEQ ID NO: 6126997 - DNA, 21 bp, Homo sapiens
ctcccttgagtaggccctgct

SEQ ID NO: 6126998 - DNA, 17 bp, Homo sapiens
ctcccttgatggggtcc

SEQ ID NO: 6126999 - DNA, 17 bp, Homo sapiens
ctcccttgccccaggcc

SEQ ID NO: 6127000 - DNA, 19 bp, Homo sapiens
ctcccttgccccaggccag

SEQ ID NO: 6127001 - DNA, 21 bp, Homo sapiens
ctcccttgccccaggccaggt

SEQ ID NO: 6127002 - DNA, 16 bp, Homo sapiens
ctcccttgctgaacac

SEQ ID NO: 6127003 - DNA, 19 bp, Homo sapiens
ctcccttgctgaacacaca

SEQ ID NO: 6127004 - DNA, 21 bp, Homo sapiens
ctcccttgctgaacacacaca

SEQ ID NO: 6127005 - DNA, 12 bp, Homo sapiens
ctcccttgctgg

SEQ ID NO: 6127006 - DNA, 14 bp, Homo sapiens
ctcccttgctggcc

SEQ ID NO: 6127007 - DNA, 18 bp, Homo sapiens
ctcccttggaaacctgcc

SEQ ID NO: 6127008 - DNA, 17 bp, Homo sapiens
ctcccttggattgtccc

SEQ ID NO: 6127009 - DNA, 22 bp, Homo sapiens
ctcccttggccacggcctggga

SEQ ID NO: 6127010 - DNA, 17 bp, Homo sapiens
ctcccttggcccagaga

SEQ ID NO: 6127011 - DNA, 19 bp, Homo sapiens
ctcccttggcccagagacg

SEQ ID NO: 6127012 - DNA, 19 bp, Homo sapiens
ctcccttgggaaggacaca

SEQ ID NO: 6127013 - DNA, 21 bp, Homo sapiens
ctcccttgggcacgtgtgctg

SEQ ID NO: 6127014 - DNA, 14 bp, Homo sapiens
ctcccttgggctcc

SEQ ID NO: 6127015 - DNA, 18 bp, Homo sapiens
ctcccttgggctctgatg

SEQ ID NO: 6127016 - DNA, 14 bp, Homo sapiens
ctcccttgggctgg

SEQ ID NO: 6127017 - DNA, 19 bp, Homo sapiens
ctcccttggggcctatgca

SEQ ID NO: 6127018 - DNA, 17 bp, Homo sapiens
ctcccttgtgttccttc

SEQ ID NO: 6127019 - DNA, 22 bp, Homo sapiens
ctcccttgtgttccttctgtga

SEQ ID NO: 6127020 - DNA, 19 bp, Homo sapiens
ctccctttatcatgtgttt

SEQ ID NO: 6127021 - DNA, 17 bp, Homo sapiens
ctccctttccttcctaa

SEQ ID NO: 6127022 - DNA, 14 bp, Homo sapiens
ctccctttctcccc

SEQ ID NO: 6127023 - DNA, 15 bp, Homo sapiens
ctccctttctctctc

SEQ ID NO: 6127024 - DNA, 16 bp, Homo sapiens
ctccctttctctctcc

SEQ ID NO: 6127025 - DNA, 18 bp, Homo sapiens
ctccctttctctctcctc

SEQ ID NO: 6127026 - DNA, 14 bp, Homo sapiens
ctccctttctggga

SEQ ID NO: 6127027 - DNA, 14 bp, Homo sapiens
ctccctttgaaatg

SEQ ID NO: 6127028 - DNA, 20 bp, Homo sapiens
ctcccttttacattctgtgt

SEQ ID NO: 6127029 - DNA, 21 bp, Homo sapiens
ctcccttttacattctgtgtg

SEQ ID NO: 6127030 - DNA, 22 bp, Homo sapiens
ctcccttttataattaatgttt

SEQ ID NO: 6127031 - DNA, 14 bp, Homo sapiens
ctccctttttacac

SEQ ID NO: 6127032 - DNA, 14 bp, Homo sapiens
ctccctttttatat

SEQ ID NO: 6127033 - DNA, 20 bp, Homo sapiens
ctccctttttccttgtcccc

SEQ ID NO: 6127034 - DNA, 15 bp, Homo sapiens
ctccctttttgaatt

SEQ ID NO: 6127035 - DNA, 17 bp, Homo sapiens
ctccgaaatgctgtctt

SEQ ID NO: 6127036 - DNA, 18 bp, Homo sapiens
ctccgaaatgctgtcttt

SEQ ID NO: 6127037 - DNA, 16 bp, Homo sapiens
ctccgaacgctgctcc

SEQ ID NO: 6127038 - DNA, 17 bp, Homo sapiens
ctccgaacgctgctcca

SEQ ID NO: 6127039 - DNA, 20 bp, Homo sapiens
ctccgaacgctgctccatgc

SEQ ID NO: 6127040 - DNA, 13 bp, Homo sapiens
ctccgaagaaaag

SEQ ID NO: 6127041 - DNA, 19 bp, Homo sapiens
ctccgaagaaaagatatgt

SEQ ID NO: 6127042 - DNA, 13 bp, Homo sapiens
ctccgacctctct

SEQ ID NO: 6127043 - DNA, 17 bp, Homo sapiens
ctccgacctctctcagc

SEQ ID NO: 6127044 - DNA, 21 bp, Homo sapiens
ctccgacctctctcagcccca

SEQ ID NO: 6127045 - DNA, 20 bp, Homo sapiens
ctccgacgctgcctctcatt

SEQ ID NO: 6127046 - DNA, 14 bp, Homo sapiens
ctccgactccccct

SEQ ID NO: 6127047 - DNA, 21 bp, Homo sapiens
ctccgactctgcacccgcctc

SEQ ID NO: 6127048 - DNA, 16 bp, Homo sapiens
ctccgacttcccctgg

SEQ ID NO: 6127049 - DNA, 13 bp, Homo sapiens
ctccgagaacaac

SEQ ID NO: 6127050 - DNA, 18 bp, Homo sapiens
ctccgagacagtccagtg

SEQ ID NO: 6127051 - DNA, 23 bp, Homo sapiens
ctccgagagcagtgggcaggtgg

SEQ ID NO: 6127052 - DNA, 16 bp, Homo sapiens
ctccgagagggagaga

SEQ ID NO: 6127053 - DNA, 13 bp, Homo sapiens
ctccgagaggtgg

SEQ ID NO: 6127054 - DNA, 14 bp, Homo sapiens
ctccgagaggtggg

SEQ ID NO: 6127055 - DNA, 15 bp, Homo sapiens
ctccgagctctggtg

SEQ ID NO: 6127056 - DNA, 18 bp, Homo sapiens
ctccgagctctggtgctt

SEQ ID NO: 6127057 - DNA, 19 bp, Homo sapiens
ctccgagctctggtgcttt

SEQ ID NO: 6127058 - DNA, 13 bp, Homo sapiens
ctccgagctgtag

SEQ ID NO: 6127059 - DNA, 18 bp, Homo sapiens
ctccgagctgtaggagag

SEQ ID NO: 6127060 - DNA, 15 bp, Homo sapiens
ctccgaggacccagg

SEQ ID NO: 6127061 - DNA, 17 bp, Homo sapiens
ctccgaggactggactg

SEQ ID NO: 6127062 - DNA, 15 bp, Homo sapiens
ctccgaggctccccg

SEQ ID NO: 6127063 - DNA, 16 bp, Homo sapiens
ctccgaggctccccgc

SEQ ID NO: 6127064 - DNA, 21 bp, Homo sapiens
ctccgaggctccccgcctcca

SEQ ID NO: 6127065 - DNA, 16 bp, Homo sapiens
ctccgaggtggttcag

SEQ ID NO: 6127066 - DNA, 18 bp, Homo sapiens
ctccgagtgaactggtct

SEQ ID NO: 6127067 - DNA, 16 bp, Homo sapiens
ctccgatgctgaggcc

SEQ ID NO: 6127068 - DNA, 20 bp, Homo sapiens
ctccgatgctgaggccaccc

SEQ ID NO: 6127069 - DNA, 18 bp, Homo sapiens
ctccgcacacctctggct

SEQ ID NO: 6127070 - DNA, 22 bp, Homo sapiens
ctccgcacacctctggctgtct

SEQ ID NO: 6127071 - DNA, 16 bp, Homo sapiens
ctccgcacacctgtgg

SEQ ID NO: 6127072 - DNA, 15 bp, Homo sapiens
ctccgcacctgaccg

SEQ ID NO: 6127073 - DNA, 18 bp, Homo sapiens
ctccgcacttggaaaggt

SEQ ID NO: 6127074 - DNA, 13 bp, Homo sapiens
ctccgcaggactt

SEQ ID NO: 6127075 - DNA, 14 bp, Homo sapiens
cgtgagccactgca

SEQ ID NO: 6127076 - DNA, 22 bp, Homo sapiens
cgtgagccactgcaccgggcca

SEQ ID NO: 6127077 - DNA, 12 bp, Homo sapiens
cgtgagccaggt

SEQ ID NO: 6127078 - DNA, 14 bp, Homo sapiens
cgtgagccccatct

SEQ ID NO: 6127079 - DNA, 23 bp, Homo sapiens
cgtgagcgccccgcccccacccc

SEQ ID NO: 6127080 - DNA, 16 bp, Homo sapiens
cgtgagcgcctgtgca

SEQ ID NO: 6127081 - DNA, 20 bp, Homo sapiens
cgtgagctgcccggcgcctg

SEQ ID NO: 6127082 - DNA, 18 bp, Homo sapiens
cgtgagctggggactcag

SEQ ID NO: 6127083 - DNA, 19 bp, Homo sapiens
cgtgagctggggactcagg

SEQ ID NO: 6127084 - DNA, 23 bp, Homo sapiens
cgtgagctggggactcagggacc

SEQ ID NO: 6127085 - DNA, 12 bp, Homo sapiens
cgtgaggccaag

SEQ ID NO: 6127086 - DNA, 19 bp, Homo sapiens
cgtgaggggcaagctaggc

SEQ ID NO: 6127087 - DNA, 15 bp, Homo sapiens
cgtgagggggagctg

SEQ ID NO: 6127088 - DNA, 15 bp, Homo sapiens
cgtgaggtcccagga

SEQ ID NO: 6127089 - DNA, 23 bp, Homo sapiens
cgtgaggtttcagtagctccttg

SEQ ID NO: 6127090 - DNA, 17 bp, Homo sapiens
cgtgagtcctggcatgg

SEQ ID NO: 6127091 - DNA, 18 bp, Homo sapiens
cgtgagtcctggcatggg

SEQ ID NO: 6127092 - DNA, 17 bp, Homo sapiens
cgtgagtgacatagcct

SEQ ID NO: 6127093 - DNA, 15 bp, Homo sapiens
cgtgagtgcagaccc

SEQ ID NO: 6127094 - DNA, 19 bp, Homo sapiens
cgtgagtggacgtgtcagg

SEQ ID NO: 6127095 - DNA, 16 bp, Homo sapiens
cgtgagtgtgtgagcg

SEQ ID NO: 6127096 - DNA, 20 bp, Homo sapiens
cgtgagtgtgtgagcgcttc

SEQ ID NO: 6127097 - DNA, 18 bp, Homo sapiens
cgtgagttctcagggctc

SEQ ID NO: 6127098 - DNA, 20 bp, Homo sapiens
cgtgagttctcagggctcct

SEQ ID NO: 6127099 - DNA, 13 bp, Homo sapiens
cgtgatagaagaa

SEQ ID NO: 6127100 - DNA, 18 bp, Homo sapiens
cgtgatcaaagccacact

SEQ ID NO: 6127101 - DNA, 21 bp, Homo sapiens
cgtgatcaaagccacactctg

SEQ ID NO: 6127102 - DNA, 17 bp, Homo sapiens
cgtgatcactgagccat

SEQ ID NO: 6127103 - DNA, 18 bp, Homo sapiens
cgtgatccacccacctcg

SEQ ID NO: 6127104 - DNA, 14 bp, Homo sapiens
cgtgatcccctgct

SEQ ID NO: 6127105 - DNA, 15 bp, Homo sapiens
cgtgatctcagctca

SEQ ID NO: 6127106 - DNA, 15 bp, Homo sapiens
cgtgatctcccctca

SEQ ID NO: 6127107 - DNA, 22 bp, Homo sapiens
cgtgatctcggctcactgcaac

SEQ ID NO: 6127108 - DNA, 13 bp, Homo sapiens
cgtgatcttggct

SEQ ID NO: 6127109 - DNA, 17 bp, Homo sapiens
cgtgatgcctccctgtt

SEQ ID NO: 6127110 - DNA, 23 bp, Homo sapiens
cgtgatggaccaaagccacctgc

SEQ ID NO: 6127111 - DNA, 18 bp, Homo sapiens
cgtgatggagaggacaga

SEQ ID NO: 6127112 - DNA, 15 bp, Homo sapiens
cgtgatgggcccgcc

SEQ ID NO: 6127113 - DNA, 18 bp, Homo sapiens
cgtgatgtggaggaagag

SEQ ID NO: 6127114 - DNA, 22 bp, Homo sapiens
cgtgatgtggaggaagagccac

SEQ ID NO: 6127115 - DNA, 21 bp, Homo sapiens
cgtgattaatatgcaagtgaa

SEQ ID NO: 6127116 - DNA, 19 bp, Homo sapiens
cgtgattcctgctgcctgt

SEQ ID NO: 6127117 - DNA, 15 bp, Homo sapiens
cgtgattctgttcta

SEQ ID NO: 6127118 - DNA, 20 bp, Homo sapiens
cgtgatttggaagagaggca

SEQ ID NO: 6127119 - DNA, 18 bp, Homo sapiens
cgtgattttgctgtagaa

SEQ ID NO: 6127120 - DNA, 20 bp, Homo sapiens
cgtgcaaacaacctgaatct

SEQ ID NO: 6127121 - DNA, 13 bp, Homo sapiens
cgtgcaactgaca

SEQ ID NO: 6127122 - DNA, 16 bp, Homo sapiens
cgtgcaaggggctcag

SEQ ID NO: 6127123 - DNA, 20 bp, Homo sapiens
cgtgcaatttgtttgtgctt

SEQ ID NO: 6127124 - DNA, 18 bp, Homo sapiens
cgtgcacaaaccttcttt

SEQ ID NO: 6127125 - DNA, 19 bp, Homo sapiens
cgtgcacaaaccttctttt

SEQ ID NO: 6127126 - DNA, 22 bp, Homo sapiens
cgtgcacacaccagagcccacc

SEQ ID NO: 6127127 - DNA, 15 bp, Homo sapiens
cgtgcacacacctgc

SEQ ID NO: 6127128 - DNA, 14 bp, Homo sapiens
cgtgcacagcttcc

SEQ ID NO: 6127129 - DNA, 17 bp, Homo sapiens
cgtgcacagcttcctga

SEQ ID NO: 6127130 - DNA, 12 bp, Homo sapiens
cgtgcacagggt

SEQ ID NO: 6127131 - DNA, 22 bp, Homo sapiens
cgtgcaccaccatgccaggcta

SEQ ID NO: 6127132 - DNA, 21 bp, Homo sapiens
cgtgcacgtggagagctggtg

SEQ ID NO: 6127133 - DNA, 22 bp, Homo sapiens
cgtgcacgtggagagctggtgc

SEQ ID NO: 6127134 - DNA, 12 bp, Homo sapiens
cgtgcactgaca

SEQ ID NO: 6127135 - DNA, 14 bp, Homo sapiens
cgtgcactgacagc

SEQ ID NO: 6127136 - DNA, 12 bp, Homo sapiens
cgtgcactgtga

SEQ ID NO: 6127137 - DNA, 20 bp, Homo sapiens
cgtgcactgtgaatcctggc

SEQ ID NO: 6127138 - DNA, 15 bp, Homo sapiens
cgtgcacttgtgatc

SEQ ID NO: 6127139 - DNA, 13 bp, Homo sapiens
cgtgcagagctgg

SEQ ID NO: 6127140 - DNA, 16 bp, Homo sapiens
cgtgcagagctggggc

SEQ ID NO: 6127141 - DNA, 12 bp, Homo sapiens
cgtgcagcacct

SEQ ID NO: 6127142 - DNA, 20 bp, Homo sapiens
cgtgcagcagggaaggccca

SEQ ID NO: 6127143 - DNA, 16 bp, Homo sapiens
cgtgcaggacagctct

SEQ ID NO: 6127144 - DNA, 18 bp, Homo sapiens
cgtgcaggacagctcttg

SEQ ID NO: 6127145 - DNA, 16 bp, Homo sapiens
cgtgcagtacaggcaa

SEQ ID NO: 6127146 - DNA, 22 bp, Homo sapiens
cgtgcagtggtgcgatctgggt

SEQ ID NO: 6127147 - DNA, 20 bp, Homo sapiens
cgtgcatcccccctgctcag

SEQ ID NO: 6127148 - DNA, 18 bp, Homo sapiens
cgtgcatccttgtaatac

SEQ ID NO: 6127149 - DNA, 15 bp, Homo sapiens
cgtgcatgatttact

SEQ ID NO: 6127150 - DNA, 20 bp, Homo sapiens
cgtgcattaaaatttcttat

SEQ ID NO: 6127151 - DNA, 21 bp, Homo sapiens
cgtgcattagcacagatttta

SEQ ID NO: 6127152 - DNA, 22 bp, Homo sapiens
cgtgcattagcacagattttaa

SEQ ID NO: 6127153 - DNA, 21 bp, Homo sapiens
cgtgcattggaagaccccacc

SEQ ID NO: 6127154 - DNA, 17 bp, Homo sapiens
cgtgcatttaaactctg

SEQ ID NO: 6127155 - DNA, 23 bp, Homo sapiens
cgtgcatttgaggggccaggggc

SEQ ID NO: 6127156 - DNA, 20 bp, Homo sapiens
cgtgccaagtccaggtcctg

SEQ ID NO: 6127157 - DNA, 21 bp, Homo sapiens
cgtgccaagtccaggtcctgg

SEQ ID NO: 6127158 - DNA, 15 bp, Homo sapiens
cgtgccaccccgagg

SEQ ID NO: 6127159 - DNA, 23 bp, Homo sapiens
cgtgccacccgtaggcagcctct

SEQ ID NO: 6127160 - DNA, 19 bp, Homo sapiens
cgtgccacgcgctctgcat

SEQ ID NO: 6127161 - DNA, 17 bp, Homo sapiens
cgtgccagatataactg

SEQ ID NO: 6127162 - DNA, 19 bp, Homo sapiens
cgtgccagatataactgtc

SEQ ID NO: 6127163 - DNA, 19 bp, Homo sapiens
cgtgccagcagcctcgcac

SEQ ID NO: 6127164 - DNA, 16 bp, Homo sapiens
cgtgccagctctagtt

SEQ ID NO: 6127165 - DNA, 22 bp, Homo sapiens
cgtgccaggagcaatgggactg

SEQ ID NO: 6127166 - DNA, 19 bp, Homo sapiens
cgtgccaggcccggggctg

SEQ ID NO: 6127167 - DNA, 17 bp, Homo sapiens
cgtgccagtcgcgctgc

SEQ ID NO: 6127168 - DNA, 19 bp, Homo sapiens
cgtgccattacactccagc

SEQ ID NO: 6127169 - DNA, 24 bp, Homo sapiens
cgtgccattgtactccagcctggg

SEQ ID NO: 6127170 - DNA, 21 bp, Homo sapiens
cgtgccattgtctttcctccc

SEQ ID NO: 6127171 - DNA, 18 bp, Homo sapiens
cgtgccccacctccccac

SEQ ID NO: 6127172 - DNA, 21 bp, Homo sapiens
cgtgccccacctccccacaca

SEQ ID NO: 6127173 - DNA, 19 bp, Homo sapiens
cgtgcccccctcctccagt

SEQ ID NO: 6127174 - DNA, 20 bp, Homo sapiens
cgtgcccccctcctccagta

SEQ ID NO: 6127175 - DNA, 15 bp, Homo sapiens
cgtgcccctgctgct

SEQ ID NO: 6127176 - DNA, 18 bp, Homo sapiens
cgtgcccctgctgctgtc

SEQ ID NO: 6127177 - DNA, 16 bp, Homo sapiens
cgtgccccttccctgg

SEQ ID NO: 6127178 - DNA, 14 bp, Homo sapiens
cgtgcccgcccacc

SEQ ID NO: 6127179 - DNA, 16 bp, Homo sapiens
cgtgcccggggcagca

SEQ ID NO: 6127180 - DNA, 10 bp, Homo sapiens
cgtgccctct

SEQ ID NO: 6127181 - DNA, 15 bp, Homo sapiens
cgtgccctggaggct

SEQ ID NO: 6127182 - DNA, 16 bp, Homo sapiens
cgtgccgcctgcactc

SEQ ID NO: 6127183 - DNA, 18 bp, Homo sapiens
cgtgccgtgtatttttta

SEQ ID NO: 6127184 - DNA, 23 bp, Homo sapiens
cgtgcctccaccaccactggcca

SEQ ID NO: 6127185 - DNA, 15 bp, Homo sapiens
cgtgcctggccagat

SEQ ID NO: 6127186 - DNA, 13 bp, Homo sapiens
cgtgcctgggaga

SEQ ID NO: 6127187 - DNA, 17 bp, Homo sapiens
cgtgcctgggcccctcc

SEQ ID NO: 6127188 - DNA, 18 bp, Homo sapiens
cgtgcctgggcccctccc

SEQ ID NO: 6127189 - DNA, 22 bp, Homo sapiens
cgtgcctgggcccctcccctca

SEQ ID NO: 6127190 - DNA, 17 bp, Homo sapiens
cgtgcctgggggagaga

SEQ ID NO: 6127191 - DNA, 16 bp, Homo sapiens
cgtgcctgtagtccca

SEQ ID NO: 6127192 - DNA, 12 bp, Homo sapiens
cgtgcctgtgtc

SEQ ID NO: 6127193 - DNA, 18 bp, Homo sapiens
cgtgccttaggaatactg

SEQ ID NO: 6127194 - DNA, 23 bp, Homo sapiens
cgtgccttaggaatactgtttta

SEQ ID NO: 6127195 - DNA, 15 bp, Homo sapiens
cgtgccttcagctct

SEQ ID NO: 6127196 - DNA, 16 bp, Homo sapiens
cgtgccttcagctcta

SEQ ID NO: 6127197 - DNA, 13 bp, Homo sapiens
cgtgccttccccg

SEQ ID NO: 6127198 - DNA, 16 bp, Homo sapiens
cgtgccttccccgtgc

SEQ ID NO: 6127199 - DNA, 15 bp, Homo sapiens
cgtgcctttctctgg

SEQ ID NO: 6127200 - DNA, 21 bp, Homo sapiens
cgtgcctttctctggctccag

SEQ ID NO: 6127201 - DNA, 17 bp, Homo sapiens
cgtgccttttgcacccc

SEQ ID NO: 6127202 - DNA, 21 bp, Homo sapiens
cgtgccttttgcacccctccc

SEQ ID NO: 6127203 - DNA, 16 bp, Homo sapiens
cgtgcgacagagagag

SEQ ID NO: 6127204 - DNA, 13 bp, Homo sapiens
cgtgcgagctgcc

SEQ ID NO: 6127205 - DNA, 22 bp, Homo sapiens
cgtgcgcaacaacaaggaccct

SEQ ID NO: 6127206 - DNA, 13 bp, Homo sapiens
cgtgcgcagccgc

SEQ ID NO: 6127207 - DNA, 15 bp, Homo sapiens
cgtgcgcgcccaggc

SEQ ID NO: 6127208 - DNA, 17 bp, Homo sapiens
cgtgcgcgcccaggcca

SEQ ID NO: 6127209 - DNA, 23 bp, Homo sapiens
cgtgcgctgggcacttccctgct

SEQ ID NO: 6127210 - DNA, 22 bp, Homo sapiens
cgtgcgctggttccgccaggcg

SEQ ID NO: 6127211 - DNA, 18 bp, Homo sapiens
cgtgcgggaaattcagtc

SEQ ID NO: 6127212 - DNA, 14 bp, Homo sapiens
cgtgcgtctgtgtg

SEQ ID NO: 6127213 - DNA, 13 bp, Homo sapiens
cgtgctaaggact

SEQ ID NO: 6127214 - DNA, 23 bp, Homo sapiens
cgtgctacccccatgctggaggt

SEQ ID NO: 6127215 - DNA, 17 bp, Homo sapiens
cgtgctactgcactcca

SEQ ID NO: 6127216 - DNA, 22 bp, Homo sapiens
cgtgctattttttatcattgaa

SEQ ID NO: 6127217 - DNA, 13 bp, Homo sapiens
cgtgctcactgtg

SEQ ID NO: 6127218 - DNA, 18 bp, Homo sapiens
cgtgctccagcctggctc

SEQ ID NO: 6127219 - DNA, 22 bp, Homo sapiens
cgtgctccctcccatcctccag

SEQ ID NO: 6127220 - DNA, 13 bp, Homo sapiens
cgtgctcctctgc

SEQ ID NO: 6127221 - DNA, 16 bp, Homo sapiens
cgtgctcctctgcccg

SEQ ID NO: 6127222 - DNA, 15 bp, Homo sapiens
cgtgctcgcagcctg

SEQ ID NO: 6127223 - DNA, 19 bp, Homo sapiens
cgtgctcgccccagcaggt

SEQ ID NO: 6127224 - DNA, 16 bp, Homo sapiens
cgtgctctttgttttg

SEQ ID NO: 6127225 - DNA, 23 bp, Homo sapiens
cgtgctctttgttttgtgtctct

SEQ ID NO: 6127226 - DNA, 19 bp, Homo sapiens
cgtgctgcttacactccag

SEQ ID NO: 6127227 - DNA, 12 bp, Homo sapiens
cgtgctggagag

SEQ ID NO: 6127228 - DNA, 13 bp, Homo sapiens
cgtgctggagagt

SEQ ID NO: 6127229 - DNA, 13 bp, Homo sapiens
cgtgctggccttg

SEQ ID NO: 6127230 - DNA, 21 bp, Homo sapiens
cgtgctggcgacactcagggc

SEQ ID NO: 6127231 - DNA, 13 bp, Homo sapiens
cgtgctgggacag

SEQ ID NO: 6127232 - DNA, 12 bp, Homo sapiens
cgtgctgggcag

SEQ ID NO: 6127233 - DNA, 15 bp, Homo sapiens
cgtgctgggcggctg

SEQ ID NO: 6127234 - DNA, 22 bp, Homo sapiens
cgtgctgggcttgtagaccact

SEQ ID NO: 6127235 - DNA, 13 bp, Homo sapiens
cgtgctgtaaata

SEQ ID NO: 6127236 - DNA, 16 bp, Homo sapiens
cgtgctgtgctctggc

SEQ ID NO: 6127237 - DNA, 18 bp, Homo sapiens
cgtgcttagcctcctgac

SEQ ID NO: 6127238 - DNA, 16 bp, Homo sapiens
cgtgcttcctcctgac

SEQ ID NO: 6127239 - DNA, 16 bp, Homo sapiens
cgtgctttatttatgg

SEQ ID NO: 6127240 - DNA, 19 bp, Homo sapiens
cgtgctttatttatggctt

SEQ ID NO: 6127241 - DNA, 23 bp, Homo sapiens
cgtggaaaaagacgatgtttatg

SEQ ID NO: 6127242 - DNA, 19 bp, Homo sapiens
cgtggaaacaatcctgtta

SEQ ID NO: 6127243 - DNA, 14 bp, Homo sapiens
cgtggaacattctg

SEQ ID NO: 6127244 - DNA, 19 bp, Homo sapiens
cgtggaacctctgtctcat

SEQ ID NO: 6127245 - DNA, 15 bp, Homo sapiens
cgtggaagaagggcc

SEQ ID NO: 6127246 - DNA, 17 bp, Homo sapiens
cgtggaagaagggccac

SEQ ID NO: 6127247 - DNA, 21 bp, Homo sapiens
cgtggaagaagggccaccctg

SEQ ID NO: 6127248 - DNA, 22 bp, Homo sapiens
cgtggaagaagggccaccctga

SEQ ID NO: 6127249 - DNA, 14 bp, Homo sapiens
cgtggaagggggag

SEQ ID NO: 6127250 - DNA, 16 bp, Homo sapiens
cgtggaagggggagga

SEQ ID NO: 6127251 - DNA, 15 bp, Homo sapiens
cgtggaagtgttcct

SEQ ID NO: 6127252 - DNA, 16 bp, Homo sapiens
cgtggaagtgttcctg

SEQ ID NO: 6127253 - DNA, 20 bp, Homo sapiens
ctccgcagggcgcccagcgc

SEQ ID NO: 6127254 - DNA, 13 bp, Homo sapiens
ctccgcaggggtt

SEQ ID NO: 6127255 - DNA, 20 bp, Homo sapiens
ctccgcagtgtctccaccta

SEQ ID NO: 6127256 - DNA, 16 bp, Homo sapiens
ctccgccaagatctac

SEQ ID NO: 6127257 - DNA, 22 bp, Homo sapiens
ctccgccaagatctacaggaca

SEQ ID NO: 6127258 - DNA, 23 bp, Homo sapiens
ctccgccagaccccgtggctctg

SEQ ID NO: 6127259 - DNA, 14 bp, Homo sapiens
ctccgccagccaca

SEQ ID NO: 6127260 - DNA, 13 bp, Homo sapiens
ctccgccaggcga

SEQ ID NO: 6127261 - DNA, 14 bp, Homo sapiens
ctccgccattccaa

SEQ ID NO: 6127262 - DNA, 13 bp, Homo sapiens
ctccgcccaaatc

SEQ ID NO: 6127263 - DNA, 15 bp, Homo sapiens
ctccgcccccagcct

SEQ ID NO: 6127264 - DNA, 16 bp, Homo sapiens
ctccgcccccagccta

SEQ ID NO: 6127265 - DNA, 20 bp, Homo sapiens
ctccgcccccagcctatgag

SEQ ID NO: 6127266 - DNA, 23 bp, Homo sapiens
ctccgccccccggcctggccccc

SEQ ID NO: 6127267 - DNA, 18 bp, Homo sapiens
ctccgccccgtcccccca

SEQ ID NO: 6127268 - DNA, 14 bp, Homo sapiens
ctccgcccctgagc

SEQ ID NO: 6127269 - DNA, 15 bp, Homo sapiens
ctccgcccctgagcc

SEQ ID NO: 6127270 - DNA, 16 bp, Homo sapiens
ctccgcccctgagccc

SEQ ID NO: 6127271 - DNA, 17 bp, Homo sapiens
ctccgcccctgagccca

SEQ ID NO: 6127272 - DNA, 16 bp, Homo sapiens
ctccgcccgctcctgc

SEQ ID NO: 6127273 - DNA, 23 bp, Homo sapiens
ctccgcccgctcctgccgcagac

SEQ ID NO: 6127274 - DNA, 16 bp, Homo sapiens
ctccgccctcctcggg

SEQ ID NO: 6127275 - DNA, 13 bp, Homo sapiens
ctccgccctgcca

SEQ ID NO: 6127276 - DNA, 14 bp, Homo sapiens
ctccgccctgccac

SEQ ID NO: 6127277 - DNA, 17 bp, Homo sapiens
ctccgcctactgtccct

SEQ ID NO: 6127278 - DNA, 15 bp, Homo sapiens
ctccgcctcccgggt

SEQ ID NO: 6127279 - DNA, 14 bp, Homo sapiens
ctccgcctcctggg

SEQ ID NO: 6127280 - DNA, 15 bp, Homo sapiens
ctccgcctgaggcca

SEQ ID NO: 6127281 - DNA, 16 bp, Homo sapiens
ctccgcctggcctggc

SEQ ID NO: 6127282 - DNA, 13 bp, Homo sapiens
ctccgcctgggat

SEQ ID NO: 6127283 - DNA, 15 bp, Homo sapiens
ctccgcctgtgtcca

SEQ ID NO: 6127284 - DNA, 19 bp, Homo sapiens
ctccgcctgtgtccatctg

SEQ ID NO: 6127285 - DNA, 13 bp, Homo sapiens
ctccgccttccgg

SEQ ID NO: 6127286 - DNA, 20 bp, Homo sapiens
ctccgcgccgatgccaccgg

SEQ ID NO: 6127287 - DNA, 16 bp, Homo sapiens
ctccgcgctcggggct

SEQ ID NO: 6127288 - DNA, 19 bp, Homo sapiens
ctccgcggaggcccctgag

SEQ ID NO: 6127289 - DNA, 23 bp, Homo sapiens
ctccgcggcgggccctgcccaca

SEQ ID NO: 6127290 - DNA, 20 bp, Homo sapiens
ctccgcgggctgactgggcc

SEQ ID NO: 6127291 - DNA, 13 bp, Homo sapiens
ctccgcgggggac

SEQ ID NO: 6127292 - DNA, 16 bp, Homo sapiens
ctccgcgggggacagg

SEQ ID NO: 6127293 - DNA, 21 bp, Homo sapiens
ctccgctaaggcttccggctg

SEQ ID NO: 6127294 - DNA, 12 bp, Homo sapiens
ctccgctcccac

SEQ ID NO: 6127295 - DNA, 17 bp, Homo sapiens
ctccgctcccctttccc

SEQ ID NO: 6127296 - DNA, 21 bp, Homo sapiens
ctccgctgccgtgccgcctgc

SEQ ID NO: 6127297 - DNA, 12 bp, Homo sapiens
ctccgctgcctg

SEQ ID NO: 6127298 - DNA, 13 bp, Homo sapiens
ctccgctgccttc

SEQ ID NO: 6127299 - DNA, 12 bp, Homo sapiens
ctccgctgctcc

SEQ ID NO: 6127300 - DNA, 16 bp, Homo sapiens
ctccgctgctccttgg

SEQ ID NO: 6127301 - DNA, 22 bp, Homo sapiens
ctccgctggatggggagtctca

SEQ ID NO: 6127302 - DNA, 23 bp, Homo sapiens
ctccgctgggaggaacctgaacc

SEQ ID NO: 6127303 - DNA, 15 bp, Homo sapiens
ctccgctgggcttca

SEQ ID NO: 6127304 - DNA, 19 bp, Homo sapiens
ctccgctgggcttcattcc

SEQ ID NO: 6127305 - DNA, 18 bp, Homo sapiens
ctccgctgtgtggatggg

SEQ ID NO: 6127306 - DNA, 22 bp, Homo sapiens
ctccgcttgccagaggccctcg

SEQ ID NO: 6127307 - DNA, 21 bp, Homo sapiens
ctccgctttctacccagcgag

SEQ ID NO: 6127308 - DNA, 19 bp, Homo sapiens
ctccggaatagatgtcttc

SEQ ID NO: 6127309 - DNA, 15 bp, Homo sapiens
ctccggactggtgcc

SEQ ID NO: 6127310 - DNA, 16 bp, Homo sapiens
ctccggactggtgccc

SEQ ID NO: 6127311 - DNA, 20 bp, Homo sapiens
ctccggagagagagagagga

SEQ ID NO: 6127312 - DNA, 22 bp, Homo sapiens
ctccggagcgccctgcagggcc

SEQ ID NO: 6127313 - DNA, 12 bp, Homo sapiens
ctccggaggact

SEQ ID NO: 6127314 - DNA, 14 bp, Homo sapiens
ctccggaggagcag

SEQ ID NO: 6127315 - DNA, 16 bp, Homo sapiens
ctccggaggagcagcc

SEQ ID NO: 6127316 - DNA, 21 bp, Homo sapiens
ctccggaggagcagcctcgag

SEQ ID NO: 6127317 - DNA, 22 bp, Homo sapiens
ctccggaggctgaggcaggaga

SEQ ID NO: 6127318 - DNA, 14 bp, Homo sapiens
ctccggaggggacc

SEQ ID NO: 6127319 - DNA, 21 bp, Homo sapiens
ctccggaggggacccagctcc

SEQ ID NO: 6127320 - DNA, 22 bp, Homo sapiens
ctccggaggggacccagctcct

SEQ ID NO: 6127321 - DNA, 22 bp, Homo sapiens
ctccggagtgagaagctttgcc

SEQ ID NO: 6127322 - DNA, 16 bp, Homo sapiens
ctccggatcgaggcct

SEQ ID NO: 6127323 - DNA, 21 bp, Homo sapiens
ctccggatggaatcacagcca

SEQ ID NO: 6127324 - DNA, 22 bp, Homo sapiens
ctccggatggaatcacagccaa

SEQ ID NO: 6127325 - DNA, 22 bp, Homo sapiens
ctccggcactgggtttgctccc

SEQ ID NO: 6127326 - DNA, 12 bp, Homo sapiens
ctccggcagagg

SEQ ID NO: 6127327 - DNA, 17 bp, Homo sapiens
ctccggcagaggcaggg

SEQ ID NO: 6127328 - DNA, 23 bp, Homo sapiens
ctccggcagaggcagggccctgg

SEQ ID NO: 6127329 - DNA, 19 bp, Homo sapiens
ctccggccagcgagtggtc

SEQ ID NO: 6127330 - DNA, 18 bp, Homo sapiens
ctccggccaggtgcctcc

SEQ ID NO: 6127331 - DNA, 17 bp, Homo sapiens
ctccggccctgccccac

SEQ ID NO: 6127332 - DNA, 18 bp, Homo sapiens
ctccggccctgccccaca

SEQ ID NO: 6127333 - DNA, 14 bp, Homo sapiens
ctccggcctcccct

SEQ ID NO: 6127334 - DNA, 15 bp, Homo sapiens
ctccggcctcccctc

SEQ ID NO: 6127335 - DNA, 20 bp, Homo sapiens
ctccggcctgatgacagagc

SEQ ID NO: 6127336 - DNA, 15 bp, Homo sapiens
ctccggcctgcgtct

SEQ ID NO: 6127337 - DNA, 14 bp, Homo sapiens
ctccggcctggcct

SEQ ID NO: 6127338 - DNA, 16 bp, Homo sapiens
ctccggcctggccttt

SEQ ID NO: 6127339 - DNA, 14 bp, Homo sapiens
ctccggcgtcagcc

SEQ ID NO: 6127340 - DNA, 20 bp, Homo sapiens
ctccggcgtcagcctccagc

SEQ ID NO: 6127341 - DNA, 20 bp, Homo sapiens
ctccggcgtcttgcccagca

SEQ ID NO: 6127342 - DNA, 23 bp, Homo sapiens
ctccggcgtcttgcccagcagct

SEQ ID NO: 6127343 - DNA, 18 bp, Homo sapiens
ctccggctgcctagccct

SEQ ID NO: 6127344 - DNA, 14 bp, Homo sapiens
ctccgggaccccca

SEQ ID NO: 6127345 - DNA, 17 bp, Homo sapiens
ctccgggacccccagga

SEQ ID NO: 6127346 - DNA, 14 bp, Homo sapiens
ctccgggagagggg

SEQ ID NO: 6127347 - DNA, 18 bp, Homo sapiens
ctccgggcaaatggctga

SEQ ID NO: 6127348 - DNA, 15 bp, Homo sapiens
ctccgggcaggggag

SEQ ID NO: 6127349 - DNA, 19 bp, Homo sapiens
ctccgggcaggggagccag

SEQ ID NO: 6127350 - DNA, 13 bp, Homo sapiens
ctccgggcctcgg

SEQ ID NO: 6127351 - DNA, 16 bp, Homo sapiens
ctccgggcctcggcct

SEQ ID NO: 6127352 - DNA, 13 bp, Homo sapiens
ctccgggcgtgtg

SEQ ID NO: 6127353 - DNA, 23 bp, Homo sapiens
ctccggggaggcaggggtcctgc

SEQ ID NO: 6127354 - DNA, 14 bp, Homo sapiens
ctccggggccattt

SEQ ID NO: 6127355 - DNA, 18 bp, Homo sapiens
ctccggggctcagccctg

SEQ ID NO: 6127356 - DNA, 18 bp, Homo sapiens
ctccggggtctgtgctgt

SEQ ID NO: 6127357 - DNA, 22 bp, Homo sapiens
ctccggggtctgtgctgtgcct

SEQ ID NO: 6127358 - DNA, 18 bp, Homo sapiens
ctccggggtggccacagg

SEQ ID NO: 6127359 - DNA, 20 bp, Homo sapiens
ctccggggttcagcctcctg

SEQ ID NO: 6127360 - DNA, 14 bp, Homo sapiens
ctccgggtcctcct

SEQ ID NO: 6127361 - DNA, 16 bp, Homo sapiens
ctccgggtcctcctaa

SEQ ID NO: 6127362 - DNA, 23 bp, Homo sapiens
ctccgggtgtagattcccttgca

SEQ ID NO: 6127363 - DNA, 15 bp, Homo sapiens
ctccgggtgtggcct

SEQ ID NO: 6127364 - DNA, 16 bp, Homo sapiens
ctccgggtgtggcctc

SEQ ID NO: 6127365 - DNA, 17 bp, Homo sapiens
ctccgggtgtggcctca

SEQ ID NO: 6127366 - DNA, 18 bp, Homo sapiens
ctccgggtgtggcctcag

SEQ ID NO: 6127367 - DNA, 19 bp, Homo sapiens
ctccgggtgtggcctcagc

SEQ ID NO: 6127368 - DNA, 23 bp, Homo sapiens
ctccgggtgtggcctcagccctc

SEQ ID NO: 6127369 - DNA, 20 bp, Homo sapiens
ctccggtaaaacaccggaga

SEQ ID NO: 6127370 - DNA, 20 bp, Homo sapiens
ctccggtttgggctgtctta

SEQ ID NO: 6127371 - DNA, 13 bp, Homo sapiens
ctccgtacacttc

SEQ ID NO: 6127372 - DNA, 20 bp, Homo sapiens
ctccgtagctctgctgctga

SEQ ID NO: 6127373 - DNA, 17 bp, Homo sapiens
ctccgtagggtctttct

SEQ ID NO: 6127374 - DNA, 22 bp, Homo sapiens
ctccgtagggtctttcttggga

SEQ ID NO: 6127375 - DNA, 16 bp, Homo sapiens
ctccgtcactacctgg

SEQ ID NO: 6127376 - DNA, 13 bp, Homo sapiens
ctccgtcagcttc

SEQ ID NO: 6127377 - DNA, 20 bp, Homo sapiens
ctccgtcagcttctcccaag

SEQ ID NO: 6127378 - DNA, 14 bp, Homo sapiens
ctccgtcaggagag

SEQ ID NO: 6127379 - DNA, 20 bp, Homo sapiens
ctccgtcatctgcggggctt

SEQ ID NO: 6127380 - DNA, 22 bp, Homo sapiens
ctccgtccagccgccattgcca

SEQ ID NO: 6127381 - DNA, 22 bp, Homo sapiens
ctccgtccaggagcctgtgcct

SEQ ID NO: 6127382 - DNA, 23 bp, Homo sapiens
ctccgtccatatcagaactgtgc

SEQ ID NO: 6127383 - DNA, 22 bp, Homo sapiens
ctccgtccatccgactgcccct

SEQ ID NO: 6127384 - DNA, 13 bp, Homo sapiens
ctccgtccccagg

SEQ ID NO: 6127385 - DNA, 21 bp, Homo sapiens
ctccgtccctctgtccacttg

SEQ ID NO: 6127386 - DNA, 24 bp, Homo sapiens
ctccgtccctctgtccacttgtgg

SEQ ID NO: 6127387 - DNA, 15 bp, Homo sapiens
ctccgtcctcgatgg

SEQ ID NO: 6127388 - DNA, 17 bp, Homo sapiens
ctccgtcctctccccag

SEQ ID NO: 6127389 - DNA, 18 bp, Homo sapiens
ctccgtcctctccccagc

SEQ ID NO: 6127390 - DNA, 18 bp, Homo sapiens
ctccgtcctggcagggca

SEQ ID NO: 6127391 - DNA, 16 bp, Homo sapiens
ctccgtctctgtcctc

SEQ ID NO: 6127392 - DNA, 22 bp, Homo sapiens
ctccgtcttagaagtggaccag

SEQ ID NO: 6127393 - DNA, 18 bp, Homo sapiens
ctccgtcttcccagcggt

SEQ ID NO: 6127394 - DNA, 13 bp, Homo sapiens
ctccgtgagccct

SEQ ID NO: 6127395 - DNA, 21 bp, Homo sapiens
ctccgtgaggctgctgccatc

SEQ ID NO: 6127396 - DNA, 15 bp, Homo sapiens
ctccgtgatccatcc

SEQ ID NO: 6127397 - DNA, 21 bp, Homo sapiens
ctccgtgatccatccatctcc

SEQ ID NO: 6127398 - DNA, 13 bp, Homo sapiens
ctccgtgcctcca

SEQ ID NO: 6127399 - DNA, 15 bp, Homo sapiens
ctccgtgcctccacc

SEQ ID NO: 6127400 - DNA, 16 bp, Homo sapiens
ctccgtgcctccacca

SEQ ID NO: 6127401 - DNA, 12 bp, Homo sapiens
ctccgtggaaca

SEQ ID NO: 6127402 - DNA, 13 bp, Homo sapiens
ctccgtggaacat

SEQ ID NO: 6127403 - DNA, 17 bp, Homo sapiens
ctccgtggaacattctg

SEQ ID NO: 6127404 - DNA, 13 bp, Homo sapiens
ctccgtggactgc

SEQ ID NO: 6127405 - DNA, 13 bp, Homo sapiens
ctccgtggaggag

SEQ ID NO: 6127406 - DNA, 18 bp, Homo sapiens
ctccgtggaggaggttgg

SEQ ID NO: 6127407 - DNA, 13 bp, Homo sapiens
ctccgtggcacat

SEQ ID NO: 6127408 - DNA, 22 bp, Homo sapiens
ctccgtggccccgccctcaggc

SEQ ID NO: 6127409 - DNA, 18 bp, Homo sapiens
ctccgtgggcagctcctc

SEQ ID NO: 6127410 - DNA, 21 bp, Homo sapiens
ctccgtggtggcggcggcact

SEQ ID NO: 6127411 - DNA, 22 bp, Homo sapiens
ctccgtgtctcgcgcgactgag

SEQ ID NO: 6127412 - DNA, 16 bp, Homo sapiens
ctccgtgtgcctgggg

SEQ ID NO: 6127413 - DNA, 15 bp, Homo sapiens
ctccgtgtggactgt

SEQ ID NO: 6127414 - DNA, 13 bp, Homo sapiens
ctccgtgtgtctc

SEQ ID NO: 6127415 - DNA, 17 bp, Homo sapiens
ctccgtgtgtctcatgc

SEQ ID NO: 6127416 - DNA, 20 bp, Homo sapiens
ctccgtgtgtctcatgccag

SEQ ID NO: 6127417 - DNA, 22 bp, Homo sapiens
ctccgtgtgtctcatgccagca

SEQ ID NO: 6127418 - DNA, 19 bp, Homo sapiens
ctccgttcccacctctgag

SEQ ID NO: 6127419 - DNA, 20 bp, Homo sapiens
ctccgttcccacctctgagg

SEQ ID NO: 6127420 - DNA, 17 bp, Homo sapiens
ctccgttcctcctcagc

SEQ ID NO: 6127421 - DNA, 20 bp, Homo sapiens
ctccgttcctcctcagcctc

SEQ ID NO: 6127422 - DNA, 15 bp, Homo sapiens
ctccgtttatgggcc

SEQ ID NO: 6127423 - DNA, 20 bp, Homo sapiens
ctccgtttatgggccttgct

SEQ ID NO: 6127424 - DNA, 16 bp, Homo sapiens
ctccgtttctaccacc

SEQ ID NO: 6127425 - DNA, 20 bp, Homo sapiens
ctcctaaaacaacagatgta

SEQ ID NO: 6127426 - DNA, 13 bp, Homo sapiens
ctcctaaaactgg

SEQ ID NO: 6127427 - DNA, 16 bp, Homo sapiens
ctcctaaaaggcccag

SEQ ID NO: 6127428 - DNA, 22 bp, Homo sapiens
ctcctaaacccccgctccagat

SEQ ID NO: 6127429 - DNA, 16 bp, Homo sapiens
ctcctaaaggcagcaa

SEQ ID NO: 6127430 - DNA, 13 bp, Homo sapiens
ctcctaaataaac

SEQ ID NO: 6127431 - DNA, 17 bp, Homo sapiens
cgtggaagtgttcctgt

SEQ ID NO: 6127432 - DNA, 18 bp, Homo sapiens
cgtggaagtgttcctgtc

SEQ ID NO: 6127433 - DNA, 20 bp, Homo sapiens
cgtggaagtgttcctgtctc

SEQ ID NO: 6127434 - DNA, 13 bp, Homo sapiens
cgtggacacccca

SEQ ID NO: 6127435 - DNA, 12 bp, Homo sapiens
cgtggacacctg

SEQ ID NO: 6127436 - DNA, 17 bp, Homo sapiens
cgtggacacctgccctg

SEQ ID NO: 6127437 - DNA, 18 bp, Homo sapiens
cgtggacacctgccctgc

SEQ ID NO: 6127438 - DNA, 11 bp, Homo sapiens
cgtggacaggc

SEQ ID NO: 6127439 - DNA, 14 bp, Homo sapiens
cgtggaccacccgc

SEQ ID NO: 6127440 - DNA, 14 bp, Homo sapiens
cgtggaccttcctg

SEQ ID NO: 6127441 - DNA, 14 bp, Homo sapiens
cgtggactccagct

SEQ ID NO: 6127442 - DNA, 13 bp, Homo sapiens
cgtggactctgca

SEQ ID NO: 6127443 - DNA, 16 bp, Homo sapiens
cgtggactctgcacat

SEQ ID NO: 6127444 - DNA, 21 bp, Homo sapiens
cgtggactctgctagactcct

SEQ ID NO: 6127445 - DNA, 17 bp, Homo sapiens
cgtggactctgtgctca

SEQ ID NO: 6127446 - DNA, 13 bp, Homo sapiens
cgtggactgtgct

SEQ ID NO: 6127447 - DNA, 19 bp, Homo sapiens
cgtggactgtgctggtgca

SEQ ID NO: 6127448 - DNA, 22 bp, Homo sapiens
cgtggacttggggtcagagact

SEQ ID NO: 6127449 - DNA, 17 bp, Homo sapiens
cgtggagaatcacaggc

SEQ ID NO: 6127450 - DNA, 16 bp, Homo sapiens
cgtggagactggcagg

SEQ ID NO: 6127451 - DNA, 19 bp, Homo sapiens
cgtggagagctaggagcaa

SEQ ID NO: 6127452 - DNA, 20 bp, Homo sapiens
cgtggagagctggtgcccgg

SEQ ID NO: 6127453 - DNA, 13 bp, Homo sapiens
cgtggagatagtg

SEQ ID NO: 6127454 - DNA, 15 bp, Homo sapiens
cgtggagatagtgcc

SEQ ID NO: 6127455 - DNA, 21 bp, Homo sapiens
cgtggagatagtgccaggtgg

SEQ ID NO: 6127456 - DNA, 22 bp, Homo sapiens
cgtggagatagtgccaggtggc

SEQ ID NO: 6127457 - DNA, 23 bp, Homo sapiens
cgtggagatagtgccaggtggct

SEQ ID NO: 6127458 - DNA, 22 bp, Homo sapiens
cgtggagcaggcggtggggaga

SEQ ID NO: 6127459 - DNA, 19 bp, Homo sapiens
cgtggagccacaggcagac

SEQ ID NO: 6127460 - DNA, 14 bp, Homo sapiens
cgtggagctgcctg

SEQ ID NO: 6127461 - DNA, 13 bp, Homo sapiens
cgtggagcttgga

SEQ ID NO: 6127462 - DNA, 15 bp, Homo sapiens
cgtggaggagaggag

SEQ ID NO: 6127463 - DNA, 13 bp, Homo sapiens
cgtggaggctgct

SEQ ID NO: 6127464 - DNA, 19 bp, Homo sapiens
cgtggaggggtaggggctg

SEQ ID NO: 6127465 - DNA, 20 bp, Homo sapiens
cgtggaggtgaagtccctgt

SEQ ID NO: 6127466 - DNA, 21 bp, Homo sapiens
cgtggagtcgagctggccgac

SEQ ID NO: 6127467 - DNA, 15 bp, Homo sapiens
cgtggatcgagtgta

SEQ ID NO: 6127468 - DNA, 22 bp, Homo sapiens
cgtggatcgagtgtagctgtga

SEQ ID NO: 6127469 - DNA, 18 bp, Homo sapiens
cgtggatctccttccctt

SEQ ID NO: 6127470 - DNA, 22 bp, Homo sapiens
cgtggatctccttcccttctct

SEQ ID NO: 6127471 - DNA, 23 bp, Homo sapiens
cgtggatctccttcccttctctt

SEQ ID NO: 6127472 - DNA, 18 bp, Homo sapiens
cgtggatgctctttcaat

SEQ ID NO: 6127473 - DNA, 19 bp, Homo sapiens
cgtggatgggcaaagcttg

SEQ ID NO: 6127474 - DNA, 15 bp, Homo sapiens
cgtggatggtctcca

SEQ ID NO: 6127475 - DNA, 15 bp, Homo sapiens
cgtggattgtattta

SEQ ID NO: 6127476 - DNA, 23 bp, Homo sapiens
cgtggattgtatttaagacataa

SEQ ID NO: 6127477 - DNA, 13 bp, Homo sapiens
cgtggatttgtac

SEQ ID NO: 6127478 - DNA, 14 bp, Homo sapiens
cgtggatttgtact

SEQ ID NO: 6127479 - DNA, 13 bp, Homo sapiens
cgtggcaaatata

SEQ ID NO: 6127480 - DNA, 18 bp, Homo sapiens
cgtggcacagctgggagc

SEQ ID NO: 6127481 - DNA, 14 bp, Homo sapiens
cgtggcacctcctc

SEQ ID NO: 6127482 - DNA, 17 bp, Homo sapiens
cgtggcacctcttccga

SEQ ID NO: 6127483 - DNA, 20 bp, Homo sapiens
cgtggcagataatcagcctc

SEQ ID NO: 6127484 - DNA, 21 bp, Homo sapiens
cgtggcagataatcagcctct

SEQ ID NO: 6127485 - DNA, 22 bp, Homo sapiens
cgtggcagataatcagcctctt

SEQ ID NO: 6127486 - DNA, 21 bp, Homo sapiens
cgtggcagcacggcccggccc

SEQ ID NO: 6127487 - DNA, 13 bp, Homo sapiens
cgtggcaggactt

SEQ ID NO: 6127488 - DNA, 16 bp, Homo sapiens
cgtggcatcttaaaag

SEQ ID NO: 6127489 - DNA, 16 bp, Homo sapiens
cgtggcatgtggcctg

SEQ ID NO: 6127490 - DNA, 19 bp, Homo sapiens
cgtggcatgtggcctgtgg

SEQ ID NO: 6127491 - DNA, 20 bp, Homo sapiens
cgtggccacgggggcagtgt

SEQ ID NO: 6127492 - DNA, 23 bp, Homo sapiens
cgtggccacgggggcagtgtgag

SEQ ID NO: 6127493 - DNA, 13 bp, Homo sapiens
cgtggccaggagc

SEQ ID NO: 6127494 - DNA, 16 bp, Homo sapiens
cgtggccatccctgtg

SEQ ID NO: 6127495 - DNA, 19 bp, Homo sapiens
cgtggccatccctgtgagg

SEQ ID NO: 6127496 - DNA, 13 bp, Homo sapiens
cgtggcccaaggc

SEQ ID NO: 6127497 - DNA, 15 bp, Homo sapiens
cgtggcccagagaag

SEQ ID NO: 6127498 - DNA, 12 bp, Homo sapiens
cgtggccccagc

SEQ ID NO: 6127499 - DNA, 15 bp, Homo sapiens
cgtggccccagcctg

SEQ ID NO: 6127500 - DNA, 17 bp, Homo sapiens
cgtggccccagcctggc

SEQ ID NO: 6127501 - DNA, 19 bp, Homo sapiens
cgtggccccagcctggccc

SEQ ID NO: 6127502 - DNA, 22 bp, Homo sapiens
cgtggccccagcctggcccagc

SEQ ID NO: 6127503 - DNA, 18 bp, Homo sapiens
cgtggcccgtggcctggc

SEQ ID NO: 6127504 - DNA, 18 bp, Homo sapiens
cgtggccctgccctctcc

SEQ ID NO: 6127505 - DNA, 17 bp, Homo sapiens
cgtggcccttcctggac

SEQ ID NO: 6127506 - DNA, 18 bp, Homo sapiens
cgtggcccttcctggaca

SEQ ID NO: 6127507 - DNA, 15 bp, Homo sapiens
cgtggccgctgccca

SEQ ID NO: 6127508 - DNA, 16 bp, Homo sapiens
cgtggccgctgcccac

SEQ ID NO: 6127509 - DNA, 21 bp, Homo sapiens
cgtggcctcccaaagtgctgg

SEQ ID NO: 6127510 - DNA, 14 bp, Homo sapiens
cgtggcctctctct

SEQ ID NO: 6127511 - DNA, 20 bp, Homo sapiens
cgtggcctgagtcctggtcc

SEQ ID NO: 6127512 - DNA, 20 bp, Homo sapiens
cgtggccttccccagcctct

SEQ ID NO: 6127513 - DNA, 21 bp, Homo sapiens
cgtggccttccccttttgcct

SEQ ID NO: 6127514 - DNA, 17 bp, Homo sapiens
cgtggccttgggaggac

SEQ ID NO: 6127515 - DNA, 15 bp, Homo sapiens
cgtggcgcaggtgcc

SEQ ID NO: 6127516 - DNA, 21 bp, Homo sapiens
cgtggcgcaggtgccatgcct

SEQ ID NO: 6127517 - DNA, 16 bp, Homo sapiens
cgtggcggggcagcag

SEQ ID NO: 6127518 - DNA, 15 bp, Homo sapiens
cgtggctaacatcct

SEQ ID NO: 6127519 - DNA, 22 bp, Homo sapiens
cgtggctaagagtgtcctagga

SEQ ID NO: 6127520 - DNA, 23 bp, Homo sapiens
cgtggctagggttccactggaga

SEQ ID NO: 6127521 - DNA, 14 bp, Homo sapiens
cgtggctcagccag

SEQ ID NO: 6127522 - DNA, 11 bp, Homo sapiens
cgtggctctgg

SEQ ID NO: 6127523 - DNA, 22 bp, Homo sapiens
cgtggctctgggagagccagct

SEQ ID NO: 6127524 - DNA, 19 bp, Homo sapiens
cgtggctgacccccctcag

SEQ ID NO: 6127525 - DNA, 21 bp, Homo sapiens
cgtggctgcccacacacccca

SEQ ID NO: 6127526 - DNA, 15 bp, Homo sapiens
cgtggctgcttcaag

SEQ ID NO: 6127527 - DNA, 12 bp, Homo sapiens
cgtggctgtggc

SEQ ID NO: 6127528 - DNA, 17 bp, Homo sapiens
cgtggctgtggcacaga

SEQ ID NO: 6127529 - DNA, 20 bp, Homo sapiens
cgtggcttggcatctgtgtg

SEQ ID NO: 6127530 - DNA, 17 bp, Homo sapiens
cgtggcttgggctggtc

SEQ ID NO: 6127531 - DNA, 14 bp, Homo sapiens
cgtggcttggggat

SEQ ID NO: 6127532 - DNA, 16 bp, Homo sapiens
cgtgggaaaggggagt

SEQ ID NO: 6127533 - DNA, 22 bp, Homo sapiens
cgtgggaacccccctcccaccc

SEQ ID NO: 6127534 - DNA, 23 bp, Homo sapiens
cgtgggaactcgaacttgaagca

SEQ ID NO: 6127535 - DNA, 19 bp, Homo sapiens
cgtgggaattttatctttt

SEQ ID NO: 6127536 - DNA, 14 bp, Homo sapiens
cgtgggacccaggc

SEQ ID NO: 6127537 - DNA, 13 bp, Homo sapiens
cgtgggaccctca

SEQ ID NO: 6127538 - DNA, 22 bp, Homo sapiens
cgtgggagacaagaaatccctg

SEQ ID NO: 6127539 - DNA, 14 bp, Homo sapiens
cgtgggagccagcc

SEQ ID NO: 6127540 - DNA, 17 bp, Homo sapiens
cgtgggagcgtgggagg

SEQ ID NO: 6127541 - DNA, 18 bp, Homo sapiens
cgtgggatggcatttggt

SEQ ID NO: 6127542 - DNA, 23 bp, Homo sapiens
cgtgggattcagagaaaggcaag

SEQ ID NO: 6127543 - DNA, 22 bp, Homo sapiens
cgtgggcctcccaaaacgctgg

SEQ ID NO: 6127544 - DNA, 19 bp, Homo sapiens
cgtgggcgcaaaggtgcct

SEQ ID NO: 6127545 - DNA, 21 bp, Homo sapiens
cgtgggcgcaaaggtgcctca

SEQ ID NO: 6127546 - DNA, 17 bp, Homo sapiens
cgtgggcggggccttgc

SEQ ID NO: 6127547 - DNA, 15 bp, Homo sapiens
cgtgggctcagcagg

SEQ ID NO: 6127548 - DNA, 12 bp, Homo sapiens
cgtgggctcccg

SEQ ID NO: 6127549 - DNA, 12 bp, Homo sapiens
cgtgggctctgc

SEQ ID NO: 6127550 - DNA, 16 bp, Homo sapiens
cgtgggctctgccaat

SEQ ID NO: 6127551 - DNA, 14 bp, Homo sapiens
cgtgggctctggct

SEQ ID NO: 6127552 - DNA, 16 bp, Homo sapiens
cgtgggctgttacttg

SEQ ID NO: 6127553 - DNA, 17 bp, Homo sapiens
cgtgggcttaaagcaga

SEQ ID NO: 6127554 - DNA, 18 bp, Homo sapiens
cgtgggcttaaagcagaa

SEQ ID NO: 6127555 - DNA, 20 bp, Homo sapiens
cgtggggaacggaggaggac

SEQ ID NO: 6127556 - DNA, 13 bp, Homo sapiens
cgtggggaagggg

SEQ ID NO: 6127557 - DNA, 18 bp, Homo sapiens
cgtggggaatgggcaggt

SEQ ID NO: 6127558 - DNA, 22 bp, Homo sapiens
cgtggggaatgggcaggtggcc

SEQ ID NO: 6127559 - DNA, 22 bp, Homo sapiens
cgtggggaggccatttgctgcc

SEQ ID NO: 6127560 - DNA, 23 bp, Homo sapiens
cgtggggagggccgtaccccacc

SEQ ID NO: 6127561 - DNA, 18 bp, Homo sapiens
cgtggggaggggctgagg

SEQ ID NO: 6127562 - DNA, 11 bp, Homo sapiens
cgtggggaggt

SEQ ID NO: 6127563 - DNA, 12 bp, Homo sapiens
cgtggggcagca

SEQ ID NO: 6127564 - DNA, 23 bp, Homo sapiens
cgtggggccatgctgagagctgg

SEQ ID NO: 6127565 - DNA, 13 bp, Homo sapiens
cgtggggcccact

SEQ ID NO: 6127566 - DNA, 16 bp, Homo sapiens
cgtggggccgggagcg

SEQ ID NO: 6127567 - DNA, 14 bp, Homo sapiens
cgtggggctcccgg

SEQ ID NO: 6127568 - DNA, 22 bp, Homo sapiens
cgtggggctcccggcatcctga

SEQ ID NO: 6127569 - DNA, 18 bp, Homo sapiens
cgtgggggcactgaccag

SEQ ID NO: 6127570 - DNA, 23 bp, Homo sapiens
cgtgggggcactgaccaggccca

SEQ ID NO: 6127571 - DNA, 18 bp, Homo sapiens
cgtggggggagctctggt

SEQ ID NO: 6127572 - DNA, 17 bp, Homo sapiens
cgtgggggtggccactc

SEQ ID NO: 6127573 - DNA, 19 bp, Homo sapiens
cgtgggtacccaggctggt

SEQ ID NO: 6127574 - DNA, 17 bp, Homo sapiens
cgtgggtatttcctgct

SEQ ID NO: 6127575 - DNA, 14 bp, Homo sapiens
cgtgggtcagaaga

SEQ ID NO: 6127576 - DNA, 19 bp, Homo sapiens
cgtgggtcctgaggcctgc

SEQ ID NO: 6127577 - DNA, 15 bp, Homo sapiens
cgtgggtctctgggg

SEQ ID NO: 6127578 - DNA, 18 bp, Homo sapiens
cgtgggtctgttttcctt

SEQ ID NO: 6127579 - DNA, 22 bp, Homo sapiens
cgtgggtcttcagggggccagg

SEQ ID NO: 6127580 - DNA, 19 bp, Homo sapiens
cgtgggtgccctctccaaa

SEQ ID NO: 6127581 - DNA, 18 bp, Homo sapiens
cgtgggtgggcctggccc

SEQ ID NO: 6127582 - DNA, 15 bp, Homo sapiens
cgtgggttcaatttg

SEQ ID NO: 6127583 - DNA, 23 bp, Homo sapiens
cgtgggtttttgtatccagagct

SEQ ID NO: 6127584 - DNA, 13 bp, Homo sapiens
cgtggtagaggcc

SEQ ID NO: 6127585 - DNA, 18 bp, Homo sapiens
cgtggtagaggcctgggg

SEQ ID NO: 6127586 - DNA, 21 bp, Homo sapiens
cgtggtcaaggcccggcccca

SEQ ID NO: 6127587 - DNA, 16 bp, Homo sapiens
cgtggtcactgctgtc

SEQ ID NO: 6127588 - DNA, 18 bp, Homo sapiens
cgtggtcactgtgcactg

SEQ ID NO: 6127589 - DNA, 17 bp, Homo sapiens
cgtggtcagagtgccac

SEQ ID NO: 6127590 - DNA, 19 bp, Homo sapiens
cgtggtcagggcagggctc

SEQ ID NO: 6127591 - DNA, 17 bp, Homo sapiens
cgtggtcatgaatagaa

SEQ ID NO: 6127592 - DNA, 14 bp, Homo sapiens
cgtggtccagctct

SEQ ID NO: 6127593 - DNA, 20 bp, Homo sapiens
cgtggtccatgctgatgatt

SEQ ID NO: 6127594 - DNA, 21 bp, Homo sapiens
cgtggtccccaacagcgacat

SEQ ID NO: 6127595 - DNA, 22 bp, Homo sapiens
cgtggtctagaccagggctgct

SEQ ID NO: 6127596 - DNA, 12 bp, Homo sapiens
cgtggtctttga

SEQ ID NO: 6127597 - DNA, 13 bp, Homo sapiens
cgtggtctttgaa

SEQ ID NO: 6127598 - DNA, 15 bp, Homo sapiens
cgtggtctttgaata

SEQ ID NO: 6127599 - DNA, 17 bp, Homo sapiens
cgtggtctttgaataaa

SEQ ID NO: 6127600 - DNA, 19 bp, Homo sapiens
cgtggtgacccctgctttg

SEQ ID NO: 6127601 - DNA, 22 bp, Homo sapiens
cgtggtgacgccccggggcgcc

SEQ ID NO: 6127602 - DNA, 19 bp, Homo sapiens
cgtggtgccgacgtcccca

SEQ ID NO: 6127603 - DNA, 18 bp, Homo sapiens
cgtggtgcgagtgcgtga

SEQ ID NO: 6127604 - DNA, 18 bp, Homo sapiens
cgtggtggagaatctgag

SEQ ID NO: 6127605 - DNA, 23 bp, Homo sapiens
cgtggtgggggaggagcctctgg

SEQ ID NO: 6127606 - DNA, 14 bp, Homo sapiens
cgtggtgtggcccg

SEQ ID NO: 6127607 - DNA, 21 bp, Homo sapiens
cgtggtgtggcccgtggcctg

SEQ ID NO: 6127608 - DNA, 22 bp, Homo sapiens
cgtggtgtggcccgtggcctgg

SEQ ID NO: 6127609 - DNA, 14 bp, Homo sapiens
ctcctaaataaatt

SEQ ID NO: 6127610 - DNA, 19 bp, Homo sapiens
ctcctaacctcaagtgatc

SEQ ID NO: 6127611 - DNA, 17 bp, Homo sapiens
ctcctaactccaccgcc

SEQ ID NO: 6127612 - DNA, 18 bp, Homo sapiens
ctcctaactccaccgcct

SEQ ID NO: 6127613 - DNA, 18 bp, Homo sapiens
ctcctaactttggaccta

SEQ ID NO: 6127614 - DNA, 22 bp, Homo sapiens
ctcctaagcacctgtaatgtgc

SEQ ID NO: 6127615 - DNA, 14 bp, Homo sapiens
ctcctaagcagctg

SEQ ID NO: 6127616 - DNA, 17 bp, Homo sapiens
ctcctaagcagctggga

SEQ ID NO: 6127617 - DNA, 17 bp, Homo sapiens
ctcctaaggaaattgag

SEQ ID NO: 6127618 - DNA, 16 bp, Homo sapiens
ctcctaaggctcccca

SEQ ID NO: 6127619 - DNA, 18 bp, Homo sapiens
ctcctaaggctccccacc

SEQ ID NO: 6127620 - DNA, 19 bp, Homo sapiens
ctcctaaggctccccaccc

SEQ ID NO: 6127621 - DNA, 19 bp, Homo sapiens
ctcctaatagcttttcctg

SEQ ID NO: 6127622 - DNA, 19 bp, Homo sapiens
ctcctaatcaagagtctct

SEQ ID NO: 6127623 - DNA, 22 bp, Homo sapiens
ctcctaatcaagagtctctcca

SEQ ID NO: 6127624 - DNA, 15 bp, Homo sapiens
ctcctaatgctctga

SEQ ID NO: 6127625 - DNA, 14 bp, Homo sapiens
ctcctaatggcatg

SEQ ID NO: 6127626 - DNA, 20 bp, Homo sapiens
ctcctaatggcatggagact

SEQ ID NO: 6127627 - DNA, 23 bp, Homo sapiens
ctcctaatggcatggagactctg

SEQ ID NO: 6127628 - DNA, 22 bp, Homo sapiens
ctcctaatttgatcacagtggc

SEQ ID NO: 6127629 - DNA, 20 bp, Homo sapiens
ctcctacagcactccacctt

SEQ ID NO: 6127630 - DNA, 19 bp, Homo sapiens
ctcctacatatcccttcca

SEQ ID NO: 6127631 - DNA, 20 bp, Homo sapiens
ctcctacatatcccttccag

SEQ ID NO: 6127632 - DNA, 18 bp, Homo sapiens
ctcctacatccagctcct

SEQ ID NO: 6127633 - DNA, 17 bp, Homo sapiens
ctcctacccctcccagc

SEQ ID NO: 6127634 - DNA, 18 bp, Homo sapiens
ctcctacccctcccagct

SEQ ID NO: 6127635 - DNA, 13 bp, Homo sapiens
ctcctacccctgt

SEQ ID NO: 6127636 - DNA, 15 bp, Homo sapiens
ctcctaccccttcct

SEQ ID NO: 6127637 - DNA, 20 bp, Homo sapiens
ctcctaccccttcctgtcct

SEQ ID NO: 6127638 - DNA, 21 bp, Homo sapiens
ctcctaccccttcctgtcctg

SEQ ID NO: 6127639 - DNA, 13 bp, Homo sapiens
ctcctaccctccc

SEQ ID NO: 6127640 - DNA, 16 bp, Homo sapiens
ctcctaccctcccacc

SEQ ID NO: 6127641 - DNA, 12 bp, Homo sapiens
ctcctacctcag

SEQ ID NO: 6127642 - DNA, 14 bp, Homo sapiens
ctcctacctctgtg

SEQ ID NO: 6127643 - DNA, 20 bp, Homo sapiens
ctcctacctgaaggcagggc

SEQ ID NO: 6127644 - DNA, 22 bp, Homo sapiens
ctcctacctgaaggcagggctc

SEQ ID NO: 6127645 - DNA, 17 bp, Homo sapiens
ctcctacctgccctgga

SEQ ID NO: 6127646 - DNA, 18 bp, Homo sapiens
ctcctacctgccctggaa

SEQ ID NO: 6127647 - DNA, 20 bp, Homo sapiens
ctcctacctgccctggaaca

SEQ ID NO: 6127648 - DNA, 15 bp, Homo sapiens
ctcctacctgctgct

SEQ ID NO: 6127649 - DNA, 11 bp, Homo sapiens
ctcctacctgg

SEQ ID NO: 6127650 - DNA, 13 bp, Homo sapiens
ctcctacctgggg

SEQ ID NO: 6127651 - DNA, 16 bp, Homo sapiens
ctcctacctgggggca

SEQ ID NO: 6127652 - DNA, 17 bp, Homo sapiens
ctcctacctgtctgctg

SEQ ID NO: 6127653 - DNA, 15 bp, Homo sapiens
ctcctacgcaccatt

SEQ ID NO: 6127654 - DNA, 13 bp, Homo sapiens
ctcctactcctga

SEQ ID NO: 6127655 - DNA, 18 bp, Homo sapiens
ctcctactctgtgtaaat

SEQ ID NO: 6127656 - DNA, 12 bp, Homo sapiens
ctcctactgagg

SEQ ID NO: 6127657 - DNA, 21 bp, Homo sapiens
ctcctacttagggaagaaaaa

SEQ ID NO: 6127658 - DNA, 19 bp, Homo sapiens
ctcctagaagaaccaaata

SEQ ID NO: 6127659 - DNA, 23 bp, Homo sapiens
ctcctagagacagaagcaggctg

SEQ ID NO: 6127660 - DNA, 23 bp, Homo sapiens
ctcctagaggggacaagccaggc

SEQ ID NO: 6127661 - DNA, 17 bp, Homo sapiens
ctcctagaggtgggcag

SEQ ID NO: 6127662 - DNA, 19 bp, Homo sapiens
ctcctagaggtgggcagct

SEQ ID NO: 6127663 - DNA, 20 bp, Homo sapiens
ctcctagaggtgggcagctg

SEQ ID NO: 6127664 - DNA, 23 bp, Homo sapiens
ctcctagaggtgggcagctgggc

SEQ ID NO: 6127665 - DNA, 19 bp, Homo sapiens
ctcctagcagacagaaact

SEQ ID NO: 6127666 - DNA, 16 bp, Homo sapiens
ctcctagccacccacc

SEQ ID NO: 6127667 - DNA, 14 bp, Homo sapiens
ctcctagcccagca

SEQ ID NO: 6127668 - DNA, 16 bp, Homo sapiens
ctcctagcccctctct

SEQ ID NO: 6127669 - DNA, 13 bp, Homo sapiens
ctcctagcctgct

SEQ ID NO: 6127670 - DNA, 15 bp, Homo sapiens
ctcctagcctgctct

SEQ ID NO: 6127671 - DNA, 14 bp, Homo sapiens
ctcctagctccacc

SEQ ID NO: 6127672 - DNA, 14 bp, Homo sapiens
ctcctagctgtcct

SEQ ID NO: 6127673 - DNA, 19 bp, Homo sapiens
ctcctaggagagccaacct

SEQ ID NO: 6127674 - DNA, 20 bp, Homo sapiens
ctcctaggctaaatgagaat

SEQ ID NO: 6127675 - DNA, 15 bp, Homo sapiens
ctcctagggcattgt

SEQ ID NO: 6127676 - DNA, 17 bp, Homo sapiens
ctcctaggggaaggggg

SEQ ID NO: 6127677 - DNA, 22 bp, Homo sapiens
ctcctagtactaactcctagga

SEQ ID NO: 6127678 - DNA, 21 bp, Homo sapiens
ctcctagttcttcatcccact

SEQ ID NO: 6127679 - DNA, 19 bp, Homo sapiens
ctcctagtttgacctcaca

SEQ ID NO: 6127680 - DNA, 22 bp, Homo sapiens
ctcctataaagggcccacacct

SEQ ID NO: 6127681 - DNA, 16 bp, Homo sapiens
ctcctataaagtgcct

SEQ ID NO: 6127682 - DNA, 14 bp, Homo sapiens
ctcctataatctgt

SEQ ID NO: 6127683 - DNA, 15 bp, Homo sapiens
ctcctataatctgtc

SEQ ID NO: 6127684 - DNA, 18 bp, Homo sapiens
ctcctataatctgtcaaa

SEQ ID NO: 6127685 - DNA, 22 bp, Homo sapiens
ctcctataatctgtcaaaacac

SEQ ID NO: 6127686 - DNA, 13 bp, Homo sapiens
ctcctatacccag

SEQ ID NO: 6127687 - DNA, 17 bp, Homo sapiens
ctcctatacccagcaga

SEQ ID NO: 6127688 - DNA, 15 bp, Homo sapiens
ctcctatatatttct

SEQ ID NO: 6127689 - DNA, 18 bp, Homo sapiens
ctcctatatatttctatt

SEQ ID NO: 6127690 - DNA, 16 bp, Homo sapiens
ctcctatatcctcctt

SEQ ID NO: 6127691 - DNA, 14 bp, Homo sapiens
ctcctatccccagg

SEQ ID NO: 6127692 - DNA, 14 bp, Homo sapiens
ctcctatccttgga

SEQ ID NO: 6127693 - DNA, 15 bp, Homo sapiens
ctcctatgtggcagc

SEQ ID NO: 6127694 - DNA, 18 bp, Homo sapiens
ctcctatgtggcagctgg

SEQ ID NO: 6127695 - DNA, 20 bp, Homo sapiens
ctcctattccttcacacagt

SEQ ID NO: 6127696 - DNA, 16 bp, Homo sapiens
ctcctattctataaaa

SEQ ID NO: 6127697 - DNA, 13 bp, Homo sapiens
ctcctatttcaat

SEQ ID NO: 6127698 - DNA, 20 bp, Homo sapiens
ctcctatttgaccagaactt

SEQ ID NO: 6127699 - DNA, 16 bp, Homo sapiens
ctcctatttttgtaaa

SEQ ID NO: 6127700 - DNA, 16 bp, Homo sapiens
ctcctatttttttaaa

SEQ ID NO: 6127701 - DNA, 15 bp, Homo sapiens
ctcctcaacccacat

SEQ ID NO: 6127702 - DNA, 14 bp, Homo sapiens
ctcctcaaccttga

SEQ ID NO: 6127703 - DNA, 14 bp, Homo sapiens
ctcctcaagcctgt

SEQ ID NO: 6127704 - DNA, 23 bp, Homo sapiens
ctcctcaattccagggaaccaga

SEQ ID NO: 6127705 - DNA, 17 bp, Homo sapiens
ctcctcacacaccctga

SEQ ID NO: 6127706 - DNA, 19 bp, Homo sapiens
ctcctcacacaccctgagg

SEQ ID NO: 6127707 - DNA, 19 bp, Homo sapiens
ctcctcacaccccagcacc

SEQ ID NO: 6127708 - DNA, 17 bp, Homo sapiens
ctcctcacccacctctg

SEQ ID NO: 6127709 - DNA, 19 bp, Homo sapiens
ctcctcacccacctctggg

SEQ ID NO: 6127710 - DNA, 21 bp, Homo sapiens
ctcctcacccacctctgggtc

SEQ ID NO: 6127711 - DNA, 15 bp, Homo sapiens
ctcctcacccagggc

SEQ ID NO: 6127712 - DNA, 21 bp, Homo sapiens
ctcctcacccccacccctgta

SEQ ID NO: 6127713 - DNA, 14 bp, Homo sapiens
ctcctcacccccag

SEQ ID NO: 6127714 - DNA, 17 bp, Homo sapiens
ctcctcacccccagctt

SEQ ID NO: 6127715 - DNA, 13 bp, Homo sapiens
ctcctcacctctg

SEQ ID NO: 6127716 - DNA, 21 bp, Homo sapiens
ctcctcacctctggactggct

SEQ ID NO: 6127717 - DNA, 20 bp, Homo sapiens
ctcctcactccctaggccca

SEQ ID NO: 6127718 - DNA, 23 bp, Homo sapiens
ctcctcactccctaggcccaagt

SEQ ID NO: 6127719 - DNA, 14 bp, Homo sapiens
ctcctcactccctt

SEQ ID NO: 6127720 - DNA, 13 bp, Homo sapiens
ctcctcactctgt

SEQ ID NO: 6127721 - DNA, 14 bp, Homo sapiens
ctcctcactgccac

SEQ ID NO: 6127722 - DNA, 11 bp, Homo sapiens
ctcctcagact

SEQ ID NO: 6127723 - DNA, 17 bp, Homo sapiens
ctcctcagagcgccagg

SEQ ID NO: 6127724 - DNA, 21 bp, Homo sapiens
ctcctcagagcgccaggaagc

SEQ ID NO: 6127725 - DNA, 20 bp, Homo sapiens
ctcctcagagtcccggcgtt

SEQ ID NO: 6127726 - DNA, 14 bp, Homo sapiens
ctcctcagatcttc

SEQ ID NO: 6127727 - DNA, 18 bp, Homo sapiens
ctcctcagatcttctgtg

SEQ ID NO: 6127728 - DNA, 17 bp, Homo sapiens
ctcctcagcagcctcac

SEQ ID NO: 6127729 - DNA, 14 bp, Homo sapiens
ctcctcagccagcc

SEQ ID NO: 6127730 - DNA, 15 bp, Homo sapiens
ctcctcagccctctc

SEQ ID NO: 6127731 - DNA, 19 bp, Homo sapiens
ctcctcagccctctcttgc

SEQ ID NO: 6127732 - DNA, 12 bp, Homo sapiens
ctcctcagcctg

SEQ ID NO: 6127733 - DNA, 16 bp, Homo sapiens
ctcctcagctccctgc

SEQ ID NO: 6127734 - DNA, 19 bp, Homo sapiens
ctcctcagctccctgcctg

SEQ ID NO: 6127735 - DNA, 21 bp, Homo sapiens
ctcctcagctgcatggagcct

SEQ ID NO: 6127736 - DNA, 22 bp, Homo sapiens
ctcctcagctgcatggagcctg

SEQ ID NO: 6127737 - DNA, 21 bp, Homo sapiens
ctcctcaggacaaggccttgc

SEQ ID NO: 6127738 - DNA, 12 bp, Homo sapiens
ctcctcaggacc

SEQ ID NO: 6127739 - DNA, 20 bp, Homo sapiens
ctcctcaggaccctcagccc

SEQ ID NO: 6127740 - DNA, 22 bp, Homo sapiens
ctcctcaggaccctcagccctg

SEQ ID NO: 6127741 - DNA, 13 bp, Homo sapiens
ctcctcaggagaa

SEQ ID NO: 6127742 - DNA, 12 bp, Homo sapiens
ctcctcaggagc

SEQ ID NO: 6127743 - DNA, 20 bp, Homo sapiens
ctcctcaggcccagctgctc

SEQ ID NO: 6127744 - DNA, 21 bp, Homo sapiens
ctcctcagggggtaggagagc

SEQ ID NO: 6127745 - DNA, 15 bp, Homo sapiens
ctcctcagggtgggg

SEQ ID NO: 6127746 - DNA, 23 bp, Homo sapiens
ctcctcagggttgaggtccagcc

SEQ ID NO: 6127747 - DNA, 22 bp, Homo sapiens
ctcctcagtaaaagtcttctcc

SEQ ID NO: 6127748 - DNA, 19 bp, Homo sapiens
ctcctcagtctttggggga

SEQ ID NO: 6127749 - DNA, 16 bp, Homo sapiens
ctcctcagtgacatca

SEQ ID NO: 6127750 - DNA, 23 bp, Homo sapiens
ctcctcagtggcttctccaggga

SEQ ID NO: 6127751 - DNA, 18 bp, Homo sapiens
ctcctcatagcatgatat

SEQ ID NO: 6127752 - DNA, 20 bp, Homo sapiens
ctcctcatcagtgtgtaaat

SEQ ID NO: 6127753 - DNA, 20 bp, Homo sapiens
ctcctcatccagggctctga

SEQ ID NO: 6127754 - DNA, 12 bp, Homo sapiens
ctcctcatcccg

SEQ ID NO: 6127755 - DNA, 20 bp, Homo sapiens
ctcctcatctgcctggaaag

SEQ ID NO: 6127756 - DNA, 20 bp, Homo sapiens
ctcctcatggcagcctactc

SEQ ID NO: 6127757 - DNA, 20 bp, Homo sapiens
ctcctcatgtacataccctg

SEQ ID NO: 6127758 - DNA, 18 bp, Homo sapiens
ctcctcattctctcccta

SEQ ID NO: 6127759 - DNA, 18 bp, Homo sapiens
ctcctccaaaggccccct

SEQ ID NO: 6127760 - DNA, 19 bp, Homo sapiens
ctcctccaagaagccctcc

SEQ ID NO: 6127761 - DNA, 20 bp, Homo sapiens
ctcctccaagaagccctcct

SEQ ID NO: 6127762 - DNA, 22 bp, Homo sapiens
ctcctccaagaagccctccttg

SEQ ID NO: 6127763 - DNA, 21 bp, Homo sapiens
ctcctccaagacactgtggac

SEQ ID NO: 6127764 - DNA, 16 bp, Homo sapiens
ctcctccaatgtcctg

SEQ ID NO: 6127765 - DNA, 13 bp, Homo sapiens
ctcctccacattt

SEQ ID NO: 6127766 - DNA, 21 bp, Homo sapiens
ctcctccaccaccgcccgtct

SEQ ID NO: 6127767 - DNA, 17 bp, Homo sapiens
ctcctccacccaccccc

SEQ ID NO: 6127768 - DNA, 16 bp, Homo sapiens
ctcctccaccgccatg

SEQ ID NO: 6127769 - DNA, 15 bp, Homo sapiens
ctcctccacctcaac

SEQ ID NO: 6127770 - DNA, 19 bp, Homo sapiens
ctcctccactcactccagc

SEQ ID NO: 6127771 - DNA, 16 bp, Homo sapiens
ctcctccactctcccc

SEQ ID NO: 6127772 - DNA, 22 bp, Homo sapiens
ctcctccagactcgagagggct

SEQ ID NO: 6127773 - DNA, 15 bp, Homo sapiens
ctcctccagagcctg

SEQ ID NO: 6127774 - DNA, 18 bp, Homo sapiens
ctcctccagagcctgggc

SEQ ID NO: 6127775 - DNA, 15 bp, Homo sapiens
ctcctccagagtcag

SEQ ID NO: 6127776 - DNA, 12 bp, Homo sapiens
ctcctccagccc

SEQ ID NO: 6127777 - DNA, 14 bp, Homo sapiens
ctcctccagccctg

SEQ ID NO: 6127778 - DNA, 13 bp, Homo sapiens
ctcctccagcgag

SEQ ID NO: 6127779 - DNA, 19 bp, Homo sapiens
ctcctccagctcctgcccc

SEQ ID NO: 6127780 - DNA, 21 bp, Homo sapiens
ctcctccaggcacgtcccgga

SEQ ID NO: 6127781 - DNA, 18 bp, Homo sapiens
ctcctccaggcctgcctc

SEQ ID NO: 6127782 - DNA, 21 bp, Homo sapiens
ctcctccaggcctgcctccca

SEQ ID NO: 6127783 - DNA, 23 bp, Homo sapiens
ctcctccaggcctgcctcccact

SEQ ID NO: 6127784 - DNA, 11 bp, Homo sapiens
ctcctccaggg

SEQ ID NO: 6127785 - DNA, 24 bp, Homo sapiens
ctcctccagggaaggtggccacag

SEQ ID NO: 6127786 - DNA, 13 bp, Homo sapiens
ctcctccagggac

SEQ ID NO: 6127787 - DNA, 19 bp, Homo sapiens
cgtggtgtgtccctggaca

SEQ ID NO: 6127788 - DNA, 21 bp, Homo sapiens
cgtggtgtgtccctggacaca

SEQ ID NO: 6127789 - DNA, 17 bp, Homo sapiens
cgtggttcagagactgg

SEQ ID NO: 6127790 - DNA, 13 bp, Homo sapiens
cgtggttccaaga

SEQ ID NO: 6127791 - DNA, 13 bp, Homo sapiens
cgtggttcttaaa

SEQ ID NO: 6127792 - DNA, 13 bp, Homo sapiens
cgtggttgatttc

SEQ ID NO: 6127793 - DNA, 21 bp, Homo sapiens
cgtggttgggaacacagcatt

SEQ ID NO: 6127794 - DNA, 19 bp, Homo sapiens
cgtggtttgcctgaggctg

SEQ ID NO: 6127795 - DNA, 21 bp, Homo sapiens
cgtggtttgcctgaggctgta

SEQ ID NO: 6127796 - DNA, 18 bp, Homo sapiens
cgtggttttatgaagcta

SEQ ID NO: 6127797 - DNA, 17 bp, Homo sapiens
cgtggtttttatgtgta

SEQ ID NO: 6127798 - DNA, 19 bp, Homo sapiens
cgtgtaaaaagcctccttg

SEQ ID NO: 6127799 - DNA, 19 bp, Homo sapiens
cgtgtaaaggaaaataatg

SEQ ID NO: 6127800 - DNA, 12 bp, Homo sapiens
cgtgtaaataat

SEQ ID NO: 6127801 - DNA, 19 bp, Homo sapiens
cgtgtaaatatgtacattt

SEQ ID NO: 6127802 - DNA, 19 bp, Homo sapiens
cgtgtaaattgcacagagc

SEQ ID NO: 6127803 - DNA, 13 bp, Homo sapiens
cgtgtacagcaca

SEQ ID NO: 6127804 - DNA, 15 bp, Homo sapiens
cgtgtacagcacaga

SEQ ID NO: 6127805 - DNA, 17 bp, Homo sapiens
cgtgtacagcacagaat

SEQ ID NO: 6127806 - DNA, 20 bp, Homo sapiens
cgtgtacagctcccttccct

SEQ ID NO: 6127807 - DNA, 18 bp, Homo sapiens
cgtgtacatagccctggt

SEQ ID NO: 6127808 - DNA, 18 bp, Homo sapiens
cgtgtactggctcctctg

SEQ ID NO: 6127809 - DNA, 22 bp, Homo sapiens
cgtgtagctatggaagttgcat

SEQ ID NO: 6127810 - DNA, 21 bp, Homo sapiens
cgtgtagtggaagagcagcct

SEQ ID NO: 6127811 - DNA, 23 bp, Homo sapiens
cgtgtatatgaggatgtatgtgt

SEQ ID NO: 6127812 - DNA, 16 bp, Homo sapiens
cgtgtatgtttcttct

SEQ ID NO: 6127813 - DNA, 17 bp, Homo sapiens
cgtgtatttggctgggc

SEQ ID NO: 6127814 - DNA, 17 bp, Homo sapiens
cgtgtcaagctgctctg

SEQ ID NO: 6127815 - DNA, 22 bp, Homo sapiens
cgtgtcaatgaatgccggggac

SEQ ID NO: 6127816 - DNA, 15 bp, Homo sapiens
cgtgtcaatgtgtgc

SEQ ID NO: 6127817 - DNA, 14 bp, Homo sapiens
cgtgtcacacttgt

SEQ ID NO: 6127818 - DNA, 16 bp, Homo sapiens
cgtgtcacctgtgctt

SEQ ID NO: 6127819 - DNA, 14 bp, Homo sapiens
cgtgtcagggctga

SEQ ID NO: 6127820 - DNA, 14 bp, Homo sapiens
cgtgtccaccccca

SEQ ID NO: 6127821 - DNA, 22 bp, Homo sapiens
cgtgtccagactcagagggctg

SEQ ID NO: 6127822 - DNA, 14 bp, Homo sapiens
cgtgtccagcacag

SEQ ID NO: 6127823 - DNA, 22 bp, Homo sapiens
cgtgtccaggagaccttccaca

SEQ ID NO: 6127824 - DNA, 13 bp, Homo sapiens
cgtgtccccccag

SEQ ID NO: 6127825 - DNA, 22 bp, Homo sapiens
cgtgtcccctatcctacttccc

SEQ ID NO: 6127826 - DNA, 19 bp, Homo sapiens
cgtgtcccctgacagggcc

SEQ ID NO: 6127827 - DNA, 17 bp, Homo sapiens
cgtgtccgactcttctg

SEQ ID NO: 6127828 - DNA, 13 bp, Homo sapiens
cgtgtccgtccac

SEQ ID NO: 6127829 - DNA, 18 bp, Homo sapiens
cgtgtccgtccacccttc

SEQ ID NO: 6127830 - DNA, 19 bp, Homo sapiens
cgtgtccgtccacccttcc

SEQ ID NO: 6127831 - DNA, 14 bp, Homo sapiens
cgtgtcctatcccc

SEQ ID NO: 6127832 - DNA, 14 bp, Homo sapiens
cgtgtcctcctctg

SEQ ID NO: 6127833 - DNA, 12 bp, Homo sapiens
cgtgtcctctcc

SEQ ID NO: 6127834 - DNA, 16 bp, Homo sapiens
cgtgtcctctccccca

SEQ ID NO: 6127835 - DNA, 20 bp, Homo sapiens
cgtgtcctctccctgccaag

SEQ ID NO: 6127836 - DNA, 21 bp, Homo sapiens
cgtgtcctgctagctgtctct

SEQ ID NO: 6127837 - DNA, 21 bp, Homo sapiens
cgtgtctataatggaaacatt

SEQ ID NO: 6127838 - DNA, 14 bp, Homo sapiens
cgtgtctcagcctc

SEQ ID NO: 6127839 - DNA, 23 bp, Homo sapiens
cgtgtctctcccaccccggcctc

SEQ ID NO: 6127840 - DNA, 13 bp, Homo sapiens
cgtgtctctgcca

SEQ ID NO: 6127841 - DNA, 12 bp, Homo sapiens
cgtgtctgaatc

SEQ ID NO: 6127842 - DNA, 13 bp, Homo sapiens
cgtgtctggcaca

SEQ ID NO: 6127843 - DNA, 14 bp, Homo sapiens
cgtgtctggcacag

SEQ ID NO: 6127844 - DNA, 20 bp, Homo sapiens
cgtgtctggcgttgtgggga

SEQ ID NO: 6127845 - DNA, 14 bp, Homo sapiens
cgtgtctgtggccc

SEQ ID NO: 6127846 - DNA, 17 bp, Homo sapiens
cgtgtcttcaattaaaa

SEQ ID NO: 6127847 - DNA, 16 bp, Homo sapiens
cgtgtgaaatctgtct

SEQ ID NO: 6127848 - DNA, 19 bp, Homo sapiens
cgtgtgaaatctgtctttg

SEQ ID NO: 6127849 - DNA, 12 bp, Homo sapiens
cgtgtgaatgta

SEQ ID NO: 6127850 - DNA, 23 bp, Homo sapiens
cgtgtgaatgtagcttccacctc

SEQ ID NO: 6127851 - DNA, 22 bp, Homo sapiens
cgtgtgagaagtgaatgctggg

SEQ ID NO: 6127852 - DNA, 18 bp, Homo sapiens
cgtgtgagtgagggagac

SEQ ID NO: 6127853 - DNA, 20 bp, Homo sapiens
cgtgtgagtgtgacagggcc

SEQ ID NO: 6127854 - DNA, 21 bp, Homo sapiens
cgtgtgagtgtgacagggcca

SEQ ID NO: 6127855 - DNA, 15 bp, Homo sapiens
cgtgtgatgtatgtt

SEQ ID NO: 6127856 - DNA, 11 bp, Homo sapiens
cgtgtgatttt

SEQ ID NO: 6127857 - DNA, 18 bp, Homo sapiens
cgtgtgcacacacaccac

SEQ ID NO: 6127858 - DNA, 20 bp, Homo sapiens
cgtgtgcatagcgtcctgcc

SEQ ID NO: 6127859 - DNA, 22 bp, Homo sapiens
cgtgtgcatagcgtcctgccct

SEQ ID NO: 6127860 - DNA, 23 bp, Homo sapiens
cgtgtgcatagcgtcctgccctg

SEQ ID NO: 6127861 - DNA, 24 bp, Homo sapiens
cgtgtgcatagcgtcctgccctgc

SEQ ID NO: 6127862 - DNA, 16 bp, Homo sapiens
cgtgtgcatgagaatg

SEQ ID NO: 6127863 - DNA, 14 bp, Homo sapiens
cgtgtgccaggcag

SEQ ID NO: 6127864 - DNA, 22 bp, Homo sapiens
cgtgtgcccactgaacatgctc

SEQ ID NO: 6127865 - DNA, 17 bp, Homo sapiens
cgtgtgcctcctgtgtg

SEQ ID NO: 6127866 - DNA, 18 bp, Homo sapiens
cgtgtgcctcctgtgtgt

SEQ ID NO: 6127867 - DNA, 16 bp, Homo sapiens
cgtgtgctccagtgtt

SEQ ID NO: 6127868 - DNA, 14 bp, Homo sapiens
cgtgtgctgctgct

SEQ ID NO: 6127869 - DNA, 18 bp, Homo sapiens
cgtgtgctgtggccaggc

SEQ ID NO: 6127870 - DNA, 18 bp, Homo sapiens
cgtgtggagcagagctct

SEQ ID NO: 6127871 - DNA, 19 bp, Homo sapiens
cgtgtggccctgtgggagt

SEQ ID NO: 6127872 - DNA, 14 bp, Homo sapiens
cgtgtggcctccgt

SEQ ID NO: 6127873 - DNA, 14 bp, Homo sapiens
cgtgtggcctgggt

SEQ ID NO: 6127874 - DNA, 16 bp, Homo sapiens
cgtgtggcctgggtcc

SEQ ID NO: 6127875 - DNA, 14 bp, Homo sapiens
cgtgtggcgtggcc

SEQ ID NO: 6127876 - DNA, 23 bp, Homo sapiens
cgtgtgggagaccggcctgccag

SEQ ID NO: 6127877 - DNA, 22 bp, Homo sapiens
cgtgtgggaggctggggaccca

SEQ ID NO: 6127878 - DNA, 22 bp, Homo sapiens
cgtgtggtaccttcagccctgg

SEQ ID NO: 6127879 - DNA, 23 bp, Homo sapiens
cgtgtggtaccttcagccctggc

SEQ ID NO: 6127880 - DNA, 17 bp, Homo sapiens
cgtgtggtttccctgcc

SEQ ID NO: 6127881 - DNA, 19 bp, Homo sapiens
cgtgtgtagatagtatgca

SEQ ID NO: 6127882 - DNA, 15 bp, Homo sapiens
cgtgtgtatatttgt

SEQ ID NO: 6127883 - DNA, 21 bp, Homo sapiens
cgtgtgtatccgactctaagc

SEQ ID NO: 6127884 - DNA, 22 bp, Homo sapiens
cgtgtgtatccgactctaagct

SEQ ID NO: 6127885 - DNA, 23 bp, Homo sapiens
cgtgtgtatgtgtatgtgtgtga

SEQ ID NO: 6127886 - DNA, 15 bp, Homo sapiens
cgtgtgtcagggatg

SEQ ID NO: 6127887 - DNA, 17 bp, Homo sapiens
cgtgtgtcccagatgct

SEQ ID NO: 6127888 - DNA, 18 bp, Homo sapiens
cgtgtgtcccagatgctg

SEQ ID NO: 6127889 - DNA, 19 bp, Homo sapiens
cgtgtgtcccagatgctgt

SEQ ID NO: 6127890 - DNA, 16 bp, Homo sapiens
cgtgtgtccctgtggt

SEQ ID NO: 6127891 - DNA, 17 bp, Homo sapiens
cgtgtgtctcatgccag

SEQ ID NO: 6127892 - DNA, 20 bp, Homo sapiens
cgtgtgtctcatgccagcag

SEQ ID NO: 6127893 - DNA, 17 bp, Homo sapiens
cgtgtgtgacactgatg

SEQ ID NO: 6127894 - DNA, 13 bp, Homo sapiens
cgtgtgtgcatgt

SEQ ID NO: 6127895 - DNA, 23 bp, Homo sapiens
cgtgtgtgcgcccctccccaccc

SEQ ID NO: 6127896 - DNA, 18 bp, Homo sapiens
cgtgtgtgtatgctgtgt

SEQ ID NO: 6127897 - DNA, 20 bp, Homo sapiens
cgtgtgtgtgcgtcctgtcg

SEQ ID NO: 6127898 - DNA, 14 bp, Homo sapiens
cgtgtgtgtggccg

SEQ ID NO: 6127899 - DNA, 18 bp, Homo sapiens
cgtgtgttccccagctga

SEQ ID NO: 6127900 - DNA, 15 bp, Homo sapiens
cgtgtgttctctccg

SEQ ID NO: 6127901 - DNA, 17 bp, Homo sapiens
cgtgtgtttagaagcct

SEQ ID NO: 6127902 - DNA, 22 bp, Homo sapiens
cgtgttaattataaacagcagg

SEQ ID NO: 6127903 - DNA, 15 bp, Homo sapiens
cgtgttatgaatctg

SEQ ID NO: 6127904 - DNA, 22 bp, Homo sapiens
cgtgttatgaatctgtgctggc

SEQ ID NO: 6127905 - DNA, 14 bp, Homo sapiens
cgtgttattattat

SEQ ID NO: 6127906 - DNA, 17 bp, Homo sapiens
cgtgttcacaggctgct

SEQ ID NO: 6127907 - DNA, 13 bp, Homo sapiens
cgtgttcagcaga

SEQ ID NO: 6127908 - DNA, 22 bp, Homo sapiens
cgtgttcaggacacatctattg

SEQ ID NO: 6127909 - DNA, 17 bp, Homo sapiens
cgtgttccagtgtctgt

SEQ ID NO: 6127910 - DNA, 13 bp, Homo sapiens
cgtgttcccctct

SEQ ID NO: 6127911 - DNA, 18 bp, Homo sapiens
cgtgttccgcttctctct

SEQ ID NO: 6127912 - DNA, 12 bp, Homo sapiens
cgtgttcctttg

SEQ ID NO: 6127913 - DNA, 14 bp, Homo sapiens
cgtgttcgctggct

SEQ ID NO: 6127914 - DNA, 17 bp, Homo sapiens
cgtgttcgctggctgat

SEQ ID NO: 6127915 - DNA, 21 bp, Homo sapiens
cgtgttctgaaggtgcccagg

SEQ ID NO: 6127916 - DNA, 14 bp, Homo sapiens
cgtgttgagattac

SEQ ID NO: 6127917 - DNA, 22 bp, Homo sapiens
cgtgttgccttgaaccacttcc

SEQ ID NO: 6127918 - DNA, 22 bp, Homo sapiens
cgtgttgcttcaaactgagaca

SEQ ID NO: 6127919 - DNA, 15 bp, Homo sapiens
cgtgttgtatctaca

SEQ ID NO: 6127920 - DNA, 19 bp, Homo sapiens
cgtgttgtgttctttataa

SEQ ID NO: 6127921 - DNA, 20 bp, Homo sapiens
cgtgttgtgttctttataac

SEQ ID NO: 6127922 - DNA, 13 bp, Homo sapiens
cgtgtttacaaaa

SEQ ID NO: 6127923 - DNA, 22 bp, Homo sapiens
cgtgtttcctcatctatggttc

SEQ ID NO: 6127924 - DNA, 20 bp, Homo sapiens
cgtgtttctgactctgagct

SEQ ID NO: 6127925 - DNA, 11 bp, Homo sapiens
cgtgtttgcac

SEQ ID NO: 6127926 - DNA, 21 bp, Homo sapiens
cgtgtttgggtttttttcctt

SEQ ID NO: 6127927 - DNA, 16 bp, Homo sapiens
cgtgtttgtctcttct

SEQ ID NO: 6127928 - DNA, 18 bp, Homo sapiens
cgtgtttgtctcttctgg

SEQ ID NO: 6127929 - DNA, 12 bp, Homo sapiens
cgtgtttgtgtt

SEQ ID NO: 6127930 - DNA, 13 bp, Homo sapiens
cgtgttttcaagg

SEQ ID NO: 6127931 - DNA, 15 bp, Homo sapiens
cgttaaataagcaaa

SEQ ID NO: 6127932 - DNA, 22 bp, Homo sapiens
cgttaacattgaccaagaactg

SEQ ID NO: 6127933 - DNA, 20 bp, Homo sapiens
cgttaacctttttgtaaata

SEQ ID NO: 6127934 - DNA, 17 bp, Homo sapiens
cgttaactgtgtatgta

SEQ ID NO: 6127935 - DNA, 15 bp, Homo sapiens
cgttaagggcagagt

SEQ ID NO: 6127936 - DNA, 18 bp, Homo sapiens
cgttaatagattatttca

SEQ ID NO: 6127937 - DNA, 14 bp, Homo sapiens
cgttaattaaacaa

SEQ ID NO: 6127938 - DNA, 11 bp, Homo sapiens
cgttaatttaa

SEQ ID NO: 6127939 - DNA, 22 bp, Homo sapiens
cgttactcagggctcctcccag

SEQ ID NO: 6127940 - DNA, 14 bp, Homo sapiens
cgttactcccctgg

SEQ ID NO: 6127941 - DNA, 13 bp, Homo sapiens
cgttagctcctgt

SEQ ID NO: 6127942 - DNA, 20 bp, Homo sapiens
cgttagcttcctgcaggact

SEQ ID NO: 6127943 - DNA, 21 bp, Homo sapiens
cgttaggacaaggctgtgcca

SEQ ID NO: 6127944 - DNA, 18 bp, Homo sapiens
cgttaggaggacaaaagg

SEQ ID NO: 6127945 - DNA, 14 bp, Homo sapiens
cgttaggcatttcc

SEQ ID NO: 6127946 - DNA, 19 bp, Homo sapiens
cgttaggcatttcctgctg

SEQ ID NO: 6127947 - DNA, 17 bp, Homo sapiens
cgttaggccaggcctta

SEQ ID NO: 6127948 - DNA, 17 bp, Homo sapiens
cgttagggaagagaaac

SEQ ID NO: 6127949 - DNA, 16 bp, Homo sapiens
cgttagtaatctgtat

SEQ ID NO: 6127950 - DNA, 18 bp, Homo sapiens
cgttataaagtgtgccac

SEQ ID NO: 6127951 - DNA, 22 bp, Homo sapiens
cgttatatttgacttgaaaaga

SEQ ID NO: 6127952 - DNA, 22 bp, Homo sapiens
cgttatcacccaggcctgattc

SEQ ID NO: 6127953 - DNA, 21 bp, Homo sapiens
cgttatgtaagtttctaagaa

SEQ ID NO: 6127954 - DNA, 22 bp, Homo sapiens
cgttatgtgtgtatatgtatgt

SEQ ID NO: 6127955 - DNA, 14 bp, Homo sapiens
cgttattataaatg

SEQ ID NO: 6127956 - DNA, 20 bp, Homo sapiens
cgttattataaatgttagtt

SEQ ID NO: 6127957 - DNA, 15 bp, Homo sapiens
cgttattgttgactt

SEQ ID NO: 6127958 - DNA, 13 bp, Homo sapiens
cgttatttatgga

SEQ ID NO: 6127959 - DNA, 19 bp, Homo sapiens
cgttcaacttttcctttga

SEQ ID NO: 6127960 - DNA, 23 bp, Homo sapiens
cgttcaagacttgagcggagccc

SEQ ID NO: 6127961 - DNA, 20 bp, Homo sapiens
cgttcacccctccacccttg

SEQ ID NO: 6127962 - DNA, 22 bp, Homo sapiens
cgttcacctccaagcatttcat

SEQ ID NO: 6127963 - DNA, 23 bp, Homo sapiens
cgttcacctccaagcatttcatg

SEQ ID NO: 6127964 - DNA, 17 bp, Homo sapiens
cgttcacctccctgctc

SEQ ID NO: 6127965 - DNA, 21 bp, Homo sapiens
ctcctccagggtgattttatg

SEQ ID NO: 6127966 - DNA, 23 bp, Homo sapiens
ctcctccagtacaataaataaaa

SEQ ID NO: 6127967 - DNA, 20 bp, Homo sapiens
ctcctccagttctgatgagg

SEQ ID NO: 6127968 - DNA, 14 bp, Homo sapiens
ctcctccatcacct

SEQ ID NO: 6127969 - DNA, 16 bp, Homo sapiens
ctcctccatgcaggcc

SEQ ID NO: 6127970 - DNA, 13 bp, Homo sapiens
ctcctccatgctg

SEQ ID NO: 6127971 - DNA, 14 bp, Homo sapiens
ctcctccattcatg

SEQ ID NO: 6127972 - DNA, 13 bp, Homo sapiens
ctcctcccaaagt

SEQ ID NO: 6127973 - DNA, 18 bp, Homo sapiens
ctcctcccaactctggcc

SEQ ID NO: 6127974 - DNA, 13 bp, Homo sapiens
ctcctcccacaat

SEQ ID NO: 6127975 - DNA, 14 bp, Homo sapiens
ctcctcccacaatc

SEQ ID NO: 6127976 - DNA, 17 bp, Homo sapiens
ctcctcccacttctcaa

SEQ ID NO: 6127977 - DNA, 13 bp, Homo sapiens
ctcctcccagatg

SEQ ID NO: 6127978 - DNA, 11 bp, Homo sapiens
ctcctcccagc

SEQ ID NO: 6127979 - DNA, 18 bp, Homo sapiens
ctcctcccagcacaggca

SEQ ID NO: 6127980 - DNA, 14 bp, Homo sapiens
ctcctcccagccca

SEQ ID NO: 6127981 - DNA, 13 bp, Homo sapiens
ctcctcccagctg

SEQ ID NO: 6127982 - DNA, 14 bp, Homo sapiens
ctcctcccagcttg

SEQ ID NO: 6127983 - DNA, 12 bp, Homo sapiens
ctcctcccaggg

SEQ ID NO: 6127984 - DNA, 19 bp, Homo sapiens
ctcctcccagggcctcctg

SEQ ID NO: 6127985 - DNA, 14 bp, Homo sapiens
ctcctcccagggtt

SEQ ID NO: 6127986 - DNA, 13 bp, Homo sapiens
ctcctcccagtgc

SEQ ID NO: 6127987 - DNA, 15 bp, Homo sapiens
ctcctcccagtgcct

SEQ ID NO: 6127988 - DNA, 22 bp, Homo sapiens
ctcctcccatctccttccccca

SEQ ID NO: 6127989 - DNA, 14 bp, Homo sapiens
ctcctcccatggcc

SEQ ID NO: 6127990 - DNA, 19 bp, Homo sapiens
ctcctcccatgtcactgca

SEQ ID NO: 6127991 - DNA, 20 bp, Homo sapiens
ctcctcccatgtcactgcag

SEQ ID NO: 6127992 - DNA, 15 bp, Homo sapiens
ctcctcccatgttat

SEQ ID NO: 6127993 - DNA, 17 bp, Homo sapiens
ctcctccccaaatcaat

SEQ ID NO: 6127994 - DNA, 16 bp, Homo sapiens
ctcctccccacctgta

SEQ ID NO: 6127995 - DNA, 13 bp, Homo sapiens
ctcctccccagct

SEQ ID NO: 6127996 - DNA, 16 bp, Homo sapiens
ctcctcccccacccct

SEQ ID NO: 6127997 - DNA, 13 bp, Homo sapiens
ctcctcccccacg

SEQ ID NO: 6127998 - DNA, 15 bp, Homo sapiens
ctcctcccccacgcc

SEQ ID NO: 6127999 - DNA, 18 bp, Homo sapiens
ctcctcccccacgcctcc

SEQ ID NO: 6128000 - DNA, 21 bp, Homo sapiens
ctcctcccccacgcctccatc

SEQ ID NO: 6128001 - DNA, 23 bp, Homo sapiens
ctcctcccccggctgggcctcct

SEQ ID NO: 6128002 - DNA, 18 bp, Homo sapiens
ctcctccccctcctaggg

SEQ ID NO: 6128003 - DNA, 17 bp, Homo sapiens
ctcctccccctcctcca

SEQ ID NO: 6128004 - DNA, 14 bp, Homo sapiens
ctcctccccctttg

SEQ ID NO: 6128005 - DNA, 15 bp, Homo sapiens
ctcctccccctttgg

SEQ ID NO: 6128006 - DNA, 16 bp, Homo sapiens
ctcctccccctttggg

SEQ ID NO: 6128007 - DNA, 18 bp, Homo sapiens
ctcctccccctttggggt

SEQ ID NO: 6128008 - DNA, 21 bp, Homo sapiens
ctcctccccgctccgtctctg

SEQ ID NO: 6128009 - DNA, 22 bp, Homo sapiens
ctcctccccgctccgtctctgt

SEQ ID NO: 6128010 - DNA, 14 bp, Homo sapiens
ctcctcccctcctc

SEQ ID NO: 6128011 - DNA, 14 bp, Homo sapiens
ctcctcccctggag

SEQ ID NO: 6128012 - DNA, 17 bp, Homo sapiens
ctcctccccttcctctt

SEQ ID NO: 6128013 - DNA, 20 bp, Homo sapiens
ctcctccccttcctgtttct

SEQ ID NO: 6128014 - DNA, 15 bp, Homo sapiens
ctcctcccgaaaccc

SEQ ID NO: 6128015 - DNA, 16 bp, Homo sapiens
ctcctcccgaaaccca

SEQ ID NO: 6128016 - DNA, 17 bp, Homo sapiens
ctcctcccgactgacca

SEQ ID NO: 6128017 - DNA, 15 bp, Homo sapiens
ctcctcccgcccttc

SEQ ID NO: 6128018 - DNA, 17 bp, Homo sapiens
ctcctccctcagaccca

SEQ ID NO: 6128019 - DNA, 20 bp, Homo sapiens
ctcctccctcagacccagga

SEQ ID NO: 6128020 - DNA, 15 bp, Homo sapiens
ctcctccctcagact

SEQ ID NO: 6128021 - DNA, 22 bp, Homo sapiens
ctcctccctcagctctctggga

SEQ ID NO: 6128022 - DNA, 11 bp, Homo sapiens
ctcctccctcc

SEQ ID NO: 6128023 - DNA, 14 bp, Homo sapiens
ctcctccctcccag

SEQ ID NO: 6128024 - DNA, 16 bp, Homo sapiens
ctcctccctcccagct

SEQ ID NO: 6128025 - DNA, 21 bp, Homo sapiens
ctcctccctccctctgccggc

SEQ ID NO: 6128026 - DNA, 12 bp, Homo sapiens
ctcctccctcct

SEQ ID NO: 6128027 - DNA, 15 bp, Homo sapiens
ctcctccctctgagg

SEQ ID NO: 6128028 - DNA, 17 bp, Homo sapiens
ctcctccctctgcctca

SEQ ID NO: 6128029 - DNA, 10 bp, Homo sapiens
ctcctccctg

SEQ ID NO: 6128030 - DNA, 16 bp, Homo sapiens
ctcctccctgatgtac

SEQ ID NO: 6128031 - DNA, 14 bp, Homo sapiens
ctcctccctgcccc

SEQ ID NO: 6128032 - DNA, 16 bp, Homo sapiens
ctcctccctgcccccc

SEQ ID NO: 6128033 - DNA, 17 bp, Homo sapiens
ctcctccctgcccccca

SEQ ID NO: 6128034 - DNA, 19 bp, Homo sapiens
ctcctccctgccctcgggt

SEQ ID NO: 6128035 - DNA, 14 bp, Homo sapiens
ctcctccctgctcc

SEQ ID NO: 6128036 - DNA, 15 bp, Homo sapiens
ctcctccctggctgc

SEQ ID NO: 6128037 - DNA, 16 bp, Homo sapiens
ctcctccctggctgca

SEQ ID NO: 6128038 - DNA, 18 bp, Homo sapiens
ctcctccctggctgcagc

SEQ ID NO: 6128039 - DNA, 17 bp, Homo sapiens
ctcctccctggctgccc

SEQ ID NO: 6128040 - DNA, 21 bp, Homo sapiens
ctcctccctggctgccctggc

SEQ ID NO: 6128041 - DNA, 19 bp, Homo sapiens
ctcctccctgggggtgggg

SEQ ID NO: 6128042 - DNA, 17 bp, Homo sapiens
ctcctccctgtgccccc

SEQ ID NO: 6128043 - DNA, 21 bp, Homo sapiens
ctcctccctgtgcccccagcc

SEQ ID NO: 6128044 - DNA, 19 bp, Homo sapiens
ctcctccctgttattttca

SEQ ID NO: 6128045 - DNA, 22 bp, Homo sapiens
ctcctccctgttattttcaagt

SEQ ID NO: 6128046 - DNA, 14 bp, Homo sapiens
ctcctcccttcccc

SEQ ID NO: 6128047 - DNA, 15 bp, Homo sapiens
ctcctcccttccttt

SEQ ID NO: 6128048 - DNA, 16 bp, Homo sapiens
ctcctccgagacccag

SEQ ID NO: 6128049 - DNA, 22 bp, Homo sapiens
ctcctccgaggtggttttaaag

SEQ ID NO: 6128050 - DNA, 16 bp, Homo sapiens
ctcctccgcctgtgtc

SEQ ID NO: 6128051 - DNA, 18 bp, Homo sapiens
ctcctccgcctgtgtcca

SEQ ID NO: 6128052 - DNA, 22 bp, Homo sapiens
ctcctccgcctgtgtccatctg

SEQ ID NO: 6128053 - DNA, 13 bp, Homo sapiens
ctcctccgccttg

SEQ ID NO: 6128054 - DNA, 14 bp, Homo sapiens
ctcctccgccttgc

SEQ ID NO: 6128055 - DNA, 21 bp, Homo sapiens
ctcctccgtctgaccctctgc

SEQ ID NO: 6128056 - DNA, 20 bp, Homo sapiens
ctcctccgtgcttcctcagt

SEQ ID NO: 6128057 - DNA, 21 bp, Homo sapiens
ctcctcctaggaaaccagctc

SEQ ID NO: 6128058 - DNA, 14 bp, Homo sapiens
ctcctcctcaccca

SEQ ID NO: 6128059 - DNA, 13 bp, Homo sapiens
ctcctcctccagc

SEQ ID NO: 6128060 - DNA, 14 bp, Homo sapiens
ctcctcctcccctc

SEQ ID NO: 6128061 - DNA, 13 bp, Homo sapiens
ctcctcctccctg

SEQ ID NO: 6128062 - DNA, 15 bp, Homo sapiens
ctcctcctcctcctg

SEQ ID NO: 6128063 - DNA, 13 bp, Homo sapiens
ctcctcctcctgc

SEQ ID NO: 6128064 - DNA, 15 bp, Homo sapiens
ctcctcctcctgttc

SEQ ID NO: 6128065 - DNA, 12 bp, Homo sapiens
ctcctcctctca

SEQ ID NO: 6128066 - DNA, 13 bp, Homo sapiens
ctcctcctctgtg

SEQ ID NO: 6128067 - DNA, 13 bp, Homo sapiens
ctcctcctcttca

SEQ ID NO: 6128068 - DNA, 12 bp, Homo sapiens
ctcctcctgaag

SEQ ID NO: 6128069 - DNA, 10 bp, Homo sapiens
ctcctcctgc

SEQ ID NO: 6128070 - DNA, 12 bp, Homo sapiens
ctcctcctgcat

SEQ ID NO: 6128071 - DNA, 12 bp, Homo sapiens
ctcctcctgcca

SEQ ID NO: 6128072 - DNA, 15 bp, Homo sapiens
ctcctcctgccagct

SEQ ID NO: 6128073 - DNA, 13 bp, Homo sapiens
ctcctcctgccct

SEQ ID NO: 6128074 - DNA, 17 bp, Homo sapiens
ctcctcctgccctccgc

SEQ ID NO: 6128075 - DNA, 17 bp, Homo sapiens
ctcctcctgctgctcac

SEQ ID NO: 6128076 - DNA, 21 bp, Homo sapiens
ctcctcctgctgctcactccc

SEQ ID NO: 6128077 - DNA, 14 bp, Homo sapiens
ctcctcctggactc

SEQ ID NO: 6128078 - DNA, 20 bp, Homo sapiens
ctcctcctgggctccagagg

SEQ ID NO: 6128079 - DNA, 13 bp, Homo sapiens
ctcctcctggggg

SEQ ID NO: 6128080 - DNA, 17 bp, Homo sapiens
ctcctcctgggggctgg

SEQ ID NO: 6128081 - DNA, 12 bp, Homo sapiens
ctcctcctgtgt

SEQ ID NO: 6128082 - DNA, 20 bp, Homo sapiens
ctcctcctgttcctgccttc

SEQ ID NO: 6128083 - DNA, 15 bp, Homo sapiens
ctcctccttcccctg

SEQ ID NO: 6128084 - DNA, 14 bp, Homo sapiens
ctcctccttcctag

SEQ ID NO: 6128085 - DNA, 13 bp, Homo sapiens
ctcctccttgccc

SEQ ID NO: 6128086 - DNA, 14 bp, Homo sapiens
ctcctccttgcctg

SEQ ID NO: 6128087 - DNA, 11 bp, Homo sapiens
ctcctcctttc

SEQ ID NO: 6128088 - DNA, 20 bp, Homo sapiens
ctcctcctttgcctaggagg

SEQ ID NO: 6128089 - DNA, 15 bp, Homo sapiens
ctcctcgaacccact

SEQ ID NO: 6128090 - DNA, 17 bp, Homo sapiens
ctcctcgacatcactgt

SEQ ID NO: 6128091 - DNA, 21 bp, Homo sapiens
ctcctcgagatcccaacactg

SEQ ID NO: 6128092 - DNA, 14 bp, Homo sapiens
ctcctcgagccctc

SEQ ID NO: 6128093 - DNA, 17 bp, Homo sapiens
ctcctcgcaagctgggt

SEQ ID NO: 6128094 - DNA, 14 bp, Homo sapiens
ctcctcgcccccac

SEQ ID NO: 6128095 - DNA, 17 bp, Homo sapiens
ctcctcgcccccaccag

SEQ ID NO: 6128096 - DNA, 22 bp, Homo sapiens
ctcctcgcccccaccagtgtag

SEQ ID NO: 6128097 - DNA, 14 bp, Homo sapiens
ctcctcgctgtgcc

SEQ ID NO: 6128098 - DNA, 18 bp, Homo sapiens
ctcctcggacacccaggg

SEQ ID NO: 6128099 - DNA, 20 bp, Homo sapiens
ctcctcggccccctccatcg

SEQ ID NO: 6128100 - DNA, 16 bp, Homo sapiens
ctcctcggcctggctc

SEQ ID NO: 6128101 - DNA, 20 bp, Homo sapiens
ctcctcggctggctgtccac

SEQ ID NO: 6128102 - DNA, 21 bp, Homo sapiens
ctcctcggctggctgtccacc

SEQ ID NO: 6128103 - DNA, 22 bp, Homo sapiens
ctcctcggctggctgtccaccc

SEQ ID NO: 6128104 - DNA, 19 bp, Homo sapiens
ctcctcgggcaagggccgt

SEQ ID NO: 6128105 - DNA, 14 bp, Homo sapiens
ctcctcgggccctg

SEQ ID NO: 6128106 - DNA, 22 bp, Homo sapiens
ctcctcgggccctgtggtgctg

SEQ ID NO: 6128107 - DNA, 17 bp, Homo sapiens
ctcctcgggccgaggcc

SEQ ID NO: 6128108 - DNA, 17 bp, Homo sapiens
ctcctcggggctccagg

SEQ ID NO: 6128109 - DNA, 18 bp, Homo sapiens
ctcctcgggtggggcctg

SEQ ID NO: 6128110 - DNA, 16 bp, Homo sapiens
ctcctcggtggcattt

SEQ ID NO: 6128111 - DNA, 17 bp, Homo sapiens
ctcctcggttcaaggtc

SEQ ID NO: 6128112 - DNA, 15 bp, Homo sapiens
ctcctctacctctct

SEQ ID NO: 6128113 - DNA, 16 bp, Homo sapiens
ctcctctagccatccc

SEQ ID NO: 6128114 - DNA, 17 bp, Homo sapiens
ctcctctagctctggtg

SEQ ID NO: 6128115 - DNA, 15 bp, Homo sapiens
ctcctctaggccctg

SEQ ID NO: 6128116 - DNA, 16 bp, Homo sapiens
ctcctctaggccctgt

SEQ ID NO: 6128117 - DNA, 18 bp, Homo sapiens
ctcctctaggccctgtga

SEQ ID NO: 6128118 - DNA, 19 bp, Homo sapiens
ctcctctaggccctgtgag

SEQ ID NO: 6128119 - DNA, 20 bp, Homo sapiens
ctcctctaggccctgtgagc

SEQ ID NO: 6128120 - DNA, 17 bp, Homo sapiens
ctcctctatcctgggct

SEQ ID NO: 6128121 - DNA, 22 bp, Homo sapiens
ctcctctatcctgggcttttgt

SEQ ID NO: 6128122 - DNA, 21 bp, Homo sapiens
ctcctctcaaacctggcagat

SEQ ID NO: 6128123 - DNA, 18 bp, Homo sapiens
ctcctctcactccccagc

SEQ ID NO: 6128124 - DNA, 15 bp, Homo sapiens
ctcctctcagagtga

SEQ ID NO: 6128125 - DNA, 22 bp, Homo sapiens
ctcctctcagagtgacagtcat

SEQ ID NO: 6128126 - DNA, 19 bp, Homo sapiens
ctcctctcagcttctaatt

SEQ ID NO: 6128127 - DNA, 16 bp, Homo sapiens
ctcctctcaggctggg

SEQ ID NO: 6128128 - DNA, 14 bp, Homo sapiens
ctcctctcagtgtt

SEQ ID NO: 6128129 - DNA, 15 bp, Homo sapiens
ctcctctcagtgttt

SEQ ID NO: 6128130 - DNA, 15 bp, Homo sapiens
ctcctctccaccatc

SEQ ID NO: 6128131 - DNA, 11 bp, Homo sapiens
ctcctctccag

SEQ ID NO: 6128132 - DNA, 13 bp, Homo sapiens
ctcctctccagcc

SEQ ID NO: 6128133 - DNA, 12 bp, Homo sapiens
ctcctctccagg

SEQ ID NO: 6128134 - DNA, 15 bp, Homo sapiens
ctcctctccatgcaa

SEQ ID NO: 6128135 - DNA, 21 bp, Homo sapiens
ctcctctccatgcaagtgctg

SEQ ID NO: 6128136 - DNA, 10 bp, Homo sapiens
ctcctctccc

SEQ ID NO: 6128137 - DNA, 13 bp, Homo sapiens
ctcctctcccaaa

SEQ ID NO: 6128138 - DNA, 13 bp, Homo sapiens
ctcctctcccatc

SEQ ID NO: 6128139 - DNA, 21 bp, Homo sapiens
ctcctctcccatccccctgcc

SEQ ID NO: 6128140 - DNA, 23 bp, Homo sapiens
ctcctctcccatccccctgccct

SEQ ID NO: 6128141 - DNA, 18 bp, Homo sapiens
ctcctctcccatccttga

SEQ ID NO: 6128142 - DNA, 24 bp, Homo sapiens
ctcctctccccaatccatgcttca

SEQ ID NO: 6128143 - DNA, 13 bp, Homo sapiens
ctcctctccccag

SEQ ID NO: 6128144 - DNA, 22 bp, Homo sapiens
ctcctctccccagcaagtgaga

SEQ ID NO: 6128145 - DNA, 22 bp, Homo sapiens
ctcctctccccagcccagagac

SEQ ID NO: 6128146 - DNA, 14 bp, Homo sapiens
ctcctctcccccag

SEQ ID NO: 6128147 - DNA, 12 bp, Homo sapiens
ctcctctcccct

SEQ ID NO: 6128148 - DNA, 13 bp, Homo sapiens
cgttcacttcccc

SEQ ID NO: 6128149 - DNA, 12 bp, Homo sapiens
cgttcagcctgt

SEQ ID NO: 6128150 - DNA, 21 bp, Homo sapiens
cgttcatatgctctgctttta

SEQ ID NO: 6128151 - DNA, 15 bp, Homo sapiens
cgttcatcacctgct

SEQ ID NO: 6128152 - DNA, 13 bp, Homo sapiens
cgttcattgctct

SEQ ID NO: 6128153 - DNA, 17 bp, Homo sapiens
cgttccacagttgccac

SEQ ID NO: 6128154 - DNA, 20 bp, Homo sapiens
cgttccacagttgccaccac

SEQ ID NO: 6128155 - DNA, 11 bp, Homo sapiens
cgttccagccg

SEQ ID NO: 6128156 - DNA, 21 bp, Homo sapiens
cgttccagccggcatggctgg

SEQ ID NO: 6128157 - DNA, 13 bp, Homo sapiens
cgttccagttccc

SEQ ID NO: 6128158 - DNA, 12 bp, Homo sapiens
cgttcccaaaga

SEQ ID NO: 6128159 - DNA, 19 bp, Homo sapiens
cgttcccactgccctgggc

SEQ ID NO: 6128160 - DNA, 12 bp, Homo sapiens
cgttcccagcag

SEQ ID NO: 6128161 - DNA, 22 bp, Homo sapiens
cgttcccccaggggtgagcccc

SEQ ID NO: 6128162 - DNA, 18 bp, Homo sapiens
cgttccccttggcttcct

SEQ ID NO: 6128163 - DNA, 17 bp, Homo sapiens
cgttcccttctccccct

SEQ ID NO: 6128164 - DNA, 20 bp, Homo sapiens
cgttcccttgtgtctgttgc

SEQ ID NO: 6128165 - DNA, 18 bp, Homo sapiens
cgttccggttatgttgtg

SEQ ID NO: 6128166 - DNA, 15 bp, Homo sapiens
cgttcctcctcagcc

SEQ ID NO: 6128167 - DNA, 19 bp, Homo sapiens
cgttcctgacatcacagca

SEQ ID NO: 6128168 - DNA, 11 bp, Homo sapiens
cgttcctgcca

SEQ ID NO: 6128169 - DNA, 22 bp, Homo sapiens
cgttcctgccaggctctccctc

SEQ ID NO: 6128170 - DNA, 12 bp, Homo sapiens
cgttcctggcct

SEQ ID NO: 6128171 - DNA, 13 bp, Homo sapiens
cgttcctggcctt

SEQ ID NO: 6128172 - DNA, 18 bp, Homo sapiens
cgttcctgggactgtcag

SEQ ID NO: 6128173 - DNA, 19 bp, Homo sapiens
cgttcctgggactgtcaga

SEQ ID NO: 6128174 - DNA, 16 bp, Homo sapiens
cgttcctttcttttcc

SEQ ID NO: 6128175 - DNA, 23 bp, Homo sapiens
cgttcgaggcggtttccaggaag

SEQ ID NO: 6128176 - DNA, 14 bp, Homo sapiens
cgttcgatttctac

SEQ ID NO: 6128177 - DNA, 21 bp, Homo sapiens
cgttcgcagagcttttcagat

SEQ ID NO: 6128178 - DNA, 20 bp, Homo sapiens
cgttcgcctctggccctggg

SEQ ID NO: 6128179 - DNA, 13 bp, Homo sapiens
cgttcgcggcggt

SEQ ID NO: 6128180 - DNA, 14 bp, Homo sapiens
cgttctattgtgtg

SEQ ID NO: 6128181 - DNA, 12 bp, Homo sapiens
cgttctcaagaa

SEQ ID NO: 6128182 - DNA, 22 bp, Homo sapiens
cgttctcaagaatctagaagat

SEQ ID NO: 6128183 - DNA, 14 bp, Homo sapiens
cgttctcacaccca

SEQ ID NO: 6128184 - DNA, 16 bp, Homo sapiens
cgttctcacacccacc

SEQ ID NO: 6128185 - DNA, 15 bp, Homo sapiens
cgttctccagcccac

SEQ ID NO: 6128186 - DNA, 18 bp, Homo sapiens
cgttctccagcccacacc

SEQ ID NO: 6128187 - DNA, 20 bp, Homo sapiens
cgttctccagcccacacccc

SEQ ID NO: 6128188 - DNA, 12 bp, Homo sapiens
cgttctcccagc

SEQ ID NO: 6128189 - DNA, 21 bp, Homo sapiens
cgttctcccagcactgcctcc

SEQ ID NO: 6128190 - DNA, 22 bp, Homo sapiens
cgttctcccagcactgcctcct

SEQ ID NO: 6128191 - DNA, 13 bp, Homo sapiens
cgttctcctgctt

SEQ ID NO: 6128192 - DNA, 13 bp, Homo sapiens
cgttctccttccc

SEQ ID NO: 6128193 - DNA, 21 bp, Homo sapiens
cgttctcgtgacccagtggca

SEQ ID NO: 6128194 - DNA, 13 bp, Homo sapiens
cgttctctctttg

SEQ ID NO: 6128195 - DNA, 22 bp, Homo sapiens
cgttctctgccccgtttcttgc

SEQ ID NO: 6128196 - DNA, 22 bp, Homo sapiens
cgttctctgtccccaggtcctg

SEQ ID NO: 6128197 - DNA, 20 bp, Homo sapiens
cgttctctgtcctacttctg

SEQ ID NO: 6128198 - DNA, 13 bp, Homo sapiens
cgttctctttaaa

SEQ ID NO: 6128199 - DNA, 18 bp, Homo sapiens
cgttctctttaaaagctg

SEQ ID NO: 6128200 - DNA, 16 bp, Homo sapiens
cgttctgatatgtgaa

SEQ ID NO: 6128201 - DNA, 17 bp, Homo sapiens
cgttctgatttctgccc

SEQ ID NO: 6128202 - DNA, 12 bp, Homo sapiens
cgttctgctgcc

SEQ ID NO: 6128203 - DNA, 13 bp, Homo sapiens
cgttctgctggcc

SEQ ID NO: 6128204 - DNA, 18 bp, Homo sapiens
cgttctgctggcctggat

SEQ ID NO: 6128205 - DNA, 19 bp, Homo sapiens
cgttctggactctgcccca

SEQ ID NO: 6128206 - DNA, 23 bp, Homo sapiens
cgttctgggtcagcttgaatgtc

SEQ ID NO: 6128207 - DNA, 12 bp, Homo sapiens
cgttctgtgcac

SEQ ID NO: 6128208 - DNA, 22 bp, Homo sapiens
cgttctgttccaacctcctgct

SEQ ID NO: 6128209 - DNA, 16 bp, Homo sapiens
cgttcttacaagctta

SEQ ID NO: 6128210 - DNA, 21 bp, Homo sapiens
cgttcttatttaatctccatt

SEQ ID NO: 6128211 - DNA, 17 bp, Homo sapiens
cgttgacccctttcccc

SEQ ID NO: 6128212 - DNA, 16 bp, Homo sapiens
cgttgacgtgaccaat

SEQ ID NO: 6128213 - DNA, 20 bp, Homo sapiens
cgttgaggccgcatctttct

SEQ ID NO: 6128214 - DNA, 16 bp, Homo sapiens
cgttgagggaatgaca

SEQ ID NO: 6128215 - DNA, 15 bp, Homo sapiens
cgttgagtccttttg

SEQ ID NO: 6128216 - DNA, 15 bp, Homo sapiens
cgttgcacagctgtt

SEQ ID NO: 6128217 - DNA, 12 bp, Homo sapiens
cgttgcatgtcg

SEQ ID NO: 6128218 - DNA, 17 bp, Homo sapiens
cgttgccctaattcatc

SEQ ID NO: 6128219 - DNA, 19 bp, Homo sapiens
cgttgccctaattcatctt

SEQ ID NO: 6128220 - DNA, 17 bp, Homo sapiens
cgttgcctctctgccag

SEQ ID NO: 6128221 - DNA, 14 bp, Homo sapiens
cgttgctatttcca

SEQ ID NO: 6128222 - DNA, 14 bp, Homo sapiens
cgttgcttcccgct

SEQ ID NO: 6128223 - DNA, 19 bp, Homo sapiens
cgttgcttcccgctgcaca

SEQ ID NO: 6128224 - DNA, 20 bp, Homo sapiens
cgttgcttgaaattactgtg

SEQ ID NO: 6128225 - DNA, 14 bp, Homo sapiens
cgttgctttcactc

SEQ ID NO: 6128226 - DNA, 15 bp, Homo sapiens
cgttgctttttcact

SEQ ID NO: 6128227 - DNA, 14 bp, Homo sapiens
cgttggagactgaa

SEQ ID NO: 6128228 - DNA, 14 bp, Homo sapiens
cgttggagagcagc

SEQ ID NO: 6128229 - DNA, 20 bp, Homo sapiens
cgttggagtttgggctggag

SEQ ID NO: 6128230 - DNA, 14 bp, Homo sapiens
cgttggatttaaaa

SEQ ID NO: 6128231 - DNA, 19 bp, Homo sapiens
cgttggcttctccctgggg

SEQ ID NO: 6128232 - DNA, 17 bp, Homo sapiens
cgttgggagcctagctc

SEQ ID NO: 6128233 - DNA, 15 bp, Homo sapiens
cgttggtccagagcg

SEQ ID NO: 6128234 - DNA, 15 bp, Homo sapiens
cgttggttaaataaa

SEQ ID NO: 6128235 - DNA, 17 bp, Homo sapiens
cgttgtccctacaggag

SEQ ID NO: 6128236 - DNA, 18 bp, Homo sapiens
cgttgtctccctggccct

SEQ ID NO: 6128237 - DNA, 17 bp, Homo sapiens
cgttgtctgtggatggt

SEQ ID NO: 6128238 - DNA, 12 bp, Homo sapiens
cgttgtgagctg

SEQ ID NO: 6128239 - DNA, 14 bp, Homo sapiens
cgttgtgagctgga

SEQ ID NO: 6128240 - DNA, 16 bp, Homo sapiens
cgttgtgggcaggcta

SEQ ID NO: 6128241 - DNA, 14 bp, Homo sapiens
cgttgttgtcattg

SEQ ID NO: 6128242 - DNA, 15 bp, Homo sapiens
cgttgttgtccctgc

SEQ ID NO: 6128243 - DNA, 20 bp, Homo sapiens
cgttgtttacttaaagattt

SEQ ID NO: 6128244 - DNA, 18 bp, Homo sapiens
cgtttaaagtactgagca

SEQ ID NO: 6128245 - DNA, 21 bp, Homo sapiens
cgtttaaagtgcagtcatttg

SEQ ID NO: 6128246 - DNA, 17 bp, Homo sapiens
cgtttaaagttctgtgt

SEQ ID NO: 6128247 - DNA, 14 bp, Homo sapiens
cgtttaactgcagt

SEQ ID NO: 6128248 - DNA, 17 bp, Homo sapiens
cgtttaagccaaaacaa

SEQ ID NO: 6128249 - DNA, 18 bp, Homo sapiens
cgtttaagccaaaacaat

SEQ ID NO: 6128250 - DNA, 23 bp, Homo sapiens
cgtttaagcttaacatttcatgt

SEQ ID NO: 6128251 - DNA, 19 bp, Homo sapiens
cgtttaatcccagcacttt

SEQ ID NO: 6128252 - DNA, 19 bp, Homo sapiens
cgtttaatggtatctgtta

SEQ ID NO: 6128253 - DNA, 14 bp, Homo sapiens
cgtttaatgtttat

SEQ ID NO: 6128254 - DNA, 14 bp, Homo sapiens
cgtttaattttaag

SEQ ID NO: 6128255 - DNA, 14 bp, Homo sapiens
cgtttacagtgtat

SEQ ID NO: 6128256 - DNA, 15 bp, Homo sapiens
cgtttacctagaaga

SEQ ID NO: 6128257 - DNA, 17 bp, Homo sapiens
cgtttactatgcctgtg

SEQ ID NO: 6128258 - DNA, 20 bp, Homo sapiens
cgtttactatgcctgtgtct

SEQ ID NO: 6128259 - DNA, 15 bp, Homo sapiens
cgtttactcacagcc

SEQ ID NO: 6128260 - DNA, 23 bp, Homo sapiens
cgtttactttttaactggcttca

SEQ ID NO: 6128261 - DNA, 17 bp, Homo sapiens
cgtttagaatcagaata

SEQ ID NO: 6128262 - DNA, 15 bp, Homo sapiens
cgtttagaccaagga

SEQ ID NO: 6128263 - DNA, 21 bp, Homo sapiens
cgtttagaccaaggaacaaaa

SEQ ID NO: 6128264 - DNA, 14 bp, Homo sapiens
cgtttagtgccaat

SEQ ID NO: 6128265 - DNA, 18 bp, Homo sapiens
cgtttagtgccaatgttg

SEQ ID NO: 6128266 - DNA, 23 bp, Homo sapiens
cgtttagtgccaatgttgtgtgt

SEQ ID NO: 6128267 - DNA, 21 bp, Homo sapiens
cgtttatatttttttaactgt

SEQ ID NO: 6128268 - DNA, 16 bp, Homo sapiens
cgtttatgggccttgc

SEQ ID NO: 6128269 - DNA, 20 bp, Homo sapiens
cgtttattaatgcctctccc

SEQ ID NO: 6128270 - DNA, 13 bp, Homo sapiens
cgtttattgctta

SEQ ID NO: 6128271 - DNA, 14 bp, Homo sapiens
cgtttattttcaag

SEQ ID NO: 6128272 - DNA, 13 bp, Homo sapiens
cgtttcaaaaaca

SEQ ID NO: 6128273 - DNA, 18 bp, Homo sapiens
cgtttcacatctgtatat

SEQ ID NO: 6128274 - DNA, 14 bp, Homo sapiens
cgtttcattcattt

SEQ ID NO: 6128275 - DNA, 15 bp, Homo sapiens
cgtttccatcatgtc

SEQ ID NO: 6128276 - DNA, 18 bp, Homo sapiens
cgtttccccaataaagcc

SEQ ID NO: 6128277 - DNA, 20 bp, Homo sapiens
cgtttccccaataaagcctt

SEQ ID NO: 6128278 - DNA, 22 bp, Homo sapiens
cgtttccccaataaagcctttt

SEQ ID NO: 6128279 - DNA, 12 bp, Homo sapiens
cgtttcctaccg

SEQ ID NO: 6128280 - DNA, 20 bp, Homo sapiens
cgtttcctgagaagtgtcta

SEQ ID NO: 6128281 - DNA, 17 bp, Homo sapiens
cgtttccttacacattt

SEQ ID NO: 6128282 - DNA, 20 bp, Homo sapiens
cgtttctatgacacatgcaa

SEQ ID NO: 6128283 - DNA, 12 bp, Homo sapiens
cgtttctccttt

SEQ ID NO: 6128284 - DNA, 16 bp, Homo sapiens
cgtttctccttttcct

SEQ ID NO: 6128285 - DNA, 13 bp, Homo sapiens
cgtttcttccctg

SEQ ID NO: 6128286 - DNA, 13 bp, Homo sapiens
cgtttcttcctgc

SEQ ID NO: 6128287 - DNA, 11 bp, Homo sapiens
cgtttgaccaa

SEQ ID NO: 6128288 - DNA, 22 bp, Homo sapiens
cgtttgatttcttcctgcagag

SEQ ID NO: 6128289 - DNA, 15 bp, Homo sapiens
cgtttgcaccgcctg

SEQ ID NO: 6128290 - DNA, 20 bp, Homo sapiens
cgtttgcaccgcctgccctc

SEQ ID NO: 6128291 - DNA, 17 bp, Homo sapiens
cgtttgcctccagaacc

SEQ ID NO: 6128292 - DNA, 14 bp, Homo sapiens
cgtttgctgtgcca

SEQ ID NO: 6128293 - DNA, 22 bp, Homo sapiens
cgtttggaagatcctgtgagga

SEQ ID NO: 6128294 - DNA, 15 bp, Homo sapiens
cgtttggcatttctc

SEQ ID NO: 6128295 - DNA, 18 bp, Homo sapiens
cgtttggtcttaggtctt

SEQ ID NO: 6128296 - DNA, 22 bp, Homo sapiens
cgtttggtcttaggtcttcctg

SEQ ID NO: 6128297 - DNA, 18 bp, Homo sapiens
cgtttggtgcttctcaga

SEQ ID NO: 6128298 - DNA, 16 bp, Homo sapiens
cgtttggtgtctgatg

SEQ ID NO: 6128299 - DNA, 19 bp, Homo sapiens
cgtttggttaaagtatgtc

SEQ ID NO: 6128300 - DNA, 14 bp, Homo sapiens
cgtttgtacatggg

SEQ ID NO: 6128301 - DNA, 18 bp, Homo sapiens
cgtttgtgaacgctgtga

SEQ ID NO: 6128302 - DNA, 23 bp, Homo sapiens
cgtttgtgaacgctgtgatgctg

SEQ ID NO: 6128303 - DNA, 11 bp, Homo sapiens
cgtttgtgttc

SEQ ID NO: 6128304 - DNA, 19 bp, Homo sapiens
cgtttgtgttctgttttgt

SEQ ID NO: 6128305 - DNA, 19 bp, Homo sapiens
cgtttgtttgtttgtttaa

SEQ ID NO: 6128306 - DNA, 16 bp, Homo sapiens
cgtttgtttgttttgt

SEQ ID NO: 6128307 - DNA, 17 bp, Homo sapiens
cgtttgtttgttttgtt

SEQ ID NO: 6128308 - DNA, 12 bp, Homo sapiens
cgttttaagccc

SEQ ID NO: 6128309 - DNA, 23 bp, Homo sapiens
cgttttaaggactgactgaggca

SEQ ID NO: 6128310 - DNA, 13 bp, Homo sapiens
cgttttacagata

SEQ ID NO: 6128311 - DNA, 20 bp, Homo sapiens
cgttttaccaataaactgag

SEQ ID NO: 6128312 - DNA, 16 bp, Homo sapiens
cgttttagtgtctgac

SEQ ID NO: 6128313 - DNA, 20 bp, Homo sapiens
cgttttcatcctggcctcct

SEQ ID NO: 6128314 - DNA, 19 bp, Homo sapiens
cgttttccaaactgactca

SEQ ID NO: 6128315 - DNA, 14 bp, Homo sapiens
cgttttccccatga

SEQ ID NO: 6128316 - DNA, 17 bp, Homo sapiens
cgttttcctcatccttt

SEQ ID NO: 6128317 - DNA, 17 bp, Homo sapiens
cgttttctaattgctta

SEQ ID NO: 6128318 - DNA, 20 bp, Homo sapiens
cgttttctaattgcttattt

SEQ ID NO: 6128319 - DNA, 18 bp, Homo sapiens
cgttttctactttgaaat

SEQ ID NO: 6128320 - DNA, 21 bp, Homo sapiens
cgttttctcttccttgtgatt

SEQ ID NO: 6128321 - DNA, 15 bp, Homo sapiens
cgttttctgtttgga

SEQ ID NO: 6128322 - DNA, 14 bp, Homo sapiens
cgttttcttaaagt

SEQ ID NO: 6128323 - DNA, 15 bp, Homo sapiens
cgttttcttctttcc

SEQ ID NO: 6128324 - DNA, 21 bp, Homo sapiens
cgttttgaagacgtggactcc

SEQ ID NO: 6128325 - DNA, 14 bp, Homo sapiens
cgttttgcacattt

SEQ ID NO: 6128326 - DNA, 23 bp, Homo sapiens
cgttttgcctcatgaacactggc

SEQ ID NO: 6128327 - DNA, 15 bp, Homo sapiens
cgttttggaagctct

SEQ ID NO: 6128328 - DNA, 17 bp, Homo sapiens
cgttttgggtactttct

SEQ ID NO: 6128329 - DNA, 14 bp, Homo sapiens
ctcctctcccctct

SEQ ID NO: 6128330 - DNA, 15 bp, Homo sapiens
ctcctctcccctcta

SEQ ID NO: 6128331 - DNA, 19 bp, Homo sapiens
ctcctctcccgtctcgcct

SEQ ID NO: 6128332 - DNA, 12 bp, Homo sapiens
ctcctctccctg

SEQ ID NO: 6128333 - DNA, 15 bp, Homo sapiens
ctcctctccctgcac

SEQ ID NO: 6128334 - DNA, 19 bp, Homo sapiens
ctcctctcctcctcagctg

SEQ ID NO: 6128335 - DNA, 16 bp, Homo sapiens
ctcctctcctcctctg

SEQ ID NO: 6128336 - DNA, 21 bp, Homo sapiens
ctcctctcctcgtccggcctg

SEQ ID NO: 6128337 - DNA, 12 bp, Homo sapiens
ctcctctcctgg

SEQ ID NO: 6128338 - DNA, 15 bp, Homo sapiens
ctcctctcctggagg

SEQ ID NO: 6128339 - DNA, 16 bp, Homo sapiens
ctcctctcctggagga

SEQ ID NO: 6128340 - DNA, 9 bp, Homo sapiens
ctcctctct

SEQ ID NO: 6128341 - DNA, 18 bp, Homo sapiens
ctcctctctaacctcctt

SEQ ID NO: 6128342 - DNA, 19 bp, Homo sapiens
ctcctctctaacctccttt

SEQ ID NO: 6128343 - DNA, 17 bp, Homo sapiens
ctcctctctccctgcct

SEQ ID NO: 6128344 - DNA, 12 bp, Homo sapiens
ctcctctctctc

SEQ ID NO: 6128345 - DNA, 19 bp, Homo sapiens
ctcctctctctccctccac

SEQ ID NO: 6128346 - DNA, 23 bp, Homo sapiens
ctcctctctctttcctccaccca

SEQ ID NO: 6128347 - DNA, 14 bp, Homo sapiens
ctcctctctgagac

SEQ ID NO: 6128348 - DNA, 12 bp, Homo sapiens
ctcctctctgcc

SEQ ID NO: 6128349 - DNA, 15 bp, Homo sapiens
ctcctctctgccacc

SEQ ID NO: 6128350 - DNA, 19 bp, Homo sapiens
ctcctctctgccctaatgc

SEQ ID NO: 6128351 - DNA, 14 bp, Homo sapiens
ctcctctctgctgg

SEQ ID NO: 6128352 - DNA, 12 bp, Homo sapiens
ctcctctctggg

SEQ ID NO: 6128353 - DNA, 15 bp, Homo sapiens
ctcctctctgggcct

SEQ ID NO: 6128354 - DNA, 14 bp, Homo sapiens
ctcctctcttggca

SEQ ID NO: 6128355 - DNA, 14 bp, Homo sapiens
ctcctctgaaacag

SEQ ID NO: 6128356 - DNA, 15 bp, Homo sapiens
ctcctctgaaacagc

SEQ ID NO: 6128357 - DNA, 16 bp, Homo sapiens
ctcctctgaaacagct

SEQ ID NO: 6128358 - DNA, 20 bp, Homo sapiens
ctcctctgaaacagctgcct

SEQ ID NO: 6128359 - DNA, 23 bp, Homo sapiens
ctcctctgaaacagctgccttag

SEQ ID NO: 6128360 - DNA, 19 bp, Homo sapiens
ctcctctgactcagggctc

SEQ ID NO: 6128361 - DNA, 14 bp, Homo sapiens
ctcctctgaggaag

SEQ ID NO: 6128362 - DNA, 12 bp, Homo sapiens
ctcctctgcact

SEQ ID NO: 6128363 - DNA, 15 bp, Homo sapiens
ctcctctgcagcctg

SEQ ID NO: 6128364 - DNA, 16 bp, Homo sapiens
ctcctctgcagcctga

SEQ ID NO: 6128365 - DNA, 18 bp, Homo sapiens
ctcctctgcagcctgagc

SEQ ID NO: 6128366 - DNA, 17 bp, Homo sapiens
ctcctctgcagtgcctt

SEQ ID NO: 6128367 - DNA, 22 bp, Homo sapiens
ctcctctgcatcttgctctgtg

SEQ ID NO: 6128368 - DNA, 11 bp, Homo sapiens
ctcctctgcca

SEQ ID NO: 6128369 - DNA, 14 bp, Homo sapiens
ctcctctgccacct

SEQ ID NO: 6128370 - DNA, 17 bp, Homo sapiens
ctcctctgccacctccc

SEQ ID NO: 6128371 - DNA, 15 bp, Homo sapiens
ctcctctgccagcag

SEQ ID NO: 6128372 - DNA, 16 bp, Homo sapiens
ctcctctgccagcagg

SEQ ID NO: 6128373 - DNA, 11 bp, Homo sapiens
ctcctctgccc

SEQ ID NO: 6128374 - DNA, 12 bp, Homo sapiens
ctcctctgcccc

SEQ ID NO: 6128375 - DNA, 12 bp, Homo sapiens
ctcctctgccta

SEQ ID NO: 6128376 - DNA, 13 bp, Homo sapiens
ctcctctgcctac

SEQ ID NO: 6128377 - DNA, 20 bp, Homo sapiens
ctcctctgcctgtgcccgct

SEQ ID NO: 6128378 - DNA, 22 bp, Homo sapiens
ctcctctgcctgtgcccgctgc

SEQ ID NO: 6128379 - DNA, 12 bp, Homo sapiens
ctcctctgcctt

SEQ ID NO: 6128380 - DNA, 14 bp, Homo sapiens
ctcctctgccttgg

SEQ ID NO: 6128381 - DNA, 15 bp, Homo sapiens
ctcctctgccttgga

SEQ ID NO: 6128382 - DNA, 13 bp, Homo sapiens
ctcctctgctcca

SEQ ID NO: 6128383 - DNA, 21 bp, Homo sapiens
ctcctctgctccaacagacac

SEQ ID NO: 6128384 - DNA, 14 bp, Homo sapiens
ctcctctgctccac

SEQ ID NO: 6128385 - DNA, 12 bp, Homo sapiens
ctcctctgctga

SEQ ID NO: 6128386 - DNA, 15 bp, Homo sapiens
ctcctctgctgctcc

SEQ ID NO: 6128387 - DNA, 15 bp, Homo sapiens
ctcctctgctgctgg

SEQ ID NO: 6128388 - DNA, 14 bp, Homo sapiens
ctcctctgctggga

SEQ ID NO: 6128389 - DNA, 15 bp, Homo sapiens
ctcctctgcttgcca

SEQ ID NO: 6128390 - DNA, 21 bp, Homo sapiens
ctcctctggacggcaggctca

SEQ ID NO: 6128391 - DNA, 19 bp, Homo sapiens
ctcctctggcaggcttccc

SEQ ID NO: 6128392 - DNA, 21 bp, Homo sapiens
ctcctctggcaggcttccccc

SEQ ID NO: 6128393 - DNA, 22 bp, Homo sapiens
ctcctctggctttcccaggaga

SEQ ID NO: 6128394 - DNA, 15 bp, Homo sapiens
ctcctctgggcagga

SEQ ID NO: 6128395 - DNA, 13 bp, Homo sapiens
ctcctctgggcct

SEQ ID NO: 6128396 - DNA, 16 bp, Homo sapiens
ctcctctgggcctggg

SEQ ID NO: 6128397 - DNA, 11 bp, Homo sapiens
ctcctctgtcc

SEQ ID NO: 6128398 - DNA, 18 bp, Homo sapiens
ctcctctgtccagggccc

SEQ ID NO: 6128399 - DNA, 22 bp, Homo sapiens
ctcctctgtccccatagctggt

SEQ ID NO: 6128400 - DNA, 15 bp, Homo sapiens
ctcctctgtctctgc

SEQ ID NO: 6128401 - DNA, 19 bp, Homo sapiens
ctcctctgtctctgctctt

SEQ ID NO: 6128402 - DNA, 23 bp, Homo sapiens
ctcctctgtctctgctcttgcct

SEQ ID NO: 6128403 - DNA, 13 bp, Homo sapiens
ctcctctgtgaaa

SEQ ID NO: 6128404 - DNA, 18 bp, Homo sapiens
ctcctctgtgaagcattc

SEQ ID NO: 6128405 - DNA, 23 bp, Homo sapiens
ctcctctgtgaccaatgtcttga

SEQ ID NO: 6128406 - DNA, 12 bp, Homo sapiens
ctcctctgtgct

SEQ ID NO: 6128407 - DNA, 14 bp, Homo sapiens
ctcctctgtgctcc

SEQ ID NO: 6128408 - DNA, 13 bp, Homo sapiens
ctcctctgttcag

SEQ ID NO: 6128409 - DNA, 18 bp, Homo sapiens
ctcctctgttcagtcgca

SEQ ID NO: 6128410 - DNA, 12 bp, Homo sapiens
ctcctctgtttg

SEQ ID NO: 6128411 - DNA, 14 bp, Homo sapiens
ctcctctgtttgtt

SEQ ID NO: 6128412 - DNA, 20 bp, Homo sapiens
ctcctcttaaaaaataaaaa

SEQ ID NO: 6128413 - DNA, 21 bp, Homo sapiens
ctcctcttaccgtagcctccg

SEQ ID NO: 6128414 - DNA, 16 bp, Homo sapiens
ctcctcttcaccaggt

SEQ ID NO: 6128415 - DNA, 17 bp, Homo sapiens
ctcctcttcaccaggtg

SEQ ID NO: 6128416 - DNA, 23 bp, Homo sapiens
ctcctcttcaccaggtgcatgca

SEQ ID NO: 6128417 - DNA, 16 bp, Homo sapiens
ctcctcttccatgctg

SEQ ID NO: 6128418 - DNA, 16 bp, Homo sapiens
ctcctcttcccagagt

SEQ ID NO: 6128419 - DNA, 19 bp, Homo sapiens
ctcctcttcccccttccaa

SEQ ID NO: 6128420 - DNA, 17 bp, Homo sapiens
ctcctcttccgagctgc

SEQ ID NO: 6128421 - DNA, 14 bp, Homo sapiens
ctcctcttcctgcc

SEQ ID NO: 6128422 - DNA, 23 bp, Homo sapiens
ctcctcttcctgcctctctcatg

SEQ ID NO: 6128423 - DNA, 17 bp, Homo sapiens
ctcctcttctactcact

SEQ ID NO: 6128424 - DNA, 23 bp, Homo sapiens
ctcctcttctactcacttttccc

SEQ ID NO: 6128425 - DNA, 19 bp, Homo sapiens
ctcctcttctgacgtgcct

SEQ ID NO: 6128426 - DNA, 16 bp, Homo sapiens
ctcctcttgattcctg

SEQ ID NO: 6128427 - DNA, 16 bp, Homo sapiens
ctcctcttgccactgc

SEQ ID NO: 6128428 - DNA, 15 bp, Homo sapiens
ctcctcttgtagcca

SEQ ID NO: 6128429 - DNA, 15 bp, Homo sapiens
ctcctcttgttcctg

SEQ ID NO: 6128430 - DNA, 12 bp, Homo sapiens
ctcctctttaaa

SEQ ID NO: 6128431 - DNA, 14 bp, Homo sapiens
ctcctctttcccct

SEQ ID NO: 6128432 - DNA, 20 bp, Homo sapiens
ctcctctttcccctcctttg

SEQ ID NO: 6128433 - DNA, 12 bp, Homo sapiens
ctcctctttctc

SEQ ID NO: 6128434 - DNA, 14 bp, Homo sapiens
ctcctctttctctc

SEQ ID NO: 6128435 - DNA, 13 bp, Homo sapiens
ctcctctttgaga

SEQ ID NO: 6128436 - DNA, 20 bp, Homo sapiens
ctcctctttgagaccccagt

SEQ ID NO: 6128437 - DNA, 20 bp, Homo sapiens
ctcctctttgttttgtttta

SEQ ID NO: 6128438 - DNA, 15 bp, Homo sapiens
ctcctctttttctgt

SEQ ID NO: 6128439 - DNA, 21 bp, Homo sapiens
ctcctgaaaaaaaacctgaga

SEQ ID NO: 6128440 - DNA, 21 bp, Homo sapiens
ctcctgaaacccaaagccctg

SEQ ID NO: 6128441 - DNA, 11 bp, Homo sapiens
ctcctgaaatc

SEQ ID NO: 6128442 - DNA, 20 bp, Homo sapiens
ctcctgaaatcatatagaaa

SEQ ID NO: 6128443 - DNA, 21 bp, Homo sapiens
ctcctgaaatgccaagtgcct

SEQ ID NO: 6128444 - DNA, 21 bp, Homo sapiens
ctcctgaaccagtcctgctgc

SEQ ID NO: 6128445 - DNA, 22 bp, Homo sapiens
ctcctgaaccagtcctgctgcc

SEQ ID NO: 6128446 - DNA, 18 bp, Homo sapiens
ctcctgaaccgcacagct

SEQ ID NO: 6128447 - DNA, 19 bp, Homo sapiens
ctcctgaaccgcacagctc

SEQ ID NO: 6128448 - DNA, 23 bp, Homo sapiens
ctcctgaaccgcacagctcagga

SEQ ID NO: 6128449 - DNA, 20 bp, Homo sapiens
ctcctgaaggaggcggggct

SEQ ID NO: 6128450 - DNA, 17 bp, Homo sapiens
ctcctgaagggtgctca

SEQ ID NO: 6128451 - DNA, 20 bp, Homo sapiens
ctcctgaaggtttcctggtc

SEQ ID NO: 6128452 - DNA, 12 bp, Homo sapiens
ctcctgaataaa

SEQ ID NO: 6128453 - DNA, 21 bp, Homo sapiens
ctcctgaatctaacacatttc

SEQ ID NO: 6128454 - DNA, 21 bp, Homo sapiens
ctcctgaattcagttgctttg

SEQ ID NO: 6128455 - DNA, 20 bp, Homo sapiens
ctcctgacacacctgcagcc

SEQ ID NO: 6128456 - DNA, 22 bp, Homo sapiens
ctcctgacacccttctcccact

SEQ ID NO: 6128457 - DNA, 14 bp, Homo sapiens
ctcctgacactgct

SEQ ID NO: 6128458 - DNA, 15 bp, Homo sapiens
ctcctgacagccaca

SEQ ID NO: 6128459 - DNA, 17 bp, Homo sapiens
ctcctgacagccacacg

SEQ ID NO: 6128460 - DNA, 20 bp, Homo sapiens
ctcctgacatcaggtgatcc

SEQ ID NO: 6128461 - DNA, 12 bp, Homo sapiens
ctcctgaccaaa

SEQ ID NO: 6128462 - DNA, 22 bp, Homo sapiens
ctcctgaccagttgcagtcact

SEQ ID NO: 6128463 - DNA, 19 bp, Homo sapiens
ctcctgacccattgctgtt

SEQ ID NO: 6128464 - DNA, 13 bp, Homo sapiens
ctcctgaccccac

SEQ ID NO: 6128465 - DNA, 19 bp, Homo sapiens
ctcctgacccccatgtaaa

SEQ ID NO: 6128466 - DNA, 15 bp, Homo sapiens
ctcctgaccctccca

SEQ ID NO: 6128467 - DNA, 18 bp, Homo sapiens
ctcctgaccctcccactc

SEQ ID NO: 6128468 - DNA, 13 bp, Homo sapiens
ctcctgaccctgt

SEQ ID NO: 6128469 - DNA, 12 bp, Homo sapiens
ctcctgacctca

SEQ ID NO: 6128470 - DNA, 13 bp, Homo sapiens
ctcctgacctcag

SEQ ID NO: 6128471 - DNA, 14 bp, Homo sapiens
ctcctgacctcagg

SEQ ID NO: 6128472 - DNA, 16 bp, Homo sapiens
ctcctgacctcaggca

SEQ ID NO: 6128473 - DNA, 14 bp, Homo sapiens
ctcctgaccttagg

SEQ ID NO: 6128474 - DNA, 21 bp, Homo sapiens
ctcctgactcatccgcctggc

SEQ ID NO: 6128475 - DNA, 20 bp, Homo sapiens
ctcctgagaaaaaaggttcc

SEQ ID NO: 6128476 - DNA, 20 bp, Homo sapiens
ctcctgagaaggcgaggaga

SEQ ID NO: 6128477 - DNA, 21 bp, Homo sapiens
ctcctgagaaggcgaggagag

SEQ ID NO: 6128478 - DNA, 22 bp, Homo sapiens
ctcctgagaaggcgaggagagt

SEQ ID NO: 6128479 - DNA, 20 bp, Homo sapiens
ctcctgagacacatgggtgc

SEQ ID NO: 6128480 - DNA, 23 bp, Homo sapiens
ctcctgagacacatgggtgctat

SEQ ID NO: 6128481 - DNA, 21 bp, Homo sapiens
ctcctgagacccctggcctcc

SEQ ID NO: 6128482 - DNA, 23 bp, Homo sapiens
ctcctgagacccctggcctccgg

SEQ ID NO: 6128483 - DNA, 20 bp, Homo sapiens
ctcctgagaggtgctgcagg

SEQ ID NO: 6128484 - DNA, 11 bp, Homo sapiens
ctcctgagccc

SEQ ID NO: 6128485 - DNA, 19 bp, Homo sapiens
ctcctgagcccccagcttc

SEQ ID NO: 6128486 - DNA, 22 bp, Homo sapiens
ctcctgagcccccagcttccag

SEQ ID NO: 6128487 - DNA, 13 bp, Homo sapiens
ctcctgagcctca

SEQ ID NO: 6128488 - DNA, 16 bp, Homo sapiens
ctcctgagcctcacct

SEQ ID NO: 6128489 - DNA, 14 bp, Homo sapiens
ctcctgagcctgtc

SEQ ID NO: 6128490 - DNA, 15 bp, Homo sapiens
ctcctgagcctgtct

SEQ ID NO: 6128491 - DNA, 18 bp, Homo sapiens
ctcctgagcctgtgggtc

SEQ ID NO: 6128492 - DNA, 13 bp, Homo sapiens
ctcctgagctagg

SEQ ID NO: 6128493 - DNA, 11 bp, Homo sapiens
ctcctgagctc

SEQ ID NO: 6128494 - DNA, 15 bp, Homo sapiens
ctcctgagctcgggg

SEQ ID NO: 6128495 - DNA, 16 bp, Homo sapiens
ctcctgagctcgtgat

SEQ ID NO: 6128496 - DNA, 14 bp, Homo sapiens
ctcctgaggacagc

SEQ ID NO: 6128497 - DNA, 16 bp, Homo sapiens
ctcctgaggacagctg

SEQ ID NO: 6128498 - DNA, 19 bp, Homo sapiens
ctcctgaggacagctgtcc

SEQ ID NO: 6128499 - DNA, 14 bp, Homo sapiens
ctcctgaggagcag

SEQ ID NO: 6128500 - DNA, 19 bp, Homo sapiens
ctcctgaggagcagcccac

SEQ ID NO: 6128501 - DNA, 17 bp, Homo sapiens
ctcctgagggctccatg

SEQ ID NO: 6128502 - DNA, 21 bp, Homo sapiens
ctcctgaggggcatctgcccc

SEQ ID NO: 6128503 - DNA, 22 bp, Homo sapiens
ctcctgaggggcatctgcccct

SEQ ID NO: 6128504 - DNA, 17 bp, Homo sapiens
ctcctgaggtctggatt

SEQ ID NO: 6128505 - DNA, 16 bp, Homo sapiens
ctcctgagtagctggg

SEQ ID NO: 6128506 - DNA, 17 bp, Homo sapiens
ctcctgagtagctggga

SEQ ID NO: 6128507 - DNA, 18 bp, Homo sapiens
ctcctgagtagctgggac

SEQ ID NO: 6128508 - DNA, 20 bp, Homo sapiens
ctcctgagtagctgggacta

SEQ ID NO: 6128509 - DNA, 20 bp, Homo sapiens
ctcctgagtagctgggatta

SEQ ID NO: 6128510 - DNA, 12 bp, Homo sapiens
cgttttgtatag

SEQ ID NO: 6128511 - DNA, 18 bp, Homo sapiens
cgttttgtattgcttcct

SEQ ID NO: 6128512 - DNA, 21 bp, Homo sapiens
cgttttgtctgtgttgctgtt

SEQ ID NO: 6128513 - DNA, 14 bp, Homo sapiens
cgttttgtttgaaa

SEQ ID NO: 6128514 - DNA, 16 bp, Homo sapiens
cgtttttagctttgtg

SEQ ID NO: 6128515 - DNA, 21 bp, Homo sapiens
cgtttttatattacttttgta

SEQ ID NO: 6128516 - DNA, 13 bp, Homo sapiens
cgtttttcaagaa

SEQ ID NO: 6128517 - DNA, 13 bp, Homo sapiens
cgtttttccttta

SEQ ID NO: 6128518 - DNA, 19 bp, Homo sapiens
cgtttttcttcttgggccc

SEQ ID NO: 6128519 - DNA, 16 bp, Homo sapiens
cgtttttgctgcagag

SEQ ID NO: 6128520 - DNA, 16 bp, Homo sapiens
cgtttttggtggagtc

SEQ ID NO: 6128521 - DNA, 21 bp, Homo sapiens
cgtttttgtattttcatgaaa

SEQ ID NO: 6128522 - DNA, 13 bp, Homo sapiens
cgtttttgtgctg

SEQ ID NO: 6128523 - DNA, 18 bp, Homo sapiens
cgtttttgtgctgtgggc

SEQ ID NO: 6128524 - DNA, 16 bp, Homo sapiens
cgtttttgtttactgg

SEQ ID NO: 6128525 - DNA, 17 bp, Homo sapiens
cgttttttaaatgtata

SEQ ID NO: 6128526 - DNA, 20 bp, Homo sapiens
cgtttttttttttttattgt

SEQ ID NO: 6128527 - DNA, 16 bp, Homo sapiens
ctaaaaaaaaaaaagt

SEQ ID NO: 6128528 - DNA, 20 bp, Homo sapiens
ctaaaaaaaatgcatattaa

SEQ ID NO: 6128529 - DNA, 20 bp, Homo sapiens
ctaaaaaaataaaaatagaa

SEQ ID NO: 6128530 - DNA, 15 bp, Homo sapiens
ctaaaaaagatatat

SEQ ID NO: 6128531 - DNA, 20 bp, Homo sapiens
ctaaaaaagctgaatcagac

SEQ ID NO: 6128532 - DNA, 14 bp, Homo sapiens
ctaaaaacatttta

SEQ ID NO: 6128533 - DNA, 16 bp, Homo sapiens
ctaaaaacattttaaa

SEQ ID NO: 6128534 - DNA, 10 bp, Homo sapiens
ctaaaaagaa

SEQ ID NO: 6128535 - DNA, 21 bp, Homo sapiens
ctaaaaagaaggaaaatgatc

SEQ ID NO: 6128536 - DNA, 19 bp, Homo sapiens
ctaaaaagagactgtgcca

SEQ ID NO: 6128537 - DNA, 20 bp, Homo sapiens
ctaaaaagagactgtgccat

SEQ ID NO: 6128538 - DNA, 15 bp, Homo sapiens
ctaaaaagatgtaat

SEQ ID NO: 6128539 - DNA, 15 bp, Homo sapiens
ctaaaaagattagca

SEQ ID NO: 6128540 - DNA, 24 bp, Homo sapiens
ctaaaaagctatgtatcgctccta

SEQ ID NO: 6128541 - DNA, 16 bp, Homo sapiens
ctaaaaaggaagaaaa

SEQ ID NO: 6128542 - DNA, 18 bp, Homo sapiens
ctaaaaaggcccttagag

SEQ ID NO: 6128543 - DNA, 13 bp, Homo sapiens
ctaaaaagtacca

SEQ ID NO: 6128544 - DNA, 17 bp, Homo sapiens
ctaaaaagtataaaata

SEQ ID NO: 6128545 - DNA, 14 bp, Homo sapiens
ctaaaaataaaatg

SEQ ID NO: 6128546 - DNA, 20 bp, Homo sapiens
ctaaaaataaaatgcattta

SEQ ID NO: 6128547 - DNA, 14 bp, Homo sapiens
ctaaaaataaatta

SEQ ID NO: 6128548 - DNA, 23 bp, Homo sapiens
ctaaaaataactgtaattatttg

SEQ ID NO: 6128549 - DNA, 23 bp, Homo sapiens
ctaaaaataagaaattagccggg

SEQ ID NO: 6128550 - DNA, 11 bp, Homo sapiens
ctaaaaatata

SEQ ID NO: 6128551 - DNA, 23 bp, Homo sapiens
ctaaaaatatacatgtttatgta

SEQ ID NO: 6128552 - DNA, 22 bp, Homo sapiens
ctaaaaatattataacttaaaa

SEQ ID NO: 6128553 - DNA, 21 bp, Homo sapiens
ctaaaaatctgagaaactcta

SEQ ID NO: 6128554 - DNA, 12 bp, Homo sapiens
ctaaaaatgaag

SEQ ID NO: 6128555 - DNA, 23 bp, Homo sapiens
ctaaaaatgagcttgattaaatc

SEQ ID NO: 6128556 - DNA, 12 bp, Homo sapiens
ctaaaaatgcat

SEQ ID NO: 6128557 - DNA, 14 bp, Homo sapiens
ctaaaaattggtgt

SEQ ID NO: 6128558 - DNA, 14 bp, Homo sapiens
ctaaaaatttacaa

SEQ ID NO: 6128559 - DNA, 22 bp, Homo sapiens
ctaaaaatttttacaaaactgc

SEQ ID NO: 6128560 - DNA, 18 bp, Homo sapiens
ctaaaacaaaatctgaac

SEQ ID NO: 6128561 - DNA, 17 bp, Homo sapiens
ctaaaacaataaaattt

SEQ ID NO: 6128562 - DNA, 21 bp, Homo sapiens
ctaaaacagacaataatttaa

SEQ ID NO: 6128563 - DNA, 15 bp, Homo sapiens
ctaaaacagctattt

SEQ ID NO: 6128564 - DNA, 22 bp, Homo sapiens
ctaaaacatagactgaagattt

SEQ ID NO: 6128565 - DNA, 21 bp, Homo sapiens
ctaaaaccagttttgctgcta

SEQ ID NO: 6128566 - DNA, 11 bp, Homo sapiens
ctaaaaccatt

SEQ ID NO: 6128567 - DNA, 22 bp, Homo sapiens
ctaaaacctgagctagaagctg

SEQ ID NO: 6128568 - DNA, 23 bp, Homo sapiens
ctaaaaccttccatgtcaagatt

SEQ ID NO: 6128569 - DNA, 22 bp, Homo sapiens
ctaaaacgaatggtctttgctc

SEQ ID NO: 6128570 - DNA, 16 bp, Homo sapiens
ctaaaactactgcctt

SEQ ID NO: 6128571 - DNA, 19 bp, Homo sapiens
ctaaaactagataacttaa

SEQ ID NO: 6128572 - DNA, 22 bp, Homo sapiens
ctaaaactatggttcccaataa

SEQ ID NO: 6128573 - DNA, 15 bp, Homo sapiens
ctaaaactctgccag

SEQ ID NO: 6128574 - DNA, 22 bp, Homo sapiens
ctaaaactctgccagccctgca

SEQ ID NO: 6128575 - DNA, 17 bp, Homo sapiens
ctaaaactctttcggta

SEQ ID NO: 6128576 - DNA, 16 bp, Homo sapiens
ctaaaacttggatgga

SEQ ID NO: 6128577 - DNA, 15 bp, Homo sapiens
ctaaaagaaactatg

SEQ ID NO: 6128578 - DNA, 13 bp, Homo sapiens
ctaaaagaaactt

SEQ ID NO: 6128579 - DNA, 10 bp, Homo sapiens
ctaaaagaat

SEQ ID NO: 6128580 - DNA, 20 bp, Homo sapiens
ctaaaagaatattcagagaa

SEQ ID NO: 6128581 - DNA, 15 bp, Homo sapiens
ctaaaagaatttaaa

SEQ ID NO: 6128582 - DNA, 12 bp, Homo sapiens
ctaaaagacatg

SEQ ID NO: 6128583 - DNA, 17 bp, Homo sapiens
ctaaaagacatgcattt

SEQ ID NO: 6128584 - DNA, 14 bp, Homo sapiens
ctaaaagacatttg

SEQ ID NO: 6128585 - DNA, 17 bp, Homo sapiens
ctaaaagacatttgtta

SEQ ID NO: 6128586 - DNA, 19 bp, Homo sapiens
ctaaaagagatctgggcat

SEQ ID NO: 6128587 - DNA, 16 bp, Homo sapiens
ctaaaagatataagtg

SEQ ID NO: 6128588 - DNA, 21 bp, Homo sapiens
ctaaaagattctttaaactac

SEQ ID NO: 6128589 - DNA, 21 bp, Homo sapiens
ctaaaagattttgtgaaattt

SEQ ID NO: 6128590 - DNA, 15 bp, Homo sapiens
ctaaaagcaaatcta

SEQ ID NO: 6128591 - DNA, 12 bp, Homo sapiens
ctaaaagcacac

SEQ ID NO: 6128592 - DNA, 16 bp, Homo sapiens
ctaaaagcatgaattg

SEQ ID NO: 6128593 - DNA, 19 bp, Homo sapiens
ctaaaagcatgaattggaa

SEQ ID NO: 6128594 - DNA, 16 bp, Homo sapiens
ctaaaagcatgtatag

SEQ ID NO: 6128595 - DNA, 20 bp, Homo sapiens
ctaaaagcatgtatagttag

SEQ ID NO: 6128596 - DNA, 15 bp, Homo sapiens
ctaaaagccacccca

SEQ ID NO: 6128597 - DNA, 15 bp, Homo sapiens
ctaaaagctctgttc

SEQ ID NO: 6128598 - DNA, 23 bp, Homo sapiens
ctaaaaggcccagagagaagagc

SEQ ID NO: 6128599 - DNA, 17 bp, Homo sapiens
ctaaaaggcttccaggc

SEQ ID NO: 6128600 - DNA, 17 bp, Homo sapiens
ctaaaaggtttccacta

SEQ ID NO: 6128601 - DNA, 13 bp, Homo sapiens
ctaaaagtaaaca

SEQ ID NO: 6128602 - DNA, 18 bp, Homo sapiens
ctaaaagtgatgtgattt

SEQ ID NO: 6128603 - DNA, 22 bp, Homo sapiens
ctaaaagtgatgtgatttatgc

SEQ ID NO: 6128604 - DNA, 14 bp, Homo sapiens
ctaaaagtgcattt

SEQ ID NO: 6128605 - DNA, 17 bp, Homo sapiens
ctaaaagtgcatttaag

SEQ ID NO: 6128606 - DNA, 23 bp, Homo sapiens
ctaaaagtgcatttaaggagatt

SEQ ID NO: 6128607 - DNA, 19 bp, Homo sapiens
ctaaaagtggcatagagaa

SEQ ID NO: 6128608 - DNA, 20 bp, Homo sapiens
ctaaaagtggcatagagaat

SEQ ID NO: 6128609 - DNA, 19 bp, Homo sapiens
ctaaaagtgggcttgattc

SEQ ID NO: 6128610 - DNA, 12 bp, Homo sapiens
ctaaaagtgtca

SEQ ID NO: 6128611 - DNA, 23 bp, Homo sapiens
ctaaaagttcataacagtgccat

SEQ ID NO: 6128612 - DNA, 20 bp, Homo sapiens
ctaaaagtttagaacttgca

SEQ ID NO: 6128613 - DNA, 15 bp, Homo sapiens
ctaaaagtttgagga

SEQ ID NO: 6128614 - DNA, 18 bp, Homo sapiens
ctaaaataaaaaccagaa

SEQ ID NO: 6128615 - DNA, 14 bp, Homo sapiens
ctaaaataaatgtt

SEQ ID NO: 6128616 - DNA, 17 bp, Homo sapiens
ctaaaataaatgttttg

SEQ ID NO: 6128617 - DNA, 14 bp, Homo sapiens
ctaaaatacattta

SEQ ID NO: 6128618 - DNA, 22 bp, Homo sapiens
ctaaaatactattggagagaaa

SEQ ID NO: 6128619 - DNA, 21 bp, Homo sapiens
ctaaaatactcaccaaaatat

SEQ ID NO: 6128620 - DNA, 18 bp, Homo sapiens
ctaaaatagaatatagca

SEQ ID NO: 6128621 - DNA, 23 bp, Homo sapiens
ctaaaatagaatatagcatcttt

SEQ ID NO: 6128622 - DNA, 18 bp, Homo sapiens
ctaaaatagatcctaggt

SEQ ID NO: 6128623 - DNA, 20 bp, Homo sapiens
ctaaaatagtttaaaaatat

SEQ ID NO: 6128624 - DNA, 21 bp, Homo sapiens
ctaaaatagtttaaaaatatt

SEQ ID NO: 6128625 - DNA, 18 bp, Homo sapiens
ctaaaatatataatttat

SEQ ID NO: 6128626 - DNA, 15 bp, Homo sapiens
ctaaaatatttattt

SEQ ID NO: 6128627 - DNA, 16 bp, Homo sapiens
ctaaaatattttagat

SEQ ID NO: 6128628 - DNA, 19 bp, Homo sapiens
ctaaaatattttagatgtt

SEQ ID NO: 6128629 - DNA, 21 bp, Homo sapiens
ctaaaatcaagtgcacctaca

SEQ ID NO: 6128630 - DNA, 13 bp, Homo sapiens
ctaaaatcatgaa

SEQ ID NO: 6128631 - DNA, 12 bp, Homo sapiens
ctaaaatcgtat

SEQ ID NO: 6128632 - DNA, 18 bp, Homo sapiens
ctaaaatcgtattctaat

SEQ ID NO: 6128633 - DNA, 15 bp, Homo sapiens
ctaaaatctgcttgt

SEQ ID NO: 6128634 - DNA, 22 bp, Homo sapiens
ctaaaatcttatagttctaggc

SEQ ID NO: 6128635 - DNA, 22 bp, Homo sapiens
ctaaaatgaggatccagggcag

SEQ ID NO: 6128636 - DNA, 14 bp, Homo sapiens
ctaaaatgatttta

SEQ ID NO: 6128637 - DNA, 15 bp, Homo sapiens
ctaaaatgctgttct

SEQ ID NO: 6128638 - DNA, 17 bp, Homo sapiens
ctaaaatgctgttctca

SEQ ID NO: 6128639 - DNA, 19 bp, Homo sapiens
ctaaaatgctgttctcaat

SEQ ID NO: 6128640 - DNA, 16 bp, Homo sapiens
ctaaaatggacatttt

SEQ ID NO: 6128641 - DNA, 18 bp, Homo sapiens
ctaaaatggacattttct

SEQ ID NO: 6128642 - DNA, 21 bp, Homo sapiens
ctaaaatggactgtggtgact

SEQ ID NO: 6128643 - DNA, 20 bp, Homo sapiens
ctaaaatggcgaacatgtgt

SEQ ID NO: 6128644 - DNA, 19 bp, Homo sapiens
ctaaaatgtgatgttctaa

SEQ ID NO: 6128645 - DNA, 23 bp, Homo sapiens
ctaaaatgttctccttagatgtg

SEQ ID NO: 6128646 - DNA, 17 bp, Homo sapiens
ctaaaatgttttatgac

SEQ ID NO: 6128647 - DNA, 14 bp, Homo sapiens
ctaaaatgttttca

SEQ ID NO: 6128648 - DNA, 22 bp, Homo sapiens
ctaaaattaaaaagaaaatatt

SEQ ID NO: 6128649 - DNA, 17 bp, Homo sapiens
ctaaaattactattctt

SEQ ID NO: 6128650 - DNA, 18 bp, Homo sapiens
ctaaaattaggactgtat

SEQ ID NO: 6128651 - DNA, 15 bp, Homo sapiens
ctaaaattatgttac

SEQ ID NO: 6128652 - DNA, 16 bp, Homo sapiens
ctaaaattatgttact

SEQ ID NO: 6128653 - DNA, 19 bp, Homo sapiens
ctaaaattcaacaaatgat

SEQ ID NO: 6128654 - DNA, 22 bp, Homo sapiens
ctaaaattgtatgaaaatcctt

SEQ ID NO: 6128655 - DNA, 14 bp, Homo sapiens
ctaaaatttaaaat

SEQ ID NO: 6128656 - DNA, 20 bp, Homo sapiens
ctaaaatttcataattctga

SEQ ID NO: 6128657 - DNA, 21 bp, Homo sapiens
ctaaaatttgtgggttttttt

SEQ ID NO: 6128658 - DNA, 13 bp, Homo sapiens
ctaaaattttcta

SEQ ID NO: 6128659 - DNA, 18 bp, Homo sapiens
ctaaacaaaattgcaatt

SEQ ID NO: 6128660 - DNA, 21 bp, Homo sapiens
ctaaacaagaatcagtctatc

SEQ ID NO: 6128661 - DNA, 17 bp, Homo sapiens
ctaaacaaggtaatttt

SEQ ID NO: 6128662 - DNA, 19 bp, Homo sapiens
ctaaacaatgctgatttgg

SEQ ID NO: 6128663 - DNA, 13 bp, Homo sapiens
ctaaacacacttt

SEQ ID NO: 6128664 - DNA, 16 bp, Homo sapiens
ctaaacactgcgcttt

SEQ ID NO: 6128665 - DNA, 14 bp, Homo sapiens
ctaaacagctgctt

SEQ ID NO: 6128666 - DNA, 24 bp, Homo sapiens
ctaaacataattgtggattataaa

SEQ ID NO: 6128667 - DNA, 21 bp, Homo sapiens
ctaaacatagtggtattttaa

SEQ ID NO: 6128668 - DNA, 12 bp, Homo sapiens
ctaaacatccat

SEQ ID NO: 6128669 - DNA, 13 bp, Homo sapiens
ctaaacattgtga

SEQ ID NO: 6128670 - DNA, 21 bp, Homo sapiens
ctaaacatttcctttttctat

SEQ ID NO: 6128671 - DNA, 12 bp, Homo sapiens
ctaaacattttt

SEQ ID NO: 6128672 - DNA, 14 bp, Homo sapiens
ctaaaccaaaaatt

SEQ ID NO: 6128673 - DNA, 13 bp, Homo sapiens
ctaaaccaaaaca

SEQ ID NO: 6128674 - DNA, 17 bp, Homo sapiens
ctaaaccaaggactgag

SEQ ID NO: 6128675 - DNA, 19 bp, Homo sapiens
ctaaaccaaggactgagca

SEQ ID NO: 6128676 - DNA, 23 bp, Homo sapiens
ctaaaccaaggactgagcaccct

SEQ ID NO: 6128677 - DNA, 19 bp, Homo sapiens
ctaaaccatctatgtgaat

SEQ ID NO: 6128678 - DNA, 18 bp, Homo sapiens
ctaaaccatggcacttga

SEQ ID NO: 6128679 - DNA, 19 bp, Homo sapiens
ctaaacccaaataaatgtg

SEQ ID NO: 6128680 - DNA, 16 bp, Homo sapiens
ctaaacccctgtccca

SEQ ID NO: 6128681 - DNA, 14 bp, Homo sapiens
ctaaacctatctgt

SEQ ID NO: 6128682 - DNA, 16 bp, Homo sapiens
ctaaacctatctgtat

SEQ ID NO: 6128683 - DNA, 12 bp, Homo sapiens
ctaaacctcagt

SEQ ID NO: 6128684 - DNA, 14 bp, Homo sapiens
ctaaacctgtgcct

SEQ ID NO: 6128685 - DNA, 17 bp, Homo sapiens
ctaaaccttagtactga

SEQ ID NO: 6128686 - DNA, 21 bp, Homo sapiens
ctaaacgactccgagaacaac

SEQ ID NO: 6128687 - DNA, 16 bp, Homo sapiens
ctaaacggattccaaa

SEQ ID NO: 6128688 - DNA, 22 bp, Homo sapiens
ctcctgagtagctgggattaca

SEQ ID NO: 6128689 - DNA, 23 bp, Homo sapiens
ctcctgagtagctgggcctgtgc

SEQ ID NO: 6128690 - DNA, 24 bp, Homo sapiens
ctcctgagtagctgggcctgtgca

SEQ ID NO: 6128691 - DNA, 23 bp, Homo sapiens
ctcctgagtatgtaacttgcaat

SEQ ID NO: 6128692 - DNA, 22 bp, Homo sapiens
ctcctgagtgccccacttctgg

SEQ ID NO: 6128693 - DNA, 23 bp, Homo sapiens
ctcctgagtgccccacttctggc

SEQ ID NO: 6128694 - DNA, 16 bp, Homo sapiens
ctcctgagtgcttgct

SEQ ID NO: 6128695 - DNA, 22 bp, Homo sapiens
ctcctgagtggaatcaagttct

SEQ ID NO: 6128696 - DNA, 20 bp, Homo sapiens
ctcctgagttgtataaaagt

SEQ ID NO: 6128697 - DNA, 21 bp, Homo sapiens
ctcctgatcagaggcatttga

SEQ ID NO: 6128698 - DNA, 23 bp, Homo sapiens
ctcctgatggtgtcattctgcct

SEQ ID NO: 6128699 - DNA, 14 bp, Homo sapiens
ctcctgattctctt

SEQ ID NO: 6128700 - DNA, 17 bp, Homo sapiens
ctcctgatttctctgaa

SEQ ID NO: 6128701 - DNA, 19 bp, Homo sapiens
ctcctgatttctctgaaca

SEQ ID NO: 6128702 - DNA, 14 bp, Homo sapiens
ctcctgatttttct

SEQ ID NO: 6128703 - DNA, 14 bp, Homo sapiens
ctcctgcaaagtct

SEQ ID NO: 6128704 - DNA, 22 bp, Homo sapiens
ctcctgcacacagaatgctcag

SEQ ID NO: 6128705 - DNA, 23 bp, Homo sapiens
ctcctgcacacagaatgctcagg

SEQ ID NO: 6128706 - DNA, 17 bp, Homo sapiens
ctcctgcacacagggca

SEQ ID NO: 6128707 - DNA, 21 bp, Homo sapiens
ctcctgcacgcggactccggg

SEQ ID NO: 6128708 - DNA, 14 bp, Homo sapiens
ctcctgcactgttt

SEQ ID NO: 6128709 - DNA, 15 bp, Homo sapiens
ctcctgcactgttta

SEQ ID NO: 6128710 - DNA, 15 bp, Homo sapiens
ctcctgcacttactt

SEQ ID NO: 6128711 - DNA, 18 bp, Homo sapiens
ctcctgcacttacttgct

SEQ ID NO: 6128712 - DNA, 20 bp, Homo sapiens
ctcctgcacttacttgctta

SEQ ID NO: 6128713 - DNA, 20 bp, Homo sapiens
ctcctgcagcactttttcct

SEQ ID NO: 6128714 - DNA, 14 bp, Homo sapiens
ctcctgcagcatgg

SEQ ID NO: 6128715 - DNA, 23 bp, Homo sapiens
ctcctgcagcctgaccccaggca

SEQ ID NO: 6128716 - DNA, 12 bp, Homo sapiens
ctcctgcaggca

SEQ ID NO: 6128717 - DNA, 14 bp, Homo sapiens
ctcctgcaggctgg

SEQ ID NO: 6128718 - DNA, 17 bp, Homo sapiens
ctcctgcaggctggctg

SEQ ID NO: 6128719 - DNA, 19 bp, Homo sapiens
ctcctgcagggagccttct

SEQ ID NO: 6128720 - DNA, 15 bp, Homo sapiens
ctcctgcagtctgtg

SEQ ID NO: 6128721 - DNA, 17 bp, Homo sapiens
ctcctgcagtttgggag

SEQ ID NO: 6128722 - DNA, 18 bp, Homo sapiens
ctcctgcagtttgggaga

SEQ ID NO: 6128723 - DNA, 23 bp, Homo sapiens
ctcctgcagtttgggagacatgg

SEQ ID NO: 6128724 - DNA, 17 bp, Homo sapiens
ctcctgcatagcttttc

SEQ ID NO: 6128725 - DNA, 14 bp, Homo sapiens
ctcctgccaccagc

SEQ ID NO: 6128726 - DNA, 14 bp, Homo sapiens
ctcctgccagcccg

SEQ ID NO: 6128727 - DNA, 22 bp, Homo sapiens
ctcctgccagcccggctcggcc

SEQ ID NO: 6128728 - DNA, 21 bp, Homo sapiens
ctcctgccaggcacacacagc

SEQ ID NO: 6128729 - DNA, 13 bp, Homo sapiens
ctcctgccaggga

SEQ ID NO: 6128730 - DNA, 15 bp, Homo sapiens
ctcctgcccacgtgc

SEQ ID NO: 6128731 - DNA, 24 bp, Homo sapiens
ctcctgcccacgtgcagcacctgt

SEQ ID NO: 6128732 - DNA, 13 bp, Homo sapiens
ctcctgcccagat

SEQ ID NO: 6128733 - DNA, 14 bp, Homo sapiens
ctcctgcccagcca

SEQ ID NO: 6128734 - DNA, 15 bp, Homo sapiens
ctcctgcccagccac

SEQ ID NO: 6128735 - DNA, 17 bp, Homo sapiens
ctcctgcccagctcctc

SEQ ID NO: 6128736 - DNA, 16 bp, Homo sapiens
ctcctgcccagctctg

SEQ ID NO: 6128737 - DNA, 12 bp, Homo sapiens
ctcctgcccagg

SEQ ID NO: 6128738 - DNA, 14 bp, Homo sapiens
ctcctgcccaggac

SEQ ID NO: 6128739 - DNA, 16 bp, Homo sapiens
ctcctgcccaggagag

SEQ ID NO: 6128740 - DNA, 18 bp, Homo sapiens
ctcctgcccaggagcagc

SEQ ID NO: 6128741 - DNA, 14 bp, Homo sapiens
ctcctgcccaggcc

SEQ ID NO: 6128742 - DNA, 18 bp, Homo sapiens
ctcctgcccaggccacag

SEQ ID NO: 6128743 - DNA, 15 bp, Homo sapiens
ctcctgcccccacac

SEQ ID NO: 6128744 - DNA, 16 bp, Homo sapiens
ctcctgcccccacccc

SEQ ID NO: 6128745 - DNA, 23 bp, Homo sapiens
ctcctgcccccaccccaggctgg

SEQ ID NO: 6128746 - DNA, 19 bp, Homo sapiens
ctcctgcccccccacccca

SEQ ID NO: 6128747 - DNA, 17 bp, Homo sapiens
ctcctgccccctgccag

SEQ ID NO: 6128748 - DNA, 18 bp, Homo sapiens
ctcctgccccctgccagt

SEQ ID NO: 6128749 - DNA, 20 bp, Homo sapiens
ctcctgccccggcccaacct

SEQ ID NO: 6128750 - DNA, 14 bp, Homo sapiens
ctcctgcccctttc

SEQ ID NO: 6128751 - DNA, 22 bp, Homo sapiens
ctcctgcccgcagacctctgga

SEQ ID NO: 6128752 - DNA, 21 bp, Homo sapiens
ctcctgcccgccctccctcct

SEQ ID NO: 6128753 - DNA, 12 bp, Homo sapiens
ctcctgccctcc

SEQ ID NO: 6128754 - DNA, 14 bp, Homo sapiens
ctcctgccctccgc

SEQ ID NO: 6128755 - DNA, 23 bp, Homo sapiens
ctcctgccctccgccccgtcccc

SEQ ID NO: 6128756 - DNA, 13 bp, Homo sapiens
ctcctgccctcct

SEQ ID NO: 6128757 - DNA, 14 bp, Homo sapiens
ctcctgccctctgc

SEQ ID NO: 6128758 - DNA, 15 bp, Homo sapiens
ctcctgccctctgct

SEQ ID NO: 6128759 - DNA, 17 bp, Homo sapiens
ctcctgccctctgctct

SEQ ID NO: 6128760 - DNA, 19 bp, Homo sapiens
ctcctgccctctgctctgc

SEQ ID NO: 6128761 - DNA, 15 bp, Homo sapiens
ctcctgccctgtgat

SEQ ID NO: 6128762 - DNA, 11 bp, Homo sapiens
ctcctgccctt

SEQ ID NO: 6128763 - DNA, 17 bp, Homo sapiens
ctcctgccgactcctgg

SEQ ID NO: 6128764 - DNA, 17 bp, Homo sapiens
ctcctgccgcagagctg

SEQ ID NO: 6128765 - DNA, 17 bp, Homo sapiens
ctcctgccgctcctctc

SEQ ID NO: 6128766 - DNA, 19 bp, Homo sapiens
ctcctgcctacattccctg

SEQ ID NO: 6128767 - DNA, 16 bp, Homo sapiens
ctcctgcctactcacg

SEQ ID NO: 6128768 - DNA, 12 bp, Homo sapiens
ctcctgcctcag

SEQ ID NO: 6128769 - DNA, 14 bp, Homo sapiens
ctcctgcctcagcc

SEQ ID NO: 6128770 - DNA, 16 bp, Homo sapiens
ctcctgcctcagcctc

SEQ ID NO: 6128771 - DNA, 17 bp, Homo sapiens
ctcctgcctcagcctcc

SEQ ID NO: 6128772 - DNA, 20 bp, Homo sapiens
ctcctgcctcagcctcctga

SEQ ID NO: 6128773 - DNA, 23 bp, Homo sapiens
ctcctgcctcagcctcctgaaca

SEQ ID NO: 6128774 - DNA, 21 bp, Homo sapiens
ctcctgcctcagccttccaag

SEQ ID NO: 6128775 - DNA, 16 bp, Homo sapiens
ctcctgcctccgggca

SEQ ID NO: 6128776 - DNA, 19 bp, Homo sapiens
ctcctgcctccgggcaggc

SEQ ID NO: 6128777 - DNA, 21 bp, Homo sapiens
ctcctgcctcgaactggctgc

SEQ ID NO: 6128778 - DNA, 15 bp, Homo sapiens
ctcctgcctctactg

SEQ ID NO: 6128779 - DNA, 17 bp, Homo sapiens
ctcctgcctgcccctct

SEQ ID NO: 6128780 - DNA, 12 bp, Homo sapiens
ctcctgcctggg

SEQ ID NO: 6128781 - DNA, 16 bp, Homo sapiens
ctcctgcctggggtgg

SEQ ID NO: 6128782 - DNA, 18 bp, Homo sapiens
ctcctgcctgtgctgtga

SEQ ID NO: 6128783 - DNA, 16 bp, Homo sapiens
ctcctgccttcctcct

SEQ ID NO: 6128784 - DNA, 18 bp, Homo sapiens
ctcctgccttcctcctgg

SEQ ID NO: 6128785 - DNA, 19 bp, Homo sapiens
ctcctgccttcctcctggg

SEQ ID NO: 6128786 - DNA, 22 bp, Homo sapiens
ctcctgccttctgtcctggtgt

SEQ ID NO: 6128787 - DNA, 23 bp, Homo sapiens
ctcctgcctttaggccatgggtg

SEQ ID NO: 6128788 - DNA, 22 bp, Homo sapiens
ctcctgcgccccgcccacaccc

SEQ ID NO: 6128789 - DNA, 17 bp, Homo sapiens
ctcctgcgcgcatgtgc

SEQ ID NO: 6128790 - DNA, 20 bp, Homo sapiens
ctcctgcggctcagccttgc

SEQ ID NO: 6128791 - DNA, 23 bp, Homo sapiens
ctcctgcgggagtagttggaaag

SEQ ID NO: 6128792 - DNA, 22 bp, Homo sapiens
ctcctgcgggggcgaggcccct

SEQ ID NO: 6128793 - DNA, 19 bp, Homo sapiens
ctcctgcgtgttctcagag

SEQ ID NO: 6128794 - DNA, 16 bp, Homo sapiens
ctcctgctacttcccc

SEQ ID NO: 6128795 - DNA, 15 bp, Homo sapiens
ctcctgctcctcagg

SEQ ID NO: 6128796 - DNA, 18 bp, Homo sapiens
ctcctgctcctccctgcc

SEQ ID NO: 6128797 - DNA, 13 bp, Homo sapiens
ctcctgctctctg

SEQ ID NO: 6128798 - DNA, 14 bp, Homo sapiens
ctcctgctctgctt

SEQ ID NO: 6128799 - DNA, 13 bp, Homo sapiens
ctcctgctctggg

SEQ ID NO: 6128800 - DNA, 22 bp, Homo sapiens
ctcctgctgaaacacctcccag

SEQ ID NO: 6128801 - DNA, 16 bp, Homo sapiens
ctcctgctgaccttct

SEQ ID NO: 6128802 - DNA, 18 bp, Homo sapiens
ctcctgctgaccttctgc

SEQ ID NO: 6128803 - DNA, 17 bp, Homo sapiens
ctcctgctgagctgccc

SEQ ID NO: 6128804 - DNA, 23 bp, Homo sapiens
ctcctgctgagctgcccctgctg

SEQ ID NO: 6128805 - DNA, 20 bp, Homo sapiens
ctcctgctgagtggtccaca

SEQ ID NO: 6128806 - DNA, 17 bp, Homo sapiens
ctcctgctgcacaggcc

SEQ ID NO: 6128807 - DNA, 14 bp, Homo sapiens
ctcctgctgcacca

SEQ ID NO: 6128808 - DNA, 21 bp, Homo sapiens
ctcctgctgcaccaacccagc

SEQ ID NO: 6128809 - DNA, 12 bp, Homo sapiens
ctcctgctgcca

SEQ ID NO: 6128810 - DNA, 21 bp, Homo sapiens
ctcctgctgcctaataaagag

SEQ ID NO: 6128811 - DNA, 13 bp, Homo sapiens
ctcctgctgcgtg

SEQ ID NO: 6128812 - DNA, 15 bp, Homo sapiens
ctcctgctgctccct

SEQ ID NO: 6128813 - DNA, 19 bp, Homo sapiens
ctcctgctgctccctcaga

SEQ ID NO: 6128814 - DNA, 21 bp, Homo sapiens
ctcctgctgctccctcagact

SEQ ID NO: 6128815 - DNA, 23 bp, Homo sapiens
ctcctgctgctccctcagactgg

SEQ ID NO: 6128816 - DNA, 13 bp, Homo sapiens
ctcctgctggctg

SEQ ID NO: 6128817 - DNA, 17 bp, Homo sapiens
ctcctgctggctgaggc

SEQ ID NO: 6128818 - DNA, 13 bp, Homo sapiens
ctcctgctgggca

SEQ ID NO: 6128819 - DNA, 21 bp, Homo sapiens
ctcctgctggggggcagggcc

SEQ ID NO: 6128820 - DNA, 15 bp, Homo sapiens
ctcctgctggtacct

SEQ ID NO: 6128821 - DNA, 20 bp, Homo sapiens
ctcctgctggtacctgccct

SEQ ID NO: 6128822 - DNA, 14 bp, Homo sapiens
ctcctgctgtgctg

SEQ ID NO: 6128823 - DNA, 21 bp, Homo sapiens
ctcctgcttcccctccctacc

SEQ ID NO: 6128824 - DNA, 22 bp, Homo sapiens
ctcctgcttcccctccctaccc

SEQ ID NO: 6128825 - DNA, 21 bp, Homo sapiens
ctcctgcttgtactaagccag

SEQ ID NO: 6128826 - DNA, 23 bp, Homo sapiens
ctcctgcttgtactaagccagga

SEQ ID NO: 6128827 - DNA, 21 bp, Homo sapiens
ctcctgcttttctgtcctggg

SEQ ID NO: 6128828 - DNA, 18 bp, Homo sapiens
ctcctggaaaggctcagt

SEQ ID NO: 6128829 - DNA, 16 bp, Homo sapiens
ctcctggaaccaatcc

SEQ ID NO: 6128830 - DNA, 12 bp, Homo sapiens
ctcctggaacct

SEQ ID NO: 6128831 - DNA, 20 bp, Homo sapiens
ctcctggaacctggcaggcc

SEQ ID NO: 6128832 - DNA, 21 bp, Homo sapiens
ctcctggaaccttgctgtcct

SEQ ID NO: 6128833 - DNA, 22 bp, Homo sapiens
ctcctggaaccttgctgtcctg

SEQ ID NO: 6128834 - DNA, 23 bp, Homo sapiens
ctcctggaaccttgctgtcctga

SEQ ID NO: 6128835 - DNA, 15 bp, Homo sapiens
ctcctggaagcacag

SEQ ID NO: 6128836 - DNA, 15 bp, Homo sapiens
ctcctggaagctgtg

SEQ ID NO: 6128837 - DNA, 17 bp, Homo sapiens
ctcctggaccaggccca

SEQ ID NO: 6128838 - DNA, 20 bp, Homo sapiens
ctcctggacccagcaggggc

SEQ ID NO: 6128839 - DNA, 22 bp, Homo sapiens
ctcctggaccttgacagagcag

SEQ ID NO: 6128840 - DNA, 11 bp, Homo sapiens
ctcctggactc

SEQ ID NO: 6128841 - DNA, 16 bp, Homo sapiens
ctcctggactcccctc

SEQ ID NO: 6128842 - DNA, 17 bp, Homo sapiens
ctcctggactccggagg

SEQ ID NO: 6128843 - DNA, 18 bp, Homo sapiens
ctcctggactccggagga

SEQ ID NO: 6128844 - DNA, 21 bp, Homo sapiens
ctcctggactccggaggactg

SEQ ID NO: 6128845 - DNA, 17 bp, Homo sapiens
ctcctggagatagctgg

SEQ ID NO: 6128846 - DNA, 22 bp, Homo sapiens
ctcctggagcaagctctgccct

SEQ ID NO: 6128847 - DNA, 17 bp, Homo sapiens
ctcctggagcagaaagt

SEQ ID NO: 6128848 - DNA, 21 bp, Homo sapiens
ctcctggagcagaaagtgcct

SEQ ID NO: 6128849 - DNA, 19 bp, Homo sapiens
ctcctggagcagcagctga

SEQ ID NO: 6128850 - DNA, 13 bp, Homo sapiens
ctcctggagccag

SEQ ID NO: 6128851 - DNA, 10 bp, Homo sapiens
ctcctggagg

SEQ ID NO: 6128852 - DNA, 16 bp, Homo sapiens
ctcctggaggaccaga

SEQ ID NO: 6128853 - DNA, 17 bp, Homo sapiens
ctcctggaggcaggggc

SEQ ID NO: 6128854 - DNA, 18 bp, Homo sapiens
ctcctggaggcaggggct

SEQ ID NO: 6128855 - DNA, 14 bp, Homo sapiens
ctcctggagggcgc

SEQ ID NO: 6128856 - DNA, 18 bp, Homo sapiens
ctcctggagggcgcccag

SEQ ID NO: 6128857 - DNA, 22 bp, Homo sapiens
ctcctggagggcgcccagcagc

SEQ ID NO: 6128858 - DNA, 18 bp, Homo sapiens
ctcctggagtctgaagcc

SEQ ID NO: 6128859 - DNA, 17 bp, Homo sapiens
ctcctggatccctttca

SEQ ID NO: 6128860 - DNA, 15 bp, Homo sapiens
ctcctggatctccct

SEQ ID NO: 6128861 - DNA, 17 bp, Homo sapiens
ctcctggcaatcaatac

SEQ ID NO: 6128862 - DNA, 19 bp, Homo sapiens
ctcctggcacccagagaaa

SEQ ID NO: 6128863 - DNA, 22 bp, Homo sapiens
ctcctggcagggccacctgcag

SEQ ID NO: 6128864 - DNA, 20 bp, Homo sapiens
ctcctggccaagcaggctgg

SEQ ID NO: 6128865 - DNA, 15 bp, Homo sapiens
ctaaacggttcagtt

SEQ ID NO: 6128866 - DNA, 16 bp, Homo sapiens
ctaaacgtggtcacct

SEQ ID NO: 6128867 - DNA, 17 bp, Homo sapiens
ctaaacgtggtcacctt

SEQ ID NO: 6128868 - DNA, 18 bp, Homo sapiens
ctaaacgtgtatgttttt

SEQ ID NO: 6128869 - DNA, 22 bp, Homo sapiens
ctaaacgtgtatgtttttcagt

SEQ ID NO: 6128870 - DNA, 17 bp, Homo sapiens
ctaaactaccacctcag

SEQ ID NO: 6128871 - DNA, 17 bp, Homo sapiens
ctaaactaggctccttc

SEQ ID NO: 6128872 - DNA, 15 bp, Homo sapiens
ctaaactatctgtat

SEQ ID NO: 6128873 - DNA, 19 bp, Homo sapiens
ctaaactatctgtatttat

SEQ ID NO: 6128874 - DNA, 21 bp, Homo sapiens
ctaaactatctgtatttatta

SEQ ID NO: 6128875 - DNA, 14 bp, Homo sapiens
ctaaactatctttt

SEQ ID NO: 6128876 - DNA, 15 bp, Homo sapiens
ctaaactatcttttt

SEQ ID NO: 6128877 - DNA, 14 bp, Homo sapiens
ctaaactcatttat

SEQ ID NO: 6128878 - DNA, 15 bp, Homo sapiens
ctaaactcatttata

SEQ ID NO: 6128879 - DNA, 19 bp, Homo sapiens
ctaaactccaggatttata

SEQ ID NO: 6128880 - DNA, 12 bp, Homo sapiens
ctaaactctggg

SEQ ID NO: 6128881 - DNA, 17 bp, Homo sapiens
ctaaactctggggcttg

SEQ ID NO: 6128882 - DNA, 22 bp, Homo sapiens
ctaaactgccccctctgccctg

SEQ ID NO: 6128883 - DNA, 23 bp, Homo sapiens
ctaaactgccccctctgccctgc

SEQ ID NO: 6128884 - DNA, 17 bp, Homo sapiens
ctaaactggagactgtg

SEQ ID NO: 6128885 - DNA, 14 bp, Homo sapiens
ctaaactgtgaaaa

SEQ ID NO: 6128886 - DNA, 16 bp, Homo sapiens
ctaaactgtgaaaaat

SEQ ID NO: 6128887 - DNA, 18 bp, Homo sapiens
ctaaacttacatttaaaa

SEQ ID NO: 6128888 - DNA, 16 bp, Homo sapiens
ctaaacttccccatct

SEQ ID NO: 6128889 - DNA, 20 bp, Homo sapiens
ctaaacttggtgcttattga

SEQ ID NO: 6128890 - DNA, 17 bp, Homo sapiens
ctaaactttaatatgta

SEQ ID NO: 6128891 - DNA, 13 bp, Homo sapiens
ctaaactttattt

SEQ ID NO: 6128892 - DNA, 18 bp, Homo sapiens
ctaaactttttttctgta

SEQ ID NO: 6128893 - DNA, 18 bp, Homo sapiens
ctaaagaaaaagtcatcc

SEQ ID NO: 6128894 - DNA, 12 bp, Homo sapiens
ctaaagaaaaat

SEQ ID NO: 6128895 - DNA, 21 bp, Homo sapiens
ctaaagaaaaatatcttggcc

SEQ ID NO: 6128896 - DNA, 15 bp, Homo sapiens
ctaaagaaactgctt

SEQ ID NO: 6128897 - DNA, 20 bp, Homo sapiens
ctaaagaaacttggctggaa

SEQ ID NO: 6128898 - DNA, 18 bp, Homo sapiens
ctaaagaatataaagcct

SEQ ID NO: 6128899 - DNA, 16 bp, Homo sapiens
ctaaagacaagtacat

SEQ ID NO: 6128900 - DNA, 18 bp, Homo sapiens
ctaaagacaagtacataa

SEQ ID NO: 6128901 - DNA, 12 bp, Homo sapiens
ctaaagacagaa

SEQ ID NO: 6128902 - DNA, 14 bp, Homo sapiens
ctaaagagaacaag

SEQ ID NO: 6128903 - DNA, 22 bp, Homo sapiens
ctaaagagaacaagaggtgcta

SEQ ID NO: 6128904 - DNA, 18 bp, Homo sapiens
ctaaagagagaatgtaga

SEQ ID NO: 6128905 - DNA, 19 bp, Homo sapiens
ctaaagagcacttactgta

SEQ ID NO: 6128906 - DNA, 16 bp, Homo sapiens
ctaaagagcatcctga

SEQ ID NO: 6128907 - DNA, 15 bp, Homo sapiens
ctaaagagcccttgc

SEQ ID NO: 6128908 - DNA, 23 bp, Homo sapiens
ctaaagagcccttgcctccccat

SEQ ID NO: 6128909 - DNA, 20 bp, Homo sapiens
ctaaagagctacttctaatt

SEQ ID NO: 6128910 - DNA, 12 bp, Homo sapiens
ctaaagagctgc

SEQ ID NO: 6128911 - DNA, 19 bp, Homo sapiens
ctaaagaggaagccttgcc

SEQ ID NO: 6128912 - DNA, 23 bp, Homo sapiens
ctaaagaggtggggtgaagctgg

SEQ ID NO: 6128913 - DNA, 18 bp, Homo sapiens
ctaaagagtttattttaa

SEQ ID NO: 6128914 - DNA, 20 bp, Homo sapiens
ctaaagatatcagagctctt

SEQ ID NO: 6128915 - DNA, 22 bp, Homo sapiens
ctaaagatatcagagctcttaa

SEQ ID NO: 6128916 - DNA, 18 bp, Homo sapiens
ctaaagatctttttttaa

SEQ ID NO: 6128917 - DNA, 19 bp, Homo sapiens
ctaaagatggagtttctaa

SEQ ID NO: 6128918 - DNA, 23 bp, Homo sapiens
ctaaagatggagtttctaaggtc

SEQ ID NO: 6128919 - DNA, 22 bp, Homo sapiens
ctaaagatggcgcacccggcag

SEQ ID NO: 6128920 - DNA, 23 bp, Homo sapiens
ctaaagatgggaggagaccagcg

SEQ ID NO: 6128921 - DNA, 22 bp, Homo sapiens
ctaaagattctatagttctaga

SEQ ID NO: 6128922 - DNA, 23 bp, Homo sapiens
ctaaagattctatagttctagac

SEQ ID NO: 6128923 - DNA, 15 bp, Homo sapiens
ctaaagattgttaaa

SEQ ID NO: 6128924 - DNA, 16 bp, Homo sapiens
ctaaagattgttaaat

SEQ ID NO: 6128925 - DNA, 17 bp, Homo sapiens
ctaaagattttgatctc

SEQ ID NO: 6128926 - DNA, 16 bp, Homo sapiens
ctaaagcaatagaaac

SEQ ID NO: 6128927 - DNA, 21 bp, Homo sapiens
ctaaagcactttgcacttaat

SEQ ID NO: 6128928 - DNA, 14 bp, Homo sapiens
ctaaagcagaggca

SEQ ID NO: 6128929 - DNA, 18 bp, Homo sapiens
ctaaagcagtaaaataaa

SEQ ID NO: 6128930 - DNA, 19 bp, Homo sapiens
ctaaagcagtaaaataaaa

SEQ ID NO: 6128931 - DNA, 11 bp, Homo sapiens
ctaaagccaaa

SEQ ID NO: 6128932 - DNA, 17 bp, Homo sapiens
ctaaagccaaccagcct

SEQ ID NO: 6128933 - DNA, 19 bp, Homo sapiens
ctaaagccaaccagccttt

SEQ ID NO: 6128934 - DNA, 14 bp, Homo sapiens
ctaaagccagcctg

SEQ ID NO: 6128935 - DNA, 13 bp, Homo sapiens
ctaaagccaggct

SEQ ID NO: 6128936 - DNA, 20 bp, Homo sapiens
ctaaagccaggctcaggaga

SEQ ID NO: 6128937 - DNA, 12 bp, Homo sapiens
ctaaagcccatt

SEQ ID NO: 6128938 - DNA, 12 bp, Homo sapiens
ctaaagccctct

SEQ ID NO: 6128939 - DNA, 15 bp, Homo sapiens
ctaaagccctcttca

SEQ ID NO: 6128940 - DNA, 21 bp, Homo sapiens
ctaaagcctaccctattctat

SEQ ID NO: 6128941 - DNA, 16 bp, Homo sapiens
ctaaagcctcaaaaca

SEQ ID NO: 6128942 - DNA, 15 bp, Homo sapiens
ctaaagcctgaattt

SEQ ID NO: 6128943 - DNA, 15 bp, Homo sapiens
ctaaagctgccagcc

SEQ ID NO: 6128944 - DNA, 14 bp, Homo sapiens
ctaaagctggagag

SEQ ID NO: 6128945 - DNA, 17 bp, Homo sapiens
ctaaagctggtttaatg

SEQ ID NO: 6128946 - DNA, 15 bp, Homo sapiens
ctaaagcttcagact

SEQ ID NO: 6128947 - DNA, 16 bp, Homo sapiens
ctaaaggaaaaaactt

SEQ ID NO: 6128948 - DNA, 14 bp, Homo sapiens
ctaaaggactggtt

SEQ ID NO: 6128949 - DNA, 11 bp, Homo sapiens
ctaaaggaggc

SEQ ID NO: 6128950 - DNA, 14 bp, Homo sapiens
ctaaaggatccaga

SEQ ID NO: 6128951 - DNA, 15 bp, Homo sapiens
ctaaaggatccagag

SEQ ID NO: 6128952 - DNA, 20 bp, Homo sapiens
ctaaaggatggaaaaataaa

SEQ ID NO: 6128953 - DNA, 13 bp, Homo sapiens
ctaaaggcctctt

SEQ ID NO: 6128954 - DNA, 15 bp, Homo sapiens
ctaaaggcggagggt

SEQ ID NO: 6128955 - DNA, 17 bp, Homo sapiens
ctaaagggaagccctga

SEQ ID NO: 6128956 - DNA, 17 bp, Homo sapiens
ctaaagggaccatctgc

SEQ ID NO: 6128957 - DNA, 20 bp, Homo sapiens
ctaaagggaccatctgctgc

SEQ ID NO: 6128958 - DNA, 21 bp, Homo sapiens
ctaaagggactacctctgtgc

SEQ ID NO: 6128959 - DNA, 23 bp, Homo sapiens
ctaaagggactacctctgtgcct

SEQ ID NO: 6128960 - DNA, 15 bp, Homo sapiens
ctaaagggcagggcc

SEQ ID NO: 6128961 - DNA, 18 bp, Homo sapiens
ctaaagggcagggcccac

SEQ ID NO: 6128962 - DNA, 22 bp, Homo sapiens
ctaaagggctatgcctccattt

SEQ ID NO: 6128963 - DNA, 18 bp, Homo sapiens
ctaaaggggagaaactga

SEQ ID NO: 6128964 - DNA, 21 bp, Homo sapiens
ctaaaggggttttttgggaag

SEQ ID NO: 6128965 - DNA, 22 bp, Homo sapiens
ctaaaggggttttttgggaaga

SEQ ID NO: 6128966 - DNA, 17 bp, Homo sapiens
ctaaagggtatgagctg

SEQ ID NO: 6128967 - DNA, 21 bp, Homo sapiens
ctaaagtaaaaagggaattat

SEQ ID NO: 6128968 - DNA, 17 bp, Homo sapiens
ctaaagtaccagattat

SEQ ID NO: 6128969 - DNA, 22 bp, Homo sapiens
ctaaagtactgagcagtgatat

SEQ ID NO: 6128970 - DNA, 20 bp, Homo sapiens
ctaaagtagcaactgctggt

SEQ ID NO: 6128971 - DNA, 19 bp, Homo sapiens
ctaaagtatacaactgcct

SEQ ID NO: 6128972 - DNA, 15 bp, Homo sapiens
ctaaagtatagagaa

SEQ ID NO: 6128973 - DNA, 20 bp, Homo sapiens
ctaaagtcaggccattcagt

SEQ ID NO: 6128974 - DNA, 22 bp, Homo sapiens
ctaaagtcatcatgaactggct

SEQ ID NO: 6128975 - DNA, 23 bp, Homo sapiens
ctaaagtcatcatgaactggctt

SEQ ID NO: 6128976 - DNA, 19 bp, Homo sapiens
ctaaagtccagactatgga

SEQ ID NO: 6128977 - DNA, 15 bp, Homo sapiens
ctaaagtcctggccc

SEQ ID NO: 6128978 - DNA, 23 bp, Homo sapiens
ctaaagtcctttgagctcctggg

SEQ ID NO: 6128979 - DNA, 13 bp, Homo sapiens
ctaaagtctcagg

SEQ ID NO: 6128980 - DNA, 21 bp, Homo sapiens
ctaaagtgatgggctttctct

SEQ ID NO: 6128981 - DNA, 15 bp, Homo sapiens
ctaaagtgctggaac

SEQ ID NO: 6128982 - DNA, 14 bp, Homo sapiens
ctaaagtgctggga

SEQ ID NO: 6128983 - DNA, 17 bp, Homo sapiens
ctaaagtgtgctttata

SEQ ID NO: 6128984 - DNA, 18 bp, Homo sapiens
ctaaagtgtgctttataa

SEQ ID NO: 6128985 - DNA, 17 bp, Homo sapiens
ctaaagtgttggtcttt

SEQ ID NO: 6128986 - DNA, 18 bp, Homo sapiens
ctaaagtgtttagctgtc

SEQ ID NO: 6128987 - DNA, 15 bp, Homo sapiens
ctaaagttacctgtt

SEQ ID NO: 6128988 - DNA, 21 bp, Homo sapiens
ctaaagttagggcatttttct

SEQ ID NO: 6128989 - DNA, 10 bp, Homo sapiens
ctaaagttat

SEQ ID NO: 6128990 - DNA, 14 bp, Homo sapiens
ctaaagttctaaga

SEQ ID NO: 6128991 - DNA, 17 bp, Homo sapiens
ctaaagttctaagattc

SEQ ID NO: 6128992 - DNA, 20 bp, Homo sapiens
ctaaagttgtactttaaaaa

SEQ ID NO: 6128993 - DNA, 19 bp, Homo sapiens
ctaaagtttacagtaaata

SEQ ID NO: 6128994 - DNA, 20 bp, Homo sapiens
ctaaagttttgcaacaatta

SEQ ID NO: 6128995 - DNA, 15 bp, Homo sapiens
ctaaataaaaaattc

SEQ ID NO: 6128996 - DNA, 15 bp, Homo sapiens
ctaaataaaaatatg

SEQ ID NO: 6128997 - DNA, 16 bp, Homo sapiens
ctaaataaaaatatgt

SEQ ID NO: 6128998 - DNA, 18 bp, Homo sapiens
ctaaataaaagttttaca

SEQ ID NO: 6128999 - DNA, 18 bp, Homo sapiens
ctaaataaaatataattg

SEQ ID NO: 6129000 - DNA, 20 bp, Homo sapiens
ctaaataaaatataattgtt

SEQ ID NO: 6129001 - DNA, 19 bp, Homo sapiens
ctaaataaaatgctaggtt

SEQ ID NO: 6129002 - DNA, 23 bp, Homo sapiens
ctaaataaagcttgcaacaaaat

SEQ ID NO: 6129003 - DNA, 20 bp, Homo sapiens
ctaaataaatttgcttttat

SEQ ID NO: 6129004 - DNA, 19 bp, Homo sapiens
ctaaataacttgccatttc

SEQ ID NO: 6129005 - DNA, 19 bp, Homo sapiens
ctaaataaggaatttcctc

SEQ ID NO: 6129006 - DNA, 22 bp, Homo sapiens
ctaaataaggaatttcctccca

SEQ ID NO: 6129007 - DNA, 18 bp, Homo sapiens
ctaaataatatcctgaat

SEQ ID NO: 6129008 - DNA, 12 bp, Homo sapiens
ctaaataatgaa

SEQ ID NO: 6129009 - DNA, 16 bp, Homo sapiens
ctaaataatgaataaa

SEQ ID NO: 6129010 - DNA, 22 bp, Homo sapiens
ctaaataatgaataaactgaat

SEQ ID NO: 6129011 - DNA, 24 bp, Homo sapiens
ctaaatacctgccctgacatgcac

SEQ ID NO: 6129012 - DNA, 14 bp, Homo sapiens
ctaaatactgtaca

SEQ ID NO: 6129013 - DNA, 17 bp, Homo sapiens
ctaaatacttgctccat

SEQ ID NO: 6129014 - DNA, 17 bp, Homo sapiens
ctaaatacttttttcta

SEQ ID NO: 6129015 - DNA, 20 bp, Homo sapiens
ctaaatagcatgtattgtgt

SEQ ID NO: 6129016 - DNA, 22 bp, Homo sapiens
ctaaatagcccagatcccaaga

SEQ ID NO: 6129017 - DNA, 18 bp, Homo sapiens
ctaaataggatcctggag

SEQ ID NO: 6129018 - DNA, 14 bp, Homo sapiens
ctaaatataaattt

SEQ ID NO: 6129019 - DNA, 22 bp, Homo sapiens
ctaaatataaattttcagaatt

SEQ ID NO: 6129020 - DNA, 16 bp, Homo sapiens
ctaaatatataaagta

SEQ ID NO: 6129021 - DNA, 17 bp, Homo sapiens
ctaaatatccaaagact

SEQ ID NO: 6129022 - DNA, 18 bp, Homo sapiens
ctaaatatccaaagactg

SEQ ID NO: 6129023 - DNA, 22 bp, Homo sapiens
ctaaatatccaaagactgtact

SEQ ID NO: 6129024 - DNA, 15 bp, Homo sapiens
ctaaatatctagtgc

SEQ ID NO: 6129025 - DNA, 16 bp, Homo sapiens
ctaaatatctagtgct

SEQ ID NO: 6129026 - DNA, 14 bp, Homo sapiens
ctaaatatctgtca

SEQ ID NO: 6129027 - DNA, 15 bp, Homo sapiens
ctaaatatgaaattt

SEQ ID NO: 6129028 - DNA, 23 bp, Homo sapiens
ctaaatatgaatgaatgggatat

SEQ ID NO: 6129029 - DNA, 21 bp, Homo sapiens
ctaaatatgcaatatatgttc

SEQ ID NO: 6129030 - DNA, 22 bp, Homo sapiens
ctaaatatggactgctcaggaa

SEQ ID NO: 6129031 - DNA, 14 bp, Homo sapiens
ctaaatattatgcc

SEQ ID NO: 6129032 - DNA, 14 bp, Homo sapiens
ctaaatattgcttc

SEQ ID NO: 6129033 - DNA, 21 bp, Homo sapiens
ctaaatattggtttgttattc

SEQ ID NO: 6129034 - DNA, 23 bp, Homo sapiens
ctaaatattggtttgttattctt

SEQ ID NO: 6129035 - DNA, 13 bp, Homo sapiens
ctaaatatttcat

SEQ ID NO: 6129036 - DNA, 16 bp, Homo sapiens
ctaaatattttcaaga

SEQ ID NO: 6129037 - DNA, 18 bp, Homo sapiens
ctaaatcactttaattta

SEQ ID NO: 6129038 - DNA, 20 bp, Homo sapiens
ctaaatcactttaatttaga

SEQ ID NO: 6129039 - DNA, 14 bp, Homo sapiens
ctaaatcagagaca

SEQ ID NO: 6129040 - DNA, 17 bp, Homo sapiens
ctaaatccatttggaaa

SEQ ID NO: 6129041 - DNA, 20 bp, Homo sapiens
ctaaatccatttggaaatct

SEQ ID NO: 6129042 - DNA, 17 bp, Homo sapiens
ctaaatccattttctaa

SEQ ID NO: 6129043 - DNA, 12 bp, Homo sapiens
ctcctggccaga

SEQ ID NO: 6129044 - DNA, 23 bp, Homo sapiens
ctcctggccagacgctgccgctg

SEQ ID NO: 6129045 - DNA, 16 bp, Homo sapiens
ctcctggcccactgca

SEQ ID NO: 6129046 - DNA, 20 bp, Homo sapiens
ctcctggcccgccctcacct

SEQ ID NO: 6129047 - DNA, 14 bp, Homo sapiens
ctcctggcccttct

SEQ ID NO: 6129048 - DNA, 22 bp, Homo sapiens
ctcctggcctatccgctgccag

SEQ ID NO: 6129049 - DNA, 23 bp, Homo sapiens
ctcctggcctatccgctgccagc

SEQ ID NO: 6129050 - DNA, 14 bp, Homo sapiens
ctcctggcctcaga

SEQ ID NO: 6129051 - DNA, 23 bp, Homo sapiens
ctcctggcctcagactgcaccca

SEQ ID NO: 6129052 - DNA, 13 bp, Homo sapiens
ctcctggcctgag

SEQ ID NO: 6129053 - DNA, 17 bp, Homo sapiens
ctcctggcctgagcgca

SEQ ID NO: 6129054 - DNA, 13 bp, Homo sapiens
ctcctggccttcc

SEQ ID NO: 6129055 - DNA, 14 bp, Homo sapiens
ctcctggccttcct

SEQ ID NO: 6129056 - DNA, 16 bp, Homo sapiens
ctcctggccttcctcg

SEQ ID NO: 6129057 - DNA, 12 bp, Homo sapiens
ctcctggccttt

SEQ ID NO: 6129058 - DNA, 13 bp, Homo sapiens
ctcctggcctttt

SEQ ID NO: 6129059 - DNA, 14 bp, Homo sapiens
ctcctggccttttg

SEQ ID NO: 6129060 - DNA, 16 bp, Homo sapiens
ctcctggctaagcctc

SEQ ID NO: 6129061 - DNA, 22 bp, Homo sapiens
ctcctggctaagcctctgcttc

SEQ ID NO: 6129062 - DNA, 20 bp, Homo sapiens
ctcctggctcaagccctgaa

SEQ ID NO: 6129063 - DNA, 13 bp, Homo sapiens
ctcctggctcaca

SEQ ID NO: 6129064 - DNA, 16 bp, Homo sapiens
ctcctggctcacagcc

SEQ ID NO: 6129065 - DNA, 19 bp, Homo sapiens
ctcctggctcaggcccagc

SEQ ID NO: 6129066 - DNA, 14 bp, Homo sapiens
ctcctggctccctc

SEQ ID NO: 6129067 - DNA, 13 bp, Homo sapiens
ctcctggctcggg

SEQ ID NO: 6129068 - DNA, 22 bp, Homo sapiens
ctcctggctcttgatacccccc

SEQ ID NO: 6129069 - DNA, 23 bp, Homo sapiens
ctcctggctgaggggcttcaacc

SEQ ID NO: 6129070 - DNA, 13 bp, Homo sapiens
ctcctggctgcca

SEQ ID NO: 6129071 - DNA, 11 bp, Homo sapiens
ctcctggctgg

SEQ ID NO: 6129072 - DNA, 18 bp, Homo sapiens
ctcctggctgtctgaggc

SEQ ID NO: 6129073 - DNA, 12 bp, Homo sapiens
ctcctggctgtg

SEQ ID NO: 6129074 - DNA, 22 bp, Homo sapiens
ctcctggctgtgcccagcaggc

SEQ ID NO: 6129075 - DNA, 14 bp, Homo sapiens
ctcctggcttccca

SEQ ID NO: 6129076 - DNA, 11 bp, Homo sapiens
ctcctggcttt

SEQ ID NO: 6129077 - DNA, 21 bp, Homo sapiens
ctcctggcttttaaacctgtt

SEQ ID NO: 6129078 - DNA, 22 bp, Homo sapiens
ctcctgggaaacctgcctttgt

SEQ ID NO: 6129079 - DNA, 14 bp, Homo sapiens
ctcctgggaacaca

SEQ ID NO: 6129080 - DNA, 17 bp, Homo sapiens
ctcctgggaacacatct

SEQ ID NO: 6129081 - DNA, 22 bp, Homo sapiens
ctcctgggaacacatctggctg

SEQ ID NO: 6129082 - DNA, 17 bp, Homo sapiens
ctcctgggaacctcctt

SEQ ID NO: 6129083 - DNA, 23 bp, Homo sapiens
ctcctgggaaggagggagctgct

SEQ ID NO: 6129084 - DNA, 14 bp, Homo sapiens
ctcctgggaaggcc

SEQ ID NO: 6129085 - DNA, 21 bp, Homo sapiens
ctcctgggaccatggacacat

SEQ ID NO: 6129086 - DNA, 13 bp, Homo sapiens
ctcctgggaccct

SEQ ID NO: 6129087 - DNA, 19 bp, Homo sapiens
ctcctgggacccttggcta

SEQ ID NO: 6129088 - DNA, 12 bp, Homo sapiens
ctcctgggaggc

SEQ ID NO: 6129089 - DNA, 21 bp, Homo sapiens
ctcctgggaggccctggcaga

SEQ ID NO: 6129090 - DNA, 22 bp, Homo sapiens
ctcctgggaggccctggcagaa

SEQ ID NO: 6129091 - DNA, 17 bp, Homo sapiens
ctcctgggagggagact

SEQ ID NO: 6129092 - DNA, 22 bp, Homo sapiens
ctcctgggagggagactcagcc

SEQ ID NO: 6129093 - DNA, 23 bp, Homo sapiens
ctcctgggagggagactcagcct

SEQ ID NO: 6129094 - DNA, 23 bp, Homo sapiens
ctcctgggattggctgtgaactg

SEQ ID NO: 6129095 - DNA, 12 bp, Homo sapiens
ctcctgggcagc

SEQ ID NO: 6129096 - DNA, 21 bp, Homo sapiens
ctcctgggcagccgttttcct

SEQ ID NO: 6129097 - DNA, 22 bp, Homo sapiens
ctcctgggcagctgcctcccct

SEQ ID NO: 6129098 - DNA, 16 bp, Homo sapiens
ctcctgggcagcttga

SEQ ID NO: 6129099 - DNA, 23 bp, Homo sapiens
ctcctgggcatctggccctgctg

SEQ ID NO: 6129100 - DNA, 20 bp, Homo sapiens
ctcctgggcattagcaaggc

SEQ ID NO: 6129101 - DNA, 23 bp, Homo sapiens
ctcctgggcattagcaaggcaga

SEQ ID NO: 6129102 - DNA, 15 bp, Homo sapiens
ctcctgggccagggt

SEQ ID NO: 6129103 - DNA, 22 bp, Homo sapiens
ctcctgggcccaggcagcacct

SEQ ID NO: 6129104 - DNA, 22 bp, Homo sapiens
ctcctgggccccagaaagcctc

SEQ ID NO: 6129105 - DNA, 13 bp, Homo sapiens
ctcctgggcccct

SEQ ID NO: 6129106 - DNA, 23 bp, Homo sapiens
ctcctgggcccgctttgcctgct

SEQ ID NO: 6129107 - DNA, 20 bp, Homo sapiens
ctcctgggccctctctgctc

SEQ ID NO: 6129108 - DNA, 14 bp, Homo sapiens
ctcctgggccctgg

SEQ ID NO: 6129109 - DNA, 15 bp, Homo sapiens
ctcctgggccctggg

SEQ ID NO: 6129110 - DNA, 19 bp, Homo sapiens
ctcctgggccctgggctgg

SEQ ID NO: 6129111 - DNA, 17 bp, Homo sapiens
ctcctgggctctgaaca

SEQ ID NO: 6129112 - DNA, 18 bp, Homo sapiens
ctcctgggctctgaacac

SEQ ID NO: 6129113 - DNA, 23 bp, Homo sapiens
ctcctgggcttaaggcctaagga

SEQ ID NO: 6129114 - DNA, 20 bp, Homo sapiens
ctcctggggaaggtcgccct

SEQ ID NO: 6129115 - DNA, 20 bp, Homo sapiens
ctcctggggagaaagagggg

SEQ ID NO: 6129116 - DNA, 23 bp, Homo sapiens
ctcctggggagctcctgggaccc

SEQ ID NO: 6129117 - DNA, 14 bp, Homo sapiens
ctcctgggggctgg

SEQ ID NO: 6129118 - DNA, 21 bp, Homo sapiens
ctcctgggggctggctcccag

SEQ ID NO: 6129119 - DNA, 22 bp, Homo sapiens
ctcctgggggctggctcccagg

SEQ ID NO: 6129120 - DNA, 14 bp, Homo sapiens
ctcctgggggtggc

SEQ ID NO: 6129121 - DNA, 15 bp, Homo sapiens
ctcctgggggtggca

SEQ ID NO: 6129122 - DNA, 18 bp, Homo sapiens
ctcctgggggtggcaggc

SEQ ID NO: 6129123 - DNA, 22 bp, Homo sapiens
ctcctgggggttctttcttcct

SEQ ID NO: 6129124 - DNA, 21 bp, Homo sapiens
ctcctgggtgtgtttggcttg

SEQ ID NO: 6129125 - DNA, 23 bp, Homo sapiens
ctcctgggttggagggaaccacc

SEQ ID NO: 6129126 - DNA, 23 bp, Homo sapiens
ctcctgggttttgtattctctga

SEQ ID NO: 6129127 - DNA, 22 bp, Homo sapiens
ctcctggtaccaagctgctggg

SEQ ID NO: 6129128 - DNA, 21 bp, Homo sapiens
ctcctggtagaggggccggct

SEQ ID NO: 6129129 - DNA, 22 bp, Homo sapiens
ctcctggtagaggggccggctg

SEQ ID NO: 6129130 - DNA, 20 bp, Homo sapiens
ctcctggtagcatgaccttt

SEQ ID NO: 6129131 - DNA, 22 bp, Homo sapiens
ctcctggtagcatgaccttttg

SEQ ID NO: 6129132 - DNA, 13 bp, Homo sapiens
ctcctggtcctag

SEQ ID NO: 6129133 - DNA, 23 bp, Homo sapiens
ctcctggtcctggacacctccca

SEQ ID NO: 6129134 - DNA, 14 bp, Homo sapiens
ctcctggtctgtga

SEQ ID NO: 6129135 - DNA, 16 bp, Homo sapiens
ctcctggtctgtgaag

SEQ ID NO: 6129136 - DNA, 23 bp, Homo sapiens
ctcctggtcttgagatgtcttct

SEQ ID NO: 6129137 - DNA, 17 bp, Homo sapiens
ctcctggtgaagtgtga

SEQ ID NO: 6129138 - DNA, 16 bp, Homo sapiens
ctcctggtgcaggtct

SEQ ID NO: 6129139 - DNA, 12 bp, Homo sapiens
ctcctggtgccc

SEQ ID NO: 6129140 - DNA, 17 bp, Homo sapiens
ctcctggtgggtccagg

SEQ ID NO: 6129141 - DNA, 21 bp, Homo sapiens
ctcctggtgtcaccccagagc

SEQ ID NO: 6129142 - DNA, 23 bp, Homo sapiens
ctcctggtgtcaccccagagcca

SEQ ID NO: 6129143 - DNA, 17 bp, Homo sapiens
ctcctggtttcctttct

SEQ ID NO: 6129144 - DNA, 18 bp, Homo sapiens
ctcctggtttgatttgat

SEQ ID NO: 6129145 - DNA, 13 bp, Homo sapiens
ctcctgtaaaata

SEQ ID NO: 6129146 - DNA, 23 bp, Homo sapiens
ctcctgtaacatactggcctgga

SEQ ID NO: 6129147 - DNA, 20 bp, Homo sapiens
ctcctgtaagccaaagaaat

SEQ ID NO: 6129148 - DNA, 14 bp, Homo sapiens
ctcctgtaattcct

SEQ ID NO: 6129149 - DNA, 17 bp, Homo sapiens
ctcctgtacctcagtgg

SEQ ID NO: 6129150 - DNA, 16 bp, Homo sapiens
ctcctgtacctcttga

SEQ ID NO: 6129151 - DNA, 19 bp, Homo sapiens
ctcctgtacttgtcctcag

SEQ ID NO: 6129152 - DNA, 19 bp, Homo sapiens
ctcctgtagccactggcat

SEQ ID NO: 6129153 - DNA, 14 bp, Homo sapiens
ctcctgtcactcac

SEQ ID NO: 6129154 - DNA, 16 bp, Homo sapiens
ctcctgtcactcactg

SEQ ID NO: 6129155 - DNA, 18 bp, Homo sapiens
ctcctgtcactcactgag

SEQ ID NO: 6129156 - DNA, 19 bp, Homo sapiens
ctcctgtcactcactgagg

SEQ ID NO: 6129157 - DNA, 16 bp, Homo sapiens
ctcctgtcagtgagga

SEQ ID NO: 6129158 - DNA, 14 bp, Homo sapiens
ctcctgtccccggc

SEQ ID NO: 6129159 - DNA, 16 bp, Homo sapiens
ctcctgtccctaccca

SEQ ID NO: 6129160 - DNA, 15 bp, Homo sapiens
ctcctgtcccttttc

SEQ ID NO: 6129161 - DNA, 20 bp, Homo sapiens
ctcctgtctcagcctcctga

SEQ ID NO: 6129162 - DNA, 16 bp, Homo sapiens
ctcctgtctccctcct

SEQ ID NO: 6129163 - DNA, 13 bp, Homo sapiens
ctcctgtctcctc

SEQ ID NO: 6129164 - DNA, 19 bp, Homo sapiens
ctcctgtctcctctgtcag

SEQ ID NO: 6129165 - DNA, 23 bp, Homo sapiens
ctcctgtctcgccagaagactcc

SEQ ID NO: 6129166 - DNA, 13 bp, Homo sapiens
ctcctgtctcttg

SEQ ID NO: 6129167 - DNA, 11 bp, Homo sapiens
ctcctgtctgc

SEQ ID NO: 6129168 - DNA, 14 bp, Homo sapiens
ctcctgtctgccag

SEQ ID NO: 6129169 - DNA, 15 bp, Homo sapiens
ctcctgtctgccagc

SEQ ID NO: 6129170 - DNA, 19 bp, Homo sapiens
ctcctgtctgccagccagc

SEQ ID NO: 6129171 - DNA, 17 bp, Homo sapiens
ctcctgtctgccctctg

SEQ ID NO: 6129172 - DNA, 19 bp, Homo sapiens
ctcctgtctgccctctggg

SEQ ID NO: 6129173 - DNA, 12 bp, Homo sapiens
ctcctgtctggc

SEQ ID NO: 6129174 - DNA, 14 bp, Homo sapiens
ctcctgtctgtcct

SEQ ID NO: 6129175 - DNA, 17 bp, Homo sapiens
ctcctgtcttcagagca

SEQ ID NO: 6129176 - DNA, 18 bp, Homo sapiens
ctcctgtcttcagagcaa

SEQ ID NO: 6129177 - DNA, 17 bp, Homo sapiens
ctcctgtcttcccaggg

SEQ ID NO: 6129178 - DNA, 18 bp, Homo sapiens
ctcctgtcttcccagggt

SEQ ID NO: 6129179 - DNA, 19 bp, Homo sapiens
ctcctgtcttcccagggta

SEQ ID NO: 6129180 - DNA, 17 bp, Homo sapiens
ctcctgtcttctgcttt

SEQ ID NO: 6129181 - DNA, 15 bp, Homo sapiens
ctcctgtcttctttc

SEQ ID NO: 6129182 - DNA, 17 bp, Homo sapiens
ctcctgtcttggcctcc

SEQ ID NO: 6129183 - DNA, 19 bp, Homo sapiens
ctcctgtcttggcctccca

SEQ ID NO: 6129184 - DNA, 17 bp, Homo sapiens
ctcctgtgaatggaggc

SEQ ID NO: 6129185 - DNA, 20 bp, Homo sapiens
ctcctgtgaatggaggcaga

SEQ ID NO: 6129186 - DNA, 11 bp, Homo sapiens
ctcctgtgacc

SEQ ID NO: 6129187 - DNA, 16 bp, Homo sapiens
ctcctgtgagctcccc

SEQ ID NO: 6129188 - DNA, 17 bp, Homo sapiens
ctcctgtgcatgggtga

SEQ ID NO: 6129189 - DNA, 20 bp, Homo sapiens
ctcctgtgcatgggtgaagg

SEQ ID NO: 6129190 - DNA, 17 bp, Homo sapiens
ctcctgtgccccagctg

SEQ ID NO: 6129191 - DNA, 17 bp, Homo sapiens
ctcctgtgcccctcaga

SEQ ID NO: 6129192 - DNA, 11 bp, Homo sapiens
ctcctgtgcct

SEQ ID NO: 6129193 - DNA, 15 bp, Homo sapiens
ctcctgtgctcaccc

SEQ ID NO: 6129194 - DNA, 16 bp, Homo sapiens
ctcctgtgctcaccct

SEQ ID NO: 6129195 - DNA, 22 bp, Homo sapiens
ctcctgtgctggactgtttcct

SEQ ID NO: 6129196 - DNA, 15 bp, Homo sapiens
ctcctgtgctttccc

SEQ ID NO: 6129197 - DNA, 18 bp, Homo sapiens
ctcctgtggaacccagca

SEQ ID NO: 6129198 - DNA, 22 bp, Homo sapiens
ctcctgtggaaggcagagaaat

SEQ ID NO: 6129199 - DNA, 19 bp, Homo sapiens
ctcctgtggccccaccctg

SEQ ID NO: 6129200 - DNA, 20 bp, Homo sapiens
ctcctgtggccccaccctgg

SEQ ID NO: 6129201 - DNA, 22 bp, Homo sapiens
ctcctgtggccccaccctgggc

SEQ ID NO: 6129202 - DNA, 17 bp, Homo sapiens
ctcctgtggcctgccag

SEQ ID NO: 6129203 - DNA, 20 bp, Homo sapiens
ctcctgtggcctgccagtca

SEQ ID NO: 6129204 - DNA, 16 bp, Homo sapiens
ctcctgtggcctgctc

SEQ ID NO: 6129205 - DNA, 20 bp, Homo sapiens
ctcctgtggcctgctcatca

SEQ ID NO: 6129206 - DNA, 15 bp, Homo sapiens
ctcctgtgggagcct

SEQ ID NO: 6129207 - DNA, 16 bp, Homo sapiens
ctcctgtgggagcctc

SEQ ID NO: 6129208 - DNA, 17 bp, Homo sapiens
ctcctgtgggagcctcg

SEQ ID NO: 6129209 - DNA, 19 bp, Homo sapiens
ctcctgtgggagcctcgca

SEQ ID NO: 6129210 - DNA, 20 bp, Homo sapiens
ctcctgtggtagtcctccca

SEQ ID NO: 6129211 - DNA, 23 bp, Homo sapiens
ctcctgtggtagtcctcccaagc

SEQ ID NO: 6129212 - DNA, 9 bp, Homo sapiens
ctcctgtgt

SEQ ID NO: 6129213 - DNA, 10 bp, Homo sapiens
ctcctgtgtc

SEQ ID NO: 6129214 - DNA, 15 bp, Homo sapiens
ctcctgtgtcttgca

SEQ ID NO: 6129215 - DNA, 23 bp, Homo sapiens
ctcctgtgtcttgcaatggcagc

SEQ ID NO: 6129216 - DNA, 15 bp, Homo sapiens
ctcctgtgtgcttgt

SEQ ID NO: 6129217 - DNA, 17 bp, Homo sapiens
ctcctgtgtgcttgtca

SEQ ID NO: 6129218 - DNA, 13 bp, Homo sapiens
ctcctgtgtgtct

SEQ ID NO: 6129219 - DNA, 16 bp, Homo sapiens
ctcctgtgtgtgcgcc

SEQ ID NO: 6129220 - DNA, 14 bp, Homo sapiens
ctcctgtgtgtgga

SEQ ID NO: 6129221 - DNA, 19 bp, Homo sapiens
ctcctgtgttccctttgag

SEQ ID NO: 6129222 - DNA, 20 bp, Homo sapiens
ctcctgtgttgtgctgggag

SEQ ID NO: 6129223 - DNA, 23 bp, Homo sapiens
ctcctgttagctcctcactgtgg

SEQ ID NO: 6129224 - DNA, 22 bp, Homo sapiens
ctcctgttagtagcagaaatat

SEQ ID NO: 6129225 - DNA, 20 bp, Homo sapiens
ctcctgttcatctgtgcacc

SEQ ID NO: 6129226 - DNA, 19 bp, Homo sapiens
ctcctgttcctgccttctc

SEQ ID NO: 6129227 - DNA, 13 bp, Homo sapiens
ctcctgttctgaa

SEQ ID NO: 6129228 - DNA, 19 bp, Homo sapiens
ctcctgttgcacccagccc

SEQ ID NO: 6129229 - DNA, 22 bp, Homo sapiens
ctcctgttgcacccagccctgg

SEQ ID NO: 6129230 - DNA, 18 bp, Homo sapiens
ctcctgtttaactcccta

SEQ ID NO: 6129231 - DNA, 16 bp, Homo sapiens
ctcctgtttcagacca

SEQ ID NO: 6129232 - DNA, 18 bp, Homo sapiens
ctcctgtttcccttccct

SEQ ID NO: 6129233 - DNA, 20 bp, Homo sapiens
ctcctgtttcccttcccttc

SEQ ID NO: 6129234 - DNA, 15 bp, Homo sapiens
ctcctgtttgcaggc

SEQ ID NO: 6129235 - DNA, 23 bp, Homo sapiens
ctcctgtttggaaatggggagct

SEQ ID NO: 6129236 - DNA, 18 bp, Homo sapiens
ctcctgtttggggagcaa

SEQ ID NO: 6129237 - DNA, 17 bp, Homo sapiens
ctcctgttttcacacct

SEQ ID NO: 6129238 - DNA, 21 bp, Homo sapiens
ctcctgttttcacaccttaca

SEQ ID NO: 6129239 - DNA, 14 bp, Homo sapiens
ctcctgttttctcc

SEQ ID NO: 6129240 - DNA, 18 bp, Homo sapiens
ctcctgttttctccctct

SEQ ID NO: 6129241 - DNA, 22 bp, Homo sapiens
ctccttaaaaatgtatgttggt

SEQ ID NO: 6129242 - DNA, 21 bp, Homo sapiens
ctccttaaagttctgggcagc

SEQ ID NO: 6129243 - DNA, 17 bp, Homo sapiens
ctccttaacactgagct

SEQ ID NO: 6129244 - DNA, 13 bp, Homo sapiens
ctccttaaggctc

SEQ ID NO: 6129245 - DNA, 17 bp, Homo sapiens
ctccttaatatgatctg

SEQ ID NO: 6129246 - DNA, 22 bp, Homo sapiens
ctccttaatatgatctgtggag

SEQ ID NO: 6129247 - DNA, 21 bp, Homo sapiens
ctccttaatttaattgctttg

SEQ ID NO: 6129248 - DNA, 14 bp, Homo sapiens
ctccttacattaaa

SEQ ID NO: 6129249 - DNA, 15 bp, Homo sapiens
ctccttacctctgga

SEQ ID NO: 6129250 - DNA, 16 bp, Homo sapiens
ctccttacctctggaa

SEQ ID NO: 6129251 - DNA, 16 bp, Homo sapiens
ctccttactctgagcc

SEQ ID NO: 6129252 - DNA, 21 bp, Homo sapiens
ctccttactctgagcccaggc

SEQ ID NO: 6129253 - DNA, 22 bp, Homo sapiens
ctccttactctgagcccaggcc

SEQ ID NO: 6129254 - DNA, 18 bp, Homo sapiens
ctccttagacacctatca

SEQ ID NO: 6129255 - DNA, 22 bp, Homo sapiens
ctccttagccctgtctgctagg

SEQ ID NO: 6129256 - DNA, 20 bp, Homo sapiens
ctccttagggttttctctct

SEQ ID NO: 6129257 - DNA, 18 bp, Homo sapiens
ctccttaggtgcccagaa

SEQ ID NO: 6129258 - DNA, 16 bp, Homo sapiens
ctccttagtcttctca

SEQ ID NO: 6129259 - DNA, 20 bp, Homo sapiens
ctccttatagacacttgctc

SEQ ID NO: 6129260 - DNA, 23 bp, Homo sapiens
ctccttatgggtagggctctgac

SEQ ID NO: 6129261 - DNA, 19 bp, Homo sapiens
ctccttattggaaggtatt

SEQ ID NO: 6129262 - DNA, 21 bp, Homo sapiens
ctccttcaacaattctaaaat

SEQ ID NO: 6129263 - DNA, 21 bp, Homo sapiens
ctccttcacctttgtccccac

SEQ ID NO: 6129264 - DNA, 17 bp, Homo sapiens
ctccttcactctgacag

SEQ ID NO: 6129265 - DNA, 17 bp, Homo sapiens
ctccttcactgttccct

SEQ ID NO: 6129266 - DNA, 22 bp, Homo sapiens
ctccttcactgttccctctggc

SEQ ID NO: 6129267 - DNA, 12 bp, Homo sapiens
ctccttcagaca

SEQ ID NO: 6129268 - DNA, 13 bp, Homo sapiens
ctccttcagcacg

SEQ ID NO: 6129269 - DNA, 13 bp, Homo sapiens
ctccttcagccct

SEQ ID NO: 6129270 - DNA, 20 bp, Homo sapiens
ctccttcagccctcacccct

SEQ ID NO: 6129271 - DNA, 14 bp, Homo sapiens
ctccttcatgcttt

SEQ ID NO: 6129272 - DNA, 16 bp, Homo sapiens
ctccttcatgcttttc

SEQ ID NO: 6129273 - DNA, 22 bp, Homo sapiens
ctccttcattaatgatgatctt

SEQ ID NO: 6129274 - DNA, 14 bp, Homo sapiens
ctccttccaactgc

SEQ ID NO: 6129275 - DNA, 15 bp, Homo sapiens
ctccttccaactgct

SEQ ID NO: 6129276 - DNA, 19 bp, Homo sapiens
ctccttccaactgctgccc

SEQ ID NO: 6129277 - DNA, 16 bp, Homo sapiens
ctccttccacctccct

SEQ ID NO: 6129278 - DNA, 18 bp, Homo sapiens
ctccttccacctccctcc

SEQ ID NO: 6129279 - DNA, 12 bp, Homo sapiens
ctccttccagcc

SEQ ID NO: 6129280 - DNA, 16 bp, Homo sapiens
ctccttccagctagtg

SEQ ID NO: 6129281 - DNA, 13 bp, Homo sapiens
ctccttccatcct

SEQ ID NO: 6129282 - DNA, 18 bp, Homo sapiens
ctccttccatctgcctga

SEQ ID NO: 6129283 - DNA, 20 bp, Homo sapiens
ctccttcccacccctacaca

SEQ ID NO: 6129284 - DNA, 23 bp, Homo sapiens
ctccttcccacccctacacacac

SEQ ID NO: 6129285 - DNA, 20 bp, Homo sapiens
ctccttcccactcttctcat

SEQ ID NO: 6129286 - DNA, 22 bp, Homo sapiens
ctccttcccagataaggcaagc

SEQ ID NO: 6129287 - DNA, 16 bp, Homo sapiens
ctccttcccagcaaca

SEQ ID NO: 6129288 - DNA, 13 bp, Homo sapiens
ctccttcccagct

SEQ ID NO: 6129289 - DNA, 14 bp, Homo sapiens
ctccttcccagctg

SEQ ID NO: 6129290 - DNA, 15 bp, Homo sapiens
ctccttcccagctgc

SEQ ID NO: 6129291 - DNA, 17 bp, Homo sapiens
ctccttcccatcgctgt

SEQ ID NO: 6129292 - DNA, 13 bp, Homo sapiens
ctccttcccatgc

SEQ ID NO: 6129293 - DNA, 16 bp, Homo sapiens
ctccttcccatgcctg

SEQ ID NO: 6129294 - DNA, 17 bp, Homo sapiens
ctccttcccatgcctgt

SEQ ID NO: 6129295 - DNA, 19 bp, Homo sapiens
ctccttcccattggctttc

SEQ ID NO: 6129296 - DNA, 22 bp, Homo sapiens
ctccttcccattggctttctct

SEQ ID NO: 6129297 - DNA, 14 bp, Homo sapiens
ctccttccccaccc

SEQ ID NO: 6129298 - DNA, 15 bp, Homo sapiens
ctccttccccacccc

SEQ ID NO: 6129299 - DNA, 13 bp, Homo sapiens
ctccttccccaga

SEQ ID NO: 6129300 - DNA, 14 bp, Homo sapiens
ctccttccccagct

SEQ ID NO: 6129301 - DNA, 16 bp, Homo sapiens
ctccttccccagctcc

SEQ ID NO: 6129302 - DNA, 14 bp, Homo sapiens
ctccttccccagga

SEQ ID NO: 6129303 - DNA, 15 bp, Homo sapiens
ctccttccccaggat

SEQ ID NO: 6129304 - DNA, 18 bp, Homo sapiens
ctccttccccccatctct

SEQ ID NO: 6129305 - DNA, 21 bp, Homo sapiens
ctccttccccccatctctgag

SEQ ID NO: 6129306 - DNA, 20 bp, Homo sapiens
ctccttccccgagtgactct

SEQ ID NO: 6129307 - DNA, 23 bp, Homo sapiens
ctccttcccctacacctccctcc

SEQ ID NO: 6129308 - DNA, 12 bp, Homo sapiens
ctccttcccctg

SEQ ID NO: 6129309 - DNA, 17 bp, Homo sapiens
ctccttcccctgcacct

SEQ ID NO: 6129310 - DNA, 23 bp, Homo sapiens
ctccttcccctgcacctggcctg

SEQ ID NO: 6129311 - DNA, 13 bp, Homo sapiens
ctccttcccctgt

SEQ ID NO: 6129312 - DNA, 18 bp, Homo sapiens
ctccttccccttgtccct

SEQ ID NO: 6129313 - DNA, 20 bp, Homo sapiens
ctccttccccttgtccctgg

SEQ ID NO: 6129314 - DNA, 15 bp, Homo sapiens
ctccttccctcctgt

SEQ ID NO: 6129315 - DNA, 13 bp, Homo sapiens
ctccttccctctc

SEQ ID NO: 6129316 - DNA, 17 bp, Homo sapiens
ctccttccctctctgga

SEQ ID NO: 6129317 - DNA, 18 bp, Homo sapiens
ctccttccctctctggag

SEQ ID NO: 6129318 - DNA, 23 bp, Homo sapiens
ctccttccctctttccccacctc

SEQ ID NO: 6129319 - DNA, 13 bp, Homo sapiens
ctccttcccttct

SEQ ID NO: 6129320 - DNA, 15 bp, Homo sapiens
ctccttcccttctct

SEQ ID NO: 6129321 - DNA, 19 bp, Homo sapiens
ctccttcccttctctcctt

SEQ ID NO: 6129322 - DNA, 17 bp, Homo sapiens
ctccttcccttgctacc

SEQ ID NO: 6129323 - DNA, 14 bp, Homo sapiens
ctccttccggggaa

SEQ ID NO: 6129324 - DNA, 20 bp, Homo sapiens
ctccttccggggaaggattt

SEQ ID NO: 6129325 - DNA, 17 bp, Homo sapiens
ctccttcctcagcctcc

SEQ ID NO: 6129326 - DNA, 22 bp, Homo sapiens
ctccttcctcagtcctggaagc

SEQ ID NO: 6129327 - DNA, 20 bp, Homo sapiens
ctccttcctctttgcttggg

SEQ ID NO: 6129328 - DNA, 16 bp, Homo sapiens
ctccttcctgccacct

SEQ ID NO: 6129329 - DNA, 13 bp, Homo sapiens
ctccttcctggag

SEQ ID NO: 6129330 - DNA, 12 bp, Homo sapiens
ctccttcctggg

SEQ ID NO: 6129331 - DNA, 12 bp, Homo sapiens
ctccttcctgtc

SEQ ID NO: 6129332 - DNA, 16 bp, Homo sapiens
ctccttcctgtcttcc

SEQ ID NO: 6129333 - DNA, 14 bp, Homo sapiens
ctccttcctgtggc

SEQ ID NO: 6129334 - DNA, 16 bp, Homo sapiens
ctccttcctgtggcct

SEQ ID NO: 6129335 - DNA, 23 bp, Homo sapiens
ctccttcctgtgggtggggcttc

SEQ ID NO: 6129336 - DNA, 14 bp, Homo sapiens
ctccttccttaccc

SEQ ID NO: 6129337 - DNA, 19 bp, Homo sapiens
ctccttccttacccaaact

SEQ ID NO: 6129338 - DNA, 14 bp, Homo sapiens
ctccttccttgacc

SEQ ID NO: 6129339 - DNA, 17 bp, Homo sapiens
ctccttcgctttcctga

SEQ ID NO: 6129340 - DNA, 20 bp, Homo sapiens
ctccttcgctttcctgagcc

SEQ ID NO: 6129341 - DNA, 19 bp, Homo sapiens
ctccttcgtgtctctccca

SEQ ID NO: 6129342 - DNA, 18 bp, Homo sapiens
ctccttctattttcccta

SEQ ID NO: 6129343 - DNA, 12 bp, Homo sapiens
ctccttctcccc

SEQ ID NO: 6129344 - DNA, 20 bp, Homo sapiens
ctccttctcccctccagacc

SEQ ID NO: 6129345 - DNA, 15 bp, Homo sapiens
ctccttctcccctgc

SEQ ID NO: 6129346 - DNA, 18 bp, Homo sapiens
ctccttctcctagctctg

SEQ ID NO: 6129347 - DNA, 15 bp, Homo sapiens
ctccttctccttccc

SEQ ID NO: 6129348 - DNA, 16 bp, Homo sapiens
ctccttctctgtctca

SEQ ID NO: 6129349 - DNA, 20 bp, Homo sapiens
ctccttctcttctcttcttt

SEQ ID NO: 6129350 - DNA, 12 bp, Homo sapiens
ctccttctgcaa

SEQ ID NO: 6129351 - DNA, 13 bp, Homo sapiens
ctccttctgcagt

SEQ ID NO: 6129352 - DNA, 20 bp, Homo sapiens
ctccttctgcagtcagactg

SEQ ID NO: 6129353 - DNA, 14 bp, Homo sapiens
ctccttctgtccta

SEQ ID NO: 6129354 - DNA, 11 bp, Homo sapiens
ctccttcttcc

SEQ ID NO: 6129355 - DNA, 15 bp, Homo sapiens
ctccttcttccactt

SEQ ID NO: 6129356 - DNA, 13 bp, Homo sapiens
ctccttcttccct

SEQ ID NO: 6129357 - DNA, 19 bp, Homo sapiens
ctccttcttgccctgagct

SEQ ID NO: 6129358 - DNA, 17 bp, Homo sapiens
ctccttgaagacatatc

SEQ ID NO: 6129359 - DNA, 13 bp, Homo sapiens
ctccttgaataag

SEQ ID NO: 6129360 - DNA, 20 bp, Homo sapiens
ctccttgagagaccaggcaa

SEQ ID NO: 6129361 - DNA, 15 bp, Homo sapiens
ctccttgagatcctg

SEQ ID NO: 6129362 - DNA, 17 bp, Homo sapiens
ctccttgagatcctgat

SEQ ID NO: 6129363 - DNA, 15 bp, Homo sapiens
ctccttgattacata

SEQ ID NO: 6129364 - DNA, 21 bp, Homo sapiens
ctccttgattttagccttctc

SEQ ID NO: 6129365 - DNA, 16 bp, Homo sapiens
ctccttgcaaccaggc

SEQ ID NO: 6129366 - DNA, 17 bp, Homo sapiens
ctccttgcaaccaggca

SEQ ID NO: 6129367 - DNA, 19 bp, Homo sapiens
ctccttgcaaccaggcagc

SEQ ID NO: 6129368 - DNA, 22 bp, Homo sapiens
ctccttgcaaccaggcagctga

SEQ ID NO: 6129369 - DNA, 14 bp, Homo sapiens
ctccttgcagcagg

SEQ ID NO: 6129370 - DNA, 17 bp, Homo sapiens
ctccttgcagcagggct

SEQ ID NO: 6129371 - DNA, 14 bp, Homo sapiens
ctccttgccagccc

SEQ ID NO: 6129372 - DNA, 19 bp, Homo sapiens
ctccttgccccagtcctgg

SEQ ID NO: 6129373 - DNA, 22 bp, Homo sapiens
ctccttgccccagtcctggttc

SEQ ID NO: 6129374 - DNA, 14 bp, Homo sapiens
ctccttgcccccag

SEQ ID NO: 6129375 - DNA, 13 bp, Homo sapiens
ctccttgccctgg

SEQ ID NO: 6129376 - DNA, 15 bp, Homo sapiens
ctccttgccctgggc

SEQ ID NO: 6129377 - DNA, 17 bp, Homo sapiens
ctccttgcctcctgtgt

SEQ ID NO: 6129378 - DNA, 18 bp, Homo sapiens
ctccttgcctcctgtgta

SEQ ID NO: 6129379 - DNA, 13 bp, Homo sapiens
ctccttgcctgga

SEQ ID NO: 6129380 - DNA, 16 bp, Homo sapiens
ctccttgcctggaact

SEQ ID NO: 6129381 - DNA, 18 bp, Homo sapiens
ctccttgccttgcttctc

SEQ ID NO: 6129382 - DNA, 17 bp, Homo sapiens
ctccttgctacccagaa

SEQ ID NO: 6129383 - DNA, 15 bp, Homo sapiens
ctccttgctgacccc

SEQ ID NO: 6129384 - DNA, 19 bp, Homo sapiens
ctccttgctgaccccaggt

SEQ ID NO: 6129385 - DNA, 20 bp, Homo sapiens
ctccttgctgaccccaggtc

SEQ ID NO: 6129386 - DNA, 15 bp, Homo sapiens
ctccttgcttcctga

SEQ ID NO: 6129387 - DNA, 13 bp, Homo sapiens
ctccttggaaatc

SEQ ID NO: 6129388 - DNA, 16 bp, Homo sapiens
ctccttggaaggtctt

SEQ ID NO: 6129389 - DNA, 18 bp, Homo sapiens
ctccttggaggacagtgg

SEQ ID NO: 6129390 - DNA, 15 bp, Homo sapiens
ctccttggcaccccc

SEQ ID NO: 6129391 - DNA, 16 bp, Homo sapiens
ctccttggcaccccca

SEQ ID NO: 6129392 - DNA, 14 bp, Homo sapiens
ctccttggccacag

SEQ ID NO: 6129393 - DNA, 11 bp, Homo sapiens
ctccttggcct

SEQ ID NO: 6129394 - DNA, 14 bp, Homo sapiens
ctccttggcctagc

SEQ ID NO: 6129395 - DNA, 19 bp, Homo sapiens
ctccttggcctttcctgga

SEQ ID NO: 6129396 - DNA, 20 bp, Homo sapiens
ctccttggcctttcctggaa

SEQ ID NO: 6129397 - DNA, 16 bp, Homo sapiens
ctccttggctgcagcc

SEQ ID NO: 6129398 - DNA, 17 bp, Homo sapiens
ctccttggctgcagcca

SEQ ID NO: 6129399 - DNA, 22 bp, Homo sapiens
ctccttggctgtctgtgggccg

SEQ ID NO: 6129400 - DNA, 20 bp, Homo sapiens
ctccttggcttacctgacct

SEQ ID NO: 6129401 - DNA, 19 bp, Homo sapiens
ctaaatccattttctaaac

SEQ ID NO: 6129402 - DNA, 17 bp, Homo sapiens
ctaaatcccaagaaatg

SEQ ID NO: 6129403 - DNA, 20 bp, Homo sapiens
ctaaatccttttgttttgaa

SEQ ID NO: 6129404 - DNA, 16 bp, Homo sapiens
ctaaatctagactcaa

SEQ ID NO: 6129405 - DNA, 19 bp, Homo sapiens
ctaaatctatttattaata

SEQ ID NO: 6129406 - DNA, 21 bp, Homo sapiens
ctaaatctccaaaataaaact

SEQ ID NO: 6129407 - DNA, 13 bp, Homo sapiens
ctaaatcttcctt

SEQ ID NO: 6129408 - DNA, 15 bp, Homo sapiens
ctaaatctttttgct

SEQ ID NO: 6129409 - DNA, 15 bp, Homo sapiens
ctaaatgaaaagaga

SEQ ID NO: 6129410 - DNA, 22 bp, Homo sapiens
ctaaatgaaaatcgtgacaaca

SEQ ID NO: 6129411 - DNA, 12 bp, Homo sapiens
ctaaatgaagag

SEQ ID NO: 6129412 - DNA, 13 bp, Homo sapiens
ctaaatgaagtgc

SEQ ID NO: 6129413 - DNA, 21 bp, Homo sapiens
ctaaatgaatgagccaaaatg

SEQ ID NO: 6129414 - DNA, 13 bp, Homo sapiens
ctaaatgacctca

SEQ ID NO: 6129415 - DNA, 17 bp, Homo sapiens
ctaaatgacctcagcaa

SEQ ID NO: 6129416 - DNA, 16 bp, Homo sapiens
ctaaatgacttattga

SEQ ID NO: 6129417 - DNA, 22 bp, Homo sapiens
ctaaatgacttgcagatgaaaa

SEQ ID NO: 6129418 - DNA, 12 bp, Homo sapiens
ctaaatgatggt

SEQ ID NO: 6129419 - DNA, 20 bp, Homo sapiens
ctaaatgcaaacactgtgta

SEQ ID NO: 6129420 - DNA, 11 bp, Homo sapiens
ctaaatgcaat

SEQ ID NO: 6129421 - DNA, 12 bp, Homo sapiens
ctaaatgcaata

SEQ ID NO: 6129422 - DNA, 19 bp, Homo sapiens
ctaaatgcaataagattta

SEQ ID NO: 6129423 - DNA, 21 bp, Homo sapiens
ctaaatgcatatcctgagcca

SEQ ID NO: 6129424 - DNA, 22 bp, Homo sapiens
ctaaatgcatatcctgagccat

SEQ ID NO: 6129425 - DNA, 18 bp, Homo sapiens
ctaaatgccatgtttatc

SEQ ID NO: 6129426 - DNA, 13 bp, Homo sapiens
ctaaatgccctgc

SEQ ID NO: 6129427 - DNA, 17 bp, Homo sapiens
ctaaatgcctagttttt

SEQ ID NO: 6129428 - DNA, 20 bp, Homo sapiens
ctaaatgcctagtttttagt

SEQ ID NO: 6129429 - DNA, 15 bp, Homo sapiens
ctaaatgctgaaaaa

SEQ ID NO: 6129430 - DNA, 23 bp, Homo sapiens
ctaaatgctggtctaggagctgt

SEQ ID NO: 6129431 - DNA, 17 bp, Homo sapiens
ctaaatggagaaagctg

SEQ ID NO: 6129432 - DNA, 12 bp, Homo sapiens
ctaaatggcctc

SEQ ID NO: 6129433 - DNA, 16 bp, Homo sapiens
ctaaatggcctcatgt

SEQ ID NO: 6129434 - DNA, 20 bp, Homo sapiens
ctaaatggtcgcccaggaga

SEQ ID NO: 6129435 - DNA, 12 bp, Homo sapiens
ctaaatgtaaaa

SEQ ID NO: 6129436 - DNA, 14 bp, Homo sapiens
ctaaatgtaacagt

SEQ ID NO: 6129437 - DNA, 16 bp, Homo sapiens
ctaaatgtaacagtct

SEQ ID NO: 6129438 - DNA, 18 bp, Homo sapiens
ctaaatgtaacagtctga

SEQ ID NO: 6129439 - DNA, 18 bp, Homo sapiens
ctaaatgtgcaatagaag

SEQ ID NO: 6129440 - DNA, 22 bp, Homo sapiens
ctaaatgtggacatcatgaagc

SEQ ID NO: 6129441 - DNA, 19 bp, Homo sapiens
ctaaatgtgtaataatgta

SEQ ID NO: 6129442 - DNA, 14 bp, Homo sapiens
ctaaatgtgtacac

SEQ ID NO: 6129443 - DNA, 16 bp, Homo sapiens
ctaaatgttaaagatg

SEQ ID NO: 6129444 - DNA, 23 bp, Homo sapiens
ctaaatgttaaagatgtagcaaa

SEQ ID NO: 6129445 - DNA, 13 bp, Homo sapiens
ctaaatgttcatg

SEQ ID NO: 6129446 - DNA, 17 bp, Homo sapiens
ctaaatgtttaaagaaa

SEQ ID NO: 6129447 - DNA, 13 bp, Homo sapiens
ctaaatgtttctt

SEQ ID NO: 6129448 - DNA, 18 bp, Homo sapiens
ctaaatgtttctttttct

SEQ ID NO: 6129449 - DNA, 12 bp, Homo sapiens
ctaaattaaaaa

SEQ ID NO: 6129450 - DNA, 15 bp, Homo sapiens
ctaaattaaaaaaga

SEQ ID NO: 6129451 - DNA, 16 bp, Homo sapiens
ctaaattaaaaaagaa

SEQ ID NO: 6129452 - DNA, 17 bp, Homo sapiens
ctaaattaacaaattca

SEQ ID NO: 6129453 - DNA, 13 bp, Homo sapiens
ctaaattactgtt

SEQ ID NO: 6129454 - DNA, 14 bp, Homo sapiens
ctaaattataaaat

SEQ ID NO: 6129455 - DNA, 21 bp, Homo sapiens
ctaaattataaaattgaaaac

SEQ ID NO: 6129456 - DNA, 23 bp, Homo sapiens
ctaaattataaaattgaaaacac

SEQ ID NO: 6129457 - DNA, 22 bp, Homo sapiens
ctaaattatagtgtagaaaaga

SEQ ID NO: 6129458 - DNA, 15 bp, Homo sapiens
ctaaattatttactg

SEQ ID NO: 6129459 - DNA, 17 bp, Homo sapiens
ctaaattcactgttgaa

SEQ ID NO: 6129460 - DNA, 16 bp, Homo sapiens
ctaaattctataaaaa

SEQ ID NO: 6129461 - DNA, 17 bp, Homo sapiens
ctaaattctttatttct

SEQ ID NO: 6129462 - DNA, 19 bp, Homo sapiens
ctaaattctttcattttag

SEQ ID NO: 6129463 - DNA, 13 bp, Homo sapiens
ctaaattgaataa

SEQ ID NO: 6129464 - DNA, 23 bp, Homo sapiens
ctaaattgacacttaaaaatggt

SEQ ID NO: 6129465 - DNA, 12 bp, Homo sapiens
ctaaattgcagt

SEQ ID NO: 6129466 - DNA, 20 bp, Homo sapiens
ctaaattgcagtttacagta

SEQ ID NO: 6129467 - DNA, 23 bp, Homo sapiens
ctaaattgcagtttacagtattt

SEQ ID NO: 6129468 - DNA, 22 bp, Homo sapiens
ctaaattggctccatatcattt

SEQ ID NO: 6129469 - DNA, 14 bp, Homo sapiens
ctaaattgtaaact

SEQ ID NO: 6129470 - DNA, 18 bp, Homo sapiens
ctaaattgtaaactcctg

SEQ ID NO: 6129471 - DNA, 21 bp, Homo sapiens
ctaaattgtatacattttgtt

SEQ ID NO: 6129472 - DNA, 17 bp, Homo sapiens
ctaaattgtctgccatt

SEQ ID NO: 6129473 - DNA, 20 bp, Homo sapiens
ctaaattgtctgccattaca

SEQ ID NO: 6129474 - DNA, 19 bp, Homo sapiens
ctaaattgttgtaattgca

SEQ ID NO: 6129475 - DNA, 13 bp, Homo sapiens
ctaaatttaatta

SEQ ID NO: 6129476 - DNA, 19 bp, Homo sapiens
ctaaatttacgtatatttc

SEQ ID NO: 6129477 - DNA, 16 bp, Homo sapiens
ctaaatttatattcat

SEQ ID NO: 6129478 - DNA, 13 bp, Homo sapiens
ctaaatttcacta

SEQ ID NO: 6129479 - DNA, 20 bp, Homo sapiens
ctaaatttcccaattttctg

SEQ ID NO: 6129480 - DNA, 14 bp, Homo sapiens
ctaaatttcttcct

SEQ ID NO: 6129481 - DNA, 14 bp, Homo sapiens
ctaaatttgataat

SEQ ID NO: 6129482 - DNA, 13 bp, Homo sapiens
ctaaatttgggga

SEQ ID NO: 6129483 - DNA, 12 bp, Homo sapiens
ctaaattttcta

SEQ ID NO: 6129484 - DNA, 15 bp, Homo sapiens
ctaaattttctaaat

SEQ ID NO: 6129485 - DNA, 12 bp, Homo sapiens
ctaaattttctt

SEQ ID NO: 6129486 - DNA, 15 bp, Homo sapiens
ctaaattttgttact

SEQ ID NO: 6129487 - DNA, 19 bp, Homo sapiens
ctaaatttttaactgcctt

SEQ ID NO: 6129488 - DNA, 19 bp, Homo sapiens
ctaacaaaaagcaattact

SEQ ID NO: 6129489 - DNA, 20 bp, Homo sapiens
ctaacaaaagatgaaagcag

SEQ ID NO: 6129490 - DNA, 13 bp, Homo sapiens
ctaacaaaataag

SEQ ID NO: 6129491 - DNA, 22 bp, Homo sapiens
ctaacaaaatttgaataataaa

SEQ ID NO: 6129492 - DNA, 13 bp, Homo sapiens
ctaacaaactaga

SEQ ID NO: 6129493 - DNA, 14 bp, Homo sapiens
ctaacaaaggcagc

SEQ ID NO: 6129494 - DNA, 19 bp, Homo sapiens
ctaacaaaggcagctgtgt

SEQ ID NO: 6129495 - DNA, 20 bp, Homo sapiens
ctaacaaaggcagctgtgtc

SEQ ID NO: 6129496 - DNA, 22 bp, Homo sapiens
ctaacaagtcataggttaatat

SEQ ID NO: 6129497 - DNA, 20 bp, Homo sapiens
ctaacaatatgattgcacta

SEQ ID NO: 6129498 - DNA, 23 bp, Homo sapiens
ctaacaatatgattgcactaaat

SEQ ID NO: 6129499 - DNA, 15 bp, Homo sapiens
ctaacaatgacattt

SEQ ID NO: 6129500 - DNA, 17 bp, Homo sapiens
ctaacacacacagaaaa

SEQ ID NO: 6129501 - DNA, 15 bp, Homo sapiens
ctaacacacagctcc

SEQ ID NO: 6129502 - DNA, 16 bp, Homo sapiens
ctaacacagcatgtgt

SEQ ID NO: 6129503 - DNA, 13 bp, Homo sapiens
ctaacacatttcg

SEQ ID NO: 6129504 - DNA, 12 bp, Homo sapiens
ctaacaccacac

SEQ ID NO: 6129505 - DNA, 17 bp, Homo sapiens
ctaacaccacactgacc

SEQ ID NO: 6129506 - DNA, 15 bp, Homo sapiens
ctaacaccagacaga

SEQ ID NO: 6129507 - DNA, 17 bp, Homo sapiens
ctaacacctgcctaggt

SEQ ID NO: 6129508 - DNA, 14 bp, Homo sapiens
ctaacactggcccc

SEQ ID NO: 6129509 - DNA, 15 bp, Homo sapiens
ctaacactggcccct

SEQ ID NO: 6129510 - DNA, 18 bp, Homo sapiens
ctaacagataagcaagag

SEQ ID NO: 6129511 - DNA, 17 bp, Homo sapiens
ctaacagctacaaactt

SEQ ID NO: 6129512 - DNA, 17 bp, Homo sapiens
ctaacagctgaagtaat

SEQ ID NO: 6129513 - DNA, 17 bp, Homo sapiens
ctaacaggaattttcat

SEQ ID NO: 6129514 - DNA, 17 bp, Homo sapiens
ctaacagggaaggcagg

SEQ ID NO: 6129515 - DNA, 12 bp, Homo sapiens
ctaacagggaga

SEQ ID NO: 6129516 - DNA, 23 bp, Homo sapiens
ctaacagggagaagtagctagta

SEQ ID NO: 6129517 - DNA, 19 bp, Homo sapiens
ctaacaggggctggtgggc

SEQ ID NO: 6129518 - DNA, 12 bp, Homo sapiens
ctaacagtcctt

SEQ ID NO: 6129519 - DNA, 17 bp, Homo sapiens
ctaacagtccttgcttt

SEQ ID NO: 6129520 - DNA, 20 bp, Homo sapiens
ctaacagtgaagttttactg

SEQ ID NO: 6129521 - DNA, 15 bp, Homo sapiens
ctaacagttgccaca

SEQ ID NO: 6129522 - DNA, 17 bp, Homo sapiens
ctaacagttgccacatc

SEQ ID NO: 6129523 - DNA, 17 bp, Homo sapiens
ctaacagtttgcctgct

SEQ ID NO: 6129524 - DNA, 17 bp, Homo sapiens
ctaacataaaatctgtg

SEQ ID NO: 6129525 - DNA, 18 bp, Homo sapiens
ctaacataaaatctgtga

SEQ ID NO: 6129526 - DNA, 19 bp, Homo sapiens
ctaacataccgtttataat

SEQ ID NO: 6129527 - DNA, 20 bp, Homo sapiens
ctaacatagtgtctgctgct

SEQ ID NO: 6129528 - DNA, 15 bp, Homo sapiens
ctaacatatgtatta

SEQ ID NO: 6129529 - DNA, 16 bp, Homo sapiens
ctaacatatgtattaa

SEQ ID NO: 6129530 - DNA, 21 bp, Homo sapiens
ctaacatcatgcattcacaag

SEQ ID NO: 6129531 - DNA, 15 bp, Homo sapiens
ctaacatcccaataa

SEQ ID NO: 6129532 - DNA, 22 bp, Homo sapiens
ctaacatcccaataaagtcctc

SEQ ID NO: 6129533 - DNA, 13 bp, Homo sapiens
ctaacatctttac

SEQ ID NO: 6129534 - DNA, 16 bp, Homo sapiens
ctaacatgaagacctt

SEQ ID NO: 6129535 - DNA, 15 bp, Homo sapiens
ctaacatggaagtac

SEQ ID NO: 6129536 - DNA, 17 bp, Homo sapiens
ctaacatggaagtacta

SEQ ID NO: 6129537 - DNA, 17 bp, Homo sapiens
ctaacatggtaaaaccc

SEQ ID NO: 6129538 - DNA, 22 bp, Homo sapiens
ctaacatggtgaaaccccgtct

SEQ ID NO: 6129539 - DNA, 16 bp, Homo sapiens
ctaacatggtttaaaa

SEQ ID NO: 6129540 - DNA, 20 bp, Homo sapiens
ctaacatgttatcaaatctg

SEQ ID NO: 6129541 - DNA, 17 bp, Homo sapiens
ctaacattatattgcaa

SEQ ID NO: 6129542 - DNA, 17 bp, Homo sapiens
ctaacatttaggagaag

SEQ ID NO: 6129543 - DNA, 11 bp, Homo sapiens
ctaacatttcc

SEQ ID NO: 6129544 - DNA, 21 bp, Homo sapiens
ctaacatttcccccgagctct

SEQ ID NO: 6129545 - DNA, 10 bp, Homo sapiens
ctaacatttg

SEQ ID NO: 6129546 - DNA, 19 bp, Homo sapiens
ctaacatttgataattttg

SEQ ID NO: 6129547 - DNA, 20 bp, Homo sapiens
ctaacatttgataattttga

SEQ ID NO: 6129548 - DNA, 22 bp, Homo sapiens
ctaacatttgcaaaatggaaat

SEQ ID NO: 6129549 - DNA, 18 bp, Homo sapiens
ctaacattttaaataaaa

SEQ ID NO: 6129550 - DNA, 21 bp, Homo sapiens
ctaacattttaaataaaagaa

SEQ ID NO: 6129551 - DNA, 19 bp, Homo sapiens
ctaacatttttgaggaagt

SEQ ID NO: 6129552 - DNA, 21 bp, Homo sapiens
ctaaccaaagagtctctggct

SEQ ID NO: 6129553 - DNA, 19 bp, Homo sapiens
ctaaccaaattctccctgg

SEQ ID NO: 6129554 - DNA, 16 bp, Homo sapiens
ctaaccaagaggctgg

SEQ ID NO: 6129555 - DNA, 17 bp, Homo sapiens
ctaaccaagaggctggt

SEQ ID NO: 6129556 - DNA, 19 bp, Homo sapiens
ctaaccaaggctgtgttta

SEQ ID NO: 6129557 - DNA, 21 bp, Homo sapiens
ctaaccaaggctgtgtttaga

SEQ ID NO: 6129558 - DNA, 14 bp, Homo sapiens
ctaaccacacagcc

SEQ ID NO: 6129559 - DNA, 13 bp, Homo sapiens
ctaaccacatcaa

SEQ ID NO: 6129560 - DNA, 20 bp, Homo sapiens
ctaaccacgtctgtcttcac

SEQ ID NO: 6129561 - DNA, 17 bp, Homo sapiens
ctaaccactaacattgt

SEQ ID NO: 6129562 - DNA, 14 bp, Homo sapiens
ctaaccaggcccag

SEQ ID NO: 6129563 - DNA, 15 bp, Homo sapiens
ctaaccaggcccagc

SEQ ID NO: 6129564 - DNA, 16 bp, Homo sapiens
ctaaccaggcccagcc

SEQ ID NO: 6129565 - DNA, 17 bp, Homo sapiens
ctaaccaggcccagcca

SEQ ID NO: 6129566 - DNA, 12 bp, Homo sapiens
ctaaccagggcc

SEQ ID NO: 6129567 - DNA, 20 bp, Homo sapiens
ctaaccagtacctctgtata

SEQ ID NO: 6129568 - DNA, 16 bp, Homo sapiens
ctaaccatccccaact

SEQ ID NO: 6129569 - DNA, 17 bp, Homo sapiens
ctaaccatccccaactc

SEQ ID NO: 6129570 - DNA, 21 bp, Homo sapiens
ctaaccatccccaactccatg

SEQ ID NO: 6129571 - DNA, 23 bp, Homo sapiens
ctaaccatgggctcagggccagg

SEQ ID NO: 6129572 - DNA, 20 bp, Homo sapiens
ctaaccattaagtcatgtgt

SEQ ID NO: 6129573 - DNA, 13 bp, Homo sapiens
ctaacccagcagt

SEQ ID NO: 6129574 - DNA, 13 bp, Homo sapiens
ctaacccagtctt

SEQ ID NO: 6129575 - DNA, 14 bp, Homo sapiens
ctaacccagtcttt

SEQ ID NO: 6129576 - DNA, 22 bp, Homo sapiens
ctaaccccaacgcacaggaaaa

SEQ ID NO: 6129577 - DNA, 15 bp, Homo sapiens
ctaaccccagctgcc

SEQ ID NO: 6129578 - DNA, 20 bp, Homo sapiens
ctaaccccagctgccggcag

SEQ ID NO: 6129579 - DNA, 13 bp, Homo sapiens
ctaaccccaggcc

SEQ ID NO: 6129580 - DNA, 16 bp, Homo sapiens
ctaaccccaggccccg

SEQ ID NO: 6129581 - DNA, 14 bp, Homo sapiens
ctccttgggaggaa

SEQ ID NO: 6129582 - DNA, 22 bp, Homo sapiens
ctccttgggaggaagcagaata

SEQ ID NO: 6129583 - DNA, 16 bp, Homo sapiens
ctccttgggaggcccc

SEQ ID NO: 6129584 - DNA, 22 bp, Homo sapiens
ctccttgggaggccccactggg

SEQ ID NO: 6129585 - DNA, 13 bp, Homo sapiens
ctccttgggcagg

SEQ ID NO: 6129586 - DNA, 12 bp, Homo sapiens
ctccttgggccc

SEQ ID NO: 6129587 - DNA, 13 bp, Homo sapiens
ctccttgggccct

SEQ ID NO: 6129588 - DNA, 15 bp, Homo sapiens
ctccttgggcccttt

SEQ ID NO: 6129589 - DNA, 22 bp, Homo sapiens
ctccttgggccctttttccctt

SEQ ID NO: 6129590 - DNA, 13 bp, Homo sapiens
ctccttgggctcc

SEQ ID NO: 6129591 - DNA, 17 bp, Homo sapiens
ctccttgggctcctggc

SEQ ID NO: 6129592 - DNA, 21 bp, Homo sapiens
ctccttgggctcctggctgcc

SEQ ID NO: 6129593 - DNA, 22 bp, Homo sapiens
ctccttgggctcctggctgcca

SEQ ID NO: 6129594 - DNA, 22 bp, Homo sapiens
ctccttggggcagggcctgggc

SEQ ID NO: 6129595 - DNA, 21 bp, Homo sapiens
ctccttggtgattccgcagtg

SEQ ID NO: 6129596 - DNA, 13 bp, Homo sapiens
ctccttggtgcct

SEQ ID NO: 6129597 - DNA, 14 bp, Homo sapiens
ctccttggtgcctc

SEQ ID NO: 6129598 - DNA, 19 bp, Homo sapiens
ctccttggtgcctggcctg

SEQ ID NO: 6129599 - DNA, 16 bp, Homo sapiens
ctccttggtttgctag

SEQ ID NO: 6129600 - DNA, 22 bp, Homo sapiens
ctccttgtcacagaatctccat

SEQ ID NO: 6129601 - DNA, 19 bp, Homo sapiens
ctccttgtcactgaagatt

SEQ ID NO: 6129602 - DNA, 21 bp, Homo sapiens
ctccttgtcagggtctccttc

SEQ ID NO: 6129603 - DNA, 19 bp, Homo sapiens
ctccttgtctagtttccca

SEQ ID NO: 6129604 - DNA, 13 bp, Homo sapiens
ctccttgtgcaat

SEQ ID NO: 6129605 - DNA, 14 bp, Homo sapiens
ctccttgtgcaatt

SEQ ID NO: 6129606 - DNA, 14 bp, Homo sapiens
ctccttgtgccaga

SEQ ID NO: 6129607 - DNA, 16 bp, Homo sapiens
ctccttgtggactggc

SEQ ID NO: 6129608 - DNA, 20 bp, Homo sapiens
ctccttgtggactggctgtg

SEQ ID NO: 6129609 - DNA, 15 bp, Homo sapiens
ctccttgtggcctat

SEQ ID NO: 6129610 - DNA, 17 bp, Homo sapiens
ctccttgtggcctatga

SEQ ID NO: 6129611 - DNA, 23 bp, Homo sapiens
ctccttgtggccttttttataac

SEQ ID NO: 6129612 - DNA, 19 bp, Homo sapiens
ctccttgtgggcctgggct

SEQ ID NO: 6129613 - DNA, 22 bp, Homo sapiens
ctccttgtgttgcactgaacag

SEQ ID NO: 6129614 - DNA, 23 bp, Homo sapiens
ctccttgtgttgcactgaacagg

SEQ ID NO: 6129615 - DNA, 23 bp, Homo sapiens
ctccttgttgttctttaaccctc

SEQ ID NO: 6129616 - DNA, 22 bp, Homo sapiens
ctcctttaacccaatggagact

SEQ ID NO: 6129617 - DNA, 13 bp, Homo sapiens
ctcctttaattgt

SEQ ID NO: 6129618 - DNA, 21 bp, Homo sapiens
ctcctttacaaccatacttta

SEQ ID NO: 6129619 - DNA, 12 bp, Homo sapiens
ctcctttaccag

SEQ ID NO: 6129620 - DNA, 14 bp, Homo sapiens
ctcctttagcaggt

SEQ ID NO: 6129621 - DNA, 22 bp, Homo sapiens
ctcctttagcgcccagttgggt

SEQ ID NO: 6129622 - DNA, 17 bp, Homo sapiens
ctcctttagggacagct

SEQ ID NO: 6129623 - DNA, 23 bp, Homo sapiens
ctcctttatctgtaattgtaatt

SEQ ID NO: 6129624 - DNA, 18 bp, Homo sapiens
ctcctttattgctcctgt

SEQ ID NO: 6129625 - DNA, 17 bp, Homo sapiens
ctcctttcacaaccttc

SEQ ID NO: 6129626 - DNA, 12 bp, Homo sapiens
ctcctttcacca

SEQ ID NO: 6129627 - DNA, 16 bp, Homo sapiens
ctcctttcaccacccc

SEQ ID NO: 6129628 - DNA, 16 bp, Homo sapiens
ctcctttcagccacat

SEQ ID NO: 6129629 - DNA, 14 bp, Homo sapiens
ctcctttcagggcc

SEQ ID NO: 6129630 - DNA, 15 bp, Homo sapiens
ctcctttccaaataa

SEQ ID NO: 6129631 - DNA, 18 bp, Homo sapiens
ctcctttccataaatcct

SEQ ID NO: 6129632 - DNA, 17 bp, Homo sapiens
ctcctttccatcagctt

SEQ ID NO: 6129633 - DNA, 21 bp, Homo sapiens
ctcctttccatcagctttata

SEQ ID NO: 6129634 - DNA, 15 bp, Homo sapiens
ctcctttcccacagt

SEQ ID NO: 6129635 - DNA, 18 bp, Homo sapiens
ctcctttccccttccttt

SEQ ID NO: 6129636 - DNA, 22 bp, Homo sapiens
ctcctttccccttccttttaag

SEQ ID NO: 6129637 - DNA, 18 bp, Homo sapiens
ctcctttcccctttctct

SEQ ID NO: 6129638 - DNA, 19 bp, Homo sapiens
ctcctttcccctttctctt

SEQ ID NO: 6129639 - DNA, 12 bp, Homo sapiens
ctcctttccctt

SEQ ID NO: 6129640 - DNA, 16 bp, Homo sapiens
ctcctttcctttgccc

SEQ ID NO: 6129641 - DNA, 17 bp, Homo sapiens
ctcctttctccacaccc

SEQ ID NO: 6129642 - DNA, 14 bp, Homo sapiens
ctcctttctccagc

SEQ ID NO: 6129643 - DNA, 14 bp, Homo sapiens
ctcctttctccctg

SEQ ID NO: 6129644 - DNA, 14 bp, Homo sapiens
ctcctttctcctgt

SEQ ID NO: 6129645 - DNA, 11 bp, Homo sapiens
ctcctttctct

SEQ ID NO: 6129646 - DNA, 23 bp, Homo sapiens
ctcctttctctatcccaagccaa

SEQ ID NO: 6129647 - DNA, 15 bp, Homo sapiens
ctcctttctctgtat

SEQ ID NO: 6129648 - DNA, 16 bp, Homo sapiens
ctcctttctctgtata

SEQ ID NO: 6129649 - DNA, 17 bp, Homo sapiens
ctcctttctctgtatat

SEQ ID NO: 6129650 - DNA, 18 bp, Homo sapiens
ctcctttctgagggcccg

SEQ ID NO: 6129651 - DNA, 14 bp, Homo sapiens
ctcctttctgccca

SEQ ID NO: 6129652 - DNA, 15 bp, Homo sapiens
ctcctttctgcccag

SEQ ID NO: 6129653 - DNA, 18 bp, Homo sapiens
ctcctttctgtcctggag

SEQ ID NO: 6129654 - DNA, 12 bp, Homo sapiens
ctcctttctgtg

SEQ ID NO: 6129655 - DNA, 13 bp, Homo sapiens
ctcctttctgtgc

SEQ ID NO: 6129656 - DNA, 16 bp, Homo sapiens
ctcctttctgtgccct

SEQ ID NO: 6129657 - DNA, 20 bp, Homo sapiens
ctcctttgcaatagcagtta

SEQ ID NO: 6129658 - DNA, 14 bp, Homo sapiens
ctcctttgcactga

SEQ ID NO: 6129659 - DNA, 22 bp, Homo sapiens
ctcctttgcactgagggccaca

SEQ ID NO: 6129660 - DNA, 22 bp, Homo sapiens
ctcctttgcatggcagggcctc

SEQ ID NO: 6129661 - DNA, 23 bp, Homo sapiens
ctcctttgcctaggaggccttct

SEQ ID NO: 6129662 - DNA, 14 bp, Homo sapiens
ctcctttgcctctg

SEQ ID NO: 6129663 - DNA, 16 bp, Homo sapiens
ctcctttgcctctgct

SEQ ID NO: 6129664 - DNA, 16 bp, Homo sapiens
ctcctttgctcttgcc

SEQ ID NO: 6129665 - DNA, 19 bp, Homo sapiens
ctcctttggaaggtgacac

SEQ ID NO: 6129666 - DNA, 16 bp, Homo sapiens
ctcctttggaccctgt

SEQ ID NO: 6129667 - DNA, 19 bp, Homo sapiens
ctcctttggcatgtttaat

SEQ ID NO: 6129668 - DNA, 20 bp, Homo sapiens
ctcctttggcatgtttaatt

SEQ ID NO: 6129669 - DNA, 17 bp, Homo sapiens
ctcctttggccattcca

SEQ ID NO: 6129670 - DNA, 13 bp, Homo sapiens
ctcctttgtactt

SEQ ID NO: 6129671 - DNA, 12 bp, Homo sapiens
ctcctttgtata

SEQ ID NO: 6129672 - DNA, 17 bp, Homo sapiens
ctcctttgtattctgtc

SEQ ID NO: 6129673 - DNA, 19 bp, Homo sapiens
ctcctttgtattctgtctt

SEQ ID NO: 6129674 - DNA, 16 bp, Homo sapiens
ctcctttgtcaaatgg

SEQ ID NO: 6129675 - DNA, 17 bp, Homo sapiens
ctcctttgtgtggctgc

SEQ ID NO: 6129676 - DNA, 21 bp, Homo sapiens
ctcctttgtttaataaaggct

SEQ ID NO: 6129677 - DNA, 11 bp, Homo sapiens
ctccttttaaa

SEQ ID NO: 6129678 - DNA, 14 bp, Homo sapiens
ctccttttaaaatt

SEQ ID NO: 6129679 - DNA, 18 bp, Homo sapiens
ctccttttaaaattttgt

SEQ ID NO: 6129680 - DNA, 14 bp, Homo sapiens
ctccttttaaagaa

SEQ ID NO: 6129681 - DNA, 23 bp, Homo sapiens
ctccttttaaagaaaaaaattga

SEQ ID NO: 6129682 - DNA, 20 bp, Homo sapiens
ctccttttatctggtgcctc

SEQ ID NO: 6129683 - DNA, 23 bp, Homo sapiens
ctccttttatctggtgcctcctc

SEQ ID NO: 6129684 - DNA, 17 bp, Homo sapiens
ctccttttccagagcat

SEQ ID NO: 6129685 - DNA, 13 bp, Homo sapiens
ctccttttcccaa

SEQ ID NO: 6129686 - DNA, 12 bp, Homo sapiens
ctccttttccta

SEQ ID NO: 6129687 - DNA, 12 bp, Homo sapiens
ctccttttctct

SEQ ID NO: 6129688 - DNA, 15 bp, Homo sapiens
ctccttttctgtgaa

SEQ ID NO: 6129689 - DNA, 21 bp, Homo sapiens
ctccttttctgtgaagccctt

SEQ ID NO: 6129690 - DNA, 14 bp, Homo sapiens
ctccttttcttcta

SEQ ID NO: 6129691 - DNA, 17 bp, Homo sapiens
ctccttttcttttgtta

SEQ ID NO: 6129692 - DNA, 22 bp, Homo sapiens
ctccttttgcgcttatttggaa

SEQ ID NO: 6129693 - DNA, 15 bp, Homo sapiens
ctccttttgctcttt

SEQ ID NO: 6129694 - DNA, 16 bp, Homo sapiens
ctccttttggaacccc

SEQ ID NO: 6129695 - DNA, 16 bp, Homo sapiens
ctccttttggctgggg

SEQ ID NO: 6129696 - DNA, 17 bp, Homo sapiens
ctccttttgtatcttcc

SEQ ID NO: 6129697 - DNA, 20 bp, Homo sapiens
ctccttttgtatcttccttt

SEQ ID NO: 6129698 - DNA, 20 bp, Homo sapiens
ctccttttgtccccagggcc

SEQ ID NO: 6129699 - DNA, 16 bp, Homo sapiens
ctcctttttattttag

SEQ ID NO: 6129700 - DNA, 18 bp, Homo sapiens
ctcctttttctccctctg

SEQ ID NO: 6129701 - DNA, 15 bp, Homo sapiens
ctcgaaacacagaaa

SEQ ID NO: 6129702 - DNA, 13 bp, Homo sapiens
ctcgaaactgaca

SEQ ID NO: 6129703 - DNA, 20 bp, Homo sapiens
ctcgaaactgacagtattaa

SEQ ID NO: 6129704 - DNA, 22 bp, Homo sapiens
ctcgaacatggaactcattcct

SEQ ID NO: 6129705 - DNA, 14 bp, Homo sapiens
ctcgaaccaaggca

SEQ ID NO: 6129706 - DNA, 19 bp, Homo sapiens
ctcgaaccaaggcagcctc

SEQ ID NO: 6129707 - DNA, 14 bp, Homo sapiens
ctcgaacccactcc

SEQ ID NO: 6129708 - DNA, 17 bp, Homo sapiens
ctcgaactcctgacctt

SEQ ID NO: 6129709 - DNA, 14 bp, Homo sapiens
ctcgaactcctggg

SEQ ID NO: 6129710 - DNA, 15 bp, Homo sapiens
ctcgaactcctgggc

SEQ ID NO: 6129711 - DNA, 13 bp, Homo sapiens
ctcgaactcggga

SEQ ID NO: 6129712 - DNA, 14 bp, Homo sapiens
ctcgaactggctgc

SEQ ID NO: 6129713 - DNA, 15 bp, Homo sapiens
ctcgaactggctgca

SEQ ID NO: 6129714 - DNA, 15 bp, Homo sapiens
ctcgaagcccttcca

SEQ ID NO: 6129715 - DNA, 19 bp, Homo sapiens
ctcgaagcccttccagtgg

SEQ ID NO: 6129716 - DNA, 12 bp, Homo sapiens
ctcgaagcgcgc

SEQ ID NO: 6129717 - DNA, 14 bp, Homo sapiens
ctcgaagctgttct

SEQ ID NO: 6129718 - DNA, 18 bp, Homo sapiens
ctcgaagctgttctctgc

SEQ ID NO: 6129719 - DNA, 13 bp, Homo sapiens
ctcgaatctctgt

SEQ ID NO: 6129720 - DNA, 18 bp, Homo sapiens
ctcgaatctctgtgcctt

SEQ ID NO: 6129721 - DNA, 21 bp, Homo sapiens
ctcgaatgaaaagctgctggt

SEQ ID NO: 6129722 - DNA, 14 bp, Homo sapiens
ctcgaatgtaattg

SEQ ID NO: 6129723 - DNA, 21 bp, Homo sapiens
ctcgaatgtgtgggcccaagg

SEQ ID NO: 6129724 - DNA, 14 bp, Homo sapiens
ctcgaatttgaaga

SEQ ID NO: 6129725 - DNA, 22 bp, Homo sapiens
ctcgacaaaggccacaggcagt

SEQ ID NO: 6129726 - DNA, 19 bp, Homo sapiens
ctcgacagggcctggagcc

SEQ ID NO: 6129727 - DNA, 19 bp, Homo sapiens
ctcgacatcactgttcatg

SEQ ID NO: 6129728 - DNA, 13 bp, Homo sapiens
ctcgacccagaat

SEQ ID NO: 6129729 - DNA, 19 bp, Homo sapiens
ctcgaccctgtcccctagg

SEQ ID NO: 6129730 - DNA, 17 bp, Homo sapiens
ctcgacctccctggctt

SEQ ID NO: 6129731 - DNA, 18 bp, Homo sapiens
ctcgacctccctggcttg

SEQ ID NO: 6129732 - DNA, 16 bp, Homo sapiens
ctcgactaaaacaagt

SEQ ID NO: 6129733 - DNA, 14 bp, Homo sapiens
ctcgactcagcacc

SEQ ID NO: 6129734 - DNA, 15 bp, Homo sapiens
ctcgactcccccctg

SEQ ID NO: 6129735 - DNA, 22 bp, Homo sapiens
ctcgagaaccaaccagggaagc

SEQ ID NO: 6129736 - DNA, 19 bp, Homo sapiens
ctcgagaactttcattttt

SEQ ID NO: 6129737 - DNA, 15 bp, Homo sapiens
ctcgagagggctgag

SEQ ID NO: 6129738 - DNA, 17 bp, Homo sapiens
ctcgagagggctgagcc

SEQ ID NO: 6129739 - DNA, 22 bp, Homo sapiens
ctcgagagggctgagcccctcc

SEQ ID NO: 6129740 - DNA, 13 bp, Homo sapiens
ctcgagatcccaa

SEQ ID NO: 6129741 - DNA, 15 bp, Homo sapiens
ctcgagcaaaattca

SEQ ID NO: 6129742 - DNA, 16 bp, Homo sapiens
ctcgagcaaaattcaa

SEQ ID NO: 6129743 - DNA, 15 bp, Homo sapiens
ctcgagcaactgctg

SEQ ID NO: 6129744 - DNA, 23 bp, Homo sapiens
ctcgagcagtcctgcctcagcct

SEQ ID NO: 6129745 - DNA, 16 bp, Homo sapiens
ctcgagcatgcctgga

SEQ ID NO: 6129746 - DNA, 22 bp, Homo sapiens
ctcgagccatagagcctgaaat

SEQ ID NO: 6129747 - DNA, 12 bp, Homo sapiens
ctcgagcgccct

SEQ ID NO: 6129748 - DNA, 18 bp, Homo sapiens
ctcgagcgccctgcagac

SEQ ID NO: 6129749 - DNA, 17 bp, Homo sapiens
ctcgaggaactccagga

SEQ ID NO: 6129750 - DNA, 18 bp, Homo sapiens
ctcgaggaactccaggac

SEQ ID NO: 6129751 - DNA, 20 bp, Homo sapiens
ctcgaggaactccaggacga

SEQ ID NO: 6129752 - DNA, 16 bp, Homo sapiens
ctcgaggactgtattt

SEQ ID NO: 6129753 - DNA, 14 bp, Homo sapiens
ctcgaggcaccggc

SEQ ID NO: 6129754 - DNA, 22 bp, Homo sapiens
ctcgaggcctacagaggaggcc

SEQ ID NO: 6129755 - DNA, 17 bp, Homo sapiens
ctcgaggctcttccatc

SEQ ID NO: 6129756 - DNA, 12 bp, Homo sapiens
ctcgaggctggt

SEQ ID NO: 6129757 - DNA, 15 bp, Homo sapiens
ctcgaggctggtgcc

SEQ ID NO: 6129758 - DNA, 13 bp, Homo sapiens
ctcgagggccgcc

SEQ ID NO: 6129759 - DNA, 15 bp, Homo sapiens
ctcgagggccgcctg

SEQ ID NO: 6129760 - DNA, 16 bp, Homo sapiens
ctcgagggccgcctgc

SEQ ID NO: 6129761 - DNA, 18 bp, Homo sapiens
ctcgagggccgcctgcct

SEQ ID NO: 6129762 - DNA, 16 bp, Homo sapiens
ctcgaggggtgggctg

SEQ ID NO: 6129763 - DNA, 16 bp, Homo sapiens
ctcgaggtggagggta

SEQ ID NO: 6129764 - DNA, 16 bp, Homo sapiens
ctcgagtactgtgggc

SEQ ID NO: 6129765 - DNA, 18 bp, Homo sapiens
ctcgagtactgtgggcaa

SEQ ID NO: 6129766 - DNA, 18 bp, Homo sapiens
ctcgagtcacattctgct

SEQ ID NO: 6129767 - DNA, 19 bp, Homo sapiens
ctcgagtcacattctgctt

SEQ ID NO: 6129768 - DNA, 15 bp, Homo sapiens
ctcgagtccccatga

SEQ ID NO: 6129769 - DNA, 14 bp, Homo sapiens
ctcgagtcccccca

SEQ ID NO: 6129770 - DNA, 19 bp, Homo sapiens
ctcgagtccccccacccct

SEQ ID NO: 6129771 - DNA, 20 bp, Homo sapiens
ctcgagtccccccacccctc

SEQ ID NO: 6129772 - DNA, 19 bp, Homo sapiens
ctcgagtgcccctgcaggg

SEQ ID NO: 6129773 - DNA, 23 bp, Homo sapiens
ctcgagtgcccctgtcccacctg

SEQ ID NO: 6129774 - DNA, 14 bp, Homo sapiens
ctcgatcaaaacct

SEQ ID NO: 6129775 - DNA, 17 bp, Homo sapiens
ctcgatcaaaaccttcc

SEQ ID NO: 6129776 - DNA, 21 bp, Homo sapiens
ctcgatcaaaaccttccttcc

SEQ ID NO: 6129777 - DNA, 14 bp, Homo sapiens
ctcgatccaaattg

SEQ ID NO: 6129778 - DNA, 15 bp, Homo sapiens
ctcgatccaaattgt

SEQ ID NO: 6129779 - DNA, 22 bp, Homo sapiens
ctcgatgcaagtgtttctgttc

SEQ ID NO: 6129780 - DNA, 12 bp, Homo sapiens
ctcgatgcactg

SEQ ID NO: 6129781 - DNA, 14 bp, Homo sapiens
ctcgatgcagacag

SEQ ID NO: 6129782 - DNA, 16 bp, Homo sapiens
ctcgatgcctgattcg

SEQ ID NO: 6129783 - DNA, 15 bp, Homo sapiens
ctcgatgcctttgct

SEQ ID NO: 6129784 - DNA, 15 bp, Homo sapiens
ctcgatgctgctggc

SEQ ID NO: 6129785 - DNA, 16 bp, Homo sapiens
ctcgatggacctcagc

SEQ ID NO: 6129786 - DNA, 22 bp, Homo sapiens
ctcgatgtaagggattccttgt

SEQ ID NO: 6129787 - DNA, 15 bp, Homo sapiens
ctcgatgtcctcctc

SEQ ID NO: 6129788 - DNA, 19 bp, Homo sapiens
ctcgatgtcctcctctgtg

SEQ ID NO: 6129789 - DNA, 20 bp, Homo sapiens
ctcgatgtcctcctctgtga

SEQ ID NO: 6129790 - DNA, 22 bp, Homo sapiens
ctcgatgtcctcctctgtgaaa

SEQ ID NO: 6129791 - DNA, 20 bp, Homo sapiens
ctcgatgtggtcacagctgt

SEQ ID NO: 6129792 - DNA, 24 bp, Homo sapiens
ctcgatgtggtcacagctgtatag

SEQ ID NO: 6129793 - DNA, 15 bp, Homo sapiens
ctcgatgttcatgga

SEQ ID NO: 6129794 - DNA, 17 bp, Homo sapiens
ctcgatgttcatggaat

SEQ ID NO: 6129795 - DNA, 18 bp, Homo sapiens
ctcgatgttcatggaatt

SEQ ID NO: 6129796 - DNA, 22 bp, Homo sapiens
ctcgattttatctttcgcacag

SEQ ID NO: 6129797 - DNA, 21 bp, Homo sapiens
ctcgattttgcacttttttct

SEQ ID NO: 6129798 - DNA, 13 bp, Homo sapiens
ctcgattttgtat

SEQ ID NO: 6129799 - DNA, 14 bp, Homo sapiens
ctcgattttgtatc

SEQ ID NO: 6129800 - DNA, 15 bp, Homo sapiens
ctcgattttgtatct

SEQ ID NO: 6129801 - DNA, 16 bp, Homo sapiens
ctcgattttgtatctg

SEQ ID NO: 6129802 - DNA, 23 bp, Homo sapiens
ctcgcaaaaacgtatctcctaat

SEQ ID NO: 6129803 - DNA, 12 bp, Homo sapiens
ctcgcaacccgt

SEQ ID NO: 6129804 - DNA, 16 bp, Homo sapiens
ctcgcaacccgtgcca

SEQ ID NO: 6129805 - DNA, 21 bp, Homo sapiens
ctcgcaacccgtgccaagtcc

SEQ ID NO: 6129806 - DNA, 22 bp, Homo sapiens
ctcgcaacccgtgccaagtcca

SEQ ID NO: 6129807 - DNA, 14 bp, Homo sapiens
ctcgcaaccctgcc

SEQ ID NO: 6129808 - DNA, 13 bp, Homo sapiens
ctcgcaagagggt

SEQ ID NO: 6129809 - DNA, 16 bp, Homo sapiens
ctcgcacaatgcatgt

SEQ ID NO: 6129810 - DNA, 16 bp, Homo sapiens
ctcgcacacagggctc

SEQ ID NO: 6129811 - DNA, 23 bp, Homo sapiens
ctcgcacacagggctcacagggc

SEQ ID NO: 6129812 - DNA, 14 bp, Homo sapiens
ctcgcacaggccct

SEQ ID NO: 6129813 - DNA, 16 bp, Homo sapiens
ctcgcacaggccctag

SEQ ID NO: 6129814 - DNA, 16 bp, Homo sapiens
ctcgcacagggcatgc

SEQ ID NO: 6129815 - DNA, 17 bp, Homo sapiens
ctcgcacagggcatgcc

SEQ ID NO: 6129816 - DNA, 23 bp, Homo sapiens
ctcgcacagggcatgcctggcct

SEQ ID NO: 6129817 - DNA, 20 bp, Homo sapiens
ctcgcacccccctgttctaa

SEQ ID NO: 6129818 - DNA, 21 bp, Homo sapiens
ctcgcacccccctgttctaag

SEQ ID NO: 6129819 - DNA, 14 bp, Homo sapiens
ctcgcacctgtgct

SEQ ID NO: 6129820 - DNA, 17 bp, Homo sapiens
ctcgcacggccccgaag

SEQ ID NO: 6129821 - DNA, 18 bp, Homo sapiens
ctcgcagacctaagccct

SEQ ID NO: 6129822 - DNA, 15 bp, Homo sapiens
ctcgcagcaggtgca

SEQ ID NO: 6129823 - DNA, 22 bp, Homo sapiens
ctcgcagcaggtgcaagagaca

SEQ ID NO: 6129824 - DNA, 14 bp, Homo sapiens
ctcgcagcccccgc

SEQ ID NO: 6129825 - DNA, 21 bp, Homo sapiens
ctcgcagcccccgcgccctcc

SEQ ID NO: 6129826 - DNA, 18 bp, Homo sapiens
ctcgcagcctctcagtgc

SEQ ID NO: 6129827 - DNA, 12 bp, Homo sapiens
ctcgcagcctgg

SEQ ID NO: 6129828 - DNA, 13 bp, Homo sapiens
ctcgcagcctggc

SEQ ID NO: 6129829 - DNA, 18 bp, Homo sapiens
ctcgcaggcctccctgcc

SEQ ID NO: 6129830 - DNA, 20 bp, Homo sapiens
ctcgcagggaatgcagcagg

SEQ ID NO: 6129831 - DNA, 21 bp, Homo sapiens
ctcgcagggaatgcagcagga

SEQ ID NO: 6129832 - DNA, 14 bp, Homo sapiens
ctcgcaggtctcag

SEQ ID NO: 6129833 - DNA, 18 bp, Homo sapiens
ctcgcataggacctttcc

SEQ ID NO: 6129834 - DNA, 19 bp, Homo sapiens
ctcgcataggacctttcca

SEQ ID NO: 6129835 - DNA, 22 bp, Homo sapiens
ctcgcataggacctttccacca

SEQ ID NO: 6129836 - DNA, 15 bp, Homo sapiens
ctcgcatccagacag

SEQ ID NO: 6129837 - DNA, 22 bp, Homo sapiens
ctcgcatccgcctctgagccag

SEQ ID NO: 6129838 - DNA, 23 bp, Homo sapiens
ctcgcatccgcctctgagccagg

SEQ ID NO: 6129839 - DNA, 22 bp, Homo sapiens
ctcgcatttgtcaatgacagtt

SEQ ID NO: 6129840 - DNA, 18 bp, Homo sapiens
ctcgcattttctctagct

SEQ ID NO: 6129841 - DNA, 15 bp, Homo sapiens
ctcgccaaggcctag

SEQ ID NO: 6129842 - DNA, 19 bp, Homo sapiens
ctcgccacggggaggggga

SEQ ID NO: 6129843 - DNA, 16 bp, Homo sapiens
ctcgccagaagactcc

SEQ ID NO: 6129844 - DNA, 12 bp, Homo sapiens
ctcgccagcttg

SEQ ID NO: 6129845 - DNA, 21 bp, Homo sapiens
ctcgccatcaaggtccagtgg

SEQ ID NO: 6129846 - DNA, 13 bp, Homo sapiens
ctcgcccaggaag

SEQ ID NO: 6129847 - DNA, 15 bp, Homo sapiens
ctcgcccaggaaggc

SEQ ID NO: 6129848 - DNA, 18 bp, Homo sapiens
ctcgcccagtcccagcag

SEQ ID NO: 6129849 - DNA, 19 bp, Homo sapiens
ctcgcccatacccgtgaca

SEQ ID NO: 6129850 - DNA, 15 bp, Homo sapiens
ctcgcccatcagtgc

SEQ ID NO: 6129851 - DNA, 14 bp, Homo sapiens
ctcgccccaaagtt

SEQ ID NO: 6129852 - DNA, 23 bp, Homo sapiens
ctcgccccacctccacctgtgag

SEQ ID NO: 6129853 - DNA, 17 bp, Homo sapiens
ctcgccccatccctgct

SEQ ID NO: 6129854 - DNA, 17 bp, Homo sapiens
ctcgcccccaccagtgt

SEQ ID NO: 6129855 - DNA, 19 bp, Homo sapiens
ctcgcccccaccagtgtag

SEQ ID NO: 6129856 - DNA, 23 bp, Homo sapiens
ctcgcccccaggaacgctctcct

SEQ ID NO: 6129857 - DNA, 22 bp, Homo sapiens
ctcgccccccgcccggcctcct

SEQ ID NO: 6129858 - DNA, 12 bp, Homo sapiens
ctcgcccctccc

SEQ ID NO: 6129859 - DNA, 16 bp, Homo sapiens
ctcgcccctcccctca

SEQ ID NO: 6129860 - DNA, 17 bp, Homo sapiens
ctcgcccctcccctcag

SEQ ID NO: 6129861 - DNA, 17 bp, Homo sapiens
ctcgcccctggcagaga

SEQ ID NO: 6129862 - DNA, 23 bp, Homo sapiens
ctcgccccttccctctctccctg

SEQ ID NO: 6129863 - DNA, 20 bp, Homo sapiens
ctcgcccgcccactgtcctg

SEQ ID NO: 6129864 - DNA, 22 bp, Homo sapiens
ctcgcccgcccactgtcctggg

SEQ ID NO: 6129865 - DNA, 23 bp, Homo sapiens
ctcgcccgcccactgtcctgggc

SEQ ID NO: 6129866 - DNA, 18 bp, Homo sapiens
ctcgccctgtccctccca

SEQ ID NO: 6129867 - DNA, 22 bp, Homo sapiens
ctcgccctgtccctcccactcc

SEQ ID NO: 6129868 - DNA, 12 bp, Homo sapiens
ctcgccctgtgc

SEQ ID NO: 6129869 - DNA, 16 bp, Homo sapiens
ctcgcccttcagccca

SEQ ID NO: 6129870 - DNA, 17 bp, Homo sapiens
ctcgccggatctgaggg

SEQ ID NO: 6129871 - DNA, 18 bp, Homo sapiens
ctcgccgtgtctcagcct

SEQ ID NO: 6129872 - DNA, 20 bp, Homo sapiens
ctcgccgtgtctcagcctct

SEQ ID NO: 6129873 - DNA, 22 bp, Homo sapiens
ctcgccgtgtctcagcctctgc

SEQ ID NO: 6129874 - DNA, 23 bp, Homo sapiens
ctcgcctaggatttcagccatgc

SEQ ID NO: 6129875 - DNA, 18 bp, Homo sapiens
ctcgcctaggcctgtgag

SEQ ID NO: 6129876 - DNA, 14 bp, Homo sapiens
ctcgcctcctcctc

SEQ ID NO: 6129877 - DNA, 17 bp, Homo sapiens
ctcgcctcctcctcctg

SEQ ID NO: 6129878 - DNA, 19 bp, Homo sapiens
ctcgcctgccctcctctcc

SEQ ID NO: 6129879 - DNA, 15 bp, Homo sapiens
ctcgcctggaaacag

SEQ ID NO: 6129880 - DNA, 17 bp, Homo sapiens
ctcgcctgggcccaggc

SEQ ID NO: 6129881 - DNA, 18 bp, Homo sapiens
ctcgcctgtcacccccac

SEQ ID NO: 6129882 - DNA, 14 bp, Homo sapiens
ctcgccttcaggag

SEQ ID NO: 6129883 - DNA, 16 bp, Homo sapiens
ctcgccttcaggagaa

SEQ ID NO: 6129884 - DNA, 15 bp, Homo sapiens
ctcgccttccctcct

SEQ ID NO: 6129885 - DNA, 16 bp, Homo sapiens
ctcgccttcctgcagt

SEQ ID NO: 6129886 - DNA, 14 bp, Homo sapiens
ctcgccttcggcct

SEQ ID NO: 6129887 - DNA, 18 bp, Homo sapiens
ctcgccttctgcttccac

SEQ ID NO: 6129888 - DNA, 19 bp, Homo sapiens
ctcgccttttaggctcagg

SEQ ID NO: 6129889 - DNA, 20 bp, Homo sapiens
ctcgcgaaggtcccacagcc

SEQ ID NO: 6129890 - DNA, 13 bp, Homo sapiens
ctcgcgcccctgt

SEQ ID NO: 6129891 - DNA, 15 bp, Homo sapiens
ctcgcgcccctgtcc

SEQ ID NO: 6129892 - DNA, 13 bp, Homo sapiens
ctcgcgcgactga

SEQ ID NO: 6129893 - DNA, 15 bp, Homo sapiens
ctcgcggccctcagt

SEQ ID NO: 6129894 - DNA, 14 bp, Homo sapiens
ctcgcgggcagcgg

SEQ ID NO: 6129895 - DNA, 15 bp, Homo sapiens
ctcgcgggcagcggg

SEQ ID NO: 6129896 - DNA, 18 bp, Homo sapiens
ctcgcgggcagcgggcca

SEQ ID NO: 6129897 - DNA, 20 bp, Homo sapiens
ctcgcgggcagcgggccagg

SEQ ID NO: 6129898 - DNA, 21 bp, Homo sapiens
ctcgcgggcagcgggccaggc

SEQ ID NO: 6129899 - DNA, 21 bp, Homo sapiens
ctcgcgggtgtcacattcctg

SEQ ID NO: 6129900 - DNA, 19 bp, Homo sapiens
ctcgctattgtcaccaggg

SEQ ID NO: 6129901 - DNA, 16 bp, Homo sapiens
ctcgctcagtcagtgc

SEQ ID NO: 6129902 - DNA, 17 bp, Homo sapiens
ctcgctcagtcagtgca

SEQ ID NO: 6129903 - DNA, 19 bp, Homo sapiens
ctcgctcagtcagtgcact

SEQ ID NO: 6129904 - DNA, 16 bp, Homo sapiens
ctcgctccccactctg

SEQ ID NO: 6129905 - DNA, 23 bp, Homo sapiens
ctcgctccccactctgctctgat

SEQ ID NO: 6129906 - DNA, 16 bp, Homo sapiens
ctcgctcccctctgga

SEQ ID NO: 6129907 - DNA, 18 bp, Homo sapiens
ctcgctccctcccaggac

SEQ ID NO: 6129908 - DNA, 22 bp, Homo sapiens
ctcgctccctgtagctctgcct

SEQ ID NO: 6129909 - DNA, 14 bp, Homo sapiens
ctcgctctcctaag

SEQ ID NO: 6129910 - DNA, 11 bp, Homo sapiens
ctcgctctgct

SEQ ID NO: 6129911 - DNA, 13 bp, Homo sapiens
ctcgctctgggat

SEQ ID NO: 6129912 - DNA, 12 bp, Homo sapiens
ctcgctctgtca

SEQ ID NO: 6129913 - DNA, 16 bp, Homo sapiens
ctcgctctgttgccca

SEQ ID NO: 6129914 - DNA, 21 bp, Homo sapiens
ctcgctgatgctgggctgggt

SEQ ID NO: 6129915 - DNA, 22 bp, Homo sapiens
ctcgctgatgctgggctgggtg

SEQ ID NO: 6129916 - DNA, 23 bp, Homo sapiens
ctcgctgatgctgggctgggtgc

SEQ ID NO: 6129917 - DNA, 16 bp, Homo sapiens
ctcgctgccagctctg

SEQ ID NO: 6129918 - DNA, 11 bp, Homo sapiens
ctcgctgccat

SEQ ID NO: 6129919 - DNA, 22 bp, Homo sapiens
ctcgctgccatcaccgctgggt

SEQ ID NO: 6129920 - DNA, 20 bp, Homo sapiens
ctcgctgctgcgccctgggc

SEQ ID NO: 6129921 - DNA, 24 bp, Homo sapiens
ctcgctgctgctactacccgagcc

SEQ ID NO: 6129922 - DNA, 12 bp, Homo sapiens
ctcgctgctggg

SEQ ID NO: 6129923 - DNA, 23 bp, Homo sapiens
ctcgctggaatcaatttcccaga

SEQ ID NO: 6129924 - DNA, 16 bp, Homo sapiens
ctcgctggactctcag

SEQ ID NO: 6129925 - DNA, 19 bp, Homo sapiens
ctcgctggactctcagtct

SEQ ID NO: 6129926 - DNA, 17 bp, Homo sapiens
ctcgctggcccccactg

SEQ ID NO: 6129927 - DNA, 20 bp, Homo sapiens
ctcgctggcccccactggct

SEQ ID NO: 6129928 - DNA, 21 bp, Homo sapiens
ctcgctggcccccactggctg

SEQ ID NO: 6129929 - DNA, 18 bp, Homo sapiens
ctcgctggctttctctct

SEQ ID NO: 6129930 - DNA, 16 bp, Homo sapiens
ctcgctgtcctgctgt

SEQ ID NO: 6129931 - DNA, 18 bp, Homo sapiens
ctcgctgtcctttctaga

SEQ ID NO: 6129932 - DNA, 22 bp, Homo sapiens
ctcgctgtgattttaagacaag

SEQ ID NO: 6129933 - DNA, 11 bp, Homo sapiens
ctcgctgtgcc

SEQ ID NO: 6129934 - DNA, 15 bp, Homo sapiens
ctcgctgtgccacca

SEQ ID NO: 6129935 - DNA, 21 bp, Homo sapiens
ctcgctgtgccaccacccctc

SEQ ID NO: 6129936 - DNA, 18 bp, Homo sapiens
ctcgctgtggtttctcgt

SEQ ID NO: 6129937 - DNA, 20 bp, Homo sapiens
ctcgcttaggtagaaactat

SEQ ID NO: 6129938 - DNA, 17 bp, Homo sapiens
ctcgcttcataggcaga

SEQ ID NO: 6129939 - DNA, 21 bp, Homo sapiens
ctcgcttcataggcagagccc

SEQ ID NO: 6129940 - DNA, 21 bp, Homo sapiens
ctaacccccagcccacagagc

SEQ ID NO: 6129941 - DNA, 15 bp, Homo sapiens
ctaacccccagctgg

SEQ ID NO: 6129942 - DNA, 16 bp, Homo sapiens
ctaacccccagtgcca

SEQ ID NO: 6129943 - DNA, 21 bp, Homo sapiens
ctaacccccagtgccacagag

SEQ ID NO: 6129944 - DNA, 14 bp, Homo sapiens
ctaaccccttccag

SEQ ID NO: 6129945 - DNA, 14 bp, Homo sapiens
ctaacccctttcct

SEQ ID NO: 6129946 - DNA, 13 bp, Homo sapiens
ctaaccctctgtc

SEQ ID NO: 6129947 - DNA, 13 bp, Homo sapiens
ctaaccctgggct

SEQ ID NO: 6129948 - DNA, 22 bp, Homo sapiens
ctaaccctgtggaagcatggct

SEQ ID NO: 6129949 - DNA, 18 bp, Homo sapiens
ctaacccttaaaaatgca

SEQ ID NO: 6129950 - DNA, 20 bp, Homo sapiens
ctaacctagtttgttacttt

SEQ ID NO: 6129951 - DNA, 21 bp, Homo sapiens
ctaacctatctatgaacaaca

SEQ ID NO: 6129952 - DNA, 13 bp, Homo sapiens
ctaacctcaaaat

SEQ ID NO: 6129953 - DNA, 15 bp, Homo sapiens
ctaacctcactgcct

SEQ ID NO: 6129954 - DNA, 17 bp, Homo sapiens
ctaacctcactgcctca

SEQ ID NO: 6129955 - DNA, 18 bp, Homo sapiens
ctaacctcactgcctcat

SEQ ID NO: 6129956 - DNA, 12 bp, Homo sapiens
ctaacctcagcc

SEQ ID NO: 6129957 - DNA, 12 bp, Homo sapiens
ctaacctccttt

SEQ ID NO: 6129958 - DNA, 16 bp, Homo sapiens
ctaacctcgccctctc

SEQ ID NO: 6129959 - DNA, 17 bp, Homo sapiens
ctaacctcgccctctcc

SEQ ID NO: 6129960 - DNA, 21 bp, Homo sapiens
ctaacctcgctcgatgactgt

SEQ ID NO: 6129961 - DNA, 19 bp, Homo sapiens
ctaacctcttttctgcatc

SEQ ID NO: 6129962 - DNA, 19 bp, Homo sapiens
ctaacctgccgagagtcca

SEQ ID NO: 6129963 - DNA, 21 bp, Homo sapiens
ctaacctgccgagagtccatc

SEQ ID NO: 6129964 - DNA, 14 bp, Homo sapiens
ctaacctggagaca

SEQ ID NO: 6129965 - DNA, 13 bp, Homo sapiens
ctaacctggctta

SEQ ID NO: 6129966 - DNA, 21 bp, Homo sapiens
ctaacctgttacactgggctg

SEQ ID NO: 6129967 - DNA, 23 bp, Homo sapiens
ctaacctgttacactgggctggg

SEQ ID NO: 6129968 - DNA, 15 bp, Homo sapiens
ctaaccttatcctgc

SEQ ID NO: 6129969 - DNA, 22 bp, Homo sapiens
ctaaccttatcctgcattgtta

SEQ ID NO: 6129970 - DNA, 16 bp, Homo sapiens
ctaaccttgaatgctg

SEQ ID NO: 6129971 - DNA, 18 bp, Homo sapiens
ctaaccttgaatgctgcc

SEQ ID NO: 6129972 - DNA, 21 bp, Homo sapiens
ctaaccttgaatgctgccagt

SEQ ID NO: 6129973 - DNA, 18 bp, Homo sapiens
ctaaccttgagtcagaaa

SEQ ID NO: 6129974 - DNA, 21 bp, Homo sapiens
ctaaccttgcctggtacagta

SEQ ID NO: 6129975 - DNA, 21 bp, Homo sapiens
ctaacctttacatgaggactc

SEQ ID NO: 6129976 - DNA, 17 bp, Homo sapiens
ctaacgaacgttttaaa

SEQ ID NO: 6129977 - DNA, 22 bp, Homo sapiens
ctaacgcctgagcccagggagg

SEQ ID NO: 6129978 - DNA, 21 bp, Homo sapiens
ctaacgggggtgcggcaggag

SEQ ID NO: 6129979 - DNA, 19 bp, Homo sapiens
ctaacggtgctcagggggc

SEQ ID NO: 6129980 - DNA, 24 bp, Homo sapiens
ctaacgtgataaacctgctccaag

SEQ ID NO: 6129981 - DNA, 21 bp, Homo sapiens
ctaacgttttctactttgaaa

SEQ ID NO: 6129982 - DNA, 14 bp, Homo sapiens
ctaacgttttttct

SEQ ID NO: 6129983 - DNA, 15 bp, Homo sapiens
ctaacgttttttctt

SEQ ID NO: 6129984 - DNA, 13 bp, Homo sapiens
ctaactaaactct

SEQ ID NO: 6129985 - DNA, 16 bp, Homo sapiens
ctaactaaccacattt

SEQ ID NO: 6129986 - DNA, 14 bp, Homo sapiens
ctaactaaggacag

SEQ ID NO: 6129987 - DNA, 22 bp, Homo sapiens
ctaactaaggtcccataataaa

SEQ ID NO: 6129988 - DNA, 20 bp, Homo sapiens
ctaactacaaaggtttaaat

SEQ ID NO: 6129989 - DNA, 21 bp, Homo sapiens
ctaactacaaggacaatgcct

SEQ ID NO: 6129990 - DNA, 21 bp, Homo sapiens
ctaactagaattagtatgtct

SEQ ID NO: 6129991 - DNA, 22 bp, Homo sapiens
ctaactagaattagtatgtctg

SEQ ID NO: 6129992 - DNA, 20 bp, Homo sapiens
ctaactcaaatacacatttg

SEQ ID NO: 6129993 - DNA, 18 bp, Homo sapiens
ctaactcaagataatcct

SEQ ID NO: 6129994 - DNA, 15 bp, Homo sapiens
ctaactcacctaact

SEQ ID NO: 6129995 - DNA, 17 bp, Homo sapiens
ctaactcatactgtgct

SEQ ID NO: 6129996 - DNA, 20 bp, Homo sapiens
ctaactccagtctcctgaca

SEQ ID NO: 6129997 - DNA, 12 bp, Homo sapiens
ctaactccctcc

SEQ ID NO: 6129998 - DNA, 19 bp, Homo sapiens
ctaactccttgaggtcttg

SEQ ID NO: 6129999 - DNA, 16 bp, Homo sapiens
ctaactctgcccaccc

SEQ ID NO: 6130000 - DNA, 18 bp, Homo sapiens
ctaactctgcccaccctc

SEQ ID NO: 6130001 - DNA, 18 bp, Homo sapiens
ctaactcttttctatttt

SEQ ID NO: 6130002 - DNA, 16 bp, Homo sapiens
ctaactgaactttgaa

SEQ ID NO: 6130003 - DNA, 16 bp, Homo sapiens
ctaactgactctgtta

SEQ ID NO: 6130004 - DNA, 13 bp, Homo sapiens
ctaactgccatgt

SEQ ID NO: 6130005 - DNA, 20 bp, Homo sapiens
ctaactgctacaaatactct

SEQ ID NO: 6130006 - DNA, 13 bp, Homo sapiens
ctaactgctgtta

SEQ ID NO: 6130007 - DNA, 20 bp, Homo sapiens
ctaactgcttcatctccttt

SEQ ID NO: 6130008 - DNA, 23 bp, Homo sapiens
ctaactggaaacaaaacagaagg

SEQ ID NO: 6130009 - DNA, 13 bp, Homo sapiens
ctaactggaagca

SEQ ID NO: 6130010 - DNA, 15 bp, Homo sapiens
ctaactggacagcct

SEQ ID NO: 6130011 - DNA, 12 bp, Homo sapiens
ctaactggcccc

SEQ ID NO: 6130012 - DNA, 17 bp, Homo sapiens
ctaactggccccaggcg

SEQ ID NO: 6130013 - DNA, 11 bp, Homo sapiens
ctaactgtaaa

SEQ ID NO: 6130014 - DNA, 14 bp, Homo sapiens
ctaactgtaaatca

SEQ ID NO: 6130015 - DNA, 16 bp, Homo sapiens
ctaactgtaaatcact

SEQ ID NO: 6130016 - DNA, 15 bp, Homo sapiens
ctaactgtaaatcat

SEQ ID NO: 6130017 - DNA, 12 bp, Homo sapiens
ctaactgtatat

SEQ ID NO: 6130018 - DNA, 15 bp, Homo sapiens
ctaactgtatatttg

SEQ ID NO: 6130019 - DNA, 19 bp, Homo sapiens
ctaactgtatatttgtatg

SEQ ID NO: 6130020 - DNA, 12 bp, Homo sapiens
ctaactgtatct

SEQ ID NO: 6130021 - DNA, 13 bp, Homo sapiens
ctaactgtatctt

SEQ ID NO: 6130022 - DNA, 14 bp, Homo sapiens
ctaactgtgatttg

SEQ ID NO: 6130023 - DNA, 23 bp, Homo sapiens
ctaactgtgatttgtagatttac

SEQ ID NO: 6130024 - DNA, 15 bp, Homo sapiens
ctaactgtgcaaagc

SEQ ID NO: 6130025 - DNA, 14 bp, Homo sapiens
ctaactgtggagaa

SEQ ID NO: 6130026 - DNA, 15 bp, Homo sapiens
ctaacttattgcctg

SEQ ID NO: 6130027 - DNA, 19 bp, Homo sapiens
ctaacttattttatttcca

SEQ ID NO: 6130028 - DNA, 14 bp, Homo sapiens
ctaacttattttga

SEQ ID NO: 6130029 - DNA, 15 bp, Homo sapiens
ctaacttattttgat

SEQ ID NO: 6130030 - DNA, 13 bp, Homo sapiens
ctaacttcataga

SEQ ID NO: 6130031 - DNA, 13 bp, Homo sapiens
ctaacttctgtaa

SEQ ID NO: 6130032 - DNA, 16 bp, Homo sapiens
ctaacttgcttaaatg

SEQ ID NO: 6130033 - DNA, 17 bp, Homo sapiens
ctaacttgcttaaatgt

SEQ ID NO: 6130034 - DNA, 18 bp, Homo sapiens
ctaacttgcttaaatgtg

SEQ ID NO: 6130035 - DNA, 17 bp, Homo sapiens
ctaacttggagccccag

SEQ ID NO: 6130036 - DNA, 14 bp, Homo sapiens
ctaacttggagccg

SEQ ID NO: 6130037 - DNA, 15 bp, Homo sapiens
ctaacttggctcaca

SEQ ID NO: 6130038 - DNA, 13 bp, Homo sapiens
ctaacttgggtta

SEQ ID NO: 6130039 - DNA, 14 bp, Homo sapiens
ctaacttgtaaaaa

SEQ ID NO: 6130040 - DNA, 18 bp, Homo sapiens
ctaacttgtgaagacaat

SEQ ID NO: 6130041 - DNA, 13 bp, Homo sapiens
ctaacttgtttga

SEQ ID NO: 6130042 - DNA, 20 bp, Homo sapiens
ctaactttagaagtgcattt

SEQ ID NO: 6130043 - DNA, 22 bp, Homo sapiens
ctaactttagaagtgcatttct

SEQ ID NO: 6130044 - DNA, 16 bp, Homo sapiens
ctaactttccttcatt

SEQ ID NO: 6130045 - DNA, 14 bp, Homo sapiens
ctaactttcttgct

SEQ ID NO: 6130046 - DNA, 15 bp, Homo sapiens
ctaactttcttgctt

SEQ ID NO: 6130047 - DNA, 17 bp, Homo sapiens
ctaactttttgaattct

SEQ ID NO: 6130048 - DNA, 11 bp, Homo sapiens
ctaagaaaaag

SEQ ID NO: 6130049 - DNA, 14 bp, Homo sapiens
ctaagaaaaaggaa

SEQ ID NO: 6130050 - DNA, 12 bp, Homo sapiens
ctaagaaaagag

SEQ ID NO: 6130051 - DNA, 22 bp, Homo sapiens
ctaagaaaagatacgactttat

SEQ ID NO: 6130052 - DNA, 23 bp, Homo sapiens
ctaagaaaagatacgactttatt

SEQ ID NO: 6130053 - DNA, 22 bp, Homo sapiens
ctaagaaaagcctaatcacagt

SEQ ID NO: 6130054 - DNA, 14 bp, Homo sapiens
ctaagaaaatagca

SEQ ID NO: 6130055 - DNA, 18 bp, Homo sapiens
ctaagaaacattggaagc

SEQ ID NO: 6130056 - DNA, 16 bp, Homo sapiens
ctaagaaacttaaatt

SEQ ID NO: 6130057 - DNA, 18 bp, Homo sapiens
ctaagaaacttttgtaaa

SEQ ID NO: 6130058 - DNA, 20 bp, Homo sapiens
ctaagaaacttttgtaaaga

SEQ ID NO: 6130059 - DNA, 22 bp, Homo sapiens
ctaagaaagaaaggaaagaagg

SEQ ID NO: 6130060 - DNA, 13 bp, Homo sapiens
ctaagaaagaaat

SEQ ID NO: 6130061 - DNA, 17 bp, Homo sapiens
ctaagaaagaaatgcta

SEQ ID NO: 6130062 - DNA, 15 bp, Homo sapiens
ctaagaaagaacacg

SEQ ID NO: 6130063 - DNA, 20 bp, Homo sapiens
ctaagaaataaaactgttaa

SEQ ID NO: 6130064 - DNA, 16 bp, Homo sapiens
ctaagaaatatgtgag

SEQ ID NO: 6130065 - DNA, 15 bp, Homo sapiens
ctaagaaatattcca

SEQ ID NO: 6130066 - DNA, 19 bp, Homo sapiens
ctaagaaatgggactctga

SEQ ID NO: 6130067 - DNA, 20 bp, Homo sapiens
ctaagaacaaaagaagcagc

SEQ ID NO: 6130068 - DNA, 14 bp, Homo sapiens
ctaagaacccctct

SEQ ID NO: 6130069 - DNA, 15 bp, Homo sapiens
ctaagaacctggaac

SEQ ID NO: 6130070 - DNA, 16 bp, Homo sapiens
ctaagaacctggaact

SEQ ID NO: 6130071 - DNA, 17 bp, Homo sapiens
ctaagaagaaggccaga

SEQ ID NO: 6130072 - DNA, 18 bp, Homo sapiens
ctaagaagaaggccagag

SEQ ID NO: 6130073 - DNA, 19 bp, Homo sapiens
ctaagaagaaggccagaga

SEQ ID NO: 6130074 - DNA, 15 bp, Homo sapiens
ctaagaagacatttt

SEQ ID NO: 6130075 - DNA, 17 bp, Homo sapiens
ctaagaagacattttgt

SEQ ID NO: 6130076 - DNA, 21 bp, Homo sapiens
ctaagaagctctggccccagg

SEQ ID NO: 6130077 - DNA, 17 bp, Homo sapiens
ctaagaagcttctaata

SEQ ID NO: 6130078 - DNA, 22 bp, Homo sapiens
ctaagaagcttctaataaatta

SEQ ID NO: 6130079 - DNA, 23 bp, Homo sapiens
ctaagaagcttctaataaattat

SEQ ID NO: 6130080 - DNA, 20 bp, Homo sapiens
ctaagaaggaaaagaagaag

SEQ ID NO: 6130081 - DNA, 14 bp, Homo sapiens
ctaagaagtggggc

SEQ ID NO: 6130082 - DNA, 13 bp, Homo sapiens
ctaagaagttact

SEQ ID NO: 6130083 - DNA, 17 bp, Homo sapiens
ctaagaataaataaaga

SEQ ID NO: 6130084 - DNA, 20 bp, Homo sapiens
ctaagaataaataaagaaga

SEQ ID NO: 6130085 - DNA, 19 bp, Homo sapiens
ctaagaataacaagaagcc

SEQ ID NO: 6130086 - DNA, 13 bp, Homo sapiens
ctaagaataatga

SEQ ID NO: 6130087 - DNA, 17 bp, Homo sapiens
ctaagaataatggactc

SEQ ID NO: 6130088 - DNA, 15 bp, Homo sapiens
ctaagaatataaata

SEQ ID NO: 6130089 - DNA, 20 bp, Homo sapiens
ctaagaatgtccttattctt

SEQ ID NO: 6130090 - DNA, 11 bp, Homo sapiens
ctaagaattca

SEQ ID NO: 6130091 - DNA, 18 bp, Homo sapiens
ctaagaatttcactgtct

SEQ ID NO: 6130092 - DNA, 15 bp, Homo sapiens
ctaagacagaggaac

SEQ ID NO: 6130093 - DNA, 23 bp, Homo sapiens
ctaagacatagtctctacctata

SEQ ID NO: 6130094 - DNA, 23 bp, Homo sapiens
ctaagacatgtgaggaggaaaag

SEQ ID NO: 6130095 - DNA, 21 bp, Homo sapiens
ctaagacattcaccaacaaca

SEQ ID NO: 6130096 - DNA, 13 bp, Homo sapiens
ctaagacattttt

SEQ ID NO: 6130097 - DNA, 15 bp, Homo sapiens
ctaagacatttttca

SEQ ID NO: 6130098 - DNA, 15 bp, Homo sapiens
ctaagacctccccac

SEQ ID NO: 6130099 - DNA, 19 bp, Homo sapiens
ctaagactaatgctttctg

SEQ ID NO: 6130100 - DNA, 21 bp, Homo sapiens
ctaagactaatgctttctgtg

SEQ ID NO: 6130101 - DNA, 14 bp, Homo sapiens
ctaagactacagca

SEQ ID NO: 6130102 - DNA, 17 bp, Homo sapiens
ctaagactcaaatgttc

SEQ ID NO: 6130103 - DNA, 22 bp, Homo sapiens
ctaagactcaaatgttctaagt

SEQ ID NO: 6130104 - DNA, 15 bp, Homo sapiens
ctaagactcccgccc

SEQ ID NO: 6130105 - DNA, 18 bp, Homo sapiens
ctaagactctgtgtggct

SEQ ID NO: 6130106 - DNA, 19 bp, Homo sapiens
ctaagactctgtgtggctg

SEQ ID NO: 6130107 - DNA, 23 bp, Homo sapiens
ctaagactctgtgtggctgtgca

SEQ ID NO: 6130108 - DNA, 16 bp, Homo sapiens
ctaagactgccttcag

SEQ ID NO: 6130109 - DNA, 12 bp, Homo sapiens
ctaagactgctt

SEQ ID NO: 6130110 - DNA, 22 bp, Homo sapiens
ctaagactgtgacaactgtcta

SEQ ID NO: 6130111 - DNA, 19 bp, Homo sapiens
ctaagacttactctaagat

SEQ ID NO: 6130112 - DNA, 23 bp, Homo sapiens
ctaagacttactctaagatctta

SEQ ID NO: 6130113 - DNA, 13 bp, Homo sapiens
ctaagacttccta

SEQ ID NO: 6130114 - DNA, 19 bp, Homo sapiens
ctaagagaaaattgcacta

SEQ ID NO: 6130115 - DNA, 15 bp, Homo sapiens
ctaagagaaactgtg

SEQ ID NO: 6130116 - DNA, 16 bp, Homo sapiens
ctaagagaaactgtgt

SEQ ID NO: 6130117 - DNA, 14 bp, Homo sapiens
ctaagagaaggcct

SEQ ID NO: 6130118 - DNA, 19 bp, Homo sapiens
ctaagagaagtagaaatca

SEQ ID NO: 6130119 - DNA, 22 bp, Homo sapiens
ctaagagaagttattttctaca

SEQ ID NO: 6130120 - DNA, 16 bp, Homo sapiens
ctcgcttcccccatag

SEQ ID NO: 6130121 - DNA, 13 bp, Homo sapiens
ctcgcttgctgga

SEQ ID NO: 6130122 - DNA, 13 bp, Homo sapiens
ctcgcttgtaaat

SEQ ID NO: 6130123 - DNA, 14 bp, Homo sapiens
ctcgcttgtaaata

SEQ ID NO: 6130124 - DNA, 19 bp, Homo sapiens
ctcgctttctatgtagttt

SEQ ID NO: 6130125 - DNA, 18 bp, Homo sapiens
ctcgctttttcatccttc

SEQ ID NO: 6130126 - DNA, 21 bp, Homo sapiens
ctcggaaccgctcacctagag

SEQ ID NO: 6130127 - DNA, 19 bp, Homo sapiens
ctcggaactgcatgctgct

SEQ ID NO: 6130128 - DNA, 22 bp, Homo sapiens
ctcggaactgcatgctgctgga

SEQ ID NO: 6130129 - DNA, 14 bp, Homo sapiens
ctcggaagagcccg

SEQ ID NO: 6130130 - DNA, 17 bp, Homo sapiens
ctcggaagccgtctgac

SEQ ID NO: 6130131 - DNA, 20 bp, Homo sapiens
ctcggaaggctggctgggca

SEQ ID NO: 6130132 - DNA, 15 bp, Homo sapiens
ctcggacacccaggg

SEQ ID NO: 6130133 - DNA, 17 bp, Homo sapiens
ctcggacacccagggtc

SEQ ID NO: 6130134 - DNA, 18 bp, Homo sapiens
ctcggacagagcccccct

SEQ ID NO: 6130135 - DNA, 13 bp, Homo sapiens
ctcggacccacca

SEQ ID NO: 6130136 - DNA, 14 bp, Homo sapiens
ctcggacccacccc

SEQ ID NO: 6130137 - DNA, 16 bp, Homo sapiens
ctcggacccaccccaa

SEQ ID NO: 6130138 - DNA, 18 bp, Homo sapiens
ctcggactaagcctacct

SEQ ID NO: 6130139 - DNA, 22 bp, Homo sapiens
ctcggactaagcctacctgctc

SEQ ID NO: 6130140 - DNA, 20 bp, Homo sapiens
ctcggacttactgcctgacc

SEQ ID NO: 6130141 - DNA, 18 bp, Homo sapiens
ctcggactttgcaggagt

SEQ ID NO: 6130142 - DNA, 17 bp, Homo sapiens
ctcggagaagagcgcag

SEQ ID NO: 6130143 - DNA, 18 bp, Homo sapiens
ctcggagacgggaccctg

SEQ ID NO: 6130144 - DNA, 19 bp, Homo sapiens
ctcggagactatggcctcg

SEQ ID NO: 6130145 - DNA, 20 bp, Homo sapiens
ctcggagagcagcagcacca

SEQ ID NO: 6130146 - DNA, 14 bp, Homo sapiens
ctcggagcaccctt

SEQ ID NO: 6130147 - DNA, 19 bp, Homo sapiens
ctcggagccccccactcag

SEQ ID NO: 6130148 - DNA, 12 bp, Homo sapiens
ctcggagcctca

SEQ ID NO: 6130149 - DNA, 23 bp, Homo sapiens
ctcggagcctcatccgaggcagg

SEQ ID NO: 6130150 - DNA, 15 bp, Homo sapiens
ctcggagctggccca

SEQ ID NO: 6130151 - DNA, 18 bp, Homo sapiens
ctcggagctggcccaggg

SEQ ID NO: 6130152 - DNA, 13 bp, Homo sapiens
ctcggaggccagg

SEQ ID NO: 6130153 - DNA, 14 bp, Homo sapiens
ctcggaggccaggc

SEQ ID NO: 6130154 - DNA, 16 bp, Homo sapiens
ctcggaggccaggccc

SEQ ID NO: 6130155 - DNA, 18 bp, Homo sapiens
ctcggaggccaggccctc

SEQ ID NO: 6130156 - DNA, 20 bp, Homo sapiens
ctcggaggccaggccctcct

SEQ ID NO: 6130157 - DNA, 13 bp, Homo sapiens
ctcggaggcccca

SEQ ID NO: 6130158 - DNA, 13 bp, Homo sapiens
ctcggaggctcct

SEQ ID NO: 6130159 - DNA, 19 bp, Homo sapiens
ctcggaggctcctccctct

SEQ ID NO: 6130160 - DNA, 12 bp, Homo sapiens
ctcggaggctgc

SEQ ID NO: 6130161 - DNA, 16 bp, Homo sapiens
ctcggaggctgccccc

SEQ ID NO: 6130162 - DNA, 17 bp, Homo sapiens
ctcggagtatctgggaa

SEQ ID NO: 6130163 - DNA, 14 bp, Homo sapiens
ctcggagtgtggcc

SEQ ID NO: 6130164 - DNA, 22 bp, Homo sapiens
ctcggagtgtggcctggatcca

SEQ ID NO: 6130165 - DNA, 21 bp, Homo sapiens
ctcggagtgtgtatgccaaga

SEQ ID NO: 6130166 - DNA, 18 bp, Homo sapiens
ctcggatcatatggagct

SEQ ID NO: 6130167 - DNA, 14 bp, Homo sapiens
ctcggatctctcct

SEQ ID NO: 6130168 - DNA, 17 bp, Homo sapiens
ctcggatgaccaaacca

SEQ ID NO: 6130169 - DNA, 14 bp, Homo sapiens
ctcggatggggcac

SEQ ID NO: 6130170 - DNA, 21 bp, Homo sapiens
ctcggcacacactgtgcccca

SEQ ID NO: 6130171 - DNA, 22 bp, Homo sapiens
ctcggcacacactgtgccccac

SEQ ID NO: 6130172 - DNA, 18 bp, Homo sapiens
ctcggcaccgccagccgc

SEQ ID NO: 6130173 - DNA, 19 bp, Homo sapiens
ctcggcagaactctctgtc

SEQ ID NO: 6130174 - DNA, 20 bp, Homo sapiens
ctcggcatagtccccagagc

SEQ ID NO: 6130175 - DNA, 23 bp, Homo sapiens
ctcggcatagtccccagagctcc

SEQ ID NO: 6130176 - DNA, 17 bp, Homo sapiens
ctcggcattcacacaca

SEQ ID NO: 6130177 - DNA, 21 bp, Homo sapiens
ctcggcattcacacacagcct

SEQ ID NO: 6130178 - DNA, 21 bp, Homo sapiens
ctcggccacccgcctccctct

SEQ ID NO: 6130179 - DNA, 14 bp, Homo sapiens
ctcggccactgtgt

SEQ ID NO: 6130180 - DNA, 18 bp, Homo sapiens
ctcggccactgtgtctct

SEQ ID NO: 6130181 - DNA, 18 bp, Homo sapiens
ctcggccagagctcccag

SEQ ID NO: 6130182 - DNA, 19 bp, Homo sapiens
ctcggccagagctcccagg

SEQ ID NO: 6130183 - DNA, 23 bp, Homo sapiens
ctcggccattgaacactgcaccc

SEQ ID NO: 6130184 - DNA, 13 bp, Homo sapiens
ctcggcccatctg

SEQ ID NO: 6130185 - DNA, 24 bp, Homo sapiens
ctcggcccatctgtccatcctcct

SEQ ID NO: 6130186 - DNA, 15 bp, Homo sapiens
ctcggccccatcgcc

SEQ ID NO: 6130187 - DNA, 17 bp, Homo sapiens
ctcggccccatcgcccc

SEQ ID NO: 6130188 - DNA, 16 bp, Homo sapiens
ctcggccccctccatc

SEQ ID NO: 6130189 - DNA, 14 bp, Homo sapiens
ctcggccccgtctc

SEQ ID NO: 6130190 - DNA, 20 bp, Homo sapiens
ctcggcccctcaccacctct

SEQ ID NO: 6130191 - DNA, 14 bp, Homo sapiens
ctcggccctccctg

SEQ ID NO: 6130192 - DNA, 13 bp, Homo sapiens
ctcggccctgaac

SEQ ID NO: 6130193 - DNA, 14 bp, Homo sapiens
ctcggccctgaacc

SEQ ID NO: 6130194 - DNA, 19 bp, Homo sapiens
ctcggccctgaaccacgag

SEQ ID NO: 6130195 - DNA, 21 bp, Homo sapiens
ctcggccctgtagccctggcc

SEQ ID NO: 6130196 - DNA, 22 bp, Homo sapiens
ctcggccctgtagccctggccc

SEQ ID NO: 6130197 - DNA, 18 bp, Homo sapiens
ctcggccgcccggcagtg

SEQ ID NO: 6130198 - DNA, 20 bp, Homo sapiens
ctcggccgtacatctctgtg

SEQ ID NO: 6130199 - DNA, 13 bp, Homo sapiens
ctcggcctcccaa

SEQ ID NO: 6130200 - DNA, 14 bp, Homo sapiens
ctcggcctcccaaa

SEQ ID NO: 6130201 - DNA, 18 bp, Homo sapiens
ctcggcctcccaaagtgc

SEQ ID NO: 6130202 - DNA, 22 bp, Homo sapiens
ctcggcctcccaaagtgctggg

SEQ ID NO: 6130203 - DNA, 13 bp, Homo sapiens
ctcggcctgcccc

SEQ ID NO: 6130204 - DNA, 18 bp, Homo sapiens
ctcggcctggctggccag

SEQ ID NO: 6130205 - DNA, 19 bp, Homo sapiens
ctcggcctggctggccagg

SEQ ID NO: 6130206 - DNA, 14 bp, Homo sapiens
ctcggcctggcttc

SEQ ID NO: 6130207 - DNA, 17 bp, Homo sapiens
ctcggccttcacaatct

SEQ ID NO: 6130208 - DNA, 19 bp, Homo sapiens
ctcggcgcccccacccctg

SEQ ID NO: 6130209 - DNA, 23 bp, Homo sapiens
ctcggcgttagtccctagccgcg

SEQ ID NO: 6130210 - DNA, 22 bp, Homo sapiens
ctcggctactggttacctggag

SEQ ID NO: 6130211 - DNA, 23 bp, Homo sapiens
ctcggctactggttacctggaga

SEQ ID NO: 6130212 - DNA, 19 bp, Homo sapiens
ctcggctaggggtcctcgg

SEQ ID NO: 6130213 - DNA, 22 bp, Homo sapiens
ctcggctcactgcaacctctgc

SEQ ID NO: 6130214 - DNA, 15 bp, Homo sapiens
ctcggctcaggctct

SEQ ID NO: 6130215 - DNA, 19 bp, Homo sapiens
ctcggctccccatgtgtcc

SEQ ID NO: 6130216 - DNA, 13 bp, Homo sapiens
ctcggctcctgct

SEQ ID NO: 6130217 - DNA, 13 bp, Homo sapiens
ctcggctctggag

SEQ ID NO: 6130218 - DNA, 21 bp, Homo sapiens
ctcggctgccaggggctctgt

SEQ ID NO: 6130219 - DNA, 16 bp, Homo sapiens
ctcggctggaagaaca

SEQ ID NO: 6130220 - DNA, 13 bp, Homo sapiens
ctcggctggctcc

SEQ ID NO: 6130221 - DNA, 14 bp, Homo sapiens
ctcggctggctccc

SEQ ID NO: 6130222 - DNA, 21 bp, Homo sapiens
ctcggctggctcccctgcagc

SEQ ID NO: 6130223 - DNA, 12 bp, Homo sapiens
ctcggctgtctc

SEQ ID NO: 6130224 - DNA, 16 bp, Homo sapiens
ctcggctgtctcctgt

SEQ ID NO: 6130225 - DNA, 17 bp, Homo sapiens
ctcggctgtggagaaca

SEQ ID NO: 6130226 - DNA, 18 bp, Homo sapiens
ctcggcttgatcacagct

SEQ ID NO: 6130227 - DNA, 18 bp, Homo sapiens
ctcggcttggatcctggg

SEQ ID NO: 6130228 - DNA, 20 bp, Homo sapiens
ctcggcttgtgggctggtgc

SEQ ID NO: 6130229 - DNA, 22 bp, Homo sapiens
ctcggctttggctcgggacttc

SEQ ID NO: 6130230 - DNA, 17 bp, Homo sapiens
ctcggcttttctcagct

SEQ ID NO: 6130231 - DNA, 16 bp, Homo sapiens
ctcgggaacctcactc

SEQ ID NO: 6130232 - DNA, 15 bp, Homo sapiens
ctcgggaagcagcca

SEQ ID NO: 6130233 - DNA, 17 bp, Homo sapiens
ctcgggaagcagccagc

SEQ ID NO: 6130234 - DNA, 19 bp, Homo sapiens
ctcgggaagcagccagctc

SEQ ID NO: 6130235 - DNA, 16 bp, Homo sapiens
ctcgggaagggagggg

SEQ ID NO: 6130236 - DNA, 15 bp, Homo sapiens
ctcgggacacctgcc

SEQ ID NO: 6130237 - DNA, 16 bp, Homo sapiens
ctcgggaccccactcg

SEQ ID NO: 6130238 - DNA, 11 bp, Homo sapiens
ctcgggaccct

SEQ ID NO: 6130239 - DNA, 19 bp, Homo sapiens
ctcgggagccctagccctg

SEQ ID NO: 6130240 - DNA, 14 bp, Homo sapiens
ctcgggagctgcac

SEQ ID NO: 6130241 - DNA, 15 bp, Homo sapiens
ctcgggagctgcaca

SEQ ID NO: 6130242 - DNA, 21 bp, Homo sapiens
ctcgggagctgcacacacctg

SEQ ID NO: 6130243 - DNA, 16 bp, Homo sapiens
ctcgggcccacctggc

SEQ ID NO: 6130244 - DNA, 18 bp, Homo sapiens
ctcgggcccacctggcca

SEQ ID NO: 6130245 - DNA, 19 bp, Homo sapiens
ctcgggcccacctggccac

SEQ ID NO: 6130246 - DNA, 18 bp, Homo sapiens
ctcgggcccagcccccac

SEQ ID NO: 6130247 - DNA, 24 bp, Homo sapiens
ctcgggcccaggccatcttccagg

SEQ ID NO: 6130248 - DNA, 16 bp, Homo sapiens
ctcgggccctgtggtg

SEQ ID NO: 6130249 - DNA, 13 bp, Homo sapiens
ctcgggccgaggc

SEQ ID NO: 6130250 - DNA, 17 bp, Homo sapiens
ctcgggccgaggcccag

SEQ ID NO: 6130251 - DNA, 12 bp, Homo sapiens
ctcgggccgcct

SEQ ID NO: 6130252 - DNA, 16 bp, Homo sapiens
ctcgggcgcctgcgct

SEQ ID NO: 6130253 - DNA, 22 bp, Homo sapiens
ctcgggcgcctgcgctcctctg

SEQ ID NO: 6130254 - DNA, 15 bp, Homo sapiens
ctcgggctctctcac

SEQ ID NO: 6130255 - DNA, 17 bp, Homo sapiens
ctcgggctctctcaccc

SEQ ID NO: 6130256 - DNA, 18 bp, Homo sapiens
ctcgggcttgagtgagaa

SEQ ID NO: 6130257 - DNA, 17 bp, Homo sapiens
ctcggggaataaaacat

SEQ ID NO: 6130258 - DNA, 23 bp, Homo sapiens
ctcggggaataaaacatttctct

SEQ ID NO: 6130259 - DNA, 13 bp, Homo sapiens
ctcggggagcctt

SEQ ID NO: 6130260 - DNA, 13 bp, Homo sapiens
ctcggggaggcag

SEQ ID NO: 6130261 - DNA, 19 bp, Homo sapiens
ctcggggatgtgtcctgac

SEQ ID NO: 6130262 - DNA, 15 bp, Homo sapiens
ctcggggcaggaagt

SEQ ID NO: 6130263 - DNA, 18 bp, Homo sapiens
ctcggggcccccatcttg

SEQ ID NO: 6130264 - DNA, 20 bp, Homo sapiens
ctcggggcgacccctcagtg

SEQ ID NO: 6130265 - DNA, 20 bp, Homo sapiens
ctcggggctccaggctggct

SEQ ID NO: 6130266 - DNA, 13 bp, Homo sapiens
ctcggggctgggg

SEQ ID NO: 6130267 - DNA, 22 bp, Homo sapiens
ctcggggctgggggctgcaggg

SEQ ID NO: 6130268 - DNA, 15 bp, Homo sapiens
ctcgggggcgcctgg

SEQ ID NO: 6130269 - DNA, 17 bp, Homo sapiens
ctcgggggcgcctggag

SEQ ID NO: 6130270 - DNA, 23 bp, Homo sapiens
ctcggggggtcacaggcccagaa

SEQ ID NO: 6130271 - DNA, 13 bp, Homo sapiens
ctcgggggtgctg

SEQ ID NO: 6130272 - DNA, 19 bp, Homo sapiens
ctcgggggtgctggggcca

SEQ ID NO: 6130273 - DNA, 22 bp, Homo sapiens
ctcgggggtgctggggccaggg

SEQ ID NO: 6130274 - DNA, 17 bp, Homo sapiens
ctcggggtaaaaagtgg

SEQ ID NO: 6130275 - DNA, 15 bp, Homo sapiens
ctcggggtccaccag

SEQ ID NO: 6130276 - DNA, 14 bp, Homo sapiens
ctcggggtccctgg

SEQ ID NO: 6130277 - DNA, 20 bp, Homo sapiens
ctcggggtgtgtcatttcta

SEQ ID NO: 6130278 - DNA, 20 bp, Homo sapiens
ctcgggtctccccacctgca

SEQ ID NO: 6130279 - DNA, 15 bp, Homo sapiens
ctcgggtctgggcag

SEQ ID NO: 6130280 - DNA, 22 bp, Homo sapiens
ctcgggtgcgtgtgtttgtatg

SEQ ID NO: 6130281 - DNA, 21 bp, Homo sapiens
ctcgggtggctagtcagagag

SEQ ID NO: 6130282 - DNA, 16 bp, Homo sapiens
ctcgggtgggggagcc

SEQ ID NO: 6130283 - DNA, 18 bp, Homo sapiens
ctcggtacccggggccca

SEQ ID NO: 6130284 - DNA, 18 bp, Homo sapiens
ctcggtatagttttgtca

SEQ ID NO: 6130285 - DNA, 14 bp, Homo sapiens
ctcggtatctggct

SEQ ID NO: 6130286 - DNA, 19 bp, Homo sapiens
ctcggtatctggcttccct

SEQ ID NO: 6130287 - DNA, 15 bp, Homo sapiens
ctcggtcacctgtgc

SEQ ID NO: 6130288 - DNA, 21 bp, Homo sapiens
ctcggtcagcgactggatgct

SEQ ID NO: 6130289 - DNA, 12 bp, Homo sapiens
ctcggtcgcccc

SEQ ID NO: 6130290 - DNA, 19 bp, Homo sapiens
ctcggtctccaccccaggg

SEQ ID NO: 6130291 - DNA, 20 bp, Homo sapiens
ctcggtgaccactcttcttt

SEQ ID NO: 6130292 - DNA, 11 bp, Homo sapiens
ctcggtgcctt

SEQ ID NO: 6130293 - DNA, 22 bp, Homo sapiens
ctcggtgctgaacgacagtccc

SEQ ID NO: 6130294 - DNA, 14 bp, Homo sapiens
ctcggtggacccag

SEQ ID NO: 6130295 - DNA, 18 bp, Homo sapiens
ctcggtggacccagggat

SEQ ID NO: 6130296 - DNA, 18 bp, Homo sapiens
ctcggtggcatttgctga

SEQ ID NO: 6130297 - DNA, 14 bp, Homo sapiens
ctcggtggccatgc

SEQ ID NO: 6130298 - DNA, 15 bp, Homo sapiens
ctcggtggccatgct

SEQ ID NO: 6130299 - DNA, 14 bp, Homo sapiens
ctaagagagaatga

SEQ ID NO: 6130300 - DNA, 16 bp, Homo sapiens
ctaagagattctgatt

SEQ ID NO: 6130301 - DNA, 16 bp, Homo sapiens
ctaagagattcttcta

SEQ ID NO: 6130302 - DNA, 12 bp, Homo sapiens
ctaagagattta

SEQ ID NO: 6130303 - DNA, 20 bp, Homo sapiens
ctaagagccatttaggggcc

SEQ ID NO: 6130304 - DNA, 16 bp, Homo sapiens
ctaagagctagcgctg

SEQ ID NO: 6130305 - DNA, 21 bp, Homo sapiens
ctaagaggaaactagtgtttg

SEQ ID NO: 6130306 - DNA, 19 bp, Homo sapiens
ctaagaggatacaaattta

SEQ ID NO: 6130307 - DNA, 19 bp, Homo sapiens
ctaagaggattcaacacct

SEQ ID NO: 6130308 - DNA, 23 bp, Homo sapiens
ctaagaggcgacttcctctccag

SEQ ID NO: 6130309 - DNA, 16 bp, Homo sapiens
ctaagaggctgccctc

SEQ ID NO: 6130310 - DNA, 18 bp, Homo sapiens
ctaagaggctgccctcct

SEQ ID NO: 6130311 - DNA, 23 bp, Homo sapiens
ctaagagggagggagggctccag

SEQ ID NO: 6130312 - DNA, 20 bp, Homo sapiens
ctaagagggcccaaagaatt

SEQ ID NO: 6130313 - DNA, 15 bp, Homo sapiens
ctaagaggggctgga

SEQ ID NO: 6130314 - DNA, 21 bp, Homo sapiens
ctaagaggggctggacctggc

SEQ ID NO: 6130315 - DNA, 22 bp, Homo sapiens
ctaagagtgtcactgagctgtg

SEQ ID NO: 6130316 - DNA, 15 bp, Homo sapiens
ctaagatacactgca

SEQ ID NO: 6130317 - DNA, 18 bp, Homo sapiens
ctaagatacactgcactt

SEQ ID NO: 6130318 - DNA, 17 bp, Homo sapiens
ctaagatagaaagctgg

SEQ ID NO: 6130319 - DNA, 19 bp, Homo sapiens
ctaagatagaaagctggac

SEQ ID NO: 6130320 - DNA, 23 bp, Homo sapiens
ctaagatagaaagctggactgac

SEQ ID NO: 6130321 - DNA, 23 bp, Homo sapiens
ctaagatatacttgtttttgtaa

SEQ ID NO: 6130322 - DNA, 17 bp, Homo sapiens
ctaagatcacacaaata

SEQ ID NO: 6130323 - DNA, 17 bp, Homo sapiens
ctaagatcggttaacaa

SEQ ID NO: 6130324 - DNA, 14 bp, Homo sapiens
ctaagatcttagat

SEQ ID NO: 6130325 - DNA, 16 bp, Homo sapiens
ctaagatcttagattc

SEQ ID NO: 6130326 - DNA, 17 bp, Homo sapiens
ctaagatcttagattct

SEQ ID NO: 6130327 - DNA, 20 bp, Homo sapiens
ctaagatcttagattctctg

SEQ ID NO: 6130328 - DNA, 21 bp, Homo sapiens
ctaagatcttgcctctttcct

SEQ ID NO: 6130329 - DNA, 12 bp, Homo sapiens
ctaagatgaaat

SEQ ID NO: 6130330 - DNA, 15 bp, Homo sapiens
ctaagatgaaattgc

SEQ ID NO: 6130331 - DNA, 16 bp, Homo sapiens
ctaagatgaatccaaa

SEQ ID NO: 6130332 - DNA, 22 bp, Homo sapiens
ctaagatgaatccaaatgtgaa

SEQ ID NO: 6130333 - DNA, 24 bp, Homo sapiens
ctaagatgagatttgccagcacag

SEQ ID NO: 6130334 - DNA, 22 bp, Homo sapiens
ctaagatgtattaacctacctg

SEQ ID NO: 6130335 - DNA, 19 bp, Homo sapiens
ctaagatgtgatattctaa

SEQ ID NO: 6130336 - DNA, 22 bp, Homo sapiens
ctaagatgtgatattctaagac

SEQ ID NO: 6130337 - DNA, 23 bp, Homo sapiens
ctaagatgtgatattctaagact

SEQ ID NO: 6130338 - DNA, 19 bp, Homo sapiens
ctaagatgttatatttttc

SEQ ID NO: 6130339 - DNA, 20 bp, Homo sapiens
ctaagatgttatatttttct

SEQ ID NO: 6130340 - DNA, 17 bp, Homo sapiens
ctaagatgttcactgtg

SEQ ID NO: 6130341 - DNA, 14 bp, Homo sapiens
ctaagattctaaag

SEQ ID NO: 6130342 - DNA, 15 bp, Homo sapiens
ctaagattctaaagg

SEQ ID NO: 6130343 - DNA, 16 bp, Homo sapiens
ctaagattctaaaggt

SEQ ID NO: 6130344 - DNA, 21 bp, Homo sapiens
ctaagattctaatgatgatca

SEQ ID NO: 6130345 - DNA, 12 bp, Homo sapiens
ctaagattctag

SEQ ID NO: 6130346 - DNA, 15 bp, Homo sapiens
ctaagattctagatc

SEQ ID NO: 6130347 - DNA, 22 bp, Homo sapiens
ctaagattctagatcagatgct

SEQ ID NO: 6130348 - DNA, 19 bp, Homo sapiens
ctaagattctgattttagg

SEQ ID NO: 6130349 - DNA, 13 bp, Homo sapiens
ctaagattgtaca

SEQ ID NO: 6130350 - DNA, 15 bp, Homo sapiens
ctaagattgtacata

SEQ ID NO: 6130351 - DNA, 14 bp, Homo sapiens
ctaagatttatctg

SEQ ID NO: 6130352 - DNA, 14 bp, Homo sapiens
ctaagatttctgtc

SEQ ID NO: 6130353 - DNA, 23 bp, Homo sapiens
ctaagatttggtttgggatcaat

SEQ ID NO: 6130354 - DNA, 21 bp, Homo sapiens
ctaagatttttatattaaaaa

SEQ ID NO: 6130355 - DNA, 20 bp, Homo sapiens
ctaagcaaccacactgcttg

SEQ ID NO: 6130356 - DNA, 13 bp, Homo sapiens
ctaagcaagccag

SEQ ID NO: 6130357 - DNA, 14 bp, Homo sapiens
ctaagcaagccagg

SEQ ID NO: 6130358 - DNA, 15 bp, Homo sapiens
ctaagcaagccagga

SEQ ID NO: 6130359 - DNA, 17 bp, Homo sapiens
ctaagcaatcactgggc

SEQ ID NO: 6130360 - DNA, 18 bp, Homo sapiens
ctaagcaatcactgggcc

SEQ ID NO: 6130361 - DNA, 14 bp, Homo sapiens
ctaagcaatgcaaa

SEQ ID NO: 6130362 - DNA, 16 bp, Homo sapiens
ctaagcacattatgtt

SEQ ID NO: 6130363 - DNA, 20 bp, Homo sapiens
ctaagcactgtgtttatatg

SEQ ID NO: 6130364 - DNA, 13 bp, Homo sapiens
ctaagcacttcta

SEQ ID NO: 6130365 - DNA, 21 bp, Homo sapiens
ctaagcagaaagtgcctttca

SEQ ID NO: 6130366 - DNA, 19 bp, Homo sapiens
ctaagcagaggaggggccg

SEQ ID NO: 6130367 - DNA, 23 bp, Homo sapiens
ctaagcagaggaggggccgctgc

SEQ ID NO: 6130368 - DNA, 21 bp, Homo sapiens
ctaagcagctggtcttttctc

SEQ ID NO: 6130369 - DNA, 23 bp, Homo sapiens
ctaagcaggaaggtctcatgcct

SEQ ID NO: 6130370 - DNA, 18 bp, Homo sapiens
ctaagcaggggagaagcg

SEQ ID NO: 6130371 - DNA, 23 bp, Homo sapiens
ctaagcagttatggtgatgactt

SEQ ID NO: 6130372 - DNA, 21 bp, Homo sapiens
ctaagcagttgcaatgatcag

SEQ ID NO: 6130373 - DNA, 21 bp, Homo sapiens
ctaagcatacgtatacaataa

SEQ ID NO: 6130374 - DNA, 21 bp, Homo sapiens
ctaagcatagcaaacagagga

SEQ ID NO: 6130375 - DNA, 14 bp, Homo sapiens
ctaagcatctaagt

SEQ ID NO: 6130376 - DNA, 15 bp, Homo sapiens
ctaagcatctaagtt

SEQ ID NO: 6130377 - DNA, 22 bp, Homo sapiens
ctaagcatcttgtcaagaaata

SEQ ID NO: 6130378 - DNA, 16 bp, Homo sapiens
ctaagcattagcttta

SEQ ID NO: 6130379 - DNA, 13 bp, Homo sapiens
ctaagccaagctg

SEQ ID NO: 6130380 - DNA, 15 bp, Homo sapiens
ctaagccaagctgtg

SEQ ID NO: 6130381 - DNA, 14 bp, Homo sapiens
ctaagccaagggcc

SEQ ID NO: 6130382 - DNA, 19 bp, Homo sapiens
ctaagccaagttttaaata

SEQ ID NO: 6130383 - DNA, 20 bp, Homo sapiens
ctaagccactcttccaaagg

SEQ ID NO: 6130384 - DNA, 13 bp, Homo sapiens
ctaagccagcctg

SEQ ID NO: 6130385 - DNA, 15 bp, Homo sapiens
ctaagccaggcctgg

SEQ ID NO: 6130386 - DNA, 22 bp, Homo sapiens
ctaagccaggcctggctggagg

SEQ ID NO: 6130387 - DNA, 23 bp, Homo sapiens
ctaagccaggcctggctggagga

SEQ ID NO: 6130388 - DNA, 23 bp, Homo sapiens
ctaagccatcatatcccctgtgc

SEQ ID NO: 6130389 - DNA, 13 bp, Homo sapiens
ctaagccatgcca

SEQ ID NO: 6130390 - DNA, 15 bp, Homo sapiens
ctaagccccagcaag

SEQ ID NO: 6130391 - DNA, 19 bp, Homo sapiens
ctaagccccagcaagcaat

SEQ ID NO: 6130392 - DNA, 16 bp, Homo sapiens
ctaagcccccagggcc

SEQ ID NO: 6130393 - DNA, 16 bp, Homo sapiens
ctaagccccgtctgac

SEQ ID NO: 6130394 - DNA, 20 bp, Homo sapiens
ctaagccctgtcgagacact

SEQ ID NO: 6130395 - DNA, 18 bp, Homo sapiens
ctaagccctgttctcctg

SEQ ID NO: 6130396 - DNA, 23 bp, Homo sapiens
ctaagccctgttctcctgtccct

SEQ ID NO: 6130397 - DNA, 17 bp, Homo sapiens
ctaagcctacctgctct

SEQ ID NO: 6130398 - DNA, 23 bp, Homo sapiens
ctaagcctacctgctctccaagt

SEQ ID NO: 6130399 - DNA, 13 bp, Homo sapiens
ctaagcctggaag

SEQ ID NO: 6130400 - DNA, 17 bp, Homo sapiens
ctaagcctggaagccat

SEQ ID NO: 6130401 - DNA, 20 bp, Homo sapiens
ctaagcctggaagccatcct

SEQ ID NO: 6130402 - DNA, 16 bp, Homo sapiens
ctaagcctggacacag

SEQ ID NO: 6130403 - DNA, 19 bp, Homo sapiens
ctaagcctggcttagaagg

SEQ ID NO: 6130404 - DNA, 13 bp, Homo sapiens
ctaagcctgtccc

SEQ ID NO: 6130405 - DNA, 13 bp, Homo sapiens
ctaagcctgtggc

SEQ ID NO: 6130406 - DNA, 13 bp, Homo sapiens
ctaagcctgttgc

SEQ ID NO: 6130407 - DNA, 16 bp, Homo sapiens
ctaagcctttccataa

SEQ ID NO: 6130408 - DNA, 17 bp, Homo sapiens
ctaagcctttccataag

SEQ ID NO: 6130409 - DNA, 20 bp, Homo sapiens
ctaagcgcctattgtttgta

SEQ ID NO: 6130410 - DNA, 23 bp, Homo sapiens
ctaagcgctagaggaagcagcca

SEQ ID NO: 6130411 - DNA, 22 bp, Homo sapiens
ctaagcggaccagcctccctgt

SEQ ID NO: 6130412 - DNA, 20 bp, Homo sapiens
ctaagcggctgtttactgct

SEQ ID NO: 6130413 - DNA, 21 bp, Homo sapiens
ctaagcggctgtttactgctt

SEQ ID NO: 6130414 - DNA, 21 bp, Homo sapiens
ctaagcgggcccgggtcccac

SEQ ID NO: 6130415 - DNA, 14 bp, Homo sapiens
ctaagcggtggagg

SEQ ID NO: 6130416 - DNA, 15 bp, Homo sapiens
ctaagcgtgctgaca

SEQ ID NO: 6130417 - DNA, 19 bp, Homo sapiens
ctaagctaccttgtcatat

SEQ ID NO: 6130418 - DNA, 14 bp, Homo sapiens
ctaagctaggaatg

SEQ ID NO: 6130419 - DNA, 17 bp, Homo sapiens
ctaagctaggaatgaaa

SEQ ID NO: 6130420 - DNA, 22 bp, Homo sapiens
ctaagctaggaatgaaatcctg

SEQ ID NO: 6130421 - DNA, 15 bp, Homo sapiens
ctaagctcaaatgta

SEQ ID NO: 6130422 - DNA, 16 bp, Homo sapiens
ctaagctcaaatgtat

SEQ ID NO: 6130423 - DNA, 16 bp, Homo sapiens
ctaagctcacgtcctg

SEQ ID NO: 6130424 - DNA, 14 bp, Homo sapiens
ctaagctccagccc

SEQ ID NO: 6130425 - DNA, 23 bp, Homo sapiens
ctaagctccaggtgccctgtggg

SEQ ID NO: 6130426 - DNA, 15 bp, Homo sapiens
ctaagctctctgggc

SEQ ID NO: 6130427 - DNA, 19 bp, Homo sapiens
ctaagctgcagcttcctgt

SEQ ID NO: 6130428 - DNA, 13 bp, Homo sapiens
ctaagctgcaggc

SEQ ID NO: 6130429 - DNA, 14 bp, Homo sapiens
ctaagctgcggaat

SEQ ID NO: 6130430 - DNA, 17 bp, Homo sapiens
ctaagctggagctcttg

SEQ ID NO: 6130431 - DNA, 19 bp, Homo sapiens
ctaagctggagctcttgga

SEQ ID NO: 6130432 - DNA, 21 bp, Homo sapiens
ctaagctggagctcttggaag

SEQ ID NO: 6130433 - DNA, 23 bp, Homo sapiens
ctaagctggagctcttggaagag

SEQ ID NO: 6130434 - DNA, 14 bp, Homo sapiens
ctaagctgtgtgca

SEQ ID NO: 6130435 - DNA, 17 bp, Homo sapiens
ctaagcttaaaaaaaac

SEQ ID NO: 6130436 - DNA, 14 bp, Homo sapiens
ctaagctttctcct

SEQ ID NO: 6130437 - DNA, 15 bp, Homo sapiens
ctaagctttctcctt

SEQ ID NO: 6130438 - DNA, 16 bp, Homo sapiens
ctaagctttctccttt

SEQ ID NO: 6130439 - DNA, 22 bp, Homo sapiens
ctaagctttgccagctgctgct

SEQ ID NO: 6130440 - DNA, 15 bp, Homo sapiens
ctaaggaaactgctt

SEQ ID NO: 6130441 - DNA, 17 bp, Homo sapiens
ctaaggaacaatgccgc

SEQ ID NO: 6130442 - DNA, 17 bp, Homo sapiens
ctaaggaactaaaactt

SEQ ID NO: 6130443 - DNA, 18 bp, Homo sapiens
ctaaggaagctaaaagca

SEQ ID NO: 6130444 - DNA, 18 bp, Homo sapiens
ctaaggaagtatcagcac

SEQ ID NO: 6130445 - DNA, 20 bp, Homo sapiens
ctaaggacctgaaattccaa

SEQ ID NO: 6130446 - DNA, 14 bp, Homo sapiens
ctaaggactttttc

SEQ ID NO: 6130447 - DNA, 13 bp, Homo sapiens
ctaaggagaaatg

SEQ ID NO: 6130448 - DNA, 20 bp, Homo sapiens
ctaaggagcctaactccaaa

SEQ ID NO: 6130449 - DNA, 20 bp, Homo sapiens
ctaaggaggggaaaaaaatg

SEQ ID NO: 6130450 - DNA, 23 bp, Homo sapiens
ctaaggagtgtagcaactacagt

SEQ ID NO: 6130451 - DNA, 20 bp, Homo sapiens
ctaaggatagcaccgctttt

SEQ ID NO: 6130452 - DNA, 19 bp, Homo sapiens
ctaaggatagcctttgtag

SEQ ID NO: 6130453 - DNA, 15 bp, Homo sapiens
ctaaggatctctcag

SEQ ID NO: 6130454 - DNA, 18 bp, Homo sapiens
ctaaggatctctcaggag

SEQ ID NO: 6130455 - DNA, 20 bp, Homo sapiens
ctaaggatctctcaggagca

SEQ ID NO: 6130456 - DNA, 23 bp, Homo sapiens
ctaaggatctctcaggagcacag

SEQ ID NO: 6130457 - DNA, 19 bp, Homo sapiens
ctaaggatgtcacagggcc

SEQ ID NO: 6130458 - DNA, 19 bp, Homo sapiens
ctaaggattagtccctggc

SEQ ID NO: 6130459 - DNA, 19 bp, Homo sapiens
ctaaggatttttccatgga

SEQ ID NO: 6130460 - DNA, 20 bp, Homo sapiens
ctaaggcagacaggaaggaa

SEQ ID NO: 6130461 - DNA, 13 bp, Homo sapiens
ctaaggcagctga

SEQ ID NO: 6130462 - DNA, 14 bp, Homo sapiens
ctaaggcaggagga

SEQ ID NO: 6130463 - DNA, 17 bp, Homo sapiens
ctaaggcatgctcccag

SEQ ID NO: 6130464 - DNA, 18 bp, Homo sapiens
ctaaggcatgctcccagc

SEQ ID NO: 6130465 - DNA, 20 bp, Homo sapiens
ctaaggcatgtgtgaaacat

SEQ ID NO: 6130466 - DNA, 16 bp, Homo sapiens
ctaaggccaaggcctc

SEQ ID NO: 6130467 - DNA, 23 bp, Homo sapiens
ctaaggccactgttttaaaagat

SEQ ID NO: 6130468 - DNA, 22 bp, Homo sapiens
ctaaggccagctagagcttcca

SEQ ID NO: 6130469 - DNA, 16 bp, Homo sapiens
ctaaggcccagctgcc

SEQ ID NO: 6130470 - DNA, 19 bp, Homo sapiens
ctaaggcccagctgccagg

SEQ ID NO: 6130471 - DNA, 21 bp, Homo sapiens
ctaaggcccagctgccaggga

SEQ ID NO: 6130472 - DNA, 13 bp, Homo sapiens
ctaaggcccccaa

SEQ ID NO: 6130473 - DNA, 22 bp, Homo sapiens
ctaaggccgtgtctctgaggac

SEQ ID NO: 6130474 - DNA, 13 bp, Homo sapiens
ctaaggcctactt

SEQ ID NO: 6130475 - DNA, 16 bp, Homo sapiens
ctcggtgggccagagc

SEQ ID NO: 6130476 - DNA, 10 bp, Homo sapiens
ctcggtgtaa

SEQ ID NO: 6130477 - DNA, 22 bp, Homo sapiens
ctcggtgtccccaccatctgct

SEQ ID NO: 6130478 - DNA, 16 bp, Homo sapiens
ctcggtgtggagaagc

SEQ ID NO: 6130479 - DNA, 17 bp, Homo sapiens
ctcggtgtggagaagcg

SEQ ID NO: 6130480 - DNA, 23 bp, Homo sapiens
ctcggtgtggagaagcggctggc

SEQ ID NO: 6130481 - DNA, 15 bp, Homo sapiens
ctcggttgaaacctg

SEQ ID NO: 6130482 - DNA, 15 bp, Homo sapiens
ctcggtttgccaaaa

SEQ ID NO: 6130483 - DNA, 16 bp, Homo sapiens
ctcgtaagatttcctt

SEQ ID NO: 6130484 - DNA, 19 bp, Homo sapiens
ctcgtaatagcttctgtgt

SEQ ID NO: 6130485 - DNA, 21 bp, Homo sapiens
ctcgtaatagcttctgtgtgt

SEQ ID NO: 6130486 - DNA, 15 bp, Homo sapiens
ctcgtaccagccagg

SEQ ID NO: 6130487 - DNA, 20 bp, Homo sapiens
ctcgtactctctctcttttc

SEQ ID NO: 6130488 - DNA, 22 bp, Homo sapiens
ctcgtactttcacatctctgta

SEQ ID NO: 6130489 - DNA, 17 bp, Homo sapiens
ctcgtagaacctgcgca

SEQ ID NO: 6130490 - DNA, 16 bp, Homo sapiens
ctcgtagatgctgcct

SEQ ID NO: 6130491 - DNA, 19 bp, Homo sapiens
ctcgtaggggatgtggagt

SEQ ID NO: 6130492 - DNA, 15 bp, Homo sapiens
ctcgtatctccttga

SEQ ID NO: 6130493 - DNA, 18 bp, Homo sapiens
ctcgtatttctttttcct

SEQ ID NO: 6130494 - DNA, 22 bp, Homo sapiens
ctcgtcagctgggatgtgaagt

SEQ ID NO: 6130495 - DNA, 16 bp, Homo sapiens
ctcgtcaggaggtgcc

SEQ ID NO: 6130496 - DNA, 12 bp, Homo sapiens
ctcgtcaggctg

SEQ ID NO: 6130497 - DNA, 21 bp, Homo sapiens
ctcgtccaaggcagttctgtg

SEQ ID NO: 6130498 - DNA, 19 bp, Homo sapiens
ctcgtccaagggacagccc

SEQ ID NO: 6130499 - DNA, 21 bp, Homo sapiens
ctcgtccaagggacagcccac

SEQ ID NO: 6130500 - DNA, 19 bp, Homo sapiens
ctcgtccacaggggcaggc

SEQ ID NO: 6130501 - DNA, 22 bp, Homo sapiens
ctcgtccacaggggcaggcctg

SEQ ID NO: 6130502 - DNA, 13 bp, Homo sapiens
ctcgtccaccccc

SEQ ID NO: 6130503 - DNA, 17 bp, Homo sapiens
ctcgtccaccccccaca

SEQ ID NO: 6130504 - DNA, 18 bp, Homo sapiens
ctcgtccaccccccacac

SEQ ID NO: 6130505 - DNA, 19 bp, Homo sapiens
ctcgtccaccccccacaca

SEQ ID NO: 6130506 - DNA, 15 bp, Homo sapiens
ctcgtcccatccagc

SEQ ID NO: 6130507 - DNA, 18 bp, Homo sapiens
ctcgtccccaagtgacct

SEQ ID NO: 6130508 - DNA, 12 bp, Homo sapiens
ctcgtccccctc

SEQ ID NO: 6130509 - DNA, 16 bp, Homo sapiens
ctcgtccccctccctg

SEQ ID NO: 6130510 - DNA, 18 bp, Homo sapiens
ctcgtccccctccctgcc

SEQ ID NO: 6130511 - DNA, 19 bp, Homo sapiens
ctcgtccccctccctgccc

SEQ ID NO: 6130512 - DNA, 13 bp, Homo sapiens
ctcgtccctccct

SEQ ID NO: 6130513 - DNA, 17 bp, Homo sapiens
ctcgtccctccctcact

SEQ ID NO: 6130514 - DNA, 15 bp, Homo sapiens
ctcgtccctcctccc

SEQ ID NO: 6130515 - DNA, 22 bp, Homo sapiens
ctcgtccggcctgcagcccaga

SEQ ID NO: 6130516 - DNA, 15 bp, Homo sapiens
ctcgtccgtctgtct

SEQ ID NO: 6130517 - DNA, 16 bp, Homo sapiens
ctcgtccgtctgtctc

SEQ ID NO: 6130518 - DNA, 17 bp, Homo sapiens
ctcgtccgtctgtctcg

SEQ ID NO: 6130519 - DNA, 23 bp, Homo sapiens
ctcgtcctcactggtctacactg

SEQ ID NO: 6130520 - DNA, 16 bp, Homo sapiens
ctcgtcctccccctgc

SEQ ID NO: 6130521 - DNA, 17 bp, Homo sapiens
ctcgtcctccccctgcc

SEQ ID NO: 6130522 - DNA, 14 bp, Homo sapiens
ctcgtcctcgtttg

SEQ ID NO: 6130523 - DNA, 19 bp, Homo sapiens
ctcgtcctcgtttgtgttc

SEQ ID NO: 6130524 - DNA, 13 bp, Homo sapiens
ctcgtcctgtccc

SEQ ID NO: 6130525 - DNA, 20 bp, Homo sapiens
ctcgtctccctggtgcctct

SEQ ID NO: 6130526 - DNA, 16 bp, Homo sapiens
ctcgtctgatgttttg

SEQ ID NO: 6130527 - DNA, 14 bp, Homo sapiens
ctcgtcttcattaa

SEQ ID NO: 6130528 - DNA, 14 bp, Homo sapiens
ctcgtcttcctctc

SEQ ID NO: 6130529 - DNA, 16 bp, Homo sapiens
ctcgtcttcctctctc

SEQ ID NO: 6130530 - DNA, 21 bp, Homo sapiens
ctcgtgacagcctctgactca

SEQ ID NO: 6130531 - DNA, 22 bp, Homo sapiens
ctcgtgacctacagggaactgg

SEQ ID NO: 6130532 - DNA, 17 bp, Homo sapiens
ctcgtgatatgctgctt

SEQ ID NO: 6130533 - DNA, 16 bp, Homo sapiens
ctcgtgatgggcccgc

SEQ ID NO: 6130534 - DNA, 18 bp, Homo sapiens
ctcgtgattggcatataa

SEQ ID NO: 6130535 - DNA, 16 bp, Homo sapiens
ctcgtgatttgcctgc

SEQ ID NO: 6130536 - DNA, 16 bp, Homo sapiens
ctcgtgcatccctgag

SEQ ID NO: 6130537 - DNA, 19 bp, Homo sapiens
ctcgtgcatccctgagaca

SEQ ID NO: 6130538 - DNA, 21 bp, Homo sapiens
ctcgtgccaccccgagggctg

SEQ ID NO: 6130539 - DNA, 15 bp, Homo sapiens
ctcgtgccagcagcc

SEQ ID NO: 6130540 - DNA, 16 bp, Homo sapiens
ctcgtgccagcagcct

SEQ ID NO: 6130541 - DNA, 22 bp, Homo sapiens
ctcgtgccagcagcctcgcaca

SEQ ID NO: 6130542 - DNA, 21 bp, Homo sapiens
ctcgtgccagtcgcgctgcct

SEQ ID NO: 6130543 - DNA, 22 bp, Homo sapiens
ctcgtgcccatcaagtgcagtc

SEQ ID NO: 6130544 - DNA, 12 bp, Homo sapiens
ctcgtgctttaa

SEQ ID NO: 6130545 - DNA, 15 bp, Homo sapiens
ctcgtgctttaagtg

SEQ ID NO: 6130546 - DNA, 12 bp, Homo sapiens
ctcgtggacacc

SEQ ID NO: 6130547 - DNA, 14 bp, Homo sapiens
ctcgtggacacctg

SEQ ID NO: 6130548 - DNA, 19 bp, Homo sapiens
ctcgtggacacctgccctg

SEQ ID NO: 6130549 - DNA, 20 bp, Homo sapiens
ctcgtggacacctgccctgc

SEQ ID NO: 6130550 - DNA, 21 bp, Homo sapiens
ctcgtggactgtgctggtgca

SEQ ID NO: 6130551 - DNA, 18 bp, Homo sapiens
ctcgtggagaatttttac

SEQ ID NO: 6130552 - DNA, 14 bp, Homo sapiens
ctcgtggccagccc

SEQ ID NO: 6130553 - DNA, 14 bp, Homo sapiens
ctcgtggccttccc

SEQ ID NO: 6130554 - DNA, 21 bp, Homo sapiens
ctcgtggcgcgggagctggga

SEQ ID NO: 6130555 - DNA, 15 bp, Homo sapiens
ctcgtggcggggcag

SEQ ID NO: 6130556 - DNA, 18 bp, Homo sapiens
ctcgtggcggggcagcag

SEQ ID NO: 6130557 - DNA, 13 bp, Homo sapiens
ctcgtgggctctg

SEQ ID NO: 6130558 - DNA, 17 bp, Homo sapiens
ctcgtgggtaaatatac

SEQ ID NO: 6130559 - DNA, 20 bp, Homo sapiens
ctcgtgggttcttcctctgt

SEQ ID NO: 6130560 - DNA, 14 bp, Homo sapiens
ctcgtggtatgtat

SEQ ID NO: 6130561 - DNA, 16 bp, Homo sapiens
ctcgtggtgaggctga

SEQ ID NO: 6130562 - DNA, 21 bp, Homo sapiens
ctcgtggttattagcaaggct

SEQ ID NO: 6130563 - DNA, 23 bp, Homo sapiens
ctcgtggttattagcaaggctgg

SEQ ID NO: 6130564 - DNA, 17 bp, Homo sapiens
ctcgtgtatcctggggc

SEQ ID NO: 6130565 - DNA, 18 bp, Homo sapiens
ctcgtgtatcctggggct

SEQ ID NO: 6130566 - DNA, 19 bp, Homo sapiens
ctcgtgtatcctggggctc

SEQ ID NO: 6130567 - DNA, 16 bp, Homo sapiens
ctcgtgtcagctcagg

SEQ ID NO: 6130568 - DNA, 23 bp, Homo sapiens
ctcgtgtcctgctagctgtctct

SEQ ID NO: 6130569 - DNA, 12 bp, Homo sapiens
ctcgtgtgattt

SEQ ID NO: 6130570 - DNA, 14 bp, Homo sapiens
ctcgtgtgtttcta

SEQ ID NO: 6130571 - DNA, 20 bp, Homo sapiens
ctcgttagagaatggcctga

SEQ ID NO: 6130572 - DNA, 19 bp, Homo sapiens
ctcgttaggacaaggctgt

SEQ ID NO: 6130573 - DNA, 18 bp, Homo sapiens
ctcgttagggaagagaaa

SEQ ID NO: 6130574 - DNA, 19 bp, Homo sapiens
ctcgttattgttgttgcca

SEQ ID NO: 6130575 - DNA, 15 bp, Homo sapiens
ctcgttcaaaacatt

SEQ ID NO: 6130576 - DNA, 18 bp, Homo sapiens
ctcgttcaaaacattcca

SEQ ID NO: 6130577 - DNA, 19 bp, Homo sapiens
ctcgttcaaaacattccaa

SEQ ID NO: 6130578 - DNA, 14 bp, Homo sapiens
ctcgttcccaaaga

SEQ ID NO: 6130579 - DNA, 15 bp, Homo sapiens
ctcgttcccccaggg

SEQ ID NO: 6130580 - DNA, 21 bp, Homo sapiens
ctcgttcccctcctcttccga

SEQ ID NO: 6130581 - DNA, 21 bp, Homo sapiens
ctcgttccggtccccacagac

SEQ ID NO: 6130582 - DNA, 23 bp, Homo sapiens
ctcgttcctgcagccagaaagga

SEQ ID NO: 6130583 - DNA, 14 bp, Homo sapiens
ctcgttcctttctc

SEQ ID NO: 6130584 - DNA, 13 bp, Homo sapiens
ctcgttgacatgc

SEQ ID NO: 6130585 - DNA, 20 bp, Homo sapiens
ctcgttgccctaattcatct

SEQ ID NO: 6130586 - DNA, 18 bp, Homo sapiens
ctcgttggaagaggaaca

SEQ ID NO: 6130587 - DNA, 20 bp, Homo sapiens
ctcgttggatgtctgtgagt

SEQ ID NO: 6130588 - DNA, 14 bp, Homo sapiens
ctcgtttagtgcca

SEQ ID NO: 6130589 - DNA, 13 bp, Homo sapiens
ctcgtttctacac

SEQ ID NO: 6130590 - DNA, 17 bp, Homo sapiens
ctcgtttgatagtgctt

SEQ ID NO: 6130591 - DNA, 22 bp, Homo sapiens
ctcgtttgctctagtcttgctt

SEQ ID NO: 6130592 - DNA, 12 bp, Homo sapiens
ctcgtttgtgat

SEQ ID NO: 6130593 - DNA, 23 bp, Homo sapiens
ctcgtttttcagcacccccaccc

SEQ ID NO: 6130594 - DNA, 18 bp, Homo sapiens
ctctaaaaaacattttta

SEQ ID NO: 6130595 - DNA, 23 bp, Homo sapiens
ctctaaaaaacatttttaattta

SEQ ID NO: 6130596 - DNA, 16 bp, Homo sapiens
ctctaaaaaagaagca

SEQ ID NO: 6130597 - DNA, 16 bp, Homo sapiens
ctctaaaaataaaatg

SEQ ID NO: 6130598 - DNA, 19 bp, Homo sapiens
ctctaaaaataaaatgatg

SEQ ID NO: 6130599 - DNA, 20 bp, Homo sapiens
ctctaaaaataaaatgatgt

SEQ ID NO: 6130600 - DNA, 15 bp, Homo sapiens
ctctaaaactctcaa

SEQ ID NO: 6130601 - DNA, 23 bp, Homo sapiens
ctctaaaagcgttggatgtagca

SEQ ID NO: 6130602 - DNA, 22 bp, Homo sapiens
ctctaaaagggggctattccct

SEQ ID NO: 6130603 - DNA, 23 bp, Homo sapiens
ctctaaaagggggctattccctg

SEQ ID NO: 6130604 - DNA, 22 bp, Homo sapiens
ctctaaaaggtaatgtgtggat

SEQ ID NO: 6130605 - DNA, 17 bp, Homo sapiens
ctctaaaatagccactt

SEQ ID NO: 6130606 - DNA, 20 bp, Homo sapiens
ctctaaaataggtaaatgta

SEQ ID NO: 6130607 - DNA, 13 bp, Homo sapiens
ctctaaaatctgc

SEQ ID NO: 6130608 - DNA, 24 bp, Homo sapiens
ctctaaaatgctgttctcaatcat

SEQ ID NO: 6130609 - DNA, 17 bp, Homo sapiens
ctctaaaattataaatg

SEQ ID NO: 6130610 - DNA, 16 bp, Homo sapiens
ctctaaaattctagtc

SEQ ID NO: 6130611 - DNA, 22 bp, Homo sapiens
ctctaaacagacaggaatttag

SEQ ID NO: 6130612 - DNA, 14 bp, Homo sapiens
ctctaaactgcaaa

SEQ ID NO: 6130613 - DNA, 19 bp, Homo sapiens
ctctaaactgcaaacagaa

SEQ ID NO: 6130614 - DNA, 18 bp, Homo sapiens
ctctaaactgctgttaat

SEQ ID NO: 6130615 - DNA, 17 bp, Homo sapiens
ctctaaactggcatctg

SEQ ID NO: 6130616 - DNA, 15 bp, Homo sapiens
ctctaaagaaacttg

SEQ ID NO: 6130617 - DNA, 19 bp, Homo sapiens
ctctaaagaccaaacttca

SEQ ID NO: 6130618 - DNA, 20 bp, Homo sapiens
ctctaaagaccaaacttcac

SEQ ID NO: 6130619 - DNA, 12 bp, Homo sapiens
ctctaaagcaaa

SEQ ID NO: 6130620 - DNA, 23 bp, Homo sapiens
ctctaaagcaataatggtcccat

SEQ ID NO: 6130621 - DNA, 19 bp, Homo sapiens
ctctaaagccaagcacttt

SEQ ID NO: 6130622 - DNA, 21 bp, Homo sapiens
ctctaaagtagcaactgctgg

SEQ ID NO: 6130623 - DNA, 22 bp, Homo sapiens
ctctaaagtctgttgattaaag

SEQ ID NO: 6130624 - DNA, 13 bp, Homo sapiens
ctctaaataaaga

SEQ ID NO: 6130625 - DNA, 14 bp, Homo sapiens
ctctaaatagccca

SEQ ID NO: 6130626 - DNA, 15 bp, Homo sapiens
ctctaaatcttcctt

SEQ ID NO: 6130627 - DNA, 18 bp, Homo sapiens
ctctaaatgggaaagtat

SEQ ID NO: 6130628 - DNA, 13 bp, Homo sapiens
ctctaaattaaga

SEQ ID NO: 6130629 - DNA, 17 bp, Homo sapiens
ctctaaattctttcatt

SEQ ID NO: 6130630 - DNA, 14 bp, Homo sapiens
ctctaacaaatgat

SEQ ID NO: 6130631 - DNA, 13 bp, Homo sapiens
ctctaacagcacc

SEQ ID NO: 6130632 - DNA, 14 bp, Homo sapiens
ctctaacagcacca

SEQ ID NO: 6130633 - DNA, 14 bp, Homo sapiens
ctctaacaggggct

SEQ ID NO: 6130634 - DNA, 19 bp, Homo sapiens
ctctaacagtggacaaagt

SEQ ID NO: 6130635 - DNA, 19 bp, Homo sapiens
ctctaacattactgccttc

SEQ ID NO: 6130636 - DNA, 13 bp, Homo sapiens
ctctaaccagtgt

SEQ ID NO: 6130637 - DNA, 14 bp, Homo sapiens
ctctaacccagtgg

SEQ ID NO: 6130638 - DNA, 15 bp, Homo sapiens
ctctaaccccaggcc

SEQ ID NO: 6130639 - DNA, 16 bp, Homo sapiens
ctctaaccccaggccc

SEQ ID NO: 6130640 - DNA, 17 bp, Homo sapiens
ctctaaccccaggcccc

SEQ ID NO: 6130641 - DNA, 18 bp, Homo sapiens
ctctaaccccaggccccg

SEQ ID NO: 6130642 - DNA, 14 bp, Homo sapiens
ctctaaccctgtgg

SEQ ID NO: 6130643 - DNA, 17 bp, Homo sapiens
ctctaaccctgtggaag

SEQ ID NO: 6130644 - DNA, 14 bp, Homo sapiens
ctctaacctccttt

SEQ ID NO: 6130645 - DNA, 13 bp, Homo sapiens
ctctaacgcctga

SEQ ID NO: 6130646 - DNA, 20 bp, Homo sapiens
ctctaacgcctgagcccagg

SEQ ID NO: 6130647 - DNA, 12 bp, Homo sapiens
ctctaactcatt

SEQ ID NO: 6130648 - DNA, 21 bp, Homo sapiens
ctctaactccctcctcacact

SEQ ID NO: 6130649 - DNA, 14 bp, Homo sapiens
ctctaactcctggg

SEQ ID NO: 6130650 - DNA, 16 bp, Homo sapiens
ctctaactgtgcaaag

SEQ ID NO: 6130651 - DNA, 14 bp, Homo sapiens
ctctaacttctcaa

SEQ ID NO: 6130652 - DNA, 15 bp, Homo sapiens
ctctaacttctcaag

SEQ ID NO: 6130653 - DNA, 21 bp, Homo sapiens
ctctaagaaatggctttccac

SEQ ID NO: 6130654 - DNA, 21 bp, Homo sapiens
ctaaggcctaggattctaaaa

SEQ ID NO: 6130655 - DNA, 21 bp, Homo sapiens
ctaaggcctcttgctggtgca

SEQ ID NO: 6130656 - DNA, 18 bp, Homo sapiens
ctaaggccttgccagcaa

SEQ ID NO: 6130657 - DNA, 21 bp, Homo sapiens
ctaaggccttttatgtaattt

SEQ ID NO: 6130658 - DNA, 17 bp, Homo sapiens
ctaaggcgtggagctgc

SEQ ID NO: 6130659 - DNA, 19 bp, Homo sapiens
ctaaggcgtggagctgcct

SEQ ID NO: 6130660 - DNA, 22 bp, Homo sapiens
ctaaggcgtggagctgcctgat

SEQ ID NO: 6130661 - DNA, 14 bp, Homo sapiens
ctaaggctcagccc

SEQ ID NO: 6130662 - DNA, 14 bp, Homo sapiens
ctaaggctcctcct

SEQ ID NO: 6130663 - DNA, 18 bp, Homo sapiens
ctaaggctctatgagtct

SEQ ID NO: 6130664 - DNA, 20 bp, Homo sapiens
ctaaggctctatgagtctag

SEQ ID NO: 6130665 - DNA, 20 bp, Homo sapiens
ctaaggctctgagagtctag

SEQ ID NO: 6130666 - DNA, 22 bp, Homo sapiens
ctaaggctctgagagtctagat

SEQ ID NO: 6130667 - DNA, 15 bp, Homo sapiens
ctaaggctgctggct

SEQ ID NO: 6130668 - DNA, 17 bp, Homo sapiens
ctaaggctgctggcttc

SEQ ID NO: 6130669 - DNA, 15 bp, Homo sapiens
ctaaggctgtttgct

SEQ ID NO: 6130670 - DNA, 20 bp, Homo sapiens
ctaaggcttccggctgagct

SEQ ID NO: 6130671 - DNA, 19 bp, Homo sapiens
ctaagggaaataacagtat

SEQ ID NO: 6130672 - DNA, 16 bp, Homo sapiens
ctaagggaagacattt

SEQ ID NO: 6130673 - DNA, 19 bp, Homo sapiens
ctaagggaagatcactgta

SEQ ID NO: 6130674 - DNA, 22 bp, Homo sapiens
ctaagggagagtggtatttgca

SEQ ID NO: 6130675 - DNA, 23 bp, Homo sapiens
ctaagggaggcacttcctcccct

SEQ ID NO: 6130676 - DNA, 22 bp, Homo sapiens
ctaagggagtgtttgtgtctga

SEQ ID NO: 6130677 - DNA, 18 bp, Homo sapiens
ctaagggatccagagacc

SEQ ID NO: 6130678 - DNA, 20 bp, Homo sapiens
ctaaggggacctacagacag

SEQ ID NO: 6130679 - DNA, 19 bp, Homo sapiens
ctaaggggcagctcctgac

SEQ ID NO: 6130680 - DNA, 17 bp, Homo sapiens
ctaaggggcaggaatca

SEQ ID NO: 6130681 - DNA, 23 bp, Homo sapiens
ctaaggggcaggaatcaaggagc

SEQ ID NO: 6130682 - DNA, 13 bp, Homo sapiens
ctaaggggcccgg

SEQ ID NO: 6130683 - DNA, 22 bp, Homo sapiens
ctaaggggctagggctgagcac

SEQ ID NO: 6130684 - DNA, 18 bp, Homo sapiens
ctaagggtcgaaagctct

SEQ ID NO: 6130685 - DNA, 21 bp, Homo sapiens
ctaagggtcgaaagctctaga

SEQ ID NO: 6130686 - DNA, 22 bp, Homo sapiens
ctaagggtcgaaagctctagaa

SEQ ID NO: 6130687 - DNA, 15 bp, Homo sapiens
ctaagggtctctcat

SEQ ID NO: 6130688 - DNA, 15 bp, Homo sapiens
ctaagggtggagagt

SEQ ID NO: 6130689 - DNA, 18 bp, Homo sapiens
ctaagggtgggtgctcag

SEQ ID NO: 6130690 - DNA, 14 bp, Homo sapiens
ctaaggtaagaacg

SEQ ID NO: 6130691 - DNA, 14 bp, Homo sapiens
ctaaggtcatttct

SEQ ID NO: 6130692 - DNA, 19 bp, Homo sapiens
ctaaggtcccataataaaa

SEQ ID NO: 6130693 - DNA, 14 bp, Homo sapiens
ctaaggtccccagc

SEQ ID NO: 6130694 - DNA, 17 bp, Homo sapiens
ctaaggtccccagcaga

SEQ ID NO: 6130695 - DNA, 14 bp, Homo sapiens
ctaaggtccctggg

SEQ ID NO: 6130696 - DNA, 19 bp, Homo sapiens
ctaaggtccggtgttctaa

SEQ ID NO: 6130697 - DNA, 21 bp, Homo sapiens
ctaaggtccggtgttctaaga

SEQ ID NO: 6130698 - DNA, 21 bp, Homo sapiens
ctaaggtgactcgagtgttta

SEQ ID NO: 6130699 - DNA, 19 bp, Homo sapiens
ctaaggtgactttctgaaa

SEQ ID NO: 6130700 - DNA, 16 bp, Homo sapiens
ctaaggttctaaggcc

SEQ ID NO: 6130701 - DNA, 15 bp, Homo sapiens
ctaaggttcttgctt

SEQ ID NO: 6130702 - DNA, 21 bp, Homo sapiens
ctaaggttgtctacgggggca

SEQ ID NO: 6130703 - DNA, 18 bp, Homo sapiens
ctaaggtttccagtcaga

SEQ ID NO: 6130704 - DNA, 20 bp, Homo sapiens
ctaagtaaaaatattaactg

SEQ ID NO: 6130705 - DNA, 19 bp, Homo sapiens
ctaagtaaaaccacagcag

SEQ ID NO: 6130706 - DNA, 23 bp, Homo sapiens
ctaagtaaatctcttctgtgttt

SEQ ID NO: 6130707 - DNA, 15 bp, Homo sapiens
ctaagtaagaaacac

SEQ ID NO: 6130708 - DNA, 19 bp, Homo sapiens
ctaagtaagtttcttcctg

SEQ ID NO: 6130709 - DNA, 20 bp, Homo sapiens
ctaagtaagtttcttcctgc

SEQ ID NO: 6130710 - DNA, 19 bp, Homo sapiens
ctaagtaatctcacagcat

SEQ ID NO: 6130711 - DNA, 22 bp, Homo sapiens
ctaagtaatctcacagcatttg

SEQ ID NO: 6130712 - DNA, 19 bp, Homo sapiens
ctaagtacacaataagcaa

SEQ ID NO: 6130713 - DNA, 20 bp, Homo sapiens
ctaagtacacaataagcaaa

SEQ ID NO: 6130714 - DNA, 13 bp, Homo sapiens
ctaagtactgtaa

SEQ ID NO: 6130715 - DNA, 23 bp, Homo sapiens
ctaagtagagtatattgaaaaga

SEQ ID NO: 6130716 - DNA, 21 bp, Homo sapiens
ctaagtagatagaaagcaata

SEQ ID NO: 6130717 - DNA, 18 bp, Homo sapiens
ctaagtagggccagggca

SEQ ID NO: 6130718 - DNA, 20 bp, Homo sapiens
ctaagtaggggcagtgatgg

SEQ ID NO: 6130719 - DNA, 21 bp, Homo sapiens
ctaagtatattatatggcagg

SEQ ID NO: 6130720 - DNA, 18 bp, Homo sapiens
ctaagtatcaagtataga

SEQ ID NO: 6130721 - DNA, 12 bp, Homo sapiens
ctaagtattaaa

SEQ ID NO: 6130722 - DNA, 20 bp, Homo sapiens
ctaagtattaaaacattgga

SEQ ID NO: 6130723 - DNA, 13 bp, Homo sapiens
ctaagtatttaaa

SEQ ID NO: 6130724 - DNA, 17 bp, Homo sapiens
ctaagtatttaaatgtt

SEQ ID NO: 6130725 - DNA, 22 bp, Homo sapiens
ctaagtcaagatcaacattcca

SEQ ID NO: 6130726 - DNA, 13 bp, Homo sapiens
ctaagtcaggtaa

SEQ ID NO: 6130727 - DNA, 18 bp, Homo sapiens
ctaagtcaggtaatatac

SEQ ID NO: 6130728 - DNA, 12 bp, Homo sapiens
ctaagtcagtac

SEQ ID NO: 6130729 - DNA, 17 bp, Homo sapiens
ctaagtcatggtcctgg

SEQ ID NO: 6130730 - DNA, 18 bp, Homo sapiens
ctaagtcattggcaaagt

SEQ ID NO: 6130731 - DNA, 20 bp, Homo sapiens
ctaagtccaactactaaact

SEQ ID NO: 6130732 - DNA, 20 bp, Homo sapiens
ctaagtccctataataaagg

SEQ ID NO: 6130733 - DNA, 14 bp, Homo sapiens
ctaagtcccttcct

SEQ ID NO: 6130734 - DNA, 23 bp, Homo sapiens
ctaagtcccttcctattctcctg

SEQ ID NO: 6130735 - DNA, 16 bp, Homo sapiens
ctaagtcgcgagccag

SEQ ID NO: 6130736 - DNA, 18 bp, Homo sapiens
ctaagtcgtgcactttct

SEQ ID NO: 6130737 - DNA, 13 bp, Homo sapiens
ctaagtctgttat

SEQ ID NO: 6130738 - DNA, 22 bp, Homo sapiens
ctaagtctgttattgttttgtt

SEQ ID NO: 6130739 - DNA, 13 bp, Homo sapiens
ctaagtcttgtct

SEQ ID NO: 6130740 - DNA, 16 bp, Homo sapiens
ctaagtcttgtctcat

SEQ ID NO: 6130741 - DNA, 18 bp, Homo sapiens
ctaagtcttgtctcattt

SEQ ID NO: 6130742 - DNA, 16 bp, Homo sapiens
ctaagtgaaatttcta

SEQ ID NO: 6130743 - DNA, 15 bp, Homo sapiens
ctaagtgacagtatc

SEQ ID NO: 6130744 - DNA, 10 bp, Homo sapiens
ctaagtgact

SEQ ID NO: 6130745 - DNA, 18 bp, Homo sapiens
ctaagtgaggatgaaaaa

SEQ ID NO: 6130746 - DNA, 13 bp, Homo sapiens
ctaagtgatataa

SEQ ID NO: 6130747 - DNA, 16 bp, Homo sapiens
ctaagtgatataaatc

SEQ ID NO: 6130748 - DNA, 15 bp, Homo sapiens
ctaagtgatgctgtg

SEQ ID NO: 6130749 - DNA, 14 bp, Homo sapiens
ctaagtgcccaaag

SEQ ID NO: 6130750 - DNA, 21 bp, Homo sapiens
ctaagtgcccaaagtggggag

SEQ ID NO: 6130751 - DNA, 12 bp, Homo sapiens
ctaagtggaaga

SEQ ID NO: 6130752 - DNA, 13 bp, Homo sapiens
ctaagtggaagac

SEQ ID NO: 6130753 - DNA, 14 bp, Homo sapiens
ctaagtggaagaca

SEQ ID NO: 6130754 - DNA, 22 bp, Homo sapiens
ctaagtggaagacagagatggc

SEQ ID NO: 6130755 - DNA, 17 bp, Homo sapiens
ctaagtggctgccttct

SEQ ID NO: 6130756 - DNA, 12 bp, Homo sapiens
ctaagtgggaca

SEQ ID NO: 6130757 - DNA, 22 bp, Homo sapiens
ctaagtgggacattcaaaaaac

SEQ ID NO: 6130758 - DNA, 14 bp, Homo sapiens
ctaagtgggagaca

SEQ ID NO: 6130759 - DNA, 20 bp, Homo sapiens
ctaagtgggcattgccatgt

SEQ ID NO: 6130760 - DNA, 14 bp, Homo sapiens
ctaagtgtaaaaaa

SEQ ID NO: 6130761 - DNA, 12 bp, Homo sapiens
ctaagtgtaacc

SEQ ID NO: 6130762 - DNA, 17 bp, Homo sapiens
ctaagtgtaacctcagt

SEQ ID NO: 6130763 - DNA, 14 bp, Homo sapiens
ctaagtgtgaactg

SEQ ID NO: 6130764 - DNA, 19 bp, Homo sapiens
ctaagtgtggatgttcaga

SEQ ID NO: 6130765 - DNA, 20 bp, Homo sapiens
ctaagtgttgactttttaaa

SEQ ID NO: 6130766 - DNA, 15 bp, Homo sapiens
ctaagttaaatcatt

SEQ ID NO: 6130767 - DNA, 16 bp, Homo sapiens
ctaagttaaatcattt

SEQ ID NO: 6130768 - DNA, 21 bp, Homo sapiens
ctaagttaaatcattttcatt

SEQ ID NO: 6130769 - DNA, 21 bp, Homo sapiens
ctaagttaatttaaagttgtt

SEQ ID NO: 6130770 - DNA, 14 bp, Homo sapiens
ctaagttagactct

SEQ ID NO: 6130771 - DNA, 23 bp, Homo sapiens
ctaagttagactcttcccctccc

SEQ ID NO: 6130772 - DNA, 16 bp, Homo sapiens
ctaagttatagtatat

SEQ ID NO: 6130773 - DNA, 23 bp, Homo sapiens
ctaagttatgactgtgaaatgat

SEQ ID NO: 6130774 - DNA, 17 bp, Homo sapiens
ctaagttattttatgac

SEQ ID NO: 6130775 - DNA, 22 bp, Homo sapiens
ctaagttattttatgacatgaa

SEQ ID NO: 6130776 - DNA, 23 bp, Homo sapiens
ctaagttattttatgacatgaaa

SEQ ID NO: 6130777 - DNA, 16 bp, Homo sapiens
ctaagttattttgtac

SEQ ID NO: 6130778 - DNA, 21 bp, Homo sapiens
ctaagttcacagtgtttctta

SEQ ID NO: 6130779 - DNA, 14 bp, Homo sapiens
ctaagttcacatta

SEQ ID NO: 6130780 - DNA, 18 bp, Homo sapiens
ctaagttcacattagaat

SEQ ID NO: 6130781 - DNA, 15 bp, Homo sapiens
ctaagttcagttctg

SEQ ID NO: 6130782 - DNA, 18 bp, Homo sapiens
ctaagttccactgagctc

SEQ ID NO: 6130783 - DNA, 20 bp, Homo sapiens
ctaagtttaattacaacagc

SEQ ID NO: 6130784 - DNA, 18 bp, Homo sapiens
ctaagtttagaagcgctc

SEQ ID NO: 6130785 - DNA, 14 bp, Homo sapiens
ctaagtttcctttt

SEQ ID NO: 6130786 - DNA, 15 bp, Homo sapiens
ctaagtttcctttta

SEQ ID NO: 6130787 - DNA, 12 bp, Homo sapiens
ctaagtttctaa

SEQ ID NO: 6130788 - DNA, 13 bp, Homo sapiens
ctaagtttctaag

SEQ ID NO: 6130789 - DNA, 16 bp, Homo sapiens
ctaagttttgtcatca

SEQ ID NO: 6130790 - DNA, 22 bp, Homo sapiens
ctaagttttgtcatcaatccag

SEQ ID NO: 6130791 - DNA, 16 bp, Homo sapiens
ctaagttttgtgtgta

SEQ ID NO: 6130792 - DNA, 20 bp, Homo sapiens
ctaagttttgtgtgtatata

SEQ ID NO: 6130793 - DNA, 23 bp, Homo sapiens
ctaagtttttatggcttttgtgc

SEQ ID NO: 6130794 - DNA, 20 bp, Homo sapiens
ctaataaaaagcttttgtct

SEQ ID NO: 6130795 - DNA, 22 bp, Homo sapiens
ctaataaaaagcttttgtctac

SEQ ID NO: 6130796 - DNA, 14 bp, Homo sapiens
ctaataaaaaggtt

SEQ ID NO: 6130797 - DNA, 16 bp, Homo sapiens
ctaataaaaaggttta

SEQ ID NO: 6130798 - DNA, 21 bp, Homo sapiens
ctaataaaaattggagctcat

SEQ ID NO: 6130799 - DNA, 10 bp, Homo sapiens
ctaataaaac

SEQ ID NO: 6130800 - DNA, 11 bp, Homo sapiens
ctaataaaact

SEQ ID NO: 6130801 - DNA, 14 bp, Homo sapiens
ctaataaaactgat

SEQ ID NO: 6130802 - DNA, 19 bp, Homo sapiens
ctaataaaagcatcttgat

SEQ ID NO: 6130803 - DNA, 22 bp, Homo sapiens
ctaataaaagtcagagctcagg

SEQ ID NO: 6130804 - DNA, 13 bp, Homo sapiens
ctaataaaatatc

SEQ ID NO: 6130805 - DNA, 20 bp, Homo sapiens
ctaataaaatatcattcagc

SEQ ID NO: 6130806 - DNA, 21 bp, Homo sapiens
ctaataaaatatcattcagca

SEQ ID NO: 6130807 - DNA, 22 bp, Homo sapiens
ctaataaaatatcattcagcaa

SEQ ID NO: 6130808 - DNA, 16 bp, Homo sapiens
ctaataaaatattttc

SEQ ID NO: 6130809 - DNA, 17 bp, Homo sapiens
ctaataaaatattttct

SEQ ID NO: 6130810 - DNA, 21 bp, Homo sapiens
ctaataaaatttaaaagtctt

SEQ ID NO: 6130811 - DNA, 21 bp, Homo sapiens
ctaataaactaataattgcag

SEQ ID NO: 6130812 - DNA, 13 bp, Homo sapiens
ctaataaacttta

SEQ ID NO: 6130813 - DNA, 14 bp, Homo sapiens
ctaataaactttat

SEQ ID NO: 6130814 - DNA, 16 bp, Homo sapiens
ctaataaagagactga

SEQ ID NO: 6130815 - DNA, 12 bp, Homo sapiens
ctaataaagcca

SEQ ID NO: 6130816 - DNA, 20 bp, Homo sapiens
ctaataaagctcctctgctc

SEQ ID NO: 6130817 - DNA, 11 bp, Homo sapiens
ctaataaatac

SEQ ID NO: 6130818 - DNA, 15 bp, Homo sapiens
ctaataaatacatac

SEQ ID NO: 6130819 - DNA, 14 bp, Homo sapiens
ctaataaatataat

SEQ ID NO: 6130820 - DNA, 12 bp, Homo sapiens
ctaataaatcaa

SEQ ID NO: 6130821 - DNA, 17 bp, Homo sapiens
ctaataaatcaatgtga

SEQ ID NO: 6130822 - DNA, 12 bp, Homo sapiens
ctaataaatgac

SEQ ID NO: 6130823 - DNA, 13 bp, Homo sapiens
ctaataaatgacc

SEQ ID NO: 6130824 - DNA, 17 bp, Homo sapiens
ctaataacatgtgaaaa

SEQ ID NO: 6130825 - DNA, 14 bp, Homo sapiens
ctaataagacccca

SEQ ID NO: 6130826 - DNA, 17 bp, Homo sapiens
ctaataagctagttgaa

SEQ ID NO: 6130827 - DNA, 23 bp, Homo sapiens
ctaataaggcatgcgaaatgttc

SEQ ID NO: 6130828 - DNA, 22 bp, Homo sapiens
ctaataagttcctctgaagact

SEQ ID NO: 6130829 - DNA, 20 bp, Homo sapiens
ctaataataaatagttcttc

SEQ ID NO: 6130830 - DNA, 13 bp, Homo sapiens
ctaataataaatg

SEQ ID NO: 6130831 - DNA, 15 bp, Homo sapiens
ctaataataaatgca

SEQ ID NO: 6130832 - DNA, 17 bp, Homo sapiens
ctctaagaagctgcaat

SEQ ID NO: 6130833 - DNA, 13 bp, Homo sapiens
ctctaagaattca

SEQ ID NO: 6130834 - DNA, 18 bp, Homo sapiens
ctctaagaattcagtagc

SEQ ID NO: 6130835 - DNA, 22 bp, Homo sapiens
ctctaagacaaatgcagtgtat

SEQ ID NO: 6130836 - DNA, 14 bp, Homo sapiens
ctctaagatcttag

SEQ ID NO: 6130837 - DNA, 18 bp, Homo sapiens
ctctaagatgaatccaaa

SEQ ID NO: 6130838 - DNA, 21 bp, Homo sapiens
ctctaagatgaatccaaatgt

SEQ ID NO: 6130839 - DNA, 12 bp, Homo sapiens
ctctaagatgtt

SEQ ID NO: 6130840 - DNA, 17 bp, Homo sapiens
ctctaagatgttatatt

SEQ ID NO: 6130841 - DNA, 23 bp, Homo sapiens
ctctaagatgttatatttttctt

SEQ ID NO: 6130842 - DNA, 15 bp, Homo sapiens
ctctaagcccaggat

SEQ ID NO: 6130843 - DNA, 19 bp, Homo sapiens
ctctaagcccaggatctct

SEQ ID NO: 6130844 - DNA, 23 bp, Homo sapiens
ctctaagcctatacgtttctgtg

SEQ ID NO: 6130845 - DNA, 17 bp, Homo sapiens
ctctaagctcagtgctc

SEQ ID NO: 6130846 - DNA, 12 bp, Homo sapiens
ctctaagctgtg

SEQ ID NO: 6130847 - DNA, 22 bp, Homo sapiens
ctctaaggaattatttcacaca

SEQ ID NO: 6130848 - DNA, 23 bp, Homo sapiens
ctctaaggccgaagaagggtcct

SEQ ID NO: 6130849 - DNA, 17 bp, Homo sapiens
ctctaagtcatgtatgt

SEQ ID NO: 6130850 - DNA, 18 bp, Homo sapiens
ctctaagtcatgtatgtt

SEQ ID NO: 6130851 - DNA, 12 bp, Homo sapiens
ctctaagtgcca

SEQ ID NO: 6130852 - DNA, 15 bp, Homo sapiens
ctctaagtgctgctg

SEQ ID NO: 6130853 - DNA, 18 bp, Homo sapiens
ctctaagtgctgctgtgg

SEQ ID NO: 6130854 - DNA, 19 bp, Homo sapiens
ctctaagtgctgctgtgga

SEQ ID NO: 6130855 - DNA, 15 bp, Homo sapiens
ctctaagtgtaaaaa

SEQ ID NO: 6130856 - DNA, 22 bp, Homo sapiens
ctctaagtgtaaaaaaaagtct

SEQ ID NO: 6130857 - DNA, 19 bp, Homo sapiens
ctctaagttccactgagct

SEQ ID NO: 6130858 - DNA, 15 bp, Homo sapiens
ctctaagtttagaag

SEQ ID NO: 6130859 - DNA, 13 bp, Homo sapiens
ctctaataaaatt

SEQ ID NO: 6130860 - DNA, 14 bp, Homo sapiens
ctctaataaacact

SEQ ID NO: 6130861 - DNA, 19 bp, Homo sapiens
ctctaataaacactgtttt

SEQ ID NO: 6130862 - DNA, 20 bp, Homo sapiens
ctctaataaagctcctctgc

SEQ ID NO: 6130863 - DNA, 15 bp, Homo sapiens
ctctaataagaaaac

SEQ ID NO: 6130864 - DNA, 18 bp, Homo sapiens
ctctaataagaaaaccac

SEQ ID NO: 6130865 - DNA, 13 bp, Homo sapiens
ctctaataataaa

SEQ ID NO: 6130866 - DNA, 15 bp, Homo sapiens
ctctaataataaata

SEQ ID NO: 6130867 - DNA, 15 bp, Homo sapiens
ctctaatacattcca

SEQ ID NO: 6130868 - DNA, 15 bp, Homo sapiens
ctctaatagaaaagt

SEQ ID NO: 6130869 - DNA, 19 bp, Homo sapiens
ctctaatatgattatacaa

SEQ ID NO: 6130870 - DNA, 14 bp, Homo sapiens
ctctaatattgctt

SEQ ID NO: 6130871 - DNA, 23 bp, Homo sapiens
ctctaatctgagctgcagcctgg

SEQ ID NO: 6130872 - DNA, 22 bp, Homo sapiens
ctctaatctgtgctgtttcaaa

SEQ ID NO: 6130873 - DNA, 18 bp, Homo sapiens
ctctaatgctcacgctcc

SEQ ID NO: 6130874 - DNA, 17 bp, Homo sapiens
ctctaatgtctgcagct

SEQ ID NO: 6130875 - DNA, 18 bp, Homo sapiens
ctctaatgtctgcagctc

SEQ ID NO: 6130876 - DNA, 20 bp, Homo sapiens
ctctaatgtctgcagctcaa

SEQ ID NO: 6130877 - DNA, 17 bp, Homo sapiens
ctctaatgtttgcatat

SEQ ID NO: 6130878 - DNA, 17 bp, Homo sapiens
ctctaattagagaactg

SEQ ID NO: 6130879 - DNA, 18 bp, Homo sapiens
ctctaattctaaccagag

SEQ ID NO: 6130880 - DNA, 22 bp, Homo sapiens
ctctaattctaaccagagcaag

SEQ ID NO: 6130881 - DNA, 18 bp, Homo sapiens
ctctaattctattaaagt

SEQ ID NO: 6130882 - DNA, 14 bp, Homo sapiens
ctctaattctctag

SEQ ID NO: 6130883 - DNA, 17 bp, Homo sapiens
ctctaattcttttcaaa

SEQ ID NO: 6130884 - DNA, 17 bp, Homo sapiens
ctctaattggaagaaat

SEQ ID NO: 6130885 - DNA, 22 bp, Homo sapiens
ctctaattggaagaaattcctg

SEQ ID NO: 6130886 - DNA, 15 bp, Homo sapiens
ctctaatttaactta

SEQ ID NO: 6130887 - DNA, 17 bp, Homo sapiens
ctctaatttaacttatt

SEQ ID NO: 6130888 - DNA, 11 bp, Homo sapiens
ctctaatttcc

SEQ ID NO: 6130889 - DNA, 23 bp, Homo sapiens
ctctaattttggataatattcat

SEQ ID NO: 6130890 - DNA, 15 bp, Homo sapiens
ctctacaaaaaaaat

SEQ ID NO: 6130891 - DNA, 13 bp, Homo sapiens
ctctacaaaaagc

SEQ ID NO: 6130892 - DNA, 16 bp, Homo sapiens
ctctacaactgagtcc

SEQ ID NO: 6130893 - DNA, 23 bp, Homo sapiens
ctctacaactgagtccttaaaca

SEQ ID NO: 6130894 - DNA, 17 bp, Homo sapiens
ctctacaattcctctga

SEQ ID NO: 6130895 - DNA, 17 bp, Homo sapiens
ctctacacaacatgtat

SEQ ID NO: 6130896 - DNA, 13 bp, Homo sapiens
ctctacactgaaa

SEQ ID NO: 6130897 - DNA, 14 bp, Homo sapiens
ctctacactgtgaa

SEQ ID NO: 6130898 - DNA, 20 bp, Homo sapiens
ctctacagagcttccctgac

SEQ ID NO: 6130899 - DNA, 22 bp, Homo sapiens
ctctacagagcttccctgactc

SEQ ID NO: 6130900 - DNA, 14 bp, Homo sapiens
ctctacagaggcca

SEQ ID NO: 6130901 - DNA, 14 bp, Homo sapiens
ctctacagccgtcc

SEQ ID NO: 6130902 - DNA, 15 bp, Homo sapiens
ctctacagccgtccc

SEQ ID NO: 6130903 - DNA, 21 bp, Homo sapiens
ctctacagctaatcagcattc

SEQ ID NO: 6130904 - DNA, 18 bp, Homo sapiens
ctctacaggcctcttcct

SEQ ID NO: 6130905 - DNA, 12 bp, Homo sapiens
ctctacatattt

SEQ ID NO: 6130906 - DNA, 15 bp, Homo sapiens
ctctacatcttctgc

SEQ ID NO: 6130907 - DNA, 16 bp, Homo sapiens
ctctacattctgctct

SEQ ID NO: 6130908 - DNA, 17 bp, Homo sapiens
ctctacattctgctctg

SEQ ID NO: 6130909 - DNA, 24 bp, Homo sapiens
ctctacattctgctctgcccatgc

SEQ ID NO: 6130910 - DNA, 12 bp, Homo sapiens
ctctacatttaa

SEQ ID NO: 6130911 - DNA, 23 bp, Homo sapiens
ctctacatttgcagatgttcaaa

SEQ ID NO: 6130912 - DNA, 20 bp, Homo sapiens
ctctaccaagacataatgca

SEQ ID NO: 6130913 - DNA, 20 bp, Homo sapiens
ctctaccaagctatcctggc

SEQ ID NO: 6130914 - DNA, 23 bp, Homo sapiens
ctctaccagtgcaggctggccag

SEQ ID NO: 6130915 - DNA, 18 bp, Homo sapiens
ctctaccagttggcagac

SEQ ID NO: 6130916 - DNA, 18 bp, Homo sapiens
ctctaccatcatccggtt

SEQ ID NO: 6130917 - DNA, 20 bp, Homo sapiens
ctctaccatggttctgcctc

SEQ ID NO: 6130918 - DNA, 20 bp, Homo sapiens
ctctaccatttgcagagtcc

SEQ ID NO: 6130919 - DNA, 14 bp, Homo sapiens
ctctacccaaaccc

SEQ ID NO: 6130920 - DNA, 18 bp, Homo sapiens
ctctacccagcccatctt

SEQ ID NO: 6130921 - DNA, 14 bp, Homo sapiens
ctctacccatctcc

SEQ ID NO: 6130922 - DNA, 16 bp, Homo sapiens
ctctacccatgagcct

SEQ ID NO: 6130923 - DNA, 19 bp, Homo sapiens
ctctacccatgagcctgcc

SEQ ID NO: 6130924 - DNA, 23 bp, Homo sapiens
ctctaccccaaagaattcctgaa

SEQ ID NO: 6130925 - DNA, 16 bp, Homo sapiens
ctctacccccaacacc

SEQ ID NO: 6130926 - DNA, 22 bp, Homo sapiens
ctctacccctgctcccattcct

SEQ ID NO: 6130927 - DNA, 16 bp, Homo sapiens
ctctacccctttcttc

SEQ ID NO: 6130928 - DNA, 19 bp, Homo sapiens
ctctacccggcccagagac

SEQ ID NO: 6130929 - DNA, 13 bp, Homo sapiens
ctctaccctgcag

SEQ ID NO: 6130930 - DNA, 15 bp, Homo sapiens
ctctaccctgcagct

SEQ ID NO: 6130931 - DNA, 14 bp, Homo sapiens
ctctaccctgctcc

SEQ ID NO: 6130932 - DNA, 23 bp, Homo sapiens
ctctaccctggtaggaaagcacc

SEQ ID NO: 6130933 - DNA, 21 bp, Homo sapiens
ctctaccctgtgctaagcacg

SEQ ID NO: 6130934 - DNA, 16 bp, Homo sapiens
ctctacctccaccctg

SEQ ID NO: 6130935 - DNA, 13 bp, Homo sapiens
ctctacctctctc

SEQ ID NO: 6130936 - DNA, 14 bp, Homo sapiens
ctctacctctctcc

SEQ ID NO: 6130937 - DNA, 16 bp, Homo sapiens
ctctacctctctcctc

SEQ ID NO: 6130938 - DNA, 16 bp, Homo sapiens
ctctacctctctttct

SEQ ID NO: 6130939 - DNA, 12 bp, Homo sapiens
ctctacctgaca

SEQ ID NO: 6130940 - DNA, 13 bp, Homo sapiens
ctctacctggccg

SEQ ID NO: 6130941 - DNA, 19 bp, Homo sapiens
ctctaccttcctgtccctg

SEQ ID NO: 6130942 - DNA, 14 bp, Homo sapiens
ctctaccttctccc

SEQ ID NO: 6130943 - DNA, 22 bp, Homo sapiens
ctctactaaaaatacaaaaatt

SEQ ID NO: 6130944 - DNA, 17 bp, Homo sapiens
ctctactaaaattcaaa

SEQ ID NO: 6130945 - DNA, 19 bp, Homo sapiens
ctctactaggtctgctcct

SEQ ID NO: 6130946 - DNA, 22 bp, Homo sapiens
ctctactccaggcttccacact

SEQ ID NO: 6130947 - DNA, 19 bp, Homo sapiens
ctctactgccaagcccctg

SEQ ID NO: 6130948 - DNA, 13 bp, Homo sapiens
ctctactgcccca

SEQ ID NO: 6130949 - DNA, 13 bp, Homo sapiens
ctctactgccctc

SEQ ID NO: 6130950 - DNA, 15 bp, Homo sapiens
ctctactgccctccc

SEQ ID NO: 6130951 - DNA, 12 bp, Homo sapiens
ctctactgtctc

SEQ ID NO: 6130952 - DNA, 13 bp, Homo sapiens
ctctactgtgcat

SEQ ID NO: 6130953 - DNA, 13 bp, Homo sapiens
ctctactgtgtaa

SEQ ID NO: 6130954 - DNA, 14 bp, Homo sapiens
ctctactgtgtaat

SEQ ID NO: 6130955 - DNA, 18 bp, Homo sapiens
ctctactgttgcaaagct

SEQ ID NO: 6130956 - DNA, 15 bp, Homo sapiens
ctctacttaatgaga

SEQ ID NO: 6130957 - DNA, 16 bp, Homo sapiens
ctctacttaatttgtt

SEQ ID NO: 6130958 - DNA, 12 bp, Homo sapiens
ctctacttcccc

SEQ ID NO: 6130959 - DNA, 19 bp, Homo sapiens
ctctacttccccttcttgc

SEQ ID NO: 6130960 - DNA, 18 bp, Homo sapiens
ctctacttgctgaaggag

SEQ ID NO: 6130961 - DNA, 13 bp, Homo sapiens
ctctactttccag

SEQ ID NO: 6130962 - DNA, 18 bp, Homo sapiens
ctctactttccaggctag

SEQ ID NO: 6130963 - DNA, 13 bp, Homo sapiens
ctctactttcctg

SEQ ID NO: 6130964 - DNA, 21 bp, Homo sapiens
ctctactttcctgatgttgat

SEQ ID NO: 6130965 - DNA, 18 bp, Homo sapiens
ctctactttgattctgat

SEQ ID NO: 6130966 - DNA, 22 bp, Homo sapiens
ctctactttgtcccctcacctc

SEQ ID NO: 6130967 - DNA, 23 bp, Homo sapiens
ctctagaaagtatagatggccaa

SEQ ID NO: 6130968 - DNA, 16 bp, Homo sapiens
ctctagaacacccact

SEQ ID NO: 6130969 - DNA, 18 bp, Homo sapiens
ctctagaacacccactgg

SEQ ID NO: 6130970 - DNA, 17 bp, Homo sapiens
ctctagaacatgcacat

SEQ ID NO: 6130971 - DNA, 19 bp, Homo sapiens
ctctagaagccaagggaaa

SEQ ID NO: 6130972 - DNA, 16 bp, Homo sapiens
ctctagaagctcaggt

SEQ ID NO: 6130973 - DNA, 13 bp, Homo sapiens
ctctagaaggctg

SEQ ID NO: 6130974 - DNA, 13 bp, Homo sapiens
ctctagaatccca

SEQ ID NO: 6130975 - DNA, 16 bp, Homo sapiens
ctctagaatcccagca

SEQ ID NO: 6130976 - DNA, 12 bp, Homo sapiens
ctctagaatctg

SEQ ID NO: 6130977 - DNA, 20 bp, Homo sapiens
ctctagaattttaagtgctt

SEQ ID NO: 6130978 - DNA, 17 bp, Homo sapiens
ctctagacaaccctgca

SEQ ID NO: 6130979 - DNA, 16 bp, Homo sapiens
ctctagacaagatatt

SEQ ID NO: 6130980 - DNA, 21 bp, Homo sapiens
ctctagagaaataagatcttt

SEQ ID NO: 6130981 - DNA, 12 bp, Homo sapiens
ctctagagagag

SEQ ID NO: 6130982 - DNA, 22 bp, Homo sapiens
ctctagagagagggagaaacaa

SEQ ID NO: 6130983 - DNA, 13 bp, Homo sapiens
ctctagagcaggg

SEQ ID NO: 6130984 - DNA, 20 bp, Homo sapiens
ctctagaggatgaaggctgt

SEQ ID NO: 6130985 - DNA, 23 bp, Homo sapiens
ctctagaggcatcacctgggacc

SEQ ID NO: 6130986 - DNA, 14 bp, Homo sapiens
ctctagaggctgcc

SEQ ID NO: 6130987 - DNA, 15 bp, Homo sapiens
ctctagaggctgcct

SEQ ID NO: 6130988 - DNA, 15 bp, Homo sapiens
ctctagagggcgagg

SEQ ID NO: 6130989 - DNA, 15 bp, Homo sapiens
ctctagagtccaagg

SEQ ID NO: 6130990 - DNA, 16 bp, Homo sapiens
ctctagagtccaaggt

SEQ ID NO: 6130991 - DNA, 16 bp, Homo sapiens
ctctagataaaacttt

SEQ ID NO: 6130992 - DNA, 19 bp, Homo sapiens
ctctagatacctaaaacat

SEQ ID NO: 6130993 - DNA, 17 bp, Homo sapiens
ctctagatggcaacatt

SEQ ID NO: 6130994 - DNA, 22 bp, Homo sapiens
ctctagatgtgtagggctgagg

SEQ ID NO: 6130995 - DNA, 15 bp, Homo sapiens
ctctagattcataaa

SEQ ID NO: 6130996 - DNA, 16 bp, Homo sapiens
ctctagcaaggctcat

SEQ ID NO: 6130997 - DNA, 13 bp, Homo sapiens
ctctagcaggcct

SEQ ID NO: 6130998 - DNA, 19 bp, Homo sapiens
ctctagccaaatggtttaa

SEQ ID NO: 6130999 - DNA, 23 bp, Homo sapiens
ctctagccatcccttggggaagg

SEQ ID NO: 6131000 - DNA, 16 bp, Homo sapiens
ctctagcctctggact

SEQ ID NO: 6131001 - DNA, 13 bp, Homo sapiens
ctctagcctcttt

SEQ ID NO: 6131002 - DNA, 14 bp, Homo sapiens
ctctagcctctttg

SEQ ID NO: 6131003 - DNA, 14 bp, Homo sapiens
ctctagcctgggca

SEQ ID NO: 6131004 - DNA, 22 bp, Homo sapiens
ctctagctccccaattctgcct

SEQ ID NO: 6131005 - DNA, 12 bp, Homo sapiens
ctctagctgaat

SEQ ID NO: 6131006 - DNA, 15 bp, Homo sapiens
ctctagctgaattga

SEQ ID NO: 6131007 - DNA, 19 bp, Homo sapiens
ctctagctggcaggacaca

SEQ ID NO: 6131008 - DNA, 23 bp, Homo sapiens
ctctagctgggggtgggccaggc

SEQ ID NO: 6131009 - DNA, 17 bp, Homo sapiens
ctctagctgttctggac

SEQ ID NO: 6131010 - DNA, 19 bp, Homo sapiens
ctctagctttagctggagg

SEQ ID NO: 6131011 - DNA, 13 bp, Homo sapiens
ctctagcttttct

SEQ ID NO: 6131012 - DNA, 17 bp, Homo sapiens
ctaataataaatgcata

SEQ ID NO: 6131013 - DNA, 18 bp, Homo sapiens
ctaataatcattggattc

SEQ ID NO: 6131014 - DNA, 19 bp, Homo sapiens
ctaataatcttgtttctga

SEQ ID NO: 6131015 - DNA, 19 bp, Homo sapiens
ctaataatgagctattaaa

SEQ ID NO: 6131016 - DNA, 20 bp, Homo sapiens
ctaataatgagctattaaaa

SEQ ID NO: 6131017 - DNA, 21 bp, Homo sapiens
ctaataattggccttcgattt

SEQ ID NO: 6131018 - DNA, 16 bp, Homo sapiens
ctaataattgtatcta

SEQ ID NO: 6131019 - DNA, 15 bp, Homo sapiens
ctaataatttctaat

SEQ ID NO: 6131020 - DNA, 18 bp, Homo sapiens
ctaataatttctaatgtt

SEQ ID NO: 6131021 - DNA, 18 bp, Homo sapiens
ctaataccaactatttca

SEQ ID NO: 6131022 - DNA, 20 bp, Homo sapiens
ctaataccaactatttcaat

SEQ ID NO: 6131023 - DNA, 17 bp, Homo sapiens
ctaatacccaaacccta

SEQ ID NO: 6131024 - DNA, 16 bp, Homo sapiens
ctaatacccagagcac

SEQ ID NO: 6131025 - DNA, 18 bp, Homo sapiens
ctaatacgagccttctca

SEQ ID NO: 6131026 - DNA, 19 bp, Homo sapiens
ctaatacgtgccagatata

SEQ ID NO: 6131027 - DNA, 23 bp, Homo sapiens
ctaatacgtgccagatataactg

SEQ ID NO: 6131028 - DNA, 16 bp, Homo sapiens
ctaatacttactgtta

SEQ ID NO: 6131029 - DNA, 15 bp, Homo sapiens
ctaatagaaagaaat

SEQ ID NO: 6131030 - DNA, 13 bp, Homo sapiens
ctaatagaactca

SEQ ID NO: 6131031 - DNA, 20 bp, Homo sapiens
ctaatagaactcagttttaa

SEQ ID NO: 6131032 - DNA, 13 bp, Homo sapiens
ctaatagaacttg

SEQ ID NO: 6131033 - DNA, 20 bp, Homo sapiens
ctaatagaataaaggcagtt

SEQ ID NO: 6131034 - DNA, 21 bp, Homo sapiens
ctaatagaataaaggcagttt

SEQ ID NO: 6131035 - DNA, 23 bp, Homo sapiens
ctaatagaataaaggcagttttc

SEQ ID NO: 6131036 - DNA, 17 bp, Homo sapiens
ctaatagagacacagag

SEQ ID NO: 6131037 - DNA, 18 bp, Homo sapiens
ctaatagaggcagtgaga

SEQ ID NO: 6131038 - DNA, 18 bp, Homo sapiens
ctaatagcccataaagtc

SEQ ID NO: 6131039 - DNA, 16 bp, Homo sapiens
ctaatagcctaaaaga

SEQ ID NO: 6131040 - DNA, 12 bp, Homo sapiens
ctaatagctttt

SEQ ID NO: 6131041 - DNA, 18 bp, Homo sapiens
ctaatagtgatcaagaag

SEQ ID NO: 6131042 - DNA, 23 bp, Homo sapiens
ctaatagtgatcaagaagacttt

SEQ ID NO: 6131043 - DNA, 16 bp, Homo sapiens
ctaatagtttttcact

SEQ ID NO: 6131044 - DNA, 12 bp, Homo sapiens
ctaatataatat

SEQ ID NO: 6131045 - DNA, 20 bp, Homo sapiens
ctaatatacttgtaaaacca

SEQ ID NO: 6131046 - DNA, 17 bp, Homo sapiens
ctaatatatatgaataa

SEQ ID NO: 6131047 - DNA, 16 bp, Homo sapiens
ctaatatatattttaa

SEQ ID NO: 6131048 - DNA, 15 bp, Homo sapiens
ctaatatatctgtaa

SEQ ID NO: 6131049 - DNA, 14 bp, Homo sapiens
ctaatatatggacc

SEQ ID NO: 6131050 - DNA, 14 bp, Homo sapiens
ctaatatatttaaa

SEQ ID NO: 6131051 - DNA, 15 bp, Homo sapiens
ctaatatatttaaaa

SEQ ID NO: 6131052 - DNA, 16 bp, Homo sapiens
ctaatatatttaaaaa

SEQ ID NO: 6131053 - DNA, 14 bp, Homo sapiens
ctaatatcatttta

SEQ ID NO: 6131054 - DNA, 20 bp, Homo sapiens
ctaatatcattttattcaca

SEQ ID NO: 6131055 - DNA, 23 bp, Homo sapiens
ctaatatgatagcgggaaaagga

SEQ ID NO: 6131056 - DNA, 21 bp, Homo sapiens
ctaatatgatgactgttttta

SEQ ID NO: 6131057 - DNA, 14 bp, Homo sapiens
ctaatatgcctaat

SEQ ID NO: 6131058 - DNA, 17 bp, Homo sapiens
ctaatatggcaaccatt

SEQ ID NO: 6131059 - DNA, 20 bp, Homo sapiens
ctaatatggccacagtagtc

SEQ ID NO: 6131060 - DNA, 21 bp, Homo sapiens
ctaatatggttttgttttcaa

SEQ ID NO: 6131061 - DNA, 15 bp, Homo sapiens
ctaatatgtaaaatt

SEQ ID NO: 6131062 - DNA, 18 bp, Homo sapiens
ctaatattaaaaatatgg

SEQ ID NO: 6131063 - DNA, 19 bp, Homo sapiens
ctaatattcacatgttcta

SEQ ID NO: 6131064 - DNA, 15 bp, Homo sapiens
ctaatattcatgctg

SEQ ID NO: 6131065 - DNA, 16 bp, Homo sapiens
ctaatattgaaaatgt

SEQ ID NO: 6131066 - DNA, 18 bp, Homo sapiens
ctaatattgaaaatgtca

SEQ ID NO: 6131067 - DNA, 22 bp, Homo sapiens
ctaatatttgggaaggctttaa

SEQ ID NO: 6131068 - DNA, 10 bp, Homo sapiens
ctaatatttt

SEQ ID NO: 6131069 - DNA, 19 bp, Homo sapiens
ctaatattttatttgaaaa

SEQ ID NO: 6131070 - DNA, 13 bp, Homo sapiens
ctaatattttcct

SEQ ID NO: 6131071 - DNA, 13 bp, Homo sapiens
ctaatcaaaactt

SEQ ID NO: 6131072 - DNA, 15 bp, Homo sapiens
ctaatcaaaactttc

SEQ ID NO: 6131073 - DNA, 19 bp, Homo sapiens
ctaatcaaagccagggtct

SEQ ID NO: 6131074 - DNA, 22 bp, Homo sapiens
ctaatcaagagtctctccagcc

SEQ ID NO: 6131075 - DNA, 23 bp, Homo sapiens
ctaatcaagagtctctccagcct

SEQ ID NO: 6131076 - DNA, 13 bp, Homo sapiens
ctaatcacagtgt

SEQ ID NO: 6131077 - DNA, 13 bp, Homo sapiens
ctaatcacatgtg

SEQ ID NO: 6131078 - DNA, 16 bp, Homo sapiens
ctaatcacatgtgctg

SEQ ID NO: 6131079 - DNA, 15 bp, Homo sapiens
ctaatcaccatgtaa

SEQ ID NO: 6131080 - DNA, 19 bp, Homo sapiens
ctaatcaccatgtaagcac

SEQ ID NO: 6131081 - DNA, 11 bp, Homo sapiens
ctaatcacctt

SEQ ID NO: 6131082 - DNA, 16 bp, Homo sapiens
ctaatcacctttccaa

SEQ ID NO: 6131083 - DNA, 22 bp, Homo sapiens
ctaatcagaaatttttatcagt

SEQ ID NO: 6131084 - DNA, 22 bp, Homo sapiens
ctaatcagatgatggccatttc

SEQ ID NO: 6131085 - DNA, 23 bp, Homo sapiens
ctaatcagatgatggccatttct

SEQ ID NO: 6131086 - DNA, 12 bp, Homo sapiens
ctaatcagattg

SEQ ID NO: 6131087 - DNA, 23 bp, Homo sapiens
ctaatcagattgcttaaaagcat

SEQ ID NO: 6131088 - DNA, 20 bp, Homo sapiens
ctaatcaggctgaggtgtct

SEQ ID NO: 6131089 - DNA, 19 bp, Homo sapiens
ctaatcagggaggtcattt

SEQ ID NO: 6131090 - DNA, 17 bp, Homo sapiens
ctaatcagtgtctcaca

SEQ ID NO: 6131091 - DNA, 20 bp, Homo sapiens
ctaatcatgagaaaaactgt

SEQ ID NO: 6131092 - DNA, 20 bp, Homo sapiens
ctaatcatgtgggtgagcca

SEQ ID NO: 6131093 - DNA, 21 bp, Homo sapiens
ctaatcatgtgggtgagccag

SEQ ID NO: 6131094 - DNA, 18 bp, Homo sapiens
ctaatccaatacctcttg

SEQ ID NO: 6131095 - DNA, 13 bp, Homo sapiens
ctaatccacctgg

SEQ ID NO: 6131096 - DNA, 16 bp, Homo sapiens
ctaatccacctggtgg

SEQ ID NO: 6131097 - DNA, 18 bp, Homo sapiens
ctaatccaggcagatcca

SEQ ID NO: 6131098 - DNA, 18 bp, Homo sapiens
ctaatccatgtgctgctg

SEQ ID NO: 6131099 - DNA, 20 bp, Homo sapiens
ctaatccattatcctttatt

SEQ ID NO: 6131100 - DNA, 18 bp, Homo sapiens
ctaatccccataacttcc

SEQ ID NO: 6131101 - DNA, 16 bp, Homo sapiens
ctaatccccttctccc

SEQ ID NO: 6131102 - DNA, 18 bp, Homo sapiens
ctaatccccttctcccct

SEQ ID NO: 6131103 - DNA, 23 bp, Homo sapiens
ctaatccctgggcattgctttcc

SEQ ID NO: 6131104 - DNA, 20 bp, Homo sapiens
ctaatcccttcctctcccat

SEQ ID NO: 6131105 - DNA, 16 bp, Homo sapiens
ctaatcctctttttct

SEQ ID NO: 6131106 - DNA, 16 bp, Homo sapiens
ctaatccttaaaagca

SEQ ID NO: 6131107 - DNA, 17 bp, Homo sapiens
ctaatccttaaaagcat

SEQ ID NO: 6131108 - DNA, 15 bp, Homo sapiens
ctaatcctttaatga

SEQ ID NO: 6131109 - DNA, 15 bp, Homo sapiens
ctaatccttttcctt

SEQ ID NO: 6131110 - DNA, 16 bp, Homo sapiens
ctaatccttttcctta

SEQ ID NO: 6131111 - DNA, 15 bp, Homo sapiens
ctaatcgaactatga

SEQ ID NO: 6131112 - DNA, 17 bp, Homo sapiens
ctaatctaacaatggaa

SEQ ID NO: 6131113 - DNA, 18 bp, Homo sapiens
ctaatctaacaatggaag

SEQ ID NO: 6131114 - DNA, 20 bp, Homo sapiens
ctaatctatggtcgggagac

SEQ ID NO: 6131115 - DNA, 14 bp, Homo sapiens
ctaatctattgggt

SEQ ID NO: 6131116 - DNA, 17 bp, Homo sapiens
ctaatctattgggttca

SEQ ID NO: 6131117 - DNA, 21 bp, Homo sapiens
ctaatctcatacctctgacca

SEQ ID NO: 6131118 - DNA, 14 bp, Homo sapiens
ctaatctctgtaaa

SEQ ID NO: 6131119 - DNA, 20 bp, Homo sapiens
ctaatctctgtaaagctaaa

SEQ ID NO: 6131120 - DNA, 18 bp, Homo sapiens
ctaatctctttattaaaa

SEQ ID NO: 6131121 - DNA, 14 bp, Homo sapiens
ctaatctgaactga

SEQ ID NO: 6131122 - DNA, 20 bp, Homo sapiens
ctaatcttaaatcagaataa

SEQ ID NO: 6131123 - DNA, 22 bp, Homo sapiens
ctaatcttaaatcagaataaat

SEQ ID NO: 6131124 - DNA, 23 bp, Homo sapiens
ctaatcttaaatcagaataaatt

SEQ ID NO: 6131125 - DNA, 21 bp, Homo sapiens
ctaatcttattcattttctct

SEQ ID NO: 6131126 - DNA, 21 bp, Homo sapiens
ctaatcttgtgaaaataattg

SEQ ID NO: 6131127 - DNA, 12 bp, Homo sapiens
ctaatctttaat

SEQ ID NO: 6131128 - DNA, 21 bp, Homo sapiens
ctaatctttaatataatatta

SEQ ID NO: 6131129 - DNA, 22 bp, Homo sapiens
ctaatctttcacttgaaagatt

SEQ ID NO: 6131130 - DNA, 21 bp, Homo sapiens
ctaatgaaaaacaaaaagcta

SEQ ID NO: 6131131 - DNA, 17 bp, Homo sapiens
ctaatgaaattgagaag

SEQ ID NO: 6131132 - DNA, 20 bp, Homo sapiens
ctaatgaacaaatatgcttt

SEQ ID NO: 6131133 - DNA, 21 bp, Homo sapiens
ctaatgaacaaatatgctttg

SEQ ID NO: 6131134 - DNA, 17 bp, Homo sapiens
ctaatgaactctttcaa

SEQ ID NO: 6131135 - DNA, 19 bp, Homo sapiens
ctaatgaaggccatcatct

SEQ ID NO: 6131136 - DNA, 22 bp, Homo sapiens
ctaatgaattttaaaagcatat

SEQ ID NO: 6131137 - DNA, 16 bp, Homo sapiens
ctaatgacaagtgact

SEQ ID NO: 6131138 - DNA, 15 bp, Homo sapiens
ctaatgacacggtag

SEQ ID NO: 6131139 - DNA, 22 bp, Homo sapiens
ctaatgacatcaccacagttta

SEQ ID NO: 6131140 - DNA, 16 bp, Homo sapiens
ctaatgagaagtcaac

SEQ ID NO: 6131141 - DNA, 18 bp, Homo sapiens
ctaatgaggagagaaaat

SEQ ID NO: 6131142 - DNA, 13 bp, Homo sapiens
ctaatgagtattt

SEQ ID NO: 6131143 - DNA, 20 bp, Homo sapiens
ctaatgataatcccaccacc

SEQ ID NO: 6131144 - DNA, 21 bp, Homo sapiens
ctaatgataatcccaccaccc

SEQ ID NO: 6131145 - DNA, 21 bp, Homo sapiens
ctaatgatgacttgagccctg

SEQ ID NO: 6131146 - DNA, 23 bp, Homo sapiens
ctaatgatgacttgagccctgcc

SEQ ID NO: 6131147 - DNA, 13 bp, Homo sapiens
ctaatgatgcttt

SEQ ID NO: 6131148 - DNA, 23 bp, Homo sapiens
ctaatgatggcccattctacttg

SEQ ID NO: 6131149 - DNA, 18 bp, Homo sapiens
ctaatgattatagataaa

SEQ ID NO: 6131150 - DNA, 20 bp, Homo sapiens
ctaatgattcaaatgtttta

SEQ ID NO: 6131151 - DNA, 19 bp, Homo sapiens
ctaatgcaaattaaaacat

SEQ ID NO: 6131152 - DNA, 13 bp, Homo sapiens
ctaatgcagaatt

SEQ ID NO: 6131153 - DNA, 21 bp, Homo sapiens
ctaatgcagccacgattggag

SEQ ID NO: 6131154 - DNA, 13 bp, Homo sapiens
ctaatgcatattt

SEQ ID NO: 6131155 - DNA, 15 bp, Homo sapiens
ctaatgcatatttat

SEQ ID NO: 6131156 - DNA, 20 bp, Homo sapiens
ctaatgcatatttataagag

SEQ ID NO: 6131157 - DNA, 22 bp, Homo sapiens
ctaatgcatatttataagagaa

SEQ ID NO: 6131158 - DNA, 21 bp, Homo sapiens
ctaatgcattattttgtcata

SEQ ID NO: 6131159 - DNA, 16 bp, Homo sapiens
ctaatgccctatgtgt

SEQ ID NO: 6131160 - DNA, 16 bp, Homo sapiens
ctaatgcctcttcatt

SEQ ID NO: 6131161 - DNA, 18 bp, Homo sapiens
ctaatgctaagaaatgct

SEQ ID NO: 6131162 - DNA, 15 bp, Homo sapiens
ctaatgctctgaaag

SEQ ID NO: 6131163 - DNA, 22 bp, Homo sapiens
ctaatgctgcacaccagttact

SEQ ID NO: 6131164 - DNA, 23 bp, Homo sapiens
ctaatgctgcagatttgggctgg

SEQ ID NO: 6131165 - DNA, 21 bp, Homo sapiens
ctaatgctggcctgactggtt

SEQ ID NO: 6131166 - DNA, 19 bp, Homo sapiens
ctaatggagtgtttgaaaa

SEQ ID NO: 6131167 - DNA, 22 bp, Homo sapiens
ctaatggagtgtttgaaaactg

SEQ ID NO: 6131168 - DNA, 14 bp, Homo sapiens
ctaatggcatgaga

SEQ ID NO: 6131169 - DNA, 18 bp, Homo sapiens
ctaatggcatgagaaata

SEQ ID NO: 6131170 - DNA, 18 bp, Homo sapiens
ctaatggcatggagactc

SEQ ID NO: 6131171 - DNA, 19 bp, Homo sapiens
ctaatggcatggagactct

SEQ ID NO: 6131172 - DNA, 20 bp, Homo sapiens
ctaatggccaagtgtacatt

SEQ ID NO: 6131173 - DNA, 21 bp, Homo sapiens
ctaatggccttccataataat

SEQ ID NO: 6131174 - DNA, 22 bp, Homo sapiens
ctaatgggctgctgtcatttta

SEQ ID NO: 6131175 - DNA, 19 bp, Homo sapiens
ctaatggtaacttttgtag

SEQ ID NO: 6131176 - DNA, 21 bp, Homo sapiens
ctaatggtaacttttgtagtc

SEQ ID NO: 6131177 - DNA, 14 bp, Homo sapiens
ctaatggtacgtgg

SEQ ID NO: 6131178 - DNA, 18 bp, Homo sapiens
ctaatggtagtcagattt

SEQ ID NO: 6131179 - DNA, 21 bp, Homo sapiens
ctaatggtcctgttatgtcat

SEQ ID NO: 6131180 - DNA, 14 bp, Homo sapiens
ctaatgtaaaatga

SEQ ID NO: 6131181 - DNA, 13 bp, Homo sapiens
ctaatgtaaattt

SEQ ID NO: 6131182 - DNA, 15 bp, Homo sapiens
ctaatgtaaatttta

SEQ ID NO: 6131183 - DNA, 16 bp, Homo sapiens
ctaatgtaaattttaa

SEQ ID NO: 6131184 - DNA, 19 bp, Homo sapiens
ctaatgtaatcatttatct

SEQ ID NO: 6131185 - DNA, 21 bp, Homo sapiens
ctaatgtaatcatttatctta

SEQ ID NO: 6131186 - DNA, 14 bp, Homo sapiens
ctaatgtactgcat

SEQ ID NO: 6131187 - DNA, 14 bp, Homo sapiens
ctaatgtactgtac

SEQ ID NO: 6131188 - DNA, 23 bp, Homo sapiens
ctaatgtactgtacataaattcc

SEQ ID NO: 6131189 - DNA, 14 bp, Homo sapiens
ctctagcttttcta

SEQ ID NO: 6131190 - DNA, 15 bp, Homo sapiens
ctctaggacccccag

SEQ ID NO: 6131191 - DNA, 14 bp, Homo sapiens
ctctaggacttcaa

SEQ ID NO: 6131192 - DNA, 21 bp, Homo sapiens
ctctaggagggagccttgtga

SEQ ID NO: 6131193 - DNA, 14 bp, Homo sapiens
ctctaggcaagcag

SEQ ID NO: 6131194 - DNA, 18 bp, Homo sapiens
ctctaggcaagcaggacc

SEQ ID NO: 6131195 - DNA, 19 bp, Homo sapiens
ctctaggcagaagaagctg

SEQ ID NO: 6131196 - DNA, 20 bp, Homo sapiens
ctctaggcagaagaagctgg

SEQ ID NO: 6131197 - DNA, 17 bp, Homo sapiens
ctctaggcctctccagt

SEQ ID NO: 6131198 - DNA, 12 bp, Homo sapiens
ctctaggcctga

SEQ ID NO: 6131199 - DNA, 12 bp, Homo sapiens
ctctaggctggg

SEQ ID NO: 6131200 - DNA, 18 bp, Homo sapiens
ctctaggctgttctgtag

SEQ ID NO: 6131201 - DNA, 21 bp, Homo sapiens
ctctagggacccctcgcccca

SEQ ID NO: 6131202 - DNA, 23 bp, Homo sapiens
ctctagggatataaaaacagatt

SEQ ID NO: 6131203 - DNA, 16 bp, Homo sapiens
ctctagggcagggtgg

SEQ ID NO: 6131204 - DNA, 21 bp, Homo sapiens
ctctagggcagggtgggagcc

SEQ ID NO: 6131205 - DNA, 21 bp, Homo sapiens
ctctagggtacatggtgctgg

SEQ ID NO: 6131206 - DNA, 18 bp, Homo sapiens
ctctagggttgctggagc

SEQ ID NO: 6131207 - DNA, 21 bp, Homo sapiens
ctctaggtaaccagtttaaat

SEQ ID NO: 6131208 - DNA, 23 bp, Homo sapiens
ctctaggtacgatgacagtgttc

SEQ ID NO: 6131209 - DNA, 17 bp, Homo sapiens
ctctaggttatacaata

SEQ ID NO: 6131210 - DNA, 12 bp, Homo sapiens
ctctagtagtgt

SEQ ID NO: 6131211 - DNA, 17 bp, Homo sapiens
ctctagtagtgtggcct

SEQ ID NO: 6131212 - DNA, 18 bp, Homo sapiens
ctctagtagtgtggcctg

SEQ ID NO: 6131213 - DNA, 18 bp, Homo sapiens
ctctagtagttaaaaaaa

SEQ ID NO: 6131214 - DNA, 18 bp, Homo sapiens
ctctagtccccaaggcct

SEQ ID NO: 6131215 - DNA, 21 bp, Homo sapiens
ctctagtccctgtgttctgca

SEQ ID NO: 6131216 - DNA, 21 bp, Homo sapiens
ctctagtcttgctttgctgtc

SEQ ID NO: 6131217 - DNA, 22 bp, Homo sapiens
ctctagtcttgctttgctgtct

SEQ ID NO: 6131218 - DNA, 13 bp, Homo sapiens
ctctagtgcagga

SEQ ID NO: 6131219 - DNA, 13 bp, Homo sapiens
ctctagtgccctc

SEQ ID NO: 6131220 - DNA, 14 bp, Homo sapiens
ctctagtgccttct

SEQ ID NO: 6131221 - DNA, 17 bp, Homo sapiens
ctctagtgctactgcta

SEQ ID NO: 6131222 - DNA, 13 bp, Homo sapiens
ctctagtgctgtg

SEQ ID NO: 6131223 - DNA, 19 bp, Homo sapiens
ctctagtgctgtgaaaaaa

SEQ ID NO: 6131224 - DNA, 16 bp, Homo sapiens
ctctagtgggacagcc

SEQ ID NO: 6131225 - DNA, 22 bp, Homo sapiens
ctctagtgggacagcccagagc

SEQ ID NO: 6131226 - DNA, 17 bp, Homo sapiens
ctctagtgtattatcac

SEQ ID NO: 6131227 - DNA, 20 bp, Homo sapiens
ctctagtgtattatcactgt

SEQ ID NO: 6131228 - DNA, 22 bp, Homo sapiens
ctctagtgtattatcactgtct

SEQ ID NO: 6131229 - DNA, 22 bp, Homo sapiens
ctctagttccctcagtgtgaag

SEQ ID NO: 6131230 - DNA, 14 bp, Homo sapiens
ctctagttctgttg

SEQ ID NO: 6131231 - DNA, 22 bp, Homo sapiens
ctctagttctgttgttttgtgt

SEQ ID NO: 6131232 - DNA, 15 bp, Homo sapiens
ctctagttgacttca

SEQ ID NO: 6131233 - DNA, 16 bp, Homo sapiens
ctctagttgacttcaa

SEQ ID NO: 6131234 - DNA, 19 bp, Homo sapiens
ctctagttgacttcaaatg

SEQ ID NO: 6131235 - DNA, 20 bp, Homo sapiens
ctctagttgtggacttttcc

SEQ ID NO: 6131236 - DNA, 14 bp, Homo sapiens
ctctagtttcccct

SEQ ID NO: 6131237 - DNA, 15 bp, Homo sapiens
ctctagtttgattaa

SEQ ID NO: 6131238 - DNA, 13 bp, Homo sapiens
ctctagttttcca

SEQ ID NO: 6131239 - DNA, 17 bp, Homo sapiens
ctctataaagaaacttt

SEQ ID NO: 6131240 - DNA, 15 bp, Homo sapiens
ctctataaagggtca

SEQ ID NO: 6131241 - DNA, 16 bp, Homo sapiens
ctctataaagggtcag

SEQ ID NO: 6131242 - DNA, 17 bp, Homo sapiens
ctctataaagggtcagg

SEQ ID NO: 6131243 - DNA, 22 bp, Homo sapiens
ctctataacagatcctttcaaa

SEQ ID NO: 6131244 - DNA, 22 bp, Homo sapiens
ctctataagcaaattgcttttt

SEQ ID NO: 6131245 - DNA, 20 bp, Homo sapiens
ctctataattagttatgaca

SEQ ID NO: 6131246 - DNA, 18 bp, Homo sapiens
ctctatacatctctcccc

SEQ ID NO: 6131247 - DNA, 15 bp, Homo sapiens
ctctataccaataaa

SEQ ID NO: 6131248 - DNA, 19 bp, Homo sapiens
ctctataccaataaagtga

SEQ ID NO: 6131249 - DNA, 21 bp, Homo sapiens
ctctatactgccctgagttgg

SEQ ID NO: 6131250 - DNA, 22 bp, Homo sapiens
ctctatactgtggcctgcagga

SEQ ID NO: 6131251 - DNA, 14 bp, Homo sapiens
ctctatactttgtt

SEQ ID NO: 6131252 - DNA, 18 bp, Homo sapiens
ctctataggtcatgattt

SEQ ID NO: 6131253 - DNA, 21 bp, Homo sapiens
ctctatataccaaagcacatt

SEQ ID NO: 6131254 - DNA, 15 bp, Homo sapiens
ctctatattatgtct

SEQ ID NO: 6131255 - DNA, 21 bp, Homo sapiens
ctctatattatgtcttctttt

SEQ ID NO: 6131256 - DNA, 22 bp, Homo sapiens
ctctatatttagattgttaaaa

SEQ ID NO: 6131257 - DNA, 13 bp, Homo sapiens
ctctatattttta

SEQ ID NO: 6131258 - DNA, 17 bp, Homo sapiens
ctctatcaaatgtgatg

SEQ ID NO: 6131259 - DNA, 21 bp, Homo sapiens
ctctatcagaaatacaaaaaa

SEQ ID NO: 6131260 - DNA, 19 bp, Homo sapiens
ctctatcagcattgtttca

SEQ ID NO: 6131261 - DNA, 23 bp, Homo sapiens
ctctatcatctgctaagtaattt

SEQ ID NO: 6131262 - DNA, 21 bp, Homo sapiens
ctctatcatggtgaaaagctc

SEQ ID NO: 6131263 - DNA, 18 bp, Homo sapiens
ctctatcattaaagttct

SEQ ID NO: 6131264 - DNA, 15 bp, Homo sapiens
ctctatcccaagcca

SEQ ID NO: 6131265 - DNA, 15 bp, Homo sapiens
ctctatccctggcca

SEQ ID NO: 6131266 - DNA, 16 bp, Homo sapiens
ctctatccctggccac

SEQ ID NO: 6131267 - DNA, 20 bp, Homo sapiens
ctctatccctggccacctgc

SEQ ID NO: 6131268 - DNA, 23 bp, Homo sapiens
ctctatccctggccacctgccag

SEQ ID NO: 6131269 - DNA, 18 bp, Homo sapiens
ctctatcctctcttcctc

SEQ ID NO: 6131270 - DNA, 21 bp, Homo sapiens
ctctatcggggtcacttgcaa

SEQ ID NO: 6131271 - DNA, 14 bp, Homo sapiens
ctctatctcacagc

SEQ ID NO: 6131272 - DNA, 20 bp, Homo sapiens
ctctatctctttatatatgt

SEQ ID NO: 6131273 - DNA, 14 bp, Homo sapiens
ctctatctgggcct

SEQ ID NO: 6131274 - DNA, 17 bp, Homo sapiens
ctctatcttgcatctac

SEQ ID NO: 6131275 - DNA, 16 bp, Homo sapiens
ctctatcttgctctgt

SEQ ID NO: 6131276 - DNA, 18 bp, Homo sapiens
ctctatcttgctctgtaa

SEQ ID NO: 6131277 - DNA, 13 bp, Homo sapiens
ctctatgaaaagc

SEQ ID NO: 6131278 - DNA, 15 bp, Homo sapiens
ctctatgaaaagcaa

SEQ ID NO: 6131279 - DNA, 13 bp, Homo sapiens
ctctatgagtcta

SEQ ID NO: 6131280 - DNA, 20 bp, Homo sapiens
ctctatgataattacaatac

SEQ ID NO: 6131281 - DNA, 19 bp, Homo sapiens
ctctatgcaaaatgtctgt

SEQ ID NO: 6131282 - DNA, 18 bp, Homo sapiens
ctctatgccctgcagagc

SEQ ID NO: 6131283 - DNA, 21 bp, Homo sapiens
ctctatgccctgcagagcaat

SEQ ID NO: 6131284 - DNA, 13 bp, Homo sapiens
ctctatgctctgg

SEQ ID NO: 6131285 - DNA, 23 bp, Homo sapiens
ctctatgctggcttttcacccca

SEQ ID NO: 6131286 - DNA, 14 bp, Homo sapiens
ctctatggaaggag

SEQ ID NO: 6131287 - DNA, 22 bp, Homo sapiens
ctctatggaaggaggcctccac

SEQ ID NO: 6131288 - DNA, 22 bp, Homo sapiens
ctctatgggcagatctacccct

SEQ ID NO: 6131289 - DNA, 19 bp, Homo sapiens
ctctatggggcatcctctt

SEQ ID NO: 6131290 - DNA, 19 bp, Homo sapiens
ctctatgtacgataaagta

SEQ ID NO: 6131291 - DNA, 12 bp, Homo sapiens
ctctatgtacta

SEQ ID NO: 6131292 - DNA, 15 bp, Homo sapiens
ctctatgtatattct

SEQ ID NO: 6131293 - DNA, 18 bp, Homo sapiens
ctctatgtccggctttaa

SEQ ID NO: 6131294 - DNA, 15 bp, Homo sapiens
ctctatgtctgcctt

SEQ ID NO: 6131295 - DNA, 22 bp, Homo sapiens
ctctatgttagtataagctttt

SEQ ID NO: 6131296 - DNA, 23 bp, Homo sapiens
ctctatgttagtataagcttttc

SEQ ID NO: 6131297 - DNA, 19 bp, Homo sapiens
ctctatgttctaagaagtg

SEQ ID NO: 6131298 - DNA, 15 bp, Homo sapiens
ctctatgtttacaaa

SEQ ID NO: 6131299 - DNA, 14 bp, Homo sapiens
ctctattaaaatgc

SEQ ID NO: 6131300 - DNA, 20 bp, Homo sapiens
ctctattaagatttccaagt

SEQ ID NO: 6131301 - DNA, 23 bp, Homo sapiens
ctctattagactttagaaataaa

SEQ ID NO: 6131302 - DNA, 21 bp, Homo sapiens
ctctattatgaatgtgaagcc

SEQ ID NO: 6131303 - DNA, 22 bp, Homo sapiens
ctctattatgaatgtgaagcct

SEQ ID NO: 6131304 - DNA, 20 bp, Homo sapiens
ctctattatgttatcatcct

SEQ ID NO: 6131305 - DNA, 20 bp, Homo sapiens
ctctattccccaccctcccc

SEQ ID NO: 6131306 - DNA, 17 bp, Homo sapiens
ctctattccctcagcct

SEQ ID NO: 6131307 - DNA, 15 bp, Homo sapiens
ctctattcctgaccc

SEQ ID NO: 6131308 - DNA, 14 bp, Homo sapiens
ctctattctctaaa

SEQ ID NO: 6131309 - DNA, 13 bp, Homo sapiens
ctctattctgtag

SEQ ID NO: 6131310 - DNA, 13 bp, Homo sapiens
ctctattctttaa

SEQ ID NO: 6131311 - DNA, 14 bp, Homo sapiens
ctctattctttcca

SEQ ID NO: 6131312 - DNA, 15 bp, Homo sapiens
ctctattctttccat

SEQ ID NO: 6131313 - DNA, 19 bp, Homo sapiens
ctctattctttccatgaca

SEQ ID NO: 6131314 - DNA, 22 bp, Homo sapiens
ctctattgggcacagcctaggg

SEQ ID NO: 6131315 - DNA, 21 bp, Homo sapiens
ctctattgtgcctatattaaa

SEQ ID NO: 6131316 - DNA, 17 bp, Homo sapiens
ctctatttaaattcttt

SEQ ID NO: 6131317 - DNA, 13 bp, Homo sapiens
ctctatttaagat

SEQ ID NO: 6131318 - DNA, 14 bp, Homo sapiens
ctctatttaagata

SEQ ID NO: 6131319 - DNA, 17 bp, Homo sapiens
ctctatttatgtttgca

SEQ ID NO: 6131320 - DNA, 13 bp, Homo sapiens
ctctatttattgg

SEQ ID NO: 6131321 - DNA, 15 bp, Homo sapiens
ctctatttcattttt

SEQ ID NO: 6131322 - DNA, 14 bp, Homo sapiens
ctctatttccccct

SEQ ID NO: 6131323 - DNA, 22 bp, Homo sapiens
ctctatttccccctttcttcct

SEQ ID NO: 6131324 - DNA, 23 bp, Homo sapiens
ctctatttccccctttcttcctc

SEQ ID NO: 6131325 - DNA, 23 bp, Homo sapiens
ctctattttaatgtatatttgct

SEQ ID NO: 6131326 - DNA, 18 bp, Homo sapiens
ctctattttacttttctg

SEQ ID NO: 6131327 - DNA, 10 bp, Homo sapiens
ctctattttt

SEQ ID NO: 6131328 - DNA, 12 bp, Homo sapiens
ctctatttttgt

SEQ ID NO: 6131329 - DNA, 18 bp, Homo sapiens
ctctcaaaagtctatttt

SEQ ID NO: 6131330 - DNA, 13 bp, Homo sapiens
ctctcaaaatgtg

SEQ ID NO: 6131331 - DNA, 15 bp, Homo sapiens
ctctcaaacctggca

SEQ ID NO: 6131332 - DNA, 19 bp, Homo sapiens
ctctcaaacctggcagatg

SEQ ID NO: 6131333 - DNA, 18 bp, Homo sapiens
ctctcaaatccctctcca

SEQ ID NO: 6131334 - DNA, 22 bp, Homo sapiens
ctctcaaatcttttagtcatta

SEQ ID NO: 6131335 - DNA, 22 bp, Homo sapiens
ctctcaaatgtgtgttcctgct

SEQ ID NO: 6131336 - DNA, 19 bp, Homo sapiens
ctctcaaattcagctctga

SEQ ID NO: 6131337 - DNA, 14 bp, Homo sapiens
ctctcaacaccatg

SEQ ID NO: 6131338 - DNA, 20 bp, Homo sapiens
ctctcaagctagccagaggg

SEQ ID NO: 6131339 - DNA, 15 bp, Homo sapiens
ctctcaaggcttgga

SEQ ID NO: 6131340 - DNA, 19 bp, Homo sapiens
ctctcaagtgaaagacttg

SEQ ID NO: 6131341 - DNA, 18 bp, Homo sapiens
ctctcaagtgatgagaca

SEQ ID NO: 6131342 - DNA, 14 bp, Homo sapiens
ctctcaatttttgg

SEQ ID NO: 6131343 - DNA, 12 bp, Homo sapiens
ctctcacacaca

SEQ ID NO: 6131344 - DNA, 19 bp, Homo sapiens
ctctcacacatttctgcca

SEQ ID NO: 6131345 - DNA, 15 bp, Homo sapiens
ctctcacaggcagct

SEQ ID NO: 6131346 - DNA, 14 bp, Homo sapiens
ctctcacattactg

SEQ ID NO: 6131347 - DNA, 12 bp, Homo sapiens
ctctcaccagcc

SEQ ID NO: 6131348 - DNA, 18 bp, Homo sapiens
ctctcacccaccagctcc

SEQ ID NO: 6131349 - DNA, 22 bp, Homo sapiens
ctctcacccaccagctccacac

SEQ ID NO: 6131350 - DNA, 13 bp, Homo sapiens
ctctcacccagtc

SEQ ID NO: 6131351 - DNA, 15 bp, Homo sapiens
ctctcacccataaac

SEQ ID NO: 6131352 - DNA, 16 bp, Homo sapiens
ctctcacccccatccc

SEQ ID NO: 6131353 - DNA, 18 bp, Homo sapiens
ctctcacctacttcctcc

SEQ ID NO: 6131354 - DNA, 19 bp, Homo sapiens
ctctcacctacttcctcct

SEQ ID NO: 6131355 - DNA, 14 bp, Homo sapiens
ctctcacctgctcc

SEQ ID NO: 6131356 - DNA, 14 bp, Homo sapiens
ctctcacctggccc

SEQ ID NO: 6131357 - DNA, 17 bp, Homo sapiens
ctctcacgccacccccg

SEQ ID NO: 6131358 - DNA, 15 bp, Homo sapiens
ctctcactatgctgc

SEQ ID NO: 6131359 - DNA, 16 bp, Homo sapiens
ctctcactcacatttt

SEQ ID NO: 6131360 - DNA, 15 bp, Homo sapiens
ctctcactccagcca

SEQ ID NO: 6131361 - DNA, 19 bp, Homo sapiens
ctctcactccagccaaaga

SEQ ID NO: 6131362 - DNA, 12 bp, Homo sapiens
ctctcactcccc

SEQ ID NO: 6131363 - DNA, 21 bp, Homo sapiens
ctctcactccccagcctgggc

SEQ ID NO: 6131364 - DNA, 14 bp, Homo sapiens
ctctcactccccat

SEQ ID NO: 6131365 - DNA, 19 bp, Homo sapiens
ctctcactccccatgccac

SEQ ID NO: 6131366 - DNA, 15 bp, Homo sapiens
ctctcactccctccc

SEQ ID NO: 6131367 - DNA, 19 bp, Homo sapiens
ctaatgtattttattgtaa

SEQ ID NO: 6131368 - DNA, 14 bp, Homo sapiens
ctaatgtcacaaca

SEQ ID NO: 6131369 - DNA, 23 bp, Homo sapiens
ctaatgtcacaacatggtgctac

SEQ ID NO: 6131370 - DNA, 22 bp, Homo sapiens
ctaatgtctcactgttctgcaa

SEQ ID NO: 6131371 - DNA, 16 bp, Homo sapiens
ctaatgtctgcagctc

SEQ ID NO: 6131372 - DNA, 16 bp, Homo sapiens
ctaatgtcttcataaa

SEQ ID NO: 6131373 - DNA, 21 bp, Homo sapiens
ctaatgtcttcatttcattgt

SEQ ID NO: 6131374 - DNA, 23 bp, Homo sapiens
ctaatgtgaaaatcatcactcaa

SEQ ID NO: 6131375 - DNA, 15 bp, Homo sapiens
ctaatgtgaatgtga

SEQ ID NO: 6131376 - DNA, 20 bp, Homo sapiens
ctaatgtgagtgtgaagctt

SEQ ID NO: 6131377 - DNA, 17 bp, Homo sapiens
ctaatgtgatcatatga

SEQ ID NO: 6131378 - DNA, 16 bp, Homo sapiens
ctaatgtgcagggata

SEQ ID NO: 6131379 - DNA, 11 bp, Homo sapiens
ctaatgtgttt

SEQ ID NO: 6131380 - DNA, 22 bp, Homo sapiens
ctaatgttatttcttaaaattc

SEQ ID NO: 6131381 - DNA, 18 bp, Homo sapiens
ctaatgttattttccttc

SEQ ID NO: 6131382 - DNA, 20 bp, Homo sapiens
ctaatgttattttccttctg

SEQ ID NO: 6131383 - DNA, 21 bp, Homo sapiens
ctaatgttattttccttctga

SEQ ID NO: 6131384 - DNA, 16 bp, Homo sapiens
ctaatgttatttttta

SEQ ID NO: 6131385 - DNA, 19 bp, Homo sapiens
ctaatgttgatcagcaaat

SEQ ID NO: 6131386 - DNA, 18 bp, Homo sapiens
ctaatgttgctggatcag

SEQ ID NO: 6131387 - DNA, 13 bp, Homo sapiens
ctaatgttgtgtg

SEQ ID NO: 6131388 - DNA, 16 bp, Homo sapiens
ctaatgtttaagcaga

SEQ ID NO: 6131389 - DNA, 17 bp, Homo sapiens
ctaatgtttgcatataa

SEQ ID NO: 6131390 - DNA, 16 bp, Homo sapiens
ctaatgtttgtgagaa

SEQ ID NO: 6131391 - DNA, 15 bp, Homo sapiens
ctaattaaaatctgg

SEQ ID NO: 6131392 - DNA, 18 bp, Homo sapiens
ctaattaaaatctggaaa

SEQ ID NO: 6131393 - DNA, 19 bp, Homo sapiens
ctaattaaaatctggaaat

SEQ ID NO: 6131394 - DNA, 19 bp, Homo sapiens
ctaattaaaatgtgcagta

SEQ ID NO: 6131395 - DNA, 13 bp, Homo sapiens
ctaattaaactga

SEQ ID NO: 6131396 - DNA, 14 bp, Homo sapiens
ctaattaacatata

SEQ ID NO: 6131397 - DNA, 15 bp, Homo sapiens
ctaattaacatataa

SEQ ID NO: 6131398 - DNA, 17 bp, Homo sapiens
ctaattaacatataata

SEQ ID NO: 6131399 - DNA, 18 bp, Homo sapiens
ctaattaaccttactaat

SEQ ID NO: 6131400 - DNA, 17 bp, Homo sapiens
ctaattaagaaaactat

SEQ ID NO: 6131401 - DNA, 21 bp, Homo sapiens
ctaattaatagccaaagattt

SEQ ID NO: 6131402 - DNA, 16 bp, Homo sapiens
ctaattaatctggaat

SEQ ID NO: 6131403 - DNA, 19 bp, Homo sapiens
ctaattaattgtaatctga

SEQ ID NO: 6131404 - DNA, 14 bp, Homo sapiens
ctaattaatttcag

SEQ ID NO: 6131405 - DNA, 17 bp, Homo sapiens
ctaattaatttcagtaa

SEQ ID NO: 6131406 - DNA, 22 bp, Homo sapiens
ctaattacgataaggaagaaac

SEQ ID NO: 6131407 - DNA, 14 bp, Homo sapiens
ctaattagaaatca

SEQ ID NO: 6131408 - DNA, 18 bp, Homo sapiens
ctaattagagaactggag

SEQ ID NO: 6131409 - DNA, 14 bp, Homo sapiens
ctaattagagcaga

SEQ ID NO: 6131410 - DNA, 14 bp, Homo sapiens
ctaattagaggatg

SEQ ID NO: 6131411 - DNA, 15 bp, Homo sapiens
ctaattataattcag

SEQ ID NO: 6131412 - DNA, 22 bp, Homo sapiens
ctaattataccccctgcaaagc

SEQ ID NO: 6131413 - DNA, 16 bp, Homo sapiens
ctaattatataatatt

SEQ ID NO: 6131414 - DNA, 18 bp, Homo sapiens
ctaattatataatatttt

SEQ ID NO: 6131415 - DNA, 18 bp, Homo sapiens
ctaattatgtagctcttt

SEQ ID NO: 6131416 - DNA, 19 bp, Homo sapiens
ctaattattattttaaaat

SEQ ID NO: 6131417 - DNA, 21 bp, Homo sapiens
ctaattattgtaatgtaataa

SEQ ID NO: 6131418 - DNA, 20 bp, Homo sapiens
ctaattcaaggaatttctta

SEQ ID NO: 6131419 - DNA, 22 bp, Homo sapiens
ctaattcacaaaaaaagtaatt

SEQ ID NO: 6131420 - DNA, 19 bp, Homo sapiens
ctaattcagccatgtacag

SEQ ID NO: 6131421 - DNA, 13 bp, Homo sapiens
ctaattcatcttt

SEQ ID NO: 6131422 - DNA, 23 bp, Homo sapiens
ctaattcatcttttaatcatgag

SEQ ID NO: 6131423 - DNA, 15 bp, Homo sapiens
ctaattcatttactc

SEQ ID NO: 6131424 - DNA, 16 bp, Homo sapiens
ctaattcatttactca

SEQ ID NO: 6131425 - DNA, 20 bp, Homo sapiens
ctaattcccaacatttctta

SEQ ID NO: 6131426 - DNA, 14 bp, Homo sapiens
ctaattcccagagt

SEQ ID NO: 6131427 - DNA, 18 bp, Homo sapiens
ctaattcccattttgcaa

SEQ ID NO: 6131428 - DNA, 21 bp, Homo sapiens
ctaattcccattttgcaaaat

SEQ ID NO: 6131429 - DNA, 12 bp, Homo sapiens
ctaattcctgta

SEQ ID NO: 6131430 - DNA, 19 bp, Homo sapiens
ctaattccttaaatgaact

SEQ ID NO: 6131431 - DNA, 20 bp, Homo sapiens
ctaattccttaccccagctg

SEQ ID NO: 6131432 - DNA, 18 bp, Homo sapiens
ctaattctaaccagagca

SEQ ID NO: 6131433 - DNA, 24 bp, Homo sapiens
ctaattctaaccagagcaagcttt

SEQ ID NO: 6131434 - DNA, 15 bp, Homo sapiens
ctaattctatgcctg

SEQ ID NO: 6131435 - DNA, 20 bp, Homo sapiens
ctaattctattaaagtgcta

SEQ ID NO: 6131436 - DNA, 13 bp, Homo sapiens
ctaattctgggaa

SEQ ID NO: 6131437 - DNA, 15 bp, Homo sapiens
ctaattctgggaagg

SEQ ID NO: 6131438 - DNA, 14 bp, Homo sapiens
ctaattctgtcatt

SEQ ID NO: 6131439 - DNA, 14 bp, Homo sapiens
ctaattcttcatag

SEQ ID NO: 6131440 - DNA, 15 bp, Homo sapiens
ctaattcttcctttg

SEQ ID NO: 6131441 - DNA, 15 bp, Homo sapiens
ctaattctttaatga

SEQ ID NO: 6131442 - DNA, 16 bp, Homo sapiens
ctaattcttttcaaaa

SEQ ID NO: 6131443 - DNA, 13 bp, Homo sapiens
ctaattgaaattt

SEQ ID NO: 6131444 - DNA, 15 bp, Homo sapiens
ctaattgaaatttaa

SEQ ID NO: 6131445 - DNA, 17 bp, Homo sapiens
ctaattgactttagaaa

SEQ ID NO: 6131446 - DNA, 22 bp, Homo sapiens
ctaattgatagcaggtgtaata

SEQ ID NO: 6131447 - DNA, 16 bp, Homo sapiens
ctaattgcatctcaaa

SEQ ID NO: 6131448 - DNA, 19 bp, Homo sapiens
ctaattgcatctcaaaatt

SEQ ID NO: 6131449 - DNA, 20 bp, Homo sapiens
ctaattgcatctcaaaatta

SEQ ID NO: 6131450 - DNA, 13 bp, Homo sapiens
ctaattgccatgt

SEQ ID NO: 6131451 - DNA, 15 bp, Homo sapiens
ctaattgctgttgaa

SEQ ID NO: 6131452 - DNA, 14 bp, Homo sapiens
ctaattgcttattt

SEQ ID NO: 6131453 - DNA, 22 bp, Homo sapiens
ctaattggaagaaattcctgta

SEQ ID NO: 6131454 - DNA, 21 bp, Homo sapiens
ctaattggcagattgtttttt

SEQ ID NO: 6131455 - DNA, 21 bp, Homo sapiens
ctaattggcagcacccactca

SEQ ID NO: 6131456 - DNA, 19 bp, Homo sapiens
ctaattggcctctttaaga

SEQ ID NO: 6131457 - DNA, 17 bp, Homo sapiens
ctaattgggagtccagg

SEQ ID NO: 6131458 - DNA, 15 bp, Homo sapiens
ctaattggtactttt

SEQ ID NO: 6131459 - DNA, 21 bp, Homo sapiens
ctaattggtccaacccagcct

SEQ ID NO: 6131460 - DNA, 20 bp, Homo sapiens
ctaattggtttttactgaaa

SEQ ID NO: 6131461 - DNA, 18 bp, Homo sapiens
ctaattgtaagtgaaatt

SEQ ID NO: 6131462 - DNA, 20 bp, Homo sapiens
ctaattgtaagtgaaattaa

SEQ ID NO: 6131463 - DNA, 19 bp, Homo sapiens
ctaattgtataacaggtta

SEQ ID NO: 6131464 - DNA, 20 bp, Homo sapiens
ctaattgtataacaggttat

SEQ ID NO: 6131465 - DNA, 12 bp, Homo sapiens
ctaattgtggat

SEQ ID NO: 6131466 - DNA, 13 bp, Homo sapiens
ctaatttaaacca

SEQ ID NO: 6131467 - DNA, 17 bp, Homo sapiens
ctaatttaaaccagcag

SEQ ID NO: 6131468 - DNA, 19 bp, Homo sapiens
ctaatttaaaccagcagaa

SEQ ID NO: 6131469 - DNA, 20 bp, Homo sapiens
ctaatttaaaccagcagaaa

SEQ ID NO: 6131470 - DNA, 22 bp, Homo sapiens
ctaatttaaaccagcagaaaag

SEQ ID NO: 6131471 - DNA, 15 bp, Homo sapiens
ctaatttaaagagac

SEQ ID NO: 6131472 - DNA, 17 bp, Homo sapiens
ctaatttaacccagctc

SEQ ID NO: 6131473 - DNA, 23 bp, Homo sapiens
ctaatttaccattattttacagt

SEQ ID NO: 6131474 - DNA, 12 bp, Homo sapiens
ctaatttataaa

SEQ ID NO: 6131475 - DNA, 13 bp, Homo sapiens
ctaatttataaaa

SEQ ID NO: 6131476 - DNA, 15 bp, Homo sapiens
ctaatttatacaaaa

SEQ ID NO: 6131477 - DNA, 16 bp, Homo sapiens
ctaatttatacaaaat

SEQ ID NO: 6131478 - DNA, 18 bp, Homo sapiens
ctaatttatacaaaataa

SEQ ID NO: 6131479 - DNA, 19 bp, Homo sapiens
ctaatttatacaaaataat

SEQ ID NO: 6131480 - DNA, 23 bp, Homo sapiens
ctaatttatacaaaataatttaa

SEQ ID NO: 6131481 - DNA, 19 bp, Homo sapiens
ctaatttatattatccata

SEQ ID NO: 6131482 - DNA, 20 bp, Homo sapiens
ctaatttatattatccatag

SEQ ID NO: 6131483 - DNA, 15 bp, Homo sapiens
ctaatttatgtgcta

SEQ ID NO: 6131484 - DNA, 22 bp, Homo sapiens
ctaatttattgccgtcctggac

SEQ ID NO: 6131485 - DNA, 14 bp, Homo sapiens
ctaatttcctgctg

SEQ ID NO: 6131486 - DNA, 17 bp, Homo sapiens
ctaatttcctgctgaaa

SEQ ID NO: 6131487 - DNA, 14 bp, Homo sapiens
ctaatttctcctcc

SEQ ID NO: 6131488 - DNA, 20 bp, Homo sapiens
ctaatttctcctcccttcct

SEQ ID NO: 6131489 - DNA, 22 bp, Homo sapiens
ctaatttgaataaactctcccc

SEQ ID NO: 6131490 - DNA, 15 bp, Homo sapiens
ctaatttgatgttta

SEQ ID NO: 6131491 - DNA, 12 bp, Homo sapiens
ctaatttgcatt

SEQ ID NO: 6131492 - DNA, 14 bp, Homo sapiens
ctaatttgcattaa

SEQ ID NO: 6131493 - DNA, 16 bp, Homo sapiens
ctaatttgctctgtgg

SEQ ID NO: 6131494 - DNA, 18 bp, Homo sapiens
ctaatttggtttttactc

SEQ ID NO: 6131495 - DNA, 23 bp, Homo sapiens
ctaatttgtgaaagtggcaagct

SEQ ID NO: 6131496 - DNA, 20 bp, Homo sapiens
ctaattttacacattagatt

SEQ ID NO: 6131497 - DNA, 17 bp, Homo sapiens
ctaattttagtattcat

SEQ ID NO: 6131498 - DNA, 13 bp, Homo sapiens
ctaattttctcaa

SEQ ID NO: 6131499 - DNA, 20 bp, Homo sapiens
ctaattttctcaaaagcatt

SEQ ID NO: 6131500 - DNA, 14 bp, Homo sapiens
ctaattttgtgctc

SEQ ID NO: 6131501 - DNA, 20 bp, Homo sapiens
ctaattttgtgctctttcct

SEQ ID NO: 6131502 - DNA, 15 bp, Homo sapiens
ctaattttgttttaa

SEQ ID NO: 6131503 - DNA, 18 bp, Homo sapiens
ctaattttgttttaaact

SEQ ID NO: 6131504 - DNA, 20 bp, Homo sapiens
ctaattttgttttaaactgt

SEQ ID NO: 6131505 - DNA, 23 bp, Homo sapiens
ctaatttttaagaaattttgcct

SEQ ID NO: 6131506 - DNA, 17 bp, Homo sapiens
ctaatttttagatattc

SEQ ID NO: 6131507 - DNA, 22 bp, Homo sapiens
ctaatttttattaattttagtt

SEQ ID NO: 6131508 - DNA, 20 bp, Homo sapiens
ctaatttttggagaaatgtc

SEQ ID NO: 6131509 - DNA, 12 bp, Homo sapiens
ctaatttttgta

SEQ ID NO: 6131510 - DNA, 18 bp, Homo sapiens
ctaatttttgtattattt

SEQ ID NO: 6131511 - DNA, 20 bp, Homo sapiens
ctaatttttgtatttttcgt

SEQ ID NO: 6131512 - DNA, 21 bp, Homo sapiens
ctaatttttgtattttttagt

SEQ ID NO: 6131513 - DNA, 16 bp, Homo sapiens
ctaattttttaaagaa

SEQ ID NO: 6131514 - DNA, 15 bp, Homo sapiens
ctaattttttatcct

SEQ ID NO: 6131515 - DNA, 15 bp, Homo sapiens
ctaatttttttcctg

SEQ ID NO: 6131516 - DNA, 14 bp, Homo sapiens
ctaatttttttgta

SEQ ID NO: 6131517 - DNA, 22 bp, Homo sapiens
ctaatttttttttatttttagt

SEQ ID NO: 6131518 - DNA, 23 bp, Homo sapiens
ctacaaaaaaaatcaaaaaatta

SEQ ID NO: 6131519 - DNA, 13 bp, Homo sapiens
ctacaaaaaataa

SEQ ID NO: 6131520 - DNA, 23 bp, Homo sapiens
ctacaaaaaattagaaattggct

SEQ ID NO: 6131521 - DNA, 20 bp, Homo sapiens
ctacaaaaacacagcaaggg

SEQ ID NO: 6131522 - DNA, 22 bp, Homo sapiens
ctacaaaaaccctaattttgta

SEQ ID NO: 6131523 - DNA, 14 bp, Homo sapiens
ctacaaaaagaaga

SEQ ID NO: 6131524 - DNA, 17 bp, Homo sapiens
ctacaaaaaggtataaa

SEQ ID NO: 6131525 - DNA, 18 bp, Homo sapiens
ctacaaaagcttgtgtat

SEQ ID NO: 6131526 - DNA, 20 bp, Homo sapiens
ctacaaaagcttgtgtatct

SEQ ID NO: 6131527 - DNA, 12 bp, Homo sapiens
ctacaaaatgga

SEQ ID NO: 6131528 - DNA, 18 bp, Homo sapiens
ctacaaaatttgaaattt

SEQ ID NO: 6131529 - DNA, 18 bp, Homo sapiens
ctacaaacaaaagcagcc

SEQ ID NO: 6131530 - DNA, 15 bp, Homo sapiens
ctacaaacaaaattt

SEQ ID NO: 6131531 - DNA, 20 bp, Homo sapiens
ctacaaacaaaatttctatt

SEQ ID NO: 6131532 - DNA, 10 bp, Homo sapiens
ctacaaacat

SEQ ID NO: 6131533 - DNA, 14 bp, Homo sapiens
ctacaaagaagaca

SEQ ID NO: 6131534 - DNA, 15 bp, Homo sapiens
ctacaaagaagacat

SEQ ID NO: 6131535 - DNA, 19 bp, Homo sapiens
ctacaaagaagacatgttt

SEQ ID NO: 6131536 - DNA, 15 bp, Homo sapiens
ctacaaagcagagat

SEQ ID NO: 6131537 - DNA, 17 bp, Homo sapiens
ctacaaagctttgctac

SEQ ID NO: 6131538 - DNA, 15 bp, Homo sapiens
ctacaaaggtttaaa

SEQ ID NO: 6131539 - DNA, 17 bp, Homo sapiens
ctacaaaggtttaaatg

SEQ ID NO: 6131540 - DNA, 21 bp, Homo sapiens
ctacaaaggtttaaatgaaca

SEQ ID NO: 6131541 - DNA, 13 bp, Homo sapiens
ctacaaatgaaaa

SEQ ID NO: 6131542 - DNA, 14 bp, Homo sapiens
ctacaaattatcat

SEQ ID NO: 6131543 - DNA, 16 bp, Homo sapiens
ctacaaatttatgcat

SEQ ID NO: 6131544 - DNA, 17 bp, Homo sapiens
ctacaaatttatgcatt

SEQ ID NO: 6131545 - DNA, 18 bp, Homo sapiens
ctacaaatttatgcattt

SEQ ID NO: 6131546 - DNA, 14 bp, Homo sapiens
ctctcactcctgcc

SEQ ID NO: 6131547 - DNA, 15 bp, Homo sapiens
ctctcactcctgcct

SEQ ID NO: 6131548 - DNA, 21 bp, Homo sapiens
ctctcactcctgcctccgctg

SEQ ID NO: 6131549 - DNA, 12 bp, Homo sapiens
ctctcactcctt

SEQ ID NO: 6131550 - DNA, 19 bp, Homo sapiens
ctctcactctggcagcctc

SEQ ID NO: 6131551 - DNA, 13 bp, Homo sapiens
ctctcactggcca

SEQ ID NO: 6131552 - DNA, 14 bp, Homo sapiens
ctctcactgtgtcc

SEQ ID NO: 6131553 - DNA, 21 bp, Homo sapiens
ctctcactgtgttactgcttt

SEQ ID NO: 6131554 - DNA, 21 bp, Homo sapiens
ctctcacttgttttatttaac

SEQ ID NO: 6131555 - DNA, 12 bp, Homo sapiens
ctctcactttgg

SEQ ID NO: 6131556 - DNA, 22 bp, Homo sapiens
ctctcactttggttggaacttt

SEQ ID NO: 6131557 - DNA, 12 bp, Homo sapiens
ctctcagaaata

SEQ ID NO: 6131558 - DNA, 13 bp, Homo sapiens
ctctcagaacata

SEQ ID NO: 6131559 - DNA, 11 bp, Homo sapiens
ctctcagaccc

SEQ ID NO: 6131560 - DNA, 13 bp, Homo sapiens
ctctcagacccag

SEQ ID NO: 6131561 - DNA, 19 bp, Homo sapiens
ctctcagaccgtcttcctc

SEQ ID NO: 6131562 - DNA, 16 bp, Homo sapiens
ctctcagagcaagcct

SEQ ID NO: 6131563 - DNA, 20 bp, Homo sapiens
ctctcagagcaagcctttga

SEQ ID NO: 6131564 - DNA, 16 bp, Homo sapiens
ctctcagagcatctgg

SEQ ID NO: 6131565 - DNA, 18 bp, Homo sapiens
ctctcagagcatctggct

SEQ ID NO: 6131566 - DNA, 15 bp, Homo sapiens
ctctcagagccctca

SEQ ID NO: 6131567 - DNA, 14 bp, Homo sapiens
ctctcagagcctca

SEQ ID NO: 6131568 - DNA, 19 bp, Homo sapiens
ctctcagagcctcagcttc

SEQ ID NO: 6131569 - DNA, 15 bp, Homo sapiens
ctctcagaggcccca

SEQ ID NO: 6131570 - DNA, 12 bp, Homo sapiens
ctctcagagtga

SEQ ID NO: 6131571 - DNA, 17 bp, Homo sapiens
ctctcagatccctcggt

SEQ ID NO: 6131572 - DNA, 23 bp, Homo sapiens
ctctcagatccctcggtcagcac

SEQ ID NO: 6131573 - DNA, 14 bp, Homo sapiens
ctctcagcaagtgc

SEQ ID NO: 6131574 - DNA, 19 bp, Homo sapiens
ctctcagcaagtgcccagt

SEQ ID NO: 6131575 - DNA, 20 bp, Homo sapiens
ctctcagcaagtgcccagtg

SEQ ID NO: 6131576 - DNA, 12 bp, Homo sapiens
ctctcagcacag

SEQ ID NO: 6131577 - DNA, 13 bp, Homo sapiens
ctctcagcacagc

SEQ ID NO: 6131578 - DNA, 14 bp, Homo sapiens
ctctcagcacagcc

SEQ ID NO: 6131579 - DNA, 15 bp, Homo sapiens
ctctcagcatagcct

SEQ ID NO: 6131580 - DNA, 23 bp, Homo sapiens
ctctcagcatagcctgcctgatc

SEQ ID NO: 6131581 - DNA, 11 bp, Homo sapiens
ctctcagccaa

SEQ ID NO: 6131582 - DNA, 23 bp, Homo sapiens
ctctcagccaacgagtaatttat

SEQ ID NO: 6131583 - DNA, 17 bp, Homo sapiens
ctctcagccagctgttt

SEQ ID NO: 6131584 - DNA, 18 bp, Homo sapiens
ctctcagcccagaagaaa

SEQ ID NO: 6131585 - DNA, 22 bp, Homo sapiens
ctctcagcccctgatcctgtga

SEQ ID NO: 6131586 - DNA, 18 bp, Homo sapiens
ctctcagccctccatggc

SEQ ID NO: 6131587 - DNA, 22 bp, Homo sapiens
ctctcagccctccatggcctgg

SEQ ID NO: 6131588 - DNA, 15 bp, Homo sapiens
ctctcagcctccact

SEQ ID NO: 6131589 - DNA, 16 bp, Homo sapiens
ctctcagctcagcgcc

SEQ ID NO: 6131590 - DNA, 15 bp, Homo sapiens
ctctcagctccaggt

SEQ ID NO: 6131591 - DNA, 14 bp, Homo sapiens
ctctcagctcccag

SEQ ID NO: 6131592 - DNA, 17 bp, Homo sapiens
ctctcagctcccaggcc

SEQ ID NO: 6131593 - DNA, 13 bp, Homo sapiens
ctctcagctccgg

SEQ ID NO: 6131594 - DNA, 14 bp, Homo sapiens
ctctcagctccggg

SEQ ID NO: 6131595 - DNA, 14 bp, Homo sapiens
ctctcagctggcag

SEQ ID NO: 6131596 - DNA, 16 bp, Homo sapiens
ctctcagcttgtgcct

SEQ ID NO: 6131597 - DNA, 17 bp, Homo sapiens
ctctcagcttgtgcctt

SEQ ID NO: 6131598 - DNA, 19 bp, Homo sapiens
ctctcaggaaatgctgacc

SEQ ID NO: 6131599 - DNA, 21 bp, Homo sapiens
ctctcaggaaatgctgaccca

SEQ ID NO: 6131600 - DNA, 21 bp, Homo sapiens
ctctcaggaccaccctgccaa

SEQ ID NO: 6131601 - DNA, 13 bp, Homo sapiens
ctctcaggagcac

SEQ ID NO: 6131602 - DNA, 21 bp, Homo sapiens
ctctcaggagccatcatcggc

SEQ ID NO: 6131603 - DNA, 12 bp, Homo sapiens
ctctcaggaggc

SEQ ID NO: 6131604 - DNA, 14 bp, Homo sapiens
ctctcaggattgct

SEQ ID NO: 6131605 - DNA, 22 bp, Homo sapiens
ctctcaggccaaactcacctgc

SEQ ID NO: 6131606 - DNA, 23 bp, Homo sapiens
ctctcaggccaaactcacctgcc

SEQ ID NO: 6131607 - DNA, 17 bp, Homo sapiens
ctctcaggccagctgct

SEQ ID NO: 6131608 - DNA, 19 bp, Homo sapiens
ctctcaggccagctgcttg

SEQ ID NO: 6131609 - DNA, 15 bp, Homo sapiens
ctctcaggccgagag

SEQ ID NO: 6131610 - DNA, 20 bp, Homo sapiens
ctctcagggcctggcaggcc

SEQ ID NO: 6131611 - DNA, 22 bp, Homo sapiens
ctctcagggcctggcaggccag

SEQ ID NO: 6131612 - DNA, 15 bp, Homo sapiens
ctctcaggtcactcc

SEQ ID NO: 6131613 - DNA, 22 bp, Homo sapiens
ctctcaggtggaggcaacaggg

SEQ ID NO: 6131614 - DNA, 19 bp, Homo sapiens
ctctcagtactttggaggc

SEQ ID NO: 6131615 - DNA, 18 bp, Homo sapiens
ctctcagtatcttaaaat

SEQ ID NO: 6131616 - DNA, 15 bp, Homo sapiens
ctctcagtgccttct

SEQ ID NO: 6131617 - DNA, 17 bp, Homo sapiens
ctctcagtgccttctct

SEQ ID NO: 6131618 - DNA, 22 bp, Homo sapiens
ctctcagtgccttctctcagct

SEQ ID NO: 6131619 - DNA, 12 bp, Homo sapiens
ctctcagtgttt

SEQ ID NO: 6131620 - DNA, 18 bp, Homo sapiens
ctctcagtgttttggact

SEQ ID NO: 6131621 - DNA, 13 bp, Homo sapiens
ctctcagttattc

SEQ ID NO: 6131622 - DNA, 15 bp, Homo sapiens
ctctcatacataaaa

SEQ ID NO: 6131623 - DNA, 15 bp, Homo sapiens
ctctcataccctccc

SEQ ID NO: 6131624 - DNA, 18 bp, Homo sapiens
ctctcatatcactgaagg

SEQ ID NO: 6131625 - DNA, 15 bp, Homo sapiens
ctctcatcagcccag

SEQ ID NO: 6131626 - DNA, 14 bp, Homo sapiens
ctctcatccaggtc

SEQ ID NO: 6131627 - DNA, 20 bp, Homo sapiens
ctctcatccaggtcctttcc

SEQ ID NO: 6131628 - DNA, 22 bp, Homo sapiens
ctctcatccaggtcctttcctt

SEQ ID NO: 6131629 - DNA, 17 bp, Homo sapiens
ctctcatcccagtcctg

SEQ ID NO: 6131630 - DNA, 14 bp, Homo sapiens
ctctcatccccctg

SEQ ID NO: 6131631 - DNA, 16 bp, Homo sapiens
ctctcatcgtctttta

SEQ ID NO: 6131632 - DNA, 16 bp, Homo sapiens
ctctcatctgacctta

SEQ ID NO: 6131633 - DNA, 21 bp, Homo sapiens
ctctcatctgatcacttcatg

SEQ ID NO: 6131634 - DNA, 13 bp, Homo sapiens
ctctcatgaacct

SEQ ID NO: 6131635 - DNA, 16 bp, Homo sapiens
ctctcatgcctcctga

SEQ ID NO: 6131636 - DNA, 21 bp, Homo sapiens
ctctcatgctgcccctgcctt

SEQ ID NO: 6131637 - DNA, 20 bp, Homo sapiens
ctctcatggtacttcctctg

SEQ ID NO: 6131638 - DNA, 22 bp, Homo sapiens
ctctcatggtacttcctctgtg

SEQ ID NO: 6131639 - DNA, 18 bp, Homo sapiens
ctctcatgtccctccagg

SEQ ID NO: 6131640 - DNA, 20 bp, Homo sapiens
ctctcatgtccctccaggga

SEQ ID NO: 6131641 - DNA, 14 bp, Homo sapiens
ctctcatgtctctt

SEQ ID NO: 6131642 - DNA, 23 bp, Homo sapiens
ctctcatgtttccctactaacat

SEQ ID NO: 6131643 - DNA, 11 bp, Homo sapiens
ctctcattccc

SEQ ID NO: 6131644 - DNA, 16 bp, Homo sapiens
ctctcattccccaggt

SEQ ID NO: 6131645 - DNA, 20 bp, Homo sapiens
ctctcattccccaggtggct

SEQ ID NO: 6131646 - DNA, 21 bp, Homo sapiens
ctctcattccccaggtggctg

SEQ ID NO: 6131647 - DNA, 16 bp, Homo sapiens
ctctcattctctttct

SEQ ID NO: 6131648 - DNA, 13 bp, Homo sapiens
ctctcattgtctt

SEQ ID NO: 6131649 - DNA, 14 bp, Homo sapiens
ctctcatttccagc

SEQ ID NO: 6131650 - DNA, 18 bp, Homo sapiens
ctctcatttccagcttct

SEQ ID NO: 6131651 - DNA, 20 bp, Homo sapiens
ctctcatttctttcaagaca

SEQ ID NO: 6131652 - DNA, 22 bp, Homo sapiens
ctctcatttctttcaagacagc

SEQ ID NO: 6131653 - DNA, 14 bp, Homo sapiens
ctctcatttgtgtg

SEQ ID NO: 6131654 - DNA, 16 bp, Homo sapiens
ctctccaaaccacttt

SEQ ID NO: 6131655 - DNA, 18 bp, Homo sapiens
ctctccaaaggggctgct

SEQ ID NO: 6131656 - DNA, 23 bp, Homo sapiens
ctctccaaaggggctgctggggc

SEQ ID NO: 6131657 - DNA, 21 bp, Homo sapiens
ctctccaaatattattcaagt

SEQ ID NO: 6131658 - DNA, 22 bp, Homo sapiens
ctctccaaatattattcaagtg

SEQ ID NO: 6131659 - DNA, 20 bp, Homo sapiens
ctctccaaatcaaggatctt

SEQ ID NO: 6131660 - DNA, 16 bp, Homo sapiens
ctctccaaccactgtg

SEQ ID NO: 6131661 - DNA, 17 bp, Homo sapiens
ctctccaaccactgtgc

SEQ ID NO: 6131662 - DNA, 13 bp, Homo sapiens
ctctccaacctgg

SEQ ID NO: 6131663 - DNA, 14 bp, Homo sapiens
ctctccaacctgga

SEQ ID NO: 6131664 - DNA, 16 bp, Homo sapiens
ctctccaagacagcag

SEQ ID NO: 6131665 - DNA, 14 bp, Homo sapiens
ctctccaagcacta

SEQ ID NO: 6131666 - DNA, 15 bp, Homo sapiens
ctctccaaggaaatc

SEQ ID NO: 6131667 - DNA, 12 bp, Homo sapiens
ctctccaagggc

SEQ ID NO: 6131668 - DNA, 14 bp, Homo sapiens
ctctccaagggctt

SEQ ID NO: 6131669 - DNA, 21 bp, Homo sapiens
ctctccaagggcttctgcacc

SEQ ID NO: 6131670 - DNA, 23 bp, Homo sapiens
ctctccaagtctcagtggcttca

SEQ ID NO: 6131671 - DNA, 19 bp, Homo sapiens
ctctccaagtctctctgtg

SEQ ID NO: 6131672 - DNA, 20 bp, Homo sapiens
ctctccaagtctctctgtga

SEQ ID NO: 6131673 - DNA, 22 bp, Homo sapiens
ctctccaagtctctctgtgaat

SEQ ID NO: 6131674 - DNA, 16 bp, Homo sapiens
ctctccaagtgccaga

SEQ ID NO: 6131675 - DNA, 22 bp, Homo sapiens
ctctccaagtgccagaggtggg

SEQ ID NO: 6131676 - DNA, 14 bp, Homo sapiens
ctctccaattgtaa

SEQ ID NO: 6131677 - DNA, 17 bp, Homo sapiens
ctctccaattgtaaaaa

SEQ ID NO: 6131678 - DNA, 15 bp, Homo sapiens
ctctccacacccagc

SEQ ID NO: 6131679 - DNA, 17 bp, Homo sapiens
ctctccacacccagcct

SEQ ID NO: 6131680 - DNA, 23 bp, Homo sapiens
ctctccacacccagcctgtccca

SEQ ID NO: 6131681 - DNA, 20 bp, Homo sapiens
ctctccacacccatgactgc

SEQ ID NO: 6131682 - DNA, 15 bp, Homo sapiens
ctctccacacggagc

SEQ ID NO: 6131683 - DNA, 15 bp, Homo sapiens
ctctccacaggagcc

SEQ ID NO: 6131684 - DNA, 18 bp, Homo sapiens
ctctccacaggagcctct

SEQ ID NO: 6131685 - DNA, 14 bp, Homo sapiens
ctctccacagtgtt

SEQ ID NO: 6131686 - DNA, 15 bp, Homo sapiens
ctctccacagtgttg

SEQ ID NO: 6131687 - DNA, 20 bp, Homo sapiens
ctctccaccagccctactcc

SEQ ID NO: 6131688 - DNA, 15 bp, Homo sapiens
ctctccacccagagg

SEQ ID NO: 6131689 - DNA, 16 bp, Homo sapiens
ctctccaccccccacg

SEQ ID NO: 6131690 - DNA, 14 bp, Homo sapiens
ctctccaccctcct

SEQ ID NO: 6131691 - DNA, 20 bp, Homo sapiens
ctctccacctagtggctgtc

SEQ ID NO: 6131692 - DNA, 15 bp, Homo sapiens
ctctccacctcacta

SEQ ID NO: 6131693 - DNA, 20 bp, Homo sapiens
ctctccacctcactagctcc

SEQ ID NO: 6131694 - DNA, 15 bp, Homo sapiens
ctctccacctcagcc

SEQ ID NO: 6131695 - DNA, 18 bp, Homo sapiens
ctctccaccttagtactt

SEQ ID NO: 6131696 - DNA, 24 bp, Homo sapiens
ctctccactaccccacaccagcct

SEQ ID NO: 6131697 - DNA, 22 bp, Homo sapiens
ctctccactcatgtgactcttt

SEQ ID NO: 6131698 - DNA, 22 bp, Homo sapiens
ctctccactcttctctcctttc

SEQ ID NO: 6131699 - DNA, 13 bp, Homo sapiens
ctctccactgacc

SEQ ID NO: 6131700 - DNA, 11 bp, Homo sapiens
ctctccactgc

SEQ ID NO: 6131701 - DNA, 18 bp, Homo sapiens
ctctccactgctctcagc

SEQ ID NO: 6131702 - DNA, 14 bp, Homo sapiens
ctctccacttctgg

SEQ ID NO: 6131703 - DNA, 15 bp, Homo sapiens
ctctccactttcagc

SEQ ID NO: 6131704 - DNA, 20 bp, Homo sapiens
ctctccagaaacagctgctt

SEQ ID NO: 6131705 - DNA, 22 bp, Homo sapiens
ctctccagaaacagctgcttct

SEQ ID NO: 6131706 - DNA, 23 bp, Homo sapiens
ctctccagaaacagctgcttctc

SEQ ID NO: 6131707 - DNA, 14 bp, Homo sapiens
ctctccagacacag

SEQ ID NO: 6131708 - DNA, 12 bp, Homo sapiens
ctctccagagag

SEQ ID NO: 6131709 - DNA, 12 bp, Homo sapiens
ctctccagagct

SEQ ID NO: 6131710 - DNA, 17 bp, Homo sapiens
ctctccagcatcccagc

SEQ ID NO: 6131711 - DNA, 18 bp, Homo sapiens
ctctccagcatcccagcc

SEQ ID NO: 6131712 - DNA, 13 bp, Homo sapiens
ctctccagccatt

SEQ ID NO: 6131713 - DNA, 12 bp, Homo sapiens
ctctccagcccc

SEQ ID NO: 6131714 - DNA, 14 bp, Homo sapiens
ctctccagcccctg

SEQ ID NO: 6131715 - DNA, 13 bp, Homo sapiens
ctctccagcccta

SEQ ID NO: 6131716 - DNA, 21 bp, Homo sapiens
ctctccagccttctctctctg

SEQ ID NO: 6131717 - DNA, 22 bp, Homo sapiens
ctctccagccttctctctctgg

SEQ ID NO: 6131718 - DNA, 19 bp, Homo sapiens
ctctccagcggtccaaagt

SEQ ID NO: 6131719 - DNA, 15 bp, Homo sapiens
ctctccagctccaag

SEQ ID NO: 6131720 - DNA, 16 bp, Homo sapiens
ctctccagctcctccc

SEQ ID NO: 6131721 - DNA, 19 bp, Homo sapiens
ctctccaggattgtccaca

SEQ ID NO: 6131722 - DNA, 20 bp, Homo sapiens
ctctccaggattgtccacaa

SEQ ID NO: 6131723 - DNA, 19 bp, Homo sapiens
ctctccaggcacccttctt

SEQ ID NO: 6131724 - DNA, 16 bp, Homo sapiens
ctctccaggcaccgcc

SEQ ID NO: 6131725 - DNA, 21 bp, Homo sapiens
ctctccaggcaccgcctgccc

SEQ ID NO: 6131726 - DNA, 21 bp, Homo sapiens
ctacaaatttatgcatttcat

SEQ ID NO: 6131727 - DNA, 12 bp, Homo sapiens
ctacaacagcct

SEQ ID NO: 6131728 - DNA, 22 bp, Homo sapiens
ctacaacatcactaatttggct

SEQ ID NO: 6131729 - DNA, 13 bp, Homo sapiens
ctacaaccaagct

SEQ ID NO: 6131730 - DNA, 12 bp, Homo sapiens
ctacaaccaatt

SEQ ID NO: 6131731 - DNA, 13 bp, Homo sapiens
ctacaaccagagc

SEQ ID NO: 6131732 - DNA, 20 bp, Homo sapiens
ctacaaccatccctgccaca

SEQ ID NO: 6131733 - DNA, 16 bp, Homo sapiens
ctacaacctccacctt

SEQ ID NO: 6131734 - DNA, 19 bp, Homo sapiens
ctacaactggagttttttt

SEQ ID NO: 6131735 - DNA, 21 bp, Homo sapiens
ctacaactgttttaaaacttt

SEQ ID NO: 6131736 - DNA, 16 bp, Homo sapiens
ctacaacttaatggaa

SEQ ID NO: 6131737 - DNA, 14 bp, Homo sapiens
ctacaacttcagca

SEQ ID NO: 6131738 - DNA, 21 bp, Homo sapiens
ctacaacttttgttttctgat

SEQ ID NO: 6131739 - DNA, 15 bp, Homo sapiens
ctacaagagcagcct

SEQ ID NO: 6131740 - DNA, 21 bp, Homo sapiens
ctacaagagcagcctgtggca

SEQ ID NO: 6131741 - DNA, 23 bp, Homo sapiens
ctacaagagcagcctgtggcatc

SEQ ID NO: 6131742 - DNA, 15 bp, Homo sapiens
ctacaagattcctgg

SEQ ID NO: 6131743 - DNA, 15 bp, Homo sapiens
ctacaagatttagaa

SEQ ID NO: 6131744 - DNA, 15 bp, Homo sapiens
ctacaagctggcact

SEQ ID NO: 6131745 - DNA, 18 bp, Homo sapiens
ctacaagcttttaacttt

SEQ ID NO: 6131746 - DNA, 13 bp, Homo sapiens
ctacaagggaagc

SEQ ID NO: 6131747 - DNA, 18 bp, Homo sapiens
ctacaagtatatgtgaaa

SEQ ID NO: 6131748 - DNA, 15 bp, Homo sapiens
ctacaataaaaagaa

SEQ ID NO: 6131749 - DNA, 16 bp, Homo sapiens
ctacaataaaaagaaa

SEQ ID NO: 6131750 - DNA, 18 bp, Homo sapiens
ctacaataaaaagaaatt

SEQ ID NO: 6131751 - DNA, 19 bp, Homo sapiens
ctacaataaatgctgaatg

SEQ ID NO: 6131752 - DNA, 22 bp, Homo sapiens
ctacaataatagagaggaagcc

SEQ ID NO: 6131753 - DNA, 16 bp, Homo sapiens
ctacaatgggaaaact

SEQ ID NO: 6131754 - DNA, 17 bp, Homo sapiens
ctacaatgggaaaactt

SEQ ID NO: 6131755 - DNA, 21 bp, Homo sapiens
ctacaatgggaaaacttcact

SEQ ID NO: 6131756 - DNA, 22 bp, Homo sapiens
ctacaatgggaaaacttcactc

SEQ ID NO: 6131757 - DNA, 13 bp, Homo sapiens
ctacaatgtgaaa

SEQ ID NO: 6131758 - DNA, 13 bp, Homo sapiens
ctacaatgtgaac

SEQ ID NO: 6131759 - DNA, 20 bp, Homo sapiens
ctacaattcctctgataata

SEQ ID NO: 6131760 - DNA, 15 bp, Homo sapiens
ctacaattttctccc

SEQ ID NO: 6131761 - DNA, 16 bp, Homo sapiens
ctacaattttctccca

SEQ ID NO: 6131762 - DNA, 13 bp, Homo sapiens
ctacacaaagcag

SEQ ID NO: 6131763 - DNA, 13 bp, Homo sapiens
ctacacaacatgt

SEQ ID NO: 6131764 - DNA, 17 bp, Homo sapiens
ctacacaatacagtatt

SEQ ID NO: 6131765 - DNA, 20 bp, Homo sapiens
ctacacaatacagtattata

SEQ ID NO: 6131766 - DNA, 10 bp, Homo sapiens
ctacacacac

SEQ ID NO: 6131767 - DNA, 13 bp, Homo sapiens
ctacacacacact

SEQ ID NO: 6131768 - DNA, 18 bp, Homo sapiens
ctacacacacactccctg

SEQ ID NO: 6131769 - DNA, 11 bp, Homo sapiens
ctacacacacc

SEQ ID NO: 6131770 - DNA, 22 bp, Homo sapiens
ctacacacagatgacaaattat

SEQ ID NO: 6131771 - DNA, 21 bp, Homo sapiens
ctacacacccccaagccacag

SEQ ID NO: 6131772 - DNA, 15 bp, Homo sapiens
ctacacagacattaa

SEQ ID NO: 6131773 - DNA, 18 bp, Homo sapiens
ctacacagacattaagaa

SEQ ID NO: 6131774 - DNA, 22 bp, Homo sapiens
ctacacagacattaagaagagc

SEQ ID NO: 6131775 - DNA, 13 bp, Homo sapiens
ctacacagaccct

SEQ ID NO: 6131776 - DNA, 17 bp, Homo sapiens
ctacacagcacaccagc

SEQ ID NO: 6131777 - DNA, 19 bp, Homo sapiens
ctacacagcacaccagccg

SEQ ID NO: 6131778 - DNA, 24 bp, Homo sapiens
ctacacagcacaccagccgctgca

SEQ ID NO: 6131779 - DNA, 12 bp, Homo sapiens
ctacacagcctg

SEQ ID NO: 6131780 - DNA, 16 bp, Homo sapiens
ctacacagcctggact

SEQ ID NO: 6131781 - DNA, 13 bp, Homo sapiens
ctacacaggacag

SEQ ID NO: 6131782 - DNA, 17 bp, Homo sapiens
ctacacaggagtcttca

SEQ ID NO: 6131783 - DNA, 13 bp, Homo sapiens
ctacacaggcagg

SEQ ID NO: 6131784 - DNA, 13 bp, Homo sapiens
ctacacagggcct

SEQ ID NO: 6131785 - DNA, 17 bp, Homo sapiens
ctacacagggcctgcta

SEQ ID NO: 6131786 - DNA, 19 bp, Homo sapiens
ctacacagtgggaactctg

SEQ ID NO: 6131787 - DNA, 20 bp, Homo sapiens
ctacacagtgggaactctga

SEQ ID NO: 6131788 - DNA, 21 bp, Homo sapiens
ctacacagtgggaactctgac

SEQ ID NO: 6131789 - DNA, 22 bp, Homo sapiens
ctacacagtgggaactctgaca

SEQ ID NO: 6131790 - DNA, 21 bp, Homo sapiens
ctacacatataaattgtctta

SEQ ID NO: 6131791 - DNA, 19 bp, Homo sapiens
ctacacatatatgtatatg

SEQ ID NO: 6131792 - DNA, 17 bp, Homo sapiens
ctacacatatgtgcttc

SEQ ID NO: 6131793 - DNA, 23 bp, Homo sapiens
ctacacattgctacctcagtgct

SEQ ID NO: 6131794 - DNA, 16 bp, Homo sapiens
ctacacatttcatcta

SEQ ID NO: 6131795 - DNA, 16 bp, Homo sapiens
ctacaccacacacaac

SEQ ID NO: 6131796 - DNA, 15 bp, Homo sapiens
ctacaccacactaaa

SEQ ID NO: 6131797 - DNA, 13 bp, Homo sapiens
ctacaccactctg

SEQ ID NO: 6131798 - DNA, 15 bp, Homo sapiens
ctacaccactctggc

SEQ ID NO: 6131799 - DNA, 19 bp, Homo sapiens
ctacaccactctggcagcc

SEQ ID NO: 6131800 - DNA, 20 bp, Homo sapiens
ctacaccactctggcagcca

SEQ ID NO: 6131801 - DNA, 22 bp, Homo sapiens
ctacaccactctggcagccaca

SEQ ID NO: 6131802 - DNA, 14 bp, Homo sapiens
ctacacccagcaat

SEQ ID NO: 6131803 - DNA, 13 bp, Homo sapiens
ctacacccagcta

SEQ ID NO: 6131804 - DNA, 22 bp, Homo sapiens
ctacacccctcccctgccctag

SEQ ID NO: 6131805 - DNA, 12 bp, Homo sapiens
ctacaccctctg

SEQ ID NO: 6131806 - DNA, 14 bp, Homo sapiens
ctacacctaactca

SEQ ID NO: 6131807 - DNA, 17 bp, Homo sapiens
ctacacctattatccca

SEQ ID NO: 6131808 - DNA, 14 bp, Homo sapiens
ctacacctccctcc

SEQ ID NO: 6131809 - DNA, 15 bp, Homo sapiens
ctacacctctgggcc

SEQ ID NO: 6131810 - DNA, 21 bp, Homo sapiens
ctacacctctgggccctgcag

SEQ ID NO: 6131811 - DNA, 12 bp, Homo sapiens
ctacacctggct

SEQ ID NO: 6131812 - DNA, 15 bp, Homo sapiens
ctacaccttgccttg

SEQ ID NO: 6131813 - DNA, 20 bp, Homo sapiens
ctacacctttctcctttgta

SEQ ID NO: 6131814 - DNA, 20 bp, Homo sapiens
ctacacggactgaggtgcct

SEQ ID NO: 6131815 - DNA, 23 bp, Homo sapiens
ctacacggttcaaacctgtgaag

SEQ ID NO: 6131816 - DNA, 20 bp, Homo sapiens
ctacacgtttcaacctctct

SEQ ID NO: 6131817 - DNA, 17 bp, Homo sapiens
ctacactccagcctgag

SEQ ID NO: 6131818 - DNA, 17 bp, Homo sapiens
ctacactccagcctggg

SEQ ID NO: 6131819 - DNA, 16 bp, Homo sapiens
ctacactccagtgaga

SEQ ID NO: 6131820 - DNA, 21 bp, Homo sapiens
ctacactcgccttctgcttcc

SEQ ID NO: 6131821 - DNA, 21 bp, Homo sapiens
ctacactctcctgggcccctc

SEQ ID NO: 6131822 - DNA, 12 bp, Homo sapiens
ctacactgaaac

SEQ ID NO: 6131823 - DNA, 16 bp, Homo sapiens
ctacactgacactggt

SEQ ID NO: 6131824 - DNA, 14 bp, Homo sapiens
ctacactgccagcc

SEQ ID NO: 6131825 - DNA, 13 bp, Homo sapiens
ctacactggataa

SEQ ID NO: 6131826 - DNA, 17 bp, Homo sapiens
ctacactggataaaaat

SEQ ID NO: 6131827 - DNA, 16 bp, Homo sapiens
ctacactgtataactg

SEQ ID NO: 6131828 - DNA, 20 bp, Homo sapiens
ctacactgtgaacttgggga

SEQ ID NO: 6131829 - DNA, 13 bp, Homo sapiens
ctacactgtgctg

SEQ ID NO: 6131830 - DNA, 17 bp, Homo sapiens
ctacactgtgctgagtc

SEQ ID NO: 6131831 - DNA, 15 bp, Homo sapiens
ctacacttacaagta

SEQ ID NO: 6131832 - DNA, 19 bp, Homo sapiens
ctacacttctccttatctt

SEQ ID NO: 6131833 - DNA, 13 bp, Homo sapiens
ctacagaaaaacc

SEQ ID NO: 6131834 - DNA, 23 bp, Homo sapiens
ctacagaaaaaccagaggcagct

SEQ ID NO: 6131835 - DNA, 16 bp, Homo sapiens
ctacagaaaaaccttg

SEQ ID NO: 6131836 - DNA, 20 bp, Homo sapiens
ctacagaaaccacagtcttc

SEQ ID NO: 6131837 - DNA, 20 bp, Homo sapiens
ctacagaaatactgctctga

SEQ ID NO: 6131838 - DNA, 16 bp, Homo sapiens
ctacagaacaaagaac

SEQ ID NO: 6131839 - DNA, 15 bp, Homo sapiens
ctacagaacaaccca

SEQ ID NO: 6131840 - DNA, 13 bp, Homo sapiens
ctacagaacctga

SEQ ID NO: 6131841 - DNA, 20 bp, Homo sapiens
ctacagaacttcagaaagac

SEQ ID NO: 6131842 - DNA, 12 bp, Homo sapiens
ctacagaatttt

SEQ ID NO: 6131843 - DNA, 15 bp, Homo sapiens
ctacagacagcttac

SEQ ID NO: 6131844 - DNA, 15 bp, Homo sapiens
ctacagacctggctc

SEQ ID NO: 6131845 - DNA, 18 bp, Homo sapiens
ctacagactccatctctt

SEQ ID NO: 6131846 - DNA, 19 bp, Homo sapiens
ctacagactccatctcttc

SEQ ID NO: 6131847 - DNA, 16 bp, Homo sapiens
ctacagacttctccag

SEQ ID NO: 6131848 - DNA, 17 bp, Homo sapiens
ctacagagaaaatgaat

SEQ ID NO: 6131849 - DNA, 18 bp, Homo sapiens
ctacagagaaaccagctt

SEQ ID NO: 6131850 - DNA, 19 bp, Homo sapiens
ctacagagaaaccagcttc

SEQ ID NO: 6131851 - DNA, 20 bp, Homo sapiens
ctacagagaaaccagcttcc

SEQ ID NO: 6131852 - DNA, 22 bp, Homo sapiens
ctacagagaaaccagcttcctt

SEQ ID NO: 6131853 - DNA, 13 bp, Homo sapiens
ctacagagaagcc

SEQ ID NO: 6131854 - DNA, 15 bp, Homo sapiens
ctacagagcagctcc

SEQ ID NO: 6131855 - DNA, 23 bp, Homo sapiens
ctacagagccgagcaatatttat

SEQ ID NO: 6131856 - DNA, 14 bp, Homo sapiens
ctacagagctgtgg

SEQ ID NO: 6131857 - DNA, 21 bp, Homo sapiens
ctacagaggaaacaatattta

SEQ ID NO: 6131858 - DNA, 15 bp, Homo sapiens
ctacagaggaggcct

SEQ ID NO: 6131859 - DNA, 18 bp, Homo sapiens
ctacagaggaggcctcaa

SEQ ID NO: 6131860 - DNA, 20 bp, Homo sapiens
ctacagaggaggcctcaaag

SEQ ID NO: 6131861 - DNA, 14 bp, Homo sapiens
ctacagaggattct

SEQ ID NO: 6131862 - DNA, 15 bp, Homo sapiens
ctacagaggccatgg

SEQ ID NO: 6131863 - DNA, 20 bp, Homo sapiens
ctacagaggccatgggcctc

SEQ ID NO: 6131864 - DNA, 20 bp, Homo sapiens
ctacagaggtctctgccggc

SEQ ID NO: 6131865 - DNA, 21 bp, Homo sapiens
ctacagataatttattttgta

SEQ ID NO: 6131866 - DNA, 14 bp, Homo sapiens
ctacagatgagtca

SEQ ID NO: 6131867 - DNA, 17 bp, Homo sapiens
ctacagattgggcgggg

SEQ ID NO: 6131868 - DNA, 19 bp, Homo sapiens
ctacagattgggcggggct

SEQ ID NO: 6131869 - DNA, 15 bp, Homo sapiens
ctacagcaaatttat

SEQ ID NO: 6131870 - DNA, 20 bp, Homo sapiens
ctacagcaaatttataattt

SEQ ID NO: 6131871 - DNA, 15 bp, Homo sapiens
ctacagcactactgg

SEQ ID NO: 6131872 - DNA, 21 bp, Homo sapiens
ctacagcactactgggtgtca

SEQ ID NO: 6131873 - DNA, 22 bp, Homo sapiens
ctacagcactactgggtgtcat

SEQ ID NO: 6131874 - DNA, 20 bp, Homo sapiens
ctacagcagcacgcatgtcc

SEQ ID NO: 6131875 - DNA, 15 bp, Homo sapiens
ctacagccacatccc

SEQ ID NO: 6131876 - DNA, 16 bp, Homo sapiens
ctacagccagaagccc

SEQ ID NO: 6131877 - DNA, 20 bp, Homo sapiens
ctacagccctcactaacaaa

SEQ ID NO: 6131878 - DNA, 21 bp, Homo sapiens
ctacagcctagggcagacaat

SEQ ID NO: 6131879 - DNA, 16 bp, Homo sapiens
ctacagcctctttcct

SEQ ID NO: 6131880 - DNA, 16 bp, Homo sapiens
ctacagcctgcacaca

SEQ ID NO: 6131881 - DNA, 18 bp, Homo sapiens
ctacagctaatcagcatt

SEQ ID NO: 6131882 - DNA, 16 bp, Homo sapiens
ctacagctatatttga

SEQ ID NO: 6131883 - DNA, 17 bp, Homo sapiens
ctacagctatgaagaaa

SEQ ID NO: 6131884 - DNA, 14 bp, Homo sapiens
ctacagctccacac

SEQ ID NO: 6131885 - DNA, 14 bp, Homo sapiens
ctacagctccccca

SEQ ID NO: 6131886 - DNA, 19 bp, Homo sapiens
ctacagcttgaccgtgagg

SEQ ID NO: 6131887 - DNA, 22 bp, Homo sapiens
ctacagcttgaccgtgaggcca

SEQ ID NO: 6131888 - DNA, 20 bp, Homo sapiens
ctacagctttcttgctccct

SEQ ID NO: 6131889 - DNA, 22 bp, Homo sapiens
ctacagctttgggtcattttta

SEQ ID NO: 6131890 - DNA, 20 bp, Homo sapiens
ctacaggacaaagggaggga

SEQ ID NO: 6131891 - DNA, 22 bp, Homo sapiens
ctacaggacaaagggagggagc

SEQ ID NO: 6131892 - DNA, 14 bp, Homo sapiens
ctacaggactgggc

SEQ ID NO: 6131893 - DNA, 23 bp, Homo sapiens
ctacaggactgggccgggcccag

SEQ ID NO: 6131894 - DNA, 17 bp, Homo sapiens
ctacaggaggggtctca

SEQ ID NO: 6131895 - DNA, 14 bp, Homo sapiens
ctacaggagtgagc

SEQ ID NO: 6131896 - DNA, 21 bp, Homo sapiens
ctacaggatggtgggcaggat

SEQ ID NO: 6131897 - DNA, 22 bp, Homo sapiens
ctacaggcacacgccacctcgc

SEQ ID NO: 6131898 - DNA, 15 bp, Homo sapiens
ctacaggcctcaggg

SEQ ID NO: 6131899 - DNA, 20 bp, Homo sapiens
ctacaggcctttcaggaagg

SEQ ID NO: 6131900 - DNA, 21 bp, Homo sapiens
ctacaggcgtgagccaccatg

SEQ ID NO: 6131901 - DNA, 15 bp, Homo sapiens
ctacaggcttgagct

SEQ ID NO: 6131902 - DNA, 12 bp, Homo sapiens
ctacagggccaa

SEQ ID NO: 6131903 - DNA, 11 bp, Homo sapiens
ctacagggccg

SEQ ID NO: 6131904 - DNA, 18 bp, Homo sapiens
ctacaggggaaggtggcc

SEQ ID NO: 6131905 - DNA, 13 bp, Homo sapiens
ctctccaggccag

SEQ ID NO: 6131906 - DNA, 14 bp, Homo sapiens
ctctccaggcccca

SEQ ID NO: 6131907 - DNA, 12 bp, Homo sapiens
ctctccaggcct

SEQ ID NO: 6131908 - DNA, 13 bp, Homo sapiens
ctctccaggcctg

SEQ ID NO: 6131909 - DNA, 10 bp, Homo sapiens
ctctccaggg

SEQ ID NO: 6131910 - DNA, 19 bp, Homo sapiens
ctctccagggagctgatgt

SEQ ID NO: 6131911 - DNA, 13 bp, Homo sapiens
ctctccaggtgct

SEQ ID NO: 6131912 - DNA, 14 bp, Homo sapiens
ctctccaggtgctc

SEQ ID NO: 6131913 - DNA, 21 bp, Homo sapiens
ctctccagtcttccacctgga

SEQ ID NO: 6131914 - DNA, 21 bp, Homo sapiens
ctctccagttatcagtactcc

SEQ ID NO: 6131915 - DNA, 22 bp, Homo sapiens
ctctccagtttgcacctgtccc

SEQ ID NO: 6131916 - DNA, 11 bp, Homo sapiens
ctctccatcta

SEQ ID NO: 6131917 - DNA, 16 bp, Homo sapiens
ctctccatctcccaag

SEQ ID NO: 6131918 - DNA, 14 bp, Homo sapiens
ctctccatgcaagt

SEQ ID NO: 6131919 - DNA, 15 bp, Homo sapiens
ctctccatgcaagtg

SEQ ID NO: 6131920 - DNA, 16 bp, Homo sapiens
ctctccattctgctcc

SEQ ID NO: 6131921 - DNA, 19 bp, Homo sapiens
ctctccattctgctccttc

SEQ ID NO: 6131922 - DNA, 21 bp, Homo sapiens
ctctccattctgctccttccc

SEQ ID NO: 6131923 - DNA, 18 bp, Homo sapiens
ctctccattcttttaaat

SEQ ID NO: 6131924 - DNA, 13 bp, Homo sapiens
ctctccatttaat

SEQ ID NO: 6131925 - DNA, 16 bp, Homo sapiens
ctctcccaacgctgaa

SEQ ID NO: 6131926 - DNA, 17 bp, Homo sapiens
ctctcccaacgctgaag

SEQ ID NO: 6131927 - DNA, 19 bp, Homo sapiens
ctctcccaacgctgaagcg

SEQ ID NO: 6131928 - DNA, 14 bp, Homo sapiens
ctctcccaattttc

SEQ ID NO: 6131929 - DNA, 20 bp, Homo sapiens
ctctcccacacaagcagtct

SEQ ID NO: 6131930 - DNA, 13 bp, Homo sapiens
ctctcccacagag

SEQ ID NO: 6131931 - DNA, 18 bp, Homo sapiens
ctctcccacagagtgctg

SEQ ID NO: 6131932 - DNA, 22 bp, Homo sapiens
ctctcccacagagtgctggact

SEQ ID NO: 6131933 - DNA, 11 bp, Homo sapiens
ctctcccaccc

SEQ ID NO: 6131934 - DNA, 15 bp, Homo sapiens
ctctcccacccaagg

SEQ ID NO: 6131935 - DNA, 13 bp, Homo sapiens
ctctcccaccccg

SEQ ID NO: 6131936 - DNA, 15 bp, Homo sapiens
ctctcccaccccggc

SEQ ID NO: 6131937 - DNA, 14 bp, Homo sapiens
ctctcccacccggc

SEQ ID NO: 6131938 - DNA, 19 bp, Homo sapiens
ctctcccacccggccacag

SEQ ID NO: 6131939 - DNA, 16 bp, Homo sapiens
ctctcccaccctaagg

SEQ ID NO: 6131940 - DNA, 18 bp, Homo sapiens
ctctcccaccctaagggc

SEQ ID NO: 6131941 - DNA, 19 bp, Homo sapiens
ctctcccaccctcttccta

SEQ ID NO: 6131942 - DNA, 20 bp, Homo sapiens
ctctcccacgggacctgggg

SEQ ID NO: 6131943 - DNA, 21 bp, Homo sapiens
ctctcccacgggacctggggc

SEQ ID NO: 6131944 - DNA, 17 bp, Homo sapiens
ctctcccacttcctcct

SEQ ID NO: 6131945 - DNA, 12 bp, Homo sapiens
ctctcccagagg

SEQ ID NO: 6131946 - DNA, 12 bp, Homo sapiens
ctctcccaggac

SEQ ID NO: 6131947 - DNA, 14 bp, Homo sapiens
ctctcccaggcccc

SEQ ID NO: 6131948 - DNA, 16 bp, Homo sapiens
ctctcccaggccccat

SEQ ID NO: 6131949 - DNA, 19 bp, Homo sapiens
ctctcccaggccccatgac

SEQ ID NO: 6131950 - DNA, 17 bp, Homo sapiens
ctctcccagtccatttc

SEQ ID NO: 6131951 - DNA, 20 bp, Homo sapiens
ctctcccagtctacccagag

SEQ ID NO: 6131952 - DNA, 21 bp, Homo sapiens
ctctcccagtctacccagaga

SEQ ID NO: 6131953 - DNA, 18 bp, Homo sapiens
ctctcccatcacttccct

SEQ ID NO: 6131954 - DNA, 13 bp, Homo sapiens
ctctcccatcccc

SEQ ID NO: 6131955 - DNA, 20 bp, Homo sapiens
ctctcccatccccctgccct

SEQ ID NO: 6131956 - DNA, 14 bp, Homo sapiens
ctctcccatcctgg

SEQ ID NO: 6131957 - DNA, 13 bp, Homo sapiens
ctctcccatggag

SEQ ID NO: 6131958 - DNA, 19 bp, Homo sapiens
ctctcccatggagccccag

SEQ ID NO: 6131959 - DNA, 14 bp, Homo sapiens
ctctcccatggctt

SEQ ID NO: 6131960 - DNA, 13 bp, Homo sapiens
ctctcccatggtg

SEQ ID NO: 6131961 - DNA, 16 bp, Homo sapiens
ctctcccattgtccct

SEQ ID NO: 6131962 - DNA, 18 bp, Homo sapiens
ctctcccattgtccctct

SEQ ID NO: 6131963 - DNA, 14 bp, Homo sapiens
ctctccccacacta

SEQ ID NO: 6131964 - DNA, 15 bp, Homo sapiens
ctctccccacactaa

SEQ ID NO: 6131965 - DNA, 23 bp, Homo sapiens
ctctccccacccagacctgcctg

SEQ ID NO: 6131966 - DNA, 23 bp, Homo sapiens
ctctccccaccttcttgggactg

SEQ ID NO: 6131967 - DNA, 21 bp, Homo sapiens
ctctccccacgagggctggct

SEQ ID NO: 6131968 - DNA, 22 bp, Homo sapiens
ctctccccagcaagtgagagct

SEQ ID NO: 6131969 - DNA, 24 bp, Homo sapiens
ctctccccagcaagtgagagctgg

SEQ ID NO: 6131970 - DNA, 18 bp, Homo sapiens
ctctccccagcctggcac

SEQ ID NO: 6131971 - DNA, 21 bp, Homo sapiens
ctctccccaggaagtggctca

SEQ ID NO: 6131972 - DNA, 23 bp, Homo sapiens
ctctccccaggtccagctctgga

SEQ ID NO: 6131973 - DNA, 12 bp, Homo sapiens
ctctccccagtg

SEQ ID NO: 6131974 - DNA, 15 bp, Homo sapiens
ctctccccagtgcct

SEQ ID NO: 6131975 - DNA, 16 bp, Homo sapiens
ctctccccagtgcctg

SEQ ID NO: 6131976 - DNA, 19 bp, Homo sapiens
ctctccccagtgcctgcca

SEQ ID NO: 6131977 - DNA, 20 bp, Homo sapiens
ctctccccagtgcctgccac

SEQ ID NO: 6131978 - DNA, 19 bp, Homo sapiens
ctctccccatatataaatt

SEQ ID NO: 6131979 - DNA, 22 bp, Homo sapiens
ctctcccccaaccccctgcaag

SEQ ID NO: 6131980 - DNA, 21 bp, Homo sapiens
ctctcccccacaagagcccca

SEQ ID NO: 6131981 - DNA, 18 bp, Homo sapiens
ctctcccccgcccaaggc

SEQ ID NO: 6131982 - DNA, 16 bp, Homo sapiens
ctctccccctcctcca

SEQ ID NO: 6131983 - DNA, 18 bp, Homo sapiens
ctctccccctcctccagg

SEQ ID NO: 6131984 - DNA, 13 bp, Homo sapiens
ctctccccctctg

SEQ ID NO: 6131985 - DNA, 15 bp, Homo sapiens
ctctccccctctgtc

SEQ ID NO: 6131986 - DNA, 19 bp, Homo sapiens
ctctccccctctgtcttct

SEQ ID NO: 6131987 - DNA, 13 bp, Homo sapiens
ctctccccctgca

SEQ ID NO: 6131988 - DNA, 15 bp, Homo sapiens
ctctccccctgcagc

SEQ ID NO: 6131989 - DNA, 20 bp, Homo sapiens
ctctccccctgcagccgtgc

SEQ ID NO: 6131990 - DNA, 14 bp, Homo sapiens
ctctcccccttcag

SEQ ID NO: 6131991 - DNA, 16 bp, Homo sapiens
ctctcccccttcagct

SEQ ID NO: 6131992 - DNA, 18 bp, Homo sapiens
ctctcccccttcagctcc

SEQ ID NO: 6131993 - DNA, 21 bp, Homo sapiens
ctctcccccttcagctcctga

SEQ ID NO: 6131994 - DNA, 16 bp, Homo sapiens
ctctcccccttggatt

SEQ ID NO: 6131995 - DNA, 23 bp, Homo sapiens
ctctcccccttggatttgaactt

SEQ ID NO: 6131996 - DNA, 16 bp, Homo sapiens
ctctccccgctcaggg

SEQ ID NO: 6131997 - DNA, 20 bp, Homo sapiens
ctctccccggacaagcccag

SEQ ID NO: 6131998 - DNA, 21 bp, Homo sapiens
ctctccccggcaggcctgaga

SEQ ID NO: 6131999 - DNA, 23 bp, Homo sapiens
ctctccccggcaggcctgagaat

SEQ ID NO: 6132000 - DNA, 22 bp, Homo sapiens
ctctccccggtaatgtcactgt

SEQ ID NO: 6132001 - DNA, 18 bp, Homo sapiens
ctctcccctcaaagtctg

SEQ ID NO: 6132002 - DNA, 21 bp, Homo sapiens
ctctcccctcaaagtctgcaa

SEQ ID NO: 6132003 - DNA, 18 bp, Homo sapiens
ctctcccctcacatcctc

SEQ ID NO: 6132004 - DNA, 18 bp, Homo sapiens
ctctcccctccagccttt

SEQ ID NO: 6132005 - DNA, 12 bp, Homo sapiens
ctctcccctccc

SEQ ID NO: 6132006 - DNA, 18 bp, Homo sapiens
ctctcccctcccagtctc

SEQ ID NO: 6132007 - DNA, 14 bp, Homo sapiens
ctctcccctcccca

SEQ ID NO: 6132008 - DNA, 15 bp, Homo sapiens
ctctcccctccctct

SEQ ID NO: 6132009 - DNA, 16 bp, Homo sapiens
ctctcccctccctctt

SEQ ID NO: 6132010 - DNA, 19 bp, Homo sapiens
ctctcccctccctcttcct

SEQ ID NO: 6132011 - DNA, 14 bp, Homo sapiens
ctctcccctccctt

SEQ ID NO: 6132012 - DNA, 14 bp, Homo sapiens
ctctcccctctctg

SEQ ID NO: 6132013 - DNA, 19 bp, Homo sapiens
ctctcccctctgccctgta

SEQ ID NO: 6132014 - DNA, 15 bp, Homo sapiens
ctctcccctgccctg

SEQ ID NO: 6132015 - DNA, 16 bp, Homo sapiens
ctctccccttctctgt

SEQ ID NO: 6132016 - DNA, 13 bp, Homo sapiens
ctctccccttggt

SEQ ID NO: 6132017 - DNA, 16 bp, Homo sapiens
ctctcccgcaccaggc

SEQ ID NO: 6132018 - DNA, 23 bp, Homo sapiens
ctctcccggaggttgggtgggcc

SEQ ID NO: 6132019 - DNA, 15 bp, Homo sapiens
ctctcccggctgcct

SEQ ID NO: 6132020 - DNA, 17 bp, Homo sapiens
ctctcccggctgcctgc

SEQ ID NO: 6132021 - DNA, 17 bp, Homo sapiens
ctctcccggttcttcca

SEQ ID NO: 6132022 - DNA, 17 bp, Homo sapiens
ctctcccgtcagggccc

SEQ ID NO: 6132023 - DNA, 21 bp, Homo sapiens
ctctcccgtcagggcccaagt

SEQ ID NO: 6132024 - DNA, 17 bp, Homo sapiens
ctctccctaccttgcct

SEQ ID NO: 6132025 - DNA, 11 bp, Homo sapiens
ctctccctcag

SEQ ID NO: 6132026 - DNA, 12 bp, Homo sapiens
ctctccctcagg

SEQ ID NO: 6132027 - DNA, 19 bp, Homo sapiens
ctctccctcaggggcaggt

SEQ ID NO: 6132028 - DNA, 16 bp, Homo sapiens
ctctccctccactcct

SEQ ID NO: 6132029 - DNA, 20 bp, Homo sapiens
ctctccctcccccagagccc

SEQ ID NO: 6132030 - DNA, 15 bp, Homo sapiens
ctctccctcctggcc

SEQ ID NO: 6132031 - DNA, 21 bp, Homo sapiens
ctctccctcctggtgaagtgt

SEQ ID NO: 6132032 - DNA, 22 bp, Homo sapiens
ctctccctctaggctctgcctt

SEQ ID NO: 6132033 - DNA, 23 bp, Homo sapiens
ctctccctctaggctctgccttc

SEQ ID NO: 6132034 - DNA, 16 bp, Homo sapiens
ctctccctctctctgg

SEQ ID NO: 6132035 - DNA, 14 bp, Homo sapiens
ctctccctctctgc

SEQ ID NO: 6132036 - DNA, 12 bp, Homo sapiens
ctctccctctgg

SEQ ID NO: 6132037 - DNA, 21 bp, Homo sapiens
ctctccctctggccctgcctt

SEQ ID NO: 6132038 - DNA, 16 bp, Homo sapiens
ctctccctcttctcaa

SEQ ID NO: 6132039 - DNA, 21 bp, Homo sapiens
ctctccctctttctagcctgg

SEQ ID NO: 6132040 - DNA, 20 bp, Homo sapiens
ctctccctgaccctgtatat

SEQ ID NO: 6132041 - DNA, 11 bp, Homo sapiens
ctctccctgcc

SEQ ID NO: 6132042 - DNA, 13 bp, Homo sapiens
ctctccctgccaa

SEQ ID NO: 6132043 - DNA, 13 bp, Homo sapiens
ctctccctgcctc

SEQ ID NO: 6132044 - DNA, 14 bp, Homo sapiens
ctctccctgccttt

SEQ ID NO: 6132045 - DNA, 14 bp, Homo sapiens
ctctccctgctgct

SEQ ID NO: 6132046 - DNA, 20 bp, Homo sapiens
ctctccctgctgctcctagg

SEQ ID NO: 6132047 - DNA, 12 bp, Homo sapiens
ctctccctggcc

SEQ ID NO: 6132048 - DNA, 10 bp, Homo sapiens
ctctccctgt

SEQ ID NO: 6132049 - DNA, 21 bp, Homo sapiens
ctctccctgtacacagtgccc

SEQ ID NO: 6132050 - DNA, 19 bp, Homo sapiens
ctctccctgtcacacactg

SEQ ID NO: 6132051 - DNA, 20 bp, Homo sapiens
ctctccctgtgttctgggct

SEQ ID NO: 6132052 - DNA, 21 bp, Homo sapiens
ctctccctgtgttctgggctg

SEQ ID NO: 6132053 - DNA, 23 bp, Homo sapiens
ctctccctgtgttctgggctggg

SEQ ID NO: 6132054 - DNA, 14 bp, Homo sapiens
ctctcccttaccca

SEQ ID NO: 6132055 - DNA, 14 bp, Homo sapiens
ctctcccttccctc

SEQ ID NO: 6132056 - DNA, 14 bp, Homo sapiens
ctctcccttgaggg

SEQ ID NO: 6132057 - DNA, 16 bp, Homo sapiens
ctctccgaaagaagac

SEQ ID NO: 6132058 - DNA, 21 bp, Homo sapiens
ctctccgaagtctgatccctg

SEQ ID NO: 6132059 - DNA, 21 bp, Homo sapiens
ctctccgacttcccctgggca

SEQ ID NO: 6132060 - DNA, 19 bp, Homo sapiens
ctctccgcacacctctggc

SEQ ID NO: 6132061 - DNA, 22 bp, Homo sapiens
ctctccgcacacctctggctgt

SEQ ID NO: 6132062 - DNA, 14 bp, Homo sapiens
ctctccgccccccg

SEQ ID NO: 6132063 - DNA, 21 bp, Homo sapiens
ctctccgccccggacagggtg

SEQ ID NO: 6132064 - DNA, 17 bp, Homo sapiens
ctctccgcccctgagcc

SEQ ID NO: 6132065 - DNA, 18 bp, Homo sapiens
ctctccgcccctgagccc

SEQ ID NO: 6132066 - DNA, 20 bp, Homo sapiens
ctctccgcccctgagcccac

SEQ ID NO: 6132067 - DNA, 16 bp, Homo sapiens
ctctccgcgccctccg

SEQ ID NO: 6132068 - DNA, 15 bp, Homo sapiens
ctctccgcgcctacc

SEQ ID NO: 6132069 - DNA, 22 bp, Homo sapiens
ctctccggatggaatcacagcc

SEQ ID NO: 6132070 - DNA, 15 bp, Homo sapiens
ctctccggcctggcc

SEQ ID NO: 6132071 - DNA, 16 bp, Homo sapiens
ctctccggcctggcct

SEQ ID NO: 6132072 - DNA, 17 bp, Homo sapiens
ctctccggcctggcctt

SEQ ID NO: 6132073 - DNA, 21 bp, Homo sapiens
ctctccgggcctttctctggc

SEQ ID NO: 6132074 - DNA, 21 bp, Homo sapiens
ctctccggggccatttgcaat

SEQ ID NO: 6132075 - DNA, 20 bp, Homo sapiens
ctctcctaccccacctcatg

SEQ ID NO: 6132076 - DNA, 22 bp, Homo sapiens
ctctcctaccccacctcatgcc

SEQ ID NO: 6132077 - DNA, 19 bp, Homo sapiens
ctctcctagcccctctctc

SEQ ID NO: 6132078 - DNA, 14 bp, Homo sapiens
ctctcctagccctc

SEQ ID NO: 6132079 - DNA, 19 bp, Homo sapiens
ctctcctagccctcctgag

SEQ ID NO: 6132080 - DNA, 23 bp, Homo sapiens
ctctcctatgtggcagctgggga

SEQ ID NO: 6132081 - DNA, 16 bp, Homo sapiens
ctctcctcacacacag

SEQ ID NO: 6132082 - DNA, 18 bp, Homo sapiens
ctctcctcagactgctca

SEQ ID NO: 6132083 - DNA, 17 bp, Homo sapiens
ctctcctcagtttacat

SEQ ID NO: 6132084 - DNA, 17 bp, Homo sapiens
ctctcctccagccctgg

SEQ ID NO: 6132085 - DNA, 17 bp, Homo sapiens
ctctcctcccagctgct

SEQ ID NO: 6132086 - DNA, 11 bp, Homo sapiens
ctctcctcccc

SEQ ID NO: 6132087 - DNA, 15 bp, Homo sapiens
ctctcctccccaaat

SEQ ID NO: 6132088 - DNA, 14 bp, Homo sapiens
ctctcctcctccat

SEQ ID NO: 6132089 - DNA, 14 bp, Homo sapiens
ctctcctcctctgt

SEQ ID NO: 6132090 - DNA, 16 bp, Homo sapiens
ctctcctcctctgtgc

SEQ ID NO: 6132091 - DNA, 15 bp, Homo sapiens
ctctcctcctgccca

SEQ ID NO: 6132092 - DNA, 19 bp, Homo sapiens
ctctcctcctgcccacctg

SEQ ID NO: 6132093 - DNA, 20 bp, Homo sapiens
ctctcctcctgcccacctgt

SEQ ID NO: 6132094 - DNA, 20 bp, Homo sapiens
ctctcctccttttcacagtt

SEQ ID NO: 6132095 - DNA, 17 bp, Homo sapiens
ctctcctcgagccctcc

SEQ ID NO: 6132096 - DNA, 21 bp, Homo sapiens
ctctcctcgggccctgtggtg

SEQ ID NO: 6132097 - DNA, 12 bp, Homo sapiens
ctctcctcgtcc

SEQ ID NO: 6132098 - DNA, 18 bp, Homo sapiens
ctctcctctctctccctc

SEQ ID NO: 6132099 - DNA, 13 bp, Homo sapiens
ctctcctctctgc

SEQ ID NO: 6132100 - DNA, 14 bp, Homo sapiens
ctctcctctctgct

SEQ ID NO: 6132101 - DNA, 14 bp, Homo sapiens
ctctcctctctgga

SEQ ID NO: 6132102 - DNA, 15 bp, Homo sapiens
ctctcctctgctgct

SEQ ID NO: 6132103 - DNA, 18 bp, Homo sapiens
ctctcctctgctgctggc

SEQ ID NO: 6132104 - DNA, 11 bp, Homo sapiens
ctctcctctgg

SEQ ID NO: 6132105 - DNA, 17 bp, Homo sapiens
ctctcctctgtccccat

SEQ ID NO: 6132106 - DNA, 14 bp, Homo sapiens
ctctcctgacagcc

SEQ ID NO: 6132107 - DNA, 12 bp, Homo sapiens
ctctcctgaccc

SEQ ID NO: 6132108 - DNA, 13 bp, Homo sapiens
ctctcctgacccc

SEQ ID NO: 6132109 - DNA, 21 bp, Homo sapiens
ctctcctgagaggtgctgcag

SEQ ID NO: 6132110 - DNA, 16 bp, Homo sapiens
ctctcctgagcctgtc

SEQ ID NO: 6132111 - DNA, 18 bp, Homo sapiens
ctctcctgagcctgtctc

SEQ ID NO: 6132112 - DNA, 12 bp, Homo sapiens
ctctcctgagga

SEQ ID NO: 6132113 - DNA, 18 bp, Homo sapiens
ctctcctgaggagcagcc

SEQ ID NO: 6132114 - DNA, 20 bp, Homo sapiens
ctctcctgaggagcagccca

SEQ ID NO: 6132115 - DNA, 12 bp, Homo sapiens
ctctcctgccac

SEQ ID NO: 6132116 - DNA, 13 bp, Homo sapiens
ctctcctgccaca

SEQ ID NO: 6132117 - DNA, 18 bp, Homo sapiens
ctctcctgcccagatgcc

SEQ ID NO: 6132118 - DNA, 19 bp, Homo sapiens
ctctcctgcccagctctga

SEQ ID NO: 6132119 - DNA, 14 bp, Homo sapiens
ctctcctgccctgt

SEQ ID NO: 6132120 - DNA, 15 bp, Homo sapiens
ctctcctgccctgtg

SEQ ID NO: 6132121 - DNA, 17 bp, Homo sapiens
ctctcctgccctgtgat

SEQ ID NO: 6132122 - DNA, 14 bp, Homo sapiens
ctctcctgcctcag

SEQ ID NO: 6132123 - DNA, 13 bp, Homo sapiens
ctctcctgctgca

SEQ ID NO: 6132124 - DNA, 14 bp, Homo sapiens
ctctcctgcttcct

SEQ ID NO: 6132125 - DNA, 16 bp, Homo sapiens
ctctcctgcttcctct

SEQ ID NO: 6132126 - DNA, 19 bp, Homo sapiens
ctctcctggagcaagctct

SEQ ID NO: 6132127 - DNA, 21 bp, Homo sapiens
ctctcctggagggcgcccagc

SEQ ID NO: 6132128 - DNA, 13 bp, Homo sapiens
ctctcctggcctt

SEQ ID NO: 6132129 - DNA, 11 bp, Homo sapiens
ctctcctggct

SEQ ID NO: 6132130 - DNA, 17 bp, Homo sapiens
ctctcctggctcggggt

SEQ ID NO: 6132131 - DNA, 15 bp, Homo sapiens
ctctcctggctgggc

SEQ ID NO: 6132132 - DNA, 16 bp, Homo sapiens
ctctcctggctgggcc

SEQ ID NO: 6132133 - DNA, 22 bp, Homo sapiens
ctctcctggctgggccatcctt

SEQ ID NO: 6132134 - DNA, 12 bp, Homo sapiens
ctctcctggctt

SEQ ID NO: 6132135 - DNA, 13 bp, Homo sapiens
ctctcctggcttc

SEQ ID NO: 6132136 - DNA, 21 bp, Homo sapiens
ctctcctgggcagctgcctcc

SEQ ID NO: 6132137 - DNA, 13 bp, Homo sapiens
ctctcctgggccc

SEQ ID NO: 6132138 - DNA, 22 bp, Homo sapiens
ctctcctgggcccctccctacc

SEQ ID NO: 6132139 - DNA, 23 bp, Homo sapiens
ctctcctgggcccctccctacct

SEQ ID NO: 6132140 - DNA, 23 bp, Homo sapiens
ctctcctgggggtggcaggcaca

SEQ ID NO: 6132141 - DNA, 11 bp, Homo sapiens
ctctcctggtg

SEQ ID NO: 6132142 - DNA, 12 bp, Homo sapiens
ctctcctggtgt

SEQ ID NO: 6132143 - DNA, 13 bp, Homo sapiens
ctctcctggtgtg

SEQ ID NO: 6132144 - DNA, 14 bp, Homo sapiens
ctctcctggtgtgg

SEQ ID NO: 6132145 - DNA, 13 bp, Homo sapiens
ctctcctgtacct

SEQ ID NO: 6132146 - DNA, 14 bp, Homo sapiens
ctctcctgtacctc

SEQ ID NO: 6132147 - DNA, 18 bp, Homo sapiens
ctctcctgtacctcttga

SEQ ID NO: 6132148 - DNA, 20 bp, Homo sapiens
ctctcctgtataatctctct

SEQ ID NO: 6132149 - DNA, 21 bp, Homo sapiens
ctctcctgtccaacctaaccc

SEQ ID NO: 6132150 - DNA, 16 bp, Homo sapiens
ctctcctgtcctccct

SEQ ID NO: 6132151 - DNA, 18 bp, Homo sapiens
ctctcctgtctgaacctg

SEQ ID NO: 6132152 - DNA, 13 bp, Homo sapiens
ctctcctgtgtgc

SEQ ID NO: 6132153 - DNA, 15 bp, Homo sapiens
ctctcctgtgtgctt

SEQ ID NO: 6132154 - DNA, 19 bp, Homo sapiens
ctctcctgtgtgcttgtca

SEQ ID NO: 6132155 - DNA, 18 bp, Homo sapiens
ctctccttaattttatat

SEQ ID NO: 6132156 - DNA, 15 bp, Homo sapiens
ctctccttcaaagaa

SEQ ID NO: 6132157 - DNA, 19 bp, Homo sapiens
ctctccttcccacaaaaga

SEQ ID NO: 6132158 - DNA, 21 bp, Homo sapiens
ctctccttcctcttggctgag

SEQ ID NO: 6132159 - DNA, 16 bp, Homo sapiens
ctctccttcctggagc

SEQ ID NO: 6132160 - DNA, 14 bp, Homo sapiens
ctctccttcctgtg

SEQ ID NO: 6132161 - DNA, 12 bp, Homo sapiens
ctctccttcctt

SEQ ID NO: 6132162 - DNA, 17 bp, Homo sapiens
ctctccttccttaccca

SEQ ID NO: 6132163 - DNA, 14 bp, Homo sapiens
ctctccttccttgt

SEQ ID NO: 6132164 - DNA, 17 bp, Homo sapiens
ctctccttcgtgtctct

SEQ ID NO: 6132165 - DNA, 22 bp, Homo sapiens
ctctccttcgtgtctctcccac

SEQ ID NO: 6132166 - DNA, 16 bp, Homo sapiens
ctctccttcttccctg

SEQ ID NO: 6132167 - DNA, 18 bp, Homo sapiens
ctctccttgccccagtcc

SEQ ID NO: 6132168 - DNA, 14 bp, Homo sapiens
ctctccttgccctg

SEQ ID NO: 6132169 - DNA, 18 bp, Homo sapiens
ctctccttgccctgggcc

SEQ ID NO: 6132170 - DNA, 14 bp, Homo sapiens
ctctccttgcctgg

SEQ ID NO: 6132171 - DNA, 16 bp, Homo sapiens
ctctccttgcctggtg

SEQ ID NO: 6132172 - DNA, 17 bp, Homo sapiens
ctctccttgcctggtga

SEQ ID NO: 6132173 - DNA, 15 bp, Homo sapiens
ctctccttggaaggt

SEQ ID NO: 6132174 - DNA, 18 bp, Homo sapiens
ctctccttggccacagac

SEQ ID NO: 6132175 - DNA, 20 bp, Homo sapiens
ctctccttggccacagactg

SEQ ID NO: 6132176 - DNA, 13 bp, Homo sapiens
ctctccttgggct

SEQ ID NO: 6132177 - DNA, 19 bp, Homo sapiens
ctctccttgggctcctggc

SEQ ID NO: 6132178 - DNA, 21 bp, Homo sapiens
ctctccttgggctcctggctg

SEQ ID NO: 6132179 - DNA, 23 bp, Homo sapiens
ctctccttgggctcctggctgcc

SEQ ID NO: 6132180 - DNA, 16 bp, Homo sapiens
ctctcctttctccctg

SEQ ID NO: 6132181 - DNA, 18 bp, Homo sapiens
ctctcctttctccctgca

SEQ ID NO: 6132182 - DNA, 22 bp, Homo sapiens
ctctcctttctccctgcagcct

SEQ ID NO: 6132183 - DNA, 21 bp, Homo sapiens
ctctcctttctttttcttctt

SEQ ID NO: 6132184 - DNA, 15 bp, Homo sapiens
ctctcctttgtatat

SEQ ID NO: 6132185 - DNA, 20 bp, Homo sapiens
ctctcctttgtatattattt

SEQ ID NO: 6132186 - DNA, 22 bp, Homo sapiens
ctctcctttgtatattatttct

SEQ ID NO: 6132187 - DNA, 20 bp, Homo sapiens
ctctcctttgtgtggctgcc

SEQ ID NO: 6132188 - DNA, 10 bp, Homo sapiens
ctctcctttt

SEQ ID NO: 6132189 - DNA, 23 bp, Homo sapiens
ctctccttttgaggcttctcctt

SEQ ID NO: 6132190 - DNA, 13 bp, Homo sapiens
ctctcctttttct

SEQ ID NO: 6132191 - DNA, 19 bp, Homo sapiens
ctctcgactgtcagtgggg

SEQ ID NO: 6132192 - DNA, 12 bp, Homo sapiens
ctctcgagccca

SEQ ID NO: 6132193 - DNA, 23 bp, Homo sapiens
ctctcgatgccactcctgcttct

SEQ ID NO: 6132194 - DNA, 17 bp, Homo sapiens
ctctcgcacaatgcatg

SEQ ID NO: 6132195 - DNA, 13 bp, Homo sapiens
ctctcgcacacct

SEQ ID NO: 6132196 - DNA, 19 bp, Homo sapiens
ctctcgcacctttccaaag

SEQ ID NO: 6132197 - DNA, 16 bp, Homo sapiens
ctctcgccccatccct

SEQ ID NO: 6132198 - DNA, 18 bp, Homo sapiens
ctctcgcctcaggctttt

SEQ ID NO: 6132199 - DNA, 21 bp, Homo sapiens
ctctcgcctcaggctttttcc

SEQ ID NO: 6132200 - DNA, 13 bp, Homo sapiens
ctctcgcctcatt

SEQ ID NO: 6132201 - DNA, 23 bp, Homo sapiens
ctctcgcggcctcttctctcaga

SEQ ID NO: 6132202 - DNA, 13 bp, Homo sapiens
ctctcgctcccct

SEQ ID NO: 6132203 - DNA, 19 bp, Homo sapiens
ctctcgctcgctcgctctc

SEQ ID NO: 6132204 - DNA, 15 bp, Homo sapiens
ctctcgctctctctc

SEQ ID NO: 6132205 - DNA, 18 bp, Homo sapiens
ctctcgctgccctgtgga

SEQ ID NO: 6132206 - DNA, 16 bp, Homo sapiens
ctctcggaactgcatg

SEQ ID NO: 6132207 - DNA, 16 bp, Homo sapiens
ctctcggaaggctggc

SEQ ID NO: 6132208 - DNA, 22 bp, Homo sapiens
ctctcggaaggctggctgggca

SEQ ID NO: 6132209 - DNA, 14 bp, Homo sapiens
ctctcggccaggca

SEQ ID NO: 6132210 - DNA, 15 bp, Homo sapiens
ctctcggccccatcg

SEQ ID NO: 6132211 - DNA, 16 bp, Homo sapiens
ctctcggcccctgtct

SEQ ID NO: 6132212 - DNA, 20 bp, Homo sapiens
ctctcggcccctgtctgttc

SEQ ID NO: 6132213 - DNA, 14 bp, Homo sapiens
ctctcggctcccca

SEQ ID NO: 6132214 - DNA, 15 bp, Homo sapiens
ctctcggctccccat

SEQ ID NO: 6132215 - DNA, 18 bp, Homo sapiens
ctctcggctccccatgtg

SEQ ID NO: 6132216 - DNA, 18 bp, Homo sapiens
ctctcggctgccaggggc

SEQ ID NO: 6132217 - DNA, 22 bp, Homo sapiens
ctctcggctgccaggggctctg

SEQ ID NO: 6132218 - DNA, 19 bp, Homo sapiens
ctctcggctggaagaacat

SEQ ID NO: 6132219 - DNA, 16 bp, Homo sapiens
ctctcgggactagctg

SEQ ID NO: 6132220 - DNA, 22 bp, Homo sapiens
ctctcgggactagctgccttcg

SEQ ID NO: 6132221 - DNA, 16 bp, Homo sapiens
ctctcgggctctctca

SEQ ID NO: 6132222 - DNA, 17 bp, Homo sapiens
ctctcgggctctctcac

SEQ ID NO: 6132223 - DNA, 15 bp, Homo sapiens
ctctcggggcccttg

SEQ ID NO: 6132224 - DNA, 19 bp, Homo sapiens
ctctcggggcgacccctca

SEQ ID NO: 6132225 - DNA, 22 bp, Homo sapiens
ctctcggggcgacccctcagtg

SEQ ID NO: 6132226 - DNA, 19 bp, Homo sapiens
ctctcgggttcaagcaatt

SEQ ID NO: 6132227 - DNA, 15 bp, Homo sapiens
ctctcggtgacctcc

SEQ ID NO: 6132228 - DNA, 19 bp, Homo sapiens
ctctcggtgctccatctcc

SEQ ID NO: 6132229 - DNA, 16 bp, Homo sapiens
ctctcgtaactggttt

SEQ ID NO: 6132230 - DNA, 21 bp, Homo sapiens
ctctcgtagaacctgcgcacc

SEQ ID NO: 6132231 - DNA, 16 bp, Homo sapiens
ctctcgtctctcgttt

SEQ ID NO: 6132232 - DNA, 16 bp, Homo sapiens
ctctcgtttctgccca

SEQ ID NO: 6132233 - DNA, 22 bp, Homo sapiens
ctctcgttttgggtactttcta

SEQ ID NO: 6132234 - DNA, 17 bp, Homo sapiens
ctctctaaaaataaaat

SEQ ID NO: 6132235 - DNA, 22 bp, Homo sapiens
ctctctaaaaataaaatgatgt

SEQ ID NO: 6132236 - DNA, 24 bp, Homo sapiens
ctctctaaaaataaaatgatgtat

SEQ ID NO: 6132237 - DNA, 20 bp, Homo sapiens
ctctctaaacccaaataaat

SEQ ID NO: 6132238 - DNA, 21 bp, Homo sapiens
ctctctaaactggtacaattt

SEQ ID NO: 6132239 - DNA, 12 bp, Homo sapiens
ctctctaacata

SEQ ID NO: 6132240 - DNA, 15 bp, Homo sapiens
ctctctaacctcctt

SEQ ID NO: 6132241 - DNA, 16 bp, Homo sapiens
ctctctaacctccttt

SEQ ID NO: 6132242 - DNA, 15 bp, Homo sapiens
ctctctaagaaaaga

SEQ ID NO: 6132243 - DNA, 18 bp, Homo sapiens
ctctctaagaattcagta

SEQ ID NO: 6132244 - DNA, 21 bp, Homo sapiens
ctctctaagacaaatgcagtg

SEQ ID NO: 6132245 - DNA, 14 bp, Homo sapiens
ctctctaagccaca

SEQ ID NO: 6132246 - DNA, 17 bp, Homo sapiens
ctctctaagccacagct

SEQ ID NO: 6132247 - DNA, 23 bp, Homo sapiens
ctctctaagccacagcttcttca

SEQ ID NO: 6132248 - DNA, 22 bp, Homo sapiens
ctctctaagtgggcattgccat

SEQ ID NO: 6132249 - DNA, 16 bp, Homo sapiens
ctctctacagtctcgt

SEQ ID NO: 6132250 - DNA, 15 bp, Homo sapiens
ctctctaccccccac

SEQ ID NO: 6132251 - DNA, 20 bp, Homo sapiens
ctctctacccggcccagaga

SEQ ID NO: 6132252 - DNA, 15 bp, Homo sapiens
ctctctacctccacc

SEQ ID NO: 6132253 - DNA, 22 bp, Homo sapiens
ctctctaccttttaaaattgaa

SEQ ID NO: 6132254 - DNA, 23 bp, Homo sapiens
ctctctaccttttaaaattgaat

SEQ ID NO: 6132255 - DNA, 22 bp, Homo sapiens
ctctctactaaaactacaaaaa

SEQ ID NO: 6132256 - DNA, 20 bp, Homo sapiens
ctctctactcctacctcagc

SEQ ID NO: 6132257 - DNA, 15 bp, Homo sapiens
ctctctacttcccct

SEQ ID NO: 6132258 - DNA, 20 bp, Homo sapiens
ctctctacttccccttcttg

SEQ ID NO: 6132259 - DNA, 13 bp, Homo sapiens
ctctctagcacaa

SEQ ID NO: 6132260 - DNA, 22 bp, Homo sapiens
ctctctagcacaatttgcacta

SEQ ID NO: 6132261 - DNA, 17 bp, Homo sapiens
ctctctagctccccaat

SEQ ID NO: 6132262 - DNA, 23 bp, Homo sapiens
ctctctagggtacatggtgctgg

SEQ ID NO: 6132263 - DNA, 19 bp, Homo sapiens
ctctctataagtgttcagt

SEQ ID NO: 6132264 - DNA, 13 bp, Homo sapiens
ctctctatctttt

SEQ ID NO: 6132265 - DNA, 13 bp, Homo sapiens
ctacaggggccag

SEQ ID NO: 6132266 - DNA, 17 bp, Homo sapiens
ctacagggggtctggct

SEQ ID NO: 6132267 - DNA, 20 bp, Homo sapiens
ctacagggggtctggctggt

SEQ ID NO: 6132268 - DNA, 21 bp, Homo sapiens
ctacaggggttagcctggact

SEQ ID NO: 6132269 - DNA, 17 bp, Homo sapiens
ctacagggtccaacata

SEQ ID NO: 6132270 - DNA, 19 bp, Homo sapiens
ctacaggtattttcatcaa

SEQ ID NO: 6132271 - DNA, 18 bp, Homo sapiens
ctacaggtgagtgccacc

SEQ ID NO: 6132272 - DNA, 16 bp, Homo sapiens
ctacaggtgtgagtca

SEQ ID NO: 6132273 - DNA, 18 bp, Homo sapiens
ctacaggttacaacagat

SEQ ID NO: 6132274 - DNA, 22 bp, Homo sapiens
ctacagtaatgaaatgtttact

SEQ ID NO: 6132275 - DNA, 12 bp, Homo sapiens
ctacagtacaat

SEQ ID NO: 6132276 - DNA, 16 bp, Homo sapiens
ctacagtactatgtaa

SEQ ID NO: 6132277 - DNA, 14 bp, Homo sapiens
ctacagtactgaca

SEQ ID NO: 6132278 - DNA, 15 bp, Homo sapiens
ctacagtactgacag

SEQ ID NO: 6132279 - DNA, 17 bp, Homo sapiens
ctacagtacttccagat

SEQ ID NO: 6132280 - DNA, 14 bp, Homo sapiens
ctacagtagctgct

SEQ ID NO: 6132281 - DNA, 14 bp, Homo sapiens
ctacagtatataag

SEQ ID NO: 6132282 - DNA, 18 bp, Homo sapiens
ctacagtcaagatagaaa

SEQ ID NO: 6132283 - DNA, 19 bp, Homo sapiens
ctacagtcctcccatctca

SEQ ID NO: 6132284 - DNA, 21 bp, Homo sapiens
ctacagtcgtaaaagagataa

SEQ ID NO: 6132285 - DNA, 16 bp, Homo sapiens
ctacagtctcgtctct

SEQ ID NO: 6132286 - DNA, 15 bp, Homo sapiens
ctacagtgactccct

SEQ ID NO: 6132287 - DNA, 17 bp, Homo sapiens
ctacagtgactccctgg

SEQ ID NO: 6132288 - DNA, 18 bp, Homo sapiens
ctacagtgactccctggg

SEQ ID NO: 6132289 - DNA, 14 bp, Homo sapiens
ctacagtgtacagt

SEQ ID NO: 6132290 - DNA, 23 bp, Homo sapiens
ctacagttcacagaggtctttca

SEQ ID NO: 6132291 - DNA, 20 bp, Homo sapiens
ctacagttggaaatccatcc

SEQ ID NO: 6132292 - DNA, 20 bp, Homo sapiens
ctacagttgggaagtctcag

SEQ ID NO: 6132293 - DNA, 21 bp, Homo sapiens
ctacagttgggaagtctcagc

SEQ ID NO: 6132294 - DNA, 21 bp, Homo sapiens
ctacagttgtgttagcctctt

SEQ ID NO: 6132295 - DNA, 22 bp, Homo sapiens
ctacagttgtgttagcctcttg

SEQ ID NO: 6132296 - DNA, 18 bp, Homo sapiens
ctacagttttaactgtgg

SEQ ID NO: 6132297 - DNA, 20 bp, Homo sapiens
ctacagtttttatttagcat

SEQ ID NO: 6132298 - DNA, 22 bp, Homo sapiens
ctacagtttttatttagcatgg

SEQ ID NO: 6132299 - DNA, 22 bp, Homo sapiens
ctacataagtaattcaagaaaa

SEQ ID NO: 6132300 - DNA, 23 bp, Homo sapiens
ctacataagtaattcaagaaaac

SEQ ID NO: 6132301 - DNA, 13 bp, Homo sapiens
ctacataatctct

SEQ ID NO: 6132302 - DNA, 23 bp, Homo sapiens
ctacatactttcatcctgactct

SEQ ID NO: 6132303 - DNA, 21 bp, Homo sapiens
ctacataggcaaagttttcca

SEQ ID NO: 6132304 - DNA, 16 bp, Homo sapiens
ctacatatcccttcca

SEQ ID NO: 6132305 - DNA, 17 bp, Homo sapiens
ctacatatcccttccag

SEQ ID NO: 6132306 - DNA, 14 bp, Homo sapiens
ctacatattgaata

SEQ ID NO: 6132307 - DNA, 14 bp, Homo sapiens
ctacatattgtctg

SEQ ID NO: 6132308 - DNA, 19 bp, Homo sapiens
ctacatatttgtatgtttt

SEQ ID NO: 6132309 - DNA, 23 bp, Homo sapiens
ctacatatttgtatgtttttctg

SEQ ID NO: 6132310 - DNA, 14 bp, Homo sapiens
ctacatcagactct

SEQ ID NO: 6132311 - DNA, 15 bp, Homo sapiens
ctacatcagagtgta

SEQ ID NO: 6132312 - DNA, 14 bp, Homo sapiens
ctacatcagtttga

SEQ ID NO: 6132313 - DNA, 14 bp, Homo sapiens
ctacatccagctcc

SEQ ID NO: 6132314 - DNA, 15 bp, Homo sapiens
ctacatccagctcct

SEQ ID NO: 6132315 - DNA, 17 bp, Homo sapiens
ctacatccagctcctct

SEQ ID NO: 6132316 - DNA, 14 bp, Homo sapiens
ctacatcccagcct

SEQ ID NO: 6132317 - DNA, 15 bp, Homo sapiens
ctacatcccagcctg

SEQ ID NO: 6132318 - DNA, 17 bp, Homo sapiens
ctacatcccagcctgtg

SEQ ID NO: 6132319 - DNA, 19 bp, Homo sapiens
ctacatcccagcctgtggt

SEQ ID NO: 6132320 - DNA, 17 bp, Homo sapiens
ctacatcccgggcctca

SEQ ID NO: 6132321 - DNA, 21 bp, Homo sapiens
ctacatcctaaggttcttgct

SEQ ID NO: 6132322 - DNA, 18 bp, Homo sapiens
ctacatctccaaatatca

SEQ ID NO: 6132323 - DNA, 17 bp, Homo sapiens
ctacatcttatttcctc

SEQ ID NO: 6132324 - DNA, 14 bp, Homo sapiens
ctacatcttctgcc

SEQ ID NO: 6132325 - DNA, 17 bp, Homo sapiens
ctacatcttcttcccag

SEQ ID NO: 6132326 - DNA, 18 bp, Homo sapiens
ctacatcttttttcacaa

SEQ ID NO: 6132327 - DNA, 16 bp, Homo sapiens
ctacatctttttttct

SEQ ID NO: 6132328 - DNA, 15 bp, Homo sapiens
ctacatgaggtactg

SEQ ID NO: 6132329 - DNA, 18 bp, Homo sapiens
ctacatgcaaatctggct

SEQ ID NO: 6132330 - DNA, 20 bp, Homo sapiens
ctacatgcaaatctggctta

SEQ ID NO: 6132331 - DNA, 22 bp, Homo sapiens
ctacatgcaaggcactgtacta

SEQ ID NO: 6132332 - DNA, 15 bp, Homo sapiens
ctacatgcagcccat

SEQ ID NO: 6132333 - DNA, 21 bp, Homo sapiens
ctacatgcagcccatgcccac

SEQ ID NO: 6132334 - DNA, 16 bp, Homo sapiens
ctacatgcataacaaa

SEQ ID NO: 6132335 - DNA, 16 bp, Homo sapiens
ctacatgcatgtttta

SEQ ID NO: 6132336 - DNA, 13 bp, Homo sapiens
ctacatgccatgc

SEQ ID NO: 6132337 - DNA, 16 bp, Homo sapiens
ctacatgccatgccta

SEQ ID NO: 6132338 - DNA, 20 bp, Homo sapiens
ctacatgccccctcccttca

SEQ ID NO: 6132339 - DNA, 21 bp, Homo sapiens
ctacatgctctttttctgtga

SEQ ID NO: 6132340 - DNA, 16 bp, Homo sapiens
ctacatgctgaaaaat

SEQ ID NO: 6132341 - DNA, 15 bp, Homo sapiens
ctacatgctggggtc

SEQ ID NO: 6132342 - DNA, 20 bp, Homo sapiens
ctacatggagtatatgtcaa

SEQ ID NO: 6132343 - DNA, 15 bp, Homo sapiens
ctacatggctttgat

SEQ ID NO: 6132344 - DNA, 15 bp, Homo sapiens
ctacatgggccagcc

SEQ ID NO: 6132345 - DNA, 20 bp, Homo sapiens
ctacatgggccagcccttgc

SEQ ID NO: 6132346 - DNA, 22 bp, Homo sapiens
ctacatggggtctgggtggggg

SEQ ID NO: 6132347 - DNA, 18 bp, Homo sapiens
ctacatgtaatgacactt

SEQ ID NO: 6132348 - DNA, 13 bp, Homo sapiens
ctacatgtattgc

SEQ ID NO: 6132349 - DNA, 20 bp, Homo sapiens
ctacatgtctagagaacact

SEQ ID NO: 6132350 - DNA, 19 bp, Homo sapiens
ctacatgtgagatagtttt

SEQ ID NO: 6132351 - DNA, 21 bp, Homo sapiens
ctacatgtgagatagttttca

SEQ ID NO: 6132352 - DNA, 23 bp, Homo sapiens
ctacatgtgagatagttttcatt

SEQ ID NO: 6132353 - DNA, 17 bp, Homo sapiens
ctacatgtgggagcttt

SEQ ID NO: 6132354 - DNA, 12 bp, Homo sapiens
ctacatgtgttt

SEQ ID NO: 6132355 - DNA, 15 bp, Homo sapiens
ctacatgttctttgt

SEQ ID NO: 6132356 - DNA, 16 bp, Homo sapiens
ctacattaaaagcttt

SEQ ID NO: 6132357 - DNA, 12 bp, Homo sapiens
ctacattaaaat

SEQ ID NO: 6132358 - DNA, 22 bp, Homo sapiens
ctacattataaatgtctcttta

SEQ ID NO: 6132359 - DNA, 14 bp, Homo sapiens
ctacattatggaat

SEQ ID NO: 6132360 - DNA, 12 bp, Homo sapiens
ctacattcattt

SEQ ID NO: 6132361 - DNA, 18 bp, Homo sapiens
ctacattccccagagtgg

SEQ ID NO: 6132362 - DNA, 20 bp, Homo sapiens
ctacattccctctcctgccc

SEQ ID NO: 6132363 - DNA, 23 bp, Homo sapiens
ctacattccctctcctgcccaga

SEQ ID NO: 6132364 - DNA, 15 bp, Homo sapiens
ctacattccctggcc

SEQ ID NO: 6132365 - DNA, 16 bp, Homo sapiens
ctacattccctggcct

SEQ ID NO: 6132366 - DNA, 17 bp, Homo sapiens
ctacattccctggcctg

SEQ ID NO: 6132367 - DNA, 22 bp, Homo sapiens
ctacattccctggcctggctct

SEQ ID NO: 6132368 - DNA, 10 bp, Homo sapiens
ctacattcct

SEQ ID NO: 6132369 - DNA, 18 bp, Homo sapiens
ctacattcctcagctgcc

SEQ ID NO: 6132370 - DNA, 22 bp, Homo sapiens
ctacattcctcagctgccaagc

SEQ ID NO: 6132371 - DNA, 16 bp, Homo sapiens
ctacattctgctctgc

SEQ ID NO: 6132372 - DNA, 18 bp, Homo sapiens
ctacattctgctctgccc

SEQ ID NO: 6132373 - DNA, 14 bp, Homo sapiens
ctacattctgttaa

SEQ ID NO: 6132374 - DNA, 21 bp, Homo sapiens
ctacattcttggttgttaatt

SEQ ID NO: 6132375 - DNA, 19 bp, Homo sapiens
ctacattggaagcctgagc

SEQ ID NO: 6132376 - DNA, 20 bp, Homo sapiens
ctacattggaagcctgagca

SEQ ID NO: 6132377 - DNA, 21 bp, Homo sapiens
ctacattggaagctttgagtt

SEQ ID NO: 6132378 - DNA, 15 bp, Homo sapiens
ctacattgtaatctg

SEQ ID NO: 6132379 - DNA, 17 bp, Homo sapiens
ctacatttagcccctct

SEQ ID NO: 6132380 - DNA, 23 bp, Homo sapiens
ctacatttcacctactttgtaag

SEQ ID NO: 6132381 - DNA, 12 bp, Homo sapiens
ctacatttgcat

SEQ ID NO: 6132382 - DNA, 13 bp, Homo sapiens
ctacatttgcatg

SEQ ID NO: 6132383 - DNA, 14 bp, Homo sapiens
ctacatttgcatgc

SEQ ID NO: 6132384 - DNA, 17 bp, Homo sapiens
ctacatttgtttgtatt

SEQ ID NO: 6132385 - DNA, 18 bp, Homo sapiens
ctacatttgtttgtattc

SEQ ID NO: 6132386 - DNA, 22 bp, Homo sapiens
ctacatttgtttgtattcatgt

SEQ ID NO: 6132387 - DNA, 12 bp, Homo sapiens
ctacattttctt

SEQ ID NO: 6132388 - DNA, 17 bp, Homo sapiens
ctacattttcttttgtt

SEQ ID NO: 6132389 - DNA, 16 bp, Homo sapiens
ctacattttctttttt

SEQ ID NO: 6132390 - DNA, 21 bp, Homo sapiens
ctacattttctttttttatta

SEQ ID NO: 6132391 - DNA, 15 bp, Homo sapiens
ctacattttgctctg

SEQ ID NO: 6132392 - DNA, 23 bp, Homo sapiens
ctaccaaaaattgccaagtgcct

SEQ ID NO: 6132393 - DNA, 14 bp, Homo sapiens
ctaccaaaatgaag

SEQ ID NO: 6132394 - DNA, 16 bp, Homo sapiens
ctaccaaacactcagt

SEQ ID NO: 6132395 - DNA, 16 bp, Homo sapiens
ctaccaaagaatgcat

SEQ ID NO: 6132396 - DNA, 15 bp, Homo sapiens
ctaccaaagcacctt

SEQ ID NO: 6132397 - DNA, 13 bp, Homo sapiens
ctaccaaatataa

SEQ ID NO: 6132398 - DNA, 16 bp, Homo sapiens
ctaccaaatataaact

SEQ ID NO: 6132399 - DNA, 19 bp, Homo sapiens
ctaccaactaagttgtatt

SEQ ID NO: 6132400 - DNA, 15 bp, Homo sapiens
ctaccaactggaagc

SEQ ID NO: 6132401 - DNA, 13 bp, Homo sapiens
ctaccaactttca

SEQ ID NO: 6132402 - DNA, 14 bp, Homo sapiens
ctaccaactttcaa

SEQ ID NO: 6132403 - DNA, 22 bp, Homo sapiens
ctaccaagacataatgcactgg

SEQ ID NO: 6132404 - DNA, 13 bp, Homo sapiens
ctaccaagctgtc

SEQ ID NO: 6132405 - DNA, 18 bp, Homo sapiens
ctaccaagctgtcacagg

SEQ ID NO: 6132406 - DNA, 15 bp, Homo sapiens
ctaccaatatttaat

SEQ ID NO: 6132407 - DNA, 18 bp, Homo sapiens
ctaccaatctgggaagat

SEQ ID NO: 6132408 - DNA, 15 bp, Homo sapiens
ctaccaatgcatgca

SEQ ID NO: 6132409 - DNA, 16 bp, Homo sapiens
ctaccacaaggaaaat

SEQ ID NO: 6132410 - DNA, 13 bp, Homo sapiens
ctaccacacacag

SEQ ID NO: 6132411 - DNA, 15 bp, Homo sapiens
ctaccacacatctgt

SEQ ID NO: 6132412 - DNA, 20 bp, Homo sapiens
ctaccacacatctgtggaga

SEQ ID NO: 6132413 - DNA, 12 bp, Homo sapiens
ctaccacagact

SEQ ID NO: 6132414 - DNA, 20 bp, Homo sapiens
ctaccacagctgcctccggg

SEQ ID NO: 6132415 - DNA, 22 bp, Homo sapiens
ctaccacagctgcctccgggcc

SEQ ID NO: 6132416 - DNA, 13 bp, Homo sapiens
ctaccacagtgtc

SEQ ID NO: 6132417 - DNA, 14 bp, Homo sapiens
ctaccacagtgtct

SEQ ID NO: 6132418 - DNA, 15 bp, Homo sapiens
ctaccacagtgtctg

SEQ ID NO: 6132419 - DNA, 21 bp, Homo sapiens
ctaccaccacaccaaatgact

SEQ ID NO: 6132420 - DNA, 14 bp, Homo sapiens
ctaccaccacggcc

SEQ ID NO: 6132421 - DNA, 16 bp, Homo sapiens
ctaccaccagctgtgt

SEQ ID NO: 6132422 - DNA, 18 bp, Homo sapiens
ctaccaccagctgtgtcc

SEQ ID NO: 6132423 - DNA, 16 bp, Homo sapiens
ctaccaccccttcctg

SEQ ID NO: 6132424 - DNA, 16 bp, Homo sapiens
ctaccaccgcatcctc

SEQ ID NO: 6132425 - DNA, 19 bp, Homo sapiens
ctaccaccttttccttata

SEQ ID NO: 6132426 - DNA, 19 bp, Homo sapiens
ctaccacgggtctgccatg

SEQ ID NO: 6132427 - DNA, 16 bp, Homo sapiens
ctaccactcacatgac

SEQ ID NO: 6132428 - DNA, 14 bp, Homo sapiens
ctaccactcctgcc

SEQ ID NO: 6132429 - DNA, 15 bp, Homo sapiens
ctaccactgagccct

SEQ ID NO: 6132430 - DNA, 19 bp, Homo sapiens
ctaccactgagcccttgca

SEQ ID NO: 6132431 - DNA, 19 bp, Homo sapiens
ctaccacttatttctaaat

SEQ ID NO: 6132432 - DNA, 19 bp, Homo sapiens
ctaccagaagaagggtgga

SEQ ID NO: 6132433 - DNA, 16 bp, Homo sapiens
ctaccagatgtgcttt

SEQ ID NO: 6132434 - DNA, 18 bp, Homo sapiens
ctaccagcaaacagctga

SEQ ID NO: 6132435 - DNA, 11 bp, Homo sapiens
ctaccagccag

SEQ ID NO: 6132436 - DNA, 16 bp, Homo sapiens
ctaccagccagcctca

SEQ ID NO: 6132437 - DNA, 17 bp, Homo sapiens
ctaccagccagcctcag

SEQ ID NO: 6132438 - DNA, 20 bp, Homo sapiens
ctaccagccagcctcagaag

SEQ ID NO: 6132439 - DNA, 21 bp, Homo sapiens
ctaccagcgccaaatgttcat

SEQ ID NO: 6132440 - DNA, 19 bp, Homo sapiens
ctaccagcgcccgctgggc

SEQ ID NO: 6132441 - DNA, 22 bp, Homo sapiens
ctaccagcgcccgctgggctga

SEQ ID NO: 6132442 - DNA, 15 bp, Homo sapiens
ctaccagctcctcca

SEQ ID NO: 6132443 - DNA, 12 bp, Homo sapiens
ctaccaggaaag

SEQ ID NO: 6132444 - DNA, 22 bp, Homo sapiens
ctaccaggtcaaaatagtgcca

SEQ ID NO: 6132445 - DNA, 14 bp, Homo sapiens
ctctctatcttttt

SEQ ID NO: 6132446 - DNA, 13 bp, Homo sapiens
ctctctcacacat

SEQ ID NO: 6132447 - DNA, 14 bp, Homo sapiens
ctctctcaccagcc

SEQ ID NO: 6132448 - DNA, 17 bp, Homo sapiens
ctctctcacccaccagc

SEQ ID NO: 6132449 - DNA, 19 bp, Homo sapiens
ctctctcacctacttcctc

SEQ ID NO: 6132450 - DNA, 21 bp, Homo sapiens
ctctctcacctacttcctcct

SEQ ID NO: 6132451 - DNA, 13 bp, Homo sapiens
ctctctcacctgc

SEQ ID NO: 6132452 - DNA, 12 bp, Homo sapiens
ctctctcactcc

SEQ ID NO: 6132453 - DNA, 16 bp, Homo sapiens
ctctctcactccttga

SEQ ID NO: 6132454 - DNA, 21 bp, Homo sapiens
ctctctcagagcatctggctg

SEQ ID NO: 6132455 - DNA, 18 bp, Homo sapiens
ctctctcagcacagcctg

SEQ ID NO: 6132456 - DNA, 15 bp, Homo sapiens
ctctctcagcccagg

SEQ ID NO: 6132457 - DNA, 19 bp, Homo sapiens
ctctctcagccccatcgcc

SEQ ID NO: 6132458 - DNA, 13 bp, Homo sapiens
ctctctcaggcca

SEQ ID NO: 6132459 - DNA, 19 bp, Homo sapiens
ctctctcagttatgtagtt

SEQ ID NO: 6132460 - DNA, 12 bp, Homo sapiens
ctctctcatgtg

SEQ ID NO: 6132461 - DNA, 13 bp, Homo sapiens
ctctctcatgtgg

SEQ ID NO: 6132462 - DNA, 22 bp, Homo sapiens
ctctctccacacggagctcctg

SEQ ID NO: 6132463 - DNA, 12 bp, Homo sapiens
ctctctccacta

SEQ ID NO: 6132464 - DNA, 16 bp, Homo sapiens
ctctctccaggcccca

SEQ ID NO: 6132465 - DNA, 15 bp, Homo sapiens
ctctctccagggtgc

SEQ ID NO: 6132466 - DNA, 18 bp, Homo sapiens
ctctctccaggtcagcct

SEQ ID NO: 6132467 - DNA, 21 bp, Homo sapiens
ctctctccaggtcagcctgga

SEQ ID NO: 6132468 - DNA, 18 bp, Homo sapiens
ctctctccagtcttccac

SEQ ID NO: 6132469 - DNA, 20 bp, Homo sapiens
ctctctccagtcttccacct

SEQ ID NO: 6132470 - DNA, 12 bp, Homo sapiens
ctctctccattt

SEQ ID NO: 6132471 - DNA, 20 bp, Homo sapiens
ctctctcccaccctaagggc

SEQ ID NO: 6132472 - DNA, 14 bp, Homo sapiens
ctctctcccaggac

SEQ ID NO: 6132473 - DNA, 13 bp, Homo sapiens
ctctctcccagtc

SEQ ID NO: 6132474 - DNA, 19 bp, Homo sapiens
ctctctcccagtctaccca

SEQ ID NO: 6132475 - DNA, 10 bp, Homo sapiens
ctctctcccc

SEQ ID NO: 6132476 - DNA, 19 bp, Homo sapiens
ctctctcccctcaaagtct

SEQ ID NO: 6132477 - DNA, 11 bp, Homo sapiens
ctctctcccta

SEQ ID NO: 6132478 - DNA, 14 bp, Homo sapiens
ctctctccctacct

SEQ ID NO: 6132479 - DNA, 12 bp, Homo sapiens
ctctctccctcc

SEQ ID NO: 6132480 - DNA, 14 bp, Homo sapiens
ctctctccctctgt

SEQ ID NO: 6132481 - DNA, 14 bp, Homo sapiens
ctctctccctgcct

SEQ ID NO: 6132482 - DNA, 16 bp, Homo sapiens
ctctctccctgcctca

SEQ ID NO: 6132483 - DNA, 15 bp, Homo sapiens
ctctctccctgcctt

SEQ ID NO: 6132484 - DNA, 12 bp, Homo sapiens
ctctctccctgg

SEQ ID NO: 6132485 - DNA, 13 bp, Homo sapiens
ctctctccctggt

SEQ ID NO: 6132486 - DNA, 15 bp, Homo sapiens
ctctctccctggtct

SEQ ID NO: 6132487 - DNA, 22 bp, Homo sapiens
ctctctccctgtcacacactgg

SEQ ID NO: 6132488 - DNA, 16 bp, Homo sapiens
ctctctccgccccgga

SEQ ID NO: 6132489 - DNA, 13 bp, Homo sapiens
ctctctcctcagg

SEQ ID NO: 6132490 - DNA, 20 bp, Homo sapiens
ctctctcctcctgcccacct

SEQ ID NO: 6132491 - DNA, 12 bp, Homo sapiens
ctctctcctctc

SEQ ID NO: 6132492 - DNA, 13 bp, Homo sapiens
ctctctcctctct

SEQ ID NO: 6132493 - DNA, 18 bp, Homo sapiens
ctctctcctctctctccc

SEQ ID NO: 6132494 - DNA, 16 bp, Homo sapiens
ctctctcctctctgct

SEQ ID NO: 6132495 - DNA, 12 bp, Homo sapiens
ctctctcctgta

SEQ ID NO: 6132496 - DNA, 16 bp, Homo sapiens
ctctctccttggccac

SEQ ID NO: 6132497 - DNA, 23 bp, Homo sapiens
ctctctcgctcgctcgctctcgc

SEQ ID NO: 6132498 - DNA, 16 bp, Homo sapiens
ctctctcggcccctgt

SEQ ID NO: 6132499 - DNA, 19 bp, Homo sapiens
ctctctcggcccctgtctg

SEQ ID NO: 6132500 - DNA, 19 bp, Homo sapiens
ctctctcgggagccctagc

SEQ ID NO: 6132501 - DNA, 22 bp, Homo sapiens
ctctctctacccggcccagaga

SEQ ID NO: 6132502 - DNA, 14 bp, Homo sapiens
ctctctctaccttt

SEQ ID NO: 6132503 - DNA, 17 bp, Homo sapiens
ctctctctaccttttaa

SEQ ID NO: 6132504 - DNA, 20 bp, Homo sapiens
ctctctctatatatacatgt

SEQ ID NO: 6132505 - DNA, 15 bp, Homo sapiens
ctctctctcacacac

SEQ ID NO: 6132506 - DNA, 13 bp, Homo sapiens
ctctctctcactc

SEQ ID NO: 6132507 - DNA, 12 bp, Homo sapiens
ctctctctccca

SEQ ID NO: 6132508 - DNA, 15 bp, Homo sapiens
ctctctctccctcca

SEQ ID NO: 6132509 - DNA, 13 bp, Homo sapiens
ctctctctcctgg

SEQ ID NO: 6132510 - DNA, 10 bp, Homo sapiens
ctctctctct

SEQ ID NO: 6132511 - DNA, 11 bp, Homo sapiens
ctctctctctc

SEQ ID NO: 6132512 - DNA, 13 bp, Homo sapiens
ctctctctctcac

SEQ ID NO: 6132513 - DNA, 15 bp, Homo sapiens
ctctctctctcccct

SEQ ID NO: 6132514 - DNA, 12 bp, Homo sapiens
ctctctctctct

SEQ ID NO: 6132515 - DNA, 13 bp, Homo sapiens
ctctctctctctc

SEQ ID NO: 6132516 - DNA, 15 bp, Homo sapiens
ctctctctctctcgc

SEQ ID NO: 6132517 - DNA, 14 bp, Homo sapiens
ctctctctctctgt

SEQ ID NO: 6132518 - DNA, 15 bp, Homo sapiens
ctctctctctctgtt

SEQ ID NO: 6132519 - DNA, 12 bp, Homo sapiens
ctctctctctgt

SEQ ID NO: 6132520 - DNA, 15 bp, Homo sapiens
ctctctctctttctc

SEQ ID NO: 6132521 - DNA, 13 bp, Homo sapiens
ctctctctctttt

SEQ ID NO: 6132522 - DNA, 15 bp, Homo sapiens
ctctctctcttttcc

SEQ ID NO: 6132523 - DNA, 9 bp, Homo sapiens
ctctctctg

SEQ ID NO: 6132524 - DNA, 10 bp, Homo sapiens
ctctctctga

SEQ ID NO: 6132525 - DNA, 15 bp, Homo sapiens
ctctctctgaggaca

SEQ ID NO: 6132526 - DNA, 12 bp, Homo sapiens
ctctctctgcct

SEQ ID NO: 6132527 - DNA, 13 bp, Homo sapiens
ctctctctgcctg

SEQ ID NO: 6132528 - DNA, 16 bp, Homo sapiens
ctctctctgctcctca

SEQ ID NO: 6132529 - DNA, 15 bp, Homo sapiens
ctctctctgtccctg

SEQ ID NO: 6132530 - DNA, 15 bp, Homo sapiens
ctctctcttcccagc

SEQ ID NO: 6132531 - DNA, 12 bp, Homo sapiens
ctctctcttcct

SEQ ID NO: 6132532 - DNA, 14 bp, Homo sapiens
ctctctcttctctg

SEQ ID NO: 6132533 - DNA, 12 bp, Homo sapiens
ctctctcttctg

SEQ ID NO: 6132534 - DNA, 13 bp, Homo sapiens
ctctctctttgtg

SEQ ID NO: 6132535 - DNA, 15 bp, Homo sapiens
ctctctcttttccct

SEQ ID NO: 6132536 - DNA, 13 bp, Homo sapiens
ctctctcttttct

SEQ ID NO: 6132537 - DNA, 15 bp, Homo sapiens
ctctctcttttctac

SEQ ID NO: 6132538 - DNA, 18 bp, Homo sapiens
ctctctctttttcttttc

SEQ ID NO: 6132539 - DNA, 21 bp, Homo sapiens
ctctctgaactgcaacactgg

SEQ ID NO: 6132540 - DNA, 20 bp, Homo sapiens
ctctctgaagcgactctcct

SEQ ID NO: 6132541 - DNA, 17 bp, Homo sapiens
ctctctgaaggaggcca

SEQ ID NO: 6132542 - DNA, 14 bp, Homo sapiens
ctctctgactctca

SEQ ID NO: 6132543 - DNA, 23 bp, Homo sapiens
ctctctgagactctttagagcag

SEQ ID NO: 6132544 - DNA, 15 bp, Homo sapiens
ctctctgagagcaca

SEQ ID NO: 6132545 - DNA, 20 bp, Homo sapiens
ctctctgaggacagagcttg

SEQ ID NO: 6132546 - DNA, 18 bp, Homo sapiens
ctctctgaggcaaggccc

SEQ ID NO: 6132547 - DNA, 11 bp, Homo sapiens
ctctctgaggg

SEQ ID NO: 6132548 - DNA, 14 bp, Homo sapiens
ctctctgagggaga

SEQ ID NO: 6132549 - DNA, 17 bp, Homo sapiens
ctctctgagtatttcct

SEQ ID NO: 6132550 - DNA, 18 bp, Homo sapiens
ctctctgagtcaaatcca

SEQ ID NO: 6132551 - DNA, 21 bp, Homo sapiens
ctctctgagtcaaatccagtg

SEQ ID NO: 6132552 - DNA, 22 bp, Homo sapiens
ctctctgagtcaaatccagtgg

SEQ ID NO: 6132553 - DNA, 20 bp, Homo sapiens
ctctctgagtcctggcccaa

SEQ ID NO: 6132554 - DNA, 17 bp, Homo sapiens
ctctctgagtctggact

SEQ ID NO: 6132555 - DNA, 22 bp, Homo sapiens
ctctctgatcttgtgctcagca

SEQ ID NO: 6132556 - DNA, 23 bp, Homo sapiens
ctctctgatcttgtgctcagcat

SEQ ID NO: 6132557 - DNA, 19 bp, Homo sapiens
ctctctgatgtcccagtgc

SEQ ID NO: 6132558 - DNA, 18 bp, Homo sapiens
ctctctgcagccagccca

SEQ ID NO: 6132559 - DNA, 16 bp, Homo sapiens
ctctctgcagcccagc

SEQ ID NO: 6132560 - DNA, 17 bp, Homo sapiens
ctctctgcagcccagcc

SEQ ID NO: 6132561 - DNA, 22 bp, Homo sapiens
ctctctgcagcccagcctagtc

SEQ ID NO: 6132562 - DNA, 12 bp, Homo sapiens
ctctctgcaggt

SEQ ID NO: 6132563 - DNA, 14 bp, Homo sapiens
ctctctgcaggtcc

SEQ ID NO: 6132564 - DNA, 22 bp, Homo sapiens
ctctctgcaggtccctaataaa

SEQ ID NO: 6132565 - DNA, 13 bp, Homo sapiens
ctctctgcagtcc

SEQ ID NO: 6132566 - DNA, 12 bp, Homo sapiens
ctctctgccact

SEQ ID NO: 6132567 - DNA, 13 bp, Homo sapiens
ctctctgccagcc

SEQ ID NO: 6132568 - DNA, 14 bp, Homo sapiens
ctctctgccagctc

SEQ ID NO: 6132569 - DNA, 20 bp, Homo sapiens
ctctctgccattctgtgcag

SEQ ID NO: 6132570 - DNA, 23 bp, Homo sapiens
ctctctgcccaagttgctctgta

SEQ ID NO: 6132571 - DNA, 11 bp, Homo sapiens
ctctctgcccc

SEQ ID NO: 6132572 - DNA, 13 bp, Homo sapiens
ctctctgccccac

SEQ ID NO: 6132573 - DNA, 12 bp, Homo sapiens
ctctctgccccc

SEQ ID NO: 6132574 - DNA, 15 bp, Homo sapiens
ctctctgcccctgat

SEQ ID NO: 6132575 - DNA, 21 bp, Homo sapiens
ctctctgcccctgatcactcc

SEQ ID NO: 6132576 - DNA, 13 bp, Homo sapiens
ctctctgccctaa

SEQ ID NO: 6132577 - DNA, 23 bp, Homo sapiens
ctctctgccctcgggtggggctg

SEQ ID NO: 6132578 - DNA, 13 bp, Homo sapiens
ctctctgccctgt

SEQ ID NO: 6132579 - DNA, 11 bp, Homo sapiens
ctctctgcctc

SEQ ID NO: 6132580 - DNA, 14 bp, Homo sapiens
ctctctgcctgctg

SEQ ID NO: 6132581 - DNA, 17 bp, Homo sapiens
ctctctgcctgctgggc

SEQ ID NO: 6132582 - DNA, 12 bp, Homo sapiens
ctctctgcctgt

SEQ ID NO: 6132583 - DNA, 18 bp, Homo sapiens
ctctctgcctgtgagcca

SEQ ID NO: 6132584 - DNA, 14 bp, Homo sapiens
ctctctgcctgttc

SEQ ID NO: 6132585 - DNA, 19 bp, Homo sapiens
ctctctgcggcagagtcct

SEQ ID NO: 6132586 - DNA, 9 bp, Homo sapiens
ctctctgct

SEQ ID NO: 6132587 - DNA, 14 bp, Homo sapiens
ctctctgctcagtg

SEQ ID NO: 6132588 - DNA, 12 bp, Homo sapiens
ctctctgctcat

SEQ ID NO: 6132589 - DNA, 14 bp, Homo sapiens
ctctctgctcatgg

SEQ ID NO: 6132590 - DNA, 12 bp, Homo sapiens
ctctctgctcca

SEQ ID NO: 6132591 - DNA, 17 bp, Homo sapiens
ctctctgctccagactc

SEQ ID NO: 6132592 - DNA, 13 bp, Homo sapiens
ctctctgctcctc

SEQ ID NO: 6132593 - DNA, 14 bp, Homo sapiens
ctctctgctcctca

SEQ ID NO: 6132594 - DNA, 17 bp, Homo sapiens
ctctctgctctagccag

SEQ ID NO: 6132595 - DNA, 15 bp, Homo sapiens
ctctctgctgagctg

SEQ ID NO: 6132596 - DNA, 11 bp, Homo sapiens
ctctctgctgg

SEQ ID NO: 6132597 - DNA, 14 bp, Homo sapiens
ctctctgctggcag

SEQ ID NO: 6132598 - DNA, 20 bp, Homo sapiens
ctctctggaaagaggctctg

SEQ ID NO: 6132599 - DNA, 22 bp, Homo sapiens
ctctctggaaagaggctctgga

SEQ ID NO: 6132600 - DNA, 12 bp, Homo sapiens
ctctctggaaga

SEQ ID NO: 6132601 - DNA, 19 bp, Homo sapiens
ctctctggactttctccaa

SEQ ID NO: 6132602 - DNA, 12 bp, Homo sapiens
ctctctggagcc

SEQ ID NO: 6132603 - DNA, 16 bp, Homo sapiens
ctctctggagcccctc

SEQ ID NO: 6132604 - DNA, 20 bp, Homo sapiens
ctctctggagcccctcctcc

SEQ ID NO: 6132605 - DNA, 17 bp, Homo sapiens
ctctctggccactctgc

SEQ ID NO: 6132606 - DNA, 18 bp, Homo sapiens
ctctctggcctcccaccc

SEQ ID NO: 6132607 - DNA, 13 bp, Homo sapiens
ctctctggccttc

SEQ ID NO: 6132608 - DNA, 16 bp, Homo sapiens
ctctctggccttcggc

SEQ ID NO: 6132609 - DNA, 22 bp, Homo sapiens
ctctctggccttcggcctccat

SEQ ID NO: 6132610 - DNA, 13 bp, Homo sapiens
ctctctggctcta

SEQ ID NO: 6132611 - DNA, 12 bp, Homo sapiens
ctctctggctgg

SEQ ID NO: 6132612 - DNA, 15 bp, Homo sapiens
ctctctggctgggga

SEQ ID NO: 6132613 - DNA, 12 bp, Homo sapiens
ctctctggcttc

SEQ ID NO: 6132614 - DNA, 20 bp, Homo sapiens
ctctctggcttctctctttt

SEQ ID NO: 6132615 - DNA, 14 bp, Homo sapiens
ctctctggcttctg

SEQ ID NO: 6132616 - DNA, 22 bp, Homo sapiens
ctctctggcttctgaagagcct

SEQ ID NO: 6132617 - DNA, 20 bp, Homo sapiens
ctctctgggacctaggggga

SEQ ID NO: 6132618 - DNA, 12 bp, Homo sapiens
ctctctgggact

SEQ ID NO: 6132619 - DNA, 20 bp, Homo sapiens
ctctctgggactctcctcct

SEQ ID NO: 6132620 - DNA, 22 bp, Homo sapiens
ctctctgggcctgggttccagg

SEQ ID NO: 6132621 - DNA, 21 bp, Homo sapiens
ctctctgggctgactgggcca

SEQ ID NO: 6132622 - DNA, 17 bp, Homo sapiens
ctctctggggctgtgtt

SEQ ID NO: 6132623 - DNA, 21 bp, Homo sapiens
ctctctgggggaggcagggct

SEQ ID NO: 6132624 - DNA, 23 bp, Homo sapiens
ctctctgggggaggcagggctgg

SEQ ID NO: 6132625 - DNA, 15 bp, Homo sapiens
ctctctggtggctct

SEQ ID NO: 6132626 - DNA, 15 bp, Homo sapiens
ctctctggtggctgg

SEQ ID NO: 6132627 - DNA, 21 bp, Homo sapiens
ctctctggtggctgggctgct

SEQ ID NO: 6132628 - DNA, 16 bp, Homo sapiens
ctctctgtaataaact

SEQ ID NO: 6132629 - DNA, 21 bp, Homo sapiens
ctctctgtaataaactcattt

SEQ ID NO: 6132630 - DNA, 18 bp, Homo sapiens
ctctctgtataaacatta

SEQ ID NO: 6132631 - DNA, 19 bp, Homo sapiens
ctaccagtatttagaagcc

SEQ ID NO: 6132632 - DNA, 20 bp, Homo sapiens
ctaccagtcgccctctgtgc

SEQ ID NO: 6132633 - DNA, 22 bp, Homo sapiens
ctaccagtcgccctctgtgcct

SEQ ID NO: 6132634 - DNA, 16 bp, Homo sapiens
ctaccagtctatttcc

SEQ ID NO: 6132635 - DNA, 18 bp, Homo sapiens
ctaccagtgcaggctggc

SEQ ID NO: 6132636 - DNA, 21 bp, Homo sapiens
ctaccagtgcaggctggccag

SEQ ID NO: 6132637 - DNA, 22 bp, Homo sapiens
ctaccagtgcaggctggccagc

SEQ ID NO: 6132638 - DNA, 23 bp, Homo sapiens
ctaccagtgcaggctggccagcc

SEQ ID NO: 6132639 - DNA, 16 bp, Homo sapiens
ctaccataagtgacac

SEQ ID NO: 6132640 - DNA, 18 bp, Homo sapiens
ctaccatcagggacagga

SEQ ID NO: 6132641 - DNA, 16 bp, Homo sapiens
ctaccatcatccggtt

SEQ ID NO: 6132642 - DNA, 13 bp, Homo sapiens
ctaccatctgcat

SEQ ID NO: 6132643 - DNA, 15 bp, Homo sapiens
ctaccatctgcatgg

SEQ ID NO: 6132644 - DNA, 21 bp, Homo sapiens
ctaccatgaagtgaaaatgcc

SEQ ID NO: 6132645 - DNA, 13 bp, Homo sapiens
ctaccatgctgct

SEQ ID NO: 6132646 - DNA, 14 bp, Homo sapiens
ctaccatgctgctt

SEQ ID NO: 6132647 - DNA, 12 bp, Homo sapiens
ctaccatttcac

SEQ ID NO: 6132648 - DNA, 13 bp, Homo sapiens
ctaccatttcaga

SEQ ID NO: 6132649 - DNA, 19 bp, Homo sapiens
ctacccaaaacaagcctgg

SEQ ID NO: 6132650 - DNA, 16 bp, Homo sapiens
ctacccaaatctaaat

SEQ ID NO: 6132651 - DNA, 13 bp, Homo sapiens
ctacccaaccact

SEQ ID NO: 6132652 - DNA, 16 bp, Homo sapiens
ctacccaaccactcaa

SEQ ID NO: 6132653 - DNA, 14 bp, Homo sapiens
ctacccacagggcc

SEQ ID NO: 6132654 - DNA, 16 bp, Homo sapiens
ctacccacagggcctg

SEQ ID NO: 6132655 - DNA, 17 bp, Homo sapiens
ctacccaccctcctttc

SEQ ID NO: 6132656 - DNA, 12 bp, Homo sapiens
ctacccactctt

SEQ ID NO: 6132657 - DNA, 14 bp, Homo sapiens
ctacccactgccag

SEQ ID NO: 6132658 - DNA, 14 bp, Homo sapiens
ctacccacttctaa

SEQ ID NO: 6132659 - DNA, 18 bp, Homo sapiens
ctacccagagaagcccct

SEQ ID NO: 6132660 - DNA, 13 bp, Homo sapiens
ctacccagcccat

SEQ ID NO: 6132661 - DNA, 18 bp, Homo sapiens
ctacccagcgagccctgg

SEQ ID NO: 6132662 - DNA, 20 bp, Homo sapiens
ctacccagcgtggcccaggc

SEQ ID NO: 6132663 - DNA, 14 bp, Homo sapiens
ctacccagctctgt

SEQ ID NO: 6132664 - DNA, 20 bp, Homo sapiens
ctacccagctctgtcctctt

SEQ ID NO: 6132665 - DNA, 17 bp, Homo sapiens
ctacccagctgatgggg

SEQ ID NO: 6132666 - DNA, 20 bp, Homo sapiens
ctacccaggaggctgaggtg

SEQ ID NO: 6132667 - DNA, 12 bp, Homo sapiens
ctacccaggtgc

SEQ ID NO: 6132668 - DNA, 19 bp, Homo sapiens
ctacccagttgcctccagg

SEQ ID NO: 6132669 - DNA, 15 bp, Homo sapiens
ctacccatatccctc

SEQ ID NO: 6132670 - DNA, 15 bp, Homo sapiens
ctacccatccccgca

SEQ ID NO: 6132671 - DNA, 18 bp, Homo sapiens
ctacccatgagcctgccc

SEQ ID NO: 6132672 - DNA, 20 bp, Homo sapiens
ctacccattgttcccttcct

SEQ ID NO: 6132673 - DNA, 18 bp, Homo sapiens
ctacccatttacaaataa

SEQ ID NO: 6132674 - DNA, 12 bp, Homo sapiens
ctaccccacacc

SEQ ID NO: 6132675 - DNA, 15 bp, Homo sapiens
ctaccccacaccagc

SEQ ID NO: 6132676 - DNA, 13 bp, Homo sapiens
ctaccccacctga

SEQ ID NO: 6132677 - DNA, 12 bp, Homo sapiens
ctaccccagcca

SEQ ID NO: 6132678 - DNA, 14 bp, Homo sapiens
ctaccccagccagg

SEQ ID NO: 6132679 - DNA, 16 bp, Homo sapiens
ctaccccagggccctg

SEQ ID NO: 6132680 - DNA, 18 bp, Homo sapiens
ctaccccagggccctggc

SEQ ID NO: 6132681 - DNA, 20 bp, Homo sapiens
ctaccccagggccctggcca

SEQ ID NO: 6132682 - DNA, 19 bp, Homo sapiens
ctaccccagttcatctctg

SEQ ID NO: 6132683 - DNA, 18 bp, Homo sapiens
ctaccccagttcctagca

SEQ ID NO: 6132684 - DNA, 22 bp, Homo sapiens
ctaccccagttcctagcactgc

SEQ ID NO: 6132685 - DNA, 23 bp, Homo sapiens
ctaccccatatacacctggaaca

SEQ ID NO: 6132686 - DNA, 22 bp, Homo sapiens
ctacccccagaggccttggcca

SEQ ID NO: 6132687 - DNA, 18 bp, Homo sapiens
ctacccccagctgtgctt

SEQ ID NO: 6132688 - DNA, 14 bp, Homo sapiens
ctaccccctcatcc

SEQ ID NO: 6132689 - DNA, 15 bp, Homo sapiens
ctaccccctcatccc

SEQ ID NO: 6132690 - DNA, 13 bp, Homo sapiens
ctaccccctgtgc

SEQ ID NO: 6132691 - DNA, 17 bp, Homo sapiens
ctaccccgactatccct

SEQ ID NO: 6132692 - DNA, 21 bp, Homo sapiens
ctaccccgactatccctgcac

SEQ ID NO: 6132693 - DNA, 18 bp, Homo sapiens
ctacccctcaaactgcac

SEQ ID NO: 6132694 - DNA, 21 bp, Homo sapiens
ctacccctcccggccctgcct

SEQ ID NO: 6132695 - DNA, 13 bp, Homo sapiens
ctacccctcttcc

SEQ ID NO: 6132696 - DNA, 13 bp, Homo sapiens
ctacccctgccct

SEQ ID NO: 6132697 - DNA, 23 bp, Homo sapiens
ctacccctgctcccattcctccc

SEQ ID NO: 6132698 - DNA, 14 bp, Homo sapiens
ctacccctggatga

SEQ ID NO: 6132699 - DNA, 15 bp, Homo sapiens
ctacccctgtcctgg

SEQ ID NO: 6132700 - DNA, 16 bp, Homo sapiens
ctaccccttcctgtcc

SEQ ID NO: 6132701 - DNA, 21 bp, Homo sapiens
ctaccccttcctgtcctgcct

SEQ ID NO: 6132702 - DNA, 13 bp, Homo sapiens
ctaccccttggaa

SEQ ID NO: 6132703 - DNA, 20 bp, Homo sapiens
ctacccctttctccagccct

SEQ ID NO: 6132704 - DNA, 16 bp, Homo sapiens
ctacccctttcttctc

SEQ ID NO: 6132705 - DNA, 23 bp, Homo sapiens
ctacccgcccgcgtccaaccccg

SEQ ID NO: 6132706 - DNA, 16 bp, Homo sapiens
ctacccgctgtggccg

SEQ ID NO: 6132707 - DNA, 14 bp, Homo sapiens
ctacccggcccaga

SEQ ID NO: 6132708 - DNA, 23 bp, Homo sapiens
ctacccggctcgttcccccaggg

SEQ ID NO: 6132709 - DNA, 16 bp, Homo sapiens
ctacccgggcctgacc

SEQ ID NO: 6132710 - DNA, 17 bp, Homo sapiens
ctacccgtgcctgggcc

SEQ ID NO: 6132711 - DNA, 19 bp, Homo sapiens
ctaccctacacctctgggc

SEQ ID NO: 6132712 - DNA, 18 bp, Homo sapiens
ctaccctagccattcctg

SEQ ID NO: 6132713 - DNA, 14 bp, Homo sapiens
ctaccctagttcaa

SEQ ID NO: 6132714 - DNA, 13 bp, Homo sapiens
ctaccctcacaat

SEQ ID NO: 6132715 - DNA, 12 bp, Homo sapiens
ctaccctcaccc

SEQ ID NO: 6132716 - DNA, 14 bp, Homo sapiens
ctaccctcagcctc

SEQ ID NO: 6132717 - DNA, 14 bp, Homo sapiens
ctaccctccagagt

SEQ ID NO: 6132718 - DNA, 15 bp, Homo sapiens
ctaccctccagagtg

SEQ ID NO: 6132719 - DNA, 14 bp, Homo sapiens
ctaccctcccaccc

SEQ ID NO: 6132720 - DNA, 19 bp, Homo sapiens
ctaccctcccacccccttc

SEQ ID NO: 6132721 - DNA, 13 bp, Homo sapiens
ctaccctccctgc

SEQ ID NO: 6132722 - DNA, 20 bp, Homo sapiens
ctaccctccctgctgtcccc

SEQ ID NO: 6132723 - DNA, 23 bp, Homo sapiens
ctaccctccctgctgtcccctct

SEQ ID NO: 6132724 - DNA, 17 bp, Homo sapiens
ctaccctcctgcactgt

SEQ ID NO: 6132725 - DNA, 19 bp, Homo sapiens
ctaccctcctgcactgttt

SEQ ID NO: 6132726 - DNA, 13 bp, Homo sapiens
ctaccctcctgct

SEQ ID NO: 6132727 - DNA, 12 bp, Homo sapiens
ctaccctcggaa

SEQ ID NO: 6132728 - DNA, 15 bp, Homo sapiens
ctaccctcgggccca

SEQ ID NO: 6132729 - DNA, 13 bp, Homo sapiens
ctaccctctagag

SEQ ID NO: 6132730 - DNA, 16 bp, Homo sapiens
ctaccctctagagaaa

SEQ ID NO: 6132731 - DNA, 23 bp, Homo sapiens
ctaccctcttattgttcctctta

SEQ ID NO: 6132732 - DNA, 19 bp, Homo sapiens
ctaccctcttctcagctcc

SEQ ID NO: 6132733 - DNA, 13 bp, Homo sapiens
ctaccctgagatc

SEQ ID NO: 6132734 - DNA, 20 bp, Homo sapiens
ctaccctgagatctgcacag

SEQ ID NO: 6132735 - DNA, 18 bp, Homo sapiens
ctaccctgcaacttctat

SEQ ID NO: 6132736 - DNA, 14 bp, Homo sapiens
ctaccctgcatggc

SEQ ID NO: 6132737 - DNA, 20 bp, Homo sapiens
ctaccctgcatggctgagct

SEQ ID NO: 6132738 - DNA, 22 bp, Homo sapiens
ctaccctggaccgagtggacca

SEQ ID NO: 6132739 - DNA, 13 bp, Homo sapiens
ctaccctggactt

SEQ ID NO: 6132740 - DNA, 14 bp, Homo sapiens
ctaccctggcaggg

SEQ ID NO: 6132741 - DNA, 13 bp, Homo sapiens
ctaccctggtgaa

SEQ ID NO: 6132742 - DNA, 17 bp, Homo sapiens
ctaccctgtcctttgca

SEQ ID NO: 6132743 - DNA, 14 bp, Homo sapiens
ctaccctgtctgtc

SEQ ID NO: 6132744 - DNA, 19 bp, Homo sapiens
ctacccttaattacttaaa

SEQ ID NO: 6132745 - DNA, 11 bp, Homo sapiens
ctacccttcct

SEQ ID NO: 6132746 - DNA, 13 bp, Homo sapiens
ctacccttcctgc

SEQ ID NO: 6132747 - DNA, 14 bp, Homo sapiens
ctacccttcctgcc

SEQ ID NO: 6132748 - DNA, 19 bp, Homo sapiens
ctacccttcctgccaagcc

SEQ ID NO: 6132749 - DNA, 15 bp, Homo sapiens
ctacccttctccttt

SEQ ID NO: 6132750 - DNA, 23 bp, Homo sapiens
ctacccttctcctttccttccca

SEQ ID NO: 6132751 - DNA, 18 bp, Homo sapiens
ctacccttgccaaggccg

SEQ ID NO: 6132752 - DNA, 12 bp, Homo sapiens
ctacccttttcc

SEQ ID NO: 6132753 - DNA, 15 bp, Homo sapiens
ctacccttttccttt

SEQ ID NO: 6132754 - DNA, 16 bp, Homo sapiens
ctacccttttcctttt

SEQ ID NO: 6132755 - DNA, 17 bp, Homo sapiens
ctacccttttccttttt

SEQ ID NO: 6132756 - DNA, 15 bp, Homo sapiens
ctaccgacccagggt

SEQ ID NO: 6132757 - DNA, 19 bp, Homo sapiens
ctaccgagtctcttctcca

SEQ ID NO: 6132758 - DNA, 21 bp, Homo sapiens
ctaccgagtctcttctccact

SEQ ID NO: 6132759 - DNA, 22 bp, Homo sapiens
ctaccgagtctcttctccactg

SEQ ID NO: 6132760 - DNA, 13 bp, Homo sapiens
ctaccgcaggccc

SEQ ID NO: 6132761 - DNA, 14 bp, Homo sapiens
ctaccgcaggcccg

SEQ ID NO: 6132762 - DNA, 12 bp, Homo sapiens
ctaccgcatggc

SEQ ID NO: 6132763 - DNA, 23 bp, Homo sapiens
ctaccgcatggcagctgggccca

SEQ ID NO: 6132764 - DNA, 13 bp, Homo sapiens
ctaccgccctggg

SEQ ID NO: 6132765 - DNA, 15 bp, Homo sapiens
ctaccgccctgggct

SEQ ID NO: 6132766 - DNA, 16 bp, Homo sapiens
ctaccgcgatacagac

SEQ ID NO: 6132767 - DNA, 17 bp, Homo sapiens
ctaccgtgccagcagcg

SEQ ID NO: 6132768 - DNA, 18 bp, Homo sapiens
ctaccgtggatctccttc

SEQ ID NO: 6132769 - DNA, 19 bp, Homo sapiens
ctaccgtggatctccttcc

SEQ ID NO: 6132770 - DNA, 22 bp, Homo sapiens
ctaccgtggatctccttccctt

SEQ ID NO: 6132771 - DNA, 18 bp, Homo sapiens
ctaccgttcccaaattgg

SEQ ID NO: 6132772 - DNA, 22 bp, Homo sapiens
ctacctaactccctaggcctga

SEQ ID NO: 6132773 - DNA, 18 bp, Homo sapiens
ctacctaagaatttcact

SEQ ID NO: 6132774 - DNA, 15 bp, Homo sapiens
ctacctacatatttg

SEQ ID NO: 6132775 - DNA, 21 bp, Homo sapiens
ctacctacgtttgcaccgcct

SEQ ID NO: 6132776 - DNA, 22 bp, Homo sapiens
ctacctacgtttgcaccgcctg

SEQ ID NO: 6132777 - DNA, 14 bp, Homo sapiens
ctacctagaagtaa

SEQ ID NO: 6132778 - DNA, 20 bp, Homo sapiens
ctacctatagaaatgtattt

SEQ ID NO: 6132779 - DNA, 14 bp, Homo sapiens
ctacctatatgcag

SEQ ID NO: 6132780 - DNA, 22 bp, Homo sapiens
ctacctatccttacatttcacc

SEQ ID NO: 6132781 - DNA, 20 bp, Homo sapiens
ctacctcaaaacactttccc

SEQ ID NO: 6132782 - DNA, 13 bp, Homo sapiens
ctacctcacagaa

SEQ ID NO: 6132783 - DNA, 13 bp, Homo sapiens
ctacctcagcagc

SEQ ID NO: 6132784 - DNA, 14 bp, Homo sapiens
ctacctcagcctag

SEQ ID NO: 6132785 - DNA, 13 bp, Homo sapiens
ctacctcaggcag

SEQ ID NO: 6132786 - DNA, 17 bp, Homo sapiens
ctacctcaggcagctca

SEQ ID NO: 6132787 - DNA, 23 bp, Homo sapiens
ctacctcaggcaggaagggcagg

SEQ ID NO: 6132788 - DNA, 14 bp, Homo sapiens
ctacctcaggttgc

SEQ ID NO: 6132789 - DNA, 19 bp, Homo sapiens
ctacctcagtgctcctgga

SEQ ID NO: 6132790 - DNA, 12 bp, Homo sapiens
ctacctccctcc

SEQ ID NO: 6132791 - DNA, 23 bp, Homo sapiens
ctacctccctccccgtctcattc

SEQ ID NO: 6132792 - DNA, 15 bp, Homo sapiens
ctacctccctcctca

SEQ ID NO: 6132793 - DNA, 13 bp, Homo sapiens
ctacctcctcact

SEQ ID NO: 6132794 - DNA, 15 bp, Homo sapiens
ctacctcctcaggga

SEQ ID NO: 6132795 - DNA, 15 bp, Homo sapiens
ctacctcctctcctg

SEQ ID NO: 6132796 - DNA, 20 bp, Homo sapiens
ctacctctcgtttctgccca

SEQ ID NO: 6132797 - DNA, 20 bp, Homo sapiens
ctacctctctgtcccttgct

SEQ ID NO: 6132798 - DNA, 12 bp, Homo sapiens
ctacctctcttt

SEQ ID NO: 6132799 - DNA, 14 bp, Homo sapiens
ctacctctctttct

SEQ ID NO: 6132800 - DNA, 14 bp, Homo sapiens
ctacctctgtctga

SEQ ID NO: 6132801 - DNA, 12 bp, Homo sapiens
ctacctctgtgc

SEQ ID NO: 6132802 - DNA, 13 bp, Homo sapiens
ctacctctgtgcc

SEQ ID NO: 6132803 - DNA, 15 bp, Homo sapiens
ctacctctgtgccag

SEQ ID NO: 6132804 - DNA, 22 bp, Homo sapiens
ctacctcttccaggaagcacag

SEQ ID NO: 6132805 - DNA, 23 bp, Homo sapiens
ctacctcttccgttggaaagaac

SEQ ID NO: 6132806 - DNA, 17 bp, Homo sapiens
ctacctcttttgagact

SEQ ID NO: 6132807 - DNA, 17 bp, Homo sapiens
ctacctgaacacttatt

SEQ ID NO: 6132808 - DNA, 22 bp, Homo sapiens
ctacctgaacacttattgcttt

SEQ ID NO: 6132809 - DNA, 16 bp, Homo sapiens
ctacctgaacattgta

SEQ ID NO: 6132810 - DNA, 15 bp, Homo sapiens
ctacctgaaggcagg

SEQ ID NO: 6132811 - DNA, 17 bp, Homo sapiens
ctacctgaaggcagggc

SEQ ID NO: 6132812 - DNA, 18 bp, Homo sapiens
ctacctgaaggcagggct

SEQ ID NO: 6132813 - DNA, 18 bp, Homo sapiens
ctctctgtctccaggcag

SEQ ID NO: 6132814 - DNA, 18 bp, Homo sapiens
ctctctgtctgtctctcc

SEQ ID NO: 6132815 - DNA, 23 bp, Homo sapiens
ctctctgtctgtctctccccctc

SEQ ID NO: 6132816 - DNA, 11 bp, Homo sapiens
ctctctgtctt

SEQ ID NO: 6132817 - DNA, 16 bp, Homo sapiens
ctctctgtcttctctc

SEQ ID NO: 6132818 - DNA, 15 bp, Homo sapiens
ctctctgtctttttc

SEQ ID NO: 6132819 - DNA, 21 bp, Homo sapiens
ctctctgtctttttccttcct

SEQ ID NO: 6132820 - DNA, 14 bp, Homo sapiens
ctctctgtgaatac

SEQ ID NO: 6132821 - DNA, 15 bp, Homo sapiens
ctctctgtgaataca

SEQ ID NO: 6132822 - DNA, 19 bp, Homo sapiens
ctctctgtggcctccatgc

SEQ ID NO: 6132823 - DNA, 17 bp, Homo sapiens
ctctctgtggggctgaa

SEQ ID NO: 6132824 - DNA, 23 bp, Homo sapiens
ctctctgtggggctgaattgcca

SEQ ID NO: 6132825 - DNA, 18 bp, Homo sapiens
ctctctgtgtctttctct

SEQ ID NO: 6132826 - DNA, 15 bp, Homo sapiens
ctctctgtgtggcaa

SEQ ID NO: 6132827 - DNA, 16 bp, Homo sapiens
ctctctgttcccttcc

SEQ ID NO: 6132828 - DNA, 17 bp, Homo sapiens
ctctctgttctcttgct

SEQ ID NO: 6132829 - DNA, 20 bp, Homo sapiens
ctctctgttctcttgcttta

SEQ ID NO: 6132830 - DNA, 21 bp, Homo sapiens
ctctctgtttaccctccctgt

SEQ ID NO: 6132831 - DNA, 20 bp, Homo sapiens
ctctcttaaagttggaattt

SEQ ID NO: 6132832 - DNA, 16 bp, Homo sapiens
ctctcttaaatgcaag

SEQ ID NO: 6132833 - DNA, 23 bp, Homo sapiens
ctctcttacccttctgtgcccag

SEQ ID NO: 6132834 - DNA, 9 bp, Homo sapiens
ctctcttca

SEQ ID NO: 6132835 - DNA, 14 bp, Homo sapiens
ctctcttcaataaa

SEQ ID NO: 6132836 - DNA, 17 bp, Homo sapiens
ctctcttcaataaacca

SEQ ID NO: 6132837 - DNA, 18 bp, Homo sapiens
ctctcttcaataaaccac

SEQ ID NO: 6132838 - DNA, 12 bp, Homo sapiens
ctctcttcactg

SEQ ID NO: 6132839 - DNA, 15 bp, Homo sapiens
ctctcttcagactct

SEQ ID NO: 6132840 - DNA, 23 bp, Homo sapiens
ctctcttcagactctcagcccag

SEQ ID NO: 6132841 - DNA, 23 bp, Homo sapiens
ctctcttcaggaggccctggtgt

SEQ ID NO: 6132842 - DNA, 13 bp, Homo sapiens
ctctcttccacag

SEQ ID NO: 6132843 - DNA, 14 bp, Homo sapiens
ctctcttccccttc

SEQ ID NO: 6132844 - DNA, 11 bp, Homo sapiens
ctctcttccct

SEQ ID NO: 6132845 - DNA, 13 bp, Homo sapiens
ctctcttccctat

SEQ ID NO: 6132846 - DNA, 15 bp, Homo sapiens
ctctcttccctcaga

SEQ ID NO: 6132847 - DNA, 18 bp, Homo sapiens
ctctcttcccttctccct

SEQ ID NO: 6132848 - DNA, 14 bp, Homo sapiens
ctctcttcctatcc

SEQ ID NO: 6132849 - DNA, 16 bp, Homo sapiens
ctctcttcctatccca

SEQ ID NO: 6132850 - DNA, 21 bp, Homo sapiens
ctctcttcctatcccatccca

SEQ ID NO: 6132851 - DNA, 14 bp, Homo sapiens
ctctcttcctccac

SEQ ID NO: 6132852 - DNA, 15 bp, Homo sapiens
ctctcttcctgcccc

SEQ ID NO: 6132853 - DNA, 20 bp, Homo sapiens
ctctcttcctgcccctcttt

SEQ ID NO: 6132854 - DNA, 21 bp, Homo sapiens
ctctcttcctgcccctctttc

SEQ ID NO: 6132855 - DNA, 13 bp, Homo sapiens
ctctcttcctgtc

SEQ ID NO: 6132856 - DNA, 18 bp, Homo sapiens
ctctcttcggtggccttg

SEQ ID NO: 6132857 - DNA, 19 bp, Homo sapiens
ctctcttcggtggccttga

SEQ ID NO: 6132858 - DNA, 13 bp, Homo sapiens
ctctcttctctgt

SEQ ID NO: 6132859 - DNA, 16 bp, Homo sapiens
ctctcttcttttttct

SEQ ID NO: 6132860 - DNA, 21 bp, Homo sapiens
ctctcttgaccctgtcacttg

SEQ ID NO: 6132861 - DNA, 16 bp, Homo sapiens
ctctcttgattgattt

SEQ ID NO: 6132862 - DNA, 20 bp, Homo sapiens
ctctcttgccaaaaagcaca

SEQ ID NO: 6132863 - DNA, 13 bp, Homo sapiens
ctctcttgcccct

SEQ ID NO: 6132864 - DNA, 20 bp, Homo sapiens
ctctcttgccgaggagccag

SEQ ID NO: 6132865 - DNA, 14 bp, Homo sapiens
ctctcttgcttgag

SEQ ID NO: 6132866 - DNA, 16 bp, Homo sapiens
ctctcttgcttgagga

SEQ ID NO: 6132867 - DNA, 20 bp, Homo sapiens
ctctcttgggccaagccagc

SEQ ID NO: 6132868 - DNA, 21 bp, Homo sapiens
ctctcttgggccaagccagct

SEQ ID NO: 6132869 - DNA, 19 bp, Homo sapiens
ctctcttggggcgcccacc

SEQ ID NO: 6132870 - DNA, 23 bp, Homo sapiens
ctctcttggtctctttctttcca

SEQ ID NO: 6132871 - DNA, 15 bp, Homo sapiens
ctctcttggtttcct

SEQ ID NO: 6132872 - DNA, 15 bp, Homo sapiens
ctctcttgtcacatg

SEQ ID NO: 6132873 - DNA, 13 bp, Homo sapiens
ctctcttgtcaga

SEQ ID NO: 6132874 - DNA, 20 bp, Homo sapiens
ctctcttgtgacgtgcactg

SEQ ID NO: 6132875 - DNA, 22 bp, Homo sapiens
ctctcttgtgacgtgcactgtg

SEQ ID NO: 6132876 - DNA, 21 bp, Homo sapiens
ctctcttgttgatttccgtga

SEQ ID NO: 6132877 - DNA, 19 bp, Homo sapiens
ctctcttgttgtccaggct

SEQ ID NO: 6132878 - DNA, 17 bp, Homo sapiens
ctctctttaaccctccc

SEQ ID NO: 6132879 - DNA, 21 bp, Homo sapiens
ctctctttacgttgtaccatt

SEQ ID NO: 6132880 - DNA, 18 bp, Homo sapiens
ctctctttatacagctgt

SEQ ID NO: 6132881 - DNA, 19 bp, Homo sapiens
ctctctttatacagctgta

SEQ ID NO: 6132882 - DNA, 17 bp, Homo sapiens
ctctctttcctccaccc

SEQ ID NO: 6132883 - DNA, 17 bp, Homo sapiens
ctctctttccttcttgc

SEQ ID NO: 6132884 - DNA, 18 bp, Homo sapiens
ctctctttccttgagctg

SEQ ID NO: 6132885 - DNA, 21 bp, Homo sapiens
ctctctttccttgagctgttg

SEQ ID NO: 6132886 - DNA, 16 bp, Homo sapiens
ctctctttctccctca

SEQ ID NO: 6132887 - DNA, 14 bp, Homo sapiens
ctctctttctctgg

SEQ ID NO: 6132888 - DNA, 12 bp, Homo sapiens
ctctctttcttt

SEQ ID NO: 6132889 - DNA, 18 bp, Homo sapiens
ctctctttggaatgaaca

SEQ ID NO: 6132890 - DNA, 18 bp, Homo sapiens
ctctctttgttctcagct

SEQ ID NO: 6132891 - DNA, 20 bp, Homo sapiens
ctctctttgttctcagctcc

SEQ ID NO: 6132892 - DNA, 21 bp, Homo sapiens
ctctctttgttctcagctccc

SEQ ID NO: 6132893 - DNA, 22 bp, Homo sapiens
ctctctttgttctcagctcccc

SEQ ID NO: 6132894 - DNA, 12 bp, Homo sapiens
ctctcttttaaa

SEQ ID NO: 6132895 - DNA, 10 bp, Homo sapiens
ctctcttttc

SEQ ID NO: 6132896 - DNA, 12 bp, Homo sapiens
ctctcttttcat

SEQ ID NO: 6132897 - DNA, 20 bp, Homo sapiens
ctctcttttccctcctttcc

SEQ ID NO: 6132898 - DNA, 12 bp, Homo sapiens
ctctcttttcct

SEQ ID NO: 6132899 - DNA, 14 bp, Homo sapiens
ctctcttttcctcc

SEQ ID NO: 6132900 - DNA, 18 bp, Homo sapiens
ctctcttttcctctctct

SEQ ID NO: 6132901 - DNA, 19 bp, Homo sapiens
ctctcttttcctctctgtc

SEQ ID NO: 6132902 - DNA, 13 bp, Homo sapiens
ctctcttttcctg

SEQ ID NO: 6132903 - DNA, 12 bp, Homo sapiens
ctctcttttctg

SEQ ID NO: 6132904 - DNA, 14 bp, Homo sapiens
ctctcttttctgta

SEQ ID NO: 6132905 - DNA, 18 bp, Homo sapiens
ctctcttttctgtacttc

SEQ ID NO: 6132906 - DNA, 21 bp, Homo sapiens
ctctctttttcttttctatgg

SEQ ID NO: 6132907 - DNA, 18 bp, Homo sapiens
ctctctttttggaggtgc

SEQ ID NO: 6132908 - DNA, 20 bp, Homo sapiens
ctctctttttggaggtgctt

SEQ ID NO: 6132909 - DNA, 17 bp, Homo sapiens
ctctcttttttttttct

SEQ ID NO: 6132910 - DNA, 22 bp, Homo sapiens
ctctgaaaagcaattgccctgt

SEQ ID NO: 6132911 - DNA, 16 bp, Homo sapiens
ctctgaaaattctgga

SEQ ID NO: 6132912 - DNA, 11 bp, Homo sapiens
ctctgaaacag

SEQ ID NO: 6132913 - DNA, 13 bp, Homo sapiens
ctctgaaacagct

SEQ ID NO: 6132914 - DNA, 17 bp, Homo sapiens
ctctgaaacagctgcct

SEQ ID NO: 6132915 - DNA, 19 bp, Homo sapiens
ctctgaaacagctgcctta

SEQ ID NO: 6132916 - DNA, 20 bp, Homo sapiens
ctctgaaacagctgccttag

SEQ ID NO: 6132917 - DNA, 12 bp, Homo sapiens
ctctgaaaccag

SEQ ID NO: 6132918 - DNA, 17 bp, Homo sapiens
ctctgaaaccagtgtta

SEQ ID NO: 6132919 - DNA, 20 bp, Homo sapiens
ctctgaaacttaattacatc

SEQ ID NO: 6132920 - DNA, 16 bp, Homo sapiens
ctctgaaagagaaaca

SEQ ID NO: 6132921 - DNA, 17 bp, Homo sapiens
ctctgaaagagaaacac

SEQ ID NO: 6132922 - DNA, 18 bp, Homo sapiens
ctctgaaagctgcttctg

SEQ ID NO: 6132923 - DNA, 15 bp, Homo sapiens
ctctgaaataaaaat

SEQ ID NO: 6132924 - DNA, 15 bp, Homo sapiens
ctctgaaataaaatg

SEQ ID NO: 6132925 - DNA, 11 bp, Homo sapiens
ctctgaaatac

SEQ ID NO: 6132926 - DNA, 19 bp, Homo sapiens
ctctgaaatcaactctctt

SEQ ID NO: 6132927 - DNA, 23 bp, Homo sapiens
ctctgaaatcttcccatgcattc

SEQ ID NO: 6132928 - DNA, 15 bp, Homo sapiens
ctctgaaattaaaga

SEQ ID NO: 6132929 - DNA, 20 bp, Homo sapiens
ctctgaaatttcccacaccc

SEQ ID NO: 6132930 - DNA, 22 bp, Homo sapiens
ctctgaacacacacgccagctc

SEQ ID NO: 6132931 - DNA, 23 bp, Homo sapiens
ctctgaacacacacgccagctcc

SEQ ID NO: 6132932 - DNA, 20 bp, Homo sapiens
ctctgaactgcaacactgga

SEQ ID NO: 6132933 - DNA, 13 bp, Homo sapiens
ctctgaactgcac

SEQ ID NO: 6132934 - DNA, 14 bp, Homo sapiens
ctctgaactgctgc

SEQ ID NO: 6132935 - DNA, 18 bp, Homo sapiens
ctctgaactgctgctggt

SEQ ID NO: 6132936 - DNA, 15 bp, Homo sapiens
ctctgaacttgcctt

SEQ ID NO: 6132937 - DNA, 14 bp, Homo sapiens
ctctgaactttgga

SEQ ID NO: 6132938 - DNA, 16 bp, Homo sapiens
ctctgaactttggaga

SEQ ID NO: 6132939 - DNA, 15 bp, Homo sapiens
ctctgaagagacctt

SEQ ID NO: 6132940 - DNA, 13 bp, Homo sapiens
ctctgaagagtgg

SEQ ID NO: 6132941 - DNA, 11 bp, Homo sapiens
ctctgaagcat

SEQ ID NO: 6132942 - DNA, 19 bp, Homo sapiens
ctctgaagccacaaatagg

SEQ ID NO: 6132943 - DNA, 17 bp, Homo sapiens
ctctgaagcctctggga

SEQ ID NO: 6132944 - DNA, 20 bp, Homo sapiens
ctctgaagcgactctcctgt

SEQ ID NO: 6132945 - DNA, 12 bp, Homo sapiens
ctctgaagctaa

SEQ ID NO: 6132946 - DNA, 20 bp, Homo sapiens
ctctgaagctaattgtacta

SEQ ID NO: 6132947 - DNA, 19 bp, Homo sapiens
ctctgaaggaggccacctc

SEQ ID NO: 6132948 - DNA, 22 bp, Homo sapiens
ctctgaaggagttacagggaag

SEQ ID NO: 6132949 - DNA, 20 bp, Homo sapiens
ctctgaagggaggggaagag

SEQ ID NO: 6132950 - DNA, 17 bp, Homo sapiens
ctctgaagggcatcatg

SEQ ID NO: 6132951 - DNA, 22 bp, Homo sapiens
ctctgaagggcatcatgcatct

SEQ ID NO: 6132952 - DNA, 23 bp, Homo sapiens
ctctgaagtcacatcacaggaca

SEQ ID NO: 6132953 - DNA, 15 bp, Homo sapiens
ctctgaagtcccttc

SEQ ID NO: 6132954 - DNA, 20 bp, Homo sapiens
ctctgaagtcccttcctgtc

SEQ ID NO: 6132955 - DNA, 23 bp, Homo sapiens
ctctgaagtcccttcctgtcctg

SEQ ID NO: 6132956 - DNA, 17 bp, Homo sapiens
ctctgaagttaaaatga

SEQ ID NO: 6132957 - DNA, 17 bp, Homo sapiens
ctctgaagttggacagc

SEQ ID NO: 6132958 - DNA, 19 bp, Homo sapiens
ctctgaataagcacttttt

SEQ ID NO: 6132959 - DNA, 16 bp, Homo sapiens
ctctgaatacacagta

SEQ ID NO: 6132960 - DNA, 15 bp, Homo sapiens
ctctgaatattttgt

SEQ ID NO: 6132961 - DNA, 18 bp, Homo sapiens
ctctgaatattttgtaat

SEQ ID NO: 6132962 - DNA, 17 bp, Homo sapiens
ctctgaatcagaaaagc

SEQ ID NO: 6132963 - DNA, 19 bp, Homo sapiens
ctctgaatcagaaaagcta

SEQ ID NO: 6132964 - DNA, 20 bp, Homo sapiens
ctctgaatctctcaaaatgt

SEQ ID NO: 6132965 - DNA, 22 bp, Homo sapiens
ctctgaatgagcctttgtgctt

SEQ ID NO: 6132966 - DNA, 22 bp, Homo sapiens
ctctgaatgctgagctgaagaa

SEQ ID NO: 6132967 - DNA, 23 bp, Homo sapiens
ctctgaatgctgagctgaagaaa

SEQ ID NO: 6132968 - DNA, 17 bp, Homo sapiens
ctctgaatggtccaggg

SEQ ID NO: 6132969 - DNA, 17 bp, Homo sapiens
ctctgaatgtagccagc

SEQ ID NO: 6132970 - DNA, 18 bp, Homo sapiens
ctctgaatgtcccagagg

SEQ ID NO: 6132971 - DNA, 20 bp, Homo sapiens
ctctgaattcaggtcccagt

SEQ ID NO: 6132972 - DNA, 22 bp, Homo sapiens
ctctgaatttaattctttcaac

SEQ ID NO: 6132973 - DNA, 23 bp, Homo sapiens
ctctgaatttaattctttcaact

SEQ ID NO: 6132974 - DNA, 18 bp, Homo sapiens
ctctgaattttcagagac

SEQ ID NO: 6132975 - DNA, 20 bp, Homo sapiens
ctctgacaactgtgaagcca

SEQ ID NO: 6132976 - DNA, 13 bp, Homo sapiens
ctctgacaagctg

SEQ ID NO: 6132977 - DNA, 18 bp, Homo sapiens
ctctgacaagggctgacc

SEQ ID NO: 6132978 - DNA, 19 bp, Homo sapiens
ctctgacaagggctgacct

SEQ ID NO: 6132979 - DNA, 16 bp, Homo sapiens
ctctgacacacagctc

SEQ ID NO: 6132980 - DNA, 18 bp, Homo sapiens
ctctgacacacagctctg

SEQ ID NO: 6132981 - DNA, 18 bp, Homo sapiens
ctctgacactgtgtaaga

SEQ ID NO: 6132982 - DNA, 23 bp, Homo sapiens
ctctgacagaagaaccccagggt

SEQ ID NO: 6132983 - DNA, 14 bp, Homo sapiens
ctctgacagcagca

SEQ ID NO: 6132984 - DNA, 18 bp, Homo sapiens
ctctgacagcagcatctc

SEQ ID NO: 6132985 - DNA, 23 bp, Homo sapiens
ctctgacagcagcatctctacct

SEQ ID NO: 6132986 - DNA, 17 bp, Homo sapiens
ctctgacagcagcctgt

SEQ ID NO: 6132987 - DNA, 18 bp, Homo sapiens
ctctgacagcagcctgtg

SEQ ID NO: 6132988 - DNA, 20 bp, Homo sapiens
ctctgacagcagcctgtgag

SEQ ID NO: 6132989 - DNA, 13 bp, Homo sapiens
ctctgacagctcc

SEQ ID NO: 6132990 - DNA, 13 bp, Homo sapiens
ctctgacagtatt

SEQ ID NO: 6132991 - DNA, 17 bp, Homo sapiens
ctctgacagtccacagg

SEQ ID NO: 6132992 - DNA, 22 bp, Homo sapiens
ctacctgaaggcagggctcctc

SEQ ID NO: 6132993 - DNA, 13 bp, Homo sapiens
ctacctgaggcct

SEQ ID NO: 6132994 - DNA, 14 bp, Homo sapiens
ctacctgaggggcc

SEQ ID NO: 6132995 - DNA, 19 bp, Homo sapiens
ctacctgaggggcctctta

SEQ ID NO: 6132996 - DNA, 23 bp, Homo sapiens
ctacctgaggggcctcttatggg

SEQ ID NO: 6132997 - DNA, 16 bp, Homo sapiens
ctacctgcacctctgg

SEQ ID NO: 6132998 - DNA, 20 bp, Homo sapiens
ctacctgcaggcggggctcc

SEQ ID NO: 6132999 - DNA, 16 bp, Homo sapiens
ctacctgccctcaagg

SEQ ID NO: 6133000 - DNA, 13 bp, Homo sapiens
ctacctgccctct

SEQ ID NO: 6133001 - DNA, 14 bp, Homo sapiens
ctacctgccttgga

SEQ ID NO: 6133002 - DNA, 16 bp, Homo sapiens
ctacctgctgctgcta

SEQ ID NO: 6133003 - DNA, 12 bp, Homo sapiens
ctacctgctgga

SEQ ID NO: 6133004 - DNA, 14 bp, Homo sapiens
ctacctgctggaca

SEQ ID NO: 6133005 - DNA, 16 bp, Homo sapiens
ctacctgctggacagc

SEQ ID NO: 6133006 - DNA, 23 bp, Homo sapiens
ctacctgctggacagcctccgcc

SEQ ID NO: 6133007 - DNA, 16 bp, Homo sapiens
ctacctgcttggtctt

SEQ ID NO: 6133008 - DNA, 11 bp, Homo sapiens
ctacctggagg

SEQ ID NO: 6133009 - DNA, 11 bp, Homo sapiens
ctacctggccg

SEQ ID NO: 6133010 - DNA, 22 bp, Homo sapiens
ctacctggccggtaggctgctg

SEQ ID NO: 6133011 - DNA, 16 bp, Homo sapiens
ctacctggctggagac

SEQ ID NO: 6133012 - DNA, 18 bp, Homo sapiens
ctacctggctggagaccg

SEQ ID NO: 6133013 - DNA, 24 bp, Homo sapiens
ctacctggggaccccccttgccca

SEQ ID NO: 6133014 - DNA, 11 bp, Homo sapiens
ctacctggggg

SEQ ID NO: 6133015 - DNA, 12 bp, Homo sapiens
ctacctgggggc

SEQ ID NO: 6133016 - DNA, 20 bp, Homo sapiens
ctacctggtcaacccgctgc

SEQ ID NO: 6133017 - DNA, 22 bp, Homo sapiens
ctacctggtcaacccgctgctt

SEQ ID NO: 6133018 - DNA, 23 bp, Homo sapiens
ctacctggttttcattattttcc

SEQ ID NO: 6133019 - DNA, 23 bp, Homo sapiens
ctacctgtatttaaaaatagaaa

SEQ ID NO: 6133020 - DNA, 14 bp, Homo sapiens
ctacctgtgagcat

SEQ ID NO: 6133021 - DNA, 17 bp, Homo sapiens
ctacctgtgtggacagg

SEQ ID NO: 6133022 - DNA, 18 bp, Homo sapiens
ctacctgtgtggtactct

SEQ ID NO: 6133023 - DNA, 22 bp, Homo sapiens
ctacctgttcagtgtcccgggc

SEQ ID NO: 6133024 - DNA, 14 bp, Homo sapiens
ctacctgttctgta

SEQ ID NO: 6133025 - DNA, 15 bp, Homo sapiens
ctacctgttctgtag

SEQ ID NO: 6133026 - DNA, 19 bp, Homo sapiens
ctaccttaaaatgtaaaac

SEQ ID NO: 6133027 - DNA, 23 bp, Homo sapiens
ctaccttaattattgcactagag

SEQ ID NO: 6133028 - DNA, 15 bp, Homo sapiens
ctaccttatcaggca

SEQ ID NO: 6133029 - DNA, 14 bp, Homo sapiens
ctaccttattttcc

SEQ ID NO: 6133030 - DNA, 19 bp, Homo sapiens
ctaccttccactctggaac

SEQ ID NO: 6133031 - DNA, 12 bp, Homo sapiens
ctaccttcctgt

SEQ ID NO: 6133032 - DNA, 16 bp, Homo sapiens
ctaccttcctgtccct

SEQ ID NO: 6133033 - DNA, 19 bp, Homo sapiens
ctaccttcctgtccctgag

SEQ ID NO: 6133034 - DNA, 20 bp, Homo sapiens
ctaccttctccccagctccc

SEQ ID NO: 6133035 - DNA, 17 bp, Homo sapiens
ctaccttctctacccat

SEQ ID NO: 6133036 - DNA, 12 bp, Homo sapiens
ctaccttctgta

SEQ ID NO: 6133037 - DNA, 16 bp, Homo sapiens
ctaccttgccccaacc

SEQ ID NO: 6133038 - DNA, 23 bp, Homo sapiens
ctaccttgctagctagccagcca

SEQ ID NO: 6133039 - DNA, 17 bp, Homo sapiens
ctaccttgcttttgctt

SEQ ID NO: 6133040 - DNA, 21 bp, Homo sapiens
ctaccttggttcccccactga

SEQ ID NO: 6133041 - DNA, 17 bp, Homo sapiens
ctaccttgtgggaataa

SEQ ID NO: 6133042 - DNA, 20 bp, Homo sapiens
ctacctttatagctcatcac

SEQ ID NO: 6133043 - DNA, 22 bp, Homo sapiens
ctacctttatagctctcatcac

SEQ ID NO: 6133044 - DNA, 17 bp, Homo sapiens
ctacctttgtattctct

SEQ ID NO: 6133045 - DNA, 17 bp, Homo sapiens
ctaccttttaaaattga

SEQ ID NO: 6133046 - DNA, 19 bp, Homo sapiens
ctaccttttgataaaatgt

SEQ ID NO: 6133047 - DNA, 21 bp, Homo sapiens
ctaccttttgataaaatgttc

SEQ ID NO: 6133048 - DNA, 14 bp, Homo sapiens
ctacctttttatat

SEQ ID NO: 6133049 - DNA, 19 bp, Homo sapiens
ctacctttttatatttaaa

SEQ ID NO: 6133050 - DNA, 20 bp, Homo sapiens
ctacctttttttctctccta

SEQ ID NO: 6133051 - DNA, 21 bp, Homo sapiens
ctaccttttttttacggaatt

SEQ ID NO: 6133052 - DNA, 18 bp, Homo sapiens
ctacgaaaggatgagcag

SEQ ID NO: 6133053 - DNA, 17 bp, Homo sapiens
ctacgaagccacaggcc

SEQ ID NO: 6133054 - DNA, 20 bp, Homo sapiens
ctacgaagccacaggcctgg

SEQ ID NO: 6133055 - DNA, 13 bp, Homo sapiens
ctacgaatcttcc

SEQ ID NO: 6133056 - DNA, 22 bp, Homo sapiens
ctacgaccccagagtgactgac

SEQ ID NO: 6133057 - DNA, 20 bp, Homo sapiens
ctacgatgggatcattattt

SEQ ID NO: 6133058 - DNA, 14 bp, Homo sapiens
ctacgcagaagaga

SEQ ID NO: 6133059 - DNA, 13 bp, Homo sapiens
ctacgccaaagtg

SEQ ID NO: 6133060 - DNA, 21 bp, Homo sapiens
ctacgccaggagaagttgagg

SEQ ID NO: 6133061 - DNA, 13 bp, Homo sapiens
ctacgcctgcctc

SEQ ID NO: 6133062 - DNA, 15 bp, Homo sapiens
ctacgctatgtagaa

SEQ ID NO: 6133063 - DNA, 16 bp, Homo sapiens
ctacgctgtccagaaa

SEQ ID NO: 6133064 - DNA, 17 bp, Homo sapiens
ctacggagaaactcatc

SEQ ID NO: 6133065 - DNA, 15 bp, Homo sapiens
ctacggttatttcct

SEQ ID NO: 6133066 - DNA, 23 bp, Homo sapiens
ctacgtaatctcacttaatacag

SEQ ID NO: 6133067 - DNA, 14 bp, Homo sapiens
ctacgtataaatat

SEQ ID NO: 6133068 - DNA, 14 bp, Homo sapiens
ctacgtcatgtatt

SEQ ID NO: 6133069 - DNA, 13 bp, Homo sapiens
ctacgtccaaggt

SEQ ID NO: 6133070 - DNA, 22 bp, Homo sapiens
ctacgtctttattacacaaact

SEQ ID NO: 6133071 - DNA, 21 bp, Homo sapiens
ctacgtgaattagctttttct

SEQ ID NO: 6133072 - DNA, 15 bp, Homo sapiens
ctacgtgtgaaatct

SEQ ID NO: 6133073 - DNA, 13 bp, Homo sapiens
ctacgtgtgattt

SEQ ID NO: 6133074 - DNA, 18 bp, Homo sapiens
ctacgtgtgatttttctg

SEQ ID NO: 6133075 - DNA, 16 bp, Homo sapiens
ctacgttaagggaagg

SEQ ID NO: 6133076 - DNA, 14 bp, Homo sapiens
ctacgttctccagc

SEQ ID NO: 6133077 - DNA, 20 bp, Homo sapiens
ctacgttctccagcccacac

SEQ ID NO: 6133078 - DNA, 16 bp, Homo sapiens
ctacgttggtgcaagt

SEQ ID NO: 6133079 - DNA, 21 bp, Homo sapiens
ctacgtttactcacagccagc

SEQ ID NO: 6133080 - DNA, 14 bp, Homo sapiens
ctacgtttctttaa

SEQ ID NO: 6133081 - DNA, 19 bp, Homo sapiens
ctacgtttgcaccgcctgc

SEQ ID NO: 6133082 - DNA, 13 bp, Homo sapiens
ctactaaaaatac

SEQ ID NO: 6133083 - DNA, 14 bp, Homo sapiens
ctactaaaaataca

SEQ ID NO: 6133084 - DNA, 20 bp, Homo sapiens
ctactaaaaatacaaaaaat

SEQ ID NO: 6133085 - DNA, 13 bp, Homo sapiens
ctactaaaaatat

SEQ ID NO: 6133086 - DNA, 14 bp, Homo sapiens
ctactaaaaatgca

SEQ ID NO: 6133087 - DNA, 20 bp, Homo sapiens
ctactaaaaatgcaaaaaaa

SEQ ID NO: 6133088 - DNA, 20 bp, Homo sapiens
ctactaaaagtttagaactt

SEQ ID NO: 6133089 - DNA, 14 bp, Homo sapiens
ctactaaaattcaa

SEQ ID NO: 6133090 - DNA, 18 bp, Homo sapiens
ctactaaagtgcctaccc

SEQ ID NO: 6133091 - DNA, 23 bp, Homo sapiens
ctactaacaatcagctccttcct

SEQ ID NO: 6133092 - DNA, 11 bp, Homo sapiens
ctactaacaga

SEQ ID NO: 6133093 - DNA, 13 bp, Homo sapiens
ctactaacagatt

SEQ ID NO: 6133094 - DNA, 15 bp, Homo sapiens
ctactaacagattat

SEQ ID NO: 6133095 - DNA, 22 bp, Homo sapiens
ctactaacagattataataaat

SEQ ID NO: 6133096 - DNA, 14 bp, Homo sapiens
ctactaacatccca

SEQ ID NO: 6133097 - DNA, 19 bp, Homo sapiens
ctactaagaagtttaagta

SEQ ID NO: 6133098 - DNA, 18 bp, Homo sapiens
ctactaagtctgtgtcct

SEQ ID NO: 6133099 - DNA, 20 bp, Homo sapiens
ctactaagttcacattagaa

SEQ ID NO: 6133100 - DNA, 15 bp, Homo sapiens
ctactaagtttcctt

SEQ ID NO: 6133101 - DNA, 12 bp, Homo sapiens
ctactaataaac

SEQ ID NO: 6133102 - DNA, 15 bp, Homo sapiens
ctactaatagtttgt

SEQ ID NO: 6133103 - DNA, 17 bp, Homo sapiens
ctactaattccacacct

SEQ ID NO: 6133104 - DNA, 21 bp, Homo sapiens
ctactacatcgccctccacat

SEQ ID NO: 6133105 - DNA, 13 bp, Homo sapiens
ctactacatctgt

SEQ ID NO: 6133106 - DNA, 16 bp, Homo sapiens
ctactaccacaaggaa

SEQ ID NO: 6133107 - DNA, 19 bp, Homo sapiens
ctactaccacaaggaaaat

SEQ ID NO: 6133108 - DNA, 20 bp, Homo sapiens
ctactacccattgttccctt

SEQ ID NO: 6133109 - DNA, 16 bp, Homo sapiens
ctactacccgagccca

SEQ ID NO: 6133110 - DNA, 12 bp, Homo sapiens
ctactacctctt

SEQ ID NO: 6133111 - DNA, 14 bp, Homo sapiens
ctactactctgcca

SEQ ID NO: 6133112 - DNA, 13 bp, Homo sapiens
ctactactgcagt

SEQ ID NO: 6133113 - DNA, 15 bp, Homo sapiens
ctactactgcagtct

SEQ ID NO: 6133114 - DNA, 22 bp, Homo sapiens
ctactagagtctgaacagctgt

SEQ ID NO: 6133115 - DNA, 17 bp, Homo sapiens
ctactagggaggctgag

SEQ ID NO: 6133116 - DNA, 19 bp, Homo sapiens
ctactaggtctgctcctga

SEQ ID NO: 6133117 - DNA, 16 bp, Homo sapiens
ctactagtgtgactcc

SEQ ID NO: 6133118 - DNA, 22 bp, Homo sapiens
ctactagttttccttgaaaaaa

SEQ ID NO: 6133119 - DNA, 15 bp, Homo sapiens
ctactataaagagaa

SEQ ID NO: 6133120 - DNA, 17 bp, Homo sapiens
ctactataaagagaaga

SEQ ID NO: 6133121 - DNA, 16 bp, Homo sapiens
ctactataaatataca

SEQ ID NO: 6133122 - DNA, 17 bp, Homo sapiens
ctactataatcaaatga

SEQ ID NO: 6133123 - DNA, 23 bp, Homo sapiens
ctactataatcaaatgatttcat

SEQ ID NO: 6133124 - DNA, 13 bp, Homo sapiens
ctactatatacat

SEQ ID NO: 6133125 - DNA, 16 bp, Homo sapiens
ctactatcatctctta

SEQ ID NO: 6133126 - DNA, 20 bp, Homo sapiens
ctactatgtgctgggtgcct

SEQ ID NO: 6133127 - DNA, 15 bp, Homo sapiens
ctactattcatgttt

SEQ ID NO: 6133128 - DNA, 12 bp, Homo sapiens
ctactattctgt

SEQ ID NO: 6133129 - DNA, 14 bp, Homo sapiens
ctactattggccct

SEQ ID NO: 6133130 - DNA, 16 bp, Homo sapiens
ctactcaagaggctga

SEQ ID NO: 6133131 - DNA, 20 bp, Homo sapiens
ctactcaagaggctgaggca

SEQ ID NO: 6133132 - DNA, 21 bp, Homo sapiens
ctactcaagcgggtggctctg

SEQ ID NO: 6133133 - DNA, 18 bp, Homo sapiens
ctactcaatactacctct

SEQ ID NO: 6133134 - DNA, 15 bp, Homo sapiens
ctactcactcaagtt

SEQ ID NO: 6133135 - DNA, 19 bp, Homo sapiens
ctactcacttttcccactc

SEQ ID NO: 6133136 - DNA, 22 bp, Homo sapiens
ctactcagatgaccccagaaac

SEQ ID NO: 6133137 - DNA, 18 bp, Homo sapiens
ctactcagcagccctcct

SEQ ID NO: 6133138 - DNA, 20 bp, Homo sapiens
ctactcagcagccctcctca

SEQ ID NO: 6133139 - DNA, 11 bp, Homo sapiens
ctactcagcat

SEQ ID NO: 6133140 - DNA, 17 bp, Homo sapiens
ctactcagcatttgatt

SEQ ID NO: 6133141 - DNA, 17 bp, Homo sapiens
ctactcagctctcctgc

SEQ ID NO: 6133142 - DNA, 20 bp, Homo sapiens
ctactcagctctcctgctgc

SEQ ID NO: 6133143 - DNA, 13 bp, Homo sapiens
ctactcaggaggc

SEQ ID NO: 6133144 - DNA, 19 bp, Homo sapiens
ctactcataagttggacca

SEQ ID NO: 6133145 - DNA, 20 bp, Homo sapiens
ctactcatacttaagcaaaa

SEQ ID NO: 6133146 - DNA, 15 bp, Homo sapiens
ctactcatgccagat

SEQ ID NO: 6133147 - DNA, 19 bp, Homo sapiens
ctactcattgtctcagtgc

SEQ ID NO: 6133148 - DNA, 14 bp, Homo sapiens
ctactcatttttct

SEQ ID NO: 6133149 - DNA, 17 bp, Homo sapiens
ctactccactgccctgg

SEQ ID NO: 6133150 - DNA, 19 bp, Homo sapiens
ctactccattaaatataaa

SEQ ID NO: 6133151 - DNA, 15 bp, Homo sapiens
ctactcccagacacc

SEQ ID NO: 6133152 - DNA, 17 bp, Homo sapiens
ctactcccagacaccca

SEQ ID NO: 6133153 - DNA, 12 bp, Homo sapiens
ctactccccacc

SEQ ID NO: 6133154 - DNA, 14 bp, Homo sapiens
ctactcccctgggc

SEQ ID NO: 6133155 - DNA, 18 bp, Homo sapiens
ctactccctcttcactgt

SEQ ID NO: 6133156 - DNA, 15 bp, Homo sapiens
ctactccctcttcca

SEQ ID NO: 6133157 - DNA, 13 bp, Homo sapiens
ctactccctcttg

SEQ ID NO: 6133158 - DNA, 20 bp, Homo sapiens
ctactccgcagctctagtcc

SEQ ID NO: 6133159 - DNA, 16 bp, Homo sapiens
ctactccggagacagg

SEQ ID NO: 6133160 - DNA, 23 bp, Homo sapiens
ctactccggaggctgaggcagga

SEQ ID NO: 6133161 - DNA, 15 bp, Homo sapiens
ctactcctagaagaa

SEQ ID NO: 6133162 - DNA, 20 bp, Homo sapiens
ctactcctccccctcctcca

SEQ ID NO: 6133163 - DNA, 21 bp, Homo sapiens
ctactcctctgcagtgccttg

SEQ ID NO: 6133164 - DNA, 12 bp, Homo sapiens
ctactcctgact

SEQ ID NO: 6133165 - DNA, 14 bp, Homo sapiens
ctactcctgcggct

SEQ ID NO: 6133166 - DNA, 12 bp, Homo sapiens
ctactcctggag

SEQ ID NO: 6133167 - DNA, 14 bp, Homo sapiens
ctactcctggagca

SEQ ID NO: 6133168 - DNA, 18 bp, Homo sapiens
ctactcctgtaattccta

SEQ ID NO: 6133169 - DNA, 16 bp, Homo sapiens
ctactcctgtcttctg

SEQ ID NO: 6133170 - DNA, 19 bp, Homo sapiens
ctactcctgtcttctgctt

SEQ ID NO: 6133171 - DNA, 20 bp, Homo sapiens
ctactcctgtcttctgcttt

SEQ ID NO: 6133172 - DNA, 23 bp, Homo sapiens
ctctgacattatgtggttttaga

SEQ ID NO: 6133173 - DNA, 16 bp, Homo sapiens
ctctgaccaacaggct

SEQ ID NO: 6133174 - DNA, 22 bp, Homo sapiens
ctctgacccaagtggggcctcc

SEQ ID NO: 6133175 - DNA, 14 bp, Homo sapiens
ctctgacccacagc

SEQ ID NO: 6133176 - DNA, 16 bp, Homo sapiens
ctctgacccacagcct

SEQ ID NO: 6133177 - DNA, 13 bp, Homo sapiens
ctctgaccccagc

SEQ ID NO: 6133178 - DNA, 12 bp, Homo sapiens
ctctgacccctc

SEQ ID NO: 6133179 - DNA, 18 bp, Homo sapiens
ctctgacccctcctcact

SEQ ID NO: 6133180 - DNA, 21 bp, Homo sapiens
ctctgacccctcctcactggc

SEQ ID NO: 6133181 - DNA, 16 bp, Homo sapiens
ctctgaccctccttct

SEQ ID NO: 6133182 - DNA, 20 bp, Homo sapiens
ctctgaccctccttctattt

SEQ ID NO: 6133183 - DNA, 14 bp, Homo sapiens
ctctgaccctgggc

SEQ ID NO: 6133184 - DNA, 19 bp, Homo sapiens
ctctgaccgaaacagcgct

SEQ ID NO: 6133185 - DNA, 15 bp, Homo sapiens
ctctgacctctgctg

SEQ ID NO: 6133186 - DNA, 12 bp, Homo sapiens
ctctgacctgca

SEQ ID NO: 6133187 - DNA, 16 bp, Homo sapiens
ctctgacctgcaggcc

SEQ ID NO: 6133188 - DNA, 13 bp, Homo sapiens
ctctgacctgcct

SEQ ID NO: 6133189 - DNA, 20 bp, Homo sapiens
ctctgacgcaccactgccaa

SEQ ID NO: 6133190 - DNA, 14 bp, Homo sapiens
ctctgacgcttgtg

SEQ ID NO: 6133191 - DNA, 17 bp, Homo sapiens
ctctgacgcttgtgaca

SEQ ID NO: 6133192 - DNA, 14 bp, Homo sapiens
ctctgacgtcaacc

SEQ ID NO: 6133193 - DNA, 21 bp, Homo sapiens
ctctgacgtcaacccaagctc

SEQ ID NO: 6133194 - DNA, 23 bp, Homo sapiens
ctctgactagtagatttctatga

SEQ ID NO: 6133195 - DNA, 16 bp, Homo sapiens
ctctgactcacacttg

SEQ ID NO: 6133196 - DNA, 14 bp, Homo sapiens
ctctgactcaccac

SEQ ID NO: 6133197 - DNA, 20 bp, Homo sapiens
ctctgactcagggctcctgg

SEQ ID NO: 6133198 - DNA, 14 bp, Homo sapiens
ctctgactccactc

SEQ ID NO: 6133199 - DNA, 13 bp, Homo sapiens
ctctgactcccaa

SEQ ID NO: 6133200 - DNA, 23 bp, Homo sapiens
ctctgactcccaaagagctgcct

SEQ ID NO: 6133201 - DNA, 18 bp, Homo sapiens
ctctgactctcaaatctt

SEQ ID NO: 6133202 - DNA, 17 bp, Homo sapiens
ctctgactcttgccttt

SEQ ID NO: 6133203 - DNA, 23 bp, Homo sapiens
ctctgactgatggtttggaaaat

SEQ ID NO: 6133204 - DNA, 19 bp, Homo sapiens
ctctgacttaagcaaaaga

SEQ ID NO: 6133205 - DNA, 14 bp, Homo sapiens
ctctgacttctgcc

SEQ ID NO: 6133206 - DNA, 16 bp, Homo sapiens
ctctgacttctgcctg

SEQ ID NO: 6133207 - DNA, 19 bp, Homo sapiens
ctctgacttctgcctggag

SEQ ID NO: 6133208 - DNA, 21 bp, Homo sapiens
ctctgacttctgcctggagac

SEQ ID NO: 6133209 - DNA, 14 bp, Homo sapiens
ctctgacttgggga

SEQ ID NO: 6133210 - DNA, 20 bp, Homo sapiens
ctctgagacaaaagaaaaaa

SEQ ID NO: 6133211 - DNA, 12 bp, Homo sapiens
ctctgagacagg

SEQ ID NO: 6133212 - DNA, 15 bp, Homo sapiens
ctctgagaccacaga

SEQ ID NO: 6133213 - DNA, 21 bp, Homo sapiens
ctctgagacggatggaaggag

SEQ ID NO: 6133214 - DNA, 14 bp, Homo sapiens
ctctgagactccag

SEQ ID NO: 6133215 - DNA, 20 bp, Homo sapiens
ctctgagactcgcgacaatg

SEQ ID NO: 6133216 - DNA, 13 bp, Homo sapiens
ctctgagagcaca

SEQ ID NO: 6133217 - DNA, 14 bp, Homo sapiens
ctctgagagcacag

SEQ ID NO: 6133218 - DNA, 22 bp, Homo sapiens
ctctgagagcgaattgtgtgga

SEQ ID NO: 6133219 - DNA, 18 bp, Homo sapiens
ctctgagaggccctggat

SEQ ID NO: 6133220 - DNA, 16 bp, Homo sapiens
ctctgagagtctagat

SEQ ID NO: 6133221 - DNA, 19 bp, Homo sapiens
ctctgagagtctagattct

SEQ ID NO: 6133222 - DNA, 16 bp, Homo sapiens
ctctgagatcctggag

SEQ ID NO: 6133223 - DNA, 21 bp, Homo sapiens
ctctgagatctaaggatgtca

SEQ ID NO: 6133224 - DNA, 18 bp, Homo sapiens
ctctgagatgctaattta

SEQ ID NO: 6133225 - DNA, 19 bp, Homo sapiens
ctctgagatgtggagactg

SEQ ID NO: 6133226 - DNA, 13 bp, Homo sapiens
ctctgagcaactg

SEQ ID NO: 6133227 - DNA, 13 bp, Homo sapiens
ctctgagcacagg

SEQ ID NO: 6133228 - DNA, 23 bp, Homo sapiens
ctctgagcagacagggcgtcctc

SEQ ID NO: 6133229 - DNA, 13 bp, Homo sapiens
ctctgagcagcct

SEQ ID NO: 6133230 - DNA, 15 bp, Homo sapiens
ctctgagcagcctct

SEQ ID NO: 6133231 - DNA, 22 bp, Homo sapiens
ctctgagcagcctctgccaggc

SEQ ID NO: 6133232 - DNA, 12 bp, Homo sapiens
ctctgagcaggg

SEQ ID NO: 6133233 - DNA, 16 bp, Homo sapiens
ctctgagcaggggcag

SEQ ID NO: 6133234 - DNA, 17 bp, Homo sapiens
ctctgagcaggggcagg

SEQ ID NO: 6133235 - DNA, 22 bp, Homo sapiens
ctctgagcaggggcaggcgcag

SEQ ID NO: 6133236 - DNA, 14 bp, Homo sapiens
ctctgagcagtcag

SEQ ID NO: 6133237 - DNA, 14 bp, Homo sapiens
ctctgagcagtggg

SEQ ID NO: 6133238 - DNA, 16 bp, Homo sapiens
ctctgagcatcaagaa

SEQ ID NO: 6133239 - DNA, 18 bp, Homo sapiens
ctctgagccaagggaggg

SEQ ID NO: 6133240 - DNA, 19 bp, Homo sapiens
ctctgagccaagggaggga

SEQ ID NO: 6133241 - DNA, 18 bp, Homo sapiens
ctctgagccacagtggga

SEQ ID NO: 6133242 - DNA, 21 bp, Homo sapiens
ctctgagccaccgcgagggcc

SEQ ID NO: 6133243 - DNA, 16 bp, Homo sapiens
ctctgagccagattac

SEQ ID NO: 6133244 - DNA, 20 bp, Homo sapiens
ctctgagccagattacagga

SEQ ID NO: 6133245 - DNA, 20 bp, Homo sapiens
ctctgagccaggagcctcct

SEQ ID NO: 6133246 - DNA, 11 bp, Homo sapiens
ctctgagccca

SEQ ID NO: 6133247 - DNA, 20 bp, Homo sapiens
ctctgagcccaagctaagcc

SEQ ID NO: 6133248 - DNA, 13 bp, Homo sapiens
ctctgagcccagg

SEQ ID NO: 6133249 - DNA, 17 bp, Homo sapiens
ctctgagcccaggccgt

SEQ ID NO: 6133250 - DNA, 12 bp, Homo sapiens
ctctgagcccat

SEQ ID NO: 6133251 - DNA, 13 bp, Homo sapiens
ctctgagcccata

SEQ ID NO: 6133252 - DNA, 19 bp, Homo sapiens
ctctgagcccatacttttg

SEQ ID NO: 6133253 - DNA, 17 bp, Homo sapiens
ctctgagccccctgtgc

SEQ ID NO: 6133254 - DNA, 13 bp, Homo sapiens
ctctgagcccctg

SEQ ID NO: 6133255 - DNA, 15 bp, Homo sapiens
ctctgagccttggga

SEQ ID NO: 6133256 - DNA, 17 bp, Homo sapiens
ctctgagcgggaggcag

SEQ ID NO: 6133257 - DNA, 15 bp, Homo sapiens
ctctgagctcatttg

SEQ ID NO: 6133258 - DNA, 15 bp, Homo sapiens
ctctgagctgtcaac

SEQ ID NO: 6133259 - DNA, 16 bp, Homo sapiens
ctctgagctgttatct

SEQ ID NO: 6133260 - DNA, 13 bp, Homo sapiens
ctctgagctttgt

SEQ ID NO: 6133261 - DNA, 16 bp, Homo sapiens
ctctgaggacactaac

SEQ ID NO: 6133262 - DNA, 18 bp, Homo sapiens
ctctgaggacagagcttg

SEQ ID NO: 6133263 - DNA, 16 bp, Homo sapiens
ctctgaggcaaggccc

SEQ ID NO: 6133264 - DNA, 19 bp, Homo sapiens
ctctgaggcaaggcccaga

SEQ ID NO: 6133265 - DNA, 20 bp, Homo sapiens
ctctgaggccagcctggcct

SEQ ID NO: 6133266 - DNA, 22 bp, Homo sapiens
ctctgaggcccgatctccactg

SEQ ID NO: 6133267 - DNA, 22 bp, Homo sapiens
ctctgaggctcagccctgagct

SEQ ID NO: 6133268 - DNA, 19 bp, Homo sapiens
ctctgaggctctttctggg

SEQ ID NO: 6133269 - DNA, 20 bp, Homo sapiens
ctctgaggctctttctgggc

SEQ ID NO: 6133270 - DNA, 19 bp, Homo sapiens
ctctgagggaaagcccaga

SEQ ID NO: 6133271 - DNA, 18 bp, Homo sapiens
ctctgaggggaggcacct

SEQ ID NO: 6133272 - DNA, 15 bp, Homo sapiens
ctctgaggggagggg

SEQ ID NO: 6133273 - DNA, 21 bp, Homo sapiens
ctctgaggggctaccaggaaa

SEQ ID NO: 6133274 - DNA, 13 bp, Homo sapiens
ctctgaggggtgg

SEQ ID NO: 6133275 - DNA, 13 bp, Homo sapiens
ctctgagggtctg

SEQ ID NO: 6133276 - DNA, 14 bp, Homo sapiens
ctctgagggtctga

SEQ ID NO: 6133277 - DNA, 15 bp, Homo sapiens
ctctgaggtcaataa

SEQ ID NO: 6133278 - DNA, 16 bp, Homo sapiens
ctctgaggtcaataaa

SEQ ID NO: 6133279 - DNA, 21 bp, Homo sapiens
ctctgaggtcaataaagcaga

SEQ ID NO: 6133280 - DNA, 23 bp, Homo sapiens
ctctgaggtcaataaagcagagc

SEQ ID NO: 6133281 - DNA, 14 bp, Homo sapiens
ctctgaggtccctt

SEQ ID NO: 6133282 - DNA, 19 bp, Homo sapiens
ctctgaggtctcaccttcg

SEQ ID NO: 6133283 - DNA, 22 bp, Homo sapiens
ctctgaggtgcctgtcccaccc

SEQ ID NO: 6133284 - DNA, 19 bp, Homo sapiens
ctctgagtacattgtgccc

SEQ ID NO: 6133285 - DNA, 17 bp, Homo sapiens
ctctgagtatctcctcg

SEQ ID NO: 6133286 - DNA, 16 bp, Homo sapiens
ctctgagtcaaatcca

SEQ ID NO: 6133287 - DNA, 17 bp, Homo sapiens
ctctgagtcaaatccag

SEQ ID NO: 6133288 - DNA, 17 bp, Homo sapiens
ctctgagtccactgctc

SEQ ID NO: 6133289 - DNA, 19 bp, Homo sapiens
ctctgagtccactgctcca

SEQ ID NO: 6133290 - DNA, 15 bp, Homo sapiens
ctctgagtctggact

SEQ ID NO: 6133291 - DNA, 17 bp, Homo sapiens
ctctgagtggaggaagc

SEQ ID NO: 6133292 - DNA, 21 bp, Homo sapiens
ctctgagtggaggaagcccac

SEQ ID NO: 6133293 - DNA, 22 bp, Homo sapiens
ctctgagtggtggttcctttgc

SEQ ID NO: 6133294 - DNA, 13 bp, Homo sapiens
ctctgagtgtctc

SEQ ID NO: 6133295 - DNA, 14 bp, Homo sapiens
ctctgagtgtctct

SEQ ID NO: 6133296 - DNA, 19 bp, Homo sapiens
ctctgagtgtctctgcctg

SEQ ID NO: 6133297 - DNA, 20 bp, Homo sapiens
ctctgagtgtctctgcctgg

SEQ ID NO: 6133298 - DNA, 21 bp, Homo sapiens
ctctgagtgtctctgcctgga

SEQ ID NO: 6133299 - DNA, 16 bp, Homo sapiens
ctctgagtttaccatt

SEQ ID NO: 6133300 - DNA, 18 bp, Homo sapiens
ctctgagtttaccatttg

SEQ ID NO: 6133301 - DNA, 20 bp, Homo sapiens
ctctgagtttaccatttgta

SEQ ID NO: 6133302 - DNA, 19 bp, Homo sapiens
ctctgagtttttgtatgta

SEQ ID NO: 6133303 - DNA, 23 bp, Homo sapiens
ctctgataaaagggcaaatctgc

SEQ ID NO: 6133304 - DNA, 20 bp, Homo sapiens
ctctgataatatattttcaa

SEQ ID NO: 6133305 - DNA, 21 bp, Homo sapiens
ctctgataatatattttcaag

SEQ ID NO: 6133306 - DNA, 14 bp, Homo sapiens
ctctgatacacagt

SEQ ID NO: 6133307 - DNA, 21 bp, Homo sapiens
ctctgatacacagtaattgtg

SEQ ID NO: 6133308 - DNA, 23 bp, Homo sapiens
ctctgatacagacagcagtctag

SEQ ID NO: 6133309 - DNA, 17 bp, Homo sapiens
ctctgatacccagagca

SEQ ID NO: 6133310 - DNA, 14 bp, Homo sapiens
ctctgatacttttt

SEQ ID NO: 6133311 - DNA, 16 bp, Homo sapiens
ctctgatacttttttg

SEQ ID NO: 6133312 - DNA, 17 bp, Homo sapiens
ctctgatacttttttga

SEQ ID NO: 6133313 - DNA, 18 bp, Homo sapiens
ctctgatacttttttgaa

SEQ ID NO: 6133314 - DNA, 20 bp, Homo sapiens
ctctgatacttttttgaaat

SEQ ID NO: 6133315 - DNA, 22 bp, Homo sapiens
ctctgatacttttttgaaatca

SEQ ID NO: 6133316 - DNA, 18 bp, Homo sapiens
ctctgatagactttgtga

SEQ ID NO: 6133317 - DNA, 19 bp, Homo sapiens
ctctgatagactttgtgaa

SEQ ID NO: 6133318 - DNA, 20 bp, Homo sapiens
ctctgatagactttgtgaat

SEQ ID NO: 6133319 - DNA, 22 bp, Homo sapiens
ctctgatatacaattagagata

SEQ ID NO: 6133320 - DNA, 13 bp, Homo sapiens
ctctgatatggga

SEQ ID NO: 6133321 - DNA, 15 bp, Homo sapiens
ctctgatatgggact

SEQ ID NO: 6133322 - DNA, 16 bp, Homo sapiens
ctctgatatgggactg

SEQ ID NO: 6133323 - DNA, 17 bp, Homo sapiens
ctctgatatgggactga

SEQ ID NO: 6133324 - DNA, 19 bp, Homo sapiens
ctctgatatgggactgagc

SEQ ID NO: 6133325 - DNA, 20 bp, Homo sapiens
ctctgatatgtctagggtgt

SEQ ID NO: 6133326 - DNA, 19 bp, Homo sapiens
ctctgatattccatgaatg

SEQ ID NO: 6133327 - DNA, 13 bp, Homo sapiens
ctctgatcaaaat

SEQ ID NO: 6133328 - DNA, 15 bp, Homo sapiens
ctctgatcaaaatta

SEQ ID NO: 6133329 - DNA, 15 bp, Homo sapiens
ctctgatcaagtatt

SEQ ID NO: 6133330 - DNA, 20 bp, Homo sapiens
ctctgatcacaacttttctg

SEQ ID NO: 6133331 - DNA, 21 bp, Homo sapiens
ctctgatcacattcttcaaag

SEQ ID NO: 6133332 - DNA, 12 bp, Homo sapiens
ctctgatccctc

SEQ ID NO: 6133333 - DNA, 22 bp, Homo sapiens
ctctgatctccataaacatgaa

SEQ ID NO: 6133334 - DNA, 14 bp, Homo sapiens
ctctgatctgtgca

SEQ ID NO: 6133335 - DNA, 17 bp, Homo sapiens
ctctgatctgtgcaggg

SEQ ID NO: 6133336 - DNA, 13 bp, Homo sapiens
ctctgatcttgtg

SEQ ID NO: 6133337 - DNA, 20 bp, Homo sapiens
ctctgatcttgtgctcagca

SEQ ID NO: 6133338 - DNA, 22 bp, Homo sapiens
ctctgatgaaaaattgctgact

SEQ ID NO: 6133339 - DNA, 14 bp, Homo sapiens
ctctgatgcagtgc

SEQ ID NO: 6133340 - DNA, 22 bp, Homo sapiens
ctctgatggaatgtgccacctg

SEQ ID NO: 6133341 - DNA, 13 bp, Homo sapiens
ctctgatggcact

SEQ ID NO: 6133342 - DNA, 15 bp, Homo sapiens
ctctgatggcacttt

SEQ ID NO: 6133343 - DNA, 13 bp, Homo sapiens
ctctgatgtattt

SEQ ID NO: 6133344 - DNA, 16 bp, Homo sapiens
ctctgatgtcccagtg

SEQ ID NO: 6133345 - DNA, 22 bp, Homo sapiens
ctctgatgttcttccagtgagg

SEQ ID NO: 6133346 - DNA, 18 bp, Homo sapiens
ctctgattagttgacagt

SEQ ID NO: 6133347 - DNA, 20 bp, Homo sapiens
ctctgattatcaggtactgg

SEQ ID NO: 6133348 - DNA, 14 bp, Homo sapiens
ctctgattcacctc

SEQ ID NO: 6133349 - DNA, 16 bp, Homo sapiens
ctctgattcacctctt

SEQ ID NO: 6133350 - DNA, 21 bp, Homo sapiens
ctctgattcacctcttcctct

SEQ ID NO: 6133351 - DNA, 22 bp, Homo sapiens
ctactcctgtcttctgctttgt

SEQ ID NO: 6133352 - DNA, 19 bp, Homo sapiens
ctactcgagcccacccagc

SEQ ID NO: 6133353 - DNA, 21 bp, Homo sapiens
ctactcgagcccacccagcat

SEQ ID NO: 6133354 - DNA, 19 bp, Homo sapiens
ctactcgagttacagacaa

SEQ ID NO: 6133355 - DNA, 23 bp, Homo sapiens
ctactcgggaggctgaggcagga

SEQ ID NO: 6133356 - DNA, 21 bp, Homo sapiens
ctactcgggaggctgaggcgg

SEQ ID NO: 6133357 - DNA, 19 bp, Homo sapiens
ctactctaccatggttctg

SEQ ID NO: 6133358 - DNA, 22 bp, Homo sapiens
ctactctagagaagtggactgg

SEQ ID NO: 6133359 - DNA, 17 bp, Homo sapiens
ctactctagttctgttg

SEQ ID NO: 6133360 - DNA, 22 bp, Homo sapiens
ctactctagttctgttgttttg

SEQ ID NO: 6133361 - DNA, 17 bp, Homo sapiens
ctactctccccacgagg

SEQ ID NO: 6133362 - DNA, 17 bp, Homo sapiens
ctactctcctcatctct

SEQ ID NO: 6133363 - DNA, 17 bp, Homo sapiens
ctactctcttatgcatt

SEQ ID NO: 6133364 - DNA, 16 bp, Homo sapiens
ctactctcttcctcca

SEQ ID NO: 6133365 - DNA, 23 bp, Homo sapiens
ctactctcttgccagcattttca

SEQ ID NO: 6133366 - DNA, 15 bp, Homo sapiens
ctactctgaagacct

SEQ ID NO: 6133367 - DNA, 12 bp, Homo sapiens
ctactctgccaa

SEQ ID NO: 6133368 - DNA, 12 bp, Homo sapiens
ctactctgccca

SEQ ID NO: 6133369 - DNA, 13 bp, Homo sapiens
ctactctgcccac

SEQ ID NO: 6133370 - DNA, 22 bp, Homo sapiens
ctactctgcgacgatccccatg

SEQ ID NO: 6133371 - DNA, 14 bp, Homo sapiens
ctactctgtccagg

SEQ ID NO: 6133372 - DNA, 15 bp, Homo sapiens
ctactctgtccaggc

SEQ ID NO: 6133373 - DNA, 16 bp, Homo sapiens
ctactctgtccaggcc

SEQ ID NO: 6133374 - DNA, 18 bp, Homo sapiens
ctactctgtccaggccac

SEQ ID NO: 6133375 - DNA, 20 bp, Homo sapiens
ctactctgtccaggccactg

SEQ ID NO: 6133376 - DNA, 13 bp, Homo sapiens
ctactctgtgtca

SEQ ID NO: 6133377 - DNA, 13 bp, Homo sapiens
ctactcttaatga

SEQ ID NO: 6133378 - DNA, 21 bp, Homo sapiens
ctactcttaatgatgttatct

SEQ ID NO: 6133379 - DNA, 17 bp, Homo sapiens
ctactcttacagagcct

SEQ ID NO: 6133380 - DNA, 13 bp, Homo sapiens
ctactcttacatg

SEQ ID NO: 6133381 - DNA, 16 bp, Homo sapiens
ctactcttacatgtat

SEQ ID NO: 6133382 - DNA, 13 bp, Homo sapiens
ctactcttcctgt

SEQ ID NO: 6133383 - DNA, 14 bp, Homo sapiens
ctactcttcctgtc

SEQ ID NO: 6133384 - DNA, 16 bp, Homo sapiens
ctactcttcctgtcct

SEQ ID NO: 6133385 - DNA, 14 bp, Homo sapiens
ctactcttctctct

SEQ ID NO: 6133386 - DNA, 23 bp, Homo sapiens
ctactcttgagagctcaggcagc

SEQ ID NO: 6133387 - DNA, 23 bp, Homo sapiens
ctactcttgggtgaaggtgcatc

SEQ ID NO: 6133388 - DNA, 20 bp, Homo sapiens
ctactctttggcactttttc

SEQ ID NO: 6133389 - DNA, 12 bp, Homo sapiens
ctactgaaacag

SEQ ID NO: 6133390 - DNA, 22 bp, Homo sapiens
ctactgaaacttacctgagaac

SEQ ID NO: 6133391 - DNA, 16 bp, Homo sapiens
ctactgaacacatgtg

SEQ ID NO: 6133392 - DNA, 14 bp, Homo sapiens
ctactgaagccctt

SEQ ID NO: 6133393 - DNA, 12 bp, Homo sapiens
ctactgaagctt

SEQ ID NO: 6133394 - DNA, 23 bp, Homo sapiens
ctactgaagggaacagcctgagc

SEQ ID NO: 6133395 - DNA, 21 bp, Homo sapiens
ctactgaataatgctaccagg

SEQ ID NO: 6133396 - DNA, 15 bp, Homo sapiens
ctactgaatgtcatt

SEQ ID NO: 6133397 - DNA, 16 bp, Homo sapiens
ctactgaattggcttc

SEQ ID NO: 6133398 - DNA, 18 bp, Homo sapiens
ctactgacaacattataa

SEQ ID NO: 6133399 - DNA, 14 bp, Homo sapiens
ctactgacagggag

SEQ ID NO: 6133400 - DNA, 15 bp, Homo sapiens
ctactgacagggagc

SEQ ID NO: 6133401 - DNA, 14 bp, Homo sapiens
ctactgacatgtgg

SEQ ID NO: 6133402 - DNA, 16 bp, Homo sapiens
ctactgacgaaagagt

SEQ ID NO: 6133403 - DNA, 22 bp, Homo sapiens
ctactgacggagtcctgtgttt

SEQ ID NO: 6133404 - DNA, 15 bp, Homo sapiens
ctactgactatattt

SEQ ID NO: 6133405 - DNA, 22 bp, Homo sapiens
ctactgactgatgacaaaccca

SEQ ID NO: 6133406 - DNA, 17 bp, Homo sapiens
ctactgactttctcagc

SEQ ID NO: 6133407 - DNA, 17 bp, Homo sapiens
ctactgagccacggacc

SEQ ID NO: 6133408 - DNA, 17 bp, Homo sapiens
ctactgagtagctttca

SEQ ID NO: 6133409 - DNA, 16 bp, Homo sapiens
ctactgattgaatgtt

SEQ ID NO: 6133410 - DNA, 21 bp, Homo sapiens
ctactgcactccagcctgggg

SEQ ID NO: 6133411 - DNA, 23 bp, Homo sapiens
ctactgcactccagcctggggga

SEQ ID NO: 6133412 - DNA, 15 bp, Homo sapiens
ctactgcactgagtt

SEQ ID NO: 6133413 - DNA, 21 bp, Homo sapiens
ctactgcacttagtagctatg

SEQ ID NO: 6133414 - DNA, 18 bp, Homo sapiens
ctactgcactttccccct

SEQ ID NO: 6133415 - DNA, 21 bp, Homo sapiens
ctactgcactttcccccttcc

SEQ ID NO: 6133416 - DNA, 13 bp, Homo sapiens
ctactgcagcacc

SEQ ID NO: 6133417 - DNA, 20 bp, Homo sapiens
ctactgcagcacctccaggc

SEQ ID NO: 6133418 - DNA, 16 bp, Homo sapiens
ctactgcatttaggga

SEQ ID NO: 6133419 - DNA, 14 bp, Homo sapiens
ctactgcatttata

SEQ ID NO: 6133420 - DNA, 19 bp, Homo sapiens
ctactgccaacctcgctcc

SEQ ID NO: 6133421 - DNA, 22 bp, Homo sapiens
ctactgccaagggcaggaccaa

SEQ ID NO: 6133422 - DNA, 17 bp, Homo sapiens
ctactgccatcctggcc

SEQ ID NO: 6133423 - DNA, 18 bp, Homo sapiens
ctactgccatcctggccc

SEQ ID NO: 6133424 - DNA, 20 bp, Homo sapiens
ctactgccatcctggcccag

SEQ ID NO: 6133425 - DNA, 12 bp, Homo sapiens
ctactgcccaca

SEQ ID NO: 6133426 - DNA, 15 bp, Homo sapiens
ctactgcccacattt

SEQ ID NO: 6133427 - DNA, 21 bp, Homo sapiens
ctactgcccaggcactgcaaa

SEQ ID NO: 6133428 - DNA, 22 bp, Homo sapiens
ctactgcccctgccctgaggag

SEQ ID NO: 6133429 - DNA, 12 bp, Homo sapiens
ctactgccctcc

SEQ ID NO: 6133430 - DNA, 13 bp, Homo sapiens
ctactgccctccc

SEQ ID NO: 6133431 - DNA, 16 bp, Homo sapiens
ctactgccctcccctt

SEQ ID NO: 6133432 - DNA, 14 bp, Homo sapiens
ctactgccttgaaa

SEQ ID NO: 6133433 - DNA, 16 bp, Homo sapiens
ctactgcctttcaaag

SEQ ID NO: 6133434 - DNA, 15 bp, Homo sapiens
ctactgctaaatcct

SEQ ID NO: 6133435 - DNA, 13 bp, Homo sapiens
ctactgctaatga

SEQ ID NO: 6133436 - DNA, 20 bp, Homo sapiens
ctactgctaatgttgatcag

SEQ ID NO: 6133437 - DNA, 14 bp, Homo sapiens
ctactgctcctgtg

SEQ ID NO: 6133438 - DNA, 18 bp, Homo sapiens
ctactgctcctgtggcag

SEQ ID NO: 6133439 - DNA, 18 bp, Homo sapiens
ctactgctgcaaagtgca

SEQ ID NO: 6133440 - DNA, 20 bp, Homo sapiens
ctactgctgtgaaccctggg

SEQ ID NO: 6133441 - DNA, 17 bp, Homo sapiens
ctactgcttcctctgaa

SEQ ID NO: 6133442 - DNA, 20 bp, Homo sapiens
ctactggaaatgtagcactt

SEQ ID NO: 6133443 - DNA, 15 bp, Homo sapiens
ctactggacgctgcc

SEQ ID NO: 6133444 - DNA, 21 bp, Homo sapiens
ctactggacttgaatggttaa

SEQ ID NO: 6133445 - DNA, 23 bp, Homo sapiens
ctactggataaacttgcttcaga

SEQ ID NO: 6133446 - DNA, 19 bp, Homo sapiens
ctactggatgcttacagtg

SEQ ID NO: 6133447 - DNA, 18 bp, Homo sapiens
ctactggcatagtttcat

SEQ ID NO: 6133448 - DNA, 15 bp, Homo sapiens
ctactggcattaatt

SEQ ID NO: 6133449 - DNA, 19 bp, Homo sapiens
ctactggggaaactggcca

SEQ ID NO: 6133450 - DNA, 22 bp, Homo sapiens
ctactggggaaactggccatgg

SEQ ID NO: 6133451 - DNA, 18 bp, Homo sapiens
ctactggggggctttggc

SEQ ID NO: 6133452 - DNA, 17 bp, Homo sapiens
ctactgggtgtagactg

SEQ ID NO: 6133453 - DNA, 18 bp, Homo sapiens
ctactgggtgtcatttca

SEQ ID NO: 6133454 - DNA, 13 bp, Homo sapiens
ctactggtctgta

SEQ ID NO: 6133455 - DNA, 17 bp, Homo sapiens
ctactggtcttgtggaa

SEQ ID NO: 6133456 - DNA, 20 bp, Homo sapiens
ctactggttacctggagaag

SEQ ID NO: 6133457 - DNA, 20 bp, Homo sapiens
ctactggtttgtatgatgta

SEQ ID NO: 6133458 - DNA, 14 bp, Homo sapiens
ctactgtaaatgta

SEQ ID NO: 6133459 - DNA, 12 bp, Homo sapiens
ctactgtaactt

SEQ ID NO: 6133460 - DNA, 14 bp, Homo sapiens
ctactgtaactttt

SEQ ID NO: 6133461 - DNA, 19 bp, Homo sapiens
ctactgtaagagacatgaa

SEQ ID NO: 6133462 - DNA, 20 bp, Homo sapiens
ctactgtaatgctgcctcag

SEQ ID NO: 6133463 - DNA, 22 bp, Homo sapiens
ctactgtaattaagtgcaattt

SEQ ID NO: 6133464 - DNA, 19 bp, Homo sapiens
ctactgtaattttatatga

SEQ ID NO: 6133465 - DNA, 17 bp, Homo sapiens
ctactgtactttgccat

SEQ ID NO: 6133466 - DNA, 15 bp, Homo sapiens
ctactgtagaaagat

SEQ ID NO: 6133467 - DNA, 16 bp, Homo sapiens
ctactgtagaaaggaa

SEQ ID NO: 6133468 - DNA, 18 bp, Homo sapiens
ctactgtagaaaggaaat

SEQ ID NO: 6133469 - DNA, 22 bp, Homo sapiens
ctactgtagaaaggaaatagac

SEQ ID NO: 6133470 - DNA, 19 bp, Homo sapiens
ctactgtatcaataaaatt

SEQ ID NO: 6133471 - DNA, 15 bp, Homo sapiens
ctactgtatttcatt

SEQ ID NO: 6133472 - DNA, 21 bp, Homo sapiens
ctactgtcaaatgatgtgcaa

SEQ ID NO: 6133473 - DNA, 13 bp, Homo sapiens
ctactgtcctgga

SEQ ID NO: 6133474 - DNA, 14 bp, Homo sapiens
ctactgtcctggaa

SEQ ID NO: 6133475 - DNA, 23 bp, Homo sapiens
ctactgtctaagcagttttgtaa

SEQ ID NO: 6133476 - DNA, 19 bp, Homo sapiens
ctactgtctattaaaattc

SEQ ID NO: 6133477 - DNA, 20 bp, Homo sapiens
ctactgtctcctccctgggc

SEQ ID NO: 6133478 - DNA, 14 bp, Homo sapiens
ctactgtctccttc

SEQ ID NO: 6133479 - DNA, 22 bp, Homo sapiens
ctactgtctccttcccactgtc

SEQ ID NO: 6133480 - DNA, 20 bp, Homo sapiens
ctactgtctttggaaaaatg

SEQ ID NO: 6133481 - DNA, 17 bp, Homo sapiens
ctactgtggaaaaatat

SEQ ID NO: 6133482 - DNA, 13 bp, Homo sapiens
ctactgtgggcaa

SEQ ID NO: 6133483 - DNA, 12 bp, Homo sapiens
ctactgtgggga

SEQ ID NO: 6133484 - DNA, 13 bp, Homo sapiens
ctactgtggggag

SEQ ID NO: 6133485 - DNA, 21 bp, Homo sapiens
ctactgtggtgttttgtttat

SEQ ID NO: 6133486 - DNA, 11 bp, Homo sapiens
ctactgtgtaa

SEQ ID NO: 6133487 - DNA, 19 bp, Homo sapiens
ctactgtgtgtgtgaatga

SEQ ID NO: 6133488 - DNA, 12 bp, Homo sapiens
ctactgtgttcc

SEQ ID NO: 6133489 - DNA, 14 bp, Homo sapiens
ctactgtgttcctg

SEQ ID NO: 6133490 - DNA, 15 bp, Homo sapiens
ctactgtgttcctgg

SEQ ID NO: 6133491 - DNA, 23 bp, Homo sapiens
ctactgttcagcttttattcctg

SEQ ID NO: 6133492 - DNA, 14 bp, Homo sapiens
ctactgttcctttc

SEQ ID NO: 6133493 - DNA, 15 bp, Homo sapiens
ctactgttcctttca

SEQ ID NO: 6133494 - DNA, 14 bp, Homo sapiens
ctactgttctaaag

SEQ ID NO: 6133495 - DNA, 16 bp, Homo sapiens
ctactgttgcaaagct

SEQ ID NO: 6133496 - DNA, 16 bp, Homo sapiens
ctactgttgcacagcc

SEQ ID NO: 6133497 - DNA, 17 bp, Homo sapiens
ctactgttgcacagcca

SEQ ID NO: 6133498 - DNA, 19 bp, Homo sapiens
ctacttaaacaaaaacttt

SEQ ID NO: 6133499 - DNA, 13 bp, Homo sapiens
ctacttaagagaa

SEQ ID NO: 6133500 - DNA, 19 bp, Homo sapiens
ctacttaatgtaattcagg

SEQ ID NO: 6133501 - DNA, 22 bp, Homo sapiens
ctacttaatgtaattcaggact

SEQ ID NO: 6133502 - DNA, 17 bp, Homo sapiens
ctacttacccaggtggg

SEQ ID NO: 6133503 - DNA, 17 bp, Homo sapiens
ctacttagatatttcat

SEQ ID NO: 6133504 - DNA, 15 bp, Homo sapiens
ctacttagctggcca

SEQ ID NO: 6133505 - DNA, 22 bp, Homo sapiens
ctacttagggaagaaaaagcaa

SEQ ID NO: 6133506 - DNA, 20 bp, Homo sapiens
ctacttagtaaaaattgatt

SEQ ID NO: 6133507 - DNA, 14 bp, Homo sapiens
ctacttatattctg

SEQ ID NO: 6133508 - DNA, 13 bp, Homo sapiens
ctacttatcattt

SEQ ID NO: 6133509 - DNA, 19 bp, Homo sapiens
ctacttatgaaatgtgcac

SEQ ID NO: 6133510 - DNA, 14 bp, Homo sapiens
ctacttcacagagg

SEQ ID NO: 6133511 - DNA, 19 bp, Homo sapiens
ctacttcattttcagagtg

SEQ ID NO: 6133512 - DNA, 14 bp, Homo sapiens
ctacttccaggatg

SEQ ID NO: 6133513 - DNA, 13 bp, Homo sapiens
ctacttcccctgg

SEQ ID NO: 6133514 - DNA, 15 bp, Homo sapiens
ctacttcccctggga

SEQ ID NO: 6133515 - DNA, 17 bp, Homo sapiens
ctacttcccctgggatg

SEQ ID NO: 6133516 - DNA, 13 bp, Homo sapiens
ctacttccccttc

SEQ ID NO: 6133517 - DNA, 14 bp, Homo sapiens
ctacttccccttcc

SEQ ID NO: 6133518 - DNA, 17 bp, Homo sapiens
ctacttccccttcttgc

SEQ ID NO: 6133519 - DNA, 18 bp, Homo sapiens
ctacttcccttcctcccg

SEQ ID NO: 6133520 - DNA, 13 bp, Homo sapiens
ctacttcctcctc

SEQ ID NO: 6133521 - DNA, 20 bp, Homo sapiens
ctacttcctgtaatgtacaa

SEQ ID NO: 6133522 - DNA, 20 bp, Homo sapiens
ctacttcctgtgacttcagc

SEQ ID NO: 6133523 - DNA, 18 bp, Homo sapiens
ctacttctagctgtattt

SEQ ID NO: 6133524 - DNA, 21 bp, Homo sapiens
ctacttctctgagtcagctga

SEQ ID NO: 6133525 - DNA, 13 bp, Homo sapiens
ctacttctcttgc

SEQ ID NO: 6133526 - DNA, 18 bp, Homo sapiens
ctacttctgtaattgtgt

SEQ ID NO: 6133527 - DNA, 15 bp, Homo sapiens
ctacttctgtgtctg

SEQ ID NO: 6133528 - DNA, 20 bp, Homo sapiens
ctacttctgtgtctgtcacc

SEQ ID NO: 6133529 - DNA, 15 bp, Homo sapiens
ctacttcttggaaaa

SEQ ID NO: 6133530 - DNA, 17 bp, Homo sapiens
ctacttcttggaaaaaa

SEQ ID NO: 6133531 - DNA, 17 bp, Homo sapiens
ctctgattctacagtga

SEQ ID NO: 6133532 - DNA, 15 bp, Homo sapiens
ctctgattctatgta

SEQ ID NO: 6133533 - DNA, 18 bp, Homo sapiens
ctctgattctatgtaact

SEQ ID NO: 6133534 - DNA, 19 bp, Homo sapiens
ctctgattctatgtaactt

SEQ ID NO: 6133535 - DNA, 18 bp, Homo sapiens
ctctgattggaatttctg

SEQ ID NO: 6133536 - DNA, 18 bp, Homo sapiens
ctctgatttattttgtat

SEQ ID NO: 6133537 - DNA, 13 bp, Homo sapiens
ctctgatttcaag

SEQ ID NO: 6133538 - DNA, 15 bp, Homo sapiens
ctctgatttcaaggc

SEQ ID NO: 6133539 - DNA, 14 bp, Homo sapiens
ctctgatttccttc

SEQ ID NO: 6133540 - DNA, 20 bp, Homo sapiens
ctctgattttcaaagctttt

SEQ ID NO: 6133541 - DNA, 18 bp, Homo sapiens
ctctgattttgatatttt

SEQ ID NO: 6133542 - DNA, 18 bp, Homo sapiens
ctctgattttttactggc

SEQ ID NO: 6133543 - DNA, 17 bp, Homo sapiens
ctctgcaaaaggagaga

SEQ ID NO: 6133544 - DNA, 20 bp, Homo sapiens
ctctgcaaactgccttcttc

SEQ ID NO: 6133545 - DNA, 17 bp, Homo sapiens
ctctgcaaccccccagc

SEQ ID NO: 6133546 - DNA, 13 bp, Homo sapiens
ctctgcaactgaa

SEQ ID NO: 6133547 - DNA, 22 bp, Homo sapiens
ctctgcaagaattgaagcagga

SEQ ID NO: 6133548 - DNA, 18 bp, Homo sapiens
ctctgcaagacagaaacc

SEQ ID NO: 6133549 - DNA, 21 bp, Homo sapiens
ctctgcaagacagaaacctcc

SEQ ID NO: 6133550 - DNA, 21 bp, Homo sapiens
ctctgcaagattctgtgggca

SEQ ID NO: 6133551 - DNA, 20 bp, Homo sapiens
ctctgcaagcttcttgctga

SEQ ID NO: 6133552 - DNA, 22 bp, Homo sapiens
ctctgcaagcttcttgctgatc

SEQ ID NO: 6133553 - DNA, 14 bp, Homo sapiens
ctctgcaagtgctc

SEQ ID NO: 6133554 - DNA, 19 bp, Homo sapiens
ctctgcaagtgctcaggga

SEQ ID NO: 6133555 - DNA, 20 bp, Homo sapiens
ctctgcaagtgtctggagcg

SEQ ID NO: 6133556 - DNA, 14 bp, Homo sapiens
ctctgcaatgcttc

SEQ ID NO: 6133557 - DNA, 18 bp, Homo sapiens
ctctgcaatgggcactgg

SEQ ID NO: 6133558 - DNA, 23 bp, Homo sapiens
ctctgcaatgggcactgggatga

SEQ ID NO: 6133559 - DNA, 15 bp, Homo sapiens
ctctgcaattcccct

SEQ ID NO: 6133560 - DNA, 20 bp, Homo sapiens
ctctgcaattcccctctgct

SEQ ID NO: 6133561 - DNA, 17 bp, Homo sapiens
ctctgcaattttactgt

SEQ ID NO: 6133562 - DNA, 21 bp, Homo sapiens
ctctgcaattttactgtgaaa

SEQ ID NO: 6133563 - DNA, 22 bp, Homo sapiens
ctctgcaattttactgtgaaaa

SEQ ID NO: 6133564 - DNA, 10 bp, Homo sapiens
ctctgcacaa

SEQ ID NO: 6133565 - DNA, 14 bp, Homo sapiens
ctctgcacaagctg

SEQ ID NO: 6133566 - DNA, 18 bp, Homo sapiens
ctctgcacaagctgcacc

SEQ ID NO: 6133567 - DNA, 19 bp, Homo sapiens
ctctgcacacaagaggcta

SEQ ID NO: 6133568 - DNA, 23 bp, Homo sapiens
ctctgcacagaaacttgaactcc

SEQ ID NO: 6133569 - DNA, 17 bp, Homo sapiens
ctctgcacagacaagca

SEQ ID NO: 6133570 - DNA, 18 bp, Homo sapiens
ctctgcacagacaagcag

SEQ ID NO: 6133571 - DNA, 14 bp, Homo sapiens
ctctgcacagatgg

SEQ ID NO: 6133572 - DNA, 15 bp, Homo sapiens
ctctgcacccagaac

SEQ ID NO: 6133573 - DNA, 21 bp, Homo sapiens
ctctgcacctaatccccataa

SEQ ID NO: 6133574 - DNA, 13 bp, Homo sapiens
ctctgcacctgtc

SEQ ID NO: 6133575 - DNA, 14 bp, Homo sapiens
ctctgcaccttctg

SEQ ID NO: 6133576 - DNA, 22 bp, Homo sapiens
ctctgcacgctcaatgcccagt

SEQ ID NO: 6133577 - DNA, 14 bp, Homo sapiens
ctctgcacggggga

SEQ ID NO: 6133578 - DNA, 16 bp, Homo sapiens
ctctgcacgtgcacac

SEQ ID NO: 6133579 - DNA, 17 bp, Homo sapiens
ctctgcacgtgcacaca

SEQ ID NO: 6133580 - DNA, 19 bp, Homo sapiens
ctctgcacgtgcacacacc

SEQ ID NO: 6133581 - DNA, 20 bp, Homo sapiens
ctctgcacgtgcacacacct

SEQ ID NO: 6133582 - DNA, 22 bp, Homo sapiens
ctctgcactactcctctgcagt

SEQ ID NO: 6133583 - DNA, 18 bp, Homo sapiens
ctctgcactactgacatg

SEQ ID NO: 6133584 - DNA, 16 bp, Homo sapiens
ctctgcactatagcca

SEQ ID NO: 6133585 - DNA, 16 bp, Homo sapiens
ctctgcactccatggc

SEQ ID NO: 6133586 - DNA, 17 bp, Homo sapiens
ctctgcactcccctgct

SEQ ID NO: 6133587 - DNA, 15 bp, Homo sapiens
ctctgcactctccac

SEQ ID NO: 6133588 - DNA, 18 bp, Homo sapiens
ctctgcactgggaattta

SEQ ID NO: 6133589 - DNA, 16 bp, Homo sapiens
ctctgcagaacagtga

SEQ ID NO: 6133590 - DNA, 18 bp, Homo sapiens
ctctgcagactgctagtg

SEQ ID NO: 6133591 - DNA, 17 bp, Homo sapiens
ctctgcagacttcccag

SEQ ID NO: 6133592 - DNA, 13 bp, Homo sapiens
ctctgcagcaata

SEQ ID NO: 6133593 - DNA, 23 bp, Homo sapiens
ctctgcagcaataaagcagcgtt

SEQ ID NO: 6133594 - DNA, 17 bp, Homo sapiens
ctctgcagcaatattct

SEQ ID NO: 6133595 - DNA, 21 bp, Homo sapiens
ctctgcagcacattgccctga

SEQ ID NO: 6133596 - DNA, 14 bp, Homo sapiens
ctctgcagccagcc

SEQ ID NO: 6133597 - DNA, 12 bp, Homo sapiens
ctctgcagccca

SEQ ID NO: 6133598 - DNA, 14 bp, Homo sapiens
ctctgcagcccagc

SEQ ID NO: 6133599 - DNA, 15 bp, Homo sapiens
ctctgcagcccagcc

SEQ ID NO: 6133600 - DNA, 21 bp, Homo sapiens
ctctgcagcccagcctagtca

SEQ ID NO: 6133601 - DNA, 20 bp, Homo sapiens
ctctgcagcccattcccaag

SEQ ID NO: 6133602 - DNA, 15 bp, Homo sapiens
ctctgcagcctcaga

SEQ ID NO: 6133603 - DNA, 23 bp, Homo sapiens
ctctgcagcctgagctccaccct

SEQ ID NO: 6133604 - DNA, 16 bp, Homo sapiens
ctctgcagctgacctc

SEQ ID NO: 6133605 - DNA, 14 bp, Homo sapiens
ctctgcagctgccg

SEQ ID NO: 6133606 - DNA, 12 bp, Homo sapiens
ctctgcaggaaa

SEQ ID NO: 6133607 - DNA, 21 bp, Homo sapiens
ctctgcaggaaatcagagctg

SEQ ID NO: 6133608 - DNA, 15 bp, Homo sapiens
ctctgcaggatgggt

SEQ ID NO: 6133609 - DNA, 23 bp, Homo sapiens
ctctgcaggcagatttactgtcc

SEQ ID NO: 6133610 - DNA, 20 bp, Homo sapiens
ctctgcaggccactgtgagc

SEQ ID NO: 6133611 - DNA, 14 bp, Homo sapiens
ctctgcaggctggg

SEQ ID NO: 6133612 - DNA, 15 bp, Homo sapiens
ctctgcaggctgggg

SEQ ID NO: 6133613 - DNA, 16 bp, Homo sapiens
ctctgcaggctgggga

SEQ ID NO: 6133614 - DNA, 13 bp, Homo sapiens
ctctgcagggcag

SEQ ID NO: 6133615 - DNA, 13 bp, Homo sapiens
ctctgcagggccg

SEQ ID NO: 6133616 - DNA, 18 bp, Homo sapiens
ctctgcagggtgaagcac

SEQ ID NO: 6133617 - DNA, 22 bp, Homo sapiens
ctctgcagggtgaagcaccagg

SEQ ID NO: 6133618 - DNA, 20 bp, Homo sapiens
ctctgcaggtccctaataaa

SEQ ID NO: 6133619 - DNA, 18 bp, Homo sapiens
ctctgcagtaaaacacat

SEQ ID NO: 6133620 - DNA, 21 bp, Homo sapiens
ctctgcagtcctcggcagctc

SEQ ID NO: 6133621 - DNA, 17 bp, Homo sapiens
ctctgcagtcctggccc

SEQ ID NO: 6133622 - DNA, 17 bp, Homo sapiens
ctctgcagtctcatttc

SEQ ID NO: 6133623 - DNA, 16 bp, Homo sapiens
ctctgcagtgccttgg

SEQ ID NO: 6133624 - DNA, 19 bp, Homo sapiens
ctctgcataagattatata

SEQ ID NO: 6133625 - DNA, 23 bp, Homo sapiens
ctctgcatcccagcacctgcctc

SEQ ID NO: 6133626 - DNA, 17 bp, Homo sapiens
ctctgcatcctctggag

SEQ ID NO: 6133627 - DNA, 14 bp, Homo sapiens
ctctgcatctgacc

SEQ ID NO: 6133628 - DNA, 14 bp, Homo sapiens
ctctgcatcttcag

SEQ ID NO: 6133629 - DNA, 22 bp, Homo sapiens
ctctgcatcttcagtcgtctgt

SEQ ID NO: 6133630 - DNA, 16 bp, Homo sapiens
ctctgcatcttgctct

SEQ ID NO: 6133631 - DNA, 13 bp, Homo sapiens
ctctgcatgatta

SEQ ID NO: 6133632 - DNA, 18 bp, Homo sapiens
ctctgcatgcggcccagc

SEQ ID NO: 6133633 - DNA, 19 bp, Homo sapiens
ctctgcatgcggcccagcc

SEQ ID NO: 6133634 - DNA, 20 bp, Homo sapiens
ctctgcatgcggcccagccc

SEQ ID NO: 6133635 - DNA, 20 bp, Homo sapiens
ctctgcatgctcctctgcct

SEQ ID NO: 6133636 - DNA, 21 bp, Homo sapiens
ctctgcatgctcctctgcctg

SEQ ID NO: 6133637 - DNA, 22 bp, Homo sapiens
ctctgcatgctcctctgcctgt

SEQ ID NO: 6133638 - DNA, 15 bp, Homo sapiens
ctctgcattgacctg

SEQ ID NO: 6133639 - DNA, 14 bp, Homo sapiens
ctctgcatttgtct

SEQ ID NO: 6133640 - DNA, 16 bp, Homo sapiens
ctctgcatttttctgc

SEQ ID NO: 6133641 - DNA, 19 bp, Homo sapiens
ctctgcatttttctgcaga

SEQ ID NO: 6133642 - DNA, 20 bp, Homo sapiens
ctctgccaacatgaggacag

SEQ ID NO: 6133643 - DNA, 10 bp, Homo sapiens
ctctgccacc

SEQ ID NO: 6133644 - DNA, 11 bp, Homo sapiens
ctctgccacca

SEQ ID NO: 6133645 - DNA, 13 bp, Homo sapiens
ctctgccacccac

SEQ ID NO: 6133646 - DNA, 23 bp, Homo sapiens
ctctgccaccccaggtttttcat

SEQ ID NO: 6133647 - DNA, 17 bp, Homo sapiens
ctctgccaccctacctg

SEQ ID NO: 6133648 - DNA, 20 bp, Homo sapiens
ctctgccaccctacctgttc

SEQ ID NO: 6133649 - DNA, 14 bp, Homo sapiens
ctctgccacctccc

SEQ ID NO: 6133650 - DNA, 18 bp, Homo sapiens
ctctgccacctcccctat

SEQ ID NO: 6133651 - DNA, 22 bp, Homo sapiens
ctctgccagaagatcccctcag

SEQ ID NO: 6133652 - DNA, 16 bp, Homo sapiens
ctctgccagcaaagag

SEQ ID NO: 6133653 - DNA, 14 bp, Homo sapiens
ctctgccagcagga

SEQ ID NO: 6133654 - DNA, 16 bp, Homo sapiens
ctctgccagcaggaat

SEQ ID NO: 6133655 - DNA, 12 bp, Homo sapiens
ctctgccagccg

SEQ ID NO: 6133656 - DNA, 14 bp, Homo sapiens
ctctgccagcgtcc

SEQ ID NO: 6133657 - DNA, 22 bp, Homo sapiens
ctctgccagctccacagggtgg

SEQ ID NO: 6133658 - DNA, 13 bp, Homo sapiens
ctctgccagggtg

SEQ ID NO: 6133659 - DNA, 14 bp, Homo sapiens
ctctgccagtcctg

SEQ ID NO: 6133660 - DNA, 15 bp, Homo sapiens
ctctgccagtcctgt

SEQ ID NO: 6133661 - DNA, 22 bp, Homo sapiens
ctctgccagtcgggagagccag

SEQ ID NO: 6133662 - DNA, 14 bp, Homo sapiens
ctctgccagtgaca

SEQ ID NO: 6133663 - DNA, 20 bp, Homo sapiens
ctctgccagtgacagacagg

SEQ ID NO: 6133664 - DNA, 18 bp, Homo sapiens
ctctgccagttacttggg

SEQ ID NO: 6133665 - DNA, 20 bp, Homo sapiens
ctctgccagttacttgggct

SEQ ID NO: 6133666 - DNA, 22 bp, Homo sapiens
ctctgccagttacttgggcttc

SEQ ID NO: 6133667 - DNA, 14 bp, Homo sapiens
ctctgccatcagcc

SEQ ID NO: 6133668 - DNA, 17 bp, Homo sapiens
ctctgccatcctccctg

SEQ ID NO: 6133669 - DNA, 21 bp, Homo sapiens
ctctgccatcctccctgttcc

SEQ ID NO: 6133670 - DNA, 16 bp, Homo sapiens
ctctgccatcttcagg

SEQ ID NO: 6133671 - DNA, 17 bp, Homo sapiens
ctctgccattctgtgca

SEQ ID NO: 6133672 - DNA, 23 bp, Homo sapiens
ctctgcccaaccaggttgcagta

SEQ ID NO: 6133673 - DNA, 18 bp, Homo sapiens
ctctgcccaagttgctct

SEQ ID NO: 6133674 - DNA, 21 bp, Homo sapiens
ctctgcccaagttgctctgta

SEQ ID NO: 6133675 - DNA, 12 bp, Homo sapiens
ctctgcccacct

SEQ ID NO: 6133676 - DNA, 15 bp, Homo sapiens
ctctgcccacctctc

SEQ ID NO: 6133677 - DNA, 14 bp, Homo sapiens
ctctgcccacctgg

SEQ ID NO: 6133678 - DNA, 19 bp, Homo sapiens
ctctgcccacctggggtct

SEQ ID NO: 6133679 - DNA, 13 bp, Homo sapiens
ctctgcccactcc

SEQ ID NO: 6133680 - DNA, 17 bp, Homo sapiens
ctctgcccactccctgc

SEQ ID NO: 6133681 - DNA, 18 bp, Homo sapiens
ctctgcccactccctgca

SEQ ID NO: 6133682 - DNA, 15 bp, Homo sapiens
ctctgcccagagctg

SEQ ID NO: 6133683 - DNA, 14 bp, Homo sapiens
ctctgcccagcctg

SEQ ID NO: 6133684 - DNA, 15 bp, Homo sapiens
ctctgcccagcctgc

SEQ ID NO: 6133685 - DNA, 23 bp, Homo sapiens
ctctgcccagcctgccccagcct

SEQ ID NO: 6133686 - DNA, 13 bp, Homo sapiens
ctctgcccagctt

SEQ ID NO: 6133687 - DNA, 20 bp, Homo sapiens
ctctgcccaggaactcgcac

SEQ ID NO: 6133688 - DNA, 12 bp, Homo sapiens
ctctgcccatgc

SEQ ID NO: 6133689 - DNA, 18 bp, Homo sapiens
ctctgcccattccccagc

SEQ ID NO: 6133690 - DNA, 12 bp, Homo sapiens
ctctgccccaag

SEQ ID NO: 6133691 - DNA, 16 bp, Homo sapiens
ctctgccccaagagca

SEQ ID NO: 6133692 - DNA, 22 bp, Homo sapiens
ctctgccccaagagcaggaggt

SEQ ID NO: 6133693 - DNA, 22 bp, Homo sapiens
ctctgccccaagcagccagcca

SEQ ID NO: 6133694 - DNA, 15 bp, Homo sapiens
ctctgccccaagggg

SEQ ID NO: 6133695 - DNA, 17 bp, Homo sapiens
ctctgccccaaggggcc

SEQ ID NO: 6133696 - DNA, 22 bp, Homo sapiens
ctctgccccaaggggcccacaa

SEQ ID NO: 6133697 - DNA, 13 bp, Homo sapiens
ctctgccccaccc

SEQ ID NO: 6133698 - DNA, 15 bp, Homo sapiens
ctctgccccaccctc

SEQ ID NO: 6133699 - DNA, 19 bp, Homo sapiens
ctctgccccaccctcagcc

SEQ ID NO: 6133700 - DNA, 15 bp, Homo sapiens
ctctgccccagaggc

SEQ ID NO: 6133701 - DNA, 22 bp, Homo sapiens
ctctgccccagaggcctctctc

SEQ ID NO: 6133702 - DNA, 18 bp, Homo sapiens
ctctgccccagctctggc

SEQ ID NO: 6133703 - DNA, 21 bp, Homo sapiens
ctctgccccagcttgggcaga

SEQ ID NO: 6133704 - DNA, 15 bp, Homo sapiens
ctctgccccaggccc

SEQ ID NO: 6133705 - DNA, 12 bp, Homo sapiens
ctctgccccagt

SEQ ID NO: 6133706 - DNA, 22 bp, Homo sapiens
ctctgcccccaactcccggagg

SEQ ID NO: 6133707 - DNA, 20 bp, Homo sapiens
ctctgcccccagcctctgtc

SEQ ID NO: 6133708 - DNA, 19 bp, Homo sapiens
ctctgcccccagctgctcc

SEQ ID NO: 6133709 - DNA, 21 bp, Homo sapiens
ctctgcccccagctgctcctc

SEQ ID NO: 6133710 - DNA, 22 bp, Homo sapiens
ctacttcttttgctcttagctg

SEQ ID NO: 6133711 - DNA, 14 bp, Homo sapiens
ctacttgagagtgg

SEQ ID NO: 6133712 - DNA, 21 bp, Homo sapiens
ctacttgagataatctaaata

SEQ ID NO: 6133713 - DNA, 20 bp, Homo sapiens
ctacttgataatattagtga

SEQ ID NO: 6133714 - DNA, 14 bp, Homo sapiens
ctacttgatataat

SEQ ID NO: 6133715 - DNA, 20 bp, Homo sapiens
ctacttgatgtaactgagaa

SEQ ID NO: 6133716 - DNA, 17 bp, Homo sapiens
ctacttgattttattgt

SEQ ID NO: 6133717 - DNA, 17 bp, Homo sapiens
ctacttgctctgctcta

SEQ ID NO: 6133718 - DNA, 17 bp, Homo sapiens
ctacttgctctggacct

SEQ ID NO: 6133719 - DNA, 21 bp, Homo sapiens
ctacttgcttattacatttaa

SEQ ID NO: 6133720 - DNA, 22 bp, Homo sapiens
ctacttggcaaggtcatagaca

SEQ ID NO: 6133721 - DNA, 19 bp, Homo sapiens
ctacttggcaggctgaggt

SEQ ID NO: 6133722 - DNA, 15 bp, Homo sapiens
ctacttgggagcctg

SEQ ID NO: 6133723 - DNA, 12 bp, Homo sapiens
ctacttgggagg

SEQ ID NO: 6133724 - DNA, 13 bp, Homo sapiens
ctacttgggaggc

SEQ ID NO: 6133725 - DNA, 18 bp, Homo sapiens
ctacttgggaggctgaga

SEQ ID NO: 6133726 - DNA, 19 bp, Homo sapiens
ctacttgggaggctgagat

SEQ ID NO: 6133727 - DNA, 18 bp, Homo sapiens
ctacttggggacataatt

SEQ ID NO: 6133728 - DNA, 15 bp, Homo sapiens
ctacttgtaatttct

SEQ ID NO: 6133729 - DNA, 13 bp, Homo sapiens
ctacttgtgtttt

SEQ ID NO: 6133730 - DNA, 16 bp, Homo sapiens
ctacttgttcatttgg

SEQ ID NO: 6133731 - DNA, 20 bp, Homo sapiens
ctactttaaatcctaccaaa

SEQ ID NO: 6133732 - DNA, 21 bp, Homo sapiens
ctactttaacctatgataatt

SEQ ID NO: 6133733 - DNA, 15 bp, Homo sapiens
ctactttaagcacta

SEQ ID NO: 6133734 - DNA, 12 bp, Homo sapiens
ctactttataat

SEQ ID NO: 6133735 - DNA, 13 bp, Homo sapiens
ctactttatgtaa

SEQ ID NO: 6133736 - DNA, 18 bp, Homo sapiens
ctactttcatcttaaact

SEQ ID NO: 6133737 - DNA, 22 bp, Homo sapiens
ctactttcatcttaaactaata

SEQ ID NO: 6133738 - DNA, 14 bp, Homo sapiens
ctactttcctgatg

SEQ ID NO: 6133739 - DNA, 16 bp, Homo sapiens
ctactttctattcttt

SEQ ID NO: 6133740 - DNA, 13 bp, Homo sapiens
ctactttctctct

SEQ ID NO: 6133741 - DNA, 17 bp, Homo sapiens
ctactttctctctcttt

SEQ ID NO: 6133742 - DNA, 14 bp, Homo sapiens
ctactttctcttgt

SEQ ID NO: 6133743 - DNA, 18 bp, Homo sapiens
ctactttctcttgtttaa

SEQ ID NO: 6133744 - DNA, 15 bp, Homo sapiens
ctactttctgttatc

SEQ ID NO: 6133745 - DNA, 19 bp, Homo sapiens
ctactttgaaaacaattca

SEQ ID NO: 6133746 - DNA, 14 bp, Homo sapiens
ctactttgactaat

SEQ ID NO: 6133747 - DNA, 18 bp, Homo sapiens
ctactttgactttttgca

SEQ ID NO: 6133748 - DNA, 13 bp, Homo sapiens
ctactttgcccct

SEQ ID NO: 6133749 - DNA, 20 bp, Homo sapiens
ctactttgcccctttcagta

SEQ ID NO: 6133750 - DNA, 16 bp, Homo sapiens
ctactttgcctcttca

SEQ ID NO: 6133751 - DNA, 19 bp, Homo sapiens
ctactttgcttccgccact

SEQ ID NO: 6133752 - DNA, 24 bp, Homo sapiens
ctactttggcattgctgcatattt

SEQ ID NO: 6133753 - DNA, 14 bp, Homo sapiens
ctactttgtccttt

SEQ ID NO: 6133754 - DNA, 22 bp, Homo sapiens
ctacttttaaagaatttcttta

SEQ ID NO: 6133755 - DNA, 14 bp, Homo sapiens
ctacttttacttgt

SEQ ID NO: 6133756 - DNA, 22 bp, Homo sapiens
ctacttttgcttttttatttac

SEQ ID NO: 6133757 - DNA, 20 bp, Homo sapiens
ctacttttgtaccagtgtga

SEQ ID NO: 6133758 - DNA, 16 bp, Homo sapiens
ctactttttaattttt

SEQ ID NO: 6133759 - DNA, 21 bp, Homo sapiens
ctactttttaatttttaagag

SEQ ID NO: 6133760 - DNA, 15 bp, Homo sapiens
ctactttttccttcc

SEQ ID NO: 6133761 - DNA, 16 bp, Homo sapiens
ctactttttccttcct

SEQ ID NO: 6133762 - DNA, 11 bp, Homo sapiens
ctactttttgt

SEQ ID NO: 6133763 - DNA, 18 bp, Homo sapiens
ctactttttgtatttagt

SEQ ID NO: 6133764 - DNA, 18 bp, Homo sapiens
ctagaaaaataaaatgtt

SEQ ID NO: 6133765 - DNA, 13 bp, Homo sapiens
ctagaaaacaagc

SEQ ID NO: 6133766 - DNA, 18 bp, Homo sapiens
ctagaaaacaagcgttta

SEQ ID NO: 6133767 - DNA, 22 bp, Homo sapiens
ctagaaaacttgactccatttc

SEQ ID NO: 6133768 - DNA, 17 bp, Homo sapiens
ctagaaaagcttcctag

SEQ ID NO: 6133769 - DNA, 18 bp, Homo sapiens
ctagaaaaggcattttgg

SEQ ID NO: 6133770 - DNA, 20 bp, Homo sapiens
ctagaaaataatgcaaatgt

SEQ ID NO: 6133771 - DNA, 22 bp, Homo sapiens
ctagaaaataatgcaaatgtca

SEQ ID NO: 6133772 - DNA, 23 bp, Homo sapiens
ctagaaaatgagaaaattgtctg

SEQ ID NO: 6133773 - DNA, 18 bp, Homo sapiens
ctagaaacaacactgtag

SEQ ID NO: 6133774 - DNA, 19 bp, Homo sapiens
ctagaaacaacactgtagt

SEQ ID NO: 6133775 - DNA, 17 bp, Homo sapiens
ctagaaaccagtatgga

SEQ ID NO: 6133776 - DNA, 22 bp, Homo sapiens
ctagaaaccagtatggaaggga

SEQ ID NO: 6133777 - DNA, 14 bp, Homo sapiens
ctagaaacccaagc

SEQ ID NO: 6133778 - DNA, 14 bp, Homo sapiens
ctagaaacttccaa

SEQ ID NO: 6133779 - DNA, 22 bp, Homo sapiens
ctagaaagaaaagaccctgaga

SEQ ID NO: 6133780 - DNA, 23 bp, Homo sapiens
ctagaaagaaaagaccctgagac

SEQ ID NO: 6133781 - DNA, 18 bp, Homo sapiens
ctagaaagaagctcgccc

SEQ ID NO: 6133782 - DNA, 18 bp, Homo sapiens
ctagaaagaatatttggt

SEQ ID NO: 6133783 - DNA, 22 bp, Homo sapiens
ctagaaagagaaaaagccctct

SEQ ID NO: 6133784 - DNA, 21 bp, Homo sapiens
ctagaaagcagagattttcaa

SEQ ID NO: 6133785 - DNA, 16 bp, Homo sapiens
ctagaaagccatattc

SEQ ID NO: 6133786 - DNA, 19 bp, Homo sapiens
ctagaaagccatattccag

SEQ ID NO: 6133787 - DNA, 20 bp, Homo sapiens
ctagaaagcccctcacctca

SEQ ID NO: 6133788 - DNA, 20 bp, Homo sapiens
ctagaaagctttgaatgcag

SEQ ID NO: 6133789 - DNA, 23 bp, Homo sapiens
ctagaaagtgaataaaaattaag

SEQ ID NO: 6133790 - DNA, 20 bp, Homo sapiens
ctagaaagtggcagagccag

SEQ ID NO: 6133791 - DNA, 22 bp, Homo sapiens
ctagaaagtggcagagccagga

SEQ ID NO: 6133792 - DNA, 20 bp, Homo sapiens
ctagaaagttagggggttct

SEQ ID NO: 6133793 - DNA, 17 bp, Homo sapiens
ctagaaatacacttttt

SEQ ID NO: 6133794 - DNA, 20 bp, Homo sapiens
ctagaaatatattcataata

SEQ ID NO: 6133795 - DNA, 18 bp, Homo sapiens
ctagaaatctgtcctgtg

SEQ ID NO: 6133796 - DNA, 19 bp, Homo sapiens
ctagaaatgggaatcatgg

SEQ ID NO: 6133797 - DNA, 19 bp, Homo sapiens
ctagaaatgtgaatgagga

SEQ ID NO: 6133798 - DNA, 16 bp, Homo sapiens
ctagaaattgacacaa

SEQ ID NO: 6133799 - DNA, 20 bp, Homo sapiens
ctagaaattgacacaagtgg

SEQ ID NO: 6133800 - DNA, 16 bp, Homo sapiens
ctagaaattgggcagt

SEQ ID NO: 6133801 - DNA, 13 bp, Homo sapiens
ctagaaattttca

SEQ ID NO: 6133802 - DNA, 13 bp, Homo sapiens
ctagaaatttttc

SEQ ID NO: 6133803 - DNA, 17 bp, Homo sapiens
ctagaacaagccagagc

SEQ ID NO: 6133804 - DNA, 16 bp, Homo sapiens
ctagaacacagaaagc

SEQ ID NO: 6133805 - DNA, 16 bp, Homo sapiens
ctagaacacccactgg

SEQ ID NO: 6133806 - DNA, 20 bp, Homo sapiens
ctagaacacccactggccag

SEQ ID NO: 6133807 - DNA, 18 bp, Homo sapiens
ctagaacatccttaaatg

SEQ ID NO: 6133808 - DNA, 20 bp, Homo sapiens
ctagaacatgcacatttata

SEQ ID NO: 6133809 - DNA, 15 bp, Homo sapiens
ctagaaccaagcact

SEQ ID NO: 6133810 - DNA, 17 bp, Homo sapiens
ctagaaccaagcttcag

SEQ ID NO: 6133811 - DNA, 22 bp, Homo sapiens
ctagaaccaagcttcagagcct

SEQ ID NO: 6133812 - DNA, 23 bp, Homo sapiens
ctagaaccaagcttcagagccta

SEQ ID NO: 6133813 - DNA, 14 bp, Homo sapiens
ctagaaccctctgt

SEQ ID NO: 6133814 - DNA, 17 bp, Homo sapiens
ctagaacctagaagggc

SEQ ID NO: 6133815 - DNA, 18 bp, Homo sapiens
ctagaacctccctccttt

SEQ ID NO: 6133816 - DNA, 21 bp, Homo sapiens
ctagaacctccctcctttcct

SEQ ID NO: 6133817 - DNA, 14 bp, Homo sapiens
ctagaacctgggct

SEQ ID NO: 6133818 - DNA, 22 bp, Homo sapiens
ctagaaccttctagaacctggg

SEQ ID NO: 6133819 - DNA, 20 bp, Homo sapiens
ctagaacgcttcgggaaaat

SEQ ID NO: 6133820 - DNA, 21 bp, Homo sapiens
ctagaactcctgtcttctttc

SEQ ID NO: 6133821 - DNA, 22 bp, Homo sapiens
ctagaactcctgtcttctttct

SEQ ID NO: 6133822 - DNA, 15 bp, Homo sapiens
ctagaactgaatttt

SEQ ID NO: 6133823 - DNA, 11 bp, Homo sapiens
ctagaactttt

SEQ ID NO: 6133824 - DNA, 19 bp, Homo sapiens
ctagaacttttttaaataa

SEQ ID NO: 6133825 - DNA, 21 bp, Homo sapiens
ctagaacttttttaaataaac

SEQ ID NO: 6133826 - DNA, 15 bp, Homo sapiens
ctagaagaaaacccg

SEQ ID NO: 6133827 - DNA, 20 bp, Homo sapiens
ctagaagaaagtaaaaagaa

SEQ ID NO: 6133828 - DNA, 12 bp, Homo sapiens
ctagaagaacaa

SEQ ID NO: 6133829 - DNA, 18 bp, Homo sapiens
ctagaagaaccaaatacc

SEQ ID NO: 6133830 - DNA, 17 bp, Homo sapiens
ctagaagagtctattgt

SEQ ID NO: 6133831 - DNA, 19 bp, Homo sapiens
ctagaagagtctattgtct

SEQ ID NO: 6133832 - DNA, 19 bp, Homo sapiens
ctagaagatcacagcaggg

SEQ ID NO: 6133833 - DNA, 21 bp, Homo sapiens
ctagaagatgaatacaaacaa

SEQ ID NO: 6133834 - DNA, 21 bp, Homo sapiens
ctagaagatgcagttcaaaaa

SEQ ID NO: 6133835 - DNA, 16 bp, Homo sapiens
ctagaagatgtgtaaa

SEQ ID NO: 6133836 - DNA, 16 bp, Homo sapiens
ctagaagcacatgtgt

SEQ ID NO: 6133837 - DNA, 12 bp, Homo sapiens
ctagaagcagaa

SEQ ID NO: 6133838 - DNA, 20 bp, Homo sapiens
ctagaagccaagggaaaggg

SEQ ID NO: 6133839 - DNA, 18 bp, Homo sapiens
ctagaagcctaagaactg

SEQ ID NO: 6133840 - DNA, 13 bp, Homo sapiens
ctagaagctcagg

SEQ ID NO: 6133841 - DNA, 22 bp, Homo sapiens
ctagaagctcaggttccctgcc

SEQ ID NO: 6133842 - DNA, 23 bp, Homo sapiens
ctagaagctcaggttccctgcca

SEQ ID NO: 6133843 - DNA, 16 bp, Homo sapiens
ctagaagctccatgga

SEQ ID NO: 6133844 - DNA, 14 bp, Homo sapiens
ctagaaggccacat

SEQ ID NO: 6133845 - DNA, 15 bp, Homo sapiens
ctagaaggccaggcc

SEQ ID NO: 6133846 - DNA, 23 bp, Homo sapiens
ctagaagggccagtcctgcctgg

SEQ ID NO: 6133847 - DNA, 17 bp, Homo sapiens
ctagaaggtttgggaac

SEQ ID NO: 6133848 - DNA, 22 bp, Homo sapiens
ctagaagtaactggtgatatat

SEQ ID NO: 6133849 - DNA, 21 bp, Homo sapiens
ctagaagtaagaagaggagcc

SEQ ID NO: 6133850 - DNA, 15 bp, Homo sapiens
ctagaagtatttgtg

SEQ ID NO: 6133851 - DNA, 23 bp, Homo sapiens
ctagaagtctgtccaaatttaaa

SEQ ID NO: 6133852 - DNA, 20 bp, Homo sapiens
ctagaagtcttaattgtgtt

SEQ ID NO: 6133853 - DNA, 20 bp, Homo sapiens
ctagaagtgggccaggacag

SEQ ID NO: 6133854 - DNA, 20 bp, Homo sapiens
ctagaagtgtgaagtgcaga

SEQ ID NO: 6133855 - DNA, 15 bp, Homo sapiens
ctagaagttactgaa

SEQ ID NO: 6133856 - DNA, 16 bp, Homo sapiens
ctagaagttactgaat

SEQ ID NO: 6133857 - DNA, 16 bp, Homo sapiens
ctagaataatctcatc

SEQ ID NO: 6133858 - DNA, 20 bp, Homo sapiens
ctagaataatctcatccccc

SEQ ID NO: 6133859 - DNA, 16 bp, Homo sapiens
ctagaataatcttgct

SEQ ID NO: 6133860 - DNA, 18 bp, Homo sapiens
ctagaatactaataaaat

SEQ ID NO: 6133861 - DNA, 18 bp, Homo sapiens
ctagaatactttttaaaa

SEQ ID NO: 6133862 - DNA, 21 bp, Homo sapiens
ctagaatatcctacttctcca

SEQ ID NO: 6133863 - DNA, 22 bp, Homo sapiens
ctagaatcatgtattttgtaaa

SEQ ID NO: 6133864 - DNA, 14 bp, Homo sapiens
ctagaatccacaca

SEQ ID NO: 6133865 - DNA, 17 bp, Homo sapiens
ctagaatccacacatat

SEQ ID NO: 6133866 - DNA, 19 bp, Homo sapiens
ctagaatctgcaattcaaa

SEQ ID NO: 6133867 - DNA, 20 bp, Homo sapiens
ctagaatctggagagctaga

SEQ ID NO: 6133868 - DNA, 12 bp, Homo sapiens
ctagaatggata

SEQ ID NO: 6133869 - DNA, 20 bp, Homo sapiens
ctagaatggtttttgttgag

SEQ ID NO: 6133870 - DNA, 22 bp, Homo sapiens
ctagaatgtaaagttatgtatt

SEQ ID NO: 6133871 - DNA, 18 bp, Homo sapiens
ctagaattagtatgtctg

SEQ ID NO: 6133872 - DNA, 16 bp, Homo sapiens
ctagaattcactgagt

SEQ ID NO: 6133873 - DNA, 16 bp, Homo sapiens
ctagaattctagtgct

SEQ ID NO: 6133874 - DNA, 20 bp, Homo sapiens
ctagaattctagtgctgctg

SEQ ID NO: 6133875 - DNA, 15 bp, Homo sapiens
ctagaattgattttt

SEQ ID NO: 6133876 - DNA, 12 bp, Homo sapiens
ctagaatttatt

SEQ ID NO: 6133877 - DNA, 15 bp, Homo sapiens
ctagaatttattcaa

SEQ ID NO: 6133878 - DNA, 23 bp, Homo sapiens
ctagaatttattcaattcctctg

SEQ ID NO: 6133879 - DNA, 16 bp, Homo sapiens
ctagaatttgtatttt

SEQ ID NO: 6133880 - DNA, 14 bp, Homo sapiens
ctagaattttaagc

SEQ ID NO: 6133881 - DNA, 15 bp, Homo sapiens
ctagaattttaagcc

SEQ ID NO: 6133882 - DNA, 14 bp, Homo sapiens
ctagacaaaatcaa

SEQ ID NO: 6133883 - DNA, 20 bp, Homo sapiens
ctagacaaacaagggagaag

SEQ ID NO: 6133884 - DNA, 21 bp, Homo sapiens
ctagacaaacaagggagaaga

SEQ ID NO: 6133885 - DNA, 22 bp, Homo sapiens
ctagacaaaggcccagaaatca

SEQ ID NO: 6133886 - DNA, 20 bp, Homo sapiens
ctagacaaccagaggctggc

SEQ ID NO: 6133887 - DNA, 23 bp, Homo sapiens
ctctgcccccgcgggttctagac

SEQ ID NO: 6133888 - DNA, 15 bp, Homo sapiens
ctctgcccccgctga

SEQ ID NO: 6133889 - DNA, 16 bp, Homo sapiens
ctctgccccctccccc

SEQ ID NO: 6133890 - DNA, 21 bp, Homo sapiens
ctctgccccctcccccgcaga

SEQ ID NO: 6133891 - DNA, 17 bp, Homo sapiens
ctctgccccctgctggc

SEQ ID NO: 6133892 - DNA, 19 bp, Homo sapiens
ctctgccccgtttcttgcc

SEQ ID NO: 6133893 - DNA, 13 bp, Homo sapiens
ctctgcccctcac

SEQ ID NO: 6133894 - DNA, 15 bp, Homo sapiens
ctctgcccctcaggg

SEQ ID NO: 6133895 - DNA, 19 bp, Homo sapiens
ctctgcccctcagggggcc

SEQ ID NO: 6133896 - DNA, 23 bp, Homo sapiens
ctctgcccctcccccagccatgc

SEQ ID NO: 6133897 - DNA, 17 bp, Homo sapiens
ctctgcccctgcagctg

SEQ ID NO: 6133898 - DNA, 18 bp, Homo sapiens
ctctgcccctgcagctgg

SEQ ID NO: 6133899 - DNA, 19 bp, Homo sapiens
ctctgcccctgcagctgga

SEQ ID NO: 6133900 - DNA, 11 bp, Homo sapiens
ctctgcccctt

SEQ ID NO: 6133901 - DNA, 13 bp, Homo sapiens
ctctgccccttcc

SEQ ID NO: 6133902 - DNA, 16 bp, Homo sapiens
ctctgccccttctgtt

SEQ ID NO: 6133903 - DNA, 19 bp, Homo sapiens
ctctgccccttctgtttcc

SEQ ID NO: 6133904 - DNA, 21 bp, Homo sapiens
ctctgccccttgggcatccac

SEQ ID NO: 6133905 - DNA, 17 bp, Homo sapiens
ctctgccccttgggcct

SEQ ID NO: 6133906 - DNA, 20 bp, Homo sapiens
ctctgccccttgggcctccc

SEQ ID NO: 6133907 - DNA, 22 bp, Homo sapiens
ctctgccccttgggcctcccac

SEQ ID NO: 6133908 - DNA, 16 bp, Homo sapiens
ctctgcccgcagagcc

SEQ ID NO: 6133909 - DNA, 19 bp, Homo sapiens
ctctgcccgcgggtggctg

SEQ ID NO: 6133910 - DNA, 16 bp, Homo sapiens
ctctgcccgggcccct

SEQ ID NO: 6133911 - DNA, 20 bp, Homo sapiens
ctctgcccgggccccttgct

SEQ ID NO: 6133912 - DNA, 22 bp, Homo sapiens
ctctgccctcattactgggcct

SEQ ID NO: 6133913 - DNA, 14 bp, Homo sapiens
ctctgccctccaag

SEQ ID NO: 6133914 - DNA, 16 bp, Homo sapiens
ctctgccctccaagac

SEQ ID NO: 6133915 - DNA, 20 bp, Homo sapiens
ctctgccctccctccttcct

SEQ ID NO: 6133916 - DNA, 15 bp, Homo sapiens
ctctgccctccctgg

SEQ ID NO: 6133917 - DNA, 20 bp, Homo sapiens
ctctgccctcccttcttgtg

SEQ ID NO: 6133918 - DNA, 23 bp, Homo sapiens
ctctgccctcgggtggggctggt

SEQ ID NO: 6133919 - DNA, 16 bp, Homo sapiens
ctctgccctctccctg

SEQ ID NO: 6133920 - DNA, 14 bp, Homo sapiens
ctctgccctctgct

SEQ ID NO: 6133921 - DNA, 15 bp, Homo sapiens
ctctgccctgcccta

SEQ ID NO: 6133922 - DNA, 19 bp, Homo sapiens
ctctgccctgccctagctc

SEQ ID NO: 6133923 - DNA, 18 bp, Homo sapiens
ctctgccctgccctggcc

SEQ ID NO: 6133924 - DNA, 13 bp, Homo sapiens
ctctgccctgcct

SEQ ID NO: 6133925 - DNA, 16 bp, Homo sapiens
ctctgccctggaacct

SEQ ID NO: 6133926 - DNA, 15 bp, Homo sapiens
ctctgccctggattg

SEQ ID NO: 6133927 - DNA, 16 bp, Homo sapiens
ctctgccctggattgg

SEQ ID NO: 6133928 - DNA, 18 bp, Homo sapiens
ctctgccctggctgtggg

SEQ ID NO: 6133929 - DNA, 15 bp, Homo sapiens
ctctgccctgggctc

SEQ ID NO: 6133930 - DNA, 15 bp, Homo sapiens
ctctgccctgtatat

SEQ ID NO: 6133931 - DNA, 19 bp, Homo sapiens
ctctgcccttcctttccct

SEQ ID NO: 6133932 - DNA, 12 bp, Homo sapiens
ctctgcccttgg

SEQ ID NO: 6133933 - DNA, 23 bp, Homo sapiens
ctctgccgaccgcctgcttcaca

SEQ ID NO: 6133934 - DNA, 15 bp, Homo sapiens
ctctgccgcctgcgt

SEQ ID NO: 6133935 - DNA, 19 bp, Homo sapiens
ctctgccgctacctccctc

SEQ ID NO: 6133936 - DNA, 21 bp, Homo sapiens
ctctgccgctacctccctccc

SEQ ID NO: 6133937 - DNA, 14 bp, Homo sapiens
ctctgccgctgcca

SEQ ID NO: 6133938 - DNA, 17 bp, Homo sapiens
ctctgccgctgccatgc

SEQ ID NO: 6133939 - DNA, 14 bp, Homo sapiens
ctctgccgctgtgt

SEQ ID NO: 6133940 - DNA, 14 bp, Homo sapiens
ctctgccggctctt

SEQ ID NO: 6133941 - DNA, 18 bp, Homo sapiens
ctctgccggctctttcct

SEQ ID NO: 6133942 - DNA, 18 bp, Homo sapiens
ctctgccggtcgggcagc

SEQ ID NO: 6133943 - DNA, 22 bp, Homo sapiens
ctctgccggtggggccagcgct

SEQ ID NO: 6133944 - DNA, 15 bp, Homo sapiens
ctctgccgtctctcc

SEQ ID NO: 6133945 - DNA, 23 bp, Homo sapiens
ctctgccgtctctcctgctctca

SEQ ID NO: 6133946 - DNA, 15 bp, Homo sapiens
ctctgccgtctctgg

SEQ ID NO: 6133947 - DNA, 18 bp, Homo sapiens
ctctgcctaaccatgggc

SEQ ID NO: 6133948 - DNA, 22 bp, Homo sapiens
ctctgcctaaccatgggctcag

SEQ ID NO: 6133949 - DNA, 17 bp, Homo sapiens
ctctgcctatttattgg

SEQ ID NO: 6133950 - DNA, 10 bp, Homo sapiens
ctctgcctca

SEQ ID NO: 6133951 - DNA, 15 bp, Homo sapiens
ctctgcctcacctgg

SEQ ID NO: 6133952 - DNA, 16 bp, Homo sapiens
ctctgcctcatcctcc

SEQ ID NO: 6133953 - DNA, 17 bp, Homo sapiens
ctctgcctcatcctcct

SEQ ID NO: 6133954 - DNA, 19 bp, Homo sapiens
ctctgcctcatcctcctcc

SEQ ID NO: 6133955 - DNA, 10 bp, Homo sapiens
ctctgcctcc

SEQ ID NO: 6133956 - DNA, 15 bp, Homo sapiens
ctctgcctccaccct

SEQ ID NO: 6133957 - DNA, 16 bp, Homo sapiens
ctctgcctccaggagg

SEQ ID NO: 6133958 - DNA, 21 bp, Homo sapiens
ctctgcctcccatcacccgct

SEQ ID NO: 6133959 - DNA, 12 bp, Homo sapiens
ctctgcctcctc

SEQ ID NO: 6133960 - DNA, 16 bp, Homo sapiens
ctctgcctcctcttca

SEQ ID NO: 6133961 - DNA, 13 bp, Homo sapiens
ctctgcctcctgg

SEQ ID NO: 6133962 - DNA, 16 bp, Homo sapiens
ctctgcctctaactcc

SEQ ID NO: 6133963 - DNA, 21 bp, Homo sapiens
ctctgcctctaactccctcct

SEQ ID NO: 6133964 - DNA, 16 bp, Homo sapiens
ctctgcctctcccagg

SEQ ID NO: 6133965 - DNA, 21 bp, Homo sapiens
ctctgcctctcccaggctgtc

SEQ ID NO: 6133966 - DNA, 19 bp, Homo sapiens
ctctgcctctgacacacag

SEQ ID NO: 6133967 - DNA, 15 bp, Homo sapiens
ctctgcctctgggca

SEQ ID NO: 6133968 - DNA, 21 bp, Homo sapiens
ctctgcctctgggcagcctgc

SEQ ID NO: 6133969 - DNA, 22 bp, Homo sapiens
ctctgcctgaagtcacacagtg

SEQ ID NO: 6133970 - DNA, 20 bp, Homo sapiens
ctctgcctgacaaggccagc

SEQ ID NO: 6133971 - DNA, 17 bp, Homo sapiens
ctctgcctgacagcatc

SEQ ID NO: 6133972 - DNA, 23 bp, Homo sapiens
ctctgcctgacagcatcctctct

SEQ ID NO: 6133973 - DNA, 16 bp, Homo sapiens
ctctgcctgaccccag

SEQ ID NO: 6133974 - DNA, 10 bp, Homo sapiens
ctctgcctgc

SEQ ID NO: 6133975 - DNA, 18 bp, Homo sapiens
ctctgcctgcactccctg

SEQ ID NO: 6133976 - DNA, 12 bp, Homo sapiens
ctctgcctgccc

SEQ ID NO: 6133977 - DNA, 14 bp, Homo sapiens
ctctgcctgctggg

SEQ ID NO: 6133978 - DNA, 12 bp, Homo sapiens
ctctgcctgctt

SEQ ID NO: 6133979 - DNA, 14 bp, Homo sapiens
ctctgcctggagca

SEQ ID NO: 6133980 - DNA, 11 bp, Homo sapiens
ctctgcctggc

SEQ ID NO: 6133981 - DNA, 13 bp, Homo sapiens
ctctgcctggcaa

SEQ ID NO: 6133982 - DNA, 18 bp, Homo sapiens
ctctgcctgggatgccct

SEQ ID NO: 6133983 - DNA, 23 bp, Homo sapiens
ctctgcctgggatgcccttcccc

SEQ ID NO: 6133984 - DNA, 15 bp, Homo sapiens
ctctgcctgggctct

SEQ ID NO: 6133985 - DNA, 20 bp, Homo sapiens
ctctgcctgggctctggaag

SEQ ID NO: 6133986 - DNA, 21 bp, Homo sapiens
ctctgcctggggcctccagaa

SEQ ID NO: 6133987 - DNA, 20 bp, Homo sapiens
ctctgcctggtggtcagatg

SEQ ID NO: 6133988 - DNA, 21 bp, Homo sapiens
ctctgcctggtggtcagatgc

SEQ ID NO: 6133989 - DNA, 13 bp, Homo sapiens
ctctgcctgtccc

SEQ ID NO: 6133990 - DNA, 21 bp, Homo sapiens
ctctgcctgtccctctcaggc

SEQ ID NO: 6133991 - DNA, 14 bp, Homo sapiens
ctctgcctgtctgg

SEQ ID NO: 6133992 - DNA, 16 bp, Homo sapiens
ctctgcctgtgagcca

SEQ ID NO: 6133993 - DNA, 16 bp, Homo sapiens
ctctgcctgtgcccgc

SEQ ID NO: 6133994 - DNA, 15 bp, Homo sapiens
ctctgcctgttcctc

SEQ ID NO: 6133995 - DNA, 20 bp, Homo sapiens
ctctgccttaatttttgaaa

SEQ ID NO: 6133996 - DNA, 17 bp, Homo sapiens
ctctgccttccaggcgt

SEQ ID NO: 6133997 - DNA, 12 bp, Homo sapiens
ctctgccttctt

SEQ ID NO: 6133998 - DNA, 17 bp, Homo sapiens
ctctgccttgccctcct

SEQ ID NO: 6133999 - DNA, 21 bp, Homo sapiens
ctctgccttgccctcctgggc

SEQ ID NO: 6134000 - DNA, 13 bp, Homo sapiens
ctctgccttgcct

SEQ ID NO: 6134001 - DNA, 15 bp, Homo sapiens
ctctgccttgccttt

SEQ ID NO: 6134002 - DNA, 23 bp, Homo sapiens
ctctgccttgcctttagcccctc

SEQ ID NO: 6134003 - DNA, 13 bp, Homo sapiens
ctctgccttggac

SEQ ID NO: 6134004 - DNA, 10 bp, Homo sapiens
ctctgccttt

SEQ ID NO: 6134005 - DNA, 14 bp, Homo sapiens
ctctgcctttatga

SEQ ID NO: 6134006 - DNA, 21 bp, Homo sapiens
ctctgcctttatgatgctaag

SEQ ID NO: 6134007 - DNA, 19 bp, Homo sapiens
ctctgcctttgacatttaa

SEQ ID NO: 6134008 - DNA, 23 bp, Homo sapiens
ctctgcctttgacatttaattta

SEQ ID NO: 6134009 - DNA, 13 bp, Homo sapiens
ctctgcctttgag

SEQ ID NO: 6134010 - DNA, 14 bp, Homo sapiens
ctctgcctttgagc

SEQ ID NO: 6134011 - DNA, 19 bp, Homo sapiens
ctctgcctttgagcttctc

SEQ ID NO: 6134012 - DNA, 20 bp, Homo sapiens
ctctgcctttgagcttctcc

SEQ ID NO: 6134013 - DNA, 21 bp, Homo sapiens
ctctgcctttgagcttctcct

SEQ ID NO: 6134014 - DNA, 15 bp, Homo sapiens
ctctgcctttgagtg

SEQ ID NO: 6134015 - DNA, 20 bp, Homo sapiens
ctctgcctttgtgatcctga

SEQ ID NO: 6134016 - DNA, 18 bp, Homo sapiens
ctctgcgagaatgaacat

SEQ ID NO: 6134017 - DNA, 21 bp, Homo sapiens
ctctgcgagtagttccacaca

SEQ ID NO: 6134018 - DNA, 18 bp, Homo sapiens
ctctgcgccaggcagagc

SEQ ID NO: 6134019 - DNA, 21 bp, Homo sapiens
ctctgcgccaggcagagctga

SEQ ID NO: 6134020 - DNA, 14 bp, Homo sapiens
ctctgcgccccagc

SEQ ID NO: 6134021 - DNA, 15 bp, Homo sapiens
ctctgcgccccagcg

SEQ ID NO: 6134022 - DNA, 16 bp, Homo sapiens
ctctgcggaccccagc

SEQ ID NO: 6134023 - DNA, 17 bp, Homo sapiens
ctctgcggaccccagct

SEQ ID NO: 6134024 - DNA, 19 bp, Homo sapiens
ctctgcggagcacactggc

SEQ ID NO: 6134025 - DNA, 18 bp, Homo sapiens
ctctgcggatagcatttg

SEQ ID NO: 6134026 - DNA, 16 bp, Homo sapiens
ctctgcgggaggctgg

SEQ ID NO: 6134027 - DNA, 18 bp, Homo sapiens
ctctgcgggaggctgggg

SEQ ID NO: 6134028 - DNA, 20 bp, Homo sapiens
ctctgcgggaggctggggcc

SEQ ID NO: 6134029 - DNA, 23 bp, Homo sapiens
ctctgcgggaggctggggcccca

SEQ ID NO: 6134030 - DNA, 18 bp, Homo sapiens
ctctgcggtggtgccaga

SEQ ID NO: 6134031 - DNA, 20 bp, Homo sapiens
ctctgcgtcccccagccctc

SEQ ID NO: 6134032 - DNA, 22 bp, Homo sapiens
ctctgcgtcggtcctggtgccc

SEQ ID NO: 6134033 - DNA, 23 bp, Homo sapiens
ctctgcgtgcagggacaaagagg

SEQ ID NO: 6134034 - DNA, 19 bp, Homo sapiens
ctctgcgtggcgcaggtgc

SEQ ID NO: 6134035 - DNA, 22 bp, Homo sapiens
ctctgcgtgtcacctgtgcttc

SEQ ID NO: 6134036 - DNA, 16 bp, Homo sapiens
ctctgcgttggcttct

SEQ ID NO: 6134037 - DNA, 17 bp, Homo sapiens
ctctgctaaattgatgt

SEQ ID NO: 6134038 - DNA, 21 bp, Homo sapiens
ctctgctagactcctcaggag

SEQ ID NO: 6134039 - DNA, 16 bp, Homo sapiens
ctctgctagatttcta

SEQ ID NO: 6134040 - DNA, 15 bp, Homo sapiens
ctctgctatttctct

SEQ ID NO: 6134041 - DNA, 20 bp, Homo sapiens
ctctgctatttctcttgctg

SEQ ID NO: 6134042 - DNA, 20 bp, Homo sapiens
ctctgctcaatgaaaccttc

SEQ ID NO: 6134043 - DNA, 22 bp, Homo sapiens
ctctgctcaccgcccatcaggg

SEQ ID NO: 6134044 - DNA, 14 bp, Homo sapiens
ctctgctcaggcct

SEQ ID NO: 6134045 - DNA, 16 bp, Homo sapiens
ctctgctcaggcctcc

SEQ ID NO: 6134046 - DNA, 21 bp, Homo sapiens
ctctgctcaggcctccctagc

SEQ ID NO: 6134047 - DNA, 12 bp, Homo sapiens
ctctgctcaggg

SEQ ID NO: 6134048 - DNA, 14 bp, Homo sapiens
ctctgctcagggcc

SEQ ID NO: 6134049 - DNA, 20 bp, Homo sapiens
ctctgctcatgggtggctgt

SEQ ID NO: 6134050 - DNA, 13 bp, Homo sapiens
ctctgctccacca

SEQ ID NO: 6134051 - DNA, 16 bp, Homo sapiens
ctctgctccaccacat

SEQ ID NO: 6134052 - DNA, 18 bp, Homo sapiens
ctctgctccaccacatcc

SEQ ID NO: 6134053 - DNA, 13 bp, Homo sapiens
ctctgctccacct

SEQ ID NO: 6134054 - DNA, 14 bp, Homo sapiens
ctctgctccacctt

SEQ ID NO: 6134055 - DNA, 21 bp, Homo sapiens
ctctgctccagcaactgccct

SEQ ID NO: 6134056 - DNA, 23 bp, Homo sapiens
ctctgctccatccccctgcctcc

SEQ ID NO: 6134057 - DNA, 13 bp, Homo sapiens
ctctgctccccct

SEQ ID NO: 6134058 - DNA, 16 bp, Homo sapiens
ctctgctccccctttt

SEQ ID NO: 6134059 - DNA, 19 bp, Homo sapiens
ctctgctcctacatccagc

SEQ ID NO: 6134060 - DNA, 22 bp, Homo sapiens
ctctgctcctacatccagctcc

SEQ ID NO: 6134061 - DNA, 23 bp, Homo sapiens
ctctgctcctacatccagctcct

SEQ ID NO: 6134062 - DNA, 19 bp, Homo sapiens
ctctgctcctcacccccac

SEQ ID NO: 6134063 - DNA, 17 bp, Homo sapiens
ctctgctcgccttagca

SEQ ID NO: 6134064 - DNA, 15 bp, Homo sapiens
ctctgctctcatagg

SEQ ID NO: 6134065 - DNA, 11 bp, Homo sapiens
ctctgctctcc

SEQ ID NO: 6134066 - DNA, 15 bp, Homo sapiens
ctagacaacctttct

SEQ ID NO: 6134067 - DNA, 15 bp, Homo sapiens
ctagacaagatattg

SEQ ID NO: 6134068 - DNA, 18 bp, Homo sapiens
ctagacaagatattgtac

SEQ ID NO: 6134069 - DNA, 23 bp, Homo sapiens
ctagacaagatattgtacataaa

SEQ ID NO: 6134070 - DNA, 22 bp, Homo sapiens
ctagacaatgatttggccaggc

SEQ ID NO: 6134071 - DNA, 20 bp, Homo sapiens
ctagacaatgccaccagaga

SEQ ID NO: 6134072 - DNA, 15 bp, Homo sapiens
ctagacacaatttca

SEQ ID NO: 6134073 - DNA, 19 bp, Homo sapiens
ctagacacaatttcatttc

SEQ ID NO: 6134074 - DNA, 12 bp, Homo sapiens
ctagacacacaa

SEQ ID NO: 6134075 - DNA, 23 bp, Homo sapiens
ctagacacatgaaggtaaataaa

SEQ ID NO: 6134076 - DNA, 16 bp, Homo sapiens
ctagacaccttctgtg

SEQ ID NO: 6134077 - DNA, 19 bp, Homo sapiens
ctagacactgaaggcaaat

SEQ ID NO: 6134078 - DNA, 13 bp, Homo sapiens
ctagacactgcca

SEQ ID NO: 6134079 - DNA, 17 bp, Homo sapiens
ctagacagagatgaact

SEQ ID NO: 6134080 - DNA, 16 bp, Homo sapiens
ctagacaggaaccctt

SEQ ID NO: 6134081 - DNA, 15 bp, Homo sapiens
ctagacagtattgcc

SEQ ID NO: 6134082 - DNA, 14 bp, Homo sapiens
ctagacattctgtc

SEQ ID NO: 6134083 - DNA, 16 bp, Homo sapiens
ctagacattctgtcgc

SEQ ID NO: 6134084 - DNA, 13 bp, Homo sapiens
ctagacattgcaa

SEQ ID NO: 6134085 - DNA, 21 bp, Homo sapiens
ctagaccagcagacagagcca

SEQ ID NO: 6134086 - DNA, 23 bp, Homo sapiens
ctagaccagcagacagagccagg

SEQ ID NO: 6134087 - DNA, 13 bp, Homo sapiens
ctagaccagggct

SEQ ID NO: 6134088 - DNA, 17 bp, Homo sapiens
ctagaccagggctgctc

SEQ ID NO: 6134089 - DNA, 22 bp, Homo sapiens
ctagaccagtgagcgcttgggc

SEQ ID NO: 6134090 - DNA, 18 bp, Homo sapiens
ctagaccagtttgcatga

SEQ ID NO: 6134091 - DNA, 18 bp, Homo sapiens
ctagaccctcccccacca

SEQ ID NO: 6134092 - DNA, 17 bp, Homo sapiens
ctagacctccagctgtt

SEQ ID NO: 6134093 - DNA, 18 bp, Homo sapiens
ctagaccttgcctcccct

SEQ ID NO: 6134094 - DNA, 17 bp, Homo sapiens
ctagacgcccctcccaa

SEQ ID NO: 6134095 - DNA, 18 bp, Homo sapiens
ctagacgcccctcccaag

SEQ ID NO: 6134096 - DNA, 19 bp, Homo sapiens
ctagacgcttcatcccaca

SEQ ID NO: 6134097 - DNA, 23 bp, Homo sapiens
ctagactaattaaaatctggaaa

SEQ ID NO: 6134098 - DNA, 14 bp, Homo sapiens
ctagactaggagac

SEQ ID NO: 6134099 - DNA, 19 bp, Homo sapiens
ctagactcaaaacctggag

SEQ ID NO: 6134100 - DNA, 21 bp, Homo sapiens
ctagactcaaaacctggagat

SEQ ID NO: 6134101 - DNA, 13 bp, Homo sapiens
ctagactcatact

SEQ ID NO: 6134102 - DNA, 18 bp, Homo sapiens
ctagactcccaagctgga

SEQ ID NO: 6134103 - DNA, 13 bp, Homo sapiens
ctagactcctcag

SEQ ID NO: 6134104 - DNA, 13 bp, Homo sapiens
ctagactcggggt

SEQ ID NO: 6134105 - DNA, 22 bp, Homo sapiens
ctagactcggggtgcttccttg

SEQ ID NO: 6134106 - DNA, 18 bp, Homo sapiens
ctagactgccacaaggaa

SEQ ID NO: 6134107 - DNA, 16 bp, Homo sapiens
ctagactgctcctggg

SEQ ID NO: 6134108 - DNA, 14 bp, Homo sapiens
ctagactgggctgg

SEQ ID NO: 6134109 - DNA, 20 bp, Homo sapiens
ctagactgggctggctgcct

SEQ ID NO: 6134110 - DNA, 22 bp, Homo sapiens
ctagactggtgactgattcttc

SEQ ID NO: 6134111 - DNA, 23 bp, Homo sapiens
ctagactggtgactgattcttca

SEQ ID NO: 6134112 - DNA, 13 bp, Homo sapiens
ctagactggtgct

SEQ ID NO: 6134113 - DNA, 16 bp, Homo sapiens
ctagactgtgtatgtc

SEQ ID NO: 6134114 - DNA, 14 bp, Homo sapiens
ctagactgtgtctg

SEQ ID NO: 6134115 - DNA, 19 bp, Homo sapiens
ctagacttagattcattaa

SEQ ID NO: 6134116 - DNA, 16 bp, Homo sapiens
ctagacttcccaacag

SEQ ID NO: 6134117 - DNA, 15 bp, Homo sapiens
ctagacttccccatc

SEQ ID NO: 6134118 - DNA, 16 bp, Homo sapiens
ctagacttccccatcc

SEQ ID NO: 6134119 - DNA, 13 bp, Homo sapiens
ctagacttgggat

SEQ ID NO: 6134120 - DNA, 22 bp, Homo sapiens
ctagactttaggctttcagctt

SEQ ID NO: 6134121 - DNA, 12 bp, Homo sapiens
ctagactttctg

SEQ ID NO: 6134122 - DNA, 14 bp, Homo sapiens
ctagactttctgtt

SEQ ID NO: 6134123 - DNA, 13 bp, Homo sapiens
ctagagaaaataa

SEQ ID NO: 6134124 - DNA, 21 bp, Homo sapiens
ctagagaaataagatcttttt

SEQ ID NO: 6134125 - DNA, 21 bp, Homo sapiens
ctagagaacagtattgggcag

SEQ ID NO: 6134126 - DNA, 23 bp, Homo sapiens
ctagagaacagtattgggcagga

SEQ ID NO: 6134127 - DNA, 17 bp, Homo sapiens
ctagagaagacaggctg

SEQ ID NO: 6134128 - DNA, 22 bp, Homo sapiens
ctagagaagacaggctggaaga

SEQ ID NO: 6134129 - DNA, 15 bp, Homo sapiens
ctagagaagaggctg

SEQ ID NO: 6134130 - DNA, 14 bp, Homo sapiens
ctagagaagataat

SEQ ID NO: 6134131 - DNA, 22 bp, Homo sapiens
ctagagaagtggactggaggag

SEQ ID NO: 6134132 - DNA, 23 bp, Homo sapiens
ctagagaagtggactggaggagc

SEQ ID NO: 6134133 - DNA, 16 bp, Homo sapiens
ctagagacaaatcttt

SEQ ID NO: 6134134 - DNA, 13 bp, Homo sapiens
ctagagacacatt

SEQ ID NO: 6134135 - DNA, 22 bp, Homo sapiens
ctagagacagtgatgcctgccc

SEQ ID NO: 6134136 - DNA, 18 bp, Homo sapiens
ctagagacgcaccttgct

SEQ ID NO: 6134137 - DNA, 19 bp, Homo sapiens
ctagagacgcaccttgctg

SEQ ID NO: 6134138 - DNA, 10 bp, Homo sapiens
ctagagactc

SEQ ID NO: 6134139 - DNA, 17 bp, Homo sapiens
ctagagagaaaaagaaa

SEQ ID NO: 6134140 - DNA, 19 bp, Homo sapiens
ctagagagaaaaagaaaga

SEQ ID NO: 6134141 - DNA, 21 bp, Homo sapiens
ctagagagaaaaagaaagaac

SEQ ID NO: 6134142 - DNA, 12 bp, Homo sapiens
ctagagagaata

SEQ ID NO: 6134143 - DNA, 12 bp, Homo sapiens
ctagagagcaga

SEQ ID NO: 6134144 - DNA, 15 bp, Homo sapiens
ctagagagccttaac

SEQ ID NO: 6134145 - DNA, 21 bp, Homo sapiens
ctagagagggaggcaagccct

SEQ ID NO: 6134146 - DNA, 22 bp, Homo sapiens
ctagagagggaggcaagccctg

SEQ ID NO: 6134147 - DNA, 19 bp, Homo sapiens
ctagagaggggcctctggc

SEQ ID NO: 6134148 - DNA, 20 bp, Homo sapiens
ctagagagtgtgatgttcac

SEQ ID NO: 6134149 - DNA, 18 bp, Homo sapiens
ctagagatattttgtaaa

SEQ ID NO: 6134150 - DNA, 17 bp, Homo sapiens
ctagagatctggttttg

SEQ ID NO: 6134151 - DNA, 21 bp, Homo sapiens
ctagagatctggttttgctat

SEQ ID NO: 6134152 - DNA, 22 bp, Homo sapiens
ctagagatctggttttgctatt

SEQ ID NO: 6134153 - DNA, 18 bp, Homo sapiens
ctagagattttcttggca

SEQ ID NO: 6134154 - DNA, 22 bp, Homo sapiens
ctagagcaacccctgtacccag

SEQ ID NO: 6134155 - DNA, 19 bp, Homo sapiens
ctagagcactctcacccca

SEQ ID NO: 6134156 - DNA, 14 bp, Homo sapiens
ctagagcactgcca

SEQ ID NO: 6134157 - DNA, 21 bp, Homo sapiens
ctagagcagcccaaatttttc

SEQ ID NO: 6134158 - DNA, 17 bp, Homo sapiens
ctagagcagccctggag

SEQ ID NO: 6134159 - DNA, 14 bp, Homo sapiens
ctagagcagggatt

SEQ ID NO: 6134160 - DNA, 18 bp, Homo sapiens
ctagagcatctgtcccac

SEQ ID NO: 6134161 - DNA, 16 bp, Homo sapiens
ctagagcatgctgcct

SEQ ID NO: 6134162 - DNA, 18 bp, Homo sapiens
ctagagccctctcctccc

SEQ ID NO: 6134163 - DNA, 14 bp, Homo sapiens
ctagagcctcttgg

SEQ ID NO: 6134164 - DNA, 14 bp, Homo sapiens
ctagagcctgcctg

SEQ ID NO: 6134165 - DNA, 16 bp, Homo sapiens
ctagagcctgcctgga

SEQ ID NO: 6134166 - DNA, 17 bp, Homo sapiens
ctagagcctgcctggag

SEQ ID NO: 6134167 - DNA, 18 bp, Homo sapiens
ctagagcctgctggatct

SEQ ID NO: 6134168 - DNA, 21 bp, Homo sapiens
ctagagcgcggctggctctgt

SEQ ID NO: 6134169 - DNA, 19 bp, Homo sapiens
ctagagctcagtatactaa

SEQ ID NO: 6134170 - DNA, 17 bp, Homo sapiens
ctagagctccagttctt

SEQ ID NO: 6134171 - DNA, 13 bp, Homo sapiens
ctagagctcctcc

SEQ ID NO: 6134172 - DNA, 17 bp, Homo sapiens
ctagagctcctccctct

SEQ ID NO: 6134173 - DNA, 19 bp, Homo sapiens
ctagagctcctccctctca

SEQ ID NO: 6134174 - DNA, 13 bp, Homo sapiens
ctagagctcctgt

SEQ ID NO: 6134175 - DNA, 14 bp, Homo sapiens
ctagagctcctgtc

SEQ ID NO: 6134176 - DNA, 17 bp, Homo sapiens
ctagagctcctgtccct

SEQ ID NO: 6134177 - DNA, 20 bp, Homo sapiens
ctagagctcctgtccctacc

SEQ ID NO: 6134178 - DNA, 22 bp, Homo sapiens
ctagagctcctgtccctaccca

SEQ ID NO: 6134179 - DNA, 23 bp, Homo sapiens
ctagagctcctgtccctacccac

SEQ ID NO: 6134180 - DNA, 13 bp, Homo sapiens
ctagagctctaat

SEQ ID NO: 6134181 - DNA, 22 bp, Homo sapiens
ctagagcttcaagtctgtgcct

SEQ ID NO: 6134182 - DNA, 18 bp, Homo sapiens
ctagagcttccactgtca

SEQ ID NO: 6134183 - DNA, 22 bp, Homo sapiens
ctagagcttgcagtgaagtgtt

SEQ ID NO: 6134184 - DNA, 17 bp, Homo sapiens
ctagaggaaaagaaaga

SEQ ID NO: 6134185 - DNA, 19 bp, Homo sapiens
ctagaggaaccaaccccca

SEQ ID NO: 6134186 - DNA, 16 bp, Homo sapiens
ctagaggaagcagcca

SEQ ID NO: 6134187 - DNA, 19 bp, Homo sapiens
ctagaggaataaagctgtg

SEQ ID NO: 6134188 - DNA, 13 bp, Homo sapiens
ctagaggagacag

SEQ ID NO: 6134189 - DNA, 20 bp, Homo sapiens
ctagaggaggaaaaaggctg

SEQ ID NO: 6134190 - DNA, 22 bp, Homo sapiens
ctagaggaggaaaaaggctggt

SEQ ID NO: 6134191 - DNA, 15 bp, Homo sapiens
ctagaggagggggca

SEQ ID NO: 6134192 - DNA, 19 bp, Homo sapiens
ctagaggcagggaggggac

SEQ ID NO: 6134193 - DNA, 14 bp, Homo sapiens
ctagaggccaggga

SEQ ID NO: 6134194 - DNA, 20 bp, Homo sapiens
ctagaggccctttgctgtcc

SEQ ID NO: 6134195 - DNA, 11 bp, Homo sapiens
ctagaggcctc

SEQ ID NO: 6134196 - DNA, 16 bp, Homo sapiens
ctagaggcctgaggat

SEQ ID NO: 6134197 - DNA, 20 bp, Homo sapiens
ctagaggcctgaggatgagc

SEQ ID NO: 6134198 - DNA, 23 bp, Homo sapiens
ctagaggcctttagttataaagg

SEQ ID NO: 6134199 - DNA, 15 bp, Homo sapiens
ctagaggcgagccag

SEQ ID NO: 6134200 - DNA, 20 bp, Homo sapiens
ctagaggctccagctctggc

SEQ ID NO: 6134201 - DNA, 16 bp, Homo sapiens
ctagaggctgagcacc

SEQ ID NO: 6134202 - DNA, 18 bp, Homo sapiens
ctagaggcttccttcatt

SEQ ID NO: 6134203 - DNA, 15 bp, Homo sapiens
ctagagggacctctc

SEQ ID NO: 6134204 - DNA, 22 bp, Homo sapiens
ctagagggagacttgttctaga

SEQ ID NO: 6134205 - DNA, 13 bp, Homo sapiens
ctagagggcccaa

SEQ ID NO: 6134206 - DNA, 14 bp, Homo sapiens
ctagagggcccatc

SEQ ID NO: 6134207 - DNA, 19 bp, Homo sapiens
ctagagggcgactctggtg

SEQ ID NO: 6134208 - DNA, 17 bp, Homo sapiens
ctagagggcgagggatg

SEQ ID NO: 6134209 - DNA, 23 bp, Homo sapiens
ctagagggcgagggatgatgagg

SEQ ID NO: 6134210 - DNA, 19 bp, Homo sapiens
ctagagggttcctgtagac

SEQ ID NO: 6134211 - DNA, 18 bp, Homo sapiens
ctagagggttgctgcctt

SEQ ID NO: 6134212 - DNA, 20 bp, Homo sapiens
ctagagggttgctgcctttc

SEQ ID NO: 6134213 - DNA, 15 bp, Homo sapiens
ctagaggtctctctg

SEQ ID NO: 6134214 - DNA, 17 bp, Homo sapiens
ctagaggtgggcagctg

SEQ ID NO: 6134215 - DNA, 18 bp, Homo sapiens
ctagaggtgggcagctgg

SEQ ID NO: 6134216 - DNA, 21 bp, Homo sapiens
ctagaggtgggcagctgggcc

SEQ ID NO: 6134217 - DNA, 23 bp, Homo sapiens
ctagaggtgggcagctgggcccc

SEQ ID NO: 6134218 - DNA, 23 bp, Homo sapiens
ctagaggttgcagcatgagactt

SEQ ID NO: 6134219 - DNA, 18 bp, Homo sapiens
ctagagtaattatctgtg

SEQ ID NO: 6134220 - DNA, 17 bp, Homo sapiens
ctagagtagagtggagg

SEQ ID NO: 6134221 - DNA, 13 bp, Homo sapiens
ctagagtagtgct

SEQ ID NO: 6134222 - DNA, 23 bp, Homo sapiens
ctagagtatacctgtggtttggt

SEQ ID NO: 6134223 - DNA, 15 bp, Homo sapiens
ctagagtatattcct

SEQ ID NO: 6134224 - DNA, 17 bp, Homo sapiens
ctagagtatgtgtatgt

SEQ ID NO: 6134225 - DNA, 23 bp, Homo sapiens
ctagagtcacccccccaggcctc

SEQ ID NO: 6134226 - DNA, 19 bp, Homo sapiens
ctagagtcatgtgagcctc

SEQ ID NO: 6134227 - DNA, 20 bp, Homo sapiens
ctagagtccaaggtttaaag

SEQ ID NO: 6134228 - DNA, 14 bp, Homo sapiens
ctagagtctcagaa

SEQ ID NO: 6134229 - DNA, 22 bp, Homo sapiens
ctagagtctcagaaactcccct

SEQ ID NO: 6134230 - DNA, 19 bp, Homo sapiens
ctagagtctgaacagctgt

SEQ ID NO: 6134231 - DNA, 21 bp, Homo sapiens
ctagagtgaacttgggccact

SEQ ID NO: 6134232 - DNA, 12 bp, Homo sapiens
ctagagtgacag

SEQ ID NO: 6134233 - DNA, 21 bp, Homo sapiens
ctagagtgactctacctgcaa

SEQ ID NO: 6134234 - DNA, 16 bp, Homo sapiens
ctagagtgagggcctg

SEQ ID NO: 6134235 - DNA, 17 bp, Homo sapiens
ctagagtgagggcctga

SEQ ID NO: 6134236 - DNA, 23 bp, Homo sapiens
ctagagtggcagccaagagccat

SEQ ID NO: 6134237 - DNA, 15 bp, Homo sapiens
ctagagtgtagccta

SEQ ID NO: 6134238 - DNA, 23 bp, Homo sapiens
ctagagtgtagcctaaagggcag

SEQ ID NO: 6134239 - DNA, 15 bp, Homo sapiens
ctagagttcggtctg

SEQ ID NO: 6134240 - DNA, 17 bp, Homo sapiens
ctagagttgatgggggt

SEQ ID NO: 6134241 - DNA, 15 bp, Homo sapiens
ctagagtttatacag

SEQ ID NO: 6134242 - DNA, 18 bp, Homo sapiens
ctagagtttatacagtgt

SEQ ID NO: 6134243 - DNA, 12 bp, Homo sapiens
ctctgctctcct

SEQ ID NO: 6134244 - DNA, 16 bp, Homo sapiens
ctctgctctcctcggg

SEQ ID NO: 6134245 - DNA, 18 bp, Homo sapiens
ctctgctctcctcgggcc

SEQ ID NO: 6134246 - DNA, 20 bp, Homo sapiens
ctctgctctcctcgggccct

SEQ ID NO: 6134247 - DNA, 22 bp, Homo sapiens
ctctgctctcctcgggccctgt

SEQ ID NO: 6134248 - DNA, 23 bp, Homo sapiens
ctctgctctcctcgggccctgtg

SEQ ID NO: 6134249 - DNA, 14 bp, Homo sapiens
ctctgctctctatg

SEQ ID NO: 6134250 - DNA, 15 bp, Homo sapiens
ctctgctctgaggct

SEQ ID NO: 6134251 - DNA, 15 bp, Homo sapiens
ctctgctctgatgca

SEQ ID NO: 6134252 - DNA, 11 bp, Homo sapiens
ctctgctctgc

SEQ ID NO: 6134253 - DNA, 13 bp, Homo sapiens
ctctgctctgccc

SEQ ID NO: 6134254 - DNA, 15 bp, Homo sapiens
ctctgctctgccctt

SEQ ID NO: 6134255 - DNA, 14 bp, Homo sapiens
ctctgctctgcctg

SEQ ID NO: 6134256 - DNA, 15 bp, Homo sapiens
ctctgctctgcctgg

SEQ ID NO: 6134257 - DNA, 16 bp, Homo sapiens
ctctgctctgcctgga

SEQ ID NO: 6134258 - DNA, 17 bp, Homo sapiens
ctctgctctgcctggag

SEQ ID NO: 6134259 - DNA, 19 bp, Homo sapiens
ctctgctctgcctggagtg

SEQ ID NO: 6134260 - DNA, 14 bp, Homo sapiens
ctctgctctgtcct

SEQ ID NO: 6134261 - DNA, 13 bp, Homo sapiens
ctctgctcttgca

SEQ ID NO: 6134262 - DNA, 14 bp, Homo sapiens
ctctgctcttgcct

SEQ ID NO: 6134263 - DNA, 16 bp, Homo sapiens
ctctgctgaagacttg

SEQ ID NO: 6134264 - DNA, 18 bp, Homo sapiens
ctctgctgacagacacag

SEQ ID NO: 6134265 - DNA, 19 bp, Homo sapiens
ctctgctgacagacacagg

SEQ ID NO: 6134266 - DNA, 13 bp, Homo sapiens
ctctgctgacctg

SEQ ID NO: 6134267 - DNA, 16 bp, Homo sapiens
ctctgctgacctgctg

SEQ ID NO: 6134268 - DNA, 17 bp, Homo sapiens
ctctgctgacctgctga

SEQ ID NO: 6134269 - DNA, 17 bp, Homo sapiens
ctctgctgagaaggcaa

SEQ ID NO: 6134270 - DNA, 15 bp, Homo sapiens
ctctgctgagcagcc

SEQ ID NO: 6134271 - DNA, 15 bp, Homo sapiens
ctctgctgagctggg

SEQ ID NO: 6134272 - DNA, 15 bp, Homo sapiens
ctctgctgaggccag

SEQ ID NO: 6134273 - DNA, 24 bp, Homo sapiens
ctctgctgaggccagaggaaggga

SEQ ID NO: 6134274 - DNA, 13 bp, Homo sapiens
ctctgctgagggt

SEQ ID NO: 6134275 - DNA, 17 bp, Homo sapiens
ctctgctgagggtccag

SEQ ID NO: 6134276 - DNA, 17 bp, Homo sapiens
ctctgctgagtgctggg

SEQ ID NO: 6134277 - DNA, 19 bp, Homo sapiens
ctctgctgagtgctgggca

SEQ ID NO: 6134278 - DNA, 15 bp, Homo sapiens
ctctgctgcacagta

SEQ ID NO: 6134279 - DNA, 22 bp, Homo sapiens
ctctgctgcccacggccaccca

SEQ ID NO: 6134280 - DNA, 13 bp, Homo sapiens
ctctgctgcccag

SEQ ID NO: 6134281 - DNA, 14 bp, Homo sapiens
ctctgctgcccagg

SEQ ID NO: 6134282 - DNA, 23 bp, Homo sapiens
ctctgctgcccccttccccagcc

SEQ ID NO: 6134283 - DNA, 14 bp, Homo sapiens
ctctgctgcctctg

SEQ ID NO: 6134284 - DNA, 15 bp, Homo sapiens
ctctgctgctcatgg

SEQ ID NO: 6134285 - DNA, 13 bp, Homo sapiens
ctctgctgctccc

SEQ ID NO: 6134286 - DNA, 12 bp, Homo sapiens
ctctgctgctga

SEQ ID NO: 6134287 - DNA, 13 bp, Homo sapiens
ctctgctgctgat

SEQ ID NO: 6134288 - DNA, 13 bp, Homo sapiens
ctctgctgctggc

SEQ ID NO: 6134289 - DNA, 15 bp, Homo sapiens
ctctgctgctggctg

SEQ ID NO: 6134290 - DNA, 11 bp, Homo sapiens
ctctgctgctt

SEQ ID NO: 6134291 - DNA, 17 bp, Homo sapiens
ctctgctgcttctgggc

SEQ ID NO: 6134292 - DNA, 13 bp, Homo sapiens
ctctgctgctttt

SEQ ID NO: 6134293 - DNA, 12 bp, Homo sapiens
ctctgctggaag

SEQ ID NO: 6134294 - DNA, 23 bp, Homo sapiens
ctctgctggaaggggcagcagga

SEQ ID NO: 6134295 - DNA, 23 bp, Homo sapiens
ctctgctggattctaaattatgt

SEQ ID NO: 6134296 - DNA, 23 bp, Homo sapiens
ctctgctggcaggattcttcccg

SEQ ID NO: 6134297 - DNA, 14 bp, Homo sapiens
ctctgctggccgga

SEQ ID NO: 6134298 - DNA, 20 bp, Homo sapiens
ctctgctggctcaggaggag

SEQ ID NO: 6134299 - DNA, 20 bp, Homo sapiens
ctctgctgggaacctagcac

SEQ ID NO: 6134300 - DNA, 15 bp, Homo sapiens
ctctgctgggtctcc

SEQ ID NO: 6134301 - DNA, 15 bp, Homo sapiens
ctctgctggtctctg

SEQ ID NO: 6134302 - DNA, 16 bp, Homo sapiens
ctctgctggtctctgg

SEQ ID NO: 6134303 - DNA, 19 bp, Homo sapiens
ctctgctggtctctggctc

SEQ ID NO: 6134304 - DNA, 20 bp, Homo sapiens
ctctgctggtctctggctct

SEQ ID NO: 6134305 - DNA, 23 bp, Homo sapiens
ctctgctgtacatatttgagact

SEQ ID NO: 6134306 - DNA, 14 bp, Homo sapiens
ctctgctgtcctaa

SEQ ID NO: 6134307 - DNA, 17 bp, Homo sapiens
ctctgctgtcctgcagt

SEQ ID NO: 6134308 - DNA, 21 bp, Homo sapiens
ctctgcttaccgttcaagagg

SEQ ID NO: 6134309 - DNA, 22 bp, Homo sapiens
ctctgcttaccgttcaagaggc

SEQ ID NO: 6134310 - DNA, 21 bp, Homo sapiens
ctctgcttactaatgtgcccc

SEQ ID NO: 6134311 - DNA, 13 bp, Homo sapiens
ctctgcttccagt

SEQ ID NO: 6134312 - DNA, 22 bp, Homo sapiens
ctctgcttccatggcttcctga

SEQ ID NO: 6134313 - DNA, 13 bp, Homo sapiens
ctctgcttcctca

SEQ ID NO: 6134314 - DNA, 15 bp, Homo sapiens
ctctgcttcctcagg

SEQ ID NO: 6134315 - DNA, 18 bp, Homo sapiens
ctctgcttctccaaggaa

SEQ ID NO: 6134316 - DNA, 22 bp, Homo sapiens
ctctgcttctcggggtccagtg

SEQ ID NO: 6134317 - DNA, 16 bp, Homo sapiens
ctctgcttctctgact

SEQ ID NO: 6134318 - DNA, 15 bp, Homo sapiens
ctctgcttgccagcc

SEQ ID NO: 6134319 - DNA, 16 bp, Homo sapiens
ctctgcttgccagcca

SEQ ID NO: 6134320 - DNA, 17 bp, Homo sapiens
ctctgcttgccagccag

SEQ ID NO: 6134321 - DNA, 21 bp, Homo sapiens
ctctgcttgccgaaactggaa

SEQ ID NO: 6134322 - DNA, 18 bp, Homo sapiens
ctctgcttgcctggagac

SEQ ID NO: 6134323 - DNA, 13 bp, Homo sapiens
ctctgcttggctt

SEQ ID NO: 6134324 - DNA, 14 bp, Homo sapiens
ctctgctttaaagt

SEQ ID NO: 6134325 - DNA, 15 bp, Homo sapiens
ctctgctttcctttt

SEQ ID NO: 6134326 - DNA, 18 bp, Homo sapiens
ctctgctttccttttctc

SEQ ID NO: 6134327 - DNA, 17 bp, Homo sapiens
ctctgctttctcctgta

SEQ ID NO: 6134328 - DNA, 18 bp, Homo sapiens
ctctgctttctgatgttg

SEQ ID NO: 6134329 - DNA, 22 bp, Homo sapiens
ctctgcttttagtcacgtgtat

SEQ ID NO: 6134330 - DNA, 17 bp, Homo sapiens
ctctgcttttccattct

SEQ ID NO: 6134331 - DNA, 17 bp, Homo sapiens
ctctgcttttcctgtct

SEQ ID NO: 6134332 - DNA, 18 bp, Homo sapiens
ctctggaaaactattgag

SEQ ID NO: 6134333 - DNA, 17 bp, Homo sapiens
ctctggaaaagctgggg

SEQ ID NO: 6134334 - DNA, 20 bp, Homo sapiens
ctctggaaaatgtgacccag

SEQ ID NO: 6134335 - DNA, 23 bp, Homo sapiens
ctctggaaaggaggaaggagcct

SEQ ID NO: 6134336 - DNA, 22 bp, Homo sapiens
ctctggaaaggggggagctggg

SEQ ID NO: 6134337 - DNA, 19 bp, Homo sapiens
ctctggaaccatcctctgt

SEQ ID NO: 6134338 - DNA, 24 bp, Homo sapiens
ctctggaaccatcctctgttaccc

SEQ ID NO: 6134339 - DNA, 15 bp, Homo sapiens
ctctggaacccccca

SEQ ID NO: 6134340 - DNA, 19 bp, Homo sapiens
ctctggaaccccccaggcc

SEQ ID NO: 6134341 - DNA, 21 bp, Homo sapiens
ctctggaagagaggaatgcct

SEQ ID NO: 6134342 - DNA, 15 bp, Homo sapiens
ctctggaagagggag

SEQ ID NO: 6134343 - DNA, 16 bp, Homo sapiens
ctctggaagcccccca

SEQ ID NO: 6134344 - DNA, 22 bp, Homo sapiens
ctctggaagccccccacctttc

SEQ ID NO: 6134345 - DNA, 14 bp, Homo sapiens
ctctggaagcctgc

SEQ ID NO: 6134346 - DNA, 15 bp, Homo sapiens
ctctggaagcctgct

SEQ ID NO: 6134347 - DNA, 22 bp, Homo sapiens
ctctggaaggccccttccctgg

SEQ ID NO: 6134348 - DNA, 19 bp, Homo sapiens
ctctggaaggggcagccct

SEQ ID NO: 6134349 - DNA, 22 bp, Homo sapiens
ctctggaaggggcagccctgag

SEQ ID NO: 6134350 - DNA, 19 bp, Homo sapiens
ctctggaatagttacttta

SEQ ID NO: 6134351 - DNA, 17 bp, Homo sapiens
ctctggaatcttcccca

SEQ ID NO: 6134352 - DNA, 21 bp, Homo sapiens
ctctggaatgacatgtgtcaa

SEQ ID NO: 6134353 - DNA, 15 bp, Homo sapiens
ctctggaatgcatgg

SEQ ID NO: 6134354 - DNA, 14 bp, Homo sapiens
ctctggaatttgaa

SEQ ID NO: 6134355 - DNA, 16 bp, Homo sapiens
ctctggacaaagcgtt

SEQ ID NO: 6134356 - DNA, 19 bp, Homo sapiens
ctctggacagcagaagcct

SEQ ID NO: 6134357 - DNA, 21 bp, Homo sapiens
ctctggacagcagaagcctcc

SEQ ID NO: 6134358 - DNA, 14 bp, Homo sapiens
ctctggacaggcat

SEQ ID NO: 6134359 - DNA, 22 bp, Homo sapiens
ctctggacaggcatgttctctg

SEQ ID NO: 6134360 - DNA, 13 bp, Homo sapiens
ctctggaccagcc

SEQ ID NO: 6134361 - DNA, 22 bp, Homo sapiens
ctctggaccatacgcggaggag

SEQ ID NO: 6134362 - DNA, 14 bp, Homo sapiens
ctctggaccatgct

SEQ ID NO: 6134363 - DNA, 20 bp, Homo sapiens
ctctggacccttctgaagca

SEQ ID NO: 6134364 - DNA, 22 bp, Homo sapiens
ctctggacccttctgaagcaga

SEQ ID NO: 6134365 - DNA, 15 bp, Homo sapiens
ctctggacctcagga

SEQ ID NO: 6134366 - DNA, 21 bp, Homo sapiens
ctctggacctcaggagggcag

SEQ ID NO: 6134367 - DNA, 23 bp, Homo sapiens
ctctggacctcaggagggcaggc

SEQ ID NO: 6134368 - DNA, 15 bp, Homo sapiens
ctctggacctcggtg

SEQ ID NO: 6134369 - DNA, 17 bp, Homo sapiens
ctctggacctgaccaga

SEQ ID NO: 6134370 - DNA, 12 bp, Homo sapiens
ctctggacctgc

SEQ ID NO: 6134371 - DNA, 13 bp, Homo sapiens
ctctggacctgcc

SEQ ID NO: 6134372 - DNA, 14 bp, Homo sapiens
ctctggacctgccc

SEQ ID NO: 6134373 - DNA, 16 bp, Homo sapiens
ctctggacgtgaaata

SEQ ID NO: 6134374 - DNA, 17 bp, Homo sapiens
ctctggacgtgaaatac

SEQ ID NO: 6134375 - DNA, 18 bp, Homo sapiens
ctctggacgttgtgagaa

SEQ ID NO: 6134376 - DNA, 11 bp, Homo sapiens
ctctggactcc

SEQ ID NO: 6134377 - DNA, 20 bp, Homo sapiens
ctctggactccacgatgcct

SEQ ID NO: 6134378 - DNA, 15 bp, Homo sapiens
ctctggactccacgg

SEQ ID NO: 6134379 - DNA, 23 bp, Homo sapiens
ctctggactggaaagcacaagac

SEQ ID NO: 6134380 - DNA, 15 bp, Homo sapiens
ctctggactggcctg

SEQ ID NO: 6134381 - DNA, 16 bp, Homo sapiens
ctctggactggcctgt

SEQ ID NO: 6134382 - DNA, 13 bp, Homo sapiens
ctctggactggct

SEQ ID NO: 6134383 - DNA, 15 bp, Homo sapiens
ctctggactggctag

SEQ ID NO: 6134384 - DNA, 19 bp, Homo sapiens
ctctggactggctagagtc

SEQ ID NO: 6134385 - DNA, 14 bp, Homo sapiens
ctctggactgggaa

SEQ ID NO: 6134386 - DNA, 13 bp, Homo sapiens
ctctggactttct

SEQ ID NO: 6134387 - DNA, 17 bp, Homo sapiens
ctctggagaacagtggt

SEQ ID NO: 6134388 - DNA, 15 bp, Homo sapiens
ctctggagaaggcct

SEQ ID NO: 6134389 - DNA, 16 bp, Homo sapiens
ctctggagaaggcctg

SEQ ID NO: 6134390 - DNA, 17 bp, Homo sapiens
ctctggagacagcccca

SEQ ID NO: 6134391 - DNA, 10 bp, Homo sapiens
ctctggagag

SEQ ID NO: 6134392 - DNA, 12 bp, Homo sapiens
ctctggagagaa

SEQ ID NO: 6134393 - DNA, 22 bp, Homo sapiens
ctctggagaggaagccagtgga

SEQ ID NO: 6134394 - DNA, 18 bp, Homo sapiens
ctctggagcagccaaggc

SEQ ID NO: 6134395 - DNA, 14 bp, Homo sapiens
ctctggagcatttc

SEQ ID NO: 6134396 - DNA, 10 bp, Homo sapiens
ctctggagcc

SEQ ID NO: 6134397 - DNA, 16 bp, Homo sapiens
ctctggagccaaggca

SEQ ID NO: 6134398 - DNA, 13 bp, Homo sapiens
ctctggagccaga

SEQ ID NO: 6134399 - DNA, 15 bp, Homo sapiens
ctctggagccagccg

SEQ ID NO: 6134400 - DNA, 23 bp, Homo sapiens
ctctggagccagccgagcaggag

SEQ ID NO: 6134401 - DNA, 15 bp, Homo sapiens
ctctggagcccactg

SEQ ID NO: 6134402 - DNA, 13 bp, Homo sapiens
ctctggagcccct

SEQ ID NO: 6134403 - DNA, 16 bp, Homo sapiens
ctctggagcccctcct

SEQ ID NO: 6134404 - DNA, 13 bp, Homo sapiens
ctctggagcccta

SEQ ID NO: 6134405 - DNA, 21 bp, Homo sapiens
ctctggaggaagttctccagc

SEQ ID NO: 6134406 - DNA, 22 bp, Homo sapiens
ctctggaggaagttctccagct

SEQ ID NO: 6134407 - DNA, 15 bp, Homo sapiens
ctctggaggcctctg

SEQ ID NO: 6134408 - DNA, 20 bp, Homo sapiens
ctctggaggcctctgggcct

SEQ ID NO: 6134409 - DNA, 22 bp, Homo sapiens
ctctggaggcctctgggcctcc

SEQ ID NO: 6134410 - DNA, 19 bp, Homo sapiens
ctctggaggctgcagagct

SEQ ID NO: 6134411 - DNA, 15 bp, Homo sapiens
ctctggaggggaggg

SEQ ID NO: 6134412 - DNA, 20 bp, Homo sapiens
ctctggaggggtgtggctcc

SEQ ID NO: 6134413 - DNA, 17 bp, Homo sapiens
ctctggaggtcatctgg

SEQ ID NO: 6134414 - DNA, 18 bp, Homo sapiens
ctctggaggtgctgctct

SEQ ID NO: 6134415 - DNA, 20 bp, Homo sapiens
ctctggaggtgttgtgggga

SEQ ID NO: 6134416 - DNA, 16 bp, Homo sapiens
ctctggagtggccact

SEQ ID NO: 6134417 - DNA, 13 bp, Homo sapiens
ctctggagtgtgt

SEQ ID NO: 6134418 - DNA, 18 bp, Homo sapiens
ctctggagtgtgtggggg

SEQ ID NO: 6134419 - DNA, 16 bp, Homo sapiens
ctctggagtttcatgt

SEQ ID NO: 6134420 - DNA, 17 bp, Homo sapiens
ctctggagtttcatgtt

SEQ ID NO: 6134421 - DNA, 20 bp, Homo sapiens
ctctggagtttcatgttatg

SEQ ID NO: 6134422 - DNA, 13 bp, Homo sapiens
ctctggatccctg

SEQ ID NO: 6134423 - DNA, 17 bp, Homo sapiens
ctctggatccctggagg

SEQ ID NO: 6134424 - DNA, 15 bp, Homo sapiens
ctagataaaaagatg

SEQ ID NO: 6134425 - DNA, 14 bp, Homo sapiens
ctagataaaaggag

SEQ ID NO: 6134426 - DNA, 22 bp, Homo sapiens
ctagataatagggttttcagat

SEQ ID NO: 6134427 - DNA, 15 bp, Homo sapiens
ctagatacaataaat

SEQ ID NO: 6134428 - DNA, 17 bp, Homo sapiens
ctagatacaataaattg

SEQ ID NO: 6134429 - DNA, 16 bp, Homo sapiens
ctagatacagaataat

SEQ ID NO: 6134430 - DNA, 17 bp, Homo sapiens
ctagatacagaataatg

SEQ ID NO: 6134431 - DNA, 19 bp, Homo sapiens
ctagatacagaataatgga

SEQ ID NO: 6134432 - DNA, 21 bp, Homo sapiens
ctagatacaggactggttcct

SEQ ID NO: 6134433 - DNA, 24 bp, Homo sapiens
ctagatacctaaaacataagatca

SEQ ID NO: 6134434 - DNA, 14 bp, Homo sapiens
ctagatactggaaa

SEQ ID NO: 6134435 - DNA, 24 bp, Homo sapiens
ctagatactgtatcatgacaaaga

SEQ ID NO: 6134436 - DNA, 12 bp, Homo sapiens
ctagatagttta

SEQ ID NO: 6134437 - DNA, 22 bp, Homo sapiens
ctagatatgaatatatggcatt

SEQ ID NO: 6134438 - DNA, 15 bp, Homo sapiens
ctagatcaaggagcc

SEQ ID NO: 6134439 - DNA, 18 bp, Homo sapiens
ctagatcaattaattctt

SEQ ID NO: 6134440 - DNA, 15 bp, Homo sapiens
ctagatcagaacagg

SEQ ID NO: 6134441 - DNA, 15 bp, Homo sapiens
ctagatcataaggct

SEQ ID NO: 6134442 - DNA, 18 bp, Homo sapiens
ctagatcataaggcttca

SEQ ID NO: 6134443 - DNA, 18 bp, Homo sapiens
ctagatcatatttaaaga

SEQ ID NO: 6134444 - DNA, 23 bp, Homo sapiens
ctagatcatttgttctgggagta

SEQ ID NO: 6134445 - DNA, 18 bp, Homo sapiens
ctagatccacacacagag

SEQ ID NO: 6134446 - DNA, 20 bp, Homo sapiens
ctagatccagcccaaacctg

SEQ ID NO: 6134447 - DNA, 13 bp, Homo sapiens
ctagatccaggct

SEQ ID NO: 6134448 - DNA, 18 bp, Homo sapiens
ctagatcctgcaccccag

SEQ ID NO: 6134449 - DNA, 19 bp, Homo sapiens
ctagatcctgcaccccagc

SEQ ID NO: 6134450 - DNA, 17 bp, Homo sapiens
ctagatcgtctctaatg

SEQ ID NO: 6134451 - DNA, 23 bp, Homo sapiens
ctagatcgtctctaatgttaggt

SEQ ID NO: 6134452 - DNA, 19 bp, Homo sapiens
ctagatctagaatcagagc

SEQ ID NO: 6134453 - DNA, 21 bp, Homo sapiens
ctagatctcctgtaattttgt

SEQ ID NO: 6134454 - DNA, 16 bp, Homo sapiens
ctagatctgcaggctg

SEQ ID NO: 6134455 - DNA, 16 bp, Homo sapiens
ctagatcttacatctg

SEQ ID NO: 6134456 - DNA, 17 bp, Homo sapiens
ctagatctttgtgccaa

SEQ ID NO: 6134457 - DNA, 17 bp, Homo sapiens
ctagatgaagaaagaga

SEQ ID NO: 6134458 - DNA, 22 bp, Homo sapiens
ctagatgacataaaatttacat

SEQ ID NO: 6134459 - DNA, 12 bp, Homo sapiens
ctagatgacctc

SEQ ID NO: 6134460 - DNA, 15 bp, Homo sapiens
ctagatgattgaata

SEQ ID NO: 6134461 - DNA, 22 bp, Homo sapiens
ctagatgcacgtggggcccact

SEQ ID NO: 6134462 - DNA, 19 bp, Homo sapiens
ctagatgctttaggttgct

SEQ ID NO: 6134463 - DNA, 18 bp, Homo sapiens
ctagatggaatggaaaag

SEQ ID NO: 6134464 - DNA, 13 bp, Homo sapiens
ctagatggacctg

SEQ ID NO: 6134465 - DNA, 16 bp, Homo sapiens
ctagatggacctgcct

SEQ ID NO: 6134466 - DNA, 18 bp, Homo sapiens
ctagatggacctgcctgc

SEQ ID NO: 6134467 - DNA, 21 bp, Homo sapiens
ctagatggagaaagtaacaca

SEQ ID NO: 6134468 - DNA, 17 bp, Homo sapiens
ctagatgggttcttagc

SEQ ID NO: 6134469 - DNA, 15 bp, Homo sapiens
ctagatggttccctt

SEQ ID NO: 6134470 - DNA, 20 bp, Homo sapiens
ctagatggttccctttgttg

SEQ ID NO: 6134471 - DNA, 22 bp, Homo sapiens
ctagatgtagtattttttgtat

SEQ ID NO: 6134472 - DNA, 19 bp, Homo sapiens
ctagatgtatgtgaataaa

SEQ ID NO: 6134473 - DNA, 22 bp, Homo sapiens
ctagatgtgtagggctgagggc

SEQ ID NO: 6134474 - DNA, 17 bp, Homo sapiens
ctagatgtttaacaaat

SEQ ID NO: 6134475 - DNA, 22 bp, Homo sapiens
ctagatgtttattcttctagag

SEQ ID NO: 6134476 - DNA, 12 bp, Homo sapiens
ctagattaaaat

SEQ ID NO: 6134477 - DNA, 13 bp, Homo sapiens
ctagattaaaata

SEQ ID NO: 6134478 - DNA, 17 bp, Homo sapiens
ctagattatatcaaagt

SEQ ID NO: 6134479 - DNA, 20 bp, Homo sapiens
ctagattcaaaggttctagg

SEQ ID NO: 6134480 - DNA, 22 bp, Homo sapiens
ctagattctaacatattgccat

SEQ ID NO: 6134481 - DNA, 16 bp, Homo sapiens
ctagattctcacctgc

SEQ ID NO: 6134482 - DNA, 24 bp, Homo sapiens
ctagattgagagaagagacaaaca

SEQ ID NO: 6134483 - DNA, 21 bp, Homo sapiens
ctagattgctaaggagctgat

SEQ ID NO: 6134484 - DNA, 12 bp, Homo sapiens
ctagatttaata

SEQ ID NO: 6134485 - DNA, 14 bp, Homo sapiens
ctagatttaatata

SEQ ID NO: 6134486 - DNA, 13 bp, Homo sapiens
ctagatttataaa

SEQ ID NO: 6134487 - DNA, 16 bp, Homo sapiens
ctagatttataaatgc

SEQ ID NO: 6134488 - DNA, 12 bp, Homo sapiens
ctagatttcaag

SEQ ID NO: 6134489 - DNA, 17 bp, Homo sapiens
ctagatttctacattaa

SEQ ID NO: 6134490 - DNA, 22 bp, Homo sapiens
ctagatttgtccttttatttct

SEQ ID NO: 6134491 - DNA, 17 bp, Homo sapiens
ctagattttgttttgct

SEQ ID NO: 6134492 - DNA, 12 bp, Homo sapiens
ctagatttttaa

SEQ ID NO: 6134493 - DNA, 22 bp, Homo sapiens
ctagcaaaacatcttttcctga

SEQ ID NO: 6134494 - DNA, 19 bp, Homo sapiens
ctagcaaaagaagtaacaa

SEQ ID NO: 6134495 - DNA, 22 bp, Homo sapiens
ctagcaaacaaaaatagaatat

SEQ ID NO: 6134496 - DNA, 21 bp, Homo sapiens
ctagcaaacagatgtttgttt

SEQ ID NO: 6134497 - DNA, 17 bp, Homo sapiens
ctagcaacatatctctg

SEQ ID NO: 6134498 - DNA, 20 bp, Homo sapiens
ctagcaacatatctctgccg

SEQ ID NO: 6134499 - DNA, 21 bp, Homo sapiens
ctagcaaccgcctcaaaatgt

SEQ ID NO: 6134500 - DNA, 14 bp, Homo sapiens
ctagcaactgttgg

SEQ ID NO: 6134501 - DNA, 17 bp, Homo sapiens
ctagcaagaagattcta

SEQ ID NO: 6134502 - DNA, 18 bp, Homo sapiens
ctagcaagaagattctaa

SEQ ID NO: 6134503 - DNA, 16 bp, Homo sapiens
ctagcaagatagtctt

SEQ ID NO: 6134504 - DNA, 15 bp, Homo sapiens
ctagcaagtgagaga

SEQ ID NO: 6134505 - DNA, 18 bp, Homo sapiens
ctagcaagtgagagagat

SEQ ID NO: 6134506 - DNA, 13 bp, Homo sapiens
ctagcaagttgac

SEQ ID NO: 6134507 - DNA, 19 bp, Homo sapiens
ctagcaataagttgaatga

SEQ ID NO: 6134508 - DNA, 15 bp, Homo sapiens
ctagcaatacaggga

SEQ ID NO: 6134509 - DNA, 18 bp, Homo sapiens
ctagcacaaggagtgccc

SEQ ID NO: 6134510 - DNA, 19 bp, Homo sapiens
ctagcacaaggagtgcccg

SEQ ID NO: 6134511 - DNA, 21 bp, Homo sapiens
ctagcacacctgaatcagctg

SEQ ID NO: 6134512 - DNA, 20 bp, Homo sapiens
ctagcacagaggcctgactg

SEQ ID NO: 6134513 - DNA, 23 bp, Homo sapiens
ctagcacagaggcctgactgact

SEQ ID NO: 6134514 - DNA, 14 bp, Homo sapiens
ctagcacagatggc

SEQ ID NO: 6134515 - DNA, 23 bp, Homo sapiens
ctagcacagtaaaagtaaagact

SEQ ID NO: 6134516 - DNA, 21 bp, Homo sapiens
ctagcacatcatggcagtggg

SEQ ID NO: 6134517 - DNA, 15 bp, Homo sapiens
ctagcacatgcttca

SEQ ID NO: 6134518 - DNA, 15 bp, Homo sapiens
ctagcaccagggact

SEQ ID NO: 6134519 - DNA, 22 bp, Homo sapiens
ctagcaccattttaagtccctg

SEQ ID NO: 6134520 - DNA, 15 bp, Homo sapiens
ctagcaccctggaga

SEQ ID NO: 6134521 - DNA, 19 bp, Homo sapiens
ctagcacctccccagacag

SEQ ID NO: 6134522 - DNA, 22 bp, Homo sapiens
ctagcacctccccagacagggc

SEQ ID NO: 6134523 - DNA, 17 bp, Homo sapiens
ctagcactcacatgctg

SEQ ID NO: 6134524 - DNA, 20 bp, Homo sapiens
ctagcactgccccacatgca

SEQ ID NO: 6134525 - DNA, 17 bp, Homo sapiens
ctagcactttgggaggc

SEQ ID NO: 6134526 - DNA, 14 bp, Homo sapiens
ctagcagaaaatat

SEQ ID NO: 6134527 - DNA, 20 bp, Homo sapiens
ctagcagaaaatataaatgg

SEQ ID NO: 6134528 - DNA, 17 bp, Homo sapiens
ctagcagaaatctagaa

SEQ ID NO: 6134529 - DNA, 11 bp, Homo sapiens
ctagcagaagt

SEQ ID NO: 6134530 - DNA, 15 bp, Homo sapiens
ctagcagacactgcc

SEQ ID NO: 6134531 - DNA, 12 bp, Homo sapiens
ctagcagacaga

SEQ ID NO: 6134532 - DNA, 18 bp, Homo sapiens
ctagcagagcgtctggca

SEQ ID NO: 6134533 - DNA, 15 bp, Homo sapiens
ctagcagagtgctgg

SEQ ID NO: 6134534 - DNA, 18 bp, Homo sapiens
ctagcagagtgctggcac

SEQ ID NO: 6134535 - DNA, 21 bp, Homo sapiens
ctagcagagtgctggcactta

SEQ ID NO: 6134536 - DNA, 12 bp, Homo sapiens
ctagcagcaccg

SEQ ID NO: 6134537 - DNA, 23 bp, Homo sapiens
ctagcagcccttgtgtgtgccct

SEQ ID NO: 6134538 - DNA, 15 bp, Homo sapiens
ctagcagctggccta

SEQ ID NO: 6134539 - DNA, 22 bp, Homo sapiens
ctagcaggaacttctagctcat

SEQ ID NO: 6134540 - DNA, 22 bp, Homo sapiens
ctagcaggcaatgctgtacttt

SEQ ID NO: 6134541 - DNA, 13 bp, Homo sapiens
ctagcaggccccc

SEQ ID NO: 6134542 - DNA, 19 bp, Homo sapiens
ctagcaggccccctaggat

SEQ ID NO: 6134543 - DNA, 22 bp, Homo sapiens
ctagcaggcctaagacatgtga

SEQ ID NO: 6134544 - DNA, 18 bp, Homo sapiens
ctagcagggaaggtgaag

SEQ ID NO: 6134545 - DNA, 16 bp, Homo sapiens
ctagcagtatgtgtgc

SEQ ID NO: 6134546 - DNA, 17 bp, Homo sapiens
ctagcagtccccagctg

SEQ ID NO: 6134547 - DNA, 22 bp, Homo sapiens
ctagcagtccccagctgagtga

SEQ ID NO: 6134548 - DNA, 20 bp, Homo sapiens
ctagcagtggcaggcagagg

SEQ ID NO: 6134549 - DNA, 21 bp, Homo sapiens
ctagcagttgttgaggggagg

SEQ ID NO: 6134550 - DNA, 21 bp, Homo sapiens
ctagcagtttgcctctgcacg

SEQ ID NO: 6134551 - DNA, 20 bp, Homo sapiens
ctagcatacgtacacatttt

SEQ ID NO: 6134552 - DNA, 21 bp, Homo sapiens
ctagcatagaatagcgacagg

SEQ ID NO: 6134553 - DNA, 21 bp, Homo sapiens
ctagcatatagactatataat

SEQ ID NO: 6134554 - DNA, 18 bp, Homo sapiens
ctagcatatctgccttta

SEQ ID NO: 6134555 - DNA, 13 bp, Homo sapiens
ctagcatgccaac

SEQ ID NO: 6134556 - DNA, 15 bp, Homo sapiens
ctagcatgccaacaa

SEQ ID NO: 6134557 - DNA, 16 bp, Homo sapiens
ctagcatggggtcagc

SEQ ID NO: 6134558 - DNA, 21 bp, Homo sapiens
ctagcattcagggttatacac

SEQ ID NO: 6134559 - DNA, 22 bp, Homo sapiens
ctagcattcagggttatacaca

SEQ ID NO: 6134560 - DNA, 12 bp, Homo sapiens
ctagcattcctc

SEQ ID NO: 6134561 - DNA, 23 bp, Homo sapiens
ctagcattgtaaaattatttcat

SEQ ID NO: 6134562 - DNA, 17 bp, Homo sapiens
ctagcatttagagcttt

SEQ ID NO: 6134563 - DNA, 16 bp, Homo sapiens
ctagcatttatttctc

SEQ ID NO: 6134564 - DNA, 20 bp, Homo sapiens
ctagcatttatttctctggc

SEQ ID NO: 6134565 - DNA, 13 bp, Homo sapiens
ctagcatttcttc

SEQ ID NO: 6134566 - DNA, 16 bp, Homo sapiens
ctagccaaaccaggac

SEQ ID NO: 6134567 - DNA, 20 bp, Homo sapiens
ctagccaaaccaggaccctg

SEQ ID NO: 6134568 - DNA, 13 bp, Homo sapiens
ctagccaaacctc

SEQ ID NO: 6134569 - DNA, 17 bp, Homo sapiens
ctagccaaacctcacca

SEQ ID NO: 6134570 - DNA, 15 bp, Homo sapiens
ctagccaaagagctc

SEQ ID NO: 6134571 - DNA, 16 bp, Homo sapiens
ctagccaacatggtga

SEQ ID NO: 6134572 - DNA, 19 bp, Homo sapiens
ctagccaactcctccttgc

SEQ ID NO: 6134573 - DNA, 12 bp, Homo sapiens
ctagccaaggct

SEQ ID NO: 6134574 - DNA, 15 bp, Homo sapiens
ctagccaccaactct

SEQ ID NO: 6134575 - DNA, 21 bp, Homo sapiens
ctagccaccaactcttgcagg

SEQ ID NO: 6134576 - DNA, 13 bp, Homo sapiens
ctagccaccagtg

SEQ ID NO: 6134577 - DNA, 14 bp, Homo sapiens
ctagccaccagtgt

SEQ ID NO: 6134578 - DNA, 21 bp, Homo sapiens
ctagccaccagtgtcctccaa

SEQ ID NO: 6134579 - DNA, 18 bp, Homo sapiens
ctagccaccgcctcctac

SEQ ID NO: 6134580 - DNA, 14 bp, Homo sapiens
ctagccacctccca

SEQ ID NO: 6134581 - DNA, 15 bp, Homo sapiens
ctagccacctcccac

SEQ ID NO: 6134582 - DNA, 21 bp, Homo sapiens
ctagccacctcccaccccact

SEQ ID NO: 6134583 - DNA, 17 bp, Homo sapiens
ctagccacctcctcgtc

SEQ ID NO: 6134584 - DNA, 21 bp, Homo sapiens
ctagccactccctcccagaaa

SEQ ID NO: 6134585 - DNA, 14 bp, Homo sapiens
ctagccagaattct

SEQ ID NO: 6134586 - DNA, 16 bp, Homo sapiens
ctagccagaattctac

SEQ ID NO: 6134587 - DNA, 21 bp, Homo sapiens
ctagccagacaaaatttgaga

SEQ ID NO: 6134588 - DNA, 17 bp, Homo sapiens
ctagccagagcccttca

SEQ ID NO: 6134589 - DNA, 19 bp, Homo sapiens
ctagccagagcccttcact

SEQ ID NO: 6134590 - DNA, 19 bp, Homo sapiens
ctagccagaggagagagga

SEQ ID NO: 6134591 - DNA, 12 bp, Homo sapiens
ctagccagccaa

SEQ ID NO: 6134592 - DNA, 15 bp, Homo sapiens
ctagccagccaggaa

SEQ ID NO: 6134593 - DNA, 23 bp, Homo sapiens
ctagccaggaagtacttccacct

SEQ ID NO: 6134594 - DNA, 14 bp, Homo sapiens
ctagccaggagtct

SEQ ID NO: 6134595 - DNA, 20 bp, Homo sapiens
ctagccaggagtctgtgctc

SEQ ID NO: 6134596 - DNA, 21 bp, Homo sapiens
ctagccaggagtctgtgctct

SEQ ID NO: 6134597 - DNA, 12 bp, Homo sapiens
ctagccaggcct

SEQ ID NO: 6134598 - DNA, 14 bp, Homo sapiens
ctagccaggcctcc

SEQ ID NO: 6134599 - DNA, 17 bp, Homo sapiens
ctagccaggtctcctgg

SEQ ID NO: 6134600 - DNA, 20 bp, Homo sapiens
ctagccagtcactaggaatt

SEQ ID NO: 6134601 - DNA, 19 bp, Homo sapiens
ctctggatcctgctgtggc

SEQ ID NO: 6134602 - DNA, 17 bp, Homo sapiens
ctctggatctagaaggg

SEQ ID NO: 6134603 - DNA, 22 bp, Homo sapiens
ctctggatctgttccttggcag

SEQ ID NO: 6134604 - DNA, 23 bp, Homo sapiens
ctctggatgcctgattgccaagc

SEQ ID NO: 6134605 - DNA, 23 bp, Homo sapiens
ctctggatggaacgggcatgggc

SEQ ID NO: 6134606 - DNA, 19 bp, Homo sapiens
ctctggatggcaccagagg

SEQ ID NO: 6134607 - DNA, 20 bp, Homo sapiens
ctctggatggcaccagaggc

SEQ ID NO: 6134608 - DNA, 17 bp, Homo sapiens
ctctggattcagccttc

SEQ ID NO: 6134609 - DNA, 20 bp, Homo sapiens
ctctggattcagccttcttt

SEQ ID NO: 6134610 - DNA, 14 bp, Homo sapiens
ctctggattttgaa

SEQ ID NO: 6134611 - DNA, 16 bp, Homo sapiens
ctctggcacagtgatg

SEQ ID NO: 6134612 - DNA, 22 bp, Homo sapiens
ctctggcacagtgatgccgggc

SEQ ID NO: 6134613 - DNA, 13 bp, Homo sapiens
ctctggcacccag

SEQ ID NO: 6134614 - DNA, 12 bp, Homo sapiens
ctctggcagaga

SEQ ID NO: 6134615 - DNA, 16 bp, Homo sapiens
ctctggcagagaagga

SEQ ID NO: 6134616 - DNA, 11 bp, Homo sapiens
ctctggcagcc

SEQ ID NO: 6134617 - DNA, 15 bp, Homo sapiens
ctctggcagccacac

SEQ ID NO: 6134618 - DNA, 17 bp, Homo sapiens
ctctggcagccacactt

SEQ ID NO: 6134619 - DNA, 17 bp, Homo sapiens
ctctggcagcctcagag

SEQ ID NO: 6134620 - DNA, 14 bp, Homo sapiens
ctctggcagctcag

SEQ ID NO: 6134621 - DNA, 23 bp, Homo sapiens
ctctggcagctcagagagggtgg

SEQ ID NO: 6134622 - DNA, 20 bp, Homo sapiens
ctctggcaggtggccagggc

SEQ ID NO: 6134623 - DNA, 19 bp, Homo sapiens
ctctggcagttctggaatg

SEQ ID NO: 6134624 - DNA, 19 bp, Homo sapiens
ctctggcattagaattatt

SEQ ID NO: 6134625 - DNA, 13 bp, Homo sapiens
ctctggccaaggg

SEQ ID NO: 6134626 - DNA, 18 bp, Homo sapiens
ctctggccaagggccaga

SEQ ID NO: 6134627 - DNA, 17 bp, Homo sapiens
ctctggccaccctggcc

SEQ ID NO: 6134628 - DNA, 19 bp, Homo sapiens
ctctggccaccctggcccg

SEQ ID NO: 6134629 - DNA, 14 bp, Homo sapiens
ctctggccaggcat

SEQ ID NO: 6134630 - DNA, 18 bp, Homo sapiens
ctctggcccagaaagcct

SEQ ID NO: 6134631 - DNA, 23 bp, Homo sapiens
ctctggcccagaaagcctctctc

SEQ ID NO: 6134632 - DNA, 15 bp, Homo sapiens
ctctggccccaaggg

SEQ ID NO: 6134633 - DNA, 13 bp, Homo sapiens
ctctggccccagg

SEQ ID NO: 6134634 - DNA, 15 bp, Homo sapiens
ctctggccccctatt

SEQ ID NO: 6134635 - DNA, 20 bp, Homo sapiens
ctctggccccctattgtctc

SEQ ID NO: 6134636 - DNA, 15 bp, Homo sapiens
ctctggccccgctag

SEQ ID NO: 6134637 - DNA, 15 bp, Homo sapiens
ctctggcccctcacc

SEQ ID NO: 6134638 - DNA, 18 bp, Homo sapiens
ctctggcccctcacccac

SEQ ID NO: 6134639 - DNA, 22 bp, Homo sapiens
ctctggcccctcacccaccatg

SEQ ID NO: 6134640 - DNA, 20 bp, Homo sapiens
ctctggcccctctcaggctg

SEQ ID NO: 6134641 - DNA, 10 bp, Homo sapiens
ctctggccct

SEQ ID NO: 6134642 - DNA, 20 bp, Homo sapiens
ctctggccctcggtggctgc

SEQ ID NO: 6134643 - DNA, 15 bp, Homo sapiens
ctctggccctgcctt

SEQ ID NO: 6134644 - DNA, 14 bp, Homo sapiens
ctctggccctgtgt

SEQ ID NO: 6134645 - DNA, 15 bp, Homo sapiens
ctctggccctgtgta

SEQ ID NO: 6134646 - DNA, 22 bp, Homo sapiens
ctctggccctgtgtaggggcag

SEQ ID NO: 6134647 - DNA, 12 bp, Homo sapiens
ctctggcccttg

SEQ ID NO: 6134648 - DNA, 14 bp, Homo sapiens
ctctggcccttgcc

SEQ ID NO: 6134649 - DNA, 15 bp, Homo sapiens
ctctggcccttgcct

SEQ ID NO: 6134650 - DNA, 16 bp, Homo sapiens
ctctggcctcccaccc

SEQ ID NO: 6134651 - DNA, 18 bp, Homo sapiens
ctctggcctgggaaaagg

SEQ ID NO: 6134652 - DNA, 19 bp, Homo sapiens
ctctggccttcggcctcca

SEQ ID NO: 6134653 - DNA, 21 bp, Homo sapiens
ctctggccttcggcctccatc

SEQ ID NO: 6134654 - DNA, 20 bp, Homo sapiens
ctctggccttgccccaggcc

SEQ ID NO: 6134655 - DNA, 20 bp, Homo sapiens
ctctggccttggttcctcca

SEQ ID NO: 6134656 - DNA, 16 bp, Homo sapiens
ctctggcgacagtttt

SEQ ID NO: 6134657 - DNA, 15 bp, Homo sapiens
ctctggctactccct

SEQ ID NO: 6134658 - DNA, 18 bp, Homo sapiens
ctctggctactccctgga

SEQ ID NO: 6134659 - DNA, 19 bp, Homo sapiens
ctctggctactccctggac

SEQ ID NO: 6134660 - DNA, 14 bp, Homo sapiens
ctctggctagagcc

SEQ ID NO: 6134661 - DNA, 22 bp, Homo sapiens
ctctggctagagccgaggggag

SEQ ID NO: 6134662 - DNA, 22 bp, Homo sapiens
ctctggctagaggccagcccca

SEQ ID NO: 6134663 - DNA, 15 bp, Homo sapiens
ctctggctcacagac

SEQ ID NO: 6134664 - DNA, 12 bp, Homo sapiens
ctctggctcagc

SEQ ID NO: 6134665 - DNA, 13 bp, Homo sapiens
ctctggctcagcc

SEQ ID NO: 6134666 - DNA, 15 bp, Homo sapiens
ctctggctcagcctg

SEQ ID NO: 6134667 - DNA, 19 bp, Homo sapiens
ctctggctcagcctgtctc

SEQ ID NO: 6134668 - DNA, 15 bp, Homo sapiens
ctctggctcagctgt

SEQ ID NO: 6134669 - DNA, 22 bp, Homo sapiens
ctctggctcagctgtggtccca

SEQ ID NO: 6134670 - DNA, 15 bp, Homo sapiens
ctctggctcagggcc

SEQ ID NO: 6134671 - DNA, 22 bp, Homo sapiens
ctctggctcagggcccacctcc

SEQ ID NO: 6134672 - DNA, 16 bp, Homo sapiens
ctctggctccaggcag

SEQ ID NO: 6134673 - DNA, 17 bp, Homo sapiens
ctctggctccccaaggc

SEQ ID NO: 6134674 - DNA, 14 bp, Homo sapiens
ctctggctccctgg

SEQ ID NO: 6134675 - DNA, 22 bp, Homo sapiens
ctctggctccttcagcagctag

SEQ ID NO: 6134676 - DNA, 15 bp, Homo sapiens
ctctggctctacaca

SEQ ID NO: 6134677 - DNA, 14 bp, Homo sapiens
ctctggctctagga

SEQ ID NO: 6134678 - DNA, 20 bp, Homo sapiens
ctctggctgaaccctgtgct

SEQ ID NO: 6134679 - DNA, 16 bp, Homo sapiens
ctctggctgccaagat

SEQ ID NO: 6134680 - DNA, 12 bp, Homo sapiens
ctctggctgcct

SEQ ID NO: 6134681 - DNA, 16 bp, Homo sapiens
ctctggctggagagga

SEQ ID NO: 6134682 - DNA, 22 bp, Homo sapiens
ctctggctgtaaggctctagat

SEQ ID NO: 6134683 - DNA, 22 bp, Homo sapiens
ctctggctgtctgtctgcagtg

SEQ ID NO: 6134684 - DNA, 12 bp, Homo sapiens
ctctggcttcca

SEQ ID NO: 6134685 - DNA, 14 bp, Homo sapiens
ctctggcttccagg

SEQ ID NO: 6134686 - DNA, 17 bp, Homo sapiens
ctctggcttccaggtat

SEQ ID NO: 6134687 - DNA, 18 bp, Homo sapiens
ctctggcttccatgctcc

SEQ ID NO: 6134688 - DNA, 13 bp, Homo sapiens
ctctggcttccct

SEQ ID NO: 6134689 - DNA, 23 bp, Homo sapiens
ctctggcttctctcctcagactt

SEQ ID NO: 6134690 - DNA, 19 bp, Homo sapiens
ctctggcttgccccaggac

SEQ ID NO: 6134691 - DNA, 20 bp, Homo sapiens
ctctggcttggccacagcca

SEQ ID NO: 6134692 - DNA, 21 bp, Homo sapiens
ctctggcttggccacagccag

SEQ ID NO: 6134693 - DNA, 14 bp, Homo sapiens
ctctggcttggcct

SEQ ID NO: 6134694 - DNA, 15 bp, Homo sapiens
ctctggctttcccag

SEQ ID NO: 6134695 - DNA, 22 bp, Homo sapiens
ctctggctttcccaggagatgg

SEQ ID NO: 6134696 - DNA, 23 bp, Homo sapiens
ctctgggaacctcccagaggtcc

SEQ ID NO: 6134697 - DNA, 14 bp, Homo sapiens
ctctgggaacttct

SEQ ID NO: 6134698 - DNA, 11 bp, Homo sapiens
ctctgggaaga

SEQ ID NO: 6134699 - DNA, 21 bp, Homo sapiens
ctctgggaaggggtgccctct

SEQ ID NO: 6134700 - DNA, 24 bp, Homo sapiens
ctctgggaaggggtgccctctgga

SEQ ID NO: 6134701 - DNA, 16 bp, Homo sapiens
ctctgggaccaggctc

SEQ ID NO: 6134702 - DNA, 12 bp, Homo sapiens
ctctgggaccca

SEQ ID NO: 6134703 - DNA, 19 bp, Homo sapiens
ctctgggacccacagaact

SEQ ID NO: 6134704 - DNA, 15 bp, Homo sapiens
ctctgggaccccagc

SEQ ID NO: 6134705 - DNA, 17 bp, Homo sapiens
ctctgggaccccagctg

SEQ ID NO: 6134706 - DNA, 18 bp, Homo sapiens
ctctgggaccccagctgc

SEQ ID NO: 6134707 - DNA, 17 bp, Homo sapiens
ctctgggactctcctcc

SEQ ID NO: 6134708 - DNA, 12 bp, Homo sapiens
ctctgggagaaa

SEQ ID NO: 6134709 - DNA, 16 bp, Homo sapiens
ctctgggagagccagc

SEQ ID NO: 6134710 - DNA, 17 bp, Homo sapiens
ctctgggagagccagct

SEQ ID NO: 6134711 - DNA, 18 bp, Homo sapiens
ctctgggagagccagctt

SEQ ID NO: 6134712 - DNA, 22 bp, Homo sapiens
ctctgggagagccagctttgct

SEQ ID NO: 6134713 - DNA, 14 bp, Homo sapiens
ctctgggagcccag

SEQ ID NO: 6134714 - DNA, 16 bp, Homo sapiens
ctctgggagcccagaa

SEQ ID NO: 6134715 - DNA, 18 bp, Homo sapiens
ctctgggagtaatacttt

SEQ ID NO: 6134716 - DNA, 20 bp, Homo sapiens
ctctgggagtccccatccca

SEQ ID NO: 6134717 - DNA, 21 bp, Homo sapiens
ctctgggagtccccatcccat

SEQ ID NO: 6134718 - DNA, 19 bp, Homo sapiens
ctctgggatgcaggcatgc

SEQ ID NO: 6134719 - DNA, 21 bp, Homo sapiens
ctctgggcaaagcccctcaca

SEQ ID NO: 6134720 - DNA, 15 bp, Homo sapiens
ctctgggcacagtgc

SEQ ID NO: 6134721 - DNA, 14 bp, Homo sapiens
ctctgggcagcctg

SEQ ID NO: 6134722 - DNA, 16 bp, Homo sapiens
ctctgggcagcctgct

SEQ ID NO: 6134723 - DNA, 23 bp, Homo sapiens
ctctgggcagcctgctttggcct

SEQ ID NO: 6134724 - DNA, 17 bp, Homo sapiens
ctctgggcagtgtggcc

SEQ ID NO: 6134725 - DNA, 14 bp, Homo sapiens
ctctgggccacttg

SEQ ID NO: 6134726 - DNA, 20 bp, Homo sapiens
ctctgggcccagagagaggc

SEQ ID NO: 6134727 - DNA, 20 bp, Homo sapiens
ctctgggccgggcctggggc

SEQ ID NO: 6134728 - DNA, 16 bp, Homo sapiens
ctctgggcctgagggt

SEQ ID NO: 6134729 - DNA, 18 bp, Homo sapiens
ctctgggcctgtgtgtgg

SEQ ID NO: 6134730 - DNA, 13 bp, Homo sapiens
ctctgggcctgtt

SEQ ID NO: 6134731 - DNA, 16 bp, Homo sapiens
ctctgggcctgttctc

SEQ ID NO: 6134732 - DNA, 18 bp, Homo sapiens
ctctgggcctgttctctt

SEQ ID NO: 6134733 - DNA, 23 bp, Homo sapiens
ctctgggcggtccagaaggagca

SEQ ID NO: 6134734 - DNA, 17 bp, Homo sapiens
ctctgggctatggacac

SEQ ID NO: 6134735 - DNA, 22 bp, Homo sapiens
ctctgggctcacaccagccctg

SEQ ID NO: 6134736 - DNA, 23 bp, Homo sapiens
ctctgggctcacaccagccctgg

SEQ ID NO: 6134737 - DNA, 16 bp, Homo sapiens
ctctgggctcagggct

SEQ ID NO: 6134738 - DNA, 11 bp, Homo sapiens
ctctgggctct

SEQ ID NO: 6134739 - DNA, 15 bp, Homo sapiens
ctctgggctctgagt

SEQ ID NO: 6134740 - DNA, 21 bp, Homo sapiens
ctctgggctgagcctactgtc

SEQ ID NO: 6134741 - DNA, 20 bp, Homo sapiens
ctctgggctggatgagctcc

SEQ ID NO: 6134742 - DNA, 22 bp, Homo sapiens
ctctgggctggatgagctccca

SEQ ID NO: 6134743 - DNA, 23 bp, Homo sapiens
ctctgggctttgattccatctcc

SEQ ID NO: 6134744 - DNA, 19 bp, Homo sapiens
ctctggggacagcttcctc

SEQ ID NO: 6134745 - DNA, 21 bp, Homo sapiens
ctctggggacccgctgggggc

SEQ ID NO: 6134746 - DNA, 21 bp, Homo sapiens
ctctggggagaccgagtgtgg

SEQ ID NO: 6134747 - DNA, 15 bp, Homo sapiens
ctctggggatgggtg

SEQ ID NO: 6134748 - DNA, 18 bp, Homo sapiens
ctctggggatgggtgggg

SEQ ID NO: 6134749 - DNA, 17 bp, Homo sapiens
ctctggggatttctggg

SEQ ID NO: 6134750 - DNA, 14 bp, Homo sapiens
ctctggggcagagc

SEQ ID NO: 6134751 - DNA, 16 bp, Homo sapiens
ctctggggcagaggaa

SEQ ID NO: 6134752 - DNA, 14 bp, Homo sapiens
ctctggggcagatc

SEQ ID NO: 6134753 - DNA, 15 bp, Homo sapiens
ctctggggcagcccc

SEQ ID NO: 6134754 - DNA, 16 bp, Homo sapiens
ctctggggcaggacca

SEQ ID NO: 6134755 - DNA, 21 bp, Homo sapiens
ctctggggctcagccctgagc

SEQ ID NO: 6134756 - DNA, 16 bp, Homo sapiens
ctctggggctctaggg

SEQ ID NO: 6134757 - DNA, 19 bp, Homo sapiens
ctctggggctggcaccagc

SEQ ID NO: 6134758 - DNA, 15 bp, Homo sapiens
ctctggggctgtgtt

SEQ ID NO: 6134759 - DNA, 21 bp, Homo sapiens
ctctggggctgttgaagtcac

SEQ ID NO: 6134760 - DNA, 22 bp, Homo sapiens
ctctggggctgttgaagtcacc

SEQ ID NO: 6134761 - DNA, 15 bp, Homo sapiens
ctctgggggctctgg

SEQ ID NO: 6134762 - DNA, 18 bp, Homo sapiens
ctctgggggctctggcca

SEQ ID NO: 6134763 - DNA, 21 bp, Homo sapiens
ctctgggggctgaggagcagc

SEQ ID NO: 6134764 - DNA, 15 bp, Homo sapiens
ctctggggggcaggg

SEQ ID NO: 6134765 - DNA, 16 bp, Homo sapiens
ctctggggggcagttg

SEQ ID NO: 6134766 - DNA, 16 bp, Homo sapiens
ctctggggggtggcca

SEQ ID NO: 6134767 - DNA, 21 bp, Homo sapiens
ctctggggggtggccaggccg

SEQ ID NO: 6134768 - DNA, 17 bp, Homo sapiens
ctctggggggttgcctc

SEQ ID NO: 6134769 - DNA, 20 bp, Homo sapiens
ctctggggggttgcctcgag

SEQ ID NO: 6134770 - DNA, 21 bp, Homo sapiens
ctctggggggttgcctcgagt

SEQ ID NO: 6134771 - DNA, 16 bp, Homo sapiens
ctctgggggtcctctc

SEQ ID NO: 6134772 - DNA, 18 bp, Homo sapiens
ctctgggggtcctctctg

SEQ ID NO: 6134773 - DNA, 19 bp, Homo sapiens
ctctggggtaggctgctcc

SEQ ID NO: 6134774 - DNA, 13 bp, Homo sapiens
ctctggggtggga

SEQ ID NO: 6134775 - DNA, 14 bp, Homo sapiens
ctctggggtgggag

SEQ ID NO: 6134776 - DNA, 15 bp, Homo sapiens
ctctggggtgggcag

SEQ ID NO: 6134777 - DNA, 16 bp, Homo sapiens
ctctggggttcatcta

SEQ ID NO: 6134778 - DNA, 15 bp, Homo sapiens
ctctgggtaggaaaa

SEQ ID NO: 6134779 - DNA, 20 bp, Homo sapiens
ctctgggtcagaaccagagg

SEQ ID NO: 6134780 - DNA, 19 bp, Homo sapiens
ctagccatggctggcagag

SEQ ID NO: 6134781 - DNA, 15 bp, Homo sapiens
ctagccattcctggt

SEQ ID NO: 6134782 - DNA, 21 bp, Homo sapiens
ctagccattcctggtacccag

SEQ ID NO: 6134783 - DNA, 12 bp, Homo sapiens
ctagcccaccct

SEQ ID NO: 6134784 - DNA, 21 bp, Homo sapiens
ctagcccactccctgcctaca

SEQ ID NO: 6134785 - DNA, 14 bp, Homo sapiens
ctagcccagactct

SEQ ID NO: 6134786 - DNA, 14 bp, Homo sapiens
ctagcccaggagag

SEQ ID NO: 6134787 - DNA, 18 bp, Homo sapiens
ctagcccaggagagagaa

SEQ ID NO: 6134788 - DNA, 23 bp, Homo sapiens
ctagcccaggagagagaaagcca

SEQ ID NO: 6134789 - DNA, 23 bp, Homo sapiens
ctagcccagtccctggagctgtc

SEQ ID NO: 6134790 - DNA, 19 bp, Homo sapiens
ctagcccatggacttcaca

SEQ ID NO: 6134791 - DNA, 12 bp, Homo sapiens
ctagccccaccc

SEQ ID NO: 6134792 - DNA, 13 bp, Homo sapiens
ctagccccagaga

SEQ ID NO: 6134793 - DNA, 20 bp, Homo sapiens
ctagccccagagatgccagc

SEQ ID NO: 6134794 - DNA, 21 bp, Homo sapiens
ctagccccagagatgccagcc

SEQ ID NO: 6134795 - DNA, 23 bp, Homo sapiens
ctagccccagagatgccagccct

SEQ ID NO: 6134796 - DNA, 12 bp, Homo sapiens
ctagccccagcg

SEQ ID NO: 6134797 - DNA, 13 bp, Homo sapiens
ctagccccagggt

SEQ ID NO: 6134798 - DNA, 15 bp, Homo sapiens
ctagccccagggtga

SEQ ID NO: 6134799 - DNA, 21 bp, Homo sapiens
ctagccccaggtcttttcttt

SEQ ID NO: 6134800 - DNA, 21 bp, Homo sapiens
ctagcccctctggattccctt

SEQ ID NO: 6134801 - DNA, 13 bp, Homo sapiens
ctagccctcagcc

SEQ ID NO: 6134802 - DNA, 18 bp, Homo sapiens
ctagccctctcacattta

SEQ ID NO: 6134803 - DNA, 19 bp, Homo sapiens
ctagccctctcacatttat

SEQ ID NO: 6134804 - DNA, 16 bp, Homo sapiens
ctagccctgagcccgg

SEQ ID NO: 6134805 - DNA, 17 bp, Homo sapiens
ctagccctgagcccggc

SEQ ID NO: 6134806 - DNA, 18 bp, Homo sapiens
ctagccctgagcccggcc

SEQ ID NO: 6134807 - DNA, 16 bp, Homo sapiens
ctagccctgcggagcc

SEQ ID NO: 6134808 - DNA, 13 bp, Homo sapiens
ctagccctgggac

SEQ ID NO: 6134809 - DNA, 19 bp, Homo sapiens
ctagccctggttagctgac

SEQ ID NO: 6134810 - DNA, 12 bp, Homo sapiens
ctagcccttcca

SEQ ID NO: 6134811 - DNA, 19 bp, Homo sapiens
ctagcccttccagcctggg

SEQ ID NO: 6134812 - DNA, 21 bp, Homo sapiens
ctagcccttccagcctgggac

SEQ ID NO: 6134813 - DNA, 22 bp, Homo sapiens
ctagcccttccagcctgggaca

SEQ ID NO: 6134814 - DNA, 13 bp, Homo sapiens
ctagcccttccct

SEQ ID NO: 6134815 - DNA, 16 bp, Homo sapiens
ctagcccttccctgag

SEQ ID NO: 6134816 - DNA, 17 bp, Homo sapiens
ctagcccttccctgagt

SEQ ID NO: 6134817 - DNA, 17 bp, Homo sapiens
ctagccgacctcagcct

SEQ ID NO: 6134818 - DNA, 19 bp, Homo sapiens
ctagccgacctcagccttc

SEQ ID NO: 6134819 - DNA, 20 bp, Homo sapiens
ctagccgacctcagccttcc

SEQ ID NO: 6134820 - DNA, 14 bp, Homo sapiens
ctagccgctgccct

SEQ ID NO: 6134821 - DNA, 20 bp, Homo sapiens
ctagccgctgccctgggtcc

SEQ ID NO: 6134822 - DNA, 19 bp, Homo sapiens
ctagccggttcctgtccct

SEQ ID NO: 6134823 - DNA, 19 bp, Homo sapiens
ctagcctatcaagccttag

SEQ ID NO: 6134824 - DNA, 17 bp, Homo sapiens
ctagcctatgtctggca

SEQ ID NO: 6134825 - DNA, 18 bp, Homo sapiens
ctagcctatgtctggcag

SEQ ID NO: 6134826 - DNA, 21 bp, Homo sapiens
ctagcctatttacctgcaggc

SEQ ID NO: 6134827 - DNA, 13 bp, Homo sapiens
ctagcctcacgct

SEQ ID NO: 6134828 - DNA, 13 bp, Homo sapiens
ctagcctcagggg

SEQ ID NO: 6134829 - DNA, 14 bp, Homo sapiens
ctagcctctgagat

SEQ ID NO: 6134830 - DNA, 14 bp, Homo sapiens
ctagcctctggact

SEQ ID NO: 6134831 - DNA, 17 bp, Homo sapiens
ctagcctctggactgga

SEQ ID NO: 6134832 - DNA, 20 bp, Homo sapiens
ctagcctctggactggaaag

SEQ ID NO: 6134833 - DNA, 20 bp, Homo sapiens
ctagcctgatgagattttta

SEQ ID NO: 6134834 - DNA, 16 bp, Homo sapiens
ctagcctgctctgcca

SEQ ID NO: 6134835 - DNA, 17 bp, Homo sapiens
ctagcctggatggcccc

SEQ ID NO: 6134836 - DNA, 17 bp, Homo sapiens
ctagcctgggccagaga

SEQ ID NO: 6134837 - DNA, 20 bp, Homo sapiens
ctagcctggggcttgaattt

SEQ ID NO: 6134838 - DNA, 22 bp, Homo sapiens
ctagcctgtgcctctgggactg

SEQ ID NO: 6134839 - DNA, 17 bp, Homo sapiens
ctagccttatcctctga

SEQ ID NO: 6134840 - DNA, 21 bp, Homo sapiens
ctagccttatcctctgatctc

SEQ ID NO: 6134841 - DNA, 23 bp, Homo sapiens
ctagcctttggctctggagacag

SEQ ID NO: 6134842 - DNA, 17 bp, Homo sapiens
ctagcgaacgtatttct

SEQ ID NO: 6134843 - DNA, 20 bp, Homo sapiens
ctagcgaacgtatttctcca

SEQ ID NO: 6134844 - DNA, 16 bp, Homo sapiens
ctagcgatctctcctg

SEQ ID NO: 6134845 - DNA, 21 bp, Homo sapiens
ctagcgcagttttttttttct

SEQ ID NO: 6134846 - DNA, 16 bp, Homo sapiens
ctagcgctgccgcacc

SEQ ID NO: 6134847 - DNA, 20 bp, Homo sapiens
ctagcggagcccagcctggg

SEQ ID NO: 6134848 - DNA, 22 bp, Homo sapiens
ctagcggagttccagcaaacaa

SEQ ID NO: 6134849 - DNA, 16 bp, Homo sapiens
ctagcgtagtgcagca

SEQ ID NO: 6134850 - DNA, 19 bp, Homo sapiens
ctagcgtagtgcagcaggg

SEQ ID NO: 6134851 - DNA, 18 bp, Homo sapiens
ctagctaaaaccaaagga

SEQ ID NO: 6134852 - DNA, 19 bp, Homo sapiens
ctagctaactaattctgtc

SEQ ID NO: 6134853 - DNA, 16 bp, Homo sapiens
ctagctaagcaagcca

SEQ ID NO: 6134854 - DNA, 15 bp, Homo sapiens
ctagctaataaacct

SEQ ID NO: 6134855 - DNA, 16 bp, Homo sapiens
ctagctaattatttaa

SEQ ID NO: 6134856 - DNA, 20 bp, Homo sapiens
ctagctacttggcaggctga

SEQ ID NO: 6134857 - DNA, 14 bp, Homo sapiens
ctagctagaaatat

SEQ ID NO: 6134858 - DNA, 15 bp, Homo sapiens
ctagctagaaatatg

SEQ ID NO: 6134859 - DNA, 13 bp, Homo sapiens
ctagctagatgct

SEQ ID NO: 6134860 - DNA, 18 bp, Homo sapiens
ctagctagatgctttagg

SEQ ID NO: 6134861 - DNA, 16 bp, Homo sapiens
ctagctagccagccaa

SEQ ID NO: 6134862 - DNA, 16 bp, Homo sapiens
ctagctagctcaacta

SEQ ID NO: 6134863 - DNA, 14 bp, Homo sapiens
ctagctatatattt

SEQ ID NO: 6134864 - DNA, 19 bp, Homo sapiens
ctagctatgctgtatctgt

SEQ ID NO: 6134865 - DNA, 13 bp, Homo sapiens
ctagctcaccagg

SEQ ID NO: 6134866 - DNA, 15 bp, Homo sapiens
ctagctcaccaggcc

SEQ ID NO: 6134867 - DNA, 23 bp, Homo sapiens
ctagctcagacatctactacagc

SEQ ID NO: 6134868 - DNA, 16 bp, Homo sapiens
ctagctccccaatccc

SEQ ID NO: 6134869 - DNA, 14 bp, Homo sapiens
ctagctcccctcct

SEQ ID NO: 6134870 - DNA, 15 bp, Homo sapiens
ctagctcccctcctc

SEQ ID NO: 6134871 - DNA, 16 bp, Homo sapiens
ctagctcccctcctct

SEQ ID NO: 6134872 - DNA, 19 bp, Homo sapiens
ctagctcctcctcctgggc

SEQ ID NO: 6134873 - DNA, 20 bp, Homo sapiens
ctagctctatgtttacaaat

SEQ ID NO: 6134874 - DNA, 16 bp, Homo sapiens
ctagctctcacagaca

SEQ ID NO: 6134875 - DNA, 13 bp, Homo sapiens
ctagctctccata

SEQ ID NO: 6134876 - DNA, 16 bp, Homo sapiens
ctagctctctaggcct

SEQ ID NO: 6134877 - DNA, 22 bp, Homo sapiens
ctagctctctaggcctctccag

SEQ ID NO: 6134878 - DNA, 14 bp, Homo sapiens
ctagctctgagcca

SEQ ID NO: 6134879 - DNA, 19 bp, Homo sapiens
ctagctctgagccagttca

SEQ ID NO: 6134880 - DNA, 10 bp, Homo sapiens
ctagctctta

SEQ ID NO: 6134881 - DNA, 12 bp, Homo sapiens
ctagctcttccc

SEQ ID NO: 6134882 - DNA, 19 bp, Homo sapiens
ctagctcttgggcctgacc

SEQ ID NO: 6134883 - DNA, 19 bp, Homo sapiens
ctagctctttgggcctctc

SEQ ID NO: 6134884 - DNA, 17 bp, Homo sapiens
ctagctgaatgtttttc

SEQ ID NO: 6134885 - DNA, 18 bp, Homo sapiens
ctagctgaatgtttttct

SEQ ID NO: 6134886 - DNA, 20 bp, Homo sapiens
ctagctgaccccgagaagtg

SEQ ID NO: 6134887 - DNA, 18 bp, Homo sapiens
ctagctgatcagaatttt

SEQ ID NO: 6134888 - DNA, 17 bp, Homo sapiens
ctagctgcacagggcag

SEQ ID NO: 6134889 - DNA, 19 bp, Homo sapiens
ctagctgcagatgcctctg

SEQ ID NO: 6134890 - DNA, 13 bp, Homo sapiens
ctagctgccactt

SEQ ID NO: 6134891 - DNA, 18 bp, Homo sapiens
ctagctgctacaaagaag

SEQ ID NO: 6134892 - DNA, 19 bp, Homo sapiens
ctagctggaattttttatt

SEQ ID NO: 6134893 - DNA, 21 bp, Homo sapiens
ctagctggagaggagccctgc

SEQ ID NO: 6134894 - DNA, 15 bp, Homo sapiens
ctagctggagtgcca

SEQ ID NO: 6134895 - DNA, 19 bp, Homo sapiens
ctagctggagtgccatggc

SEQ ID NO: 6134896 - DNA, 12 bp, Homo sapiens
ctagctgggggt

SEQ ID NO: 6134897 - DNA, 22 bp, Homo sapiens
ctagctgggggtgggccaggct

SEQ ID NO: 6134898 - DNA, 15 bp, Homo sapiens
ctagctggtggtttc

SEQ ID NO: 6134899 - DNA, 17 bp, Homo sapiens
ctagctggtggtttcac

SEQ ID NO: 6134900 - DNA, 16 bp, Homo sapiens
ctagctgtcccatggg

SEQ ID NO: 6134901 - DNA, 20 bp, Homo sapiens
ctagctgtgccccctctggt

SEQ ID NO: 6134902 - DNA, 12 bp, Homo sapiens
ctagctgtgtgc

SEQ ID NO: 6134903 - DNA, 12 bp, Homo sapiens
ctagctgttagg

SEQ ID NO: 6134904 - DNA, 16 bp, Homo sapiens
ctagctgttctggact

SEQ ID NO: 6134905 - DNA, 15 bp, Homo sapiens
ctagctgttcttttt

SEQ ID NO: 6134906 - DNA, 20 bp, Homo sapiens
ctagcttaagtgtaaatgaa

SEQ ID NO: 6134907 - DNA, 20 bp, Homo sapiens
ctagcttacatgagaacaga

SEQ ID NO: 6134908 - DNA, 22 bp, Homo sapiens
ctagcttagagcctccctcaat

SEQ ID NO: 6134909 - DNA, 17 bp, Homo sapiens
ctagcttcatgcctcag

SEQ ID NO: 6134910 - DNA, 21 bp, Homo sapiens
ctagcttcatgcctcagtttc

SEQ ID NO: 6134911 - DNA, 15 bp, Homo sapiens
ctagcttctgctttt

SEQ ID NO: 6134912 - DNA, 20 bp, Homo sapiens
ctagcttgacacagtcagca

SEQ ID NO: 6134913 - DNA, 18 bp, Homo sapiens
ctagctttacgctcatca

SEQ ID NO: 6134914 - DNA, 20 bp, Homo sapiens
ctagctttatatatggacat

SEQ ID NO: 6134915 - DNA, 23 bp, Homo sapiens
ctagctttatatatggacatggc

SEQ ID NO: 6134916 - DNA, 18 bp, Homo sapiens
ctagctttatattttgtt

SEQ ID NO: 6134917 - DNA, 22 bp, Homo sapiens
ctagctttcctttacagctgtt

SEQ ID NO: 6134918 - DNA, 23 bp, Homo sapiens
ctagctttgttgtcctcccagga

SEQ ID NO: 6134919 - DNA, 13 bp, Homo sapiens
ctagcttttaaaa

SEQ ID NO: 6134920 - DNA, 14 bp, Homo sapiens
ctagcttttaaaaa

SEQ ID NO: 6134921 - DNA, 16 bp, Homo sapiens
ctagcttttaaaaaat

SEQ ID NO: 6134922 - DNA, 19 bp, Homo sapiens
ctagcttttaaaaaatatt

SEQ ID NO: 6134923 - DNA, 15 bp, Homo sapiens
ctagcttttaggaaa

SEQ ID NO: 6134924 - DNA, 20 bp, Homo sapiens
ctagcttttttcctcctttc

SEQ ID NO: 6134925 - DNA, 15 bp, Homo sapiens
ctaggaaaagttggg

SEQ ID NO: 6134926 - DNA, 14 bp, Homo sapiens
ctaggaaaataaaa

SEQ ID NO: 6134927 - DNA, 15 bp, Homo sapiens
ctaggaaaataaaac

SEQ ID NO: 6134928 - DNA, 12 bp, Homo sapiens
ctaggaaaatac

SEQ ID NO: 6134929 - DNA, 15 bp, Homo sapiens
ctaggaaaatatttt

SEQ ID NO: 6134930 - DNA, 17 bp, Homo sapiens
ctaggaaaatattttga

SEQ ID NO: 6134931 - DNA, 19 bp, Homo sapiens
ctaggaaaccagctcgtgg

SEQ ID NO: 6134932 - DNA, 14 bp, Homo sapiens
ctaggaaacccaag

SEQ ID NO: 6134933 - DNA, 13 bp, Homo sapiens
ctaggaaagaaat

SEQ ID NO: 6134934 - DNA, 18 bp, Homo sapiens
ctaggaaagagttgagca

SEQ ID NO: 6134935 - DNA, 15 bp, Homo sapiens
ctaggaaaggcagaa

SEQ ID NO: 6134936 - DNA, 16 bp, Homo sapiens
ctaggaaaggcagaaa

SEQ ID NO: 6134937 - DNA, 18 bp, Homo sapiens
ctaggaaaggcagaaaca

SEQ ID NO: 6134938 - DNA, 18 bp, Homo sapiens
ctaggaaagggaagcctg

SEQ ID NO: 6134939 - DNA, 20 bp, Homo sapiens
ctaggaaatatttattttaa

SEQ ID NO: 6134940 - DNA, 17 bp, Homo sapiens
ctaggaaatccagggtg

SEQ ID NO: 6134941 - DNA, 16 bp, Homo sapiens
ctaggaaatgtacgat

SEQ ID NO: 6134942 - DNA, 15 bp, Homo sapiens
ctaggaacactcctt

SEQ ID NO: 6134943 - DNA, 22 bp, Homo sapiens
ctaggaacattttttaaggact

SEQ ID NO: 6134944 - DNA, 20 bp, Homo sapiens
ctaggaaccagccaaccatc

SEQ ID NO: 6134945 - DNA, 14 bp, Homo sapiens
ctaggaagaatttt

SEQ ID NO: 6134946 - DNA, 20 bp, Homo sapiens
ctaggaagaattttaaaaat

SEQ ID NO: 6134947 - DNA, 17 bp, Homo sapiens
ctaggaagactttggaa

SEQ ID NO: 6134948 - DNA, 19 bp, Homo sapiens
ctaggaagagcaggactcc

SEQ ID NO: 6134949 - DNA, 15 bp, Homo sapiens
ctaggaagaggagtg

SEQ ID NO: 6134950 - DNA, 23 bp, Homo sapiens
ctaggaagatctctgcagggccg

SEQ ID NO: 6134951 - DNA, 19 bp, Homo sapiens
ctaggaagcacgggggagt

SEQ ID NO: 6134952 - DNA, 14 bp, Homo sapiens
ctaggaagcctcag

SEQ ID NO: 6134953 - DNA, 20 bp, Homo sapiens
ctaggaagtaaagtgaagaa

SEQ ID NO: 6134954 - DNA, 14 bp, Homo sapiens
ctaggaatggagga

SEQ ID NO: 6134955 - DNA, 19 bp, Homo sapiens
ctaggaattctttgcattc

SEQ ID NO: 6134956 - DNA, 15 bp, Homo sapiens
ctaggacacagttcc

SEQ ID NO: 6134957 - DNA, 23 bp, Homo sapiens
ctaggacacctgtggtatcttta

SEQ ID NO: 6134958 - DNA, 16 bp, Homo sapiens
ctaggacatgttccct

SEQ ID NO: 6134959 - DNA, 17 bp, Homo sapiens
ctctgggtcagtggtcc

SEQ ID NO: 6134960 - DNA, 14 bp, Homo sapiens
ctctgggtcccggg

SEQ ID NO: 6134961 - DNA, 16 bp, Homo sapiens
ctctgggtcccggggt

SEQ ID NO: 6134962 - DNA, 16 bp, Homo sapiens
ctctgggtccttcctg

SEQ ID NO: 6134963 - DNA, 18 bp, Homo sapiens
ctctgggtccttcctgaa

SEQ ID NO: 6134964 - DNA, 22 bp, Homo sapiens
ctctgggtccttggctcccggg

SEQ ID NO: 6134965 - DNA, 17 bp, Homo sapiens
ctctgggtgagtggctg

SEQ ID NO: 6134966 - DNA, 14 bp, Homo sapiens
ctctgggtgctgcc

SEQ ID NO: 6134967 - DNA, 12 bp, Homo sapiens
ctctgggtgggc

SEQ ID NO: 6134968 - DNA, 22 bp, Homo sapiens
ctctgggttgtgcacatttctt

SEQ ID NO: 6134969 - DNA, 23 bp, Homo sapiens
ctctgggtttacaacaaacactg

SEQ ID NO: 6134970 - DNA, 17 bp, Homo sapiens
ctctggtaatattgact

SEQ ID NO: 6134971 - DNA, 17 bp, Homo sapiens
ctctggtacaatttctt

SEQ ID NO: 6134972 - DNA, 17 bp, Homo sapiens
ctctggtagacacagga

SEQ ID NO: 6134973 - DNA, 19 bp, Homo sapiens
ctctggtatctaattcttt

SEQ ID NO: 6134974 - DNA, 20 bp, Homo sapiens
ctctggtcaggcccactgca

SEQ ID NO: 6134975 - DNA, 15 bp, Homo sapiens
ctctggtccacacta

SEQ ID NO: 6134976 - DNA, 18 bp, Homo sapiens
ctctggtccatagagagc

SEQ ID NO: 6134977 - DNA, 22 bp, Homo sapiens
ctctggtccctttaaagagcaa

SEQ ID NO: 6134978 - DNA, 14 bp, Homo sapiens
ctctggtcctcgga

SEQ ID NO: 6134979 - DNA, 16 bp, Homo sapiens
ctctggtcgctcctgc

SEQ ID NO: 6134980 - DNA, 18 bp, Homo sapiens
ctctggtcgctcctgccc

SEQ ID NO: 6134981 - DNA, 19 bp, Homo sapiens
ctctggtgacaccagcctt

SEQ ID NO: 6134982 - DNA, 23 bp, Homo sapiens
ctctggtgagtcaccacttcagg

SEQ ID NO: 6134983 - DNA, 14 bp, Homo sapiens
ctctggtgcctcca

SEQ ID NO: 6134984 - DNA, 18 bp, Homo sapiens
ctctggtgcctccagagg

SEQ ID NO: 6134985 - DNA, 16 bp, Homo sapiens
ctctggtgctcctgca

SEQ ID NO: 6134986 - DNA, 13 bp, Homo sapiens
ctctggtggccac

SEQ ID NO: 6134987 - DNA, 15 bp, Homo sapiens
ctctggtggccactg

SEQ ID NO: 6134988 - DNA, 19 bp, Homo sapiens
ctctggtggccactgagct

SEQ ID NO: 6134989 - DNA, 20 bp, Homo sapiens
ctctggtggccactgagctg

SEQ ID NO: 6134990 - DNA, 22 bp, Homo sapiens
ctctggtggccactgagctggc

SEQ ID NO: 6134991 - DNA, 22 bp, Homo sapiens
ctctggtggccacttcattcca

SEQ ID NO: 6134992 - DNA, 21 bp, Homo sapiens
ctctggtggctcctcctagga

SEQ ID NO: 6134993 - DNA, 19 bp, Homo sapiens
ctctggtggctgccagctt

SEQ ID NO: 6134994 - DNA, 22 bp, Homo sapiens
ctctggtggctgggctgctcct

SEQ ID NO: 6134995 - DNA, 23 bp, Homo sapiens
ctctggtggcttaagtgagcaga

SEQ ID NO: 6134996 - DNA, 14 bp, Homo sapiens
ctctggtgggaaaa

SEQ ID NO: 6134997 - DNA, 20 bp, Homo sapiens
ctctggtggtcttccttcta

SEQ ID NO: 6134998 - DNA, 22 bp, Homo sapiens
ctctggtgtttattataaagct

SEQ ID NO: 6134999 - DNA, 15 bp, Homo sapiens
ctctggttatttttc

SEQ ID NO: 6135000 - DNA, 20 bp, Homo sapiens
ctctggttatttttctcttg

SEQ ID NO: 6135001 - DNA, 13 bp, Homo sapiens
ctctggttctttg

SEQ ID NO: 6135002 - DNA, 14 bp, Homo sapiens
ctctggttgaagct

SEQ ID NO: 6135003 - DNA, 14 bp, Homo sapiens
ctctggttgcctcc

SEQ ID NO: 6135004 - DNA, 21 bp, Homo sapiens
ctctggttgtctagtcattgt

SEQ ID NO: 6135005 - DNA, 23 bp, Homo sapiens
ctctggttgtgggcttggaccac

SEQ ID NO: 6135006 - DNA, 17 bp, Homo sapiens
ctctggtttctgtgtgt

SEQ ID NO: 6135007 - DNA, 15 bp, Homo sapiens
ctctgtaaaatgcac

SEQ ID NO: 6135008 - DNA, 15 bp, Homo sapiens
ctctgtaaagctaaa

SEQ ID NO: 6135009 - DNA, 16 bp, Homo sapiens
ctctgtaaccacctct

SEQ ID NO: 6135010 - DNA, 21 bp, Homo sapiens
ctctgtaaccacctctctgtc

SEQ ID NO: 6135011 - DNA, 21 bp, Homo sapiens
ctctgtaaccgcttctggggc

SEQ ID NO: 6135012 - DNA, 16 bp, Homo sapiens
ctctgtaagtgtagct

SEQ ID NO: 6135013 - DNA, 21 bp, Homo sapiens
ctctgtaatctcgtttcaaaa

SEQ ID NO: 6135014 - DNA, 12 bp, Homo sapiens
ctctgtaattac

SEQ ID NO: 6135015 - DNA, 14 bp, Homo sapiens
ctctgtaattgcaa

SEQ ID NO: 6135016 - DNA, 14 bp, Homo sapiens
ctctgtacaaaaac

SEQ ID NO: 6135017 - DNA, 14 bp, Homo sapiens
ctctgtacactgcc

SEQ ID NO: 6135018 - DNA, 18 bp, Homo sapiens
ctctgtacatattagcga

SEQ ID NO: 6135019 - DNA, 17 bp, Homo sapiens
ctctgtaccgcccggca

SEQ ID NO: 6135020 - DNA, 22 bp, Homo sapiens
ctctgtaccgcccggcagcccc

SEQ ID NO: 6135021 - DNA, 20 bp, Homo sapiens
ctctgtacgaggcttctcta

SEQ ID NO: 6135022 - DNA, 14 bp, Homo sapiens
ctctgtacgggcca

SEQ ID NO: 6135023 - DNA, 11 bp, Homo sapiens
ctctgtacttt

SEQ ID NO: 6135024 - DNA, 12 bp, Homo sapiens
ctctgtactttt

SEQ ID NO: 6135025 - DNA, 20 bp, Homo sapiens
ctctgtacttttcattctct

SEQ ID NO: 6135026 - DNA, 14 bp, Homo sapiens
ctctgtagaattta

SEQ ID NO: 6135027 - DNA, 18 bp, Homo sapiens
ctctgtagatacaggggc

SEQ ID NO: 6135028 - DNA, 13 bp, Homo sapiens
ctctgtagcctgg

SEQ ID NO: 6135029 - DNA, 14 bp, Homo sapiens
ctctgtagcctggt

SEQ ID NO: 6135030 - DNA, 20 bp, Homo sapiens
ctctgtagcctggtctgtgc

SEQ ID NO: 6135031 - DNA, 17 bp, Homo sapiens
ctctgtagctccctcct

SEQ ID NO: 6135032 - DNA, 24 bp, Homo sapiens
ctctgtagctccctcctcccatct

SEQ ID NO: 6135033 - DNA, 22 bp, Homo sapiens
ctctgtaggatcgtaaaaaaat

SEQ ID NO: 6135034 - DNA, 17 bp, Homo sapiens
ctctgtaggcagcagag

SEQ ID NO: 6135035 - DNA, 20 bp, Homo sapiens
ctctgtaggcagcagagaga

SEQ ID NO: 6135036 - DNA, 14 bp, Homo sapiens
ctctgtagtttatg

SEQ ID NO: 6135037 - DNA, 9 bp, Homo sapiens
ctctgtata

SEQ ID NO: 6135038 - DNA, 18 bp, Homo sapiens
ctctgtataaacattaaa

SEQ ID NO: 6135039 - DNA, 21 bp, Homo sapiens
ctctgtataagttgaaggaaa

SEQ ID NO: 6135040 - DNA, 22 bp, Homo sapiens
ctctgtataatctatttacata

SEQ ID NO: 6135041 - DNA, 22 bp, Homo sapiens
ctctgtatacaaggatcagatt

SEQ ID NO: 6135042 - DNA, 13 bp, Homo sapiens
ctctgtatatata

SEQ ID NO: 6135043 - DNA, 20 bp, Homo sapiens
ctctgtatattgggctcaga

SEQ ID NO: 6135044 - DNA, 22 bp, Homo sapiens
ctctgtattctgcaacagcctg

SEQ ID NO: 6135045 - DNA, 20 bp, Homo sapiens
ctctgtattttttcttgcat

SEQ ID NO: 6135046 - DNA, 23 bp, Homo sapiens
ctctgtattttttcttgcattga

SEQ ID NO: 6135047 - DNA, 14 bp, Homo sapiens
ctctgtcaattgta

SEQ ID NO: 6135048 - DNA, 13 bp, Homo sapiens
ctctgtcacatcc

SEQ ID NO: 6135049 - DNA, 15 bp, Homo sapiens
ctctgtcacatccaa

SEQ ID NO: 6135050 - DNA, 19 bp, Homo sapiens
ctctgtcacatccaactgg

SEQ ID NO: 6135051 - DNA, 16 bp, Homo sapiens
ctctgtcacccttgtc

SEQ ID NO: 6135052 - DNA, 16 bp, Homo sapiens
ctctgtcaccgccatg

SEQ ID NO: 6135053 - DNA, 19 bp, Homo sapiens
ctctgtcactaaatggcag

SEQ ID NO: 6135054 - DNA, 20 bp, Homo sapiens
ctctgtcactcctcatgcct

SEQ ID NO: 6135055 - DNA, 12 bp, Homo sapiens
ctctgtcactga

SEQ ID NO: 6135056 - DNA, 14 bp, Homo sapiens
ctctgtcactgagc

SEQ ID NO: 6135057 - DNA, 15 bp, Homo sapiens
ctctgtcactgagca

SEQ ID NO: 6135058 - DNA, 13 bp, Homo sapiens
ctctgtcagatgg

SEQ ID NO: 6135059 - DNA, 20 bp, Homo sapiens
ctctgtcagccagccgccct

SEQ ID NO: 6135060 - DNA, 23 bp, Homo sapiens
ctctgtcagccagccgccctggg

SEQ ID NO: 6135061 - DNA, 13 bp, Homo sapiens
ctctgtcaggcct

SEQ ID NO: 6135062 - DNA, 14 bp, Homo sapiens
ctctgtcaggcctt

SEQ ID NO: 6135063 - DNA, 14 bp, Homo sapiens
ctctgtcagtcaca

SEQ ID NO: 6135064 - DNA, 16 bp, Homo sapiens
ctctgtcagtcacagc

SEQ ID NO: 6135065 - DNA, 19 bp, Homo sapiens
ctctgtcagtcacagccac

SEQ ID NO: 6135066 - DNA, 22 bp, Homo sapiens
ctctgtcagtcatgcgtccact

SEQ ID NO: 6135067 - DNA, 13 bp, Homo sapiens
ctctgtcagtgtg

SEQ ID NO: 6135068 - DNA, 19 bp, Homo sapiens
ctctgtcagtgtgaaaatt

SEQ ID NO: 6135069 - DNA, 16 bp, Homo sapiens
ctctgtcagtttgtga

SEQ ID NO: 6135070 - DNA, 23 bp, Homo sapiens
ctctgtcagtttgtgaagtgatt

SEQ ID NO: 6135071 - DNA, 16 bp, Homo sapiens
ctctgtcatatcttca

SEQ ID NO: 6135072 - DNA, 21 bp, Homo sapiens
ctctgtcatcactccctggat

SEQ ID NO: 6135073 - DNA, 16 bp, Homo sapiens
ctctgtccaactctgt

SEQ ID NO: 6135074 - DNA, 18 bp, Homo sapiens
ctctgtccaattccagag

SEQ ID NO: 6135075 - DNA, 21 bp, Homo sapiens
ctctgtccaattccagagctg

SEQ ID NO: 6135076 - DNA, 19 bp, Homo sapiens
ctctgtccagccagctcct

SEQ ID NO: 6135077 - DNA, 19 bp, Homo sapiens
ctctgtccagctcccgctg

SEQ ID NO: 6135078 - DNA, 12 bp, Homo sapiens
ctctgtccaggc

SEQ ID NO: 6135079 - DNA, 15 bp, Homo sapiens
ctctgtccagggctt

SEQ ID NO: 6135080 - DNA, 13 bp, Homo sapiens
ctctgtcccacgt

SEQ ID NO: 6135081 - DNA, 13 bp, Homo sapiens
ctctgtcccagga

SEQ ID NO: 6135082 - DNA, 21 bp, Homo sapiens
ctctgtcccattccctgggat

SEQ ID NO: 6135083 - DNA, 17 bp, Homo sapiens
ctctgtccccagcctgg

SEQ ID NO: 6135084 - DNA, 16 bp, Homo sapiens
ctctgtccccaggcct

SEQ ID NO: 6135085 - DNA, 18 bp, Homo sapiens
ctctgtccccaggcctgg

SEQ ID NO: 6135086 - DNA, 16 bp, Homo sapiens
ctctgtccccaggtcc

SEQ ID NO: 6135087 - DNA, 21 bp, Homo sapiens
ctctgtccccttctctcatct

SEQ ID NO: 6135088 - DNA, 17 bp, Homo sapiens
ctctgtccctcactgcc

SEQ ID NO: 6135089 - DNA, 18 bp, Homo sapiens
ctctgtccctcactgcct

SEQ ID NO: 6135090 - DNA, 15 bp, Homo sapiens
ctctgtccctctttg

SEQ ID NO: 6135091 - DNA, 15 bp, Homo sapiens
ctctgtcccttgctg

SEQ ID NO: 6135092 - DNA, 22 bp, Homo sapiens
ctctgtccgtctgtcctgcgcc

SEQ ID NO: 6135093 - DNA, 23 bp, Homo sapiens
ctctgtccgtgccccttccctgg

SEQ ID NO: 6135094 - DNA, 13 bp, Homo sapiens
ctctgtcctactt

SEQ ID NO: 6135095 - DNA, 17 bp, Homo sapiens
ctctgtcctcccatccc

SEQ ID NO: 6135096 - DNA, 19 bp, Homo sapiens
ctctgtcctcccatcccct

SEQ ID NO: 6135097 - DNA, 21 bp, Homo sapiens
ctctgtcctcccatcccctca

SEQ ID NO: 6135098 - DNA, 17 bp, Homo sapiens
ctctgtcctctgctttg

SEQ ID NO: 6135099 - DNA, 13 bp, Homo sapiens
ctctgtcctctgt

SEQ ID NO: 6135100 - DNA, 11 bp, Homo sapiens
ctctgtcctga

SEQ ID NO: 6135101 - DNA, 13 bp, Homo sapiens
ctctgtcctgact

SEQ ID NO: 6135102 - DNA, 17 bp, Homo sapiens
ctctgtcctgttaggcc

SEQ ID NO: 6135103 - DNA, 22 bp, Homo sapiens
ctctgtcctgttaggccaactg

SEQ ID NO: 6135104 - DNA, 15 bp, Homo sapiens
ctctgtccttccccc

SEQ ID NO: 6135105 - DNA, 15 bp, Homo sapiens
ctctgtcgcccaggc

SEQ ID NO: 6135106 - DNA, 17 bp, Homo sapiens
ctctgtcgctcaggctg

SEQ ID NO: 6135107 - DNA, 19 bp, Homo sapiens
ctctgtcgctcaggctgga

SEQ ID NO: 6135108 - DNA, 15 bp, Homo sapiens
ctctgtctacaaata

SEQ ID NO: 6135109 - DNA, 17 bp, Homo sapiens
ctctgtctaccatctcc

SEQ ID NO: 6135110 - DNA, 21 bp, Homo sapiens
ctctgtctaccatctccctcg

SEQ ID NO: 6135111 - DNA, 17 bp, Homo sapiens
ctctgtctacccagtgc

SEQ ID NO: 6135112 - DNA, 20 bp, Homo sapiens
ctctgtctagcatgccaaca

SEQ ID NO: 6135113 - DNA, 20 bp, Homo sapiens
ctctgtctaggactgcagtg

SEQ ID NO: 6135114 - DNA, 21 bp, Homo sapiens
ctctgtctaggactgcagtgt

SEQ ID NO: 6135115 - DNA, 19 bp, Homo sapiens
ctctgtctcaaaaataaat

SEQ ID NO: 6135116 - DNA, 22 bp, Homo sapiens
ctctgtctcagacttttgtaca

SEQ ID NO: 6135117 - DNA, 23 bp, Homo sapiens
ctctgtctcagacttttgtacat

SEQ ID NO: 6135118 - DNA, 17 bp, Homo sapiens
ctctgtctcatcctcct

SEQ ID NO: 6135119 - DNA, 21 bp, Homo sapiens
ctctgtctcatcctcctggaa

SEQ ID NO: 6135120 - DNA, 20 bp, Homo sapiens
ctctgtctcatgtgtgctct

SEQ ID NO: 6135121 - DNA, 11 bp, Homo sapiens
ctctgtctccc

SEQ ID NO: 6135122 - DNA, 15 bp, Homo sapiens
ctctgtctcccaggc

SEQ ID NO: 6135123 - DNA, 18 bp, Homo sapiens
ctctgtctcgagcgccct

SEQ ID NO: 6135124 - DNA, 21 bp, Homo sapiens
ctctgtctcgagcgccctgca

SEQ ID NO: 6135125 - DNA, 14 bp, Homo sapiens
ctctgtctctccta

SEQ ID NO: 6135126 - DNA, 20 bp, Homo sapiens
ctctgtctctcctagcccct

SEQ ID NO: 6135127 - DNA, 13 bp, Homo sapiens
ctctgtctctgct

SEQ ID NO: 6135128 - DNA, 17 bp, Homo sapiens
ctctgtctctgctcttg

SEQ ID NO: 6135129 - DNA, 14 bp, Homo sapiens
ctctgtctctgtgg

SEQ ID NO: 6135130 - DNA, 21 bp, Homo sapiens
ctctgtctgagacaggtgcct

SEQ ID NO: 6135131 - DNA, 17 bp, Homo sapiens
ctctgtctgcccttcac

SEQ ID NO: 6135132 - DNA, 13 bp, Homo sapiens
ctctgtctgcctc

SEQ ID NO: 6135133 - DNA, 17 bp, Homo sapiens
ctctgtctggcaatgcc

SEQ ID NO: 6135134 - DNA, 23 bp, Homo sapiens
ctctgtctgtctctccccctctg

SEQ ID NO: 6135135 - DNA, 17 bp, Homo sapiens
ctctgtcttaaagaatt

SEQ ID NO: 6135136 - DNA, 13 bp, Homo sapiens
ctctgtcttcctg

SEQ ID NO: 6135137 - DNA, 23 bp, Homo sapiens
ctctgtcttttctcctccgcctg

SEQ ID NO: 6135138 - DNA, 23 bp, Homo sapiens
ctaggaccatggttaagagtcca

SEQ ID NO: 6135139 - DNA, 22 bp, Homo sapiens
ctaggacccgtctccagctgct

SEQ ID NO: 6135140 - DNA, 17 bp, Homo sapiens
ctaggacctatgttgta

SEQ ID NO: 6135141 - DNA, 18 bp, Homo sapiens
ctaggaccttttcccaat

SEQ ID NO: 6135142 - DNA, 22 bp, Homo sapiens
ctaggacgccacccagcaaaag

SEQ ID NO: 6135143 - DNA, 12 bp, Homo sapiens
ctaggactcaga

SEQ ID NO: 6135144 - DNA, 19 bp, Homo sapiens
ctaggactcagaaacgaga

SEQ ID NO: 6135145 - DNA, 20 bp, Homo sapiens
ctaggactcaggcctgccaa

SEQ ID NO: 6135146 - DNA, 12 bp, Homo sapiens
ctaggactcctt

SEQ ID NO: 6135147 - DNA, 14 bp, Homo sapiens
ctaggactctgagg

SEQ ID NO: 6135148 - DNA, 16 bp, Homo sapiens
ctaggactctgaggct

SEQ ID NO: 6135149 - DNA, 22 bp, Homo sapiens
ctaggactctgaggctctttct

SEQ ID NO: 6135150 - DNA, 15 bp, Homo sapiens
ctaggactgcagtgt

SEQ ID NO: 6135151 - DNA, 15 bp, Homo sapiens
ctaggactgtggagg

SEQ ID NO: 6135152 - DNA, 18 bp, Homo sapiens
ctaggagaaccaaatctg

SEQ ID NO: 6135153 - DNA, 21 bp, Homo sapiens
ctaggagaaccaaatctggaa

SEQ ID NO: 6135154 - DNA, 14 bp, Homo sapiens
ctaggagacagagc

SEQ ID NO: 6135155 - DNA, 23 bp, Homo sapiens
ctaggagacagagccaagcactg

SEQ ID NO: 6135156 - DNA, 15 bp, Homo sapiens
ctaggagaccagaag

SEQ ID NO: 6135157 - DNA, 22 bp, Homo sapiens
ctaggagagccaacctcggctt

SEQ ID NO: 6135158 - DNA, 20 bp, Homo sapiens
ctaggagcaaggtgagaaat

SEQ ID NO: 6135159 - DNA, 15 bp, Homo sapiens
ctaggagcaggcttg

SEQ ID NO: 6135160 - DNA, 22 bp, Homo sapiens
ctaggagcagtgggccctggct

SEQ ID NO: 6135161 - DNA, 18 bp, Homo sapiens
ctaggagctccttctggc

SEQ ID NO: 6135162 - DNA, 11 bp, Homo sapiens
ctaggagctgg

SEQ ID NO: 6135163 - DNA, 18 bp, Homo sapiens
ctaggagctggctggcag

SEQ ID NO: 6135164 - DNA, 21 bp, Homo sapiens
ctaggagctggctggcaggtg

SEQ ID NO: 6135165 - DNA, 22 bp, Homo sapiens
ctaggagctggctggcaggtgt

SEQ ID NO: 6135166 - DNA, 19 bp, Homo sapiens
ctaggagctgggaggaaaa

SEQ ID NO: 6135167 - DNA, 18 bp, Homo sapiens
ctaggaggaaaagacaga

SEQ ID NO: 6135168 - DNA, 23 bp, Homo sapiens
ctaggaggagaacttgaacaaag

SEQ ID NO: 6135169 - DNA, 18 bp, Homo sapiens
ctaggaggatgctgtgcc

SEQ ID NO: 6135170 - DNA, 17 bp, Homo sapiens
ctaggagggaaggagct

SEQ ID NO: 6135171 - DNA, 18 bp, Homo sapiens
ctaggagggagacactgg

SEQ ID NO: 6135172 - DNA, 15 bp, Homo sapiens
ctaggagggtcctct

SEQ ID NO: 6135173 - DNA, 19 bp, Homo sapiens
ctaggagtatatttccgca

SEQ ID NO: 6135174 - DNA, 23 bp, Homo sapiens
ctaggagttgagtacagtgagga

SEQ ID NO: 6135175 - DNA, 22 bp, Homo sapiens
ctaggataaaccaatcatctta

SEQ ID NO: 6135176 - DNA, 16 bp, Homo sapiens
ctaggataatttttaa

SEQ ID NO: 6135177 - DNA, 21 bp, Homo sapiens
ctaggataatttttaaaagag

SEQ ID NO: 6135178 - DNA, 22 bp, Homo sapiens
ctaggatagctaactgtaaatc

SEQ ID NO: 6135179 - DNA, 20 bp, Homo sapiens
ctaggatagttgatgcatgt

SEQ ID NO: 6135180 - DNA, 21 bp, Homo sapiens
ctaggatagttgatgcatgtt

SEQ ID NO: 6135181 - DNA, 23 bp, Homo sapiens
ctaggatattgaatgtgaaacat

SEQ ID NO: 6135182 - DNA, 18 bp, Homo sapiens
ctaggatcttcactgtct

SEQ ID NO: 6135183 - DNA, 17 bp, Homo sapiens
ctaggatgaacaatgta

SEQ ID NO: 6135184 - DNA, 22 bp, Homo sapiens
ctaggatgggagagctagaaag

SEQ ID NO: 6135185 - DNA, 23 bp, Homo sapiens
ctaggatggggcacggctctggg

SEQ ID NO: 6135186 - DNA, 15 bp, Homo sapiens
ctaggatgtcgtctt

SEQ ID NO: 6135187 - DNA, 20 bp, Homo sapiens
ctaggatgttgctcagaagt

SEQ ID NO: 6135188 - DNA, 17 bp, Homo sapiens
ctaggattacaggcctt

SEQ ID NO: 6135189 - DNA, 17 bp, Homo sapiens
ctaggattccccctgcc

SEQ ID NO: 6135190 - DNA, 15 bp, Homo sapiens
ctaggattcctcccc

SEQ ID NO: 6135191 - DNA, 14 bp, Homo sapiens
ctaggattgggcct

SEQ ID NO: 6135192 - DNA, 13 bp, Homo sapiens
ctaggatttcatg

SEQ ID NO: 6135193 - DNA, 20 bp, Homo sapiens
ctaggcacctccccgctctc

SEQ ID NO: 6135194 - DNA, 21 bp, Homo sapiens
ctaggcacctccccgctctcc

SEQ ID NO: 6135195 - DNA, 16 bp, Homo sapiens
ctaggcacctctgtgc

SEQ ID NO: 6135196 - DNA, 14 bp, Homo sapiens
ctaggcactgagca

SEQ ID NO: 6135197 - DNA, 15 bp, Homo sapiens
ctaggcactgagcag

SEQ ID NO: 6135198 - DNA, 18 bp, Homo sapiens
ctaggcactgagcaggga

SEQ ID NO: 6135199 - DNA, 21 bp, Homo sapiens
ctaggcactgtagttctaaga

SEQ ID NO: 6135200 - DNA, 21 bp, Homo sapiens
ctaggcagaagaagctgggag

SEQ ID NO: 6135201 - DNA, 14 bp, Homo sapiens
ctaggcagccagct

SEQ ID NO: 6135202 - DNA, 15 bp, Homo sapiens
ctaggcagggagggg

SEQ ID NO: 6135203 - DNA, 22 bp, Homo sapiens
ctaggcagggagggggctggga

SEQ ID NO: 6135204 - DNA, 15 bp, Homo sapiens
ctaggcaggtaataa

SEQ ID NO: 6135205 - DNA, 13 bp, Homo sapiens
ctaggcagtggga

SEQ ID NO: 6135206 - DNA, 17 bp, Homo sapiens
ctaggcagtgggaggca

SEQ ID NO: 6135207 - DNA, 18 bp, Homo sapiens
ctaggcagttagagatgc

SEQ ID NO: 6135208 - DNA, 20 bp, Homo sapiens
ctaggcagttagagatgcct

SEQ ID NO: 6135209 - DNA, 22 bp, Homo sapiens
ctaggcagttagagatgcctcc

SEQ ID NO: 6135210 - DNA, 20 bp, Homo sapiens
ctaggcagttcaaagcagga

SEQ ID NO: 6135211 - DNA, 17 bp, Homo sapiens
ctaggcatactctccag

SEQ ID NO: 6135212 - DNA, 18 bp, Homo sapiens
ctaggcatactctccagg

SEQ ID NO: 6135213 - DNA, 19 bp, Homo sapiens
ctaggcatactctccagga

SEQ ID NO: 6135214 - DNA, 22 bp, Homo sapiens
ctaggcatactctccaggattg

SEQ ID NO: 6135215 - DNA, 17 bp, Homo sapiens
ctaggcatacttttcaa

SEQ ID NO: 6135216 - DNA, 20 bp, Homo sapiens
ctaggcatctcctctcccca

SEQ ID NO: 6135217 - DNA, 14 bp, Homo sapiens
ctaggcatgcctgg

SEQ ID NO: 6135218 - DNA, 19 bp, Homo sapiens
ctaggcattacccaaaagc

SEQ ID NO: 6135219 - DNA, 14 bp, Homo sapiens
ctaggcattctgga

SEQ ID NO: 6135220 - DNA, 20 bp, Homo sapiens
ctaggcattctggacctctg

SEQ ID NO: 6135221 - DNA, 15 bp, Homo sapiens
ctaggcattgcagga

SEQ ID NO: 6135222 - DNA, 22 bp, Homo sapiens
ctaggcattgcaggaccttggg

SEQ ID NO: 6135223 - DNA, 14 bp, Homo sapiens
ctaggcatttcatt

SEQ ID NO: 6135224 - DNA, 21 bp, Homo sapiens
ctaggcatttgctgaatacag

SEQ ID NO: 6135225 - DNA, 22 bp, Homo sapiens
ctaggcatttgtaaatattaaa

SEQ ID NO: 6135226 - DNA, 14 bp, Homo sapiens
ctaggccaccccaa

SEQ ID NO: 6135227 - DNA, 16 bp, Homo sapiens
ctaggccagagcccac

SEQ ID NO: 6135228 - DNA, 16 bp, Homo sapiens
ctaggccagcaggggc

SEQ ID NO: 6135229 - DNA, 17 bp, Homo sapiens
ctaggccagcaggggct

SEQ ID NO: 6135230 - DNA, 13 bp, Homo sapiens
ctaggccagctcc

SEQ ID NO: 6135231 - DNA, 14 bp, Homo sapiens
ctaggccaggtgca

SEQ ID NO: 6135232 - DNA, 20 bp, Homo sapiens
ctaggccaggtgcaaccagg

SEQ ID NO: 6135233 - DNA, 17 bp, Homo sapiens
ctaggccatttgtattt

SEQ ID NO: 6135234 - DNA, 17 bp, Homo sapiens
ctaggcccacaagtgta

SEQ ID NO: 6135235 - DNA, 18 bp, Homo sapiens
ctaggcccaggcctgggt

SEQ ID NO: 6135236 - DNA, 19 bp, Homo sapiens
ctaggcccaggcctgggtt

SEQ ID NO: 6135237 - DNA, 23 bp, Homo sapiens
ctaggcccattgtcctccttttc

SEQ ID NO: 6135238 - DNA, 20 bp, Homo sapiens
ctaggccccagaggccctgg

SEQ ID NO: 6135239 - DNA, 22 bp, Homo sapiens
ctaggcccccaaattgccttca

SEQ ID NO: 6135240 - DNA, 22 bp, Homo sapiens
ctaggcccccacttgcctcttc

SEQ ID NO: 6135241 - DNA, 13 bp, Homo sapiens
ctaggccccccag

SEQ ID NO: 6135242 - DNA, 16 bp, Homo sapiens
ctaggcccctgccctg

SEQ ID NO: 6135243 - DNA, 13 bp, Homo sapiens
ctaggccctggtc

SEQ ID NO: 6135244 - DNA, 18 bp, Homo sapiens
ctaggccctggtctggct

SEQ ID NO: 6135245 - DNA, 22 bp, Homo sapiens
ctaggccctgtgagcacaaaga

SEQ ID NO: 6135246 - DNA, 19 bp, Homo sapiens
ctaggcccttggggtggcg

SEQ ID NO: 6135247 - DNA, 19 bp, Homo sapiens
ctaggccggccagctcccc

SEQ ID NO: 6135248 - DNA, 17 bp, Homo sapiens
ctaggcctcagccagag

SEQ ID NO: 6135249 - DNA, 19 bp, Homo sapiens
ctaggcctcagccagagaa

SEQ ID NO: 6135250 - DNA, 22 bp, Homo sapiens
ctaggcctccgttgtctggttg

SEQ ID NO: 6135251 - DNA, 13 bp, Homo sapiens
ctaggcctggcca

SEQ ID NO: 6135252 - DNA, 14 bp, Homo sapiens
ctaggcctggccag

SEQ ID NO: 6135253 - DNA, 18 bp, Homo sapiens
ctaggcctggccagatgc

SEQ ID NO: 6135254 - DNA, 12 bp, Homo sapiens
ctaggcctgggg

SEQ ID NO: 6135255 - DNA, 13 bp, Homo sapiens
ctaggcctttcct

SEQ ID NO: 6135256 - DNA, 16 bp, Homo sapiens
ctaggcgagtgccagg

SEQ ID NO: 6135257 - DNA, 18 bp, Homo sapiens
ctaggcgagtgccaggac

SEQ ID NO: 6135258 - DNA, 19 bp, Homo sapiens
ctaggcgattttgtctacc

SEQ ID NO: 6135259 - DNA, 22 bp, Homo sapiens
ctaggcgcggttcaggtcaggg

SEQ ID NO: 6135260 - DNA, 15 bp, Homo sapiens
ctaggcgctcagagg

SEQ ID NO: 6135261 - DNA, 17 bp, Homo sapiens
ctaggcgctcagaggcc

SEQ ID NO: 6135262 - DNA, 16 bp, Homo sapiens
ctaggctaaactcaag

SEQ ID NO: 6135263 - DNA, 21 bp, Homo sapiens
ctaggctacccttgccaaggc

SEQ ID NO: 6135264 - DNA, 15 bp, Homo sapiens
ctaggctcagagatg

SEQ ID NO: 6135265 - DNA, 20 bp, Homo sapiens
ctaggctcagagatgtgcac

SEQ ID NO: 6135266 - DNA, 14 bp, Homo sapiens
ctaggctccctgag

SEQ ID NO: 6135267 - DNA, 15 bp, Homo sapiens
ctaggctccctgagg

SEQ ID NO: 6135268 - DNA, 18 bp, Homo sapiens
ctaggctccctgaggtac

SEQ ID NO: 6135269 - DNA, 21 bp, Homo sapiens
ctaggctccctgaggtacctt

SEQ ID NO: 6135270 - DNA, 12 bp, Homo sapiens
ctaggctcctgg

SEQ ID NO: 6135271 - DNA, 16 bp, Homo sapiens
ctaggctcctgggagg

SEQ ID NO: 6135272 - DNA, 18 bp, Homo sapiens
ctaggctctatttaactg

SEQ ID NO: 6135273 - DNA, 13 bp, Homo sapiens
ctaggctctgcct

SEQ ID NO: 6135274 - DNA, 14 bp, Homo sapiens
ctaggctctgcctt

SEQ ID NO: 6135275 - DNA, 15 bp, Homo sapiens
ctaggctctgccttc

SEQ ID NO: 6135276 - DNA, 13 bp, Homo sapiens
ctaggctgccccg

SEQ ID NO: 6135277 - DNA, 16 bp, Homo sapiens
ctaggctgctgcacac

SEQ ID NO: 6135278 - DNA, 11 bp, Homo sapiens
ctaggctggaa

SEQ ID NO: 6135279 - DNA, 16 bp, Homo sapiens
ctaggctggaagagcc

SEQ ID NO: 6135280 - DNA, 23 bp, Homo sapiens
ctaggctggaagccatggtcccg

SEQ ID NO: 6135281 - DNA, 17 bp, Homo sapiens
ctaggctggagcccagg

SEQ ID NO: 6135282 - DNA, 12 bp, Homo sapiens
ctaggctgggtg

SEQ ID NO: 6135283 - DNA, 13 bp, Homo sapiens
ctaggctgggtgc

SEQ ID NO: 6135284 - DNA, 23 bp, Homo sapiens
ctaggcttcagcatatttatagc

SEQ ID NO: 6135285 - DNA, 23 bp, Homo sapiens
ctaggcttcccaggctgggctct

SEQ ID NO: 6135286 - DNA, 17 bp, Homo sapiens
ctaggcttctgtaatca

SEQ ID NO: 6135287 - DNA, 15 bp, Homo sapiens
ctaggcttggctcct

SEQ ID NO: 6135288 - DNA, 16 bp, Homo sapiens
ctagggaaacttcccg

SEQ ID NO: 6135289 - DNA, 20 bp, Homo sapiens
ctagggaaatgatcagtttt

SEQ ID NO: 6135290 - DNA, 14 bp, Homo sapiens
ctagggaagataat

SEQ ID NO: 6135291 - DNA, 18 bp, Homo sapiens
ctagggaaggccacctgc

SEQ ID NO: 6135292 - DNA, 20 bp, Homo sapiens
ctagggaaggccacctgcag

SEQ ID NO: 6135293 - DNA, 16 bp, Homo sapiens
ctagggacccctcctc

SEQ ID NO: 6135294 - DNA, 21 bp, Homo sapiens
ctagggacccctcgccccagc

SEQ ID NO: 6135295 - DNA, 24 bp, Homo sapiens
ctagggacccctcgccccagcctc

SEQ ID NO: 6135296 - DNA, 18 bp, Homo sapiens
ctagggacctggggaagc

SEQ ID NO: 6135297 - DNA, 21 bp, Homo sapiens
ctagggactgtcctagccagg

SEQ ID NO: 6135298 - DNA, 23 bp, Homo sapiens
ctagggactgtcctagccaggtc

SEQ ID NO: 6135299 - DNA, 17 bp, Homo sapiens
ctagggagccatttgag

SEQ ID NO: 6135300 - DNA, 18 bp, Homo sapiens
ctagggagccatttgaga

SEQ ID NO: 6135301 - DNA, 20 bp, Homo sapiens
ctagggagccctgggccagg

SEQ ID NO: 6135302 - DNA, 17 bp, Homo sapiens
ctagggaggaccaaagg

SEQ ID NO: 6135303 - DNA, 14 bp, Homo sapiens
ctagggaggacctt

SEQ ID NO: 6135304 - DNA, 23 bp, Homo sapiens
ctagggaggcatggtctgccctc

SEQ ID NO: 6135305 - DNA, 15 bp, Homo sapiens
ctagggaggctgagg

SEQ ID NO: 6135306 - DNA, 13 bp, Homo sapiens
ctagggatccctc

SEQ ID NO: 6135307 - DNA, 18 bp, Homo sapiens
ctagggatctgaaatcca

SEQ ID NO: 6135308 - DNA, 19 bp, Homo sapiens
ctagggatgttctggccct

SEQ ID NO: 6135309 - DNA, 18 bp, Homo sapiens
ctagggattcaggctgct

SEQ ID NO: 6135310 - DNA, 18 bp, Homo sapiens
ctagggatttaaagggac

SEQ ID NO: 6135311 - DNA, 21 bp, Homo sapiens
ctagggatttaaagggacacc

SEQ ID NO: 6135312 - DNA, 14 bp, Homo sapiens
ctagggcacccctt

SEQ ID NO: 6135313 - DNA, 14 bp, Homo sapiens
ctagggcagaagac

SEQ ID NO: 6135314 - DNA, 13 bp, Homo sapiens
ctagggcagacaa

SEQ ID NO: 6135315 - DNA, 14 bp, Homo sapiens
ctctgtctttttcc

SEQ ID NO: 6135316 - DNA, 15 bp, Homo sapiens
ctctgtctttttcct

SEQ ID NO: 6135317 - DNA, 21 bp, Homo sapiens
ctctgtgaacgatttagaaag

SEQ ID NO: 6135318 - DNA, 16 bp, Homo sapiens
ctctgtgaactatccc

SEQ ID NO: 6135319 - DNA, 13 bp, Homo sapiens
ctctgtgaactgt

SEQ ID NO: 6135320 - DNA, 20 bp, Homo sapiens
ctctgtgaatacaattaaag

SEQ ID NO: 6135321 - DNA, 22 bp, Homo sapiens
ctctgtgaatacaattaaaggt

SEQ ID NO: 6135322 - DNA, 18 bp, Homo sapiens
ctctgtgaccaatgtctt

SEQ ID NO: 6135323 - DNA, 15 bp, Homo sapiens
ctctgtgacccccat

SEQ ID NO: 6135324 - DNA, 19 bp, Homo sapiens
ctctgtgacccctccttgt

SEQ ID NO: 6135325 - DNA, 20 bp, Homo sapiens
ctctgtgacccctccttgtc

SEQ ID NO: 6135326 - DNA, 13 bp, Homo sapiens
ctctgtgacccta

SEQ ID NO: 6135327 - DNA, 19 bp, Homo sapiens
ctctgtgactcgcttagct

SEQ ID NO: 6135328 - DNA, 11 bp, Homo sapiens
ctctgtgagaa

SEQ ID NO: 6135329 - DNA, 18 bp, Homo sapiens
ctctgtgagcatcacagt

SEQ ID NO: 6135330 - DNA, 17 bp, Homo sapiens
ctctgtgagccccacag

SEQ ID NO: 6135331 - DNA, 15 bp, Homo sapiens
ctctgtgattacata

SEQ ID NO: 6135332 - DNA, 16 bp, Homo sapiens
ctctgtgattacctct

SEQ ID NO: 6135333 - DNA, 14 bp, Homo sapiens
ctctgtgcacagtg

SEQ ID NO: 6135334 - DNA, 20 bp, Homo sapiens
ctctgtgcacagtggcttct

SEQ ID NO: 6135335 - DNA, 14 bp, Homo sapiens
ctctgtgcaggagc

SEQ ID NO: 6135336 - DNA, 15 bp, Homo sapiens
ctctgtgcagggcac

SEQ ID NO: 6135337 - DNA, 14 bp, Homo sapiens
ctctgtgcaggtgc

SEQ ID NO: 6135338 - DNA, 20 bp, Homo sapiens
ctctgtgcagtcactggagg

SEQ ID NO: 6135339 - DNA, 14 bp, Homo sapiens
ctctgtgccagagc

SEQ ID NO: 6135340 - DNA, 19 bp, Homo sapiens
ctctgtgccagagcctggg

SEQ ID NO: 6135341 - DNA, 21 bp, Homo sapiens
ctctgtgccagagcctggggc

SEQ ID NO: 6135342 - DNA, 16 bp, Homo sapiens
ctctgtgccagggcag

SEQ ID NO: 6135343 - DNA, 22 bp, Homo sapiens
ctctgtgccagggcagcatttt

SEQ ID NO: 6135344 - DNA, 12 bp, Homo sapiens
ctctgtgcccat

SEQ ID NO: 6135345 - DNA, 23 bp, Homo sapiens
ctctgtgcccggtgccatcttcc

SEQ ID NO: 6135346 - DNA, 13 bp, Homo sapiens
ctctgtgcctaat

SEQ ID NO: 6135347 - DNA, 16 bp, Homo sapiens
ctctgtgcctaataaa

SEQ ID NO: 6135348 - DNA, 22 bp, Homo sapiens
ctctgtgcctccctccccagtg

SEQ ID NO: 6135349 - DNA, 16 bp, Homo sapiens
ctctgtgctcacccat

SEQ ID NO: 6135350 - DNA, 14 bp, Homo sapiens
ctctgtgctccctc

SEQ ID NO: 6135351 - DNA, 13 bp, Homo sapiens
ctctgtgctctga

SEQ ID NO: 6135352 - DNA, 15 bp, Homo sapiens
ctctgtgctctgaat

SEQ ID NO: 6135353 - DNA, 19 bp, Homo sapiens
ctctgtgctgaccctcctg

SEQ ID NO: 6135354 - DNA, 20 bp, Homo sapiens
ctctgtgctgaccctcctgt

SEQ ID NO: 6135355 - DNA, 19 bp, Homo sapiens
ctctgtgctgcatcccacc

SEQ ID NO: 6135356 - DNA, 18 bp, Homo sapiens
ctctgtgctgtggaagca

SEQ ID NO: 6135357 - DNA, 19 bp, Homo sapiens
ctctgtgcttcgactactg

SEQ ID NO: 6135358 - DNA, 20 bp, Homo sapiens
ctctgtgcttcgactactgc

SEQ ID NO: 6135359 - DNA, 11 bp, Homo sapiens
ctctgtgcttg

SEQ ID NO: 6135360 - DNA, 18 bp, Homo sapiens
ctctgtgctttgactcac

SEQ ID NO: 6135361 - DNA, 21 bp, Homo sapiens
ctctgtgctttgactcacctg

SEQ ID NO: 6135362 - DNA, 23 bp, Homo sapiens
ctctgtgctttgactcacctgtt

SEQ ID NO: 6135363 - DNA, 10 bp, Homo sapiens
ctctgtggcc

SEQ ID NO: 6135364 - DNA, 16 bp, Homo sapiens
ctctgtggccagcctg

SEQ ID NO: 6135365 - DNA, 23 bp, Homo sapiens
ctctgtggccagcctggcatcag

SEQ ID NO: 6135366 - DNA, 21 bp, Homo sapiens
ctctgtggccaggagccctgg

SEQ ID NO: 6135367 - DNA, 15 bp, Homo sapiens
ctctgtggcctgtgt

SEQ ID NO: 6135368 - DNA, 16 bp, Homo sapiens
ctctgtggcctgtgtc

SEQ ID NO: 6135369 - DNA, 19 bp, Homo sapiens
ctctgtggcctgtgtccag

SEQ ID NO: 6135370 - DNA, 22 bp, Homo sapiens
ctctgtggcctgtgtccagcag

SEQ ID NO: 6135371 - DNA, 20 bp, Homo sapiens
ctctgtgggaaaaaagaaaa

SEQ ID NO: 6135372 - DNA, 14 bp, Homo sapiens
ctctgtgggctgca

SEQ ID NO: 6135373 - DNA, 16 bp, Homo sapiens
ctctgtgggctgcact

SEQ ID NO: 6135374 - DNA, 17 bp, Homo sapiens
ctctgtgggctgcactc

SEQ ID NO: 6135375 - DNA, 17 bp, Homo sapiens
ctctgtgggctggcagt

SEQ ID NO: 6135376 - DNA, 16 bp, Homo sapiens
ctctgtggggccacac

SEQ ID NO: 6135377 - DNA, 19 bp, Homo sapiens
ctctgtggtaagagatatg

SEQ ID NO: 6135378 - DNA, 23 bp, Homo sapiens
ctctgtggtaagagatatgctca

SEQ ID NO: 6135379 - DNA, 20 bp, Homo sapiens
ctctgtggttttttttgaat

SEQ ID NO: 6135380 - DNA, 15 bp, Homo sapiens
ctctgtgtaaagact

SEQ ID NO: 6135381 - DNA, 19 bp, Homo sapiens
ctctgtgtaatagaataaa

SEQ ID NO: 6135382 - DNA, 22 bp, Homo sapiens
ctctgtgtaatagaataaaggc

SEQ ID NO: 6135383 - DNA, 13 bp, Homo sapiens
ctctgtgtaatct

SEQ ID NO: 6135384 - DNA, 17 bp, Homo sapiens
ctctgtgtacccactcc

SEQ ID NO: 6135385 - DNA, 23 bp, Homo sapiens
ctctgtgtacccactcctcactg

SEQ ID NO: 6135386 - DNA, 21 bp, Homo sapiens
ctctgtgtagccgccctgaga

SEQ ID NO: 6135387 - DNA, 16 bp, Homo sapiens
ctctgtgtatatctct

SEQ ID NO: 6135388 - DNA, 21 bp, Homo sapiens
ctctgtgtatgagtgtgaatg

SEQ ID NO: 6135389 - DNA, 15 bp, Homo sapiens
ctctgtgtatttata

SEQ ID NO: 6135390 - DNA, 15 bp, Homo sapiens
ctctgtgtcaggtgg

SEQ ID NO: 6135391 - DNA, 22 bp, Homo sapiens
ctctgtgtcaggtggggcagct

SEQ ID NO: 6135392 - DNA, 15 bp, Homo sapiens
ctctgtgtccgtctg

SEQ ID NO: 6135393 - DNA, 22 bp, Homo sapiens
ctctgtgtctaagattctagat

SEQ ID NO: 6135394 - DNA, 14 bp, Homo sapiens
ctctgtgtctgaga

SEQ ID NO: 6135395 - DNA, 20 bp, Homo sapiens
ctctgtgtctgagtggcttc

SEQ ID NO: 6135396 - DNA, 16 bp, Homo sapiens
ctctgtgtctttctct

SEQ ID NO: 6135397 - DNA, 13 bp, Homo sapiens
ctctgtgtgagag

SEQ ID NO: 6135398 - DNA, 16 bp, Homo sapiens
ctctgtgtgagagaga

SEQ ID NO: 6135399 - DNA, 18 bp, Homo sapiens
ctctgtgtgagagagagg

SEQ ID NO: 6135400 - DNA, 20 bp, Homo sapiens
ctctgtgtgagagagagggc

SEQ ID NO: 6135401 - DNA, 21 bp, Homo sapiens
ctctgtgtgagcgtgtccaca

SEQ ID NO: 6135402 - DNA, 17 bp, Homo sapiens
ctctgtgtgcacaaata

SEQ ID NO: 6135403 - DNA, 13 bp, Homo sapiens
ctctgtgtgctcc

SEQ ID NO: 6135404 - DNA, 12 bp, Homo sapiens
ctctgtgtgtgt

SEQ ID NO: 6135405 - DNA, 19 bp, Homo sapiens
ctctgttaaggttgaactt

SEQ ID NO: 6135406 - DNA, 16 bp, Homo sapiens
ctctgttacactaatt

SEQ ID NO: 6135407 - DNA, 15 bp, Homo sapiens
ctctgttacccaggc

SEQ ID NO: 6135408 - DNA, 19 bp, Homo sapiens
ctctgttacccaggctgga

SEQ ID NO: 6135409 - DNA, 22 bp, Homo sapiens
ctctgttatcagctgggcagtg

SEQ ID NO: 6135410 - DNA, 20 bp, Homo sapiens
ctctgttatgtactgtacta

SEQ ID NO: 6135411 - DNA, 23 bp, Homo sapiens
ctctgttatttatccctcattca

SEQ ID NO: 6135412 - DNA, 21 bp, Homo sapiens
ctctgttatttgtcctcatgt

SEQ ID NO: 6135413 - DNA, 22 bp, Homo sapiens
ctctgttcaaagctgcctgtcc

SEQ ID NO: 6135414 - DNA, 20 bp, Homo sapiens
ctctgttcacaaactacctc

SEQ ID NO: 6135415 - DNA, 15 bp, Homo sapiens
ctctgttcacagtct

SEQ ID NO: 6135416 - DNA, 21 bp, Homo sapiens
ctctgttcacagtctctggaa

SEQ ID NO: 6135417 - DNA, 21 bp, Homo sapiens
ctctgttcagtaacagggcct

SEQ ID NO: 6135418 - DNA, 17 bp, Homo sapiens
ctctgttcagtgtaaat

SEQ ID NO: 6135419 - DNA, 18 bp, Homo sapiens
ctctgttcattcctccag

SEQ ID NO: 6135420 - DNA, 19 bp, Homo sapiens
ctctgttcattcctccagg

SEQ ID NO: 6135421 - DNA, 13 bp, Homo sapiens
ctctgttcatttc

SEQ ID NO: 6135422 - DNA, 17 bp, Homo sapiens
ctctgttcatttcctca

SEQ ID NO: 6135423 - DNA, 22 bp, Homo sapiens
ctctgttccaagtgtgtgtgca

SEQ ID NO: 6135424 - DNA, 17 bp, Homo sapiens
ctctgttccccacccag

SEQ ID NO: 6135425 - DNA, 21 bp, Homo sapiens
ctctgttcccccaccctccat

SEQ ID NO: 6135426 - DNA, 14 bp, Homo sapiens
ctctgttcccctcc

SEQ ID NO: 6135427 - DNA, 22 bp, Homo sapiens
ctctgttccttccctgtgcctc

SEQ ID NO: 6135428 - DNA, 20 bp, Homo sapiens
ctctgttctctcccctcaca

SEQ ID NO: 6135429 - DNA, 13 bp, Homo sapiens
ctctgttcttcct

SEQ ID NO: 6135430 - DNA, 15 bp, Homo sapiens
ctctgttcttcctca

SEQ ID NO: 6135431 - DNA, 14 bp, Homo sapiens
ctctgttctttata

SEQ ID NO: 6135432 - DNA, 15 bp, Homo sapiens
ctctgttgaatattt

SEQ ID NO: 6135433 - DNA, 23 bp, Homo sapiens
ctctgttgaccaggctggagtga

SEQ ID NO: 6135434 - DNA, 13 bp, Homo sapiens
ctctgttgactgg

SEQ ID NO: 6135435 - DNA, 20 bp, Homo sapiens
ctctgttgatctacccgtgc

SEQ ID NO: 6135436 - DNA, 20 bp, Homo sapiens
ctctgttgcaagtgcaataa

SEQ ID NO: 6135437 - DNA, 19 bp, Homo sapiens
ctctgttgcccaggctgga

SEQ ID NO: 6135438 - DNA, 20 bp, Homo sapiens
ctctgttgcctcctctctcc

SEQ ID NO: 6135439 - DNA, 19 bp, Homo sapiens
ctctgttggtccactgtgt

SEQ ID NO: 6135440 - DNA, 20 bp, Homo sapiens
ctctgttggtccactgtgtt

SEQ ID NO: 6135441 - DNA, 14 bp, Homo sapiens
ctctgttggtctgc

SEQ ID NO: 6135442 - DNA, 13 bp, Homo sapiens
ctctgttgtaaat

SEQ ID NO: 6135443 - DNA, 14 bp, Homo sapiens
ctctgttgtaagaa

SEQ ID NO: 6135444 - DNA, 17 bp, Homo sapiens
ctctgttgtcctcccct

SEQ ID NO: 6135445 - DNA, 21 bp, Homo sapiens
ctctgtttaccctccctgtcc

SEQ ID NO: 6135446 - DNA, 17 bp, Homo sapiens
ctctgtttagaggaggc

SEQ ID NO: 6135447 - DNA, 15 bp, Homo sapiens
ctctgtttatgcttt

SEQ ID NO: 6135448 - DNA, 17 bp, Homo sapiens
ctctgtttatttgatga

SEQ ID NO: 6135449 - DNA, 17 bp, Homo sapiens
ctctgtttcccctcaga

SEQ ID NO: 6135450 - DNA, 22 bp, Homo sapiens
ctctgtttcccctcagaacacc

SEQ ID NO: 6135451 - DNA, 14 bp, Homo sapiens
ctctgtttcctgaa

SEQ ID NO: 6135452 - DNA, 18 bp, Homo sapiens
ctctgtttcctgaaatat

SEQ ID NO: 6135453 - DNA, 23 bp, Homo sapiens
ctctgtttgatgctatttatgca

SEQ ID NO: 6135454 - DNA, 17 bp, Homo sapiens
ctctgtttgctcaccca

SEQ ID NO: 6135455 - DNA, 16 bp, Homo sapiens
ctctgtttgtgggact

SEQ ID NO: 6135456 - DNA, 14 bp, Homo sapiens
ctctgtttgtgggg

SEQ ID NO: 6135457 - DNA, 18 bp, Homo sapiens
ctctgtttgtttggctgt

SEQ ID NO: 6135458 - DNA, 20 bp, Homo sapiens
ctctgttttacaagttggag

SEQ ID NO: 6135459 - DNA, 23 bp, Homo sapiens
ctctgttttacaagttggagtca

SEQ ID NO: 6135460 - DNA, 13 bp, Homo sapiens
ctctgttttctct

SEQ ID NO: 6135461 - DNA, 14 bp, Homo sapiens
ctctgttttctctc

SEQ ID NO: 6135462 - DNA, 20 bp, Homo sapiens
ctctgttttgtgccagtgct

SEQ ID NO: 6135463 - DNA, 21 bp, Homo sapiens
ctctgtttttcttctgaaata

SEQ ID NO: 6135464 - DNA, 17 bp, Homo sapiens
ctcttaaaaaataaaaa

SEQ ID NO: 6135465 - DNA, 18 bp, Homo sapiens
ctcttaaaaaataaaaac

SEQ ID NO: 6135466 - DNA, 16 bp, Homo sapiens
ctcttaaaaatcttgg

SEQ ID NO: 6135467 - DNA, 22 bp, Homo sapiens
ctcttaaaaattatctttaaaa

SEQ ID NO: 6135468 - DNA, 12 bp, Homo sapiens
ctcttaaaatat

SEQ ID NO: 6135469 - DNA, 15 bp, Homo sapiens
ctcttaaaatatctt

SEQ ID NO: 6135470 - DNA, 17 bp, Homo sapiens
ctcttaaacttgtgaat

SEQ ID NO: 6135471 - DNA, 22 bp, Homo sapiens
ctcttaaagaaaacccaccccg

SEQ ID NO: 6135472 - DNA, 17 bp, Homo sapiens
ctcttaaataaaaataa

SEQ ID NO: 6135473 - DNA, 18 bp, Homo sapiens
ctcttaaatactttttca

SEQ ID NO: 6135474 - DNA, 13 bp, Homo sapiens
ctcttaaatcatt

SEQ ID NO: 6135475 - DNA, 14 bp, Homo sapiens
ctcttaaatcattt

SEQ ID NO: 6135476 - DNA, 14 bp, Homo sapiens
ctcttaaatctctt

SEQ ID NO: 6135477 - DNA, 18 bp, Homo sapiens
ctcttaaattatatattt

SEQ ID NO: 6135478 - DNA, 20 bp, Homo sapiens
ctcttaaattatatatttat

SEQ ID NO: 6135479 - DNA, 13 bp, Homo sapiens
ctcttaagacact

SEQ ID NO: 6135480 - DNA, 15 bp, Homo sapiens
ctcttaagcagcatg

SEQ ID NO: 6135481 - DNA, 17 bp, Homo sapiens
ctcttaagcagcatgga

SEQ ID NO: 6135482 - DNA, 22 bp, Homo sapiens
ctcttaagcagcatggaaaaat

SEQ ID NO: 6135483 - DNA, 14 bp, Homo sapiens
ctcttaagccatct

SEQ ID NO: 6135484 - DNA, 22 bp, Homo sapiens
ctcttaaggattaatattcttc

SEQ ID NO: 6135485 - DNA, 20 bp, Homo sapiens
ctcttaagggggccttggaa

SEQ ID NO: 6135486 - DNA, 18 bp, Homo sapiens
ctcttaagtaccagaagc

SEQ ID NO: 6135487 - DNA, 23 bp, Homo sapiens
ctcttaagtcctaaaagttctca

SEQ ID NO: 6135488 - DNA, 16 bp, Homo sapiens
ctcttaagtgtaaata

SEQ ID NO: 6135489 - DNA, 18 bp, Homo sapiens
ctcttaagtttctcagct

SEQ ID NO: 6135490 - DNA, 19 bp, Homo sapiens
ctcttaagtttctcagctc

SEQ ID NO: 6135491 - DNA, 16 bp, Homo sapiens
ctcttaatattgagaa

SEQ ID NO: 6135492 - DNA, 17 bp, Homo sapiens
ctcttaatattgagaat

SEQ ID NO: 6135493 - DNA, 13 bp, Homo sapiens
ctagggcagggtg

SEQ ID NO: 6135494 - DNA, 23 bp, Homo sapiens
ctagggcagggtgggagccggga

SEQ ID NO: 6135495 - DNA, 15 bp, Homo sapiens
ctagggccactgaag

SEQ ID NO: 6135496 - DNA, 15 bp, Homo sapiens
ctagggcctgggttt

SEQ ID NO: 6135497 - DNA, 16 bp, Homo sapiens
ctagggccttggaaat

SEQ ID NO: 6135498 - DNA, 19 bp, Homo sapiens
ctagggctctccaagcact

SEQ ID NO: 6135499 - DNA, 22 bp, Homo sapiens
ctagggctgagcacctctcaga

SEQ ID NO: 6135500 - DNA, 13 bp, Homo sapiens
ctagggctgctgc

SEQ ID NO: 6135501 - DNA, 14 bp, Homo sapiens
ctagggctgggaaa

SEQ ID NO: 6135502 - DNA, 20 bp, Homo sapiens
ctagggctgggaaacactcc

SEQ ID NO: 6135503 - DNA, 14 bp, Homo sapiens
ctagggctgggtgt

SEQ ID NO: 6135504 - DNA, 16 bp, Homo sapiens
ctaggggaaggactgg

SEQ ID NO: 6135505 - DNA, 20 bp, Homo sapiens
ctaggggaaggactggccgt

SEQ ID NO: 6135506 - DNA, 17 bp, Homo sapiens
ctaggggaagggctttg

SEQ ID NO: 6135507 - DNA, 15 bp, Homo sapiens
ctaggggaagggggt

SEQ ID NO: 6135508 - DNA, 22 bp, Homo sapiens
ctaggggaatgagggggctcag

SEQ ID NO: 6135509 - DNA, 19 bp, Homo sapiens
ctaggggacacttccctct

SEQ ID NO: 6135510 - DNA, 12 bp, Homo sapiens
ctaggggagcag

SEQ ID NO: 6135511 - DNA, 19 bp, Homo sapiens
ctaggggaggggggagcca

SEQ ID NO: 6135512 - DNA, 23 bp, Homo sapiens
ctaggggaggggggagccagagg

SEQ ID NO: 6135513 - DNA, 20 bp, Homo sapiens
ctaggggccgagtccaggag

SEQ ID NO: 6135514 - DNA, 12 bp, Homo sapiens
ctaggggctggg

SEQ ID NO: 6135515 - DNA, 12 bp, Homo sapiens
ctaggggtagct

SEQ ID NO: 6135516 - DNA, 17 bp, Homo sapiens
ctaggggtagctggtgg

SEQ ID NO: 6135517 - DNA, 22 bp, Homo sapiens
ctaggggtcattttagctcaaa

SEQ ID NO: 6135518 - DNA, 16 bp, Homo sapiens
ctaggggtcctcggga

SEQ ID NO: 6135519 - DNA, 21 bp, Homo sapiens
ctaggggtgcgctcacctgca

SEQ ID NO: 6135520 - DNA, 22 bp, Homo sapiens
ctaggggtgcgctcacctgcag

SEQ ID NO: 6135521 - DNA, 19 bp, Homo sapiens
ctaggggtggcgctcagac

SEQ ID NO: 6135522 - DNA, 17 bp, Homo sapiens
ctagggtacatggtgct

SEQ ID NO: 6135523 - DNA, 18 bp, Homo sapiens
ctagggtacatgtccaca

SEQ ID NO: 6135524 - DNA, 14 bp, Homo sapiens
ctagggtccccctt

SEQ ID NO: 6135525 - DNA, 17 bp, Homo sapiens
ctagggtccctgaacgc

SEQ ID NO: 6135526 - DNA, 21 bp, Homo sapiens
ctagggtcctcaggcagtggc

SEQ ID NO: 6135527 - DNA, 20 bp, Homo sapiens
ctagggtctgataggaacag

SEQ ID NO: 6135528 - DNA, 16 bp, Homo sapiens
ctagggtgagggtgac

SEQ ID NO: 6135529 - DNA, 22 bp, Homo sapiens
ctagggtgagggtgacagaggg

SEQ ID NO: 6135530 - DNA, 20 bp, Homo sapiens
ctagggtgccttaaaaataa

SEQ ID NO: 6135531 - DNA, 18 bp, Homo sapiens
ctagggtgggaaggggct

SEQ ID NO: 6135532 - DNA, 15 bp, Homo sapiens
ctagggtgggcccca

SEQ ID NO: 6135533 - DNA, 17 bp, Homo sapiens
ctagggtgggccccagc

SEQ ID NO: 6135534 - DNA, 15 bp, Homo sapiens
ctagggttgctggag

SEQ ID NO: 6135535 - DNA, 19 bp, Homo sapiens
ctagggttgctggagcctg

SEQ ID NO: 6135536 - DNA, 23 bp, Homo sapiens
ctagggttgcttgggccactgcc

SEQ ID NO: 6135537 - DNA, 16 bp, Homo sapiens
ctagggtttcttaaat

SEQ ID NO: 6135538 - DNA, 18 bp, Homo sapiens
ctagggttttggcctgcc

SEQ ID NO: 6135539 - DNA, 19 bp, Homo sapiens
ctagggttttggcctgcct

SEQ ID NO: 6135540 - DNA, 20 bp, Homo sapiens
ctaggtacgatgacagtgtt

SEQ ID NO: 6135541 - DNA, 15 bp, Homo sapiens
ctaggtagaaaaagg

SEQ ID NO: 6135542 - DNA, 19 bp, Homo sapiens
ctaggtagccccctcttcc

SEQ ID NO: 6135543 - DNA, 20 bp, Homo sapiens
ctaggtagccccctcttccc

SEQ ID NO: 6135544 - DNA, 17 bp, Homo sapiens
ctaggtaggaaatgtgg

SEQ ID NO: 6135545 - DNA, 22 bp, Homo sapiens
ctaggtaggcaccacagagaag

SEQ ID NO: 6135546 - DNA, 19 bp, Homo sapiens
ctaggtataaaaaataagt

SEQ ID NO: 6135547 - DNA, 11 bp, Homo sapiens
ctaggtatcat

SEQ ID NO: 6135548 - DNA, 20 bp, Homo sapiens
ctaggtcaattttttttctg

SEQ ID NO: 6135549 - DNA, 17 bp, Homo sapiens
ctaggtcagtacccacc

SEQ ID NO: 6135550 - DNA, 14 bp, Homo sapiens
ctaggtccaagccc

SEQ ID NO: 6135551 - DNA, 21 bp, Homo sapiens
ctaggtccccatactcctatg

SEQ ID NO: 6135552 - DNA, 16 bp, Homo sapiens
ctaggtcccccaagca

SEQ ID NO: 6135553 - DNA, 20 bp, Homo sapiens
ctaggtcccttcccgaccca

SEQ ID NO: 6135554 - DNA, 21 bp, Homo sapiens
ctaggtcccttcccgacccag

SEQ ID NO: 6135555 - DNA, 22 bp, Homo sapiens
ctaggtcccttcccgacccagc

SEQ ID NO: 6135556 - DNA, 23 bp, Homo sapiens
ctaggtcccttcccgacccagcc

SEQ ID NO: 6135557 - DNA, 22 bp, Homo sapiens
ctaggtccgtccggtgtgtcag

SEQ ID NO: 6135558 - DNA, 23 bp, Homo sapiens
ctaggtccgtccggtgtgtcaga

SEQ ID NO: 6135559 - DNA, 15 bp, Homo sapiens
ctaggtctccacccc

SEQ ID NO: 6135560 - DNA, 17 bp, Homo sapiens
ctaggtctccacccctc

SEQ ID NO: 6135561 - DNA, 20 bp, Homo sapiens
ctaggtctcctcagggtggg

SEQ ID NO: 6135562 - DNA, 23 bp, Homo sapiens
ctaggtctcggactaagcctacc

SEQ ID NO: 6135563 - DNA, 13 bp, Homo sapiens
ctaggtctgctcc

SEQ ID NO: 6135564 - DNA, 17 bp, Homo sapiens
ctaggtgaacagcagga

SEQ ID NO: 6135565 - DNA, 23 bp, Homo sapiens
ctaggtgcacatatacatctagc

SEQ ID NO: 6135566 - DNA, 14 bp, Homo sapiens
ctaggtgcccaggg

SEQ ID NO: 6135567 - DNA, 15 bp, Homo sapiens
ctaggtgcccagtct

SEQ ID NO: 6135568 - DNA, 18 bp, Homo sapiens
ctaggtgcccagtcttga

SEQ ID NO: 6135569 - DNA, 18 bp, Homo sapiens
ctaggtgctatttgtcat

SEQ ID NO: 6135570 - DNA, 13 bp, Homo sapiens
ctaggtgctggat

SEQ ID NO: 6135571 - DNA, 19 bp, Homo sapiens
ctaggtgctggcatgtctg

SEQ ID NO: 6135572 - DNA, 20 bp, Homo sapiens
ctaggtgctggcatgtctgg

SEQ ID NO: 6135573 - DNA, 20 bp, Homo sapiens
ctaggtggaggttgtgcatg

SEQ ID NO: 6135574 - DNA, 23 bp, Homo sapiens
ctaggtggcaaggctgtgctccc

SEQ ID NO: 6135575 - DNA, 18 bp, Homo sapiens
ctaggtgggccagcccct

SEQ ID NO: 6135576 - DNA, 22 bp, Homo sapiens
ctaggtgggtcaactccaaggc

SEQ ID NO: 6135577 - DNA, 16 bp, Homo sapiens
ctaggtgtccccaacg

SEQ ID NO: 6135578 - DNA, 15 bp, Homo sapiens
ctaggtgtctgggat

SEQ ID NO: 6135579 - DNA, 14 bp, Homo sapiens
ctaggttaaagcta

SEQ ID NO: 6135580 - DNA, 17 bp, Homo sapiens
ctaggttaacatttgta

SEQ ID NO: 6135581 - DNA, 17 bp, Homo sapiens
ctaggttaataggagga

SEQ ID NO: 6135582 - DNA, 13 bp, Homo sapiens
ctaggttatacaa

SEQ ID NO: 6135583 - DNA, 14 bp, Homo sapiens
ctaggttatacaat

SEQ ID NO: 6135584 - DNA, 17 bp, Homo sapiens
ctaggttatacaataac

SEQ ID NO: 6135585 - DNA, 15 bp, Homo sapiens
ctaggttcaattccc

SEQ ID NO: 6135586 - DNA, 19 bp, Homo sapiens
ctaggttcccggtcccgag

SEQ ID NO: 6135587 - DNA, 16 bp, Homo sapiens
ctaggttccctgttct

SEQ ID NO: 6135588 - DNA, 13 bp, Homo sapiens
ctaggttctaaaa

SEQ ID NO: 6135589 - DNA, 14 bp, Homo sapiens
ctaggttctgtaga

SEQ ID NO: 6135590 - DNA, 14 bp, Homo sapiens
ctaggttggacagc

SEQ ID NO: 6135591 - DNA, 23 bp, Homo sapiens
ctaggttgtccatttatggtacc

SEQ ID NO: 6135592 - DNA, 20 bp, Homo sapiens
ctaggtttaaaacagcctgg

SEQ ID NO: 6135593 - DNA, 18 bp, Homo sapiens
ctaggtttaactcagatc

SEQ ID NO: 6135594 - DNA, 22 bp, Homo sapiens
ctaggtttaactcagatcacta

SEQ ID NO: 6135595 - DNA, 13 bp, Homo sapiens
ctaggtttcaaag

SEQ ID NO: 6135596 - DNA, 14 bp, Homo sapiens
ctagtaaaaccttg

SEQ ID NO: 6135597 - DNA, 21 bp, Homo sapiens
ctagtaaagacataggaacat

SEQ ID NO: 6135598 - DNA, 16 bp, Homo sapiens
ctagtaaatgttaact

SEQ ID NO: 6135599 - DNA, 14 bp, Homo sapiens
ctagtaaattttca

SEQ ID NO: 6135600 - DNA, 15 bp, Homo sapiens
ctagtaaattttcaa

SEQ ID NO: 6135601 - DNA, 14 bp, Homo sapiens
ctagtaaccaaggc

SEQ ID NO: 6135602 - DNA, 18 bp, Homo sapiens
ctagtaaccaaggccctg

SEQ ID NO: 6135603 - DNA, 22 bp, Homo sapiens
ctagtaaccaaggccctgtctc

SEQ ID NO: 6135604 - DNA, 20 bp, Homo sapiens
ctagtaagaacgtactttct

SEQ ID NO: 6135605 - DNA, 18 bp, Homo sapiens
ctagtaagcatctacttc

SEQ ID NO: 6135606 - DNA, 15 bp, Homo sapiens
ctagtaagtgccttc

SEQ ID NO: 6135607 - DNA, 16 bp, Homo sapiens
ctagtaagtgccttcc

SEQ ID NO: 6135608 - DNA, 15 bp, Homo sapiens
ctagtaataatgtaa

SEQ ID NO: 6135609 - DNA, 22 bp, Homo sapiens
ctagtaatgggccaattaaaat

SEQ ID NO: 6135610 - DNA, 16 bp, Homo sapiens
ctagtacaatcttggg

SEQ ID NO: 6135611 - DNA, 15 bp, Homo sapiens
ctagtacacttttat

SEQ ID NO: 6135612 - DNA, 19 bp, Homo sapiens
ctagtacacttttatgagc

SEQ ID NO: 6135613 - DNA, 19 bp, Homo sapiens
ctagtacattactaaatat

SEQ ID NO: 6135614 - DNA, 19 bp, Homo sapiens
ctagtaccctatagagagg

SEQ ID NO: 6135615 - DNA, 17 bp, Homo sapiens
ctagtacctgtgactct

SEQ ID NO: 6135616 - DNA, 16 bp, Homo sapiens
ctagtactaactccta

SEQ ID NO: 6135617 - DNA, 12 bp, Homo sapiens
ctagtactatta

SEQ ID NO: 6135618 - DNA, 15 bp, Homo sapiens
ctagtactctctgct

SEQ ID NO: 6135619 - DNA, 16 bp, Homo sapiens
ctagtactctctgctc

SEQ ID NO: 6135620 - DNA, 18 bp, Homo sapiens
ctagtactctctgctcta

SEQ ID NO: 6135621 - DNA, 22 bp, Homo sapiens
ctagtactctctgctctagcca

SEQ ID NO: 6135622 - DNA, 14 bp, Homo sapiens
ctagtactgtattg

SEQ ID NO: 6135623 - DNA, 15 bp, Homo sapiens
ctagtactgtgtact

SEQ ID NO: 6135624 - DNA, 22 bp, Homo sapiens
ctagtactgtgtactgtataga

SEQ ID NO: 6135625 - DNA, 13 bp, Homo sapiens
ctagtactttgat

SEQ ID NO: 6135626 - DNA, 15 bp, Homo sapiens
ctagtagaacaatgt

SEQ ID NO: 6135627 - DNA, 20 bp, Homo sapiens
ctagtagaagaagctttgcc

SEQ ID NO: 6135628 - DNA, 14 bp, Homo sapiens
ctagtagcaatgtg

SEQ ID NO: 6135629 - DNA, 16 bp, Homo sapiens
ctagtagcaatgtgcc

SEQ ID NO: 6135630 - DNA, 19 bp, Homo sapiens
ctagtagctgggattacag

SEQ ID NO: 6135631 - DNA, 15 bp, Homo sapiens
ctagtaggaatgtac

SEQ ID NO: 6135632 - DNA, 22 bp, Homo sapiens
ctagtaggtctgcacacataac

SEQ ID NO: 6135633 - DNA, 23 bp, Homo sapiens
ctagtaggtctgcacacataaca

SEQ ID NO: 6135634 - DNA, 24 bp, Homo sapiens
ctagtaggtctgcacacataacac

SEQ ID NO: 6135635 - DNA, 15 bp, Homo sapiens
ctagtagttaagaga

SEQ ID NO: 6135636 - DNA, 17 bp, Homo sapiens
ctagtatacccactgca

SEQ ID NO: 6135637 - DNA, 21 bp, Homo sapiens
ctagtatatgtcagacatgaa

SEQ ID NO: 6135638 - DNA, 11 bp, Homo sapiens
ctagtatatta

SEQ ID NO: 6135639 - DNA, 23 bp, Homo sapiens
ctagtatcaaaagaaagaaaatc

SEQ ID NO: 6135640 - DNA, 21 bp, Homo sapiens
ctagtatctattgtgttggct

SEQ ID NO: 6135641 - DNA, 20 bp, Homo sapiens
ctagtatgccctgtaatttt

SEQ ID NO: 6135642 - DNA, 13 bp, Homo sapiens
ctagtatgtcttg

SEQ ID NO: 6135643 - DNA, 22 bp, Homo sapiens
ctagtattcctaacctgtcaga

SEQ ID NO: 6135644 - DNA, 16 bp, Homo sapiens
ctagtattcgctgtgt

SEQ ID NO: 6135645 - DNA, 18 bp, Homo sapiens
ctagtattgacaaaatgt

SEQ ID NO: 6135646 - DNA, 19 bp, Homo sapiens
ctagtattgacaaaatgtt

SEQ ID NO: 6135647 - DNA, 21 bp, Homo sapiens
ctagtatttcatgctgggaat

SEQ ID NO: 6135648 - DNA, 18 bp, Homo sapiens
ctagtatttgaattaaaa

SEQ ID NO: 6135649 - DNA, 24 bp, Homo sapiens
ctagtatttgaattaaaacttctt

SEQ ID NO: 6135650 - DNA, 14 bp, Homo sapiens
ctagtatttgtatc

SEQ ID NO: 6135651 - DNA, 17 bp, Homo sapiens
ctagtatttttttctta

SEQ ID NO: 6135652 - DNA, 20 bp, Homo sapiens
ctagtcaacagtaccctggt

SEQ ID NO: 6135653 - DNA, 17 bp, Homo sapiens
ctagtcaactgctgttt

SEQ ID NO: 6135654 - DNA, 16 bp, Homo sapiens
ctagtcaagaaaaata

SEQ ID NO: 6135655 - DNA, 13 bp, Homo sapiens
ctagtcaataaac

SEQ ID NO: 6135656 - DNA, 17 bp, Homo sapiens
ctagtcaataactctga

SEQ ID NO: 6135657 - DNA, 18 bp, Homo sapiens
ctagtcaatgacatgaat

SEQ ID NO: 6135658 - DNA, 14 bp, Homo sapiens
ctagtcacaaagac

SEQ ID NO: 6135659 - DNA, 18 bp, Homo sapiens
ctagtcacaaagactcct

SEQ ID NO: 6135660 - DNA, 18 bp, Homo sapiens
ctagtcaccgacagcggc

SEQ ID NO: 6135661 - DNA, 15 bp, Homo sapiens
ctagtcacctggggg

SEQ ID NO: 6135662 - DNA, 12 bp, Homo sapiens
ctagtcactgga

SEQ ID NO: 6135663 - DNA, 15 bp, Homo sapiens
ctagtcactggcagc

SEQ ID NO: 6135664 - DNA, 20 bp, Homo sapiens
ctagtcagaaaattggcagt

SEQ ID NO: 6135665 - DNA, 13 bp, Homo sapiens
ctagtcagagaga

SEQ ID NO: 6135666 - DNA, 18 bp, Homo sapiens
ctagtcagagagagtgtt

SEQ ID NO: 6135667 - DNA, 19 bp, Homo sapiens
ctagtcagagtataatttt

SEQ ID NO: 6135668 - DNA, 14 bp, Homo sapiens
ctagtcagggcaca

SEQ ID NO: 6135669 - DNA, 21 bp, Homo sapiens
ctagtcagtaaacatttgtaa

SEQ ID NO: 6135670 - DNA, 16 bp, Homo sapiens
ctagtcagtatctgta

SEQ ID NO: 6135671 - DNA, 16 bp, Homo sapiens
ctcttaatcactactg

SEQ ID NO: 6135672 - DNA, 18 bp, Homo sapiens
ctcttaatcactactgta

SEQ ID NO: 6135673 - DNA, 19 bp, Homo sapiens
ctcttaatcactactgtat

SEQ ID NO: 6135674 - DNA, 15 bp, Homo sapiens
ctcttaatctgtgtg

SEQ ID NO: 6135675 - DNA, 18 bp, Homo sapiens
ctcttaatggtccaaagg

SEQ ID NO: 6135676 - DNA, 14 bp, Homo sapiens
ctcttaatgtgcag

SEQ ID NO: 6135677 - DNA, 12 bp, Homo sapiens
ctcttaattgcc

SEQ ID NO: 6135678 - DNA, 17 bp, Homo sapiens
ctcttaattgttcattt

SEQ ID NO: 6135679 - DNA, 14 bp, Homo sapiens
ctcttacaaaagct

SEQ ID NO: 6135680 - DNA, 19 bp, Homo sapiens
ctcttacagtgtttggaca

SEQ ID NO: 6135681 - DNA, 18 bp, Homo sapiens
ctcttacatgtataaagt

SEQ ID NO: 6135682 - DNA, 21 bp, Homo sapiens
ctcttacatgtataaagtgat

SEQ ID NO: 6135683 - DNA, 17 bp, Homo sapiens
ctcttaccagtatttaa

SEQ ID NO: 6135684 - DNA, 14 bp, Homo sapiens
ctcttaccccgtcc

SEQ ID NO: 6135685 - DNA, 21 bp, Homo sapiens
ctcttaccccgtccctttccc

SEQ ID NO: 6135686 - DNA, 23 bp, Homo sapiens
ctcttaccccgtccctttccctg

SEQ ID NO: 6135687 - DNA, 22 bp, Homo sapiens
ctcttacccttctgtgcccagc

SEQ ID NO: 6135688 - DNA, 16 bp, Homo sapiens
ctcttactaatgtaaa

SEQ ID NO: 6135689 - DNA, 18 bp, Homo sapiens
ctcttactacactgagga

SEQ ID NO: 6135690 - DNA, 18 bp, Homo sapiens
ctcttactctttcctatt

SEQ ID NO: 6135691 - DNA, 20 bp, Homo sapiens
ctcttactctttcctatttc

SEQ ID NO: 6135692 - DNA, 16 bp, Homo sapiens
ctcttactgcaaatgt

SEQ ID NO: 6135693 - DNA, 17 bp, Homo sapiens
ctcttactttttgtaaa

SEQ ID NO: 6135694 - DNA, 13 bp, Homo sapiens
ctcttagaaactc

SEQ ID NO: 6135695 - DNA, 15 bp, Homo sapiens
ctcttagaaatactt

SEQ ID NO: 6135696 - DNA, 23 bp, Homo sapiens
ctcttagaatttgtttcatctat

SEQ ID NO: 6135697 - DNA, 22 bp, Homo sapiens
ctcttagactcgcctatcttag

SEQ ID NO: 6135698 - DNA, 21 bp, Homo sapiens
ctcttagagatgattcagagg

SEQ ID NO: 6135699 - DNA, 23 bp, Homo sapiens
ctcttagaggaaggagataggga

SEQ ID NO: 6135700 - DNA, 20 bp, Homo sapiens
ctcttagatgcagttctgaa

SEQ ID NO: 6135701 - DNA, 14 bp, Homo sapiens
ctcttagatggatt

SEQ ID NO: 6135702 - DNA, 18 bp, Homo sapiens
ctcttagcaaaaacatgt

SEQ ID NO: 6135703 - DNA, 16 bp, Homo sapiens
ctcttagcccatgctg

SEQ ID NO: 6135704 - DNA, 16 bp, Homo sapiens
ctcttagcctctggat

SEQ ID NO: 6135705 - DNA, 21 bp, Homo sapiens
ctcttagctactgtatgcaaa

SEQ ID NO: 6135706 - DNA, 16 bp, Homo sapiens
ctcttagctcagctga

SEQ ID NO: 6135707 - DNA, 22 bp, Homo sapiens
ctcttagctcagctgagcatgg

SEQ ID NO: 6135708 - DNA, 15 bp, Homo sapiens
ctcttagctcccctc

SEQ ID NO: 6135709 - DNA, 15 bp, Homo sapiens
ctcttaggagtactt

SEQ ID NO: 6135710 - DNA, 17 bp, Homo sapiens
ctcttagggaaaccaat

SEQ ID NO: 6135711 - DNA, 16 bp, Homo sapiens
ctcttagtcccaagct

SEQ ID NO: 6135712 - DNA, 20 bp, Homo sapiens
ctcttagtgattgtgtctgc

SEQ ID NO: 6135713 - DNA, 21 bp, Homo sapiens
ctcttagtgcccgcctaggag

SEQ ID NO: 6135714 - DNA, 14 bp, Homo sapiens
ctcttagtttttaa

SEQ ID NO: 6135715 - DNA, 22 bp, Homo sapiens
ctcttagtttttaaaaaggcct

SEQ ID NO: 6135716 - DNA, 22 bp, Homo sapiens
ctcttataaagtggacttctga

SEQ ID NO: 6135717 - DNA, 19 bp, Homo sapiens
ctcttatagaagcttcagc

SEQ ID NO: 6135718 - DNA, 18 bp, Homo sapiens
ctcttatagaatatttat

SEQ ID NO: 6135719 - DNA, 20 bp, Homo sapiens
ctcttatagaatatttatta

SEQ ID NO: 6135720 - DNA, 21 bp, Homo sapiens
ctcttatagaatatttattac

SEQ ID NO: 6135721 - DNA, 15 bp, Homo sapiens
ctcttatatctatat

SEQ ID NO: 6135722 - DNA, 20 bp, Homo sapiens
ctcttatcactaagaaagaa

SEQ ID NO: 6135723 - DNA, 14 bp, Homo sapiens
ctcttatccccagc

SEQ ID NO: 6135724 - DNA, 15 bp, Homo sapiens
ctcttatcctctctc

SEQ ID NO: 6135725 - DNA, 11 bp, Homo sapiens
ctcttatctca

SEQ ID NO: 6135726 - DNA, 17 bp, Homo sapiens
ctcttatgcacacctcc

SEQ ID NO: 6135727 - DNA, 13 bp, Homo sapiens
ctcttatgccatt

SEQ ID NO: 6135728 - DNA, 19 bp, Homo sapiens
ctcttatggatgtccccag

SEQ ID NO: 6135729 - DNA, 22 bp, Homo sapiens
ctcttatggatgtccccagcag

SEQ ID NO: 6135730 - DNA, 17 bp, Homo sapiens
ctcttatgtacctcttt

SEQ ID NO: 6135731 - DNA, 14 bp, Homo sapiens
ctcttattacaaag

SEQ ID NO: 6135732 - DNA, 22 bp, Homo sapiens
ctcttattacagagggaaaggc

SEQ ID NO: 6135733 - DNA, 16 bp, Homo sapiens
ctcttattcagtaaaa

SEQ ID NO: 6135734 - DNA, 15 bp, Homo sapiens
ctcttattcctctag

SEQ ID NO: 6135735 - DNA, 16 bp, Homo sapiens
ctcttattcctctagg

SEQ ID NO: 6135736 - DNA, 13 bp, Homo sapiens
ctcttattgccca

SEQ ID NO: 6135737 - DNA, 17 bp, Homo sapiens
ctcttattgcctcactt

SEQ ID NO: 6135738 - DNA, 21 bp, Homo sapiens
ctcttattgggatatcatttt

SEQ ID NO: 6135739 - DNA, 16 bp, Homo sapiens
ctcttattgttcctct

SEQ ID NO: 6135740 - DNA, 18 bp, Homo sapiens
ctcttattgttcctctta

SEQ ID NO: 6135741 - DNA, 16 bp, Homo sapiens
ctcttatttatagaat

SEQ ID NO: 6135742 - DNA, 16 bp, Homo sapiens
ctcttatttctgaatt

SEQ ID NO: 6135743 - DNA, 12 bp, Homo sapiens
ctcttatttctt

SEQ ID NO: 6135744 - DNA, 16 bp, Homo sapiens
ctcttatttctttcct

SEQ ID NO: 6135745 - DNA, 19 bp, Homo sapiens
ctcttatttctttccttta

SEQ ID NO: 6135746 - DNA, 20 bp, Homo sapiens
ctcttatttctttcctttaa

SEQ ID NO: 6135747 - DNA, 12 bp, Homo sapiens
ctcttatttgct

SEQ ID NO: 6135748 - DNA, 14 bp, Homo sapiens
ctcttatttttgta

SEQ ID NO: 6135749 - DNA, 16 bp, Homo sapiens
ctcttcaaaaactgtt

SEQ ID NO: 6135750 - DNA, 14 bp, Homo sapiens
ctcttcaaagcaga

SEQ ID NO: 6135751 - DNA, 15 bp, Homo sapiens
ctcttcaaagcagag

SEQ ID NO: 6135752 - DNA, 18 bp, Homo sapiens
ctcttcaaagcagagtgg

SEQ ID NO: 6135753 - DNA, 16 bp, Homo sapiens
ctcttcaactgaccag

SEQ ID NO: 6135754 - DNA, 17 bp, Homo sapiens
ctcttcaactgaccagc

SEQ ID NO: 6135755 - DNA, 20 bp, Homo sapiens
ctcttcaactgaccagcctc

SEQ ID NO: 6135756 - DNA, 18 bp, Homo sapiens
ctcttcaaggactttctg

SEQ ID NO: 6135757 - DNA, 20 bp, Homo sapiens
ctcttcaaggaggcccactg

SEQ ID NO: 6135758 - DNA, 12 bp, Homo sapiens
ctcttcaaggcc

SEQ ID NO: 6135759 - DNA, 18 bp, Homo sapiens
ctcttcaagtactgtttt

SEQ ID NO: 6135760 - DNA, 13 bp, Homo sapiens
ctcttcaataaac

SEQ ID NO: 6135761 - DNA, 16 bp, Homo sapiens
ctcttcaataaaccac

SEQ ID NO: 6135762 - DNA, 22 bp, Homo sapiens
ctcttcaataaaccacaagcat

SEQ ID NO: 6135763 - DNA, 23 bp, Homo sapiens
ctcttcaatcactagtcaagaaa

SEQ ID NO: 6135764 - DNA, 15 bp, Homo sapiens
ctcttcaatctctgg

SEQ ID NO: 6135765 - DNA, 14 bp, Homo sapiens
ctcttcaatctctt

SEQ ID NO: 6135766 - DNA, 14 bp, Homo sapiens
ctcttcaccaggaa

SEQ ID NO: 6135767 - DNA, 16 bp, Homo sapiens
ctcttcaccaggaaga

SEQ ID NO: 6135768 - DNA, 16 bp, Homo sapiens
ctcttcaccccggcag

SEQ ID NO: 6135769 - DNA, 18 bp, Homo sapiens
ctcttcaccccggcaggc

SEQ ID NO: 6135770 - DNA, 19 bp, Homo sapiens
ctcttcaccccggcaggcc

SEQ ID NO: 6135771 - DNA, 23 bp, Homo sapiens
ctcttcaccccggcaggccctgc

SEQ ID NO: 6135772 - DNA, 16 bp, Homo sapiens
ctcttcaccttggttt

SEQ ID NO: 6135773 - DNA, 16 bp, Homo sapiens
ctcttcactaccctga

SEQ ID NO: 6135774 - DNA, 17 bp, Homo sapiens
ctcttcactaccctgat

SEQ ID NO: 6135775 - DNA, 21 bp, Homo sapiens
ctcttcactaccctgattctt

SEQ ID NO: 6135776 - DNA, 13 bp, Homo sapiens
ctcttcactcagc

SEQ ID NO: 6135777 - DNA, 22 bp, Homo sapiens
ctcttcactcagccacacccca

SEQ ID NO: 6135778 - DNA, 12 bp, Homo sapiens
ctcttcacttcc

SEQ ID NO: 6135779 - DNA, 13 bp, Homo sapiens
ctcttcacttcct

SEQ ID NO: 6135780 - DNA, 21 bp, Homo sapiens
ctcttcacttcctccagaagc

SEQ ID NO: 6135781 - DNA, 12 bp, Homo sapiens
ctcttcagaact

SEQ ID NO: 6135782 - DNA, 15 bp, Homo sapiens
ctcttcagactctca

SEQ ID NO: 6135783 - DNA, 13 bp, Homo sapiens
ctcttcagaggcc

SEQ ID NO: 6135784 - DNA, 17 bp, Homo sapiens
ctcttcagaggccctcg

SEQ ID NO: 6135785 - DNA, 19 bp, Homo sapiens
ctcttcagatctctaactt

SEQ ID NO: 6135786 - DNA, 21 bp, Homo sapiens
ctcttcagatgccacttctaa

SEQ ID NO: 6135787 - DNA, 14 bp, Homo sapiens
ctcttcagcccctt

SEQ ID NO: 6135788 - DNA, 16 bp, Homo sapiens
ctcttcagccccttct

SEQ ID NO: 6135789 - DNA, 19 bp, Homo sapiens
ctcttcagccccttctccc

SEQ ID NO: 6135790 - DNA, 23 bp, Homo sapiens
ctcttcagcctcattcactgtcc

SEQ ID NO: 6135791 - DNA, 12 bp, Homo sapiens
ctcttcagctgc

SEQ ID NO: 6135792 - DNA, 22 bp, Homo sapiens
ctcttcagctgctgacaatcct

SEQ ID NO: 6135793 - DNA, 23 bp, Homo sapiens
ctcttcaggaagaaaggagtctg

SEQ ID NO: 6135794 - DNA, 13 bp, Homo sapiens
ctcttcaggaggc

SEQ ID NO: 6135795 - DNA, 19 bp, Homo sapiens
ctcttcaggaggccctggt

SEQ ID NO: 6135796 - DNA, 13 bp, Homo sapiens
ctcttcaggcctc

SEQ ID NO: 6135797 - DNA, 17 bp, Homo sapiens
ctcttcaggcctccctc

SEQ ID NO: 6135798 - DNA, 13 bp, Homo sapiens
ctcttcagtctct

SEQ ID NO: 6135799 - DNA, 17 bp, Homo sapiens
ctcttcagtgactcctg

SEQ ID NO: 6135800 - DNA, 21 bp, Homo sapiens
ctcttcagtgactcctgctgg

SEQ ID NO: 6135801 - DNA, 22 bp, Homo sapiens
ctcttcagtgactcctgctggt

SEQ ID NO: 6135802 - DNA, 23 bp, Homo sapiens
ctcttcagtgactcctgctggta

SEQ ID NO: 6135803 - DNA, 18 bp, Homo sapiens
ctcttcagtgtgttgact

SEQ ID NO: 6135804 - DNA, 16 bp, Homo sapiens
ctcttcataataaacc

SEQ ID NO: 6135805 - DNA, 15 bp, Homo sapiens
ctcttcataattcta

SEQ ID NO: 6135806 - DNA, 13 bp, Homo sapiens
ctcttcatacttt

SEQ ID NO: 6135807 - DNA, 16 bp, Homo sapiens
ctcttcatctgcctgc

SEQ ID NO: 6135808 - DNA, 17 bp, Homo sapiens
ctcttcatgcttgacat

SEQ ID NO: 6135809 - DNA, 21 bp, Homo sapiens
ctcttcatgcttgacatacct

SEQ ID NO: 6135810 - DNA, 19 bp, Homo sapiens
ctcttcatggcatcttcaa

SEQ ID NO: 6135811 - DNA, 13 bp, Homo sapiens
ctcttcattcaaa

SEQ ID NO: 6135812 - DNA, 15 bp, Homo sapiens
ctcttcattcccact

SEQ ID NO: 6135813 - DNA, 21 bp, Homo sapiens
ctcttcattcccactgcactt

SEQ ID NO: 6135814 - DNA, 17 bp, Homo sapiens
ctcttcattctttgaag

SEQ ID NO: 6135815 - DNA, 14 bp, Homo sapiens
ctcttcattgtcta

SEQ ID NO: 6135816 - DNA, 17 bp, Homo sapiens
ctcttcatttattttga

SEQ ID NO: 6135817 - DNA, 21 bp, Homo sapiens
ctcttcatttttttttcaatc

SEQ ID NO: 6135818 - DNA, 15 bp, Homo sapiens
ctcttccaaaggcag

SEQ ID NO: 6135819 - DNA, 16 bp, Homo sapiens
ctcttccaaaggcagc

SEQ ID NO: 6135820 - DNA, 16 bp, Homo sapiens
ctcttccaaccattta

SEQ ID NO: 6135821 - DNA, 16 bp, Homo sapiens
ctcttccacagtggcg

SEQ ID NO: 6135822 - DNA, 17 bp, Homo sapiens
ctcttccactctccttg

SEQ ID NO: 6135823 - DNA, 19 bp, Homo sapiens
ctcttccaggactctctgc

SEQ ID NO: 6135824 - DNA, 20 bp, Homo sapiens
ctcttccagggcagcggctc

SEQ ID NO: 6135825 - DNA, 14 bp, Homo sapiens
ctcttccagtttgc

SEQ ID NO: 6135826 - DNA, 16 bp, Homo sapiens
ctcttccatgctgtgc

SEQ ID NO: 6135827 - DNA, 12 bp, Homo sapiens
ctcttccattca

SEQ ID NO: 6135828 - DNA, 13 bp, Homo sapiens
ctcttccattccc

SEQ ID NO: 6135829 - DNA, 11 bp, Homo sapiens
ctcttcccact

SEQ ID NO: 6135830 - DNA, 17 bp, Homo sapiens
ctcttcccactccagct

SEQ ID NO: 6135831 - DNA, 14 bp, Homo sapiens
ctcttcccagcaca

SEQ ID NO: 6135832 - DNA, 13 bp, Homo sapiens
ctcttcccaggcc

SEQ ID NO: 6135833 - DNA, 23 bp, Homo sapiens
ctcttcccatgcaacaccctctt

SEQ ID NO: 6135834 - DNA, 13 bp, Homo sapiens
ctcttcccatgtc

SEQ ID NO: 6135835 - DNA, 15 bp, Homo sapiens
ctcttcccatgtccc

SEQ ID NO: 6135836 - DNA, 20 bp, Homo sapiens
ctcttcccatgtcccaccct

SEQ ID NO: 6135837 - DNA, 23 bp, Homo sapiens
ctcttcccatgtcccaccctccc

SEQ ID NO: 6135838 - DNA, 13 bp, Homo sapiens
ctcttccccagag

SEQ ID NO: 6135839 - DNA, 15 bp, Homo sapiens
ctcttccccagagag

SEQ ID NO: 6135840 - DNA, 14 bp, Homo sapiens
ctcttcccccaaga

SEQ ID NO: 6135841 - DNA, 15 bp, Homo sapiens
ctcttcccccttcca

SEQ ID NO: 6135842 - DNA, 15 bp, Homo sapiens
ctcttcccccttccc

SEQ ID NO: 6135843 - DNA, 14 bp, Homo sapiens
ctcttcccctctca

SEQ ID NO: 6135844 - DNA, 16 bp, Homo sapiens
ctcttcccctctcaga

SEQ ID NO: 6135845 - DNA, 15 bp, Homo sapiens
ctcttccccttagaa

SEQ ID NO: 6135846 - DNA, 13 bp, Homo sapiens
ctcttccccttcc

SEQ ID NO: 6135847 - DNA, 14 bp, Homo sapiens
ctcttccccttccc

SEQ ID NO: 6135848 - DNA, 15 bp, Homo sapiens
ctcttccccttccct

SEQ ID NO: 6135849 - DNA, 15 bp, Homo sapiens
ctcttccccttcctg

SEQ ID NO: 6135850 - DNA, 19 bp, Homo sapiens
ctcttccccttcctgtttc

SEQ ID NO: 6135851 - DNA, 15 bp, Homo sapiens
ctcttccccttgccc

SEQ ID NO: 6135852 - DNA, 15 bp, Homo sapiens
ctagtcatcgtttgt

SEQ ID NO: 6135853 - DNA, 22 bp, Homo sapiens
ctagtcattaacccatctctga

SEQ ID NO: 6135854 - DNA, 14 bp, Homo sapiens
ctagtcattgtcat

SEQ ID NO: 6135855 - DNA, 20 bp, Homo sapiens
ctagtcatttgttaatattt

SEQ ID NO: 6135856 - DNA, 23 bp, Homo sapiens
ctagtcatttgttaatatttctt

SEQ ID NO: 6135857 - DNA, 14 bp, Homo sapiens
ctagtccagtgacc

SEQ ID NO: 6135858 - DNA, 18 bp, Homo sapiens
ctagtccccaaggcctct

SEQ ID NO: 6135859 - DNA, 19 bp, Homo sapiens
ctagtccccaaggcctctc

SEQ ID NO: 6135860 - DNA, 21 bp, Homo sapiens
ctagtcccccaaagggcctcc

SEQ ID NO: 6135861 - DNA, 22 bp, Homo sapiens
ctagtcccccaaagggcctcct

SEQ ID NO: 6135862 - DNA, 15 bp, Homo sapiens
ctagtcccttccaca

SEQ ID NO: 6135863 - DNA, 20 bp, Homo sapiens
ctagtcccttcccctccctg

SEQ ID NO: 6135864 - DNA, 21 bp, Homo sapiens
ctagtcccttcccctccctgg

SEQ ID NO: 6135865 - DNA, 15 bp, Homo sapiens
ctagtccggacccac

SEQ ID NO: 6135866 - DNA, 16 bp, Homo sapiens
ctagtccgtcctggca

SEQ ID NO: 6135867 - DNA, 18 bp, Homo sapiens
ctagtcctatggaaaaaa

SEQ ID NO: 6135868 - DNA, 18 bp, Homo sapiens
ctagtcctattctattgc

SEQ ID NO: 6135869 - DNA, 17 bp, Homo sapiens
ctagtcctgggggtaaa

SEQ ID NO: 6135870 - DNA, 13 bp, Homo sapiens
ctagtcctttata

SEQ ID NO: 6135871 - DNA, 23 bp, Homo sapiens
ctagtcctttctgtgaagctaat

SEQ ID NO: 6135872 - DNA, 16 bp, Homo sapiens
ctagtcgcccctcaga

SEQ ID NO: 6135873 - DNA, 20 bp, Homo sapiens
ctagtcgcccctcagagcat

SEQ ID NO: 6135874 - DNA, 19 bp, Homo sapiens
ctagtcgggacttgtaaca

SEQ ID NO: 6135875 - DNA, 21 bp, Homo sapiens
ctagtcgtggagatgtcttcg

SEQ ID NO: 6135876 - DNA, 14 bp, Homo sapiens
ctagtctatcagca

SEQ ID NO: 6135877 - DNA, 19 bp, Homo sapiens
ctagtctatcagcatctga

SEQ ID NO: 6135878 - DNA, 21 bp, Homo sapiens
ctagtctcctttgcactgagg

SEQ ID NO: 6135879 - DNA, 20 bp, Homo sapiens
ctagtctctatcattaaagt

SEQ ID NO: 6135880 - DNA, 22 bp, Homo sapiens
ctagtctctatcattaaagttc

SEQ ID NO: 6135881 - DNA, 14 bp, Homo sapiens
ctagtctctgattt

SEQ ID NO: 6135882 - DNA, 17 bp, Homo sapiens
ctagtctctgatttgca

SEQ ID NO: 6135883 - DNA, 23 bp, Homo sapiens
ctagtctctgatttgcaaatgca

SEQ ID NO: 6135884 - DNA, 16 bp, Homo sapiens
ctagtctgtcttcctg

SEQ ID NO: 6135885 - DNA, 12 bp, Homo sapiens
ctagtctgtgcc

SEQ ID NO: 6135886 - DNA, 13 bp, Homo sapiens
ctagtctgtgtgc

SEQ ID NO: 6135887 - DNA, 15 bp, Homo sapiens
ctagtcttagagata

SEQ ID NO: 6135888 - DNA, 20 bp, Homo sapiens
ctagtcttcccttacctcaa

SEQ ID NO: 6135889 - DNA, 12 bp, Homo sapiens
ctagtcttctgg

SEQ ID NO: 6135890 - DNA, 14 bp, Homo sapiens
ctagtcttctggtt

SEQ ID NO: 6135891 - DNA, 15 bp, Homo sapiens
ctagtcttgacctct

SEQ ID NO: 6135892 - DNA, 17 bp, Homo sapiens
ctagtcttgacctctcc

SEQ ID NO: 6135893 - DNA, 16 bp, Homo sapiens
ctagtcttttgctttt

SEQ ID NO: 6135894 - DNA, 20 bp, Homo sapiens
ctagtgaaactgcattattt

SEQ ID NO: 6135895 - DNA, 16 bp, Homo sapiens
ctagtgaaacttttct

SEQ ID NO: 6135896 - DNA, 18 bp, Homo sapiens
ctagtgaaagaggcagct

SEQ ID NO: 6135897 - DNA, 17 bp, Homo sapiens
ctagtgaaggcttctct

SEQ ID NO: 6135898 - DNA, 14 bp, Homo sapiens
ctagtgaatgaatc

SEQ ID NO: 6135899 - DNA, 23 bp, Homo sapiens
ctagtgacacctcagtcatattt

SEQ ID NO: 6135900 - DNA, 19 bp, Homo sapiens
ctagtgacagccacttggc

SEQ ID NO: 6135901 - DNA, 15 bp, Homo sapiens
ctagtgacagtttct

SEQ ID NO: 6135902 - DNA, 16 bp, Homo sapiens
ctagtgacccacatgc

SEQ ID NO: 6135903 - DNA, 19 bp, Homo sapiens
ctagtgacccacatgccat

SEQ ID NO: 6135904 - DNA, 20 bp, Homo sapiens
ctagtgaccccttccctgtc

SEQ ID NO: 6135905 - DNA, 15 bp, Homo sapiens
ctagtgactggggat

SEQ ID NO: 6135906 - DNA, 14 bp, Homo sapiens
ctagtgacttcctg

SEQ ID NO: 6135907 - DNA, 14 bp, Homo sapiens
ctagtgagcctggg

SEQ ID NO: 6135908 - DNA, 19 bp, Homo sapiens
ctagtgagcctgggccagg

SEQ ID NO: 6135909 - DNA, 16 bp, Homo sapiens
ctagtgagccttccca

SEQ ID NO: 6135910 - DNA, 16 bp, Homo sapiens
ctagtgagctgggcat

SEQ ID NO: 6135911 - DNA, 18 bp, Homo sapiens
ctagtgagctgggcatgg

SEQ ID NO: 6135912 - DNA, 20 bp, Homo sapiens
ctagtgagtgtgctgacttt

SEQ ID NO: 6135913 - DNA, 23 bp, Homo sapiens
ctagtgagtgtgctgacttttta

SEQ ID NO: 6135914 - DNA, 19 bp, Homo sapiens
ctagtgatacactgtatct

SEQ ID NO: 6135915 - DNA, 16 bp, Homo sapiens
ctagtgatttacacag

SEQ ID NO: 6135916 - DNA, 18 bp, Homo sapiens
ctagtgatttacacaggt

SEQ ID NO: 6135917 - DNA, 17 bp, Homo sapiens
ctagtgatttctggggc

SEQ ID NO: 6135918 - DNA, 14 bp, Homo sapiens
ctagtgatttttgg

SEQ ID NO: 6135919 - DNA, 18 bp, Homo sapiens
ctagtgcaaaaactgtaa

SEQ ID NO: 6135920 - DNA, 13 bp, Homo sapiens
ctagtgcagctga

SEQ ID NO: 6135921 - DNA, 14 bp, Homo sapiens
ctagtgcagctgat

SEQ ID NO: 6135922 - DNA, 19 bp, Homo sapiens
ctagtgcagctgattttaa

SEQ ID NO: 6135923 - DNA, 21 bp, Homo sapiens
ctagtgcaggaaaaggctgca

SEQ ID NO: 6135924 - DNA, 18 bp, Homo sapiens
ctagtgccattatttcta

SEQ ID NO: 6135925 - DNA, 19 bp, Homo sapiens
ctagtgccattatttctac

SEQ ID NO: 6135926 - DNA, 14 bp, Homo sapiens
ctagtgccccagac

SEQ ID NO: 6135927 - DNA, 21 bp, Homo sapiens
ctagtgccccagactgagctc

SEQ ID NO: 6135928 - DNA, 19 bp, Homo sapiens
ctagtgcctacaatgggaa

SEQ ID NO: 6135929 - DNA, 15 bp, Homo sapiens
ctagtgccttgccca

SEQ ID NO: 6135930 - DNA, 22 bp, Homo sapiens
ctagtgccttgcccacaggtgc

SEQ ID NO: 6135931 - DNA, 17 bp, Homo sapiens
ctagtgctaaacctatc

SEQ ID NO: 6135932 - DNA, 20 bp, Homo sapiens
ctagtgctacagatgtacat

SEQ ID NO: 6135933 - DNA, 17 bp, Homo sapiens
ctagtgctattctgtgt

SEQ ID NO: 6135934 - DNA, 18 bp, Homo sapiens
ctagtgctattctgtgtt

SEQ ID NO: 6135935 - DNA, 12 bp, Homo sapiens
ctagtgctgaag

SEQ ID NO: 6135936 - DNA, 17 bp, Homo sapiens
ctagtgctgaagcttat

SEQ ID NO: 6135937 - DNA, 17 bp, Homo sapiens
ctagtgctgtaatattg

SEQ ID NO: 6135938 - DNA, 20 bp, Homo sapiens
ctagtgctgtaatattgtaa

SEQ ID NO: 6135939 - DNA, 21 bp, Homo sapiens
ctagtgctgtaatattgtaaa

SEQ ID NO: 6135940 - DNA, 16 bp, Homo sapiens
ctagtgcttgtggaga

SEQ ID NO: 6135941 - DNA, 13 bp, Homo sapiens
ctagtgctttcct

SEQ ID NO: 6135942 - DNA, 20 bp, Homo sapiens
ctagtggacgtaggatattt

SEQ ID NO: 6135943 - DNA, 13 bp, Homo sapiens
ctagtggagagaa

SEQ ID NO: 6135944 - DNA, 17 bp, Homo sapiens
ctagtggagttttataa

SEQ ID NO: 6135945 - DNA, 22 bp, Homo sapiens
ctagtggcaagacagtggttct

SEQ ID NO: 6135946 - DNA, 14 bp, Homo sapiens
ctagtggctgtcca

SEQ ID NO: 6135947 - DNA, 17 bp, Homo sapiens
ctagtggctgtccagtg

SEQ ID NO: 6135948 - DNA, 22 bp, Homo sapiens
ctagtggctgtccagtgcccat

SEQ ID NO: 6135949 - DNA, 16 bp, Homo sapiens
ctagtggctgttcatg

SEQ ID NO: 6135950 - DNA, 18 bp, Homo sapiens
ctagtggcttcagcccct

SEQ ID NO: 6135951 - DNA, 17 bp, Homo sapiens
ctagtgggagcccagca

SEQ ID NO: 6135952 - DNA, 19 bp, Homo sapiens
ctagtgggagcccagcaca

SEQ ID NO: 6135953 - DNA, 21 bp, Homo sapiens
ctagtggggaggggcctggcc

SEQ ID NO: 6135954 - DNA, 23 bp, Homo sapiens
ctagtggggaggggcctggcctg

SEQ ID NO: 6135955 - DNA, 18 bp, Homo sapiens
ctagtggggcttaatgaa

SEQ ID NO: 6135956 - DNA, 20 bp, Homo sapiens
ctagtggggtctccctctcc

SEQ ID NO: 6135957 - DNA, 21 bp, Homo sapiens
ctagtggggtctccctctcct

SEQ ID NO: 6135958 - DNA, 20 bp, Homo sapiens
ctagtggggtgaacagctgg

SEQ ID NO: 6135959 - DNA, 23 bp, Homo sapiens
ctagtggggtgaacagctggtgc

SEQ ID NO: 6135960 - DNA, 21 bp, Homo sapiens
ctagtggtctcacctggaggc

SEQ ID NO: 6135961 - DNA, 15 bp, Homo sapiens
ctagtggtctttgta

SEQ ID NO: 6135962 - DNA, 16 bp, Homo sapiens
ctagtggtctttgtaa

SEQ ID NO: 6135963 - DNA, 19 bp, Homo sapiens
ctagtggtctttgtaagag

SEQ ID NO: 6135964 - DNA, 12 bp, Homo sapiens
ctagtggtggct

SEQ ID NO: 6135965 - DNA, 19 bp, Homo sapiens
ctagtggtggctctgagaa

SEQ ID NO: 6135966 - DNA, 20 bp, Homo sapiens
ctagtggtgtcatttttgaa

SEQ ID NO: 6135967 - DNA, 21 bp, Homo sapiens
ctagtggtgtcatttttgaat

SEQ ID NO: 6135968 - DNA, 21 bp, Homo sapiens
ctagtgtaacactgcaagaag

SEQ ID NO: 6135969 - DNA, 22 bp, Homo sapiens
ctagtgtaacactgcaagaagt

SEQ ID NO: 6135970 - DNA, 19 bp, Homo sapiens
ctagtgtaccaagtgcttc

SEQ ID NO: 6135971 - DNA, 21 bp, Homo sapiens
ctagtgtagagcaagccagtg

SEQ ID NO: 6135972 - DNA, 17 bp, Homo sapiens
ctagtgtagctgccaca

SEQ ID NO: 6135973 - DNA, 18 bp, Homo sapiens
ctagtgtatcaaaatgct

SEQ ID NO: 6135974 - DNA, 20 bp, Homo sapiens
ctagtgtattatcactgtct

SEQ ID NO: 6135975 - DNA, 17 bp, Homo sapiens
ctagtgtcacctgcaca

SEQ ID NO: 6135976 - DNA, 20 bp, Homo sapiens
ctagtgtccgcataagaaaa

SEQ ID NO: 6135977 - DNA, 19 bp, Homo sapiens
ctagtgtctcctctctggt

SEQ ID NO: 6135978 - DNA, 15 bp, Homo sapiens
ctagtgtctttgtca

SEQ ID NO: 6135979 - DNA, 12 bp, Homo sapiens
ctagtgtctttt

SEQ ID NO: 6135980 - DNA, 12 bp, Homo sapiens
ctagtgtgactc

SEQ ID NO: 6135981 - DNA, 18 bp, Homo sapiens
ctagtgtgagtggcagcc

SEQ ID NO: 6135982 - DNA, 19 bp, Homo sapiens
ctagtgtgagtggcagcca

SEQ ID NO: 6135983 - DNA, 20 bp, Homo sapiens
ctagtgtgagtggcagccat

SEQ ID NO: 6135984 - DNA, 14 bp, Homo sapiens
ctagtgtggtgtgt

SEQ ID NO: 6135985 - DNA, 22 bp, Homo sapiens
ctagtgtggtgtttcctggcac

SEQ ID NO: 6135986 - DNA, 23 bp, Homo sapiens
ctagtgtggtgtttcctggcact

SEQ ID NO: 6135987 - DNA, 16 bp, Homo sapiens
ctagtgtgtgtgcttt

SEQ ID NO: 6135988 - DNA, 19 bp, Homo sapiens
ctagtgttaatccagagaa

SEQ ID NO: 6135989 - DNA, 13 bp, Homo sapiens
ctagtgttctgtc

SEQ ID NO: 6135990 - DNA, 23 bp, Homo sapiens
ctagtgttctgtctaaaaaccag

SEQ ID NO: 6135991 - DNA, 18 bp, Homo sapiens
ctagtgttctttctcttt

SEQ ID NO: 6135992 - DNA, 17 bp, Homo sapiens
ctagtgttgtatttcta

SEQ ID NO: 6135993 - DNA, 19 bp, Homo sapiens
ctagtgtttaagtcatttt

SEQ ID NO: 6135994 - DNA, 20 bp, Homo sapiens
ctagtgtttaagtcattttt

SEQ ID NO: 6135995 - DNA, 12 bp, Homo sapiens
ctagtgtttact

SEQ ID NO: 6135996 - DNA, 20 bp, Homo sapiens
ctagtgtttctgcagaggca

SEQ ID NO: 6135997 - DNA, 20 bp, Homo sapiens
ctagttaaggaaatgttgag

SEQ ID NO: 6135998 - DNA, 23 bp, Homo sapiens
ctagttaaggtgtgcaaagatct

SEQ ID NO: 6135999 - DNA, 19 bp, Homo sapiens
ctagttaagtcgctgaaca

SEQ ID NO: 6136000 - DNA, 13 bp, Homo sapiens
ctagttacccacc

SEQ ID NO: 6136001 - DNA, 18 bp, Homo sapiens
ctagttactgtggtatgg

SEQ ID NO: 6136002 - DNA, 17 bp, Homo sapiens
ctagttagcaggaaata

SEQ ID NO: 6136003 - DNA, 20 bp, Homo sapiens
ctagttagcaggaaatagtg

SEQ ID NO: 6136004 - DNA, 15 bp, Homo sapiens
ctagttcaagaagat

SEQ ID NO: 6136005 - DNA, 13 bp, Homo sapiens
ctagttcagagcc

SEQ ID NO: 6136006 - DNA, 19 bp, Homo sapiens
ctagttcagagccaagcct

SEQ ID NO: 6136007 - DNA, 22 bp, Homo sapiens
ctagttcagagccaagccttaa

SEQ ID NO: 6136008 - DNA, 12 bp, Homo sapiens
ctagttcatcca

SEQ ID NO: 6136009 - DNA, 19 bp, Homo sapiens
ctagttcatccaatcctca

SEQ ID NO: 6136010 - DNA, 16 bp, Homo sapiens
ctagttcatcccttct

SEQ ID NO: 6136011 - DNA, 18 bp, Homo sapiens
ctagttcatcccttctct

SEQ ID NO: 6136012 - DNA, 23 bp, Homo sapiens
ctagttcatcccttctcttccag

SEQ ID NO: 6136013 - DNA, 20 bp, Homo sapiens
ctagttccctcagtgtgaag

SEQ ID NO: 6136014 - DNA, 21 bp, Homo sapiens
ctagttccctctgctcagcca

SEQ ID NO: 6136015 - DNA, 20 bp, Homo sapiens
ctagttcctgatgacccagg

SEQ ID NO: 6136016 - DNA, 23 bp, Homo sapiens
ctagttctagaaaaacaggcact

SEQ ID NO: 6136017 - DNA, 23 bp, Homo sapiens
ctagttctcaatcactgctcccc

SEQ ID NO: 6136018 - DNA, 18 bp, Homo sapiens
ctagttctcttaacactg

SEQ ID NO: 6136019 - DNA, 14 bp, Homo sapiens
ctagttctgccagg

SEQ ID NO: 6136020 - DNA, 11 bp, Homo sapiens
ctagttctgct

SEQ ID NO: 6136021 - DNA, 13 bp, Homo sapiens
ctagttctgctgc

SEQ ID NO: 6136022 - DNA, 15 bp, Homo sapiens
ctagttctgtagaaa

SEQ ID NO: 6136023 - DNA, 16 bp, Homo sapiens
ctagttctgtagaaat

SEQ ID NO: 6136024 - DNA, 22 bp, Homo sapiens
ctagttctttcctccccctgca

SEQ ID NO: 6136025 - DNA, 23 bp, Homo sapiens
ctagttctttcctccccctgcaa

SEQ ID NO: 6136026 - DNA, 13 bp, Homo sapiens
ctagttgaatact

SEQ ID NO: 6136027 - DNA, 15 bp, Homo sapiens
ctagttgaatacttg

SEQ ID NO: 6136028 - DNA, 13 bp, Homo sapiens
ctagttgacttca

SEQ ID NO: 6136029 - DNA, 16 bp, Homo sapiens
ctcttccccttgccct

SEQ ID NO: 6136030 - DNA, 13 bp, Homo sapiens
ctcttccctcagt

SEQ ID NO: 6136031 - DNA, 15 bp, Homo sapiens
ctcttccctccttcc

SEQ ID NO: 6136032 - DNA, 15 bp, Homo sapiens
ctcttccctctgggc

SEQ ID NO: 6136033 - DNA, 14 bp, Homo sapiens
ctcttccctcttcc

SEQ ID NO: 6136034 - DNA, 22 bp, Homo sapiens
ctcttccctgaacgttttcttc

SEQ ID NO: 6136035 - DNA, 21 bp, Homo sapiens
ctcttccctggtaagaaaaag

SEQ ID NO: 6136036 - DNA, 21 bp, Homo sapiens
ctcttcccttagcctctccca

SEQ ID NO: 6136037 - DNA, 22 bp, Homo sapiens
ctcttcccttagcctctcccac

SEQ ID NO: 6136038 - DNA, 14 bp, Homo sapiens
ctcttcccttccca

SEQ ID NO: 6136039 - DNA, 18 bp, Homo sapiens
ctcttcccttcctccatt

SEQ ID NO: 6136040 - DNA, 14 bp, Homo sapiens
ctcttcccttctcc

SEQ ID NO: 6136041 - DNA, 14 bp, Homo sapiens
ctcttcccttgctc

SEQ ID NO: 6136042 - DNA, 16 bp, Homo sapiens
ctcttcccttgctcat

SEQ ID NO: 6136043 - DNA, 21 bp, Homo sapiens
ctcttcccttgctcatgagct

SEQ ID NO: 6136044 - DNA, 14 bp, Homo sapiens
ctcttccctttccc

SEQ ID NO: 6136045 - DNA, 17 bp, Homo sapiens
ctcttccctttgtgtat

SEQ ID NO: 6136046 - DNA, 22 bp, Homo sapiens
ctcttccgaaaaatcctcttcc

SEQ ID NO: 6136047 - DNA, 22 bp, Homo sapiens
ctcttccgaatgggttttctat

SEQ ID NO: 6136048 - DNA, 18 bp, Homo sapiens
ctcttccgactctttctg

SEQ ID NO: 6136049 - DNA, 19 bp, Homo sapiens
ctcttccgggagctggtga

SEQ ID NO: 6136050 - DNA, 21 bp, Homo sapiens
ctcttccgggagctggtgaca

SEQ ID NO: 6136051 - DNA, 20 bp, Homo sapiens
ctcttccgtgacgtcactgg

SEQ ID NO: 6136052 - DNA, 19 bp, Homo sapiens
ctcttccgtgcatcccaga

SEQ ID NO: 6136053 - DNA, 17 bp, Homo sapiens
ctcttccgttggaaaga

SEQ ID NO: 6136054 - DNA, 19 bp, Homo sapiens
ctcttccgttggaaagaac

SEQ ID NO: 6136055 - DNA, 21 bp, Homo sapiens
ctcttccgttggaaagaacat

SEQ ID NO: 6136056 - DNA, 22 bp, Homo sapiens
ctcttccgttggaaagaacatt

SEQ ID NO: 6136057 - DNA, 20 bp, Homo sapiens
ctcttcctaccctccttcca

SEQ ID NO: 6136058 - DNA, 18 bp, Homo sapiens
ctcttcctaccctgcctc

SEQ ID NO: 6136059 - DNA, 15 bp, Homo sapiens
ctcttcctatcccat

SEQ ID NO: 6136060 - DNA, 19 bp, Homo sapiens
ctcttcctatcccatccca

SEQ ID NO: 6136061 - DNA, 20 bp, Homo sapiens
ctcttcctatccctctccta

SEQ ID NO: 6136062 - DNA, 16 bp, Homo sapiens
ctcttcctatttttgt

SEQ ID NO: 6136063 - DNA, 22 bp, Homo sapiens
ctcttcctcatcctgcttctct

SEQ ID NO: 6136064 - DNA, 15 bp, Homo sapiens
ctcttcctcccctct

SEQ ID NO: 6136065 - DNA, 15 bp, Homo sapiens
ctcttcctccctccc

SEQ ID NO: 6136066 - DNA, 12 bp, Homo sapiens
ctcttcctcctg

SEQ ID NO: 6136067 - DNA, 21 bp, Homo sapiens
ctcttcctcctgacaccccac

SEQ ID NO: 6136068 - DNA, 23 bp, Homo sapiens
ctcttcctcctggttcaagcgat

SEQ ID NO: 6136069 - DNA, 11 bp, Homo sapiens
ctcttcctctg

SEQ ID NO: 6136070 - DNA, 16 bp, Homo sapiens
ctcttcctctgaggct

SEQ ID NO: 6136071 - DNA, 19 bp, Homo sapiens
ctcttcctctggtttctgt

SEQ ID NO: 6136072 - DNA, 22 bp, Homo sapiens
ctcttcctctggtttctgtgtg

SEQ ID NO: 6136073 - DNA, 12 bp, Homo sapiens
ctcttcctcttg

SEQ ID NO: 6136074 - DNA, 14 bp, Homo sapiens
ctcttcctcttgac

SEQ ID NO: 6136075 - DNA, 19 bp, Homo sapiens
ctcttcctcttgaccctgc

SEQ ID NO: 6136076 - DNA, 23 bp, Homo sapiens
ctcttcctcttgaccctgcaccc

SEQ ID NO: 6136077 - DNA, 14 bp, Homo sapiens
ctcttcctgcaagg

SEQ ID NO: 6136078 - DNA, 21 bp, Homo sapiens
ctcttcctgcccctctttctc

SEQ ID NO: 6136079 - DNA, 14 bp, Homo sapiens
ctcttcctgcctct

SEQ ID NO: 6136080 - DNA, 16 bp, Homo sapiens
ctcttcctggaataaa

SEQ ID NO: 6136081 - DNA, 22 bp, Homo sapiens
ctcttcctggaataaacatctg

SEQ ID NO: 6136082 - DNA, 15 bp, Homo sapiens
ctcttcctggacagg

SEQ ID NO: 6136083 - DNA, 15 bp, Homo sapiens
ctcttcctggacctg

SEQ ID NO: 6136084 - DNA, 20 bp, Homo sapiens
ctcttcctggagccccagaa

SEQ ID NO: 6136085 - DNA, 13 bp, Homo sapiens
ctcttcctgtgat

SEQ ID NO: 6136086 - DNA, 20 bp, Homo sapiens
ctcttccttcccccatcccc

SEQ ID NO: 6136087 - DNA, 15 bp, Homo sapiens
ctcttccttccctgc

SEQ ID NO: 6136088 - DNA, 11 bp, Homo sapiens
ctcttccttct

SEQ ID NO: 6136089 - DNA, 12 bp, Homo sapiens
ctcttccttctc

SEQ ID NO: 6136090 - DNA, 13 bp, Homo sapiens
ctcttccttctct

SEQ ID NO: 6136091 - DNA, 23 bp, Homo sapiens
ctcttccttgaagaactgcaggc

SEQ ID NO: 6136092 - DNA, 23 bp, Homo sapiens
ctcttccttgctttctcttctaa

SEQ ID NO: 6136093 - DNA, 19 bp, Homo sapiens
ctcttcctttgctctgagg

SEQ ID NO: 6136094 - DNA, 16 bp, Homo sapiens
ctcttccttttatcag

SEQ ID NO: 6136095 - DNA, 19 bp, Homo sapiens
ctcttcgatgtgcccaggg

SEQ ID NO: 6136096 - DNA, 23 bp, Homo sapiens
ctcttcgcctttcccaccctcct

SEQ ID NO: 6136097 - DNA, 14 bp, Homo sapiens
ctcttcgctgtgat

SEQ ID NO: 6136098 - DNA, 15 bp, Homo sapiens
ctcttcgctgtgatg

SEQ ID NO: 6136099 - DNA, 13 bp, Homo sapiens
ctcttcggccctc

SEQ ID NO: 6136100 - DNA, 14 bp, Homo sapiens
ctcttcggccctca

SEQ ID NO: 6136101 - DNA, 24 bp, Homo sapiens
ctcttcggtcgtatccaccttgca

SEQ ID NO: 6136102 - DNA, 16 bp, Homo sapiens
ctcttcggtggccttg

SEQ ID NO: 6136103 - DNA, 16 bp, Homo sapiens
ctcttcggtttctgag

SEQ ID NO: 6136104 - DNA, 21 bp, Homo sapiens
ctcttctaacatgaaatatat

SEQ ID NO: 6136105 - DNA, 16 bp, Homo sapiens
ctcttctaacctcagc

SEQ ID NO: 6136106 - DNA, 15 bp, Homo sapiens
ctcttctaactcatg

SEQ ID NO: 6136107 - DNA, 21 bp, Homo sapiens
ctcttctaactcatgggtacc

SEQ ID NO: 6136108 - DNA, 15 bp, Homo sapiens
ctcttctaagaggat

SEQ ID NO: 6136109 - DNA, 16 bp, Homo sapiens
ctcttctacccttttc

SEQ ID NO: 6136110 - DNA, 22 bp, Homo sapiens
ctcttctacccttttccttttt

SEQ ID NO: 6136111 - DNA, 20 bp, Homo sapiens
ctcttctagatggaccccag

SEQ ID NO: 6136112 - DNA, 16 bp, Homo sapiens
ctcttctatcctgcaa

SEQ ID NO: 6136113 - DNA, 16 bp, Homo sapiens
ctcttctatttaaaaa

SEQ ID NO: 6136114 - DNA, 19 bp, Homo sapiens
ctcttctcagctccactct

SEQ ID NO: 6136115 - DNA, 18 bp, Homo sapiens
ctcttctcagctcttcca

SEQ ID NO: 6136116 - DNA, 16 bp, Homo sapiens
ctcttctcagtgtctg

SEQ ID NO: 6136117 - DNA, 11 bp, Homo sapiens
ctcttctcatt

SEQ ID NO: 6136118 - DNA, 19 bp, Homo sapiens
ctcttctcatttcacccct

SEQ ID NO: 6136119 - DNA, 18 bp, Homo sapiens
ctcttctcattttttcct

SEQ ID NO: 6136120 - DNA, 12 bp, Homo sapiens
ctcttctccact

SEQ ID NO: 6136121 - DNA, 13 bp, Homo sapiens
ctcttctccactg

SEQ ID NO: 6136122 - DNA, 14 bp, Homo sapiens
ctcttctccactgg

SEQ ID NO: 6136123 - DNA, 15 bp, Homo sapiens
ctcttctccaggctg

SEQ ID NO: 6136124 - DNA, 20 bp, Homo sapiens
ctcttctccattccctagca

SEQ ID NO: 6136125 - DNA, 14 bp, Homo sapiens
ctcttctccccaga

SEQ ID NO: 6136126 - DNA, 17 bp, Homo sapiens
ctcttctccccttccat

SEQ ID NO: 6136127 - DNA, 13 bp, Homo sapiens
ctcttctcctgtg

SEQ ID NO: 6136128 - DNA, 22 bp, Homo sapiens
ctcttctccttgattttaaaat

SEQ ID NO: 6136129 - DNA, 16 bp, Homo sapiens
ctcttctcctttcaca

SEQ ID NO: 6136130 - DNA, 15 bp, Homo sapiens
ctcttctcggctcag

SEQ ID NO: 6136131 - DNA, 18 bp, Homo sapiens
ctcttctcggctcaggct

SEQ ID NO: 6136132 - DNA, 23 bp, Homo sapiens
ctcttctctcaaccttggccttc

SEQ ID NO: 6136133 - DNA, 19 bp, Homo sapiens
ctcttctctccagctgact

SEQ ID NO: 6136134 - DNA, 13 bp, Homo sapiens
ctcttctctcccc

SEQ ID NO: 6136135 - DNA, 14 bp, Homo sapiens
ctcttctctcccca

SEQ ID NO: 6136136 - DNA, 19 bp, Homo sapiens
ctcttctctccccagcccc

SEQ ID NO: 6136137 - DNA, 13 bp, Homo sapiens
ctcttctctcctc

SEQ ID NO: 6136138 - DNA, 14 bp, Homo sapiens
ctcttctctcctca

SEQ ID NO: 6136139 - DNA, 15 bp, Homo sapiens
ctcttctctcctccc

SEQ ID NO: 6136140 - DNA, 17 bp, Homo sapiens
ctcttctctgcaatgct

SEQ ID NO: 6136141 - DNA, 20 bp, Homo sapiens
ctcttctctgggcccagaga

SEQ ID NO: 6136142 - DNA, 21 bp, Homo sapiens
ctcttctcttacgctctctgt

SEQ ID NO: 6136143 - DNA, 14 bp, Homo sapiens
ctcttctcttccta

SEQ ID NO: 6136144 - DNA, 16 bp, Homo sapiens
ctcttctcttcctgta

SEQ ID NO: 6136145 - DNA, 13 bp, Homo sapiens
ctcttctcttctt

SEQ ID NO: 6136146 - DNA, 20 bp, Homo sapiens
ctcttctcttgacagtctga

SEQ ID NO: 6136147 - DNA, 11 bp, Homo sapiens
ctcttctgaag

SEQ ID NO: 6136148 - DNA, 13 bp, Homo sapiens
ctcttctgactgc

SEQ ID NO: 6136149 - DNA, 17 bp, Homo sapiens
ctcttctgagcagaaat

SEQ ID NO: 6136150 - DNA, 18 bp, Homo sapiens
ctcttctgagctatttca

SEQ ID NO: 6136151 - DNA, 21 bp, Homo sapiens
ctcttctgagctatttcatct

SEQ ID NO: 6136152 - DNA, 18 bp, Homo sapiens
ctcttctgccagcctccc

SEQ ID NO: 6136153 - DNA, 11 bp, Homo sapiens
ctcttctgcta

SEQ ID NO: 6136154 - DNA, 12 bp, Homo sapiens
ctcttctgctcc

SEQ ID NO: 6136155 - DNA, 13 bp, Homo sapiens
ctcttctgctcca

SEQ ID NO: 6136156 - DNA, 16 bp, Homo sapiens
ctcttctgctccaccc

SEQ ID NO: 6136157 - DNA, 18 bp, Homo sapiens
ctcttctgctccaccctt

SEQ ID NO: 6136158 - DNA, 20 bp, Homo sapiens
ctcttctgctccacccttgg

SEQ ID NO: 6136159 - DNA, 15 bp, Homo sapiens
ctcttctgctctttt

SEQ ID NO: 6136160 - DNA, 19 bp, Homo sapiens
ctcttctgctcttttcctg

SEQ ID NO: 6136161 - DNA, 19 bp, Homo sapiens
ctcttctggagtttctcta

SEQ ID NO: 6136162 - DNA, 14 bp, Homo sapiens
ctcttctggctcaa

SEQ ID NO: 6136163 - DNA, 21 bp, Homo sapiens
ctcttctgggagggcagcagg

SEQ ID NO: 6136164 - DNA, 15 bp, Homo sapiens
ctcttctgggcagag

SEQ ID NO: 6136165 - DNA, 19 bp, Homo sapiens
ctcttctggggcaggctgg

SEQ ID NO: 6136166 - DNA, 19 bp, Homo sapiens
ctcttctggtgttgactgg

SEQ ID NO: 6136167 - DNA, 20 bp, Homo sapiens
ctcttctggtttccctttat

SEQ ID NO: 6136168 - DNA, 21 bp, Homo sapiens
ctcttctggtttccctttatt

SEQ ID NO: 6136169 - DNA, 22 bp, Homo sapiens
ctcttctgtccatcagtgcatg

SEQ ID NO: 6136170 - DNA, 13 bp, Homo sapiens
ctcttctgtccct

SEQ ID NO: 6136171 - DNA, 21 bp, Homo sapiens
ctcttctgtgccctggctcca

SEQ ID NO: 6136172 - DNA, 16 bp, Homo sapiens
ctcttctgtgggtgac

SEQ ID NO: 6136173 - DNA, 13 bp, Homo sapiens
ctcttctgtgttt

SEQ ID NO: 6136174 - DNA, 16 bp, Homo sapiens
ctcttctgttctcaaa

SEQ ID NO: 6136175 - DNA, 19 bp, Homo sapiens
ctcttctgttctcaaatgc

SEQ ID NO: 6136176 - DNA, 16 bp, Homo sapiens
ctcttctgttgaaaca

SEQ ID NO: 6136177 - DNA, 17 bp, Homo sapiens
ctcttcttaaccctgaa

SEQ ID NO: 6136178 - DNA, 19 bp, Homo sapiens
ctcttcttaaccctgaaca

SEQ ID NO: 6136179 - DNA, 20 bp, Homo sapiens
ctcttcttaaccctgaacaa

SEQ ID NO: 6136180 - DNA, 19 bp, Homo sapiens
ctcttcttatacagataaa

SEQ ID NO: 6136181 - DNA, 13 bp, Homo sapiens
ctcttcttatcac

SEQ ID NO: 6136182 - DNA, 14 bp, Homo sapiens
ctcttcttatcaca

SEQ ID NO: 6136183 - DNA, 21 bp, Homo sapiens
ctcttcttattacccaaaccc

SEQ ID NO: 6136184 - DNA, 22 bp, Homo sapiens
ctcttcttattcatgctttctc

SEQ ID NO: 6136185 - DNA, 20 bp, Homo sapiens
ctcttcttccttttgtatcc

SEQ ID NO: 6136186 - DNA, 14 bp, Homo sapiens
ctcttcttgaaaaa

SEQ ID NO: 6136187 - DNA, 15 bp, Homo sapiens
ctcttcttgaaattt

SEQ ID NO: 6136188 - DNA, 22 bp, Homo sapiens
ctcttcttgcggcaccgcccac

SEQ ID NO: 6136189 - DNA, 14 bp, Homo sapiens
ctcttcttgctata

SEQ ID NO: 6136190 - DNA, 17 bp, Homo sapiens
ctcttctttaagccata

SEQ ID NO: 6136191 - DNA, 21 bp, Homo sapiens
ctcttctttatactgtaattt

SEQ ID NO: 6136192 - DNA, 22 bp, Homo sapiens
ctcttctttatactgtaattta

SEQ ID NO: 6136193 - DNA, 15 bp, Homo sapiens
ctcttctttattgca

SEQ ID NO: 6136194 - DNA, 19 bp, Homo sapiens
ctcttctttcatctgggga

SEQ ID NO: 6136195 - DNA, 12 bp, Homo sapiens
ctcttctttccc

SEQ ID NO: 6136196 - DNA, 13 bp, Homo sapiens
ctcttctttctga

SEQ ID NO: 6136197 - DNA, 15 bp, Homo sapiens
ctcttctttctgaag

SEQ ID NO: 6136198 - DNA, 14 bp, Homo sapiens
ctcttctttctgag

SEQ ID NO: 6136199 - DNA, 15 bp, Homo sapiens
ctcttctttctgaga

SEQ ID NO: 6136200 - DNA, 16 bp, Homo sapiens
ctcttctttctgagag

SEQ ID NO: 6136201 - DNA, 13 bp, Homo sapiens
ctcttctttggga

SEQ ID NO: 6136202 - DNA, 18 bp, Homo sapiens
ctcttctttgtgcctttg

SEQ ID NO: 6136203 - DNA, 23 bp, Homo sapiens
ctcttctttgtgcctttggcctg

SEQ ID NO: 6136204 - DNA, 16 bp, Homo sapiens
ctcttcttttcccatt

SEQ ID NO: 6136205 - DNA, 19 bp, Homo sapiens
ctcttctttttcttcttgt

SEQ ID NO: 6136206 - DNA, 21 bp, Homo sapiens
ctcttcttttttttagtttac

SEQ ID NO: 6136207 - DNA, 17 bp, Homo sapiens
ctcttgaaacctgttaa

SEQ ID NO: 6136208 - DNA, 22 bp, Homo sapiens
ctcttgaaatataggaacttaa

SEQ ID NO: 6136209 - DNA, 20 bp, Homo sapiens
ctagttgccaaatctggctc

SEQ ID NO: 6136210 - DNA, 15 bp, Homo sapiens
ctagttggagtgctt

SEQ ID NO: 6136211 - DNA, 20 bp, Homo sapiens
ctagttgggagagttggaga

SEQ ID NO: 6136212 - DNA, 19 bp, Homo sapiens
ctagttggtgagaaacctg

SEQ ID NO: 6136213 - DNA, 17 bp, Homo sapiens
ctagttgtttgggcttt

SEQ ID NO: 6136214 - DNA, 15 bp, Homo sapiens
ctagtttaaaattat

SEQ ID NO: 6136215 - DNA, 16 bp, Homo sapiens
ctagtttccctggtgc

SEQ ID NO: 6136216 - DNA, 18 bp, Homo sapiens
ctagtttccctggtgccc

SEQ ID NO: 6136217 - DNA, 15 bp, Homo sapiens
ctagtttcctctcct

SEQ ID NO: 6136218 - DNA, 13 bp, Homo sapiens
ctagtttcctgcc

SEQ ID NO: 6136219 - DNA, 18 bp, Homo sapiens
ctagtttcctgccttcag

SEQ ID NO: 6136220 - DNA, 18 bp, Homo sapiens
ctagtttctttctgttat

SEQ ID NO: 6136221 - DNA, 22 bp, Homo sapiens
ctagtttgacctcacagtgacc

SEQ ID NO: 6136222 - DNA, 13 bp, Homo sapiens
ctagtttgattaa

SEQ ID NO: 6136223 - DNA, 20 bp, Homo sapiens
ctagtttgattaaattcttg

SEQ ID NO: 6136224 - DNA, 16 bp, Homo sapiens
ctagtttgattattat

SEQ ID NO: 6136225 - DNA, 13 bp, Homo sapiens
ctagtttgcattc

SEQ ID NO: 6136226 - DNA, 17 bp, Homo sapiens
ctagtttgctgtggcct

SEQ ID NO: 6136227 - DNA, 18 bp, Homo sapiens
ctagtttgggaggagcag

SEQ ID NO: 6136228 - DNA, 19 bp, Homo sapiens
ctagtttgttagtgcattt

SEQ ID NO: 6136229 - DNA, 16 bp, Homo sapiens
ctagtttgtttagtta

SEQ ID NO: 6136230 - DNA, 19 bp, Homo sapiens
ctagttttagacctcatct

SEQ ID NO: 6136231 - DNA, 20 bp, Homo sapiens
ctagttttagttttctctta

SEQ ID NO: 6136232 - DNA, 15 bp, Homo sapiens
ctagttttcagcctt

SEQ ID NO: 6136233 - DNA, 19 bp, Homo sapiens
ctagttttcagccttggga

SEQ ID NO: 6136234 - DNA, 22 bp, Homo sapiens
ctagttttcagtttgtatatac

SEQ ID NO: 6136235 - DNA, 17 bp, Homo sapiens
ctagttttctcctccca

SEQ ID NO: 6136236 - DNA, 14 bp, Homo sapiens
ctagtttttagtaa

SEQ ID NO: 6136237 - DNA, 23 bp, Homo sapiens
ctagtttttagtaatctgtacat

SEQ ID NO: 6136238 - DNA, 15 bp, Homo sapiens
ctagtttttatagct

SEQ ID NO: 6136239 - DNA, 19 bp, Homo sapiens
ctagttttttcttcctttt

SEQ ID NO: 6136240 - DNA, 15 bp, Homo sapiens
ctagttttttgcttc

SEQ ID NO: 6136241 - DNA, 22 bp, Homo sapiens
ctagttttttgcttctctttcc

SEQ ID NO: 6136242 - DNA, 14 bp, Homo sapiens
ctagttttttttct

SEQ ID NO: 6136243 - DNA, 17 bp, Homo sapiens
ctagttttttttctagt

SEQ ID NO: 6136244 - DNA, 21 bp, Homo sapiens
  misc_feature (4)..(4): n is a, c, g or t
  misc_feature (11)..(11): n is a, c, g or t
ctanccccccnacccccagtg

SEQ ID NO: 6136245 - DNA, 12 bp, Homo sapiens
ctataaaaaaga

SEQ ID NO: 6136246 - DNA, 23 bp, Homo sapiens
ctataaaaaccacccacaaagaa

SEQ ID NO: 6136247 - DNA, 17 bp, Homo sapiens
ctataaaaactgccccc

SEQ ID NO: 6136248 - DNA, 15 bp, Homo sapiens
ctataaaagaaacac

SEQ ID NO: 6136249 - DNA, 13 bp, Homo sapiens
ctataaaagccca

SEQ ID NO: 6136250 - DNA, 22 bp, Homo sapiens
ctataaaagcccatgcttaaat

SEQ ID NO: 6136251 - DNA, 15 bp, Homo sapiens
ctataaaagctttct

SEQ ID NO: 6136252 - DNA, 16 bp, Homo sapiens
ctataaaataaacttc

SEQ ID NO: 6136253 - DNA, 21 bp, Homo sapiens
ctataaaatagatataaattt

SEQ ID NO: 6136254 - DNA, 12 bp, Homo sapiens
ctataaaatgcc

SEQ ID NO: 6136255 - DNA, 15 bp, Homo sapiens
ctataaaattaaatg

SEQ ID NO: 6136256 - DNA, 14 bp, Homo sapiens
ctataaacatgaag

SEQ ID NO: 6136257 - DNA, 20 bp, Homo sapiens
ctataaacctgacctccttt

SEQ ID NO: 6136258 - DNA, 22 bp, Homo sapiens
ctataaactactgtaattaagt

SEQ ID NO: 6136259 - DNA, 14 bp, Homo sapiens
ctataaagcattta

SEQ ID NO: 6136260 - DNA, 15 bp, Homo sapiens
ctataaagcatttaa

SEQ ID NO: 6136261 - DNA, 20 bp, Homo sapiens
ctataaagcgatatacagat

SEQ ID NO: 6136262 - DNA, 19 bp, Homo sapiens
ctataaagctagatgcttt

SEQ ID NO: 6136263 - DNA, 12 bp, Homo sapiens
ctataaagggtc

SEQ ID NO: 6136264 - DNA, 13 bp, Homo sapiens
ctataaagggtca

SEQ ID NO: 6136265 - DNA, 14 bp, Homo sapiens
ctataaagggtcag

SEQ ID NO: 6136266 - DNA, 19 bp, Homo sapiens
ctataaagggtcaggcccg

SEQ ID NO: 6136267 - DNA, 9 bp, Homo sapiens
ctataaata

SEQ ID NO: 6136268 - DNA, 14 bp, Homo sapiens
ctataaataaaaac

SEQ ID NO: 6136269 - DNA, 12 bp, Homo sapiens
ctataaatacaa

SEQ ID NO: 6136270 - DNA, 16 bp, Homo sapiens
ctataaatacaaatct

SEQ ID NO: 6136271 - DNA, 19 bp, Homo sapiens
ctataaatacaaatctgta

SEQ ID NO: 6136272 - DNA, 15 bp, Homo sapiens
ctataaatagattta

SEQ ID NO: 6136273 - DNA, 12 bp, Homo sapiens
ctataaatatat

SEQ ID NO: 6136274 - DNA, 21 bp, Homo sapiens
ctataaatatattgtatattt

SEQ ID NO: 6136275 - DNA, 22 bp, Homo sapiens
ctataaatcaacaccttaatat

SEQ ID NO: 6136276 - DNA, 16 bp, Homo sapiens
ctataaatcagtattt

SEQ ID NO: 6136277 - DNA, 10 bp, Homo sapiens
ctataaatga

SEQ ID NO: 6136278 - DNA, 17 bp, Homo sapiens
ctataaatgactattgt

SEQ ID NO: 6136279 - DNA, 21 bp, Homo sapiens
ctataaatgactattgtaatg

SEQ ID NO: 6136280 - DNA, 18 bp, Homo sapiens
ctataaatggtgtttttt

SEQ ID NO: 6136281 - DNA, 17 bp, Homo sapiens
ctataaattcctctttg

SEQ ID NO: 6136282 - DNA, 22 bp, Homo sapiens
ctataaattcctctttgctttg

SEQ ID NO: 6136283 - DNA, 23 bp, Homo sapiens
ctataaattcctctttgctttgc

SEQ ID NO: 6136284 - DNA, 17 bp, Homo sapiens
ctataaatttaagaaaa

SEQ ID NO: 6136285 - DNA, 21 bp, Homo sapiens
ctataaatttactctgttgaa

SEQ ID NO: 6136286 - DNA, 17 bp, Homo sapiens
ctataaattttttgaaa

SEQ ID NO: 6136287 - DNA, 19 bp, Homo sapiens
ctataaattttttgaaaca

SEQ ID NO: 6136288 - DNA, 12 bp, Homo sapiens
ctataacaaaaa

SEQ ID NO: 6136289 - DNA, 16 bp, Homo sapiens
ctataacaaaaaaaga

SEQ ID NO: 6136290 - DNA, 18 bp, Homo sapiens
ctataacaaaggatactt

SEQ ID NO: 6136291 - DNA, 13 bp, Homo sapiens
ctataacaaatgc

SEQ ID NO: 6136292 - DNA, 17 bp, Homo sapiens
ctataacaactctattt

SEQ ID NO: 6136293 - DNA, 16 bp, Homo sapiens
ctataacaatcactgg

SEQ ID NO: 6136294 - DNA, 12 bp, Homo sapiens
ctataacagata

SEQ ID NO: 6136295 - DNA, 19 bp, Homo sapiens
ctataacatagaattgcaa

SEQ ID NO: 6136296 - DNA, 21 bp, Homo sapiens
ctataacatatgtacataaat

SEQ ID NO: 6136297 - DNA, 20 bp, Homo sapiens
ctataacattatataacaaa

SEQ ID NO: 6136298 - DNA, 20 bp, Homo sapiens
ctataacattctgacacata

SEQ ID NO: 6136299 - DNA, 16 bp, Homo sapiens
ctataaccagacacat

SEQ ID NO: 6136300 - DNA, 15 bp, Homo sapiens
ctataacctggattt

SEQ ID NO: 6136301 - DNA, 19 bp, Homo sapiens
ctataacttcttcctgctg

SEQ ID NO: 6136302 - DNA, 16 bp, Homo sapiens
ctataacttgatgcat

SEQ ID NO: 6136303 - DNA, 14 bp, Homo sapiens
ctataagaaaaagg

SEQ ID NO: 6136304 - DNA, 15 bp, Homo sapiens
ctataagaaaaagga

SEQ ID NO: 6136305 - DNA, 16 bp, Homo sapiens
ctataagaaaaaggaa

SEQ ID NO: 6136306 - DNA, 13 bp, Homo sapiens
ctataagaataag

SEQ ID NO: 6136307 - DNA, 18 bp, Homo sapiens
ctataagaataaggcttt

SEQ ID NO: 6136308 - DNA, 21 bp, Homo sapiens
ctataagagaattatatattt

SEQ ID NO: 6136309 - DNA, 22 bp, Homo sapiens
ctataagagacaaagtttggaa

SEQ ID NO: 6136310 - DNA, 18 bp, Homo sapiens
ctataagatgacaatgtt

SEQ ID NO: 6136311 - DNA, 21 bp, Homo sapiens
ctataaggagagttcaagcct

SEQ ID NO: 6136312 - DNA, 22 bp, Homo sapiens
ctataagggagtaggctgtatt

SEQ ID NO: 6136313 - DNA, 12 bp, Homo sapiens
ctataaggtgcc

SEQ ID NO: 6136314 - DNA, 15 bp, Homo sapiens
ctataaggtgcctca

SEQ ID NO: 6136315 - DNA, 12 bp, Homo sapiens
ctataagtgctc

SEQ ID NO: 6136316 - DNA, 16 bp, Homo sapiens
ctataagtgttcagtg

SEQ ID NO: 6136317 - DNA, 19 bp, Homo sapiens
ctataagtgttcagtgttg

SEQ ID NO: 6136318 - DNA, 12 bp, Homo sapiens
ctataagttgta

SEQ ID NO: 6136319 - DNA, 19 bp, Homo sapiens
ctataagttttagaatctt

SEQ ID NO: 6136320 - DNA, 19 bp, Homo sapiens
ctataataaaatggcacct

SEQ ID NO: 6136321 - DNA, 13 bp, Homo sapiens
ctataataaaggc

SEQ ID NO: 6136322 - DNA, 14 bp, Homo sapiens
ctataataaataaa

SEQ ID NO: 6136323 - DNA, 14 bp, Homo sapiens
ctataataagtttt

SEQ ID NO: 6136324 - DNA, 16 bp, Homo sapiens
ctataatacttgcaac

SEQ ID NO: 6136325 - DNA, 18 bp, Homo sapiens
ctataatcaaatgatttc

SEQ ID NO: 6136326 - DNA, 14 bp, Homo sapiens
ctataatcattagt

SEQ ID NO: 6136327 - DNA, 15 bp, Homo sapiens
ctataatctgtcaaa

SEQ ID NO: 6136328 - DNA, 21 bp, Homo sapiens
ctataatctgtcaaaacactg

SEQ ID NO: 6136329 - DNA, 22 bp, Homo sapiens
ctataatctgtcaaaacactgt

SEQ ID NO: 6136330 - DNA, 14 bp, Homo sapiens
ctataatctgtttt

SEQ ID NO: 6136331 - DNA, 15 bp, Homo sapiens
ctataatcttataca

SEQ ID NO: 6136332 - DNA, 16 bp, Homo sapiens
ctataatcttatacaa

SEQ ID NO: 6136333 - DNA, 17 bp, Homo sapiens
ctataatcttatacaac

SEQ ID NO: 6136334 - DNA, 16 bp, Homo sapiens
ctataatgatctaaga

SEQ ID NO: 6136335 - DNA, 20 bp, Homo sapiens
ctataatggaaacatttaca

SEQ ID NO: 6136336 - DNA, 16 bp, Homo sapiens
ctataatgtaagctct

SEQ ID NO: 6136337 - DNA, 14 bp, Homo sapiens
ctataatgtgaaat

SEQ ID NO: 6136338 - DNA, 14 bp, Homo sapiens
ctataatgtgcctg

SEQ ID NO: 6136339 - DNA, 15 bp, Homo sapiens
ctataatgtgcctgg

SEQ ID NO: 6136340 - DNA, 13 bp, Homo sapiens
ctataatgtgtgt

SEQ ID NO: 6136341 - DNA, 18 bp, Homo sapiens
ctataattattattcaga

SEQ ID NO: 6136342 - DNA, 20 bp, Homo sapiens
ctataattccctatctttta

SEQ ID NO: 6136343 - DNA, 19 bp, Homo sapiens
ctataattccttaaaattt

SEQ ID NO: 6136344 - DNA, 23 bp, Homo sapiens
ctataattccttaaaattttcat

SEQ ID NO: 6136345 - DNA, 17 bp, Homo sapiens
ctataattctatactgt

SEQ ID NO: 6136346 - DNA, 21 bp, Homo sapiens
ctataattctatactgttgat

SEQ ID NO: 6136347 - DNA, 21 bp, Homo sapiens
ctataattgtaaatattttga

SEQ ID NO: 6136348 - DNA, 23 bp, Homo sapiens
ctataattgtaaatattttgata

SEQ ID NO: 6136349 - DNA, 23 bp, Homo sapiens
ctataattttgatagtgggacca

SEQ ID NO: 6136350 - DNA, 15 bp, Homo sapiens
ctataattttgcaaa

SEQ ID NO: 6136351 - DNA, 14 bp, Homo sapiens
ctatacaattcagt

SEQ ID NO: 6136352 - DNA, 19 bp, Homo sapiens
ctatacagaacagagggcc

SEQ ID NO: 6136353 - DNA, 20 bp, Homo sapiens
ctatacagaacagagggcca

SEQ ID NO: 6136354 - DNA, 21 bp, Homo sapiens
ctatacagaacagagggccag

SEQ ID NO: 6136355 - DNA, 22 bp, Homo sapiens
ctatacatatctttattaatca

SEQ ID NO: 6136356 - DNA, 22 bp, Homo sapiens
ctatacatgttggaaatgtgtt

SEQ ID NO: 6136357 - DNA, 20 bp, Homo sapiens
ctataccatatgtctgcttc

SEQ ID NO: 6136358 - DNA, 21 bp, Homo sapiens
ctataccatatgtctgcttct

SEQ ID NO: 6136359 - DNA, 21 bp, Homo sapiens
ctataccatttccgtaattct

SEQ ID NO: 6136360 - DNA, 15 bp, Homo sapiens
ctatacccacccaga

SEQ ID NO: 6136361 - DNA, 15 bp, Homo sapiens
ctatacccagcagag

SEQ ID NO: 6136362 - DNA, 17 bp, Homo sapiens
ctatacccattcttcag

SEQ ID NO: 6136363 - DNA, 19 bp, Homo sapiens
ctataccccttacttagca

SEQ ID NO: 6136364 - DNA, 18 bp, Homo sapiens
ctataccggagctccagt

SEQ ID NO: 6136365 - DNA, 17 bp, Homo sapiens
ctatacctatgtgaaac

SEQ ID NO: 6136366 - DNA, 18 bp, Homo sapiens
ctatacctcacaataaga

SEQ ID NO: 6136367 - DNA, 15 bp, Homo sapiens
ctatacctcattcac

SEQ ID NO: 6136368 - DNA, 15 bp, Homo sapiens
ctatacctgagcctc

SEQ ID NO: 6136369 - DNA, 20 bp, Homo sapiens
ctatacctgggcatactaat

SEQ ID NO: 6136370 - DNA, 14 bp, Homo sapiens
ctatacctgtgcct

SEQ ID NO: 6136371 - DNA, 23 bp, Homo sapiens
ctatacctgtgtttcttgcctca

SEQ ID NO: 6136372 - DNA, 17 bp, Homo sapiens
ctatacgtttctgtgga

SEQ ID NO: 6136373 - DNA, 18 bp, Homo sapiens
ctatacgtttctgtggag

SEQ ID NO: 6136374 - DNA, 17 bp, Homo sapiens
ctatactgcatactttt

SEQ ID NO: 6136375 - DNA, 21 bp, Homo sapiens
ctatactgcatactttttaaa

SEQ ID NO: 6136376 - DNA, 13 bp, Homo sapiens
ctatactggaaat

SEQ ID NO: 6136377 - DNA, 13 bp, Homo sapiens
ctatactgtggcc

SEQ ID NO: 6136378 - DNA, 15 bp, Homo sapiens
ctatactgtggcctg

SEQ ID NO: 6136379 - DNA, 21 bp, Homo sapiens
ctatactgtggcctgcaggag

SEQ ID NO: 6136380 - DNA, 21 bp, Homo sapiens
ctatactgtgtcatggtgatg

SEQ ID NO: 6136381 - DNA, 11 bp, Homo sapiens
ctatacttgaa

SEQ ID NO: 6136382 - DNA, 15 bp, Homo sapiens
ctatactttgttctg

SEQ ID NO: 6136383 - DNA, 16 bp, Homo sapiens
ctatactttgttctgt

SEQ ID NO: 6136384 - DNA, 18 bp, Homo sapiens
ctatactttgttctgttg

SEQ ID NO: 6136385 - DNA, 13 bp, Homo sapiens
ctatagaaagtgt

SEQ ID NO: 6136386 - DNA, 15 bp, Homo sapiens
ctatagaaatagaac

SEQ ID NO: 6136387 - DNA, 22 bp, Homo sapiens
ctatagaaatgatcattgcatg

SEQ ID NO: 6136388 - DNA, 19 bp, Homo sapiens
ctatagaaatgtattttga

SEQ ID NO: 6136389 - DNA, 14 bp, Homo sapiens
ctcttgaaatgtag

SEQ ID NO: 6136390 - DNA, 17 bp, Homo sapiens
ctcttgaaatgtagaat

SEQ ID NO: 6136391 - DNA, 23 bp, Homo sapiens
ctcttgaaccccaaatgctctct

SEQ ID NO: 6136392 - DNA, 18 bp, Homo sapiens
ctcttgaactcctgacct

SEQ ID NO: 6136393 - DNA, 17 bp, Homo sapiens
ctcttgaactgagcttg

SEQ ID NO: 6136394 - DNA, 21 bp, Homo sapiens
ctcttgaagacactgaaatat

SEQ ID NO: 6136395 - DNA, 18 bp, Homo sapiens
ctcttgaaggtgctgcca

SEQ ID NO: 6136396 - DNA, 23 bp, Homo sapiens
ctcttgaaggtgctgccacccct

SEQ ID NO: 6136397 - DNA, 13 bp, Homo sapiens
ctcttgaagtact

SEQ ID NO: 6136398 - DNA, 17 bp, Homo sapiens
ctcttgaagtccaggac

SEQ ID NO: 6136399 - DNA, 20 bp, Homo sapiens
ctcttgaagtccaggactgg

SEQ ID NO: 6136400 - DNA, 15 bp, Homo sapiens
ctcttgaagtggatt

SEQ ID NO: 6136401 - DNA, 16 bp, Homo sapiens
ctcttgaatgcttaaa

SEQ ID NO: 6136402 - DNA, 19 bp, Homo sapiens
ctcttgaatgcttaaatga

SEQ ID NO: 6136403 - DNA, 16 bp, Homo sapiens
ctcttgaattattttg

SEQ ID NO: 6136404 - DNA, 17 bp, Homo sapiens
ctcttgaattcctctca

SEQ ID NO: 6136405 - DNA, 17 bp, Homo sapiens
ctcttgacagaaagcag

SEQ ID NO: 6136406 - DNA, 23 bp, Homo sapiens
ctcttgacagaaagcagttctga

SEQ ID NO: 6136407 - DNA, 14 bp, Homo sapiens
ctcttgacagtctg

SEQ ID NO: 6136408 - DNA, 22 bp, Homo sapiens
ctcttgacattccactgtgcgt

SEQ ID NO: 6136409 - DNA, 15 bp, Homo sapiens
ctcttgaccaggctg

SEQ ID NO: 6136410 - DNA, 19 bp, Homo sapiens
ctcttgaccctgcaccctc

SEQ ID NO: 6136411 - DNA, 21 bp, Homo sapiens
ctcttgaccctgcaccctcct

SEQ ID NO: 6136412 - DNA, 16 bp, Homo sapiens
ctcttgaccttgtaga

SEQ ID NO: 6136413 - DNA, 22 bp, Homo sapiens
ctcttgactccactactttact

SEQ ID NO: 6136414 - DNA, 16 bp, Homo sapiens
ctcttgactcttgcct

SEQ ID NO: 6136415 - DNA, 19 bp, Homo sapiens
ctcttgagagctcaggcag

SEQ ID NO: 6136416 - DNA, 15 bp, Homo sapiens
ctcttgagcagtggc

SEQ ID NO: 6136417 - DNA, 15 bp, Homo sapiens
ctcttgagcatcaat

SEQ ID NO: 6136418 - DNA, 16 bp, Homo sapiens
ctcttgagcctgggag

SEQ ID NO: 6136419 - DNA, 16 bp, Homo sapiens
ctcttgagccttgaac

SEQ ID NO: 6136420 - DNA, 17 bp, Homo sapiens
ctcttgagccttgaact

SEQ ID NO: 6136421 - DNA, 13 bp, Homo sapiens
ctcttgaggagct

SEQ ID NO: 6136422 - DNA, 16 bp, Homo sapiens
ctcttgaggccaggag

SEQ ID NO: 6136423 - DNA, 15 bp, Homo sapiens
ctcttgaggcctgtg

SEQ ID NO: 6136424 - DNA, 20 bp, Homo sapiens
ctcttgaggcctgtgctctg

SEQ ID NO: 6136425 - DNA, 15 bp, Homo sapiens
ctcttgagggagctt

SEQ ID NO: 6136426 - DNA, 19 bp, Homo sapiens
ctcttgagggtcattttcc

SEQ ID NO: 6136427 - DNA, 20 bp, Homo sapiens
ctcttgagttcctctgcagt

SEQ ID NO: 6136428 - DNA, 21 bp, Homo sapiens
ctcttgagttcctctgcagtt

SEQ ID NO: 6136429 - DNA, 18 bp, Homo sapiens
ctcttgagttgtttttgt

SEQ ID NO: 6136430 - DNA, 17 bp, Homo sapiens
ctcttgataaaggagag

SEQ ID NO: 6136431 - DNA, 21 bp, Homo sapiens
ctcttgatacccccctctgtc

SEQ ID NO: 6136432 - DNA, 15 bp, Homo sapiens
ctcttgatctctctt

SEQ ID NO: 6136433 - DNA, 15 bp, Homo sapiens
ctcttgatgcctggc

SEQ ID NO: 6136434 - DNA, 16 bp, Homo sapiens
ctcttgatgcctggcg

SEQ ID NO: 6136435 - DNA, 13 bp, Homo sapiens
ctcttgatgtgaa

SEQ ID NO: 6136436 - DNA, 21 bp, Homo sapiens
ctcttgattatccatattgag

SEQ ID NO: 6136437 - DNA, 24 bp, Homo sapiens
ctcttgattcataatgacttaagc

SEQ ID NO: 6136438 - DNA, 16 bp, Homo sapiens
ctcttgattcctggtt

SEQ ID NO: 6136439 - DNA, 18 bp, Homo sapiens
ctcttgatttcacatttc

SEQ ID NO: 6136440 - DNA, 23 bp, Homo sapiens
ctcttgcacacacggttttggca

SEQ ID NO: 6136441 - DNA, 16 bp, Homo sapiens
ctcttgcaccaaatta

SEQ ID NO: 6136442 - DNA, 13 bp, Homo sapiens
ctcttgcacccgc

SEQ ID NO: 6136443 - DNA, 14 bp, Homo sapiens
ctcttgcagagaag

SEQ ID NO: 6136444 - DNA, 15 bp, Homo sapiens
ctcttgcagggtctt

SEQ ID NO: 6136445 - DNA, 18 bp, Homo sapiens
ctcttgcataagcctcag

SEQ ID NO: 6136446 - DNA, 21 bp, Homo sapiens
ctcttgcataagcctcaggcc

SEQ ID NO: 6136447 - DNA, 23 bp, Homo sapiens
ctcttgcataagcctcaggcctg

SEQ ID NO: 6136448 - DNA, 21 bp, Homo sapiens
ctcttgccaacctgtaataaa

SEQ ID NO: 6136449 - DNA, 22 bp, Homo sapiens
ctcttgccaacctgtaataaat

SEQ ID NO: 6136450 - DNA, 23 bp, Homo sapiens
ctcttgccaacctgtaataaata

SEQ ID NO: 6136451 - DNA, 14 bp, Homo sapiens
ctcttgccacatct

SEQ ID NO: 6136452 - DNA, 15 bp, Homo sapiens
ctcttgccacatctt

SEQ ID NO: 6136453 - DNA, 18 bp, Homo sapiens
ctcttgccacatcttgaa

SEQ ID NO: 6136454 - DNA, 18 bp, Homo sapiens
ctcttgccactgcctctt

SEQ ID NO: 6136455 - DNA, 19 bp, Homo sapiens
ctcttgccactgcctcttc

SEQ ID NO: 6136456 - DNA, 22 bp, Homo sapiens
ctcttgccactgcctcttcctc

SEQ ID NO: 6136457 - DNA, 14 bp, Homo sapiens
ctcttgccagcctc

SEQ ID NO: 6136458 - DNA, 18 bp, Homo sapiens
ctcttgccagcctccttg

SEQ ID NO: 6136459 - DNA, 20 bp, Homo sapiens
ctcttgccagcctccttgct

SEQ ID NO: 6136460 - DNA, 12 bp, Homo sapiens
ctcttgccatcc

SEQ ID NO: 6136461 - DNA, 15 bp, Homo sapiens
ctcttgccatcctga

SEQ ID NO: 6136462 - DNA, 21 bp, Homo sapiens
ctcttgccatttgtagctttg

SEQ ID NO: 6136463 - DNA, 19 bp, Homo sapiens
ctcttgcccatcctgactg

SEQ ID NO: 6136464 - DNA, 12 bp, Homo sapiens
ctcttgccccaa

SEQ ID NO: 6136465 - DNA, 17 bp, Homo sapiens
ctcttgccccaaatcac

SEQ ID NO: 6136466 - DNA, 19 bp, Homo sapiens
ctcttgccccaaatcacaa

SEQ ID NO: 6136467 - DNA, 12 bp, Homo sapiens
ctcttgcccccc

SEQ ID NO: 6136468 - DNA, 12 bp, Homo sapiens
ctcttgcccctt

SEQ ID NO: 6136469 - DNA, 19 bp, Homo sapiens
ctcttgccccttgtcctga

SEQ ID NO: 6136470 - DNA, 23 bp, Homo sapiens
ctcttgcccgcacccctccctgc

SEQ ID NO: 6136471 - DNA, 20 bp, Homo sapiens
ctcttgcccgtcggccctgc

SEQ ID NO: 6136472 - DNA, 22 bp, Homo sapiens
ctcttgcccttccctgtccctc

SEQ ID NO: 6136473 - DNA, 19 bp, Homo sapiens
ctcttgcccttcctactcc

SEQ ID NO: 6136474 - DNA, 20 bp, Homo sapiens
ctcttgccgaggagccaggc

SEQ ID NO: 6136475 - DNA, 20 bp, Homo sapiens
ctcttgcctcaacctcccaa

SEQ ID NO: 6136476 - DNA, 13 bp, Homo sapiens
ctcttgcctctct

SEQ ID NO: 6136477 - DNA, 12 bp, Homo sapiens
ctcttgcctgca

SEQ ID NO: 6136478 - DNA, 20 bp, Homo sapiens
ctcttgcctgcacccttcct

SEQ ID NO: 6136479 - DNA, 21 bp, Homo sapiens
ctcttgcctgcacccttcctc

SEQ ID NO: 6136480 - DNA, 14 bp, Homo sapiens
ctcttgcctgccac

SEQ ID NO: 6136481 - DNA, 15 bp, Homo sapiens
ctcttgcctgccact

SEQ ID NO: 6136482 - DNA, 17 bp, Homo sapiens
ctcttgcctgccactgt

SEQ ID NO: 6136483 - DNA, 23 bp, Homo sapiens
ctcttgcctgccactgtgtgaat

SEQ ID NO: 6136484 - DNA, 10 bp, Homo sapiens
ctcttgcctt

SEQ ID NO: 6136485 - DNA, 20 bp, Homo sapiens
ctcttgcctttccacctgct

SEQ ID NO: 6136486 - DNA, 18 bp, Homo sapiens
ctcttgctattggaatgt

SEQ ID NO: 6136487 - DNA, 12 bp, Homo sapiens
ctcttgctcaaa

SEQ ID NO: 6136488 - DNA, 19 bp, Homo sapiens
ctcttgctcaaaaatctgt

SEQ ID NO: 6136489 - DNA, 17 bp, Homo sapiens
ctcttgctctcttgtga

SEQ ID NO: 6136490 - DNA, 14 bp, Homo sapiens
ctcttgctctttct

SEQ ID NO: 6136491 - DNA, 12 bp, Homo sapiens
ctcttgctgtct

SEQ ID NO: 6136492 - DNA, 17 bp, Homo sapiens
ctcttgctgtctctgct

SEQ ID NO: 6136493 - DNA, 19 bp, Homo sapiens
ctcttgctgtctctgctcg

SEQ ID NO: 6136494 - DNA, 19 bp, Homo sapiens
ctcttgctgtttaccgccc

SEQ ID NO: 6136495 - DNA, 22 bp, Homo sapiens
ctcttgcttgtgggactagcct

SEQ ID NO: 6136496 - DNA, 17 bp, Homo sapiens
ctcttggaaaaagtgat

SEQ ID NO: 6136497 - DNA, 22 bp, Homo sapiens
ctcttggaaatgttaagaaaga

SEQ ID NO: 6136498 - DNA, 22 bp, Homo sapiens
ctcttggaattacaagccctgg

SEQ ID NO: 6136499 - DNA, 20 bp, Homo sapiens
ctcttggaattactgaaagt

SEQ ID NO: 6136500 - DNA, 17 bp, Homo sapiens
ctcttggacaacagctc

SEQ ID NO: 6136501 - DNA, 16 bp, Homo sapiens
ctcttggagcctcttt

SEQ ID NO: 6136502 - DNA, 14 bp, Homo sapiens
ctcttggagcctgc

SEQ ID NO: 6136503 - DNA, 15 bp, Homo sapiens
ctcttggagcctgca

SEQ ID NO: 6136504 - DNA, 21 bp, Homo sapiens
ctcttggatgggacatttttg

SEQ ID NO: 6136505 - DNA, 15 bp, Homo sapiens
ctcttggattaagga

SEQ ID NO: 6136506 - DNA, 16 bp, Homo sapiens
ctcttggcacctgcct

SEQ ID NO: 6136507 - DNA, 17 bp, Homo sapiens
ctcttggcacctgccta

SEQ ID NO: 6136508 - DNA, 14 bp, Homo sapiens
ctcttggcaggagt

SEQ ID NO: 6136509 - DNA, 21 bp, Homo sapiens
ctcttggcattttcctcgcct

SEQ ID NO: 6136510 - DNA, 15 bp, Homo sapiens
ctcttggccagagct

SEQ ID NO: 6136511 - DNA, 16 bp, Homo sapiens
ctcttggccagagctg

SEQ ID NO: 6136512 - DNA, 21 bp, Homo sapiens
ctcttggccatccttctgtgt

SEQ ID NO: 6136513 - DNA, 13 bp, Homo sapiens
ctcttggcccctg

SEQ ID NO: 6136514 - DNA, 16 bp, Homo sapiens
ctcttggcctgatcag

SEQ ID NO: 6136515 - DNA, 15 bp, Homo sapiens
ctcttggcctttgca

SEQ ID NO: 6136516 - DNA, 20 bp, Homo sapiens
ctcttggcctttgcatttat

SEQ ID NO: 6136517 - DNA, 20 bp, Homo sapiens
ctcttggctatttctgtgtc

SEQ ID NO: 6136518 - DNA, 14 bp, Homo sapiens
ctcttggctgaccc

SEQ ID NO: 6136519 - DNA, 15 bp, Homo sapiens
ctcttggctgacccc

SEQ ID NO: 6136520 - DNA, 18 bp, Homo sapiens
ctcttggctgacccctct

SEQ ID NO: 6136521 - DNA, 19 bp, Homo sapiens
ctcttggctgacccctctg

SEQ ID NO: 6136522 - DNA, 22 bp, Homo sapiens
ctcttggctgacccctctggtg

SEQ ID NO: 6136523 - DNA, 14 bp, Homo sapiens
ctcttggctggacc

SEQ ID NO: 6136524 - DNA, 17 bp, Homo sapiens
ctcttggctggacccag

SEQ ID NO: 6136525 - DNA, 14 bp, Homo sapiens
ctcttggcttccag

SEQ ID NO: 6136526 - DNA, 14 bp, Homo sapiens
ctcttggcttctca

SEQ ID NO: 6136527 - DNA, 20 bp, Homo sapiens
ctcttggcttctcagcccct

SEQ ID NO: 6136528 - DNA, 19 bp, Homo sapiens
ctcttgggaaatatgtcaa

SEQ ID NO: 6136529 - DNA, 15 bp, Homo sapiens
ctcttgggaagcagt

SEQ ID NO: 6136530 - DNA, 23 bp, Homo sapiens
ctcttgggaagcagtttcagata

SEQ ID NO: 6136531 - DNA, 22 bp, Homo sapiens
ctcttgggacaacgtgctgctt

SEQ ID NO: 6136532 - DNA, 12 bp, Homo sapiens
ctcttgggacat

SEQ ID NO: 6136533 - DNA, 16 bp, Homo sapiens
ctcttgggcaggcaga

SEQ ID NO: 6136534 - DNA, 18 bp, Homo sapiens
ctcttgggcaggcagaga

SEQ ID NO: 6136535 - DNA, 18 bp, Homo sapiens
ctcttgggccaagccagc

SEQ ID NO: 6136536 - DNA, 19 bp, Homo sapiens
ctcttgggccaagccagct

SEQ ID NO: 6136537 - DNA, 22 bp, Homo sapiens
ctcttgggccaagccagctgcc

SEQ ID NO: 6136538 - DNA, 23 bp, Homo sapiens
ctcttgggccaagccagctgcct

SEQ ID NO: 6136539 - DNA, 16 bp, Homo sapiens
ctcttgggcctgacct

SEQ ID NO: 6136540 - DNA, 14 bp, Homo sapiens
ctcttggggaaata

SEQ ID NO: 6136541 - DNA, 16 bp, Homo sapiens
ctcttggggaagggga

SEQ ID NO: 6136542 - DNA, 19 bp, Homo sapiens
ctcttgggttcaagcgatt

SEQ ID NO: 6136543 - DNA, 18 bp, Homo sapiens
ctcttgggttcaagtgat

SEQ ID NO: 6136544 - DNA, 19 bp, Homo sapiens
ctcttggtccctggaagct

SEQ ID NO: 6136545 - DNA, 17 bp, Homo sapiens
ctcttggtcctgctgca

SEQ ID NO: 6136546 - DNA, 22 bp, Homo sapiens
ctcttggtctctttctttccaa

SEQ ID NO: 6136547 - DNA, 16 bp, Homo sapiens
ctcttggtcttcccag

SEQ ID NO: 6136548 - DNA, 19 bp, Homo sapiens
ctcttggtgaaataataaa

SEQ ID NO: 6136549 - DNA, 23 bp, Homo sapiens
ctcttggtgcatttttttggaag

SEQ ID NO: 6136550 - DNA, 20 bp, Homo sapiens
ctcttggtgggcccagggac

SEQ ID NO: 6136551 - DNA, 23 bp, Homo sapiens
ctcttggtgggtgtggccagcac

SEQ ID NO: 6136552 - DNA, 23 bp, Homo sapiens
ctcttggtgtcaaatttttaagt

SEQ ID NO: 6136553 - DNA, 22 bp, Homo sapiens
ctcttgtaaagactggttttct

SEQ ID NO: 6136554 - DNA, 12 bp, Homo sapiens
ctcttgtaaata

SEQ ID NO: 6136555 - DNA, 17 bp, Homo sapiens
ctcttgtaaataaagcc

SEQ ID NO: 6136556 - DNA, 24 bp, Homo sapiens
ctcttgtaaataaagccctgggat

SEQ ID NO: 6136557 - DNA, 12 bp, Homo sapiens
ctcttgtaagat

SEQ ID NO: 6136558 - DNA, 15 bp, Homo sapiens
ctcttgtaagatttt

SEQ ID NO: 6136559 - DNA, 23 bp, Homo sapiens
ctcttgtaatgatatagccagaa

SEQ ID NO: 6136560 - DNA, 12 bp, Homo sapiens
ctcttgtagaag

SEQ ID NO: 6136561 - DNA, 23 bp, Homo sapiens
ctcttgtagccagaattctggac

SEQ ID NO: 6136562 - DNA, 17 bp, Homo sapiens
ctcttgtagtcttggct

SEQ ID NO: 6136563 - DNA, 18 bp, Homo sapiens
ctcttgtcacccaggctg

SEQ ID NO: 6136564 - DNA, 19 bp, Homo sapiens
ctcttgtcacccaggctgg

SEQ ID NO: 6136565 - DNA, 21 bp, Homo sapiens
ctcttgtcagtgtagacacag

SEQ ID NO: 6136566 - DNA, 20 bp, Homo sapiens
ctatagaaatgtattttgaa

SEQ ID NO: 6136567 - DNA, 15 bp, Homo sapiens
ctatagagaaaaact

SEQ ID NO: 6136568 - DNA, 22 bp, Homo sapiens
ctatagagaaaaactttcattt

SEQ ID NO: 6136569 - DNA, 13 bp, Homo sapiens
ctatagaggagga

SEQ ID NO: 6136570 - DNA, 23 bp, Homo sapiens
ctatagataacggctctccagac

SEQ ID NO: 6136571 - DNA, 18 bp, Homo sapiens
ctatagattgatttacct

SEQ ID NO: 6136572 - DNA, 16 bp, Homo sapiens
ctatagcactgagctc

SEQ ID NO: 6136573 - DNA, 16 bp, Homo sapiens
ctatagcagggctggg

SEQ ID NO: 6136574 - DNA, 14 bp, Homo sapiens
ctatagcagtcatc

SEQ ID NO: 6136575 - DNA, 17 bp, Homo sapiens
ctatagcatcacttaaa

SEQ ID NO: 6136576 - DNA, 15 bp, Homo sapiens
ctatagcatttaaag

SEQ ID NO: 6136577 - DNA, 15 bp, Homo sapiens
ctatagcccaggtcc

SEQ ID NO: 6136578 - DNA, 17 bp, Homo sapiens
ctatagcccctggtgtg

SEQ ID NO: 6136579 - DNA, 22 bp, Homo sapiens
ctatagcccctggtgtgtaaat

SEQ ID NO: 6136580 - DNA, 23 bp, Homo sapiens
ctatagcccctggtgtgtaaata

SEQ ID NO: 6136581 - DNA, 18 bp, Homo sapiens
ctatagcctaggtgacag

SEQ ID NO: 6136582 - DNA, 12 bp, Homo sapiens
ctatagcctggg

SEQ ID NO: 6136583 - DNA, 14 bp, Homo sapiens
ctatagctacatgt

SEQ ID NO: 6136584 - DNA, 18 bp, Homo sapiens
ctatagctacatgttctt

SEQ ID NO: 6136585 - DNA, 12 bp, Homo sapiens
ctatagctcttc

SEQ ID NO: 6136586 - DNA, 19 bp, Homo sapiens
ctatagctcttctatttaa

SEQ ID NO: 6136587 - DNA, 22 bp, Homo sapiens
ctatagctgttctaatggatta

SEQ ID NO: 6136588 - DNA, 15 bp, Homo sapiens
ctatagcttgcagaa

SEQ ID NO: 6136589 - DNA, 15 bp, Homo sapiens
ctataggaaagtctg

SEQ ID NO: 6136590 - DNA, 16 bp, Homo sapiens
ctataggaacagccca

SEQ ID NO: 6136591 - DNA, 17 bp, Homo sapiens
ctataggagatgagctt

SEQ ID NO: 6136592 - DNA, 16 bp, Homo sapiens
ctataggcagacgtgg

SEQ ID NO: 6136593 - DNA, 16 bp, Homo sapiens
ctataggctggagaag

SEQ ID NO: 6136594 - DNA, 22 bp, Homo sapiens
ctataggtcatgatttctgtga

SEQ ID NO: 6136595 - DNA, 15 bp, Homo sapiens
ctataggtccagaag

SEQ ID NO: 6136596 - DNA, 15 bp, Homo sapiens
ctataggtgctacaa

SEQ ID NO: 6136597 - DNA, 15 bp, Homo sapiens
ctatagtaaatgtgt

SEQ ID NO: 6136598 - DNA, 13 bp, Homo sapiens
ctatagtcccagc

SEQ ID NO: 6136599 - DNA, 18 bp, Homo sapiens
ctatagtgtataccacct

SEQ ID NO: 6136600 - DNA, 21 bp, Homo sapiens
ctatagtgtataccacctgta

SEQ ID NO: 6136601 - DNA, 22 bp, Homo sapiens
ctatagtgtataccacctgtac

SEQ ID NO: 6136602 - DNA, 16 bp, Homo sapiens
ctatagttatacatca

SEQ ID NO: 6136603 - DNA, 20 bp, Homo sapiens
ctatagttattaagttcttt

SEQ ID NO: 6136604 - DNA, 17 bp, Homo sapiens
ctatagttattgtttta

SEQ ID NO: 6136605 - DNA, 13 bp, Homo sapiens
ctatagttctaga

SEQ ID NO: 6136606 - DNA, 14 bp, Homo sapiens
ctatagttctagac

SEQ ID NO: 6136607 - DNA, 18 bp, Homo sapiens
ctatagtttcaccactcc

SEQ ID NO: 6136608 - DNA, 22 bp, Homo sapiens
ctatagtttcaccactcctctc

SEQ ID NO: 6136609 - DNA, 22 bp, Homo sapiens
ctatataaaaaatatatgtaat

SEQ ID NO: 6136610 - DNA, 22 bp, Homo sapiens
ctatataaaataactaaaatgt

SEQ ID NO: 6136611 - DNA, 12 bp, Homo sapiens
ctatataaaatg

SEQ ID NO: 6136612 - DNA, 18 bp, Homo sapiens
ctatataaaatgtattca

SEQ ID NO: 6136613 - DNA, 19 bp, Homo sapiens
ctatataaaatgtattcaa

SEQ ID NO: 6136614 - DNA, 22 bp, Homo sapiens
ctatataaatgacattattaaa

SEQ ID NO: 6136615 - DNA, 19 bp, Homo sapiens
ctatataaccacatttcta

SEQ ID NO: 6136616 - DNA, 20 bp, Homo sapiens
ctatataaccacatttctaa

SEQ ID NO: 6136617 - DNA, 15 bp, Homo sapiens
ctatataagacatta

SEQ ID NO: 6136618 - DNA, 16 bp, Homo sapiens
ctatataagacattaa

SEQ ID NO: 6136619 - DNA, 19 bp, Homo sapiens
ctatataattaatattttg

SEQ ID NO: 6136620 - DNA, 20 bp, Homo sapiens
ctatataatttatttccact

SEQ ID NO: 6136621 - DNA, 19 bp, Homo sapiens
ctatatacagatgcaagca

SEQ ID NO: 6136622 - DNA, 11 bp, Homo sapiens
ctatatacatg

SEQ ID NO: 6136623 - DNA, 15 bp, Homo sapiens
ctatatacctcacta

SEQ ID NO: 6136624 - DNA, 14 bp, Homo sapiens
ctatatagaatttc

SEQ ID NO: 6136625 - DNA, 17 bp, Homo sapiens
ctatatagaatttcctg

SEQ ID NO: 6136626 - DNA, 19 bp, Homo sapiens
ctatatagaatttcctgta

SEQ ID NO: 6136627 - DNA, 19 bp, Homo sapiens
ctatatagttccttgcctt

SEQ ID NO: 6136628 - DNA, 20 bp, Homo sapiens
ctatatagttccttgcctta

SEQ ID NO: 6136629 - DNA, 16 bp, Homo sapiens
ctatatagtttattga

SEQ ID NO: 6136630 - DNA, 14 bp, Homo sapiens
ctatatataaagac

SEQ ID NO: 6136631 - DNA, 21 bp, Homo sapiens
ctatatataattctgtacata

SEQ ID NO: 6136632 - DNA, 13 bp, Homo sapiens
ctatatatacaat

SEQ ID NO: 6136633 - DNA, 17 bp, Homo sapiens
ctatatatacatatgta

SEQ ID NO: 6136634 - DNA, 15 bp, Homo sapiens
ctatatatacatgta

SEQ ID NO: 6136635 - DNA, 16 bp, Homo sapiens
ctatatatacatgtat

SEQ ID NO: 6136636 - DNA, 15 bp, Homo sapiens
ctatatatataaata

SEQ ID NO: 6136637 - DNA, 18 bp, Homo sapiens
ctatatatataaatgtat

SEQ ID NO: 6136638 - DNA, 17 bp, Homo sapiens
ctatatatccttaatat

SEQ ID NO: 6136639 - DNA, 13 bp, Homo sapiens
ctatatatgtgta

SEQ ID NO: 6136640 - DNA, 15 bp, Homo sapiens
ctatatatgtgtatg

SEQ ID NO: 6136641 - DNA, 16 bp, Homo sapiens
ctatatatttctatta

SEQ ID NO: 6136642 - DNA, 14 bp, Homo sapiens
ctatatcagggcct

SEQ ID NO: 6136643 - DNA, 19 bp, Homo sapiens
ctatatcagtagtgtacat

SEQ ID NO: 6136644 - DNA, 17 bp, Homo sapiens
ctatatcagtcgtttta

SEQ ID NO: 6136645 - DNA, 21 bp, Homo sapiens
ctatatcagtcgttttagtgt

SEQ ID NO: 6136646 - DNA, 19 bp, Homo sapiens
ctatatcatatttctgtgg

SEQ ID NO: 6136647 - DNA, 14 bp, Homo sapiens
ctatatcatgcttt

SEQ ID NO: 6136648 - DNA, 15 bp, Homo sapiens
ctatatcattattta

SEQ ID NO: 6136649 - DNA, 15 bp, Homo sapiens
ctatatccaaaattc

SEQ ID NO: 6136650 - DNA, 22 bp, Homo sapiens
ctatatccaaaattcagggctt

SEQ ID NO: 6136651 - DNA, 17 bp, Homo sapiens
ctatatccagttcctgc

SEQ ID NO: 6136652 - DNA, 18 bp, Homo sapiens
ctatatccagttcctgct

SEQ ID NO: 6136653 - DNA, 19 bp, Homo sapiens
ctatatccagttcctgctc

SEQ ID NO: 6136654 - DNA, 20 bp, Homo sapiens
ctatatccagttcctgctct

SEQ ID NO: 6136655 - DNA, 12 bp, Homo sapiens
ctatatccatgt

SEQ ID NO: 6136656 - DNA, 18 bp, Homo sapiens
ctatatcctgatgctgga

SEQ ID NO: 6136657 - DNA, 18 bp, Homo sapiens
ctatatcgagagtgtgtg

SEQ ID NO: 6136658 - DNA, 18 bp, Homo sapiens
ctatatctataaacactg

SEQ ID NO: 6136659 - DNA, 19 bp, Homo sapiens
ctatatctatttgagagca

SEQ ID NO: 6136660 - DNA, 16 bp, Homo sapiens
ctatatctgagagacc

SEQ ID NO: 6136661 - DNA, 23 bp, Homo sapiens
ctatatctggagtgagaggcccc

SEQ ID NO: 6136662 - DNA, 16 bp, Homo sapiens
ctatatctgtatataa

SEQ ID NO: 6136663 - DNA, 19 bp, Homo sapiens
ctatatctgtatataaaat

SEQ ID NO: 6136664 - DNA, 13 bp, Homo sapiens
ctatatctgtttg

SEQ ID NO: 6136665 - DNA, 16 bp, Homo sapiens
ctatatctgtttgtat

SEQ ID NO: 6136666 - DNA, 17 bp, Homo sapiens
ctatatctgtttgtata

SEQ ID NO: 6136667 - DNA, 18 bp, Homo sapiens
ctatatctgttttactgc

SEQ ID NO: 6136668 - DNA, 22 bp, Homo sapiens
ctatatctgttttactgctttt

SEQ ID NO: 6136669 - DNA, 23 bp, Homo sapiens
ctatatctgttttactgctttta

SEQ ID NO: 6136670 - DNA, 20 bp, Homo sapiens
ctatatctttaaataaatgt

SEQ ID NO: 6136671 - DNA, 17 bp, Homo sapiens
ctatatgaatgctattt

SEQ ID NO: 6136672 - DNA, 16 bp, Homo sapiens
ctatatgatcctgaaa

SEQ ID NO: 6136673 - DNA, 17 bp, Homo sapiens
ctatatgattaaagaaa

SEQ ID NO: 6136674 - DNA, 18 bp, Homo sapiens
ctatatgattaaagaaaa

SEQ ID NO: 6136675 - DNA, 16 bp, Homo sapiens
ctatatgatttatagt

SEQ ID NO: 6136676 - DNA, 19 bp, Homo sapiens
ctatatgatttatagtttg

SEQ ID NO: 6136677 - DNA, 20 bp, Homo sapiens
ctatatgcagtctctttatt

SEQ ID NO: 6136678 - DNA, 16 bp, Homo sapiens
ctatatgcataaacaa

SEQ ID NO: 6136679 - DNA, 18 bp, Homo sapiens
ctatatgcataaacaaca

SEQ ID NO: 6136680 - DNA, 19 bp, Homo sapiens
ctatatggcaagaaagctg

SEQ ID NO: 6136681 - DNA, 14 bp, Homo sapiens
ctatatgtacttgt

SEQ ID NO: 6136682 - DNA, 14 bp, Homo sapiens
ctatattaaatgag

SEQ ID NO: 6136683 - DNA, 19 bp, Homo sapiens
ctatattacggtttgcccc

SEQ ID NO: 6136684 - DNA, 13 bp, Homo sapiens
ctatattatcata

SEQ ID NO: 6136685 - DNA, 19 bp, Homo sapiens
ctatattatctagctttct

SEQ ID NO: 6136686 - DNA, 14 bp, Homo sapiens
ctatattattatat

SEQ ID NO: 6136687 - DNA, 18 bp, Homo sapiens
ctatattcctccagctgg

SEQ ID NO: 6136688 - DNA, 21 bp, Homo sapiens
ctatattcctccagctgggat

SEQ ID NO: 6136689 - DNA, 18 bp, Homo sapiens
ctatattcctttttctat

SEQ ID NO: 6136690 - DNA, 11 bp, Homo sapiens
ctatattctat

SEQ ID NO: 6136691 - DNA, 13 bp, Homo sapiens
ctatattgattta

SEQ ID NO: 6136692 - DNA, 22 bp, Homo sapiens
ctatattgcttagtaagtattt

SEQ ID NO: 6136693 - DNA, 13 bp, Homo sapiens
ctatattgggact

SEQ ID NO: 6136694 - DNA, 13 bp, Homo sapiens
ctatattgtacac

SEQ ID NO: 6136695 - DNA, 14 bp, Homo sapiens
ctatattgtgccaa

SEQ ID NO: 6136696 - DNA, 16 bp, Homo sapiens
ctatattgttcagcat

SEQ ID NO: 6136697 - DNA, 21 bp, Homo sapiens
ctatatttaataccaccaaca

SEQ ID NO: 6136698 - DNA, 15 bp, Homo sapiens
ctatatttactgttt

SEQ ID NO: 6136699 - DNA, 17 bp, Homo sapiens
ctatatttactgtttat

SEQ ID NO: 6136700 - DNA, 13 bp, Homo sapiens
ctatatttattta

SEQ ID NO: 6136701 - DNA, 23 bp, Homo sapiens
ctatatttattttcagtatactg

SEQ ID NO: 6136702 - DNA, 16 bp, Homo sapiens
ctatatttcaatactg

SEQ ID NO: 6136703 - DNA, 14 bp, Homo sapiens
ctatatttcagtga

SEQ ID NO: 6136704 - DNA, 13 bp, Homo sapiens
ctatatttcatat

SEQ ID NO: 6136705 - DNA, 15 bp, Homo sapiens
ctatatttcatattg

SEQ ID NO: 6136706 - DNA, 14 bp, Homo sapiens
ctatatttgagcac

SEQ ID NO: 6136707 - DNA, 17 bp, Homo sapiens
ctatatttgattatgta

SEQ ID NO: 6136708 - DNA, 12 bp, Homo sapiens
ctatatttgcta

SEQ ID NO: 6136709 - DNA, 15 bp, Homo sapiens
ctatatttgctaata

SEQ ID NO: 6136710 - DNA, 22 bp, Homo sapiens
ctatatttgctagactctagac

SEQ ID NO: 6136711 - DNA, 17 bp, Homo sapiens
ctatatttgtatatatt

SEQ ID NO: 6136712 - DNA, 16 bp, Homo sapiens
ctatatttgttcccat

SEQ ID NO: 6136713 - DNA, 18 bp, Homo sapiens
ctatattttaacctgcat

SEQ ID NO: 6136714 - DNA, 20 bp, Homo sapiens
ctatattttatttctgaaga

SEQ ID NO: 6136715 - DNA, 15 bp, Homo sapiens
ctatattttcattct

SEQ ID NO: 6136716 - DNA, 16 bp, Homo sapiens
ctatattttgtcatat

SEQ ID NO: 6136717 - DNA, 23 bp, Homo sapiens
ctatattttttaaatttacagaa

SEQ ID NO: 6136718 - DNA, 18 bp, Homo sapiens
ctatattttttcttttga

SEQ ID NO: 6136719 - DNA, 22 bp, Homo sapiens
ctatattttttcttttgacata

SEQ ID NO: 6136720 - DNA, 14 bp, Homo sapiens
ctatcaaaacatat

SEQ ID NO: 6136721 - DNA, 15 bp, Homo sapiens
ctatcaaaataaatt

SEQ ID NO: 6136722 - DNA, 13 bp, Homo sapiens
ctatcaaactgaa

SEQ ID NO: 6136723 - DNA, 16 bp, Homo sapiens
ctatcaaactgaagcc

SEQ ID NO: 6136724 - DNA, 20 bp, Homo sapiens
ctatcaaactgaagccagaa

SEQ ID NO: 6136725 - DNA, 21 bp, Homo sapiens
ctatcaacctaagcaacagaa

SEQ ID NO: 6136726 - DNA, 19 bp, Homo sapiens
ctatcaagaggctgagaca

SEQ ID NO: 6136727 - DNA, 20 bp, Homo sapiens
ctatcaagaggctgagacag

SEQ ID NO: 6136728 - DNA, 14 bp, Homo sapiens
ctatcaagcactaa

SEQ ID NO: 6136729 - DNA, 20 bp, Homo sapiens
ctatcaagtattataccttt

SEQ ID NO: 6136730 - DNA, 17 bp, Homo sapiens
ctatcaagtcaatcatt

SEQ ID NO: 6136731 - DNA, 23 bp, Homo sapiens
ctatcaagtgtgctttagcttga

SEQ ID NO: 6136732 - DNA, 18 bp, Homo sapiens
ctatcaatatttaagttt

SEQ ID NO: 6136733 - DNA, 19 bp, Homo sapiens
ctatcaatccaaattccct

SEQ ID NO: 6136734 - DNA, 23 bp, Homo sapiens
ctatcaatccaaattccctctgg

SEQ ID NO: 6136735 - DNA, 14 bp, Homo sapiens
ctatcaattttaag

SEQ ID NO: 6136736 - DNA, 19 bp, Homo sapiens
ctatcacacactttctctt

SEQ ID NO: 6136737 - DNA, 13 bp, Homo sapiens
ctatcacatacaa

SEQ ID NO: 6136738 - DNA, 19 bp, Homo sapiens
ctatcacccaacgctccaa

SEQ ID NO: 6136739 - DNA, 16 bp, Homo sapiens
ctatcacctatttcca

SEQ ID NO: 6136740 - DNA, 16 bp, Homo sapiens
ctatcacctcccctcc

SEQ ID NO: 6136741 - DNA, 17 bp, Homo sapiens
ctatcacctcccctcct

SEQ ID NO: 6136742 - DNA, 16 bp, Homo sapiens
ctatcacctgtcatca

SEQ ID NO: 6136743 - DNA, 22 bp, Homo sapiens
ctatcacggcttttccttattt

SEQ ID NO: 6136744 - DNA, 13 bp, Homo sapiens
ctatcactgacac

SEQ ID NO: 6136745 - DNA, 19 bp, Homo sapiens
ctatcactgacacatcagc

SEQ ID NO: 6136746 - DNA, 14 bp, Homo sapiens
ctcttgtcattctc

SEQ ID NO: 6136747 - DNA, 16 bp, Homo sapiens
ctcttgtcattctcat

SEQ ID NO: 6136748 - DNA, 21 bp, Homo sapiens
ctcttgtcattctcatccaaa

SEQ ID NO: 6136749 - DNA, 16 bp, Homo sapiens
ctcttgtccctgtcgc

SEQ ID NO: 6136750 - DNA, 18 bp, Homo sapiens
ctcttgtccctttcccta

SEQ ID NO: 6136751 - DNA, 20 bp, Homo sapiens
ctcttgtccctttccctacc

SEQ ID NO: 6136752 - DNA, 22 bp, Homo sapiens
ctcttgtcctcagtccatttat

SEQ ID NO: 6136753 - DNA, 14 bp, Homo sapiens
ctcttgtcctcttc

SEQ ID NO: 6136754 - DNA, 13 bp, Homo sapiens
ctcttgtcctggc

SEQ ID NO: 6136755 - DNA, 16 bp, Homo sapiens
ctcttgtcctggccct

SEQ ID NO: 6136756 - DNA, 19 bp, Homo sapiens
ctcttgtcctggcccttca

SEQ ID NO: 6136757 - DNA, 21 bp, Homo sapiens
ctcttgtcctggcccttcagt

SEQ ID NO: 6136758 - DNA, 12 bp, Homo sapiens
ctcttgtcctgt

SEQ ID NO: 6136759 - DNA, 15 bp, Homo sapiens
ctcttgtcctttaat

SEQ ID NO: 6136760 - DNA, 13 bp, Homo sapiens
ctcttgtctcccc

SEQ ID NO: 6136761 - DNA, 14 bp, Homo sapiens
ctcttgtctcccct

SEQ ID NO: 6136762 - DNA, 16 bp, Homo sapiens
ctcttgtctcccctgt

SEQ ID NO: 6136763 - DNA, 22 bp, Homo sapiens
ctcttgtctggcaaaagaaaaa

SEQ ID NO: 6136764 - DNA, 14 bp, Homo sapiens
ctcttgtctggctg

SEQ ID NO: 6136765 - DNA, 19 bp, Homo sapiens
ctcttgtgatttggttgca

SEQ ID NO: 6136766 - DNA, 19 bp, Homo sapiens
ctcttgtgcaaggtggcct

SEQ ID NO: 6136767 - DNA, 15 bp, Homo sapiens
ctcttgtgctcagtc

SEQ ID NO: 6136768 - DNA, 13 bp, Homo sapiens
ctcttgtgctgag

SEQ ID NO: 6136769 - DNA, 17 bp, Homo sapiens
ctcttgtgtccctggaa

SEQ ID NO: 6136770 - DNA, 17 bp, Homo sapiens
ctcttgtgttcagaaga

SEQ ID NO: 6136771 - DNA, 18 bp, Homo sapiens
ctcttgttaccatgtatg

SEQ ID NO: 6136772 - DNA, 16 bp, Homo sapiens
ctcttgttcctgaaat

SEQ ID NO: 6136773 - DNA, 20 bp, Homo sapiens
ctcttgttcttactttcctg

SEQ ID NO: 6136774 - DNA, 18 bp, Homo sapiens
ctcttgttgaagtgctgt

SEQ ID NO: 6136775 - DNA, 21 bp, Homo sapiens
ctcttgttgagccgtgggcaa

SEQ ID NO: 6136776 - DNA, 21 bp, Homo sapiens
ctcttgtttaaaaaaagaaaa

SEQ ID NO: 6136777 - DNA, 24 bp, Homo sapiens
ctcttgtttacgatttcactagga

SEQ ID NO: 6136778 - DNA, 15 bp, Homo sapiens
ctcttgtttcactcc

SEQ ID NO: 6136779 - DNA, 19 bp, Homo sapiens
ctcttgtttcactccacca

SEQ ID NO: 6136780 - DNA, 12 bp, Homo sapiens
ctcttgtttctg

SEQ ID NO: 6136781 - DNA, 13 bp, Homo sapiens
ctcttgtttctgt

SEQ ID NO: 6136782 - DNA, 15 bp, Homo sapiens
ctcttgtttctgttt

SEQ ID NO: 6136783 - DNA, 20 bp, Homo sapiens
ctcttgttttgtttgtctct

SEQ ID NO: 6136784 - DNA, 20 bp, Homo sapiens
ctcttgtttttattaattta

SEQ ID NO: 6136785 - DNA, 21 bp, Homo sapiens
ctcttgtttttgcataactgg

SEQ ID NO: 6136786 - DNA, 18 bp, Homo sapiens
ctctttaaaaacattttc

SEQ ID NO: 6136787 - DNA, 15 bp, Homo sapiens
ctctttaaaaactca

SEQ ID NO: 6136788 - DNA, 18 bp, Homo sapiens
ctctttaaaaactcactt

SEQ ID NO: 6136789 - DNA, 19 bp, Homo sapiens
ctctttaaaaggaaagaaa

SEQ ID NO: 6136790 - DNA, 23 bp, Homo sapiens
ctctttaaaaggaaagaaaacat

SEQ ID NO: 6136791 - DNA, 20 bp, Homo sapiens
ctctttaaactatgttccta

SEQ ID NO: 6136792 - DNA, 11 bp, Homo sapiens
ctctttaaatc

SEQ ID NO: 6136793 - DNA, 12 bp, Homo sapiens
ctctttaacaag

SEQ ID NO: 6136794 - DNA, 23 bp, Homo sapiens
ctctttaactcaggactccagcc

SEQ ID NO: 6136795 - DNA, 22 bp, Homo sapiens
ctctttaagggcatgccttgtg

SEQ ID NO: 6136796 - DNA, 19 bp, Homo sapiens
ctctttaagttttgattaa

SEQ ID NO: 6136797 - DNA, 22 bp, Homo sapiens
ctctttaatgctgcctgccttt

SEQ ID NO: 6136798 - DNA, 16 bp, Homo sapiens
ctctttaatgctgtct

SEQ ID NO: 6136799 - DNA, 22 bp, Homo sapiens
ctctttaatgtcacaggcaggt

SEQ ID NO: 6136800 - DNA, 21 bp, Homo sapiens
ctctttaatttgttgtagatt

SEQ ID NO: 6136801 - DNA, 14 bp, Homo sapiens
ctctttacatggtg

SEQ ID NO: 6136802 - DNA, 20 bp, Homo sapiens
ctctttacatttcttttaaa

SEQ ID NO: 6136803 - DNA, 23 bp, Homo sapiens
ctctttacatttcttttaaaata

SEQ ID NO: 6136804 - DNA, 16 bp, Homo sapiens
ctctttacctttgccc

SEQ ID NO: 6136805 - DNA, 16 bp, Homo sapiens
ctctttactcccttcc

SEQ ID NO: 6136806 - DNA, 22 bp, Homo sapiens
ctctttactcccttcctggcct

SEQ ID NO: 6136807 - DNA, 17 bp, Homo sapiens
ctctttactctctccga

SEQ ID NO: 6136808 - DNA, 12 bp, Homo sapiens
ctctttagccag

SEQ ID NO: 6136809 - DNA, 17 bp, Homo sapiens
ctctttagtgttctgtt

SEQ ID NO: 6136810 - DNA, 13 bp, Homo sapiens
ctctttattccta

SEQ ID NO: 6136811 - DNA, 14 bp, Homo sapiens
ctctttattgtctg

SEQ ID NO: 6136812 - DNA, 20 bp, Homo sapiens
ctctttattgtctgtaaatc

SEQ ID NO: 6136813 - DNA, 21 bp, Homo sapiens
ctctttattttaaaaaacact

SEQ ID NO: 6136814 - DNA, 16 bp, Homo sapiens
ctctttattttactag

SEQ ID NO: 6136815 - DNA, 13 bp, Homo sapiens
ctctttattttcc

SEQ ID NO: 6136816 - DNA, 12 bp, Homo sapiens
ctctttcaaaac

SEQ ID NO: 6136817 - DNA, 14 bp, Homo sapiens
ctctttcaatgtgt

SEQ ID NO: 6136818 - DNA, 22 bp, Homo sapiens
ctctttcaatgtgtttaatttt

SEQ ID NO: 6136819 - DNA, 16 bp, Homo sapiens
ctctttcacattgttt

SEQ ID NO: 6136820 - DNA, 17 bp, Homo sapiens
ctctttcagagaggtct

SEQ ID NO: 6136821 - DNA, 12 bp, Homo sapiens
ctctttcagctc

SEQ ID NO: 6136822 - DNA, 14 bp, Homo sapiens
ctctttcagctcct

SEQ ID NO: 6136823 - DNA, 13 bp, Homo sapiens
ctctttccaaatt

SEQ ID NO: 6136824 - DNA, 16 bp, Homo sapiens
ctctttccaaattaaa

SEQ ID NO: 6136825 - DNA, 20 bp, Homo sapiens
ctctttccacttgccctgtg

SEQ ID NO: 6136826 - DNA, 19 bp, Homo sapiens
ctctttcccacccagcctg

SEQ ID NO: 6136827 - DNA, 23 bp, Homo sapiens
ctctttcccaccctccacctctc

SEQ ID NO: 6136828 - DNA, 14 bp, Homo sapiens
ctctttcccaggac

SEQ ID NO: 6136829 - DNA, 15 bp, Homo sapiens
ctctttcccaggacg

SEQ ID NO: 6136830 - DNA, 19 bp, Homo sapiens
ctctttccccaaggaccca

SEQ ID NO: 6136831 - DNA, 16 bp, Homo sapiens
ctctttccctcatgta

SEQ ID NO: 6136832 - DNA, 13 bp, Homo sapiens
ctctttccctccc

SEQ ID NO: 6136833 - DNA, 15 bp, Homo sapiens
ctctttccctggtcc

SEQ ID NO: 6136834 - DNA, 17 bp, Homo sapiens
ctctttccctggtccct

SEQ ID NO: 6136835 - DNA, 13 bp, Homo sapiens
ctctttcccttcc

SEQ ID NO: 6136836 - DNA, 17 bp, Homo sapiens
ctctttcccttccagtt

SEQ ID NO: 6136837 - DNA, 19 bp, Homo sapiens
ctctttccgactgcccaga

SEQ ID NO: 6136838 - DNA, 20 bp, Homo sapiens
ctctttccgactgcccagaa

SEQ ID NO: 6136839 - DNA, 17 bp, Homo sapiens
ctctttcctacaagtta

SEQ ID NO: 6136840 - DNA, 20 bp, Homo sapiens
ctctttcctatttcagtgtt

SEQ ID NO: 6136841 - DNA, 18 bp, Homo sapiens
ctctttcctcctcatgaa

SEQ ID NO: 6136842 - DNA, 12 bp, Homo sapiens
ctctttcctgtg

SEQ ID NO: 6136843 - DNA, 20 bp, Homo sapiens
ctctttcctgtgccaggact

SEQ ID NO: 6136844 - DNA, 11 bp, Homo sapiens
ctctttccttg

SEQ ID NO: 6136845 - DNA, 20 bp, Homo sapiens
ctctttccttggctcccatt

SEQ ID NO: 6136846 - DNA, 16 bp, Homo sapiens
ctctttcgtctactgc

SEQ ID NO: 6136847 - DNA, 15 bp, Homo sapiens
ctctttctacagcct

SEQ ID NO: 6136848 - DNA, 22 bp, Homo sapiens
ctctttctacatgactgggcct

SEQ ID NO: 6136849 - DNA, 23 bp, Homo sapiens
ctctttctacatgactgggcctc

SEQ ID NO: 6136850 - DNA, 23 bp, Homo sapiens
ctctttctattgttaaacaaatg

SEQ ID NO: 6136851 - DNA, 13 bp, Homo sapiens
ctctttctcacct

SEQ ID NO: 6136852 - DNA, 15 bp, Homo sapiens
ctctttctcattctt

SEQ ID NO: 6136853 - DNA, 17 bp, Homo sapiens
ctctttctcattcttgc

SEQ ID NO: 6136854 - DNA, 12 bp, Homo sapiens
ctctttctccct

SEQ ID NO: 6136855 - DNA, 15 bp, Homo sapiens
ctctttctccctcac

SEQ ID NO: 6136856 - DNA, 20 bp, Homo sapiens
ctctttctcccttctgctcc

SEQ ID NO: 6136857 - DNA, 14 bp, Homo sapiens
ctctttctcccttt

SEQ ID NO: 6136858 - DNA, 12 bp, Homo sapiens
ctctttctctcc

SEQ ID NO: 6136859 - DNA, 15 bp, Homo sapiens
ctctttctctccttt

SEQ ID NO: 6136860 - DNA, 19 bp, Homo sapiens
ctctttctctcctttcttt

SEQ ID NO: 6136861 - DNA, 14 bp, Homo sapiens
ctctttctctctgt

SEQ ID NO: 6136862 - DNA, 13 bp, Homo sapiens
ctctttctctctt

SEQ ID NO: 6136863 - DNA, 12 bp, Homo sapiens
ctctttctctgg

SEQ ID NO: 6136864 - DNA, 13 bp, Homo sapiens
ctctttctctttc

SEQ ID NO: 6136865 - DNA, 19 bp, Homo sapiens
ctctttctgagtgccttct

SEQ ID NO: 6136866 - DNA, 14 bp, Homo sapiens
ctctttctgctctg

SEQ ID NO: 6136867 - DNA, 12 bp, Homo sapiens
ctctttctgggc

SEQ ID NO: 6136868 - DNA, 15 bp, Homo sapiens
ctctttctgtcttct

SEQ ID NO: 6136869 - DNA, 17 bp, Homo sapiens
ctctttctgtttcctgg

SEQ ID NO: 6136870 - DNA, 18 bp, Homo sapiens
ctctttctgtttcctggc

SEQ ID NO: 6136871 - DNA, 19 bp, Homo sapiens
ctctttctgtttcctggcc

SEQ ID NO: 6136872 - DNA, 18 bp, Homo sapiens
ctctttcttcaattaatg

SEQ ID NO: 6136873 - DNA, 22 bp, Homo sapiens
ctctttcttccactaccctccc

SEQ ID NO: 6136874 - DNA, 14 bp, Homo sapiens
ctctttcttccctc

SEQ ID NO: 6136875 - DNA, 13 bp, Homo sapiens
ctctttcttcctt

SEQ ID NO: 6136876 - DNA, 17 bp, Homo sapiens
ctctttcttcctttcta

SEQ ID NO: 6136877 - DNA, 12 bp, Homo sapiens
ctctttcttgtt

SEQ ID NO: 6136878 - DNA, 15 bp, Homo sapiens
ctctttctttccaaa

SEQ ID NO: 6136879 - DNA, 20 bp, Homo sapiens
ctctttctttcttttgtgtt

SEQ ID NO: 6136880 - DNA, 15 bp, Homo sapiens
ctctttcttttctct

SEQ ID NO: 6136881 - DNA, 14 bp, Homo sapiens
ctctttcttttgtg

SEQ ID NO: 6136882 - DNA, 14 bp, Homo sapiens
ctctttgaaaaaaa

SEQ ID NO: 6136883 - DNA, 17 bp, Homo sapiens
ctctttgaaaattcttg

SEQ ID NO: 6136884 - DNA, 23 bp, Homo sapiens
ctctttgaactccgctgccttcc

SEQ ID NO: 6136885 - DNA, 20 bp, Homo sapiens
ctctttgaagaaaagaaaaa

SEQ ID NO: 6136886 - DNA, 14 bp, Homo sapiens
ctctttgagaaata

SEQ ID NO: 6136887 - DNA, 13 bp, Homo sapiens
ctctttgataaca

SEQ ID NO: 6136888 - DNA, 15 bp, Homo sapiens
ctctttgataacaaa

SEQ ID NO: 6136889 - DNA, 20 bp, Homo sapiens
ctctttgatcgcttttaata

SEQ ID NO: 6136890 - DNA, 14 bp, Homo sapiens
ctctttgattattt

SEQ ID NO: 6136891 - DNA, 12 bp, Homo sapiens
ctctttgccctg

SEQ ID NO: 6136892 - DNA, 14 bp, Homo sapiens
ctctttgccctgag

SEQ ID NO: 6136893 - DNA, 15 bp, Homo sapiens
ctctttgccctgagg

SEQ ID NO: 6136894 - DNA, 13 bp, Homo sapiens
ctctttgcctcaa

SEQ ID NO: 6136895 - DNA, 14 bp, Homo sapiens
ctctttgctacaat

SEQ ID NO: 6136896 - DNA, 18 bp, Homo sapiens
ctctttgctacaataaat

SEQ ID NO: 6136897 - DNA, 20 bp, Homo sapiens
ctctttgctacaataaatgc

SEQ ID NO: 6136898 - DNA, 13 bp, Homo sapiens
ctctttgctccag

SEQ ID NO: 6136899 - DNA, 17 bp, Homo sapiens
ctctttgctgcagagaa

SEQ ID NO: 6136900 - DNA, 16 bp, Homo sapiens
ctctttgctttctggt

SEQ ID NO: 6136901 - DNA, 16 bp, Homo sapiens
ctctttgctttgcttt

SEQ ID NO: 6136902 - DNA, 17 bp, Homo sapiens
ctctttggcagttgcat

SEQ ID NO: 6136903 - DNA, 21 bp, Homo sapiens
ctctttggcgacctcctttca

SEQ ID NO: 6136904 - DNA, 18 bp, Homo sapiens
ctctttggctcccctgta

SEQ ID NO: 6136905 - DNA, 21 bp, Homo sapiens
ctctttgggaatgtttgtctc

SEQ ID NO: 6136906 - DNA, 20 bp, Homo sapiens
ctctttgggatcttgaagaa

SEQ ID NO: 6136907 - DNA, 21 bp, Homo sapiens
ctctttgggatcttgaagaag

SEQ ID NO: 6136908 - DNA, 13 bp, Homo sapiens
ctctttgggcagt

SEQ ID NO: 6136909 - DNA, 22 bp, Homo sapiens
ctctttgggcctctcctgccct

SEQ ID NO: 6136910 - DNA, 18 bp, Homo sapiens
ctctttgggcctggctcc

SEQ ID NO: 6136911 - DNA, 18 bp, Homo sapiens
ctctttggggagagctgg

SEQ ID NO: 6136912 - DNA, 23 bp, Homo sapiens
ctctttgggggaaacgggctcct

SEQ ID NO: 6136913 - DNA, 19 bp, Homo sapiens
ctctttggggtcagccagg

SEQ ID NO: 6136914 - DNA, 20 bp, Homo sapiens
ctctttggggtcagccaggg

SEQ ID NO: 6136915 - DNA, 18 bp, Homo sapiens
ctctttgggtttcttgtt

SEQ ID NO: 6136916 - DNA, 21 bp, Homo sapiens
ctctttggtggcatggaaggg

SEQ ID NO: 6136917 - DNA, 19 bp, Homo sapiens
ctctttgtaaggacttgtg

SEQ ID NO: 6136918 - DNA, 22 bp, Homo sapiens
ctctttgtaaggacttgtgcct

SEQ ID NO: 6136919 - DNA, 15 bp, Homo sapiens
ctctttgtaataaaa

SEQ ID NO: 6136920 - DNA, 16 bp, Homo sapiens
ctctttgtaatttaat

SEQ ID NO: 6136921 - DNA, 20 bp, Homo sapiens
ctctttgtaatttaatgaaa

SEQ ID NO: 6136922 - DNA, 22 bp, Homo sapiens
ctctttgtaatttaatgaaaag

SEQ ID NO: 6136923 - DNA, 21 bp, Homo sapiens
ctctttgtcagtctgggtgtc

SEQ ID NO: 6136924 - DNA, 21 bp, Homo sapiens
ctctttgtcccggataggcta

SEQ ID NO: 6136925 - DNA, 20 bp, Homo sapiens
ctctttgtcctgaatggctt

SEQ ID NO: 6136926 - DNA, 21 bp, Homo sapiens
ctatcactgacacatcagcat

SEQ ID NO: 6136927 - DNA, 13 bp, Homo sapiens
ctatcactgcatt

SEQ ID NO: 6136928 - DNA, 22 bp, Homo sapiens
ctatcactgcattatcttgctc

SEQ ID NO: 6136929 - DNA, 12 bp, Homo sapiens
ctatcactgtct

SEQ ID NO: 6136930 - DNA, 18 bp, Homo sapiens
ctatcagactaagccagc

SEQ ID NO: 6136931 - DNA, 18 bp, Homo sapiens
ctatcagagtatccactg

SEQ ID NO: 6136932 - DNA, 21 bp, Homo sapiens
ctatcagcaatactcatcaga

SEQ ID NO: 6136933 - DNA, 21 bp, Homo sapiens
ctatcagcagcggcagcagca

SEQ ID NO: 6136934 - DNA, 19 bp, Homo sapiens
ctatcagcagctagaaaac

SEQ ID NO: 6136935 - DNA, 15 bp, Homo sapiens
ctatcagcctgtctc

SEQ ID NO: 6136936 - DNA, 21 bp, Homo sapiens
ctatcaggcagaagaatcttt

SEQ ID NO: 6136937 - DNA, 14 bp, Homo sapiens
ctatcagggaggaa

SEQ ID NO: 6136938 - DNA, 22 bp, Homo sapiens
ctatcagggcaagctcatagca

SEQ ID NO: 6136939 - DNA, 16 bp, Homo sapiens
ctatcaggtaataaaa

SEQ ID NO: 6136940 - DNA, 22 bp, Homo sapiens
ctatcaggtgcccctcttccaa

SEQ ID NO: 6136941 - DNA, 16 bp, Homo sapiens
ctatcagtacttttat

SEQ ID NO: 6136942 - DNA, 20 bp, Homo sapiens
ctatcagtacttttattaat

SEQ ID NO: 6136943 - DNA, 24 bp, Homo sapiens
ctatcagtgttcttctcaaggaca

SEQ ID NO: 6136944 - DNA, 17 bp, Homo sapiens
ctatcagttgatttttc

SEQ ID NO: 6136945 - DNA, 23 bp, Homo sapiens
ctatcatagtcaccattttctca

SEQ ID NO: 6136946 - DNA, 22 bp, Homo sapiens
ctatcatggtgaaaagctccat

SEQ ID NO: 6136947 - DNA, 16 bp, Homo sapiens
ctatcattaaagttct

SEQ ID NO: 6136948 - DNA, 17 bp, Homo sapiens
ctatcattaaagttcta

SEQ ID NO: 6136949 - DNA, 18 bp, Homo sapiens
ctatcattgcttcctcct

SEQ ID NO: 6136950 - DNA, 20 bp, Homo sapiens
ctatcattgcttcctcctcc

SEQ ID NO: 6136951 - DNA, 15 bp, Homo sapiens
ctatcatttaataat

SEQ ID NO: 6136952 - DNA, 17 bp, Homo sapiens
ctatcatttaataatat

SEQ ID NO: 6136953 - DNA, 12 bp, Homo sapiens
ctatcatttctt

SEQ ID NO: 6136954 - DNA, 19 bp, Homo sapiens
ctatcatttcttttccaaa

SEQ ID NO: 6136955 - DNA, 17 bp, Homo sapiens
ctatccaaaataaagat

SEQ ID NO: 6136956 - DNA, 14 bp, Homo sapiens
ctatccaaacatgt

SEQ ID NO: 6136957 - DNA, 19 bp, Homo sapiens
ctatccaaacatgtattta

SEQ ID NO: 6136958 - DNA, 14 bp, Homo sapiens
ctatccaaaggaat

SEQ ID NO: 6136959 - DNA, 15 bp, Homo sapiens
ctatccaaagtgtca

SEQ ID NO: 6136960 - DNA, 20 bp, Homo sapiens
ctatccaatcaatcttgcat

SEQ ID NO: 6136961 - DNA, 23 bp, Homo sapiens
ctatccaatcaatcttgcatgta

SEQ ID NO: 6136962 - DNA, 13 bp, Homo sapiens
ctatccacactgt

SEQ ID NO: 6136963 - DNA, 18 bp, Homo sapiens
ctatccacagaacctttg

SEQ ID NO: 6136964 - DNA, 18 bp, Homo sapiens
ctatccaccaccccaccc

SEQ ID NO: 6136965 - DNA, 13 bp, Homo sapiens
ctatccacccagc

SEQ ID NO: 6136966 - DNA, 14 bp, Homo sapiens
ctatccacctgggg

SEQ ID NO: 6136967 - DNA, 19 bp, Homo sapiens
ctatccagccgcaaatcca

SEQ ID NO: 6136968 - DNA, 21 bp, Homo sapiens
ctatccagtgatcctcaaaca

SEQ ID NO: 6136969 - DNA, 12 bp, Homo sapiens
ctatccatcctg

SEQ ID NO: 6136970 - DNA, 16 bp, Homo sapiens
ctatccattctctcct

SEQ ID NO: 6136971 - DNA, 13 bp, Homo sapiens
ctatcccacttca

SEQ ID NO: 6136972 - DNA, 13 bp, Homo sapiens
ctatcccatccca

SEQ ID NO: 6136973 - DNA, 15 bp, Homo sapiens
ctatccccaagctgg

SEQ ID NO: 6136974 - DNA, 17 bp, Homo sapiens
ctatccccaatcagctc

SEQ ID NO: 6136975 - DNA, 18 bp, Homo sapiens
ctatccccaatcagctcc

SEQ ID NO: 6136976 - DNA, 13 bp, Homo sapiens
ctatcccccttaa

SEQ ID NO: 6136977 - DNA, 18 bp, Homo sapiens
ctatcccccttaaagaaa

SEQ ID NO: 6136978 - DNA, 23 bp, Homo sapiens
ctatccccggacgcatgcagggc

SEQ ID NO: 6136979 - DNA, 18 bp, Homo sapiens
ctatccctctaagagtat

SEQ ID NO: 6136980 - DNA, 19 bp, Homo sapiens
ctatccctgcacataaact

SEQ ID NO: 6136981 - DNA, 23 bp, Homo sapiens
ctatccctggacgcatgcagggc

SEQ ID NO: 6136982 - DNA, 13 bp, Homo sapiens
ctatccctggcca

SEQ ID NO: 6136983 - DNA, 14 bp, Homo sapiens
ctatccctggccac

SEQ ID NO: 6136984 - DNA, 22 bp, Homo sapiens
ctatccctggccacctgccagg

SEQ ID NO: 6136985 - DNA, 17 bp, Homo sapiens
ctatccgctgccagcct

SEQ ID NO: 6136986 - DNA, 20 bp, Homo sapiens
ctatccggacagagcacgtt

SEQ ID NO: 6136987 - DNA, 15 bp, Homo sapiens
ctatcctagagaggc

SEQ ID NO: 6136988 - DNA, 20 bp, Homo sapiens
ctatcctagagaggctggca

SEQ ID NO: 6136989 - DNA, 17 bp, Homo sapiens
ctatcctagtcttcaca

SEQ ID NO: 6136990 - DNA, 15 bp, Homo sapiens
ctatcctatgccttc

SEQ ID NO: 6136991 - DNA, 19 bp, Homo sapiens
ctatcctatgccttcaaat

SEQ ID NO: 6136992 - DNA, 14 bp, Homo sapiens
ctatcctcactgcc

SEQ ID NO: 6136993 - DNA, 11 bp, Homo sapiens
ctatcctcccc

SEQ ID NO: 6136994 - DNA, 23 bp, Homo sapiens
ctatcctccccttttaccactcc

SEQ ID NO: 6136995 - DNA, 16 bp, Homo sapiens
ctatcctctcttcctc

SEQ ID NO: 6136996 - DNA, 16 bp, Homo sapiens
ctatcctgattccaaa

SEQ ID NO: 6136997 - DNA, 20 bp, Homo sapiens
ctatcctgcaatttctcccg

SEQ ID NO: 6136998 - DNA, 20 bp, Homo sapiens
ctatcctgcaggaaatataa

SEQ ID NO: 6136999 - DNA, 17 bp, Homo sapiens
ctatcctgcgggtttta

SEQ ID NO: 6137000 - DNA, 19 bp, Homo sapiens
ctatcctggctctttggag

SEQ ID NO: 6137001 - DNA, 14 bp, Homo sapiens
ctatcctggctttg

SEQ ID NO: 6137002 - DNA, 19 bp, Homo sapiens
ctatcctggctttgcccaa

SEQ ID NO: 6137003 - DNA, 17 bp, Homo sapiens
ctatcctgtgaggcttt

SEQ ID NO: 6137004 - DNA, 13 bp, Homo sapiens
ctatcctgtttaa

SEQ ID NO: 6137005 - DNA, 19 bp, Homo sapiens
ctatccttccagtggctcg

SEQ ID NO: 6137006 - DNA, 12 bp, Homo sapiens
ctatccttcgtg

SEQ ID NO: 6137007 - DNA, 12 bp, Homo sapiens
ctatccttggca

SEQ ID NO: 6137008 - DNA, 12 bp, Homo sapiens
ctatccttggct

SEQ ID NO: 6137009 - DNA, 13 bp, Homo sapiens
ctatcctttcaaa

SEQ ID NO: 6137010 - DNA, 20 bp, Homo sapiens
ctatcgagtttgcaatgtca

SEQ ID NO: 6137011 - DNA, 17 bp, Homo sapiens
ctatcgatctggaaaga

SEQ ID NO: 6137012 - DNA, 18 bp, Homo sapiens
ctatcgatctggaaagag

SEQ ID NO: 6137013 - DNA, 16 bp, Homo sapiens
ctatcgccctcctttc

SEQ ID NO: 6137014 - DNA, 21 bp, Homo sapiens
ctatcgccctcctttccctta

SEQ ID NO: 6137015 - DNA, 16 bp, Homo sapiens
ctatcgggggtgagcg

SEQ ID NO: 6137016 - DNA, 18 bp, Homo sapiens
ctatcgtaaaattaagaa

SEQ ID NO: 6137017 - DNA, 17 bp, Homo sapiens
ctatcgttattataaat

SEQ ID NO: 6137018 - DNA, 20 bp, Homo sapiens
ctatcgttctctctttgcat

SEQ ID NO: 6137019 - DNA, 14 bp, Homo sapiens
ctatctaaagtttg

SEQ ID NO: 6137020 - DNA, 13 bp, Homo sapiens
ctatctaacactt

SEQ ID NO: 6137021 - DNA, 21 bp, Homo sapiens
ctatctaatcagatcttcttt

SEQ ID NO: 6137022 - DNA, 16 bp, Homo sapiens
ctatctaatccttaaa

SEQ ID NO: 6137023 - DNA, 14 bp, Homo sapiens
ctatctacaaaaat

SEQ ID NO: 6137024 - DNA, 16 bp, Homo sapiens
ctatctactaagtttc

SEQ ID NO: 6137025 - DNA, 21 bp, Homo sapiens
ctatctactaccagaagggct

SEQ ID NO: 6137026 - DNA, 17 bp, Homo sapiens
ctatctactctcctcat

SEQ ID NO: 6137027 - DNA, 17 bp, Homo sapiens
ctatctagcatttattt

SEQ ID NO: 6137028 - DNA, 19 bp, Homo sapiens
ctatctagcatttatttct

SEQ ID NO: 6137029 - DNA, 22 bp, Homo sapiens
ctatctagggagccctgggcca

SEQ ID NO: 6137030 - DNA, 19 bp, Homo sapiens
ctatctatacctgcctttt

SEQ ID NO: 6137031 - DNA, 17 bp, Homo sapiens
ctatctatcctgaatct

SEQ ID NO: 6137032 - DNA, 18 bp, Homo sapiens
ctatctatgaacaacagt

SEQ ID NO: 6137033 - DNA, 16 bp, Homo sapiens
ctatctattaaagtga

SEQ ID NO: 6137034 - DNA, 17 bp, Homo sapiens
ctatctattaaagtgac

SEQ ID NO: 6137035 - DNA, 18 bp, Homo sapiens
ctatctattaaagtgact

SEQ ID NO: 6137036 - DNA, 13 bp, Homo sapiens
ctatctatttgag

SEQ ID NO: 6137037 - DNA, 15 bp, Homo sapiens
ctatctcaactctgt

SEQ ID NO: 6137038 - DNA, 18 bp, Homo sapiens
ctatctcaatcctaattt

SEQ ID NO: 6137039 - DNA, 14 bp, Homo sapiens
ctatctcacagcac

SEQ ID NO: 6137040 - DNA, 15 bp, Homo sapiens
ctatctcagccatag

SEQ ID NO: 6137041 - DNA, 12 bp, Homo sapiens
ctatctcaggga

SEQ ID NO: 6137042 - DNA, 14 bp, Homo sapiens
ctatctcagggagg

SEQ ID NO: 6137043 - DNA, 15 bp, Homo sapiens
ctatctcagggaggg

SEQ ID NO: 6137044 - DNA, 21 bp, Homo sapiens
ctatctcagggagggaagggg

SEQ ID NO: 6137045 - DNA, 21 bp, Homo sapiens
ctatctcatctatctcaatcc

SEQ ID NO: 6137046 - DNA, 17 bp, Homo sapiens
ctatctcatctgtctcg

SEQ ID NO: 6137047 - DNA, 21 bp, Homo sapiens
ctatctcatgccagtgcctta

SEQ ID NO: 6137048 - DNA, 12 bp, Homo sapiens
ctatctccccca

SEQ ID NO: 6137049 - DNA, 16 bp, Homo sapiens
ctatctcccccaaccc

SEQ ID NO: 6137050 - DNA, 23 bp, Homo sapiens
ctatctcccccaacccacctctg

SEQ ID NO: 6137051 - DNA, 16 bp, Homo sapiens
ctatctcccccagccc

SEQ ID NO: 6137052 - DNA, 18 bp, Homo sapiens
ctatctccgttccatctg

SEQ ID NO: 6137053 - DNA, 21 bp, Homo sapiens
ctatctcctaactttggacct

SEQ ID NO: 6137054 - DNA, 15 bp, Homo sapiens
ctatctcctagggct

SEQ ID NO: 6137055 - DNA, 12 bp, Homo sapiens
ctatctcctgac

SEQ ID NO: 6137056 - DNA, 19 bp, Homo sapiens
ctatctcctgacagaaggt

SEQ ID NO: 6137057 - DNA, 20 bp, Homo sapiens
ctatctccttcccaccccta

SEQ ID NO: 6137058 - DNA, 17 bp, Homo sapiens
ctatctcgtgggagagc

SEQ ID NO: 6137059 - DNA, 13 bp, Homo sapiens
ctatctctatata

SEQ ID NO: 6137060 - DNA, 19 bp, Homo sapiens
ctatctctatataaaaaat

SEQ ID NO: 6137061 - DNA, 20 bp, Homo sapiens
ctatctctcaagagtgctga

SEQ ID NO: 6137062 - DNA, 17 bp, Homo sapiens
ctatctctgtgtgcaca

SEQ ID NO: 6137063 - DNA, 14 bp, Homo sapiens
ctatctctttatat

SEQ ID NO: 6137064 - DNA, 12 bp, Homo sapiens
ctatctctttct

SEQ ID NO: 6137065 - DNA, 23 bp, Homo sapiens
ctatctgagactataactgtcat

SEQ ID NO: 6137066 - DNA, 14 bp, Homo sapiens
ctatctgagtgaat

SEQ ID NO: 6137067 - DNA, 16 bp, Homo sapiens
ctatctgagtgaatta

SEQ ID NO: 6137068 - DNA, 22 bp, Homo sapiens
ctatctgcaatgtttttgtgta

SEQ ID NO: 6137069 - DNA, 17 bp, Homo sapiens
ctatctgcatttataaa

SEQ ID NO: 6137070 - DNA, 13 bp, Homo sapiens
ctatctgcctgac

SEQ ID NO: 6137071 - DNA, 14 bp, Homo sapiens
ctatctgcctggag

SEQ ID NO: 6137072 - DNA, 16 bp, Homo sapiens
ctatctgcctggaggc

SEQ ID NO: 6137073 - DNA, 17 bp, Homo sapiens
ctatctgcctggaggca

SEQ ID NO: 6137074 - DNA, 15 bp, Homo sapiens
ctatctgctgggctg

SEQ ID NO: 6137075 - DNA, 14 bp, Homo sapiens
ctatctggaaaaaa

SEQ ID NO: 6137076 - DNA, 20 bp, Homo sapiens
ctatctggaaaaaaaaaaat

SEQ ID NO: 6137077 - DNA, 22 bp, Homo sapiens
ctatctggaaaaaaaaaaatat

SEQ ID NO: 6137078 - DNA, 16 bp, Homo sapiens
ctatctgggaagctat

SEQ ID NO: 6137079 - DNA, 13 bp, Homo sapiens
ctatctgggcctg

SEQ ID NO: 6137080 - DNA, 18 bp, Homo sapiens
ctatctgggcttcctgga

SEQ ID NO: 6137081 - DNA, 19 bp, Homo sapiens
ctatctgggcttcctggag

SEQ ID NO: 6137082 - DNA, 23 bp, Homo sapiens
ctatctgggcttcctggagcaga

SEQ ID NO: 6137083 - DNA, 20 bp, Homo sapiens
ctatctggtattaaatgcca

SEQ ID NO: 6137084 - DNA, 21 bp, Homo sapiens
ctatctggtattaaatgccaa

SEQ ID NO: 6137085 - DNA, 22 bp, Homo sapiens
ctatctggtcaacctcctggac

SEQ ID NO: 6137086 - DNA, 12 bp, Homo sapiens
ctatctgtaaga

SEQ ID NO: 6137087 - DNA, 17 bp, Homo sapiens
ctatctgtattcccaaa

SEQ ID NO: 6137088 - DNA, 15 bp, Homo sapiens
ctatctgtattggca

SEQ ID NO: 6137089 - DNA, 16 bp, Homo sapiens
ctatctgtatttatta

SEQ ID NO: 6137090 - DNA, 17 bp, Homo sapiens
ctatctgtattttcatt

SEQ ID NO: 6137091 - DNA, 21 bp, Homo sapiens
ctatctgtcatctctctgggg

SEQ ID NO: 6137092 - DNA, 22 bp, Homo sapiens
ctatctgtcatctctctggggc

SEQ ID NO: 6137093 - DNA, 11 bp, Homo sapiens
ctatctgtctg

SEQ ID NO: 6137094 - DNA, 14 bp, Homo sapiens
ctatctgtgattcc

SEQ ID NO: 6137095 - DNA, 23 bp, Homo sapiens
ctatctgttcccctgtcctgtga

SEQ ID NO: 6137096 - DNA, 17 bp, Homo sapiens
ctatctgtttacagtgt

SEQ ID NO: 6137097 - DNA, 16 bp, Homo sapiens
ctatcttcatgtaaat

SEQ ID NO: 6137098 - DNA, 17 bp, Homo sapiens
ctatcttcatgtaaatt

SEQ ID NO: 6137099 - DNA, 13 bp, Homo sapiens
ctatcttccaaac

SEQ ID NO: 6137100 - DNA, 15 bp, Homo sapiens
ctatcttctttggac

SEQ ID NO: 6137101 - DNA, 18 bp, Homo sapiens
ctatcttctttggacttc

SEQ ID NO: 6137102 - DNA, 13 bp, Homo sapiens
ctatcttggagag

SEQ ID NO: 6137103 - DNA, 21 bp, Homo sapiens
ctatcttggagagctggggac

SEQ ID NO: 6137104 - DNA, 15 bp, Homo sapiens
ctatcttgtcctgga

SEQ ID NO: 6137105 - DNA, 17 bp, Homo sapiens
ctatcttgtcctggaat

SEQ ID NO: 6137106 - DNA, 16 bp, Homo sapiens
ctctttgtctaaaaca

SEQ ID NO: 6137107 - DNA, 23 bp, Homo sapiens
ctctttgtctacaccattatgtg

SEQ ID NO: 6137108 - DNA, 13 bp, Homo sapiens
ctctttgtgaaat

SEQ ID NO: 6137109 - DNA, 14 bp, Homo sapiens
ctctttgtggcagt

SEQ ID NO: 6137110 - DNA, 23 bp, Homo sapiens
ctctttgtggcagtggccaggca

SEQ ID NO: 6137111 - DNA, 22 bp, Homo sapiens
ctctttgtgggtttttcatctt

SEQ ID NO: 6137112 - DNA, 20 bp, Homo sapiens
ctctttgtgtttttgttgtt

SEQ ID NO: 6137113 - DNA, 21 bp, Homo sapiens
ctctttgtgtttttgttgttg

SEQ ID NO: 6137114 - DNA, 12 bp, Homo sapiens
ctctttgttcat

SEQ ID NO: 6137115 - DNA, 20 bp, Homo sapiens
ctctttgttctaaagatgga

SEQ ID NO: 6137116 - DNA, 15 bp, Homo sapiens
ctctttgtttctgtt

SEQ ID NO: 6137117 - DNA, 18 bp, Homo sapiens
ctctttgttttgtgtctc

SEQ ID NO: 6137118 - DNA, 14 bp, Homo sapiens
ctctttgtttttct

SEQ ID NO: 6137119 - DNA, 16 bp, Homo sapiens
ctcttttaaaatatcc

SEQ ID NO: 6137120 - DNA, 16 bp, Homo sapiens
ctcttttaaatcagat

SEQ ID NO: 6137121 - DNA, 21 bp, Homo sapiens
ctcttttacaatcctaatcat

SEQ ID NO: 6137122 - DNA, 19 bp, Homo sapiens
ctcttttaccaacttcctc

SEQ ID NO: 6137123 - DNA, 14 bp, Homo sapiens
ctcttttacctgct

SEQ ID NO: 6137124 - DNA, 16 bp, Homo sapiens
ctcttttattctgtta

SEQ ID NO: 6137125 - DNA, 15 bp, Homo sapiens
ctcttttcacatttt

SEQ ID NO: 6137126 - DNA, 16 bp, Homo sapiens
ctcttttccaaacaca

SEQ ID NO: 6137127 - DNA, 19 bp, Homo sapiens
ctcttttcccactcccttt

SEQ ID NO: 6137128 - DNA, 12 bp, Homo sapiens
ctcttttccccg

SEQ ID NO: 6137129 - DNA, 19 bp, Homo sapiens
ctcttttcccctttcctgt

SEQ ID NO: 6137130 - DNA, 22 bp, Homo sapiens
ctcttttccctcctttcctttt

SEQ ID NO: 6137131 - DNA, 16 bp, Homo sapiens
ctcttttccctctcta

SEQ ID NO: 6137132 - DNA, 13 bp, Homo sapiens
ctcttttcctctc

SEQ ID NO: 6137133 - DNA, 16 bp, Homo sapiens
ctcttttcctggcagc

SEQ ID NO: 6137134 - DNA, 21 bp, Homo sapiens
ctcttttcctggcagctgctg

SEQ ID NO: 6137135 - DNA, 23 bp, Homo sapiens
ctcttttctaagtggcgtgtgca

SEQ ID NO: 6137136 - DNA, 20 bp, Homo sapiens
ctcttttctacacactcagc

SEQ ID NO: 6137137 - DNA, 22 bp, Homo sapiens
ctcttttctacacactcagcca

SEQ ID NO: 6137138 - DNA, 13 bp, Homo sapiens
ctcttttctctac

SEQ ID NO: 6137139 - DNA, 11 bp, Homo sapiens
ctcttttctgg

SEQ ID NO: 6137140 - DNA, 20 bp, Homo sapiens
ctcttttcttactcctcctc

SEQ ID NO: 6137141 - DNA, 21 bp, Homo sapiens
ctcttttcttactcctcctct

SEQ ID NO: 6137142 - DNA, 13 bp, Homo sapiens
ctcttttgaaagt

SEQ ID NO: 6137143 - DNA, 21 bp, Homo sapiens
ctcttttgaagtgttttagtc

SEQ ID NO: 6137144 - DNA, 14 bp, Homo sapiens
ctcttttgctctct

SEQ ID NO: 6137145 - DNA, 14 bp, Homo sapiens
ctcttttggccttg

SEQ ID NO: 6137146 - DNA, 15 bp, Homo sapiens
ctcttttggccttgt

SEQ ID NO: 6137147 - DNA, 10 bp, Homo sapiens
ctcttttgta

SEQ ID NO: 6137148 - DNA, 13 bp, Homo sapiens
ctcttttgtgatg

SEQ ID NO: 6137149 - DNA, 23 bp, Homo sapiens
ctcttttgttcctggctttgaca

SEQ ID NO: 6137150 - DNA, 16 bp, Homo sapiens
ctcttttgttgtcctt

SEQ ID NO: 6137151 - DNA, 15 bp, Homo sapiens
ctctttttatcgcca

SEQ ID NO: 6137152 - DNA, 19 bp, Homo sapiens
ctctttttatttaaatgtg

SEQ ID NO: 6137153 - DNA, 20 bp, Homo sapiens
ctctttttatttaaatgtga

SEQ ID NO: 6137154 - DNA, 13 bp, Homo sapiens
ctctttttcctcc

SEQ ID NO: 6137155 - DNA, 18 bp, Homo sapiens
ctctttttccttcttcag

SEQ ID NO: 6137156 - DNA, 18 bp, Homo sapiens
ctctttttctgtgtgagg

SEQ ID NO: 6137157 - DNA, 18 bp, Homo sapiens
ctctttttgccctttagg

SEQ ID NO: 6137158 - DNA, 20 bp, Homo sapiens
ctctttttggactcagccca

SEQ ID NO: 6137159 - DNA, 21 bp, Homo sapiens
ctctttttggactcagcccac

SEQ ID NO: 6137160 - DNA, 16 bp, Homo sapiens
ctctttttgtattttg

SEQ ID NO: 6137161 - DNA, 23 bp, Homo sapiens
ctctttttgttgttgttgttctt

SEQ ID NO: 6137162 - DNA, 15 bp, Homo sapiens
ctcttttttaaaaac

SEQ ID NO: 6137163 - DNA, 13 bp, Homo sapiens
ctcttttttaagt

SEQ ID NO: 6137164 - DNA, 14 bp, Homo sapiens
ctcttttttacaaa

SEQ ID NO: 6137165 - DNA, 18 bp, Homo sapiens
ctcttttttactcattga

SEQ ID NO: 6137166 - DNA, 22 bp, Homo sapiens
ctcttttttactcattgaaatg

SEQ ID NO: 6137167 - DNA, 19 bp, Homo sapiens
ctcttttttattctgtttt

SEQ ID NO: 6137168 - DNA, 17 bp, Homo sapiens
ctcttttttcgtttgtt

SEQ ID NO: 6137169 - DNA, 16 bp, Homo sapiens
ctcttttttgggggga

SEQ ID NO: 6137170 - DNA, 19 bp, Homo sapiens
ctcttttttgtttgtttct

SEQ ID NO: 6137171 - DNA, 20 bp, Homo sapiens
ctcttttttgtttgtttctt

SEQ ID NO: 6137172 - DNA, 15 bp, Homo sapiens
ctctttttttaaaaa

SEQ ID NO: 6137173 - DNA, 13 bp, Homo sapiens
ctctttttttcct

SEQ ID NO: 6137174 - DNA, 14 bp, Homo sapiens
ctctttttttcttt

SEQ ID NO: 6137175 - DNA, 16 bp, Homo sapiens
ctctttttttgagtga

SEQ ID NO: 6137176 - DNA, 18 bp, Homo sapiens
ctctttttttggcccagg

SEQ ID NO: 6137177 - DNA, 23 bp, Homo sapiens
ctcttttttttttttttttagat

SEQ ID NO: 6137178 - DNA, 18 bp, Homo sapiens
ctgaaaaaaaaaaagaag

SEQ ID NO: 6137179 - DNA, 20 bp, Homo sapiens
ctgaaaaaaaaaaagaagaa

SEQ ID NO: 6137180 - DNA, 21 bp, Homo sapiens
ctgaaaaaaaaaaagaagaag

SEQ ID NO: 6137181 - DNA, 21 bp, Homo sapiens
ctgaaaaaacacctagcttta

SEQ ID NO: 6137182 - DNA, 22 bp, Homo sapiens
ctgaaaaaacacctagctttat

SEQ ID NO: 6137183 - DNA, 13 bp, Homo sapiens
ctgaaaaaatact

SEQ ID NO: 6137184 - DNA, 19 bp, Homo sapiens
ctgaaaaaatgctgagcca

SEQ ID NO: 6137185 - DNA, 12 bp, Homo sapiens
ctgaaaaaatgt

SEQ ID NO: 6137186 - DNA, 17 bp, Homo sapiens
ctgaaaaaatgtagctt

SEQ ID NO: 6137187 - DNA, 19 bp, Homo sapiens
ctgaaaaacacaacttgtg

SEQ ID NO: 6137188 - DNA, 15 bp, Homo sapiens
ctgaaaaagacataa

SEQ ID NO: 6137189 - DNA, 21 bp, Homo sapiens
ctgaaaaagacataaaacaga

SEQ ID NO: 6137190 - DNA, 14 bp, Homo sapiens
ctgaaaaaggaact

SEQ ID NO: 6137191 - DNA, 14 bp, Homo sapiens
ctgaaaaagtgttt

SEQ ID NO: 6137192 - DNA, 17 bp, Homo sapiens
ctgaaaaagtgttttta

SEQ ID NO: 6137193 - DNA, 20 bp, Homo sapiens
ctgaaaaatgcctgctgctg

SEQ ID NO: 6137194 - DNA, 21 bp, Homo sapiens
ctgaaaaatgcctgctgctgc

SEQ ID NO: 6137195 - DNA, 13 bp, Homo sapiens
ctgaaaaatggga

SEQ ID NO: 6137196 - DNA, 21 bp, Homo sapiens
ctgaaaaatggtaattgttgc

SEQ ID NO: 6137197 - DNA, 14 bp, Homo sapiens
ctgaaaaatgtcag

SEQ ID NO: 6137198 - DNA, 15 bp, Homo sapiens
ctgaaaaattccttt

SEQ ID NO: 6137199 - DNA, 22 bp, Homo sapiens
ctgaaaacaatggagtattctc

SEQ ID NO: 6137200 - DNA, 17 bp, Homo sapiens
ctgaaaacactgtgcac

SEQ ID NO: 6137201 - DNA, 24 bp, Homo sapiens
ctgaaaacagtaaaacaggctgct

SEQ ID NO: 6137202 - DNA, 20 bp, Homo sapiens
ctgaaaacataaaaagttaa

SEQ ID NO: 6137203 - DNA, 19 bp, Homo sapiens
ctgaaaacatctagcccaa

SEQ ID NO: 6137204 - DNA, 21 bp, Homo sapiens
ctgaaaaccatctggcctggc

SEQ ID NO: 6137205 - DNA, 14 bp, Homo sapiens
ctgaaaacccagag

SEQ ID NO: 6137206 - DNA, 15 bp, Homo sapiens
ctgaaaacctctcct

SEQ ID NO: 6137207 - DNA, 16 bp, Homo sapiens
ctgaaaacggccctct

SEQ ID NO: 6137208 - DNA, 12 bp, Homo sapiens
ctgaaaactaat

SEQ ID NO: 6137209 - DNA, 19 bp, Homo sapiens
ctgaaaactaatgtactgt

SEQ ID NO: 6137210 - DNA, 20 bp, Homo sapiens
ctgaaaactaatgtactgta

SEQ ID NO: 6137211 - DNA, 21 bp, Homo sapiens
ctgaaaactcattagagatgt

SEQ ID NO: 6137212 - DNA, 15 bp, Homo sapiens
ctgaaaactgaatgt

SEQ ID NO: 6137213 - DNA, 22 bp, Homo sapiens
ctgaaaactggaataagaagca

SEQ ID NO: 6137214 - DNA, 15 bp, Homo sapiens
ctgaaaactgtaaat

SEQ ID NO: 6137215 - DNA, 13 bp, Homo sapiens
ctgaaaactgttt

SEQ ID NO: 6137216 - DNA, 14 bp, Homo sapiens
ctgaaaagaaataa

SEQ ID NO: 6137217 - DNA, 18 bp, Homo sapiens
ctgaaaagaaggaaagat

SEQ ID NO: 6137218 - DNA, 16 bp, Homo sapiens
ctgaaaagaaggaata

SEQ ID NO: 6137219 - DNA, 19 bp, Homo sapiens
ctgaaaagactcagtgttc

SEQ ID NO: 6137220 - DNA, 21 bp, Homo sapiens
ctgaaaagcaattgccctgta

SEQ ID NO: 6137221 - DNA, 14 bp, Homo sapiens
ctgaaaagctgcat

SEQ ID NO: 6137222 - DNA, 18 bp, Homo sapiens
ctgaaaagctgtgtactt

SEQ ID NO: 6137223 - DNA, 19 bp, Homo sapiens
ctgaaaagggcactcccaa

SEQ ID NO: 6137224 - DNA, 19 bp, Homo sapiens
ctgaaaagggcggaagagt

SEQ ID NO: 6137225 - DNA, 22 bp, Homo sapiens
ctgaaaagtgtgtatatatttt

SEQ ID NO: 6137226 - DNA, 21 bp, Homo sapiens
ctgaaaatacaaaaattagct

SEQ ID NO: 6137227 - DNA, 18 bp, Homo sapiens
ctgaaaataccatcaggc

SEQ ID NO: 6137228 - DNA, 15 bp, Homo sapiens
ctgaaaatataacca

SEQ ID NO: 6137229 - DNA, 17 bp, Homo sapiens
ctgaaaatatctcttgt

SEQ ID NO: 6137230 - DNA, 17 bp, Homo sapiens
ctgaaaatattgtttta

SEQ ID NO: 6137231 - DNA, 20 bp, Homo sapiens
ctgaaaatatttttttctag

SEQ ID NO: 6137232 - DNA, 22 bp, Homo sapiens
ctgaaaatatttttttctagct

SEQ ID NO: 6137233 - DNA, 12 bp, Homo sapiens
ctgaaaatcact

SEQ ID NO: 6137234 - DNA, 20 bp, Homo sapiens
ctgaaaatccaataatcaga

SEQ ID NO: 6137235 - DNA, 21 bp, Homo sapiens
ctgaaaatcctcgcacacact

SEQ ID NO: 6137236 - DNA, 20 bp, Homo sapiens
ctgaaaatgcaaagctgaag

SEQ ID NO: 6137237 - DNA, 12 bp, Homo sapiens
ctgaaaatggtg

SEQ ID NO: 6137238 - DNA, 14 bp, Homo sapiens
ctgaaaatgtatgt

SEQ ID NO: 6137239 - DNA, 17 bp, Homo sapiens
ctgaaaatgtccttgtg

SEQ ID NO: 6137240 - DNA, 18 bp, Homo sapiens
ctgaaaatgtccttgtga

SEQ ID NO: 6137241 - DNA, 13 bp, Homo sapiens
ctgaaaatgtgaa

SEQ ID NO: 6137242 - DNA, 12 bp, Homo sapiens
ctgaaaatgtgc

SEQ ID NO: 6137243 - DNA, 13 bp, Homo sapiens
ctgaaaatgtgta

SEQ ID NO: 6137244 - DNA, 12 bp, Homo sapiens
ctgaaaatgtta

SEQ ID NO: 6137245 - DNA, 14 bp, Homo sapiens
ctgaaaatgtttaa

SEQ ID NO: 6137246 - DNA, 22 bp, Homo sapiens
ctgaaaatgtttttctgccagg

SEQ ID NO: 6137247 - DNA, 17 bp, Homo sapiens
ctgaaaattaaatttta

SEQ ID NO: 6137248 - DNA, 13 bp, Homo sapiens
ctgaaaattctgg

SEQ ID NO: 6137249 - DNA, 16 bp, Homo sapiens
ctgaaaattctggaag

SEQ ID NO: 6137250 - DNA, 15 bp, Homo sapiens
ctgaaaattgccttt

SEQ ID NO: 6137251 - DNA, 13 bp, Homo sapiens
ctgaaaatttaac

SEQ ID NO: 6137252 - DNA, 13 bp, Homo sapiens
ctgaaaatttata

SEQ ID NO: 6137253 - DNA, 18 bp, Homo sapiens
ctgaaaatttatataact

SEQ ID NO: 6137254 - DNA, 17 bp, Homo sapiens
ctgaaacaaaaattgtc

SEQ ID NO: 6137255 - DNA, 20 bp, Homo sapiens
ctgaaacaaaaattgtcttt

SEQ ID NO: 6137256 - DNA, 23 bp, Homo sapiens
ctgaaacaaaaattgtctttatg

SEQ ID NO: 6137257 - DNA, 15 bp, Homo sapiens
ctgaaacaacaaata

SEQ ID NO: 6137258 - DNA, 20 bp, Homo sapiens
ctgaaacaacttggaaagat

SEQ ID NO: 6137259 - DNA, 23 bp, Homo sapiens
ctgaaacacacgagcaaacccag

SEQ ID NO: 6137260 - DNA, 20 bp, Homo sapiens
ctgaaacacgaaacttgtta

SEQ ID NO: 6137261 - DNA, 18 bp, Homo sapiens
ctgaaacactggacctgg

SEQ ID NO: 6137262 - DNA, 20 bp, Homo sapiens
ctgaaacactggacctgggg

SEQ ID NO: 6137263 - DNA, 14 bp, Homo sapiens
ctgaaacagagaac

SEQ ID NO: 6137264 - DNA, 17 bp, Homo sapiens
ctgaaacagatttcata

SEQ ID NO: 6137265 - DNA, 10 bp, Homo sapiens
ctgaaacagc

SEQ ID NO: 6137266 - DNA, 13 bp, Homo sapiens
ctgaaacagctgc

SEQ ID NO: 6137267 - DNA, 15 bp, Homo sapiens
ctgaaacatagatag

SEQ ID NO: 6137268 - DNA, 22 bp, Homo sapiens
ctgaaacatgcacattttgtac

SEQ ID NO: 6137269 - DNA, 17 bp, Homo sapiens
ctgaaacatgtgcccct

SEQ ID NO: 6137270 - DNA, 18 bp, Homo sapiens
ctgaaacatgtgcccctg

SEQ ID NO: 6137271 - DNA, 19 bp, Homo sapiens
ctgaaacatgtgcccctgc

SEQ ID NO: 6137272 - DNA, 12 bp, Homo sapiens
ctgaaaccaaaa

SEQ ID NO: 6137273 - DNA, 15 bp, Homo sapiens
ctgaaaccaaaacat

SEQ ID NO: 6137274 - DNA, 16 bp, Homo sapiens
ctgaaaccaaaacata

SEQ ID NO: 6137275 - DNA, 15 bp, Homo sapiens
ctgaaaccattttcc

SEQ ID NO: 6137276 - DNA, 22 bp, Homo sapiens
ctgaaaccattttcccatcatc

SEQ ID NO: 6137277 - DNA, 18 bp, Homo sapiens
ctgaaacccatttactta

SEQ ID NO: 6137278 - DNA, 18 bp, Homo sapiens
ctgaaacccgccctcagg

SEQ ID NO: 6137279 - DNA, 15 bp, Homo sapiens
ctgaaacctctgttc

SEQ ID NO: 6137280 - DNA, 23 bp, Homo sapiens
ctgaaaccttagtttcaagagtc

SEQ ID NO: 6137281 - DNA, 17 bp, Homo sapiens
ctgaaacctttaagaaa

SEQ ID NO: 6137282 - DNA, 18 bp, Homo sapiens
ctgaaacctttaagaaaa

SEQ ID NO: 6137283 - DNA, 15 bp, Homo sapiens
ctgaaacgccttgca

SEQ ID NO: 6137284 - DNA, 20 bp, Homo sapiens
ctgaaacgctcctttgtgtg

SEQ ID NO: 6137285 - DNA, 15 bp, Homo sapiens
ctatctttaaacatt

SEQ ID NO: 6137286 - DNA, 22 bp, Homo sapiens
ctatctttcaggaaatttttgc

SEQ ID NO: 6137287 - DNA, 18 bp, Homo sapiens
ctatcttttatttcattc

SEQ ID NO: 6137288 - DNA, 22 bp, Homo sapiens
ctatcttttgaaagtttgttct

SEQ ID NO: 6137289 - DNA, 18 bp, Homo sapiens
ctatcttttgtttccttt

SEQ ID NO: 6137290 - DNA, 19 bp, Homo sapiens
ctatcttttttagtgttaa

SEQ ID NO: 6137291 - DNA, 20 bp, Homo sapiens
ctatcttttttagtgttaaa

SEQ ID NO: 6137292 - DNA, 21 bp, Homo sapiens
ctatcttttttagtgttaaag

SEQ ID NO: 6137293 - DNA, 14 bp, Homo sapiens
ctatgaaaatcagt

SEQ ID NO: 6137294 - DNA, 21 bp, Homo sapiens
ctatgaaaatgggatgaattc

SEQ ID NO: 6137295 - DNA, 21 bp, Homo sapiens
ctatgaaacaatcttccaaag

SEQ ID NO: 6137296 - DNA, 16 bp, Homo sapiens
ctatgaaactggttta

SEQ ID NO: 6137297 - DNA, 21 bp, Homo sapiens
ctatgaaagcaacaactttgt

SEQ ID NO: 6137298 - DNA, 20 bp, Homo sapiens
ctatgaaagctatgaatgtt

SEQ ID NO: 6137299 - DNA, 16 bp, Homo sapiens
ctatgaaatactttat

SEQ ID NO: 6137300 - DNA, 13 bp, Homo sapiens
ctatgaaatgaaa

SEQ ID NO: 6137301 - DNA, 15 bp, Homo sapiens
ctatgaacaacagta

SEQ ID NO: 6137302 - DNA, 16 bp, Homo sapiens
ctatgaactgaaggca

SEQ ID NO: 6137303 - DNA, 20 bp, Homo sapiens
ctatgaacttggatattcaa

SEQ ID NO: 6137304 - DNA, 18 bp, Homo sapiens
ctatgaagactactttta

SEQ ID NO: 6137305 - DNA, 16 bp, Homo sapiens
ctatgaagccaactga

SEQ ID NO: 6137306 - DNA, 20 bp, Homo sapiens
ctatgaagccaactgacaaa

SEQ ID NO: 6137307 - DNA, 22 bp, Homo sapiens
ctatgaagggacagctgctggg

SEQ ID NO: 6137308 - DNA, 23 bp, Homo sapiens
ctatgaagggacagctgctggga

SEQ ID NO: 6137309 - DNA, 16 bp, Homo sapiens
ctatgaagttgctgtt

SEQ ID NO: 6137310 - DNA, 18 bp, Homo sapiens
ctatgaagttgctgttta

SEQ ID NO: 6137311 - DNA, 21 bp, Homo sapiens
ctatgaagttgctgtttattt

SEQ ID NO: 6137312 - DNA, 14 bp, Homo sapiens
ctatgaatgggcaa

SEQ ID NO: 6137313 - DNA, 21 bp, Homo sapiens
ctatgaattgctaattctgag

SEQ ID NO: 6137314 - DNA, 15 bp, Homo sapiens
ctatgacaaattcaa

SEQ ID NO: 6137315 - DNA, 17 bp, Homo sapiens
ctatgacaatttttgct

SEQ ID NO: 6137316 - DNA, 12 bp, Homo sapiens
ctatgacacagt

SEQ ID NO: 6137317 - DNA, 14 bp, Homo sapiens
ctatgacacatgca

SEQ ID NO: 6137318 - DNA, 14 bp, Homo sapiens
ctatgacactgagc

SEQ ID NO: 6137319 - DNA, 21 bp, Homo sapiens
ctatgacataaaaacaacttt

SEQ ID NO: 6137320 - DNA, 18 bp, Homo sapiens
ctatgacatggaggcact

SEQ ID NO: 6137321 - DNA, 14 bp, Homo sapiens
ctatgaccctgtgc

SEQ ID NO: 6137322 - DNA, 17 bp, Homo sapiens
ctatgactgctccccag

SEQ ID NO: 6137323 - DNA, 13 bp, Homo sapiens
ctatgactttttt

SEQ ID NO: 6137324 - DNA, 15 bp, Homo sapiens
ctatgacttttttaa

SEQ ID NO: 6137325 - DNA, 16 bp, Homo sapiens
ctatgagacctccccc

SEQ ID NO: 6137326 - DNA, 19 bp, Homo sapiens
ctatgagacctcccccagg

SEQ ID NO: 6137327 - DNA, 14 bp, Homo sapiens
ctatgagcatcctg

SEQ ID NO: 6137328 - DNA, 19 bp, Homo sapiens
ctatgagcatcctgagccc

SEQ ID NO: 6137329 - DNA, 22 bp, Homo sapiens
ctatgagcatcctgagccccgc

SEQ ID NO: 6137330 - DNA, 16 bp, Homo sapiens
ctatgagctaaatgtc

SEQ ID NO: 6137331 - DNA, 19 bp, Homo sapiens
ctatgaggaaactgagtca

SEQ ID NO: 6137332 - DNA, 12 bp, Homo sapiens
ctatgaggaaag

SEQ ID NO: 6137333 - DNA, 22 bp, Homo sapiens
ctatgaggaataattatttatt

SEQ ID NO: 6137334 - DNA, 13 bp, Homo sapiens
ctatgagggcctt

SEQ ID NO: 6137335 - DNA, 15 bp, Homo sapiens
ctatgagggccttga

SEQ ID NO: 6137336 - DNA, 22 bp, Homo sapiens
ctatgagggtccccgggagcac

SEQ ID NO: 6137337 - DNA, 15 bp, Homo sapiens
ctatgagggtgtttc

SEQ ID NO: 6137338 - DNA, 13 bp, Homo sapiens
ctatgagtctaga

SEQ ID NO: 6137339 - DNA, 15 bp, Homo sapiens
ctatgagtctagatg

SEQ ID NO: 6137340 - DNA, 16 bp, Homo sapiens
ctatgagtggaaaaag

SEQ ID NO: 6137341 - DNA, 17 bp, Homo sapiens
ctatgagttcacatgtg

SEQ ID NO: 6137342 - DNA, 17 bp, Homo sapiens
ctatgagttgaaatgtt

SEQ ID NO: 6137343 - DNA, 15 bp, Homo sapiens
ctatgataaagttgt

SEQ ID NO: 6137344 - DNA, 14 bp, Homo sapiens
ctatgataaattat

SEQ ID NO: 6137345 - DNA, 13 bp, Homo sapiens
ctatgatactgtc

SEQ ID NO: 6137346 - DNA, 16 bp, Homo sapiens
ctatgatactgtctct

SEQ ID NO: 6137347 - DNA, 17 bp, Homo sapiens
ctatgatactgtctctc

SEQ ID NO: 6137348 - DNA, 17 bp, Homo sapiens
ctatgatatgtgcttgt

SEQ ID NO: 6137349 - DNA, 22 bp, Homo sapiens
ctatgatatgtgcttgtgtgta

SEQ ID NO: 6137350 - DNA, 14 bp, Homo sapiens
ctatgatcacagtg

SEQ ID NO: 6137351 - DNA, 15 bp, Homo sapiens
ctatgatcacagtga

SEQ ID NO: 6137352 - DNA, 17 bp, Homo sapiens
ctatgatcacagtgact

SEQ ID NO: 6137353 - DNA, 20 bp, Homo sapiens
ctatgatccttttttgtcat

SEQ ID NO: 6137354 - DNA, 23 bp, Homo sapiens
ctatgatgaaggtaattaaagta

SEQ ID NO: 6137355 - DNA, 18 bp, Homo sapiens
ctatgatgagaggccagc

SEQ ID NO: 6137356 - DNA, 20 bp, Homo sapiens
ctatgatggaagtgttcaga

SEQ ID NO: 6137357 - DNA, 21 bp, Homo sapiens
ctatgatggatggcagactct

SEQ ID NO: 6137358 - DNA, 14 bp, Homo sapiens
ctatgatgtatact

SEQ ID NO: 6137359 - DNA, 16 bp, Homo sapiens
ctatgatgtccaaact

SEQ ID NO: 6137360 - DNA, 19 bp, Homo sapiens
ctatgatgtccaaacttaa

SEQ ID NO: 6137361 - DNA, 16 bp, Homo sapiens
ctatgatgttgctgtt

SEQ ID NO: 6137362 - DNA, 20 bp, Homo sapiens
ctatgatgtttcttttgcaa

SEQ ID NO: 6137363 - DNA, 21 bp, Homo sapiens
ctatgatgtttcttttgcaat

SEQ ID NO: 6137364 - DNA, 20 bp, Homo sapiens
ctatgattaaactgggaaat

SEQ ID NO: 6137365 - DNA, 18 bp, Homo sapiens
ctatgattatgccactgc

SEQ ID NO: 6137366 - DNA, 14 bp, Homo sapiens
ctatgattattaac

SEQ ID NO: 6137367 - DNA, 13 bp, Homo sapiens
ctatgattttcta

SEQ ID NO: 6137368 - DNA, 20 bp, Homo sapiens
ctatgcaaaaaattctttag

SEQ ID NO: 6137369 - DNA, 14 bp, Homo sapiens
ctatgcaaaaagct

SEQ ID NO: 6137370 - DNA, 23 bp, Homo sapiens
ctatgcaaaatagacatctttaa

SEQ ID NO: 6137371 - DNA, 12 bp, Homo sapiens
ctatgcaaaatg

SEQ ID NO: 6137372 - DNA, 18 bp, Homo sapiens
ctatgcaaaatgtctgtt

SEQ ID NO: 6137373 - DNA, 18 bp, Homo sapiens
ctatgcaaaccagcttta

SEQ ID NO: 6137374 - DNA, 21 bp, Homo sapiens
ctatgcaaagcactctctgca

SEQ ID NO: 6137375 - DNA, 22 bp, Homo sapiens
ctatgcaaagcactctctgcag

SEQ ID NO: 6137376 - DNA, 13 bp, Homo sapiens
ctatgcaaataaa

SEQ ID NO: 6137377 - DNA, 17 bp, Homo sapiens
ctatgcaaatgcctcca

SEQ ID NO: 6137378 - DNA, 20 bp, Homo sapiens
ctatgcaatatatctaaatt

SEQ ID NO: 6137379 - DNA, 16 bp, Homo sapiens
ctatgcaattgtacaa

SEQ ID NO: 6137380 - DNA, 23 bp, Homo sapiens
ctatgcaattgtacaaaaaagtt

SEQ ID NO: 6137381 - DNA, 13 bp, Homo sapiens
ctatgcaattttt

SEQ ID NO: 6137382 - DNA, 17 bp, Homo sapiens
ctatgcaatttttaaac

SEQ ID NO: 6137383 - DNA, 20 bp, Homo sapiens
ctatgcaatttttaaactag

SEQ ID NO: 6137384 - DNA, 18 bp, Homo sapiens
ctatgcacaacagagtaa

SEQ ID NO: 6137385 - DNA, 21 bp, Homo sapiens
ctatgcacaacagagtaacta

SEQ ID NO: 6137386 - DNA, 15 bp, Homo sapiens
ctatgcacaccaaat

SEQ ID NO: 6137387 - DNA, 17 bp, Homo sapiens
ctatgcacaccaaattg

SEQ ID NO: 6137388 - DNA, 18 bp, Homo sapiens
ctatgcacaccaaattgc

SEQ ID NO: 6137389 - DNA, 21 bp, Homo sapiens
ctatgcacaccaaattgctga

SEQ ID NO: 6137390 - DNA, 14 bp, Homo sapiens
ctatgcacagagcc

SEQ ID NO: 6137391 - DNA, 18 bp, Homo sapiens
ctatgcacagattaaact

SEQ ID NO: 6137392 - DNA, 12 bp, Homo sapiens
ctatgcacatat

SEQ ID NO: 6137393 - DNA, 18 bp, Homo sapiens
ctatgcacatatggactc

SEQ ID NO: 6137394 - DNA, 21 bp, Homo sapiens
ctatgcacatatggactctgc

SEQ ID NO: 6137395 - DNA, 17 bp, Homo sapiens
ctatgcacctataaata

SEQ ID NO: 6137396 - DNA, 19 bp, Homo sapiens
ctatgcacctataaatact

SEQ ID NO: 6137397 - DNA, 21 bp, Homo sapiens
ctatgcagacatctctggagc

SEQ ID NO: 6137398 - DNA, 18 bp, Homo sapiens
ctatgcagaggcctgggg

SEQ ID NO: 6137399 - DNA, 20 bp, Homo sapiens
ctatgcagaggtccacaaca

SEQ ID NO: 6137400 - DNA, 13 bp, Homo sapiens
ctatgcagcctgc

SEQ ID NO: 6137401 - DNA, 19 bp, Homo sapiens
ctatgcataaaaaaatgat

SEQ ID NO: 6137402 - DNA, 20 bp, Homo sapiens
ctatgcatatcagttgagct

SEQ ID NO: 6137403 - DNA, 19 bp, Homo sapiens
ctatgcattttaaagttaa

SEQ ID NO: 6137404 - DNA, 18 bp, Homo sapiens
ctatgcattttcttcaca

SEQ ID NO: 6137405 - DNA, 17 bp, Homo sapiens
ctatgccactaggccct

SEQ ID NO: 6137406 - DNA, 15 bp, Homo sapiens
ctatgccaggctgtg

SEQ ID NO: 6137407 - DNA, 16 bp, Homo sapiens
ctatgccaggctgtgc

SEQ ID NO: 6137408 - DNA, 18 bp, Homo sapiens
ctatgccatttcttctct

SEQ ID NO: 6137409 - DNA, 21 bp, Homo sapiens
ctatgccatttcttctctctg

SEQ ID NO: 6137410 - DNA, 22 bp, Homo sapiens
ctatgccatttcttctctctgt

SEQ ID NO: 6137411 - DNA, 16 bp, Homo sapiens
ctatgcccacataccc

SEQ ID NO: 6137412 - DNA, 22 bp, Homo sapiens
ctatgcccagctgtgctgggag

SEQ ID NO: 6137413 - DNA, 15 bp, Homo sapiens
ctatgcccaggtacc

SEQ ID NO: 6137414 - DNA, 20 bp, Homo sapiens
ctatgcccaggtaccaccct

SEQ ID NO: 6137415 - DNA, 17 bp, Homo sapiens
ctatgccccaaatatag

SEQ ID NO: 6137416 - DNA, 22 bp, Homo sapiens
ctatgcccctagtaactgctgt

SEQ ID NO: 6137417 - DNA, 15 bp, Homo sapiens
ctatgccctgcagag

SEQ ID NO: 6137418 - DNA, 16 bp, Homo sapiens
ctatgccctgcagagc

SEQ ID NO: 6137419 - DNA, 18 bp, Homo sapiens
ctatgccctgcagagcaa

SEQ ID NO: 6137420 - DNA, 19 bp, Homo sapiens
ctatgccctgcagagcaat

SEQ ID NO: 6137421 - DNA, 20 bp, Homo sapiens
ctatgccctgcagagcaata

SEQ ID NO: 6137422 - DNA, 22 bp, Homo sapiens
ctatgccctgcagagcaataac

SEQ ID NO: 6137423 - DNA, 23 bp, Homo sapiens
ctatgccctgcagagcaataaca

SEQ ID NO: 6137424 - DNA, 12 bp, Homo sapiens
ctatgccctgcc

SEQ ID NO: 6137425 - DNA, 18 bp, Homo sapiens
ctatgccctgttaaatgg

SEQ ID NO: 6137426 - DNA, 18 bp, Homo sapiens
ctatgccgtcttctgccc

SEQ ID NO: 6137427 - DNA, 19 bp, Homo sapiens
ctatgccgtcttctgccct

SEQ ID NO: 6137428 - DNA, 18 bp, Homo sapiens
ctatgcctcacaaatgct

SEQ ID NO: 6137429 - DNA, 20 bp, Homo sapiens
ctatgcctcacaaatgctgt

SEQ ID NO: 6137430 - DNA, 15 bp, Homo sapiens
ctatgcctctctaca

SEQ ID NO: 6137431 - DNA, 18 bp, Homo sapiens
ctatgcctgcactgggaa

SEQ ID NO: 6137432 - DNA, 19 bp, Homo sapiens
ctatgcctgcactgggaag

SEQ ID NO: 6137433 - DNA, 17 bp, Homo sapiens
ctatgcctgtatttcca

SEQ ID NO: 6137434 - DNA, 21 bp, Homo sapiens
ctatgcctgtggtgaagtgtg

SEQ ID NO: 6137435 - DNA, 19 bp, Homo sapiens
ctatgccttgcacacaggt

SEQ ID NO: 6137436 - DNA, 19 bp, Homo sapiens
ctatgccttgtctggggac

SEQ ID NO: 6137437 - DNA, 15 bp, Homo sapiens
ctatgccttttgtag

SEQ ID NO: 6137438 - DNA, 16 bp, Homo sapiens
ctatgcgtaaatcaac

SEQ ID NO: 6137439 - DNA, 22 bp, Homo sapiens
ctatgctaaactgtgaaaaatc

SEQ ID NO: 6137440 - DNA, 16 bp, Homo sapiens
ctatgctagaggcttt

SEQ ID NO: 6137441 - DNA, 23 bp, Homo sapiens
ctatgctagaggcttttattaga

SEQ ID NO: 6137442 - DNA, 19 bp, Homo sapiens
ctatgctattgacaataaa

SEQ ID NO: 6137443 - DNA, 18 bp, Homo sapiens
ctatgctatttctggcct

SEQ ID NO: 6137444 - DNA, 19 bp, Homo sapiens
ctatgctatttctggcctc

SEQ ID NO: 6137445 - DNA, 20 bp, Homo sapiens
ctatgctatttctggcctca

SEQ ID NO: 6137446 - DNA, 22 bp, Homo sapiens
ctatgctcaggggccctggagc

SEQ ID NO: 6137447 - DNA, 15 bp, Homo sapiens
ctatgctgagtttgt

SEQ ID NO: 6137448 - DNA, 14 bp, Homo sapiens
ctatgctgcctagg

SEQ ID NO: 6137449 - DNA, 20 bp, Homo sapiens
ctatgctgcttttatatctg

SEQ ID NO: 6137450 - DNA, 15 bp, Homo sapiens
ctatgctggacatta

SEQ ID NO: 6137451 - DNA, 21 bp, Homo sapiens
ctatgctggtaggctcctgcc

SEQ ID NO: 6137452 - DNA, 22 bp, Homo sapiens
ctatgctgttcactggacactt

SEQ ID NO: 6137453 - DNA, 17 bp, Homo sapiens
ctatgcttaataaaaga

SEQ ID NO: 6137454 - DNA, 22 bp, Homo sapiens
ctatgcttctagaaagcccctc

SEQ ID NO: 6137455 - DNA, 16 bp, Homo sapiens
ctatggaaacatttta

SEQ ID NO: 6137456 - DNA, 15 bp, Homo sapiens
ctatggaaagatggc

SEQ ID NO: 6137457 - DNA, 22 bp, Homo sapiens
ctatggaaagggtgtggcttgg

SEQ ID NO: 6137458 - DNA, 16 bp, Homo sapiens
ctatggaaatacattt

SEQ ID NO: 6137459 - DNA, 17 bp, Homo sapiens
ctatggaaatacattta

SEQ ID NO: 6137460 - DNA, 18 bp, Homo sapiens
ctatggaacataaagttg

SEQ ID NO: 6137461 - DNA, 17 bp, Homo sapiens
ctatggaagcatattgt

SEQ ID NO: 6137462 - DNA, 20 bp, Homo sapiens
ctgaaactatattttgtcat

SEQ ID NO: 6137463 - DNA, 19 bp, Homo sapiens
ctgaaactatttacaatgt

SEQ ID NO: 6137464 - DNA, 19 bp, Homo sapiens
ctgaaactcatagacactg

SEQ ID NO: 6137465 - DNA, 15 bp, Homo sapiens
ctgaaactgcccact

SEQ ID NO: 6137466 - DNA, 22 bp, Homo sapiens
ctgaaactgcccactctgcaag

SEQ ID NO: 6137467 - DNA, 14 bp, Homo sapiens
ctgaaactggcttc

SEQ ID NO: 6137468 - DNA, 14 bp, Homo sapiens
ctgaaacttcccaa

SEQ ID NO: 6137469 - DNA, 21 bp, Homo sapiens
ctgaaacttgctgagctgttt

SEQ ID NO: 6137470 - DNA, 14 bp, Homo sapiens
ctgaaactttgagg

SEQ ID NO: 6137471 - DNA, 14 bp, Homo sapiens
ctgaaagaaacagt

SEQ ID NO: 6137472 - DNA, 20 bp, Homo sapiens
ctgaaagaaacagttaactt

SEQ ID NO: 6137473 - DNA, 20 bp, Homo sapiens
ctgaaagaaactaagattta

SEQ ID NO: 6137474 - DNA, 23 bp, Homo sapiens
ctgaaagaagaaaacagtacaga

SEQ ID NO: 6137475 - DNA, 19 bp, Homo sapiens
ctgaaagaagaacagctgt

SEQ ID NO: 6137476 - DNA, 18 bp, Homo sapiens
ctgaaagaataggattaa

SEQ ID NO: 6137477 - DNA, 21 bp, Homo sapiens
ctgaaagacagaatgtcacca

SEQ ID NO: 6137478 - DNA, 20 bp, Homo sapiens
ctgaaagacagtatgagaaa

SEQ ID NO: 6137479 - DNA, 20 bp, Homo sapiens
ctgaaagagaagatggccat

SEQ ID NO: 6137480 - DNA, 12 bp, Homo sapiens
ctgaaagagcat

SEQ ID NO: 6137481 - DNA, 23 bp, Homo sapiens
ctgaaagagcattattcctggtc

SEQ ID NO: 6137482 - DNA, 13 bp, Homo sapiens
ctgaaagaggaat

SEQ ID NO: 6137483 - DNA, 23 bp, Homo sapiens
ctgaaagaggaggacccctgcct

SEQ ID NO: 6137484 - DNA, 22 bp, Homo sapiens
ctgaaagaggctgaggcctgga

SEQ ID NO: 6137485 - DNA, 22 bp, Homo sapiens
ctgaaagagtccattgtttaaa

SEQ ID NO: 6137486 - DNA, 18 bp, Homo sapiens
ctgaaagatatgtatatt

SEQ ID NO: 6137487 - DNA, 15 bp, Homo sapiens
ctgaaagatctctgt

SEQ ID NO: 6137488 - DNA, 20 bp, Homo sapiens
ctgaaagatctctgtcacat

SEQ ID NO: 6137489 - DNA, 17 bp, Homo sapiens
ctgaaagcaacagctgg

SEQ ID NO: 6137490 - DNA, 16 bp, Homo sapiens
ctgaaagcagcagcta

SEQ ID NO: 6137491 - DNA, 19 bp, Homo sapiens
ctgaaagcagcagctagga

SEQ ID NO: 6137492 - DNA, 22 bp, Homo sapiens
ctgaaagcagcagctaggactg

SEQ ID NO: 6137493 - DNA, 16 bp, Homo sapiens
ctgaaagccaaggcag

SEQ ID NO: 6137494 - DNA, 23 bp, Homo sapiens
ctgaaagccagctgccgaccaga

SEQ ID NO: 6137495 - DNA, 14 bp, Homo sapiens
ctgaaagcctcacg

SEQ ID NO: 6137496 - DNA, 13 bp, Homo sapiens
ctgaaagcggctg

SEQ ID NO: 6137497 - DNA, 17 bp, Homo sapiens
ctgaaagcggctgcctc

SEQ ID NO: 6137498 - DNA, 19 bp, Homo sapiens
ctgaaagcggctgcctcca

SEQ ID NO: 6137499 - DNA, 15 bp, Homo sapiens
ctgaaagctgggagc

SEQ ID NO: 6137500 - DNA, 14 bp, Homo sapiens
ctgaaagctgttgg

SEQ ID NO: 6137501 - DNA, 12 bp, Homo sapiens
ctgaaaggaaaa

SEQ ID NO: 6137502 - DNA, 16 bp, Homo sapiens
ctgaaaggaagctgtg

SEQ ID NO: 6137503 - DNA, 18 bp, Homo sapiens
ctgaaaggaaggtttcta

SEQ ID NO: 6137504 - DNA, 19 bp, Homo sapiens
ctgaaaggatgtggaagag

SEQ ID NO: 6137505 - DNA, 22 bp, Homo sapiens
ctgaaagggaaggacagctgtg

SEQ ID NO: 6137506 - DNA, 23 bp, Homo sapiens
ctgaaagggacgctacccgggaa

SEQ ID NO: 6137507 - DNA, 23 bp, Homo sapiens
ctgaaagggcacttaatttgtaa

SEQ ID NO: 6137508 - DNA, 23 bp, Homo sapiens
ctgaaaggtgattgcagcttttg

SEQ ID NO: 6137509 - DNA, 13 bp, Homo sapiens
ctgaaagtaattt

SEQ ID NO: 6137510 - DNA, 22 bp, Homo sapiens
ctgaaagtaatttcaagaatgt

SEQ ID NO: 6137511 - DNA, 12 bp, Homo sapiens
ctgaaagtgttt

SEQ ID NO: 6137512 - DNA, 16 bp, Homo sapiens
ctgaaagtgttttact

SEQ ID NO: 6137513 - DNA, 14 bp, Homo sapiens
ctgaaagtgttttg

SEQ ID NO: 6137514 - DNA, 15 bp, Homo sapiens
ctgaaagttacccac

SEQ ID NO: 6137515 - DNA, 23 bp, Homo sapiens
ctgaaagttcatatctggagcct

SEQ ID NO: 6137516 - DNA, 12 bp, Homo sapiens
ctgaaagttctt

SEQ ID NO: 6137517 - DNA, 24 bp, Homo sapiens
ctgaaagttggggcccagtccttg

SEQ ID NO: 6137518 - DNA, 13 bp, Homo sapiens
ctgaaagttttga

SEQ ID NO: 6137519 - DNA, 13 bp, Homo sapiens
ctgaaataaaagc

SEQ ID NO: 6137520 - DNA, 17 bp, Homo sapiens
ctgaaataaaatgccat

SEQ ID NO: 6137521 - DNA, 12 bp, Homo sapiens
ctgaaataaaca

SEQ ID NO: 6137522 - DNA, 14 bp, Homo sapiens
ctgaaataaacact

SEQ ID NO: 6137523 - DNA, 23 bp, Homo sapiens
ctgaaataaacctgcactgaaac

SEQ ID NO: 6137524 - DNA, 18 bp, Homo sapiens
ctgaaataaactagggtt

SEQ ID NO: 6137525 - DNA, 14 bp, Homo sapiens
ctgaaataaatgtt

SEQ ID NO: 6137526 - DNA, 16 bp, Homo sapiens
ctgaaataaggaatga

SEQ ID NO: 6137527 - DNA, 15 bp, Homo sapiens
ctgaaataatatatt

SEQ ID NO: 6137528 - DNA, 16 bp, Homo sapiens
ctgaaataatatattt

SEQ ID NO: 6137529 - DNA, 18 bp, Homo sapiens
ctgaaataatatatttct

SEQ ID NO: 6137530 - DNA, 18 bp, Homo sapiens
ctgaaatacctttgcctg

SEQ ID NO: 6137531 - DNA, 22 bp, Homo sapiens
ctgaaatatattttaaatgtgg

SEQ ID NO: 6137532 - DNA, 18 bp, Homo sapiens
ctgaaatcaattaaaagt

SEQ ID NO: 6137533 - DNA, 14 bp, Homo sapiens
ctgaaatcctggtt

SEQ ID NO: 6137534 - DNA, 15 bp, Homo sapiens
ctgaaatcctggttc

SEQ ID NO: 6137535 - DNA, 16 bp, Homo sapiens
ctgaaatcctggttcc

SEQ ID NO: 6137536 - DNA, 13 bp, Homo sapiens
ctgaaatccttga

SEQ ID NO: 6137537 - DNA, 14 bp, Homo sapiens
ctgaaatccttgag

SEQ ID NO: 6137538 - DNA, 22 bp, Homo sapiens
ctgaaatcggaagggacttcct

SEQ ID NO: 6137539 - DNA, 13 bp, Homo sapiens
ctgaaatctacaa

SEQ ID NO: 6137540 - DNA, 16 bp, Homo sapiens
ctgaaatctgaagacc

SEQ ID NO: 6137541 - DNA, 18 bp, Homo sapiens
ctgaaatgaaacaaataa

SEQ ID NO: 6137542 - DNA, 13 bp, Homo sapiens
ctgaaatgaagat

SEQ ID NO: 6137543 - DNA, 15 bp, Homo sapiens
ctgaaatgacatttc

SEQ ID NO: 6137544 - DNA, 18 bp, Homo sapiens
ctgaaatgaccaagacag

SEQ ID NO: 6137545 - DNA, 12 bp, Homo sapiens
ctgaaatgcgct

SEQ ID NO: 6137546 - DNA, 16 bp, Homo sapiens
ctgaaatgctgcattt

SEQ ID NO: 6137547 - DNA, 20 bp, Homo sapiens
ctgaaatgctgcattttaat

SEQ ID NO: 6137548 - DNA, 21 bp, Homo sapiens
ctgaaatgctttagcatacta

SEQ ID NO: 6137549 - DNA, 24 bp, Homo sapiens
ctgaaatggcctgtccctagggct

SEQ ID NO: 6137550 - DNA, 15 bp, Homo sapiens
ctgaaatggcttcta

SEQ ID NO: 6137551 - DNA, 19 bp, Homo sapiens
ctgaaatgtggatgtgatt

SEQ ID NO: 6137552 - DNA, 16 bp, Homo sapiens
ctgaaatgtgtttcct

SEQ ID NO: 6137553 - DNA, 18 bp, Homo sapiens
ctgaaatgtgtttccttt

SEQ ID NO: 6137554 - DNA, 20 bp, Homo sapiens
ctgaaatgttcttaaatttt

SEQ ID NO: 6137555 - DNA, 15 bp, Homo sapiens
ctgaaatgtttccag

SEQ ID NO: 6137556 - DNA, 13 bp, Homo sapiens
ctgaaatgtttgg

SEQ ID NO: 6137557 - DNA, 21 bp, Homo sapiens
ctgaaattaaacgagcgaaga

SEQ ID NO: 6137558 - DNA, 20 bp, Homo sapiens
ctgaaattaaagaaatgaaa

SEQ ID NO: 6137559 - DNA, 20 bp, Homo sapiens
ctgaaattaaagtatgcaaa

SEQ ID NO: 6137560 - DNA, 18 bp, Homo sapiens
ctgaaattaatttgtgaa

SEQ ID NO: 6137561 - DNA, 21 bp, Homo sapiens
ctgaaattaatttgtgaattt

SEQ ID NO: 6137562 - DNA, 22 bp, Homo sapiens
ctgaaattaatttgtgaatttg

SEQ ID NO: 6137563 - DNA, 20 bp, Homo sapiens
ctgaaattactttaacattt

SEQ ID NO: 6137564 - DNA, 23 bp, Homo sapiens
ctgaaattaggaaagtactgcat

SEQ ID NO: 6137565 - DNA, 15 bp, Homo sapiens
ctgaaattagtgttt

SEQ ID NO: 6137566 - DNA, 18 bp, Homo sapiens
ctgaaattagtgttttca

SEQ ID NO: 6137567 - DNA, 23 bp, Homo sapiens
ctgaaattagtgttttcattctg

SEQ ID NO: 6137568 - DNA, 20 bp, Homo sapiens
ctgaaattatgtcaaatgga

SEQ ID NO: 6137569 - DNA, 23 bp, Homo sapiens
ctgaaattatgtcaaatggatgt

SEQ ID NO: 6137570 - DNA, 23 bp, Homo sapiens
ctgaaattcaggatgctgtgata

SEQ ID NO: 6137571 - DNA, 15 bp, Homo sapiens
ctgaaattccaaagt

SEQ ID NO: 6137572 - DNA, 18 bp, Homo sapiens
ctgaaattccaaagtctc

SEQ ID NO: 6137573 - DNA, 16 bp, Homo sapiens
ctgaaattccagttta

SEQ ID NO: 6137574 - DNA, 14 bp, Homo sapiens
ctgaaattctaaat

SEQ ID NO: 6137575 - DNA, 18 bp, Homo sapiens
ctgaaattctaaatattg

SEQ ID NO: 6137576 - DNA, 15 bp, Homo sapiens
ctgaaattctcctgg

SEQ ID NO: 6137577 - DNA, 18 bp, Homo sapiens
ctgaaattctcctggagg

SEQ ID NO: 6137578 - DNA, 19 bp, Homo sapiens
ctgaaattctcctggaggt

SEQ ID NO: 6137579 - DNA, 14 bp, Homo sapiens
ctgaaattgaaaag

SEQ ID NO: 6137580 - DNA, 20 bp, Homo sapiens
ctgaaattgaaaagttattt

SEQ ID NO: 6137581 - DNA, 22 bp, Homo sapiens
ctgaaattgttttaccagctcc

SEQ ID NO: 6137582 - DNA, 13 bp, Homo sapiens
ctgaaatttacct

SEQ ID NO: 6137583 - DNA, 13 bp, Homo sapiens
ctgaaatttcaga

SEQ ID NO: 6137584 - DNA, 14 bp, Homo sapiens
ctgaaatttcccac

SEQ ID NO: 6137585 - DNA, 13 bp, Homo sapiens
ctgaaatttcctg

SEQ ID NO: 6137586 - DNA, 23 bp, Homo sapiens
ctgaaatttcctgggagcttttg

SEQ ID NO: 6137587 - DNA, 18 bp, Homo sapiens
ctgaaattttagaaatat

SEQ ID NO: 6137588 - DNA, 19 bp, Homo sapiens
ctgaaatttttcttcttga

SEQ ID NO: 6137589 - DNA, 17 bp, Homo sapiens
ctgaaatttttttccta

SEQ ID NO: 6137590 - DNA, 18 bp, Homo sapiens
ctgaaatttttttcctaa

SEQ ID NO: 6137591 - DNA, 16 bp, Homo sapiens
ctgaacaaaaaataaa

SEQ ID NO: 6137592 - DNA, 15 bp, Homo sapiens
ctgaacaaaagcagg

SEQ ID NO: 6137593 - DNA, 16 bp, Homo sapiens
ctgaacaaaagctcag

SEQ ID NO: 6137594 - DNA, 21 bp, Homo sapiens
ctgaacaaactaaaggtgcac

SEQ ID NO: 6137595 - DNA, 21 bp, Homo sapiens
ctgaacaaactatcagaggaa

SEQ ID NO: 6137596 - DNA, 12 bp, Homo sapiens
ctgaacaagaaa

SEQ ID NO: 6137597 - DNA, 13 bp, Homo sapiens
ctgaacaagaatt

SEQ ID NO: 6137598 - DNA, 14 bp, Homo sapiens
ctgaacaagaattg

SEQ ID NO: 6137599 - DNA, 17 bp, Homo sapiens
ctgaacaagagtgtcta

SEQ ID NO: 6137600 - DNA, 19 bp, Homo sapiens
ctgaacaataggctgttcc

SEQ ID NO: 6137601 - DNA, 21 bp, Homo sapiens
ctgaacaataggctgttccca

SEQ ID NO: 6137602 - DNA, 14 bp, Homo sapiens
ctgaacaatgaatg

SEQ ID NO: 6137603 - DNA, 23 bp, Homo sapiens
ctgaacaattacctgccaaatgc

SEQ ID NO: 6137604 - DNA, 14 bp, Homo sapiens
ctgaacacaagcaa

SEQ ID NO: 6137605 - DNA, 20 bp, Homo sapiens
ctgaacacacacgccagctc

SEQ ID NO: 6137606 - DNA, 17 bp, Homo sapiens
ctgaacacaggcagctt

SEQ ID NO: 6137607 - DNA, 18 bp, Homo sapiens
ctgaacacaggcagcttt

SEQ ID NO: 6137608 - DNA, 14 bp, Homo sapiens
ctgaacacatgtgt

SEQ ID NO: 6137609 - DNA, 19 bp, Homo sapiens
ctgaacacatgtgtatgat

SEQ ID NO: 6137610 - DNA, 11 bp, Homo sapiens
ctgaacaccat

SEQ ID NO: 6137611 - DNA, 20 bp, Homo sapiens
ctgaacaccattgaaggctt

SEQ ID NO: 6137612 - DNA, 18 bp, Homo sapiens
ctgaacactccaattaag

SEQ ID NO: 6137613 - DNA, 23 bp, Homo sapiens
ctgaacactccaattaaggattt

SEQ ID NO: 6137614 - DNA, 14 bp, Homo sapiens
ctgaacagaattaa

SEQ ID NO: 6137615 - DNA, 15 bp, Homo sapiens
ctgaacagatgtaaa

SEQ ID NO: 6137616 - DNA, 21 bp, Homo sapiens
ctgaacagcagtaatcctggg

SEQ ID NO: 6137617 - DNA, 14 bp, Homo sapiens
ctgaacagccctct

SEQ ID NO: 6137618 - DNA, 15 bp, Homo sapiens
ctgaacagctggtgt

SEQ ID NO: 6137619 - DNA, 19 bp, Homo sapiens
ctgaacagctggtgtagct

SEQ ID NO: 6137620 - DNA, 13 bp, Homo sapiens
ctgaacagctgta

SEQ ID NO: 6137621 - DNA, 23 bp, Homo sapiens
ctgaacaggaaagagctaggaac

SEQ ID NO: 6137622 - DNA, 22 bp, Homo sapiens
ctgaacaggaatccttactgat

SEQ ID NO: 6137623 - DNA, 16 bp, Homo sapiens
ctgaacaggctggggc

SEQ ID NO: 6137624 - DNA, 17 bp, Homo sapiens
ctgaacaggctggggcc

SEQ ID NO: 6137625 - DNA, 12 bp, Homo sapiens
ctgaacagtgct

SEQ ID NO: 6137626 - DNA, 15 bp, Homo sapiens
ctgaacagtgctctg

SEQ ID NO: 6137627 - DNA, 18 bp, Homo sapiens
ctgaacagtgctctgcct

SEQ ID NO: 6137628 - DNA, 15 bp, Homo sapiens
ctgaacataaatcag

SEQ ID NO: 6137629 - DNA, 15 bp, Homo sapiens
ctgaacatattatct

SEQ ID NO: 6137630 - DNA, 20 bp, Homo sapiens
ctgaacatccttccttccca

SEQ ID NO: 6137631 - DNA, 12 bp, Homo sapiens
ctgaacatctgg

SEQ ID NO: 6137632 - DNA, 16 bp, Homo sapiens
ctgaacatctgtgtgt

SEQ ID NO: 6137633 - DNA, 16 bp, Homo sapiens
ctgaacatgcctgcca

SEQ ID NO: 6137634 - DNA, 17 bp, Homo sapiens
ctgaacatgcctgccaa

SEQ ID NO: 6137635 - DNA, 15 bp, Homo sapiens
ctgaacatggatatc

SEQ ID NO: 6137636 - DNA, 13 bp, Homo sapiens
ctgaacatgttta

SEQ ID NO: 6137637 - DNA, 15 bp, Homo sapiens
ctgaacatgtttaca

SEQ ID NO: 6137638 - DNA, 14 bp, Homo sapiens
ctgaacattggaga

SEQ ID NO: 6137639 - DNA, 21 bp, Homo sapiens
ctgaacatttgctttgttttc

SEQ ID NO: 6137640 - DNA, 16 bp, Homo sapiens
ctgaaccaaagcctct

SEQ ID NO: 6137641 - DNA, 18 bp, Homo sapiens
ctatggaagccacatcac

SEQ ID NO: 6137642 - DNA, 18 bp, Homo sapiens
ctatggaatgtcagtgtt

SEQ ID NO: 6137643 - DNA, 14 bp, Homo sapiens
ctatggacaattta

SEQ ID NO: 6137644 - DNA, 19 bp, Homo sapiens
ctatggaccaaatgtaaaa

SEQ ID NO: 6137645 - DNA, 24 bp, Homo sapiens
ctatggacgacctccagctctcag

SEQ ID NO: 6137646 - DNA, 19 bp, Homo sapiens
ctatggacggtgctccagg

SEQ ID NO: 6137647 - DNA, 23 bp, Homo sapiens
ctatggagactttgctgttactg

SEQ ID NO: 6137648 - DNA, 15 bp, Homo sapiens
ctatggagagccctg

SEQ ID NO: 6137649 - DNA, 19 bp, Homo sapiens
ctatggagagccctgggac

SEQ ID NO: 6137650 - DNA, 22 bp, Homo sapiens
ctatggagcaaaacaaagctga

SEQ ID NO: 6137651 - DNA, 19 bp, Homo sapiens
ctatggagcctggcacagg

SEQ ID NO: 6137652 - DNA, 23 bp, Homo sapiens
ctatggagcctggcacaggactg

SEQ ID NO: 6137653 - DNA, 13 bp, Homo sapiens
ctatggagggcag

SEQ ID NO: 6137654 - DNA, 16 bp, Homo sapiens
ctatggagggcagagt

SEQ ID NO: 6137655 - DNA, 22 bp, Homo sapiens
ctatggagggcagagtgggctg

SEQ ID NO: 6137656 - DNA, 23 bp, Homo sapiens
ctatggagggcagagtgggctgc

SEQ ID NO: 6137657 - DNA, 19 bp, Homo sapiens
ctatggagggtcctcctcc

SEQ ID NO: 6137658 - DNA, 18 bp, Homo sapiens
ctatggagtcttgtgaaa

SEQ ID NO: 6137659 - DNA, 18 bp, Homo sapiens
ctatggagtgaaattatt

SEQ ID NO: 6137660 - DNA, 11 bp, Homo sapiens
ctatggatgtg

SEQ ID NO: 6137661 - DNA, 20 bp, Homo sapiens
ctatggattcacttctattt

SEQ ID NO: 6137662 - DNA, 16 bp, Homo sapiens
ctatggcagaaaaaat

SEQ ID NO: 6137663 - DNA, 14 bp, Homo sapiens
ctatggcagtccag

SEQ ID NO: 6137664 - DNA, 18 bp, Homo sapiens
ctatggcagtccagccag

SEQ ID NO: 6137665 - DNA, 21 bp, Homo sapiens
ctatggcagtccagccagctc

SEQ ID NO: 6137666 - DNA, 14 bp, Homo sapiens
ctatggccactggc

SEQ ID NO: 6137667 - DNA, 17 bp, Homo sapiens
ctatggccagtctgccc

SEQ ID NO: 6137668 - DNA, 14 bp, Homo sapiens
ctatggcccagcca

SEQ ID NO: 6137669 - DNA, 15 bp, Homo sapiens
ctatggcccagccac

SEQ ID NO: 6137670 - DNA, 17 bp, Homo sapiens
ctatggcccagccactg

SEQ ID NO: 6137671 - DNA, 22 bp, Homo sapiens
ctatggcccagccactgcagca

SEQ ID NO: 6137672 - DNA, 15 bp, Homo sapiens
ctatggccccagggt

SEQ ID NO: 6137673 - DNA, 10 bp, Homo sapiens
ctatggctca

SEQ ID NO: 6137674 - DNA, 20 bp, Homo sapiens
ctatggctgatttatttcta

SEQ ID NO: 6137675 - DNA, 16 bp, Homo sapiens
ctatggcttatttcta

SEQ ID NO: 6137676 - DNA, 15 bp, Homo sapiens
ctatggctttcaaag

SEQ ID NO: 6137677 - DNA, 18 bp, Homo sapiens
ctatggctttcaaagcta

SEQ ID NO: 6137678 - DNA, 21 bp, Homo sapiens
ctatgggaaaaatctaaaatg

SEQ ID NO: 6137679 - DNA, 23 bp, Homo sapiens
ctatgggactcaatgcactgaca

SEQ ID NO: 6137680 - DNA, 22 bp, Homo sapiens
ctatgggagagtgtcaaccaga

SEQ ID NO: 6137681 - DNA, 23 bp, Homo sapiens
ctatgggagagtgtcaaccagac

SEQ ID NO: 6137682 - DNA, 15 bp, Homo sapiens
ctatgggagccccag

SEQ ID NO: 6137683 - DNA, 16 bp, Homo sapiens
ctatgggagccccagg

SEQ ID NO: 6137684 - DNA, 14 bp, Homo sapiens
ctatgggaggcagc

SEQ ID NO: 6137685 - DNA, 22 bp, Homo sapiens
ctatgggaggcagccgaggcct

SEQ ID NO: 6137686 - DNA, 13 bp, Homo sapiens
ctatgggcctgcc

SEQ ID NO: 6137687 - DNA, 16 bp, Homo sapiens
ctatggggacattcca

SEQ ID NO: 6137688 - DNA, 21 bp, Homo sapiens
ctatggggagaaaagacatga

SEQ ID NO: 6137689 - DNA, 18 bp, Homo sapiens
ctatggggaggccctgcc

SEQ ID NO: 6137690 - DNA, 19 bp, Homo sapiens
ctatggggaggccctgcct

SEQ ID NO: 6137691 - DNA, 20 bp, Homo sapiens
ctatggggaggccctgcctc

SEQ ID NO: 6137692 - DNA, 19 bp, Homo sapiens
ctatggggatagatgtgtg

SEQ ID NO: 6137693 - DNA, 21 bp, Homo sapiens
ctatggggatagatgtgtgga

SEQ ID NO: 6137694 - DNA, 18 bp, Homo sapiens
ctatggggtggggtgggt

SEQ ID NO: 6137695 - DNA, 20 bp, Homo sapiens
ctatgggtggggcactcctt

SEQ ID NO: 6137696 - DNA, 14 bp, Homo sapiens
ctatgggttatttt

SEQ ID NO: 6137697 - DNA, 22 bp, Homo sapiens
ctatgggttatttttattaaat

SEQ ID NO: 6137698 - DNA, 16 bp, Homo sapiens
ctatggtaaagatatt

SEQ ID NO: 6137699 - DNA, 20 bp, Homo sapiens
ctatggtaaataactgtgac

SEQ ID NO: 6137700 - DNA, 19 bp, Homo sapiens
ctatggtatgctggccagc

SEQ ID NO: 6137701 - DNA, 20 bp, Homo sapiens
ctatggtcacagacttctgg

SEQ ID NO: 6137702 - DNA, 17 bp, Homo sapiens
ctatggtcgggagacag

SEQ ID NO: 6137703 - DNA, 14 bp, Homo sapiens
ctatggtgaggtgt

SEQ ID NO: 6137704 - DNA, 14 bp, Homo sapiens
ctatggtgccaatg

SEQ ID NO: 6137705 - DNA, 21 bp, Homo sapiens
ctatggtgccaatggaacctc

SEQ ID NO: 6137706 - DNA, 14 bp, Homo sapiens
ctatggtgctctgt

SEQ ID NO: 6137707 - DNA, 23 bp, Homo sapiens
ctatggtgctctgtctacttgct

SEQ ID NO: 6137708 - DNA, 22 bp, Homo sapiens
ctatggtgtaatcatgaaggag

SEQ ID NO: 6137709 - DNA, 14 bp, Homo sapiens
ctatggttatgaaa

SEQ ID NO: 6137710 - DNA, 20 bp, Homo sapiens
ctatgtaaattattgtaaac

SEQ ID NO: 6137711 - DNA, 21 bp, Homo sapiens
ctatgtaactgcattgagaac

SEQ ID NO: 6137712 - DNA, 14 bp, Homo sapiens
ctatgtaacttgtt

SEQ ID NO: 6137713 - DNA, 23 bp, Homo sapiens
ctatgtaagggctttaaataaaa

SEQ ID NO: 6137714 - DNA, 19 bp, Homo sapiens
ctatgtaataatgtacaga

SEQ ID NO: 6137715 - DNA, 23 bp, Homo sapiens
ctatgtaataatgtacagaggaa

SEQ ID NO: 6137716 - DNA, 18 bp, Homo sapiens
ctatgtacaatattttaa

SEQ ID NO: 6137717 - DNA, 19 bp, Homo sapiens
ctatgtacaatattttaag

SEQ ID NO: 6137718 - DNA, 14 bp, Homo sapiens
ctatgtacagagct

SEQ ID NO: 6137719 - DNA, 16 bp, Homo sapiens
ctatgtacagatgatg

SEQ ID NO: 6137720 - DNA, 19 bp, Homo sapiens
ctatgtactagtactgtgt

SEQ ID NO: 6137721 - DNA, 20 bp, Homo sapiens
ctatgtactagtactgtgta

SEQ ID NO: 6137722 - DNA, 14 bp, Homo sapiens
ctatgtagaactgt

SEQ ID NO: 6137723 - DNA, 22 bp, Homo sapiens
ctatgtagctgaaaataaaatg

SEQ ID NO: 6137724 - DNA, 19 bp, Homo sapiens
ctatgtaggaaaaaaatag

SEQ ID NO: 6137725 - DNA, 23 bp, Homo sapiens
ctatgtaggaaagaccatttttc

SEQ ID NO: 6137726 - DNA, 15 bp, Homo sapiens
ctatgtagtcataat

SEQ ID NO: 6137727 - DNA, 18 bp, Homo sapiens
ctatgtagtggttttagg

SEQ ID NO: 6137728 - DNA, 18 bp, Homo sapiens
ctatgtatattctatttt

SEQ ID NO: 6137729 - DNA, 18 bp, Homo sapiens
ctatgtatcgctcctatt

SEQ ID NO: 6137730 - DNA, 11 bp, Homo sapiens
ctatgtatgtt

SEQ ID NO: 6137731 - DNA, 18 bp, Homo sapiens
ctatgtatgttaatttat

SEQ ID NO: 6137732 - DNA, 19 bp, Homo sapiens
ctatgtattaccagccccc

SEQ ID NO: 6137733 - DNA, 16 bp, Homo sapiens
ctatgtattctgggta

SEQ ID NO: 6137734 - DNA, 13 bp, Homo sapiens
ctatgtatttgca

SEQ ID NO: 6137735 - DNA, 22 bp, Homo sapiens
ctatgtatttgcagttcacctg

SEQ ID NO: 6137736 - DNA, 21 bp, Homo sapiens
ctatgtcaattgatatttctg

SEQ ID NO: 6137737 - DNA, 19 bp, Homo sapiens
ctatgtcaatttgtatatc

SEQ ID NO: 6137738 - DNA, 20 bp, Homo sapiens
ctatgtcaatttgtatatca

SEQ ID NO: 6137739 - DNA, 18 bp, Homo sapiens
ctatgtcatttcatttcc

SEQ ID NO: 6137740 - DNA, 13 bp, Homo sapiens
ctatgtcatttct

SEQ ID NO: 6137741 - DNA, 14 bp, Homo sapiens
ctatgtcatttcta

SEQ ID NO: 6137742 - DNA, 19 bp, Homo sapiens
ctatgtcatttttaatgta

SEQ ID NO: 6137743 - DNA, 20 bp, Homo sapiens
ctatgtcatttttaatgtat

SEQ ID NO: 6137744 - DNA, 15 bp, Homo sapiens
ctatgtcccaggaat

SEQ ID NO: 6137745 - DNA, 18 bp, Homo sapiens
ctatgtcctaaggacaca

SEQ ID NO: 6137746 - DNA, 21 bp, Homo sapiens
ctatgtcctaaggacacacta

SEQ ID NO: 6137747 - DNA, 23 bp, Homo sapiens
ctatgtcctaaggacacactaat

SEQ ID NO: 6137748 - DNA, 19 bp, Homo sapiens
ctatgtcctagtaactctt

SEQ ID NO: 6137749 - DNA, 17 bp, Homo sapiens
ctatgtcgagagctggc

SEQ ID NO: 6137750 - DNA, 17 bp, Homo sapiens
ctatgtcgatgcacagt

SEQ ID NO: 6137751 - DNA, 14 bp, Homo sapiens
ctatgtctggcaga

SEQ ID NO: 6137752 - DNA, 13 bp, Homo sapiens
ctatgtgaaaaga

SEQ ID NO: 6137753 - DNA, 16 bp, Homo sapiens
ctatgtgaaactctat

SEQ ID NO: 6137754 - DNA, 18 bp, Homo sapiens
ctatgtgaaactctatta

SEQ ID NO: 6137755 - DNA, 22 bp, Homo sapiens
ctatgtgacatttctcttcccc

SEQ ID NO: 6137756 - DNA, 17 bp, Homo sapiens
ctatgtgagtttcagaa

SEQ ID NO: 6137757 - DNA, 18 bp, Homo sapiens
ctatgtgagtttcagaaa

SEQ ID NO: 6137758 - DNA, 19 bp, Homo sapiens
ctatgtgagtttcagaaat

SEQ ID NO: 6137759 - DNA, 11 bp, Homo sapiens
ctatgtgattt

SEQ ID NO: 6137760 - DNA, 16 bp, Homo sapiens
ctatgtgattttaact

SEQ ID NO: 6137761 - DNA, 18 bp, Homo sapiens
ctatgtgattttaactct

SEQ ID NO: 6137762 - DNA, 19 bp, Homo sapiens
ctatgtgattttaactctg

SEQ ID NO: 6137763 - DNA, 21 bp, Homo sapiens
ctatgtgattttaactctgtc

SEQ ID NO: 6137764 - DNA, 17 bp, Homo sapiens
ctatgtgccttatgttg

SEQ ID NO: 6137765 - DNA, 18 bp, Homo sapiens
ctatgtgcgaagcaagaa

SEQ ID NO: 6137766 - DNA, 19 bp, Homo sapiens
ctatgtggatctaaataat

SEQ ID NO: 6137767 - DNA, 16 bp, Homo sapiens
ctatgtggattagcta

SEQ ID NO: 6137768 - DNA, 18 bp, Homo sapiens
ctatgtggattttttcct

SEQ ID NO: 6137769 - DNA, 16 bp, Homo sapiens
ctatgtggcagctggg

SEQ ID NO: 6137770 - DNA, 21 bp, Homo sapiens
ctatgtggctgaaaatgcaaa

SEQ ID NO: 6137771 - DNA, 13 bp, Homo sapiens
ctatgtgtaaggt

SEQ ID NO: 6137772 - DNA, 13 bp, Homo sapiens
ctatgtgtatata

SEQ ID NO: 6137773 - DNA, 16 bp, Homo sapiens
ctatgtgtatatatta

SEQ ID NO: 6137774 - DNA, 23 bp, Homo sapiens
ctatgtgtatatattatatatac

SEQ ID NO: 6137775 - DNA, 17 bp, Homo sapiens
ctatgtgtcatgatttc

SEQ ID NO: 6137776 - DNA, 21 bp, Homo sapiens
ctatgtgtcatgatttcaatg

SEQ ID NO: 6137777 - DNA, 15 bp, Homo sapiens
ctatgtgtgttgttt

SEQ ID NO: 6137778 - DNA, 16 bp, Homo sapiens
ctatgtgtttctgtaa

SEQ ID NO: 6137779 - DNA, 20 bp, Homo sapiens
ctatgtgtttctgtaacaaa

SEQ ID NO: 6137780 - DNA, 20 bp, Homo sapiens
ctatgtgtttggtttataat

SEQ ID NO: 6137781 - DNA, 22 bp, Homo sapiens
ctatgtgtttggtttataattt

SEQ ID NO: 6137782 - DNA, 16 bp, Homo sapiens
ctatgttaaatactgt

SEQ ID NO: 6137783 - DNA, 21 bp, Homo sapiens
ctatgttaaatactgtgcaga

SEQ ID NO: 6137784 - DNA, 13 bp, Homo sapiens
ctatgttaatatt

SEQ ID NO: 6137785 - DNA, 20 bp, Homo sapiens
ctatgttattttcagtgctt

SEQ ID NO: 6137786 - DNA, 13 bp, Homo sapiens
ctatgttcaaaga

SEQ ID NO: 6137787 - DNA, 20 bp, Homo sapiens
ctatgttcaaagactgtgaa

SEQ ID NO: 6137788 - DNA, 23 bp, Homo sapiens
ctatgttcagaacttcatctgcc

SEQ ID NO: 6137789 - DNA, 18 bp, Homo sapiens
ctatgttctaagaagtga

SEQ ID NO: 6137790 - DNA, 18 bp, Homo sapiens
ctatgttgcccaagctgg

SEQ ID NO: 6137791 - DNA, 21 bp, Homo sapiens
ctatgttgcccaggcaggtct

SEQ ID NO: 6137792 - DNA, 18 bp, Homo sapiens
ctatgttggcattaacaa

SEQ ID NO: 6137793 - DNA, 22 bp, Homo sapiens
ctatgttgggggggaccctgcc

SEQ ID NO: 6137794 - DNA, 17 bp, Homo sapiens
ctatgttggtttcagtg

SEQ ID NO: 6137795 - DNA, 12 bp, Homo sapiens
ctatgttgtaat

SEQ ID NO: 6137796 - DNA, 17 bp, Homo sapiens
ctatgttgtaattttac

SEQ ID NO: 6137797 - DNA, 16 bp, Homo sapiens
ctatgtttatctttgt

SEQ ID NO: 6137798 - DNA, 15 bp, Homo sapiens
ctatgtttattctag

SEQ ID NO: 6137799 - DNA, 21 bp, Homo sapiens
ctatgtttatttttgtacatt

SEQ ID NO: 6137800 - DNA, 16 bp, Homo sapiens
ctatgtttccatcttc

SEQ ID NO: 6137801 - DNA, 18 bp, Homo sapiens
ctatgtttccatcttcag

SEQ ID NO: 6137802 - DNA, 19 bp, Homo sapiens
ctatgtttccatcttcagt

SEQ ID NO: 6137803 - DNA, 11 bp, Homo sapiens
ctatgtttgct

SEQ ID NO: 6137804 - DNA, 21 bp, Homo sapiens
ctatgtttgtctcacttttca

SEQ ID NO: 6137805 - DNA, 13 bp, Homo sapiens
ctatgttttacca

SEQ ID NO: 6137806 - DNA, 19 bp, Homo sapiens
ctatgttttgacattttta

SEQ ID NO: 6137807 - DNA, 17 bp, Homo sapiens
ctatgtttttaaagtgt

SEQ ID NO: 6137808 - DNA, 15 bp, Homo sapiens
ctatgtttttaatgt

SEQ ID NO: 6137809 - DNA, 13 bp, Homo sapiens
ctattaaaaaagt

SEQ ID NO: 6137810 - DNA, 23 bp, Homo sapiens
ctattaaaaaagtctacaacata

SEQ ID NO: 6137811 - DNA, 12 bp, Homo sapiens
ctattaaaagac

SEQ ID NO: 6137812 - DNA, 14 bp, Homo sapiens
ctattaaaagactc

SEQ ID NO: 6137813 - DNA, 16 bp, Homo sapiens
ctattaaaagactcat

SEQ ID NO: 6137814 - DNA, 13 bp, Homo sapiens
ctattaaaagttg

SEQ ID NO: 6137815 - DNA, 18 bp, Homo sapiens
ctattaaaatattttgga

SEQ ID NO: 6137816 - DNA, 22 bp, Homo sapiens
ctattaaaattctgatgtttct

SEQ ID NO: 6137817 - DNA, 22 bp, Homo sapiens
ctattaaagaatgttttggaat

SEQ ID NO: 6137818 - DNA, 18 bp, Homo sapiens
ctgaaccacattcaggga

SEQ ID NO: 6137819 - DNA, 15 bp, Homo sapiens
ctgaaccaccctgga

SEQ ID NO: 6137820 - DNA, 18 bp, Homo sapiens
ctgaaccaccctttattc

SEQ ID NO: 6137821 - DNA, 19 bp, Homo sapiens
ctgaaccacgaggctgccc

SEQ ID NO: 6137822 - DNA, 23 bp, Homo sapiens
ctgaaccacgaggctgcccccat

SEQ ID NO: 6137823 - DNA, 21 bp, Homo sapiens
ctgaaccactgcttctctttt

SEQ ID NO: 6137824 - DNA, 18 bp, Homo sapiens
ctgaaccactgtggcctt

SEQ ID NO: 6137825 - DNA, 18 bp, Homo sapiens
ctgaaccacttgtagatt

SEQ ID NO: 6137826 - DNA, 22 bp, Homo sapiens
ctgaaccacttgtagatttgat

SEQ ID NO: 6137827 - DNA, 13 bp, Homo sapiens
ctgaaccactttg

SEQ ID NO: 6137828 - DNA, 14 bp, Homo sapiens
ctgaaccactttga

SEQ ID NO: 6137829 - DNA, 21 bp, Homo sapiens
ctgaaccagccacgaacagcc

SEQ ID NO: 6137830 - DNA, 19 bp, Homo sapiens
ctgaaccagtcctgctgcc

SEQ ID NO: 6137831 - DNA, 20 bp, Homo sapiens
ctgaaccagtcctgctgcct

SEQ ID NO: 6137832 - DNA, 14 bp, Homo sapiens
ctgaaccattactg

SEQ ID NO: 6137833 - DNA, 18 bp, Homo sapiens
ctgaacccagctgtgccc

SEQ ID NO: 6137834 - DNA, 13 bp, Homo sapiens
ctgaacccaggca

SEQ ID NO: 6137835 - DNA, 14 bp, Homo sapiens
ctgaacccaggcag

SEQ ID NO: 6137836 - DNA, 18 bp, Homo sapiens
ctgaacccaggcagctgg

SEQ ID NO: 6137837 - DNA, 20 bp, Homo sapiens
ctgaacccaggcagctggca

SEQ ID NO: 6137838 - DNA, 22 bp, Homo sapiens
ctgaacccaggcagctggcagg

SEQ ID NO: 6137839 - DNA, 14 bp, Homo sapiens
ctgaacccctggcc

SEQ ID NO: 6137840 - DNA, 17 bp, Homo sapiens
ctgaacccctggccagc

SEQ ID NO: 6137841 - DNA, 16 bp, Homo sapiens
ctgaacccgtccattc

SEQ ID NO: 6137842 - DNA, 21 bp, Homo sapiens
ctgaacccgtccattcagaaa

SEQ ID NO: 6137843 - DNA, 22 bp, Homo sapiens
ctgaacccgtccattcagaaag

SEQ ID NO: 6137844 - DNA, 17 bp, Homo sapiens
ctgaaccctcagccttg

SEQ ID NO: 6137845 - DNA, 11 bp, Homo sapiens
ctgaaccctgc

SEQ ID NO: 6137846 - DNA, 17 bp, Homo sapiens
ctgaaccctgtgctggt

SEQ ID NO: 6137847 - DNA, 23 bp, Homo sapiens
ctgaaccctgtgctggtgtcctg

SEQ ID NO: 6137848 - DNA, 20 bp, Homo sapiens
ctgaacccttgtgcttggtg

SEQ ID NO: 6137849 - DNA, 18 bp, Homo sapiens
ctgaaccgactgaccctg

SEQ ID NO: 6137850 - DNA, 21 bp, Homo sapiens
ctgaaccgactgaccctgagg

SEQ ID NO: 6137851 - DNA, 16 bp, Homo sapiens
ctgaaccgcaaggagc

SEQ ID NO: 6137852 - DNA, 15 bp, Homo sapiens
ctgaaccgcacagct

SEQ ID NO: 6137853 - DNA, 19 bp, Homo sapiens
ctgaaccgcacagctcagg

SEQ ID NO: 6137854 - DNA, 23 bp, Homo sapiens
ctgaaccgcacagctcaggaggc

SEQ ID NO: 6137855 - DNA, 23 bp, Homo sapiens
ctgaacctactgaggagcaaagc

SEQ ID NO: 6137856 - DNA, 20 bp, Homo sapiens
ctgaacctcagtttcctcat

SEQ ID NO: 6137857 - DNA, 14 bp, Homo sapiens
ctgaacctggaaat

SEQ ID NO: 6137858 - DNA, 19 bp, Homo sapiens
ctgaacctgggaaagagat

SEQ ID NO: 6137859 - DNA, 21 bp, Homo sapiens
ctgaacctgggtaactaggga

SEQ ID NO: 6137860 - DNA, 16 bp, Homo sapiens
ctgaacctgtctcctc

SEQ ID NO: 6137861 - DNA, 20 bp, Homo sapiens
ctgaaccttcctgtctccca

SEQ ID NO: 6137862 - DNA, 14 bp, Homo sapiens
ctgaaccttgagca

SEQ ID NO: 6137863 - DNA, 15 bp, Homo sapiens
ctgaacgacagtccc

SEQ ID NO: 6137864 - DNA, 15 bp, Homo sapiens
ctgaacgccctggta

SEQ ID NO: 6137865 - DNA, 15 bp, Homo sapiens
ctgaacgtcctgcag

SEQ ID NO: 6137866 - DNA, 13 bp, Homo sapiens
ctgaactaattca

SEQ ID NO: 6137867 - DNA, 20 bp, Homo sapiens
ctgaactaattcatttatta

SEQ ID NO: 6137868 - DNA, 16 bp, Homo sapiens
ctgaactacaagtgta

SEQ ID NO: 6137869 - DNA, 13 bp, Homo sapiens
ctgaactatttat

SEQ ID NO: 6137870 - DNA, 16 bp, Homo sapiens
ctgaactatttattaa

SEQ ID NO: 6137871 - DNA, 21 bp, Homo sapiens
ctgaactattttaaataaaat

SEQ ID NO: 6137872 - DNA, 16 bp, Homo sapiens
ctgaactcaagctgcg

SEQ ID NO: 6137873 - DNA, 18 bp, Homo sapiens
ctgaactcagaaggctgt

SEQ ID NO: 6137874 - DNA, 11 bp, Homo sapiens
ctgaactcagc

SEQ ID NO: 6137875 - DNA, 13 bp, Homo sapiens
ctgaactccaccg

SEQ ID NO: 6137876 - DNA, 12 bp, Homo sapiens
ctgaactccaga

SEQ ID NO: 6137877 - DNA, 13 bp, Homo sapiens
ctgaactccagag

SEQ ID NO: 6137878 - DNA, 19 bp, Homo sapiens
ctgaactccatacagcctc

SEQ ID NO: 6137879 - DNA, 13 bp, Homo sapiens
ctgaactccattt

SEQ ID NO: 6137880 - DNA, 14 bp, Homo sapiens
ctgaactcccagaa

SEQ ID NO: 6137881 - DNA, 17 bp, Homo sapiens
ctgaactccttccccac

SEQ ID NO: 6137882 - DNA, 12 bp, Homo sapiens
ctgaactctcaa

SEQ ID NO: 6137883 - DNA, 16 bp, Homo sapiens
ctgaactctgacaaca

SEQ ID NO: 6137884 - DNA, 17 bp, Homo sapiens
ctgaactctgacaacag

SEQ ID NO: 6137885 - DNA, 23 bp, Homo sapiens
ctgaactcttcagaacacacaga

SEQ ID NO: 6137886 - DNA, 13 bp, Homo sapiens
ctgaactgaacac

SEQ ID NO: 6137887 - DNA, 18 bp, Homo sapiens
ctgaactgacaatgaagg

SEQ ID NO: 6137888 - DNA, 13 bp, Homo sapiens
ctgaactgagaag

SEQ ID NO: 6137889 - DNA, 18 bp, Homo sapiens
ctgaactgagaaggcagg

SEQ ID NO: 6137890 - DNA, 16 bp, Homo sapiens
ctgaactgagccccag

SEQ ID NO: 6137891 - DNA, 15 bp, Homo sapiens
ctgaactgagcctag

SEQ ID NO: 6137892 - DNA, 16 bp, Homo sapiens
ctgaactgagcctagc

SEQ ID NO: 6137893 - DNA, 13 bp, Homo sapiens
ctgaactgaggag

SEQ ID NO: 6137894 - DNA, 13 bp, Homo sapiens
ctgaactgaggcc

SEQ ID NO: 6137895 - DNA, 14 bp, Homo sapiens
ctgaactgaggcct

SEQ ID NO: 6137896 - DNA, 18 bp, Homo sapiens
ctgaactgcaacactgga

SEQ ID NO: 6137897 - DNA, 21 bp, Homo sapiens
ctgaactgctctactttgaga

SEQ ID NO: 6137898 - DNA, 13 bp, Homo sapiens
ctgaactgctgct

SEQ ID NO: 6137899 - DNA, 18 bp, Homo sapiens
ctgaactgctgctggtca

SEQ ID NO: 6137900 - DNA, 14 bp, Homo sapiens
ctgaactgctttta

SEQ ID NO: 6137901 - DNA, 24 bp, Homo sapiens
ctgaactgcttttaaaagtgcaca

SEQ ID NO: 6137902 - DNA, 14 bp, Homo sapiens
ctgaactggccact

SEQ ID NO: 6137903 - DNA, 21 bp, Homo sapiens
ctgaactggccgctgggagaa

SEQ ID NO: 6137904 - DNA, 16 bp, Homo sapiens
ctgaactgggaccttt

SEQ ID NO: 6137905 - DNA, 13 bp, Homo sapiens
ctgaactgtgagt

SEQ ID NO: 6137906 - DNA, 13 bp, Homo sapiens
ctgaactgtgcat

SEQ ID NO: 6137907 - DNA, 21 bp, Homo sapiens
ctgaactgttaagaaatctgt

SEQ ID NO: 6137908 - DNA, 20 bp, Homo sapiens
ctgaacttaataactgtgta

SEQ ID NO: 6137909 - DNA, 18 bp, Homo sapiens
ctgaacttattacctaat

SEQ ID NO: 6137910 - DNA, 22 bp, Homo sapiens
ctgaacttcaggataataaagt

SEQ ID NO: 6137911 - DNA, 16 bp, Homo sapiens
ctgaacttggcgctgc

SEQ ID NO: 6137912 - DNA, 23 bp, Homo sapiens
ctgaacttggtctgcagaccatc

SEQ ID NO: 6137913 - DNA, 14 bp, Homo sapiens
ctgaactttgaaga

SEQ ID NO: 6137914 - DNA, 18 bp, Homo sapiens
ctgaactttgaagacccg

SEQ ID NO: 6137915 - DNA, 16 bp, Homo sapiens
ctgaactttggagagt

SEQ ID NO: 6137916 - DNA, 14 bp, Homo sapiens
ctgaactttgggaa

SEQ ID NO: 6137917 - DNA, 16 bp, Homo sapiens
ctgaactttgggaagc

SEQ ID NO: 6137918 - DNA, 20 bp, Homo sapiens
ctgaactttgtttccagaaa

SEQ ID NO: 6137919 - DNA, 14 bp, Homo sapiens
ctgaacttttcaaa

SEQ ID NO: 6137920 - DNA, 15 bp, Homo sapiens
ctgaacttttcaaaa

SEQ ID NO: 6137921 - DNA, 15 bp, Homo sapiens
ctgaacttttcagga

SEQ ID NO: 6137922 - DNA, 16 bp, Homo sapiens
ctgaacttttgtggag

SEQ ID NO: 6137923 - DNA, 14 bp, Homo sapiens
ctgaagaaacacag

SEQ ID NO: 6137924 - DNA, 18 bp, Homo sapiens
ctgaagaaacacagcatg

SEQ ID NO: 6137925 - DNA, 12 bp, Homo sapiens
ctgaagaaatta

SEQ ID NO: 6137926 - DNA, 14 bp, Homo sapiens
ctgaagaagatggt

SEQ ID NO: 6137927 - DNA, 12 bp, Homo sapiens
ctgaagaagcaa

SEQ ID NO: 6137928 - DNA, 23 bp, Homo sapiens
ctgaagaagcaccaatcatgaat

SEQ ID NO: 6137929 - DNA, 18 bp, Homo sapiens
ctgaagaagcacttctgc

SEQ ID NO: 6137930 - DNA, 21 bp, Homo sapiens
ctgaagaagtcactgaacaaa

SEQ ID NO: 6137931 - DNA, 19 bp, Homo sapiens
ctgaagaagttaattctta

SEQ ID NO: 6137932 - DNA, 15 bp, Homo sapiens
ctgaagaatcaagag

SEQ ID NO: 6137933 - DNA, 20 bp, Homo sapiens
ctgaagaatctcgactctcg

SEQ ID NO: 6137934 - DNA, 13 bp, Homo sapiens
ctgaagaatgaag

SEQ ID NO: 6137935 - DNA, 20 bp, Homo sapiens
ctgaagaattaagatacaaa

SEQ ID NO: 6137936 - DNA, 18 bp, Homo sapiens
ctgaagaattgaaaagtt

SEQ ID NO: 6137937 - DNA, 20 bp, Homo sapiens
ctgaagaattttgagtgaat

SEQ ID NO: 6137938 - DNA, 23 bp, Homo sapiens
ctgaagacaaaccactgtacata

SEQ ID NO: 6137939 - DNA, 16 bp, Homo sapiens
ctgaagacaggcacaa

SEQ ID NO: 6137940 - DNA, 21 bp, Homo sapiens
ctgaagacaggcacaaaatgt

SEQ ID NO: 6137941 - DNA, 15 bp, Homo sapiens
ctgaagacattcaaa

SEQ ID NO: 6137942 - DNA, 15 bp, Homo sapiens
ctgaagaccagctgt

SEQ ID NO: 6137943 - DNA, 21 bp, Homo sapiens
ctgaagaccccagatgtgagg

SEQ ID NO: 6137944 - DNA, 19 bp, Homo sapiens
ctgaagacctaaagtgctt

SEQ ID NO: 6137945 - DNA, 14 bp, Homo sapiens
ctgaagacctacca

SEQ ID NO: 6137946 - DNA, 16 bp, Homo sapiens
ctgaagacctcgagca

SEQ ID NO: 6137947 - DNA, 19 bp, Homo sapiens
ctgaagactcattcttctg

SEQ ID NO: 6137948 - DNA, 21 bp, Homo sapiens
ctgaagactcattcttctgta

SEQ ID NO: 6137949 - DNA, 22 bp, Homo sapiens
ctgaagacttacttattcttcc

SEQ ID NO: 6137950 - DNA, 21 bp, Homo sapiens
ctgaagagaagggcagggctg

SEQ ID NO: 6137951 - DNA, 16 bp, Homo sapiens
ctgaagagacaggcac

SEQ ID NO: 6137952 - DNA, 13 bp, Homo sapiens
ctgaagagacctt

SEQ ID NO: 6137953 - DNA, 16 bp, Homo sapiens
ctgaagagatacccac

SEQ ID NO: 6137954 - DNA, 20 bp, Homo sapiens
ctgaagagcgctcctctgcc

SEQ ID NO: 6137955 - DNA, 21 bp, Homo sapiens
ctgaagagcgctcctctgcct

SEQ ID NO: 6137956 - DNA, 22 bp, Homo sapiens
ctgaagagcgctcctctgcctt

SEQ ID NO: 6137957 - DNA, 15 bp, Homo sapiens
ctgaagagctcttgg

SEQ ID NO: 6137958 - DNA, 17 bp, Homo sapiens
ctgaagagctcttggcc

SEQ ID NO: 6137959 - DNA, 12 bp, Homo sapiens
ctgaagagctga

SEQ ID NO: 6137960 - DNA, 19 bp, Homo sapiens
ctgaagaggaactgggcct

SEQ ID NO: 6137961 - DNA, 17 bp, Homo sapiens
ctgaagaggaccagagg

SEQ ID NO: 6137962 - DNA, 18 bp, Homo sapiens
ctgaagaggaccagagga

SEQ ID NO: 6137963 - DNA, 14 bp, Homo sapiens
ctgaagaggaggag

SEQ ID NO: 6137964 - DNA, 15 bp, Homo sapiens
ctgaagaggaggagg

SEQ ID NO: 6137965 - DNA, 18 bp, Homo sapiens
ctgaagaggcaagagaca

SEQ ID NO: 6137966 - DNA, 22 bp, Homo sapiens
ctgaagaggcaagagacagaat

SEQ ID NO: 6137967 - DNA, 14 bp, Homo sapiens
ctgaagaggcgggc

SEQ ID NO: 6137968 - DNA, 22 bp, Homo sapiens
ctgaagaggcgggccagccagg

SEQ ID NO: 6137969 - DNA, 14 bp, Homo sapiens
ctgaagagtcctct

SEQ ID NO: 6137970 - DNA, 16 bp, Homo sapiens
ctgaagagtcctctga

SEQ ID NO: 6137971 - DNA, 20 bp, Homo sapiens
ctgaagagtgggtttcacaa

SEQ ID NO: 6137972 - DNA, 23 bp, Homo sapiens
ctgaagagttgccccgtctctgt

SEQ ID NO: 6137973 - DNA, 17 bp, Homo sapiens
ctgaagagtttgtaaat

SEQ ID NO: 6137974 - DNA, 18 bp, Homo sapiens
ctgaagagtttgtaaatg

SEQ ID NO: 6137975 - DNA, 15 bp, Homo sapiens
ctgaagatagaagaa

SEQ ID NO: 6137976 - DNA, 21 bp, Homo sapiens
ctgaagatagaagaaaaaaga

SEQ ID NO: 6137977 - DNA, 14 bp, Homo sapiens
ctgaagatatattt

SEQ ID NO: 6137978 - DNA, 12 bp, Homo sapiens
ctgaagatattc

SEQ ID NO: 6137979 - DNA, 18 bp, Homo sapiens
ctgaagatcagagctgca

SEQ ID NO: 6137980 - DNA, 21 bp, Homo sapiens
ctgaagatcagagctgcagcc

SEQ ID NO: 6137981 - DNA, 22 bp, Homo sapiens
ctgaagatgaaatatatattgt

SEQ ID NO: 6137982 - DNA, 16 bp, Homo sapiens
ctgaagatgatcattt

SEQ ID NO: 6137983 - DNA, 17 bp, Homo sapiens
ctgaagatgatcatttg

SEQ ID NO: 6137984 - DNA, 22 bp, Homo sapiens
ctgaagatggagggggctgggg

SEQ ID NO: 6137985 - DNA, 23 bp, Homo sapiens
ctgaagatggagggggctggggt

SEQ ID NO: 6137986 - DNA, 20 bp, Homo sapiens
ctgaagatggcatcctgtga

SEQ ID NO: 6137987 - DNA, 11 bp, Homo sapiens
ctgaagatgtc

SEQ ID NO: 6137988 - DNA, 24 bp, Homo sapiens
ctgaagatgtctcctcaagcctgt

SEQ ID NO: 6137989 - DNA, 18 bp, Homo sapiens
ctgaagattaggcacaca

SEQ ID NO: 6137990 - DNA, 22 bp, Homo sapiens
ctgaagattgtttatctagatg

SEQ ID NO: 6137991 - DNA, 16 bp, Homo sapiens
ctgaagcaaagtgccc

SEQ ID NO: 6137992 - DNA, 13 bp, Homo sapiens
ctgaagcaaatac

SEQ ID NO: 6137993 - DNA, 20 bp, Homo sapiens
ctgaagcaaataccaaagca

SEQ ID NO: 6137994 - DNA, 16 bp, Homo sapiens
ctgaagcaactgaaga

SEQ ID NO: 6137995 - DNA, 18 bp, Homo sapiens
ctgaagcaagagtgatat

SEQ ID NO: 6137996 - DNA, 23 bp, Homo sapiens
ctgaagcacagcaccgggggaga

SEQ ID NO: 6137997 - DNA, 14 bp, Homo sapiens
ctattaaagtgcca

SEQ ID NO: 6137998 - DNA, 23 bp, Homo sapiens
ctattaaagtggagaagcacact

SEQ ID NO: 6137999 - DNA, 11 bp, Homo sapiens
ctattaacaaa

SEQ ID NO: 6138000 - DNA, 12 bp, Homo sapiens
ctattaacatga

SEQ ID NO: 6138001 - DNA, 13 bp, Homo sapiens
ctattaacatgat

SEQ ID NO: 6138002 - DNA, 14 bp, Homo sapiens
ctattaacatgatg

SEQ ID NO: 6138003 - DNA, 15 bp, Homo sapiens
ctattaacatgatgt

SEQ ID NO: 6138004 - DNA, 19 bp, Homo sapiens
ctattaagaaaatcacatt

SEQ ID NO: 6138005 - DNA, 13 bp, Homo sapiens
ctattaagaaact

SEQ ID NO: 6138006 - DNA, 20 bp, Homo sapiens
ctattaagataaatagagtt

SEQ ID NO: 6138007 - DNA, 23 bp, Homo sapiens
ctattaagatttccaagtgccaa

SEQ ID NO: 6138008 - DNA, 16 bp, Homo sapiens
ctattaagcagtaaaa

SEQ ID NO: 6138009 - DNA, 20 bp, Homo sapiens
ctattaagcagtaaaaactg

SEQ ID NO: 6138010 - DNA, 21 bp, Homo sapiens
ctattaagcagtaaaaactgt

SEQ ID NO: 6138011 - DNA, 19 bp, Homo sapiens
ctattaaggatgtagcttt

SEQ ID NO: 6138012 - DNA, 23 bp, Homo sapiens
ctattaaggtgatatatttaaaa

SEQ ID NO: 6138013 - DNA, 23 bp, Homo sapiens
ctattaagtcatcatctccaaac

SEQ ID NO: 6138014 - DNA, 15 bp, Homo sapiens
ctattaatagaacac

SEQ ID NO: 6138015 - DNA, 11 bp, Homo sapiens
ctattaatata

SEQ ID NO: 6138016 - DNA, 17 bp, Homo sapiens
ctattaatatatgtatt

SEQ ID NO: 6138017 - DNA, 23 bp, Homo sapiens
ctattaatatcaactctgaagct

SEQ ID NO: 6138018 - DNA, 20 bp, Homo sapiens
ctattaatatttatgtgttt

SEQ ID NO: 6138019 - DNA, 13 bp, Homo sapiens
ctattaatatttg

SEQ ID NO: 6138020 - DNA, 22 bp, Homo sapiens
ctattaatatttgtttagttca

SEQ ID NO: 6138021 - DNA, 15 bp, Homo sapiens
ctattaatcaagaga

SEQ ID NO: 6138022 - DNA, 14 bp, Homo sapiens
ctattaatcttcag

SEQ ID NO: 6138023 - DNA, 14 bp, Homo sapiens
ctattaattactgt

SEQ ID NO: 6138024 - DNA, 14 bp, Homo sapiens
ctattaattccaag

SEQ ID NO: 6138025 - DNA, 23 bp, Homo sapiens
ctattaattccaagattaaaagt

SEQ ID NO: 6138026 - DNA, 14 bp, Homo sapiens
ctattaattccatg

SEQ ID NO: 6138027 - DNA, 21 bp, Homo sapiens
ctattacactgcctggaggat

SEQ ID NO: 6138028 - DNA, 17 bp, Homo sapiens
ctattacattttcagtg

SEQ ID NO: 6138029 - DNA, 17 bp, Homo sapiens
ctattaccatgagaaga

SEQ ID NO: 6138030 - DNA, 18 bp, Homo sapiens
ctattacgaagttcaaga

SEQ ID NO: 6138031 - DNA, 22 bp, Homo sapiens
ctattacgaagttcaagatcaa

SEQ ID NO: 6138032 - DNA, 20 bp, Homo sapiens
ctattacgtgggtgccctct

SEQ ID NO: 6138033 - DNA, 23 bp, Homo sapiens
ctattacgtgggtgccctctcca

SEQ ID NO: 6138034 - DNA, 13 bp, Homo sapiens
ctattactcccag

SEQ ID NO: 6138035 - DNA, 14 bp, Homo sapiens
ctattactgatgtg

SEQ ID NO: 6138036 - DNA, 15 bp, Homo sapiens
ctattacttgaactt

SEQ ID NO: 6138037 - DNA, 12 bp, Homo sapiens
ctattagacttt

SEQ ID NO: 6138038 - DNA, 15 bp, Homo sapiens
ctattagagaagaga

SEQ ID NO: 6138039 - DNA, 16 bp, Homo sapiens
ctattagagtatttcc

SEQ ID NO: 6138040 - DNA, 20 bp, Homo sapiens
ctattagagtatttcccttc

SEQ ID NO: 6138041 - DNA, 17 bp, Homo sapiens
ctattagatacacttct

SEQ ID NO: 6138042 - DNA, 20 bp, Homo sapiens
ctattagatacacttcttaa

SEQ ID NO: 6138043 - DNA, 21 bp, Homo sapiens
ctattagatacacttcttaaa

SEQ ID NO: 6138044 - DNA, 15 bp, Homo sapiens
ctattagatgtttta

SEQ ID NO: 6138045 - DNA, 14 bp, Homo sapiens
ctattagcaactgt

SEQ ID NO: 6138046 - DNA, 16 bp, Homo sapiens
ctattagccacaaaat

SEQ ID NO: 6138047 - DNA, 22 bp, Homo sapiens
ctattagccaggatcatggtgt

SEQ ID NO: 6138048 - DNA, 16 bp, Homo sapiens
ctattagcggctcctc

SEQ ID NO: 6138049 - DNA, 21 bp, Homo sapiens
ctattagctgggatatgtagt

SEQ ID NO: 6138050 - DNA, 23 bp, Homo sapiens
ctattaggctataagaagtagca

SEQ ID NO: 6138051 - DNA, 17 bp, Homo sapiens
ctattagtgttatatga

SEQ ID NO: 6138052 - DNA, 15 bp, Homo sapiens
ctattataaaaccat

SEQ ID NO: 6138053 - DNA, 16 bp, Homo sapiens
ctattataaaaccatg

SEQ ID NO: 6138054 - DNA, 15 bp, Homo sapiens
ctattataatataga

SEQ ID NO: 6138055 - DNA, 17 bp, Homo sapiens
ctattataattgtcatg

SEQ ID NO: 6138056 - DNA, 21 bp, Homo sapiens
ctattataatttaatgcatgt

SEQ ID NO: 6138057 - DNA, 18 bp, Homo sapiens
ctattatactgttatcca

SEQ ID NO: 6138058 - DNA, 19 bp, Homo sapiens
ctattatactgttatccat

SEQ ID NO: 6138059 - DNA, 20 bp, Homo sapiens
ctattatactttatcaaaga

SEQ ID NO: 6138060 - DNA, 14 bp, Homo sapiens
ctattatagccaca

SEQ ID NO: 6138061 - DNA, 12 bp, Homo sapiens
ctattatcacat

SEQ ID NO: 6138062 - DNA, 16 bp, Homo sapiens
ctattatccccatttc

SEQ ID NO: 6138063 - DNA, 15 bp, Homo sapiens
ctattatctgggttt

SEQ ID NO: 6138064 - DNA, 19 bp, Homo sapiens
ctattatctgtcagctgca

SEQ ID NO: 6138065 - DNA, 15 bp, Homo sapiens
ctattatctgtgctt

SEQ ID NO: 6138066 - DNA, 21 bp, Homo sapiens
ctattatgaatgtgaagcctt

SEQ ID NO: 6138067 - DNA, 21 bp, Homo sapiens
ctattatgatgttttgcaaag

SEQ ID NO: 6138068 - DNA, 21 bp, Homo sapiens
ctattatgtaacatccagaag

SEQ ID NO: 6138069 - DNA, 21 bp, Homo sapiens
ctattatgtggaataatacat

SEQ ID NO: 6138070 - DNA, 18 bp, Homo sapiens
ctattatgttgttagaga

SEQ ID NO: 6138071 - DNA, 19 bp, Homo sapiens
ctattatttagaaatgaac

SEQ ID NO: 6138072 - DNA, 12 bp, Homo sapiens
ctattatttcct

SEQ ID NO: 6138073 - DNA, 18 bp, Homo sapiens
ctattatttttataattg

SEQ ID NO: 6138074 - DNA, 19 bp, Homo sapiens
ctattatttttataattgt

SEQ ID NO: 6138075 - DNA, 21 bp, Homo sapiens
ctattatttttttaaagaaaa

SEQ ID NO: 6138076 - DNA, 13 bp, Homo sapiens
ctattcaaaataa

SEQ ID NO: 6138077 - DNA, 16 bp, Homo sapiens
ctattcaaacagtctc

SEQ ID NO: 6138078 - DNA, 18 bp, Homo sapiens
ctattcaaacagtctcag

SEQ ID NO: 6138079 - DNA, 23 bp, Homo sapiens
ctattcaaacagtctcaggaaat

SEQ ID NO: 6138080 - DNA, 23 bp, Homo sapiens
ctattcaaggtggccaaattatt

SEQ ID NO: 6138081 - DNA, 13 bp, Homo sapiens
ctattcaatgcaa

SEQ ID NO: 6138082 - DNA, 21 bp, Homo sapiens
ctattcaatttaattcttatt

SEQ ID NO: 6138083 - DNA, 16 bp, Homo sapiens
ctattcacaattattc

SEQ ID NO: 6138084 - DNA, 13 bp, Homo sapiens
ctattcacacaca

SEQ ID NO: 6138085 - DNA, 15 bp, Homo sapiens
ctattcaccctccac

SEQ ID NO: 6138086 - DNA, 13 bp, Homo sapiens
ctattcagaataa

SEQ ID NO: 6138087 - DNA, 15 bp, Homo sapiens
ctattcagacaagca

SEQ ID NO: 6138088 - DNA, 23 bp, Homo sapiens
ctattcagtaataactctaccct

SEQ ID NO: 6138089 - DNA, 18 bp, Homo sapiens
ctattcagttcccagaat

SEQ ID NO: 6138090 - DNA, 11 bp, Homo sapiens
ctattcagttg

SEQ ID NO: 6138091 - DNA, 14 bp, Homo sapiens
ctattcataataaa

SEQ ID NO: 6138092 - DNA, 17 bp, Homo sapiens
ctattcataataaacta

SEQ ID NO: 6138093 - DNA, 22 bp, Homo sapiens
ctattcatgtgggaaaaaaaga

SEQ ID NO: 6138094 - DNA, 19 bp, Homo sapiens
ctattcattaagtaatctt

SEQ ID NO: 6138095 - DNA, 16 bp, Homo sapiens
ctattcattacatcct

SEQ ID NO: 6138096 - DNA, 22 bp, Homo sapiens
ctattcattacatcctctgctt

SEQ ID NO: 6138097 - DNA, 22 bp, Homo sapiens
ctattcattatgcaacgtttaa

SEQ ID NO: 6138098 - DNA, 15 bp, Homo sapiens
ctattcattcactct

SEQ ID NO: 6138099 - DNA, 20 bp, Homo sapiens
ctattccaagactcagatga

SEQ ID NO: 6138100 - DNA, 20 bp, Homo sapiens
ctattccaataaagcagagt

SEQ ID NO: 6138101 - DNA, 16 bp, Homo sapiens
ctattccagctgtccc

SEQ ID NO: 6138102 - DNA, 20 bp, Homo sapiens
ctattccatgttttaaaatt

SEQ ID NO: 6138103 - DNA, 14 bp, Homo sapiens
ctattccattccct

SEQ ID NO: 6138104 - DNA, 18 bp, Homo sapiens
ctattcccaggcagggag

SEQ ID NO: 6138105 - DNA, 23 bp, Homo sapiens
ctattcccatcgctggaaaacag

SEQ ID NO: 6138106 - DNA, 12 bp, Homo sapiens
ctattccctgga

SEQ ID NO: 6138107 - DNA, 15 bp, Homo sapiens
ctattccctggaatt

SEQ ID NO: 6138108 - DNA, 15 bp, Homo sapiens
ctattccctggagac

SEQ ID NO: 6138109 - DNA, 17 bp, Homo sapiens
ctattccgagcccttag

SEQ ID NO: 6138110 - DNA, 16 bp, Homo sapiens
ctattcctaggcctca

SEQ ID NO: 6138111 - DNA, 14 bp, Homo sapiens
ctattcctgaacta

SEQ ID NO: 6138112 - DNA, 15 bp, Homo sapiens
ctattcctgaccctc

SEQ ID NO: 6138113 - DNA, 21 bp, Homo sapiens
ctattcctgaccctccctacc

SEQ ID NO: 6138114 - DNA, 17 bp, Homo sapiens
ctattcctgagagctgc

SEQ ID NO: 6138115 - DNA, 16 bp, Homo sapiens
ctattccttcacacag

SEQ ID NO: 6138116 - DNA, 12 bp, Homo sapiens
ctattccttggt

SEQ ID NO: 6138117 - DNA, 12 bp, Homo sapiens
ctattcctttcc

SEQ ID NO: 6138118 - DNA, 15 bp, Homo sapiens
ctattctagagcttt

SEQ ID NO: 6138119 - DNA, 15 bp, Homo sapiens
ctattctagcctgca

SEQ ID NO: 6138120 - DNA, 23 bp, Homo sapiens
ctattctagcctgcattgagctt

SEQ ID NO: 6138121 - DNA, 22 bp, Homo sapiens
ctattctataaaactctgcatg

SEQ ID NO: 6138122 - DNA, 21 bp, Homo sapiens
ctattctatccatctcctggt

SEQ ID NO: 6138123 - DNA, 19 bp, Homo sapiens
ctattctcaaatgctggca

SEQ ID NO: 6138124 - DNA, 13 bp, Homo sapiens
ctattctccagac

SEQ ID NO: 6138125 - DNA, 14 bp, Homo sapiens
ctattctccagaca

SEQ ID NO: 6138126 - DNA, 14 bp, Homo sapiens
ctattctccagctg

SEQ ID NO: 6138127 - DNA, 13 bp, Homo sapiens
ctattctctaaac

SEQ ID NO: 6138128 - DNA, 14 bp, Homo sapiens
ctattctctcctca

SEQ ID NO: 6138129 - DNA, 19 bp, Homo sapiens
ctattctctcctcagactg

SEQ ID NO: 6138130 - DNA, 12 bp, Homo sapiens
ctattctctctt

SEQ ID NO: 6138131 - DNA, 18 bp, Homo sapiens
ctattctgaaaaagacat

SEQ ID NO: 6138132 - DNA, 15 bp, Homo sapiens
ctattctgagaaaac

SEQ ID NO: 6138133 - DNA, 16 bp, Homo sapiens
ctattctgccatggga

SEQ ID NO: 6138134 - DNA, 19 bp, Homo sapiens
ctattctgtagttgcagct

SEQ ID NO: 6138135 - DNA, 20 bp, Homo sapiens
ctattctgtccctaggtgtt

SEQ ID NO: 6138136 - DNA, 20 bp, Homo sapiens
ctattctgtgaaactaatca

SEQ ID NO: 6138137 - DNA, 24 bp, Homo sapiens
ctattctgtgttgcattattcatt

SEQ ID NO: 6138138 - DNA, 16 bp, Homo sapiens
ctattctgtgttttat

SEQ ID NO: 6138139 - DNA, 12 bp, Homo sapiens
ctattcttaata

SEQ ID NO: 6138140 - DNA, 15 bp, Homo sapiens
ctattcttaataaaa

SEQ ID NO: 6138141 - DNA, 14 bp, Homo sapiens
ctattcttcattta

SEQ ID NO: 6138142 - DNA, 18 bp, Homo sapiens
ctattcttgatgtaaaat

SEQ ID NO: 6138143 - DNA, 23 bp, Homo sapiens
ctattcttgatttatttgcttct

SEQ ID NO: 6138144 - DNA, 21 bp, Homo sapiens
ctattcttggaccatgccaga

SEQ ID NO: 6138145 - DNA, 21 bp, Homo sapiens
ctattctttcgaaagaagaaa

SEQ ID NO: 6138146 - DNA, 13 bp, Homo sapiens
ctattctttgtat

SEQ ID NO: 6138147 - DNA, 22 bp, Homo sapiens
ctattctttgtattaccaaagc

SEQ ID NO: 6138148 - DNA, 14 bp, Homo sapiens
ctattgaaaacagt

SEQ ID NO: 6138149 - DNA, 16 bp, Homo sapiens
ctattgaacctaggac

SEQ ID NO: 6138150 - DNA, 13 bp, Homo sapiens
ctattgaactgta

SEQ ID NO: 6138151 - DNA, 13 bp, Homo sapiens
ctattgaagatgc

SEQ ID NO: 6138152 - DNA, 15 bp, Homo sapiens
ctattgacaataaaa

SEQ ID NO: 6138153 - DNA, 16 bp, Homo sapiens
ctattgacttttcaat

SEQ ID NO: 6138154 - DNA, 16 bp, Homo sapiens
ctattgagtcttcatg

SEQ ID NO: 6138155 - DNA, 18 bp, Homo sapiens
ctattgatactctttcta

SEQ ID NO: 6138156 - DNA, 17 bp, Homo sapiens
ctattgatgtacagtct

SEQ ID NO: 6138157 - DNA, 12 bp, Homo sapiens
ctattgatgttt

SEQ ID NO: 6138158 - DNA, 15 bp, Homo sapiens
ctattgatttgaaaa

SEQ ID NO: 6138159 - DNA, 18 bp, Homo sapiens
ctattgatttttacttca

SEQ ID NO: 6138160 - DNA, 22 bp, Homo sapiens
ctattgcaaaggttccaactgt

SEQ ID NO: 6138161 - DNA, 14 bp, Homo sapiens
ctattgcaaatgag

SEQ ID NO: 6138162 - DNA, 22 bp, Homo sapiens
ctattgcagatatttgatgtag

SEQ ID NO: 6138163 - DNA, 18 bp, Homo sapiens
ctattgcatgtaaaatgc

SEQ ID NO: 6138164 - DNA, 19 bp, Homo sapiens
ctattgcatttatatgtac

SEQ ID NO: 6138165 - DNA, 15 bp, Homo sapiens
ctattgccaaccagt

SEQ ID NO: 6138166 - DNA, 21 bp, Homo sapiens
ctattgccaggaatgtttcag

SEQ ID NO: 6138167 - DNA, 17 bp, Homo sapiens
ctattgcctctgagagc

SEQ ID NO: 6138168 - DNA, 19 bp, Homo sapiens
ctattgcgctctcaagacc

SEQ ID NO: 6138169 - DNA, 18 bp, Homo sapiens
ctattgctagagctcctc

SEQ ID NO: 6138170 - DNA, 15 bp, Homo sapiens
ctattgctgtaaata

SEQ ID NO: 6138171 - DNA, 15 bp, Homo sapiens
ctattgctgtctggt

SEQ ID NO: 6138172 - DNA, 14 bp, Homo sapiens
ctattgcttaaaca

SEQ ID NO: 6138173 - DNA, 21 bp, Homo sapiens
ctattgcttcaccatggcctt

SEQ ID NO: 6138174 - DNA, 22 bp, Homo sapiens
ctattgcttgggtctctctcca

SEQ ID NO: 6138175 - DNA, 21 bp, Homo sapiens
ctattggaatttttttttcct

SEQ ID NO: 6138176 - DNA, 12 bp, Homo sapiens
ctgaagcagagt

SEQ ID NO: 6138177 - DNA, 20 bp, Homo sapiens
ctgaagcagagtcaagctga

SEQ ID NO: 6138178 - DNA, 14 bp, Homo sapiens
ctgaagcagcctct

SEQ ID NO: 6138179 - DNA, 19 bp, Homo sapiens
ctgaagcaggttcccaagc

SEQ ID NO: 6138180 - DNA, 21 bp, Homo sapiens
ctgaagcaggttcccaagctc

SEQ ID NO: 6138181 - DNA, 18 bp, Homo sapiens
ctgaagcataaacatcac

SEQ ID NO: 6138182 - DNA, 20 bp, Homo sapiens
ctgaagcatgaaactgtgta

SEQ ID NO: 6138183 - DNA, 16 bp, Homo sapiens
ctgaagccaaagccaa

SEQ ID NO: 6138184 - DNA, 13 bp, Homo sapiens
ctgaagccacaca

SEQ ID NO: 6138185 - DNA, 15 bp, Homo sapiens
ctgaagccacacagc

SEQ ID NO: 6138186 - DNA, 18 bp, Homo sapiens
ctgaagccacacagccca

SEQ ID NO: 6138187 - DNA, 20 bp, Homo sapiens
ctgaagccacctctctgcct

SEQ ID NO: 6138188 - DNA, 22 bp, Homo sapiens
ctgaagccacctctctgcctgt

SEQ ID NO: 6138189 - DNA, 12 bp, Homo sapiens
ctgaagccagat

SEQ ID NO: 6138190 - DNA, 13 bp, Homo sapiens
ctgaagccagcct

SEQ ID NO: 6138191 - DNA, 15 bp, Homo sapiens
ctgaagccagctccc

SEQ ID NO: 6138192 - DNA, 17 bp, Homo sapiens
ctgaagccagctccctg

SEQ ID NO: 6138193 - DNA, 14 bp, Homo sapiens
ctgaagccagctgc

SEQ ID NO: 6138194 - DNA, 17 bp, Homo sapiens
ctgaagccagctgccct

SEQ ID NO: 6138195 - DNA, 20 bp, Homo sapiens
ctgaagccatgtagccaccc

SEQ ID NO: 6138196 - DNA, 22 bp, Homo sapiens
ctgaagccatgtagccacccaa

SEQ ID NO: 6138197 - DNA, 14 bp, Homo sapiens
ctgaagccattgtc

SEQ ID NO: 6138198 - DNA, 16 bp, Homo sapiens
ctgaagcccaaagcct

SEQ ID NO: 6138199 - DNA, 19 bp, Homo sapiens
ctgaagcccaaagcctgag

SEQ ID NO: 6138200 - DNA, 15 bp, Homo sapiens
ctgaagcccatgctt

SEQ ID NO: 6138201 - DNA, 15 bp, Homo sapiens
ctgaagccccccttt

SEQ ID NO: 6138202 - DNA, 21 bp, Homo sapiens
ctgaagccctcccaggtgtta

SEQ ID NO: 6138203 - DNA, 12 bp, Homo sapiens
ctgaagccgcca

SEQ ID NO: 6138204 - DNA, 21 bp, Homo sapiens
ctgaagccggacagctgccca

SEQ ID NO: 6138205 - DNA, 22 bp, Homo sapiens
ctgaagccggacagctgcccag

SEQ ID NO: 6138206 - DNA, 15 bp, Homo sapiens
ctgaagccgtgcctg

SEQ ID NO: 6138207 - DNA, 16 bp, Homo sapiens
ctgaagcctatttatt

SEQ ID NO: 6138208 - DNA, 17 bp, Homo sapiens
ctgaagcctatttattt

SEQ ID NO: 6138209 - DNA, 13 bp, Homo sapiens
ctgaagcctctgc

SEQ ID NO: 6138210 - DNA, 12 bp, Homo sapiens
ctgaagcctgga

SEQ ID NO: 6138211 - DNA, 17 bp, Homo sapiens
ctgaagcctggacgcag

SEQ ID NO: 6138212 - DNA, 20 bp, Homo sapiens
ctgaagcctggacgcagcca

SEQ ID NO: 6138213 - DNA, 16 bp, Homo sapiens
ctgaagccttcttctg

SEQ ID NO: 6138214 - DNA, 19 bp, Homo sapiens
ctgaagccttcttctgcca

SEQ ID NO: 6138215 - DNA, 23 bp, Homo sapiens
ctgaagcctttgcattttggaga

SEQ ID NO: 6138216 - DNA, 16 bp, Homo sapiens
ctgaagcgaacatctt

SEQ ID NO: 6138217 - DNA, 23 bp, Homo sapiens
ctgaagcgaacatcttcatataa

SEQ ID NO: 6138218 - DNA, 17 bp, Homo sapiens
ctgaagcgactctcctg

SEQ ID NO: 6138219 - DNA, 14 bp, Homo sapiens
ctgaagctagagga

SEQ ID NO: 6138220 - DNA, 21 bp, Homo sapiens
ctgaagctatcgtaaaattaa

SEQ ID NO: 6138221 - DNA, 17 bp, Homo sapiens
ctgaagctgacagcact

SEQ ID NO: 6138222 - DNA, 16 bp, Homo sapiens
ctgaagctgcctgctt

SEQ ID NO: 6138223 - DNA, 21 bp, Homo sapiens
ctgaagctgctgcagccctgc

SEQ ID NO: 6138224 - DNA, 18 bp, Homo sapiens
ctgaagctgctgcagctc

SEQ ID NO: 6138225 - DNA, 14 bp, Homo sapiens
ctgaagctgctgga

SEQ ID NO: 6138226 - DNA, 14 bp, Homo sapiens
ctgaagctgctgta

SEQ ID NO: 6138227 - DNA, 15 bp, Homo sapiens
ctgaagctgctgtgt

SEQ ID NO: 6138228 - DNA, 17 bp, Homo sapiens
ctgaagctgctgtgtcc

SEQ ID NO: 6138229 - DNA, 15 bp, Homo sapiens
ctgaagctggcctgg

SEQ ID NO: 6138230 - DNA, 11 bp, Homo sapiens
ctgaagctggg

SEQ ID NO: 6138231 - DNA, 16 bp, Homo sapiens
ctgaagctggggcttg

SEQ ID NO: 6138232 - DNA, 19 bp, Homo sapiens
ctgaagcttatgtttctta

SEQ ID NO: 6138233 - DNA, 15 bp, Homo sapiens
ctgaagcttgactcc

SEQ ID NO: 6138234 - DNA, 17 bp, Homo sapiens
ctgaaggaaaagcaaga

SEQ ID NO: 6138235 - DNA, 22 bp, Homo sapiens
ctgaaggaaaagcaagaaacag

SEQ ID NO: 6138236 - DNA, 14 bp, Homo sapiens
ctgaaggaagagaa

SEQ ID NO: 6138237 - DNA, 20 bp, Homo sapiens
ctgaaggaatagccagagag

SEQ ID NO: 6138238 - DNA, 23 bp, Homo sapiens
ctgaaggaatagccagagaggag

SEQ ID NO: 6138239 - DNA, 19 bp, Homo sapiens
ctgaaggacacttcctgcc

SEQ ID NO: 6138240 - DNA, 16 bp, Homo sapiens
ctgaaggaccccaggt

SEQ ID NO: 6138241 - DNA, 23 bp, Homo sapiens
ctgaaggacctgagctggccagg

SEQ ID NO: 6138242 - DNA, 12 bp, Homo sapiens
ctgaaggagaag

SEQ ID NO: 6138243 - DNA, 13 bp, Homo sapiens
ctgaaggaggcca

SEQ ID NO: 6138244 - DNA, 18 bp, Homo sapiens
ctgaaggaggcggggctc

SEQ ID NO: 6138245 - DNA, 20 bp, Homo sapiens
ctgaaggaggcggggctcta

SEQ ID NO: 6138246 - DNA, 22 bp, Homo sapiens
ctgaaggatcctggaaccactg

SEQ ID NO: 6138247 - DNA, 14 bp, Homo sapiens
ctgaaggattctgg

SEQ ID NO: 6138248 - DNA, 19 bp, Homo sapiens
ctgaaggattttaaatgct

SEQ ID NO: 6138249 - DNA, 16 bp, Homo sapiens
ctgaaggcaacctgga

SEQ ID NO: 6138250 - DNA, 17 bp, Homo sapiens
ctgaaggcaacctggaa

SEQ ID NO: 6138251 - DNA, 23 bp, Homo sapiens
ctgaaggcagagggatgaaatgc

SEQ ID NO: 6138252 - DNA, 18 bp, Homo sapiens
ctgaaggcagcatgtata

SEQ ID NO: 6138253 - DNA, 14 bp, Homo sapiens
ctgaaggcagggct

SEQ ID NO: 6138254 - DNA, 22 bp, Homo sapiens
ctgaaggcagggctcctccctg

SEQ ID NO: 6138255 - DNA, 19 bp, Homo sapiens
ctgaaggcctccatttgta

SEQ ID NO: 6138256 - DNA, 13 bp, Homo sapiens
ctgaaggcctggc

SEQ ID NO: 6138257 - DNA, 21 bp, Homo sapiens
ctgaaggcctggcccacagca

SEQ ID NO: 6138258 - DNA, 17 bp, Homo sapiens
ctgaaggctaaaaagca

SEQ ID NO: 6138259 - DNA, 22 bp, Homo sapiens
ctgaaggctaaaaagcaacagg

SEQ ID NO: 6138260 - DNA, 14 bp, Homo sapiens
ctgaaggcttctgc

SEQ ID NO: 6138261 - DNA, 17 bp, Homo sapiens
ctgaaggcttctgcagc

SEQ ID NO: 6138262 - DNA, 13 bp, Homo sapiens
ctgaaggctttca

SEQ ID NO: 6138263 - DNA, 18 bp, Homo sapiens
ctgaaggctttcagggcc

SEQ ID NO: 6138264 - DNA, 21 bp, Homo sapiens
ctgaagggaagcccagcctgc

SEQ ID NO: 6138265 - DNA, 15 bp, Homo sapiens
ctgaagggaaggcaa

SEQ ID NO: 6138266 - DNA, 18 bp, Homo sapiens
ctgaagggaaggcaaagg

SEQ ID NO: 6138267 - DNA, 17 bp, Homo sapiens
ctgaagggaatcacatc

SEQ ID NO: 6138268 - DNA, 16 bp, Homo sapiens
ctgaagggaattgttt

SEQ ID NO: 6138269 - DNA, 22 bp, Homo sapiens
ctgaagggaattgtttttataa

SEQ ID NO: 6138270 - DNA, 12 bp, Homo sapiens
ctgaagggaggg

SEQ ID NO: 6138271 - DNA, 21 bp, Homo sapiens
ctgaagggaggggaagagaga

SEQ ID NO: 6138272 - DNA, 17 bp, Homo sapiens
ctgaagggcctcccagc

SEQ ID NO: 6138273 - DNA, 16 bp, Homo sapiens
ctgaaggggaaaacct

SEQ ID NO: 6138274 - DNA, 14 bp, Homo sapiens
ctgaaggggcacac

SEQ ID NO: 6138275 - DNA, 16 bp, Homo sapiens
ctgaaggggcacacca

SEQ ID NO: 6138276 - DNA, 15 bp, Homo sapiens
ctgaagggggcggcc

SEQ ID NO: 6138277 - DNA, 16 bp, Homo sapiens
ctgaaggggttttctt

SEQ ID NO: 6138278 - DNA, 15 bp, Homo sapiens
ctgaagggtgacatc

SEQ ID NO: 6138279 - DNA, 20 bp, Homo sapiens
ctgaagggtgacatcccagg

SEQ ID NO: 6138280 - DNA, 16 bp, Homo sapiens
ctgaagggtgctcagt

SEQ ID NO: 6138281 - DNA, 20 bp, Homo sapiens
ctgaagggtgctcagtctcc

SEQ ID NO: 6138282 - DNA, 20 bp, Homo sapiens
ctgaagggtggatgtgctgg

SEQ ID NO: 6138283 - DNA, 24 bp, Homo sapiens
ctgaagggtggatgtgctggaggg

SEQ ID NO: 6138284 - DNA, 19 bp, Homo sapiens
ctgaaggtattggcctgtt

SEQ ID NO: 6138285 - DNA, 20 bp, Homo sapiens
ctgaaggtattggcctgttc

SEQ ID NO: 6138286 - DNA, 21 bp, Homo sapiens
ctgaaggtattggcctgttca

SEQ ID NO: 6138287 - DNA, 20 bp, Homo sapiens
ctgaaggtcaataaattatt

SEQ ID NO: 6138288 - DNA, 16 bp, Homo sapiens
ctgaaggtccaggctt

SEQ ID NO: 6138289 - DNA, 15 bp, Homo sapiens
ctgaaggtcccctgg

SEQ ID NO: 6138290 - DNA, 14 bp, Homo sapiens
ctgaaggtgcagtt

SEQ ID NO: 6138291 - DNA, 22 bp, Homo sapiens
ctgaaggtgttgggtcagtggc

SEQ ID NO: 6138292 - DNA, 23 bp, Homo sapiens
ctgaaggtgttgggtcagtggcc

SEQ ID NO: 6138293 - DNA, 16 bp, Homo sapiens
ctgaaggtttcctggt

SEQ ID NO: 6138294 - DNA, 17 bp, Homo sapiens
ctgaaggtttcctggtc

SEQ ID NO: 6138295 - DNA, 21 bp, Homo sapiens
ctgaaggttttttttttaagt

SEQ ID NO: 6138296 - DNA, 21 bp, Homo sapiens
ctgaagtaaaacaaacaatac

SEQ ID NO: 6138297 - DNA, 17 bp, Homo sapiens
ctgaagtaaacagctgt

SEQ ID NO: 6138298 - DNA, 14 bp, Homo sapiens
ctgaagtaataact

SEQ ID NO: 6138299 - DNA, 19 bp, Homo sapiens
ctgaagtaataactgatga

SEQ ID NO: 6138300 - DNA, 18 bp, Homo sapiens
ctgaagtaatgacagatt

SEQ ID NO: 6138301 - DNA, 21 bp, Homo sapiens
ctgaagtaatttgtaaaaaag

SEQ ID NO: 6138302 - DNA, 17 bp, Homo sapiens
ctgaagtacagtatatt

SEQ ID NO: 6138303 - DNA, 16 bp, Homo sapiens
ctgaagtactaacaca

SEQ ID NO: 6138304 - DNA, 20 bp, Homo sapiens
ctgaagtacttaaacttcca

SEQ ID NO: 6138305 - DNA, 17 bp, Homo sapiens
ctgaagtagtgtgcagt

SEQ ID NO: 6138306 - DNA, 15 bp, Homo sapiens
ctgaagtatacattt

SEQ ID NO: 6138307 - DNA, 14 bp, Homo sapiens
ctgaagtatgaagt

SEQ ID NO: 6138308 - DNA, 16 bp, Homo sapiens
ctgaagtcaaacctta

SEQ ID NO: 6138309 - DNA, 15 bp, Homo sapiens
ctgaagtcacacagt

SEQ ID NO: 6138310 - DNA, 16 bp, Homo sapiens
ctgaagtcacacagtg

SEQ ID NO: 6138311 - DNA, 21 bp, Homo sapiens
ctgaagtcacatcacaggaca

SEQ ID NO: 6138312 - DNA, 14 bp, Homo sapiens
ctgaagtcagatct

SEQ ID NO: 6138313 - DNA, 15 bp, Homo sapiens
ctgaagtcagatctg

SEQ ID NO: 6138314 - DNA, 20 bp, Homo sapiens
ctgaagtcccttcctgtcct

SEQ ID NO: 6138315 - DNA, 20 bp, Homo sapiens
ctgaagtctcaagaactgcc

SEQ ID NO: 6138316 - DNA, 14 bp, Homo sapiens
ctgaagtctccccg

SEQ ID NO: 6138317 - DNA, 14 bp, Homo sapiens
ctgaagtctgaaat

SEQ ID NO: 6138318 - DNA, 15 bp, Homo sapiens
ctgaagtctgaaatt

SEQ ID NO: 6138319 - DNA, 22 bp, Homo sapiens
ctgaagtctgagcccatttctg

SEQ ID NO: 6138320 - DNA, 18 bp, Homo sapiens
ctgaagtcttctcctcca

SEQ ID NO: 6138321 - DNA, 13 bp, Homo sapiens
ctgaagtcttgca

SEQ ID NO: 6138322 - DNA, 16 bp, Homo sapiens
ctgaagtcttgcattg

SEQ ID NO: 6138323 - DNA, 19 bp, Homo sapiens
ctgaagtcttgcattgaat

SEQ ID NO: 6138324 - DNA, 24 bp, Homo sapiens
ctgaagtctttgtacagacaacaa

SEQ ID NO: 6138325 - DNA, 14 bp, Homo sapiens
ctgaagtgaaggag

SEQ ID NO: 6138326 - DNA, 20 bp, Homo sapiens
ctgaagtgaaggagaaagga

SEQ ID NO: 6138327 - DNA, 22 bp, Homo sapiens
ctgaagtgaaggagaaaggagc

SEQ ID NO: 6138328 - DNA, 18 bp, Homo sapiens
ctgaagtgaatacatggt

SEQ ID NO: 6138329 - DNA, 19 bp, Homo sapiens
ctgaagtgaccccagctcc

SEQ ID NO: 6138330 - DNA, 22 bp, Homo sapiens
ctgaagtgaccccagctccagg

SEQ ID NO: 6138331 - DNA, 16 bp, Homo sapiens
ctgaagtgacctcact

SEQ ID NO: 6138332 - DNA, 16 bp, Homo sapiens
ctgaagtgattgaaag

SEQ ID NO: 6138333 - DNA, 17 bp, Homo sapiens
ctgaagtgcagctcagg

SEQ ID NO: 6138334 - DNA, 17 bp, Homo sapiens
ctgaagtgcatccaaag

SEQ ID NO: 6138335 - DNA, 16 bp, Homo sapiens
ctgaagtgcatgggtc

SEQ ID NO: 6138336 - DNA, 22 bp, Homo sapiens
ctgaagtgcatgggtcagggtg

SEQ ID NO: 6138337 - DNA, 14 bp, Homo sapiens
ctgaagtgctcttt

SEQ ID NO: 6138338 - DNA, 22 bp, Homo sapiens
ctgaagtgctgctccatgtttc

SEQ ID NO: 6138339 - DNA, 16 bp, Homo sapiens
ctgaagtgcttagtgt

SEQ ID NO: 6138340 - DNA, 20 bp, Homo sapiens
ctgaagtgcttgcagatcat

SEQ ID NO: 6138341 - DNA, 23 bp, Homo sapiens
ctgaagtggactctttggtggct

SEQ ID NO: 6138342 - DNA, 19 bp, Homo sapiens
ctgaagtggccctccctca

SEQ ID NO: 6138343 - DNA, 23 bp, Homo sapiens
ctgaagtgtctaatgcattaact

SEQ ID NO: 6138344 - DNA, 19 bp, Homo sapiens
ctgaagtgtgtccatcctg

SEQ ID NO: 6138345 - DNA, 17 bp, Homo sapiens
ctgaagtgttctctaga

SEQ ID NO: 6138346 - DNA, 15 bp, Homo sapiens
ctgaagttaaaatga

SEQ ID NO: 6138347 - DNA, 23 bp, Homo sapiens
ctgaagttagaaataagaatggt

SEQ ID NO: 6138348 - DNA, 19 bp, Homo sapiens
ctgaagttcagccaccctg

SEQ ID NO: 6138349 - DNA, 13 bp, Homo sapiens
ctgaagttctgag

SEQ ID NO: 6138350 - DNA, 23 bp, Homo sapiens
ctgaagttctgcctctgatgtat

SEQ ID NO: 6138351 - DNA, 15 bp, Homo sapiens
ctgaagttgaacatg

SEQ ID NO: 6138352 - DNA, 18 bp, Homo sapiens
ctgaagttgctgctgtga

SEQ ID NO: 6138353 - DNA, 17 bp, Homo sapiens
ctgaagtttcatttatg

SEQ ID NO: 6138354 - DNA, 12 bp, Homo sapiens
ctattggacaga

SEQ ID NO: 6138355 - DNA, 18 bp, Homo sapiens
ctattggatttgtccaaa

SEQ ID NO: 6138356 - DNA, 19 bp, Homo sapiens
ctattggatttgtccaaac

SEQ ID NO: 6138357 - DNA, 22 bp, Homo sapiens
ctattggatttgtccaaacagg

SEQ ID NO: 6138358 - DNA, 21 bp, Homo sapiens
ctattggcttactgaaagaca

SEQ ID NO: 6138359 - DNA, 13 bp, Homo sapiens
ctattgggagagg

SEQ ID NO: 6138360 - DNA, 19 bp, Homo sapiens
ctattggggaactcattgt

SEQ ID NO: 6138361 - DNA, 18 bp, Homo sapiens
ctattggggttggggggg

SEQ ID NO: 6138362 - DNA, 21 bp, Homo sapiens
ctattgggttaatttctccct

SEQ ID NO: 6138363 - DNA, 15 bp, Homo sapiens
ctattgggttcatta

SEQ ID NO: 6138364 - DNA, 23 bp, Homo sapiens
ctattgggttcattattggaatt

SEQ ID NO: 6138365 - DNA, 19 bp, Homo sapiens
ctattggtgcttgactctc

SEQ ID NO: 6138366 - DNA, 22 bp, Homo sapiens
ctattggtgcttgactctcact

SEQ ID NO: 6138367 - DNA, 13 bp, Homo sapiens
ctattgtaaatat

SEQ ID NO: 6138368 - DNA, 14 bp, Homo sapiens
ctattgtaaatatg

SEQ ID NO: 6138369 - DNA, 15 bp, Homo sapiens
ctattgtaaatttgg

SEQ ID NO: 6138370 - DNA, 12 bp, Homo sapiens
ctattgtaagat

SEQ ID NO: 6138371 - DNA, 16 bp, Homo sapiens
ctattgtaagataaaa

SEQ ID NO: 6138372 - DNA, 12 bp, Homo sapiens
ctattgtacaga

SEQ ID NO: 6138373 - DNA, 16 bp, Homo sapiens
ctattgtagcatttct

SEQ ID NO: 6138374 - DNA, 23 bp, Homo sapiens
ctattgtattatagtactgcttt

SEQ ID NO: 6138375 - DNA, 19 bp, Homo sapiens
ctattgtcaccagggctgg

SEQ ID NO: 6138376 - DNA, 16 bp, Homo sapiens
ctattgtctttcattt

SEQ ID NO: 6138377 - DNA, 19 bp, Homo sapiens
ctattgtgaatatttggaa

SEQ ID NO: 6138378 - DNA, 19 bp, Homo sapiens
ctattgtgacagagccatg

SEQ ID NO: 6138379 - DNA, 20 bp, Homo sapiens
ctattgtgatttgactgttt

SEQ ID NO: 6138380 - DNA, 15 bp, Homo sapiens
ctattgtgcctctgg

SEQ ID NO: 6138381 - DNA, 20 bp, Homo sapiens
ctattgtgctttctatctaa

SEQ ID NO: 6138382 - DNA, 21 bp, Homo sapiens
ctattgtgggacttattacaa

SEQ ID NO: 6138383 - DNA, 16 bp, Homo sapiens
ctattgttaaacaaat

SEQ ID NO: 6138384 - DNA, 19 bp, Homo sapiens
ctattgttaaacaaatgat

SEQ ID NO: 6138385 - DNA, 20 bp, Homo sapiens
ctattgttactctggttctt

SEQ ID NO: 6138386 - DNA, 17 bp, Homo sapiens
ctattgttgaataaatg

SEQ ID NO: 6138387 - DNA, 23 bp, Homo sapiens
ctattgttgaataaatgtatctg

SEQ ID NO: 6138388 - DNA, 16 bp, Homo sapiens
ctattgttgtgggctt

SEQ ID NO: 6138389 - DNA, 22 bp, Homo sapiens
ctattgtttaaaaacaggaaaa

SEQ ID NO: 6138390 - DNA, 23 bp, Homo sapiens
ctattgtttaaaaacaggaaaaa

SEQ ID NO: 6138391 - DNA, 16 bp, Homo sapiens
ctattgtttagatatt

SEQ ID NO: 6138392 - DNA, 14 bp, Homo sapiens
ctattgtttattct

SEQ ID NO: 6138393 - DNA, 21 bp, Homo sapiens
ctattgtttctttaagaaagt

SEQ ID NO: 6138394 - DNA, 15 bp, Homo sapiens
ctatttaaaaaatga

SEQ ID NO: 6138395 - DNA, 17 bp, Homo sapiens
ctatttaaaagtataaa

SEQ ID NO: 6138396 - DNA, 14 bp, Homo sapiens
ctatttaaaattgg

SEQ ID NO: 6138397 - DNA, 13 bp, Homo sapiens
ctatttaaagaaa

SEQ ID NO: 6138398 - DNA, 15 bp, Homo sapiens
ctatttaaagcctcc

SEQ ID NO: 6138399 - DNA, 13 bp, Homo sapiens
ctatttaaatgaa

SEQ ID NO: 6138400 - DNA, 14 bp, Homo sapiens
ctatttaaattctt

SEQ ID NO: 6138401 - DNA, 9 bp, Homo sapiens
ctatttaac

SEQ ID NO: 6138402 - DNA, 13 bp, Homo sapiens
ctatttaactgac

SEQ ID NO: 6138403 - DNA, 22 bp, Homo sapiens
ctatttaagagaacaagcaaat

SEQ ID NO: 6138404 - DNA, 21 bp, Homo sapiens
ctatttaagtactatctttgt

SEQ ID NO: 6138405 - DNA, 21 bp, Homo sapiens
ctatttaagtggactgtattt

SEQ ID NO: 6138406 - DNA, 22 bp, Homo sapiens
ctatttaagtggactgtatttc

SEQ ID NO: 6138407 - DNA, 20 bp, Homo sapiens
ctatttaatatctggcactg

SEQ ID NO: 6138408 - DNA, 18 bp, Homo sapiens
ctatttaattaggaaaaa

SEQ ID NO: 6138409 - DNA, 15 bp, Homo sapiens
ctatttaattgaaac

SEQ ID NO: 6138410 - DNA, 12 bp, Homo sapiens
ctatttaatttt

SEQ ID NO: 6138411 - DNA, 16 bp, Homo sapiens
ctatttacaaatgaag

SEQ ID NO: 6138412 - DNA, 22 bp, Homo sapiens
ctatttacactattatttccta

SEQ ID NO: 6138413 - DNA, 17 bp, Homo sapiens
ctatttactttattaac

SEQ ID NO: 6138414 - DNA, 11 bp, Homo sapiens
ctatttagaga

SEQ ID NO: 6138415 - DNA, 18 bp, Homo sapiens
ctatttagcatgacaagc

SEQ ID NO: 6138416 - DNA, 23 bp, Homo sapiens
ctatttagcatgacaagccccag

SEQ ID NO: 6138417 - DNA, 22 bp, Homo sapiens
ctatttagtttttgtaatttat

SEQ ID NO: 6138418 - DNA, 13 bp, Homo sapiens
ctatttataaact

SEQ ID NO: 6138419 - DNA, 21 bp, Homo sapiens
ctatttataatacagaatctt

SEQ ID NO: 6138420 - DNA, 20 bp, Homo sapiens
ctatttataatgaataaaca

SEQ ID NO: 6138421 - DNA, 12 bp, Homo sapiens
ctatttatatac

SEQ ID NO: 6138422 - DNA, 13 bp, Homo sapiens
ctatttatatcac

SEQ ID NO: 6138423 - DNA, 13 bp, Homo sapiens
ctatttatattca

SEQ ID NO: 6138424 - DNA, 14 bp, Homo sapiens
ctatttatattcat

SEQ ID NO: 6138425 - DNA, 18 bp, Homo sapiens
ctatttatccctttcctg

SEQ ID NO: 6138426 - DNA, 23 bp, Homo sapiens
ctatttatccctttcctggtttc

SEQ ID NO: 6138427 - DNA, 11 bp, Homo sapiens
ctatttatctg

SEQ ID NO: 6138428 - DNA, 21 bp, Homo sapiens
ctatttatctgtagtaaacta

SEQ ID NO: 6138429 - DNA, 16 bp, Homo sapiens
ctatttatctgtctga

SEQ ID NO: 6138430 - DNA, 19 bp, Homo sapiens
ctatttatctgtgtttttg

SEQ ID NO: 6138431 - DNA, 11 bp, Homo sapiens
ctatttatgaa

SEQ ID NO: 6138432 - DNA, 19 bp, Homo sapiens
ctatttatgagatcactga

SEQ ID NO: 6138433 - DNA, 11 bp, Homo sapiens
ctatttatgca

SEQ ID NO: 6138434 - DNA, 22 bp, Homo sapiens
ctatttatgtgatccttttgga

SEQ ID NO: 6138435 - DNA, 18 bp, Homo sapiens
ctatttattaaaaacatg

SEQ ID NO: 6138436 - DNA, 15 bp, Homo sapiens
ctatttattaatatt

SEQ ID NO: 6138437 - DNA, 21 bp, Homo sapiens
ctatttattcattcagtgaga

SEQ ID NO: 6138438 - DNA, 16 bp, Homo sapiens
ctatttattcctgtta

SEQ ID NO: 6138439 - DNA, 12 bp, Homo sapiens
ctatttattggg

SEQ ID NO: 6138440 - DNA, 16 bp, Homo sapiens
ctatttattggggtgc

SEQ ID NO: 6138441 - DNA, 18 bp, Homo sapiens
ctatttattttcctaaag

SEQ ID NO: 6138442 - DNA, 22 bp, Homo sapiens
ctatttatttttgcaaaccctg

SEQ ID NO: 6138443 - DNA, 18 bp, Homo sapiens
ctatttcaaaaatttgga

SEQ ID NO: 6138444 - DNA, 19 bp, Homo sapiens
ctatttcaaaaatttggaa

SEQ ID NO: 6138445 - DNA, 19 bp, Homo sapiens
ctatttcaatgagttattg

SEQ ID NO: 6138446 - DNA, 16 bp, Homo sapiens
ctatttcactggagca

SEQ ID NO: 6138447 - DNA, 17 bp, Homo sapiens
ctatttcagccaatctg

SEQ ID NO: 6138448 - DNA, 17 bp, Homo sapiens
ctatttcagcctcctgt

SEQ ID NO: 6138449 - DNA, 13 bp, Homo sapiens
ctatttcagctgc

SEQ ID NO: 6138450 - DNA, 19 bp, Homo sapiens
ctatttcagtacttcagca

SEQ ID NO: 6138451 - DNA, 21 bp, Homo sapiens
ctatttcagtgttacctgtgt

SEQ ID NO: 6138452 - DNA, 14 bp, Homo sapiens
ctatttcatcacaa

SEQ ID NO: 6138453 - DNA, 23 bp, Homo sapiens
ctatttcatcagaacagctgttg

SEQ ID NO: 6138454 - DNA, 18 bp, Homo sapiens
ctatttccactgaacaaa

SEQ ID NO: 6138455 - DNA, 23 bp, Homo sapiens
ctatttccccaggggaaaatgaa

SEQ ID NO: 6138456 - DNA, 21 bp, Homo sapiens
ctatttccctctactgagtaa

SEQ ID NO: 6138457 - DNA, 20 bp, Homo sapiens
ctatttcctgaacctggaaa

SEQ ID NO: 6138458 - DNA, 17 bp, Homo sapiens
ctatttccttccagcct

SEQ ID NO: 6138459 - DNA, 16 bp, Homo sapiens
ctatttcctttgcgca

SEQ ID NO: 6138460 - DNA, 21 bp, Homo sapiens
ctatttcggaaatacactaca

SEQ ID NO: 6138461 - DNA, 21 bp, Homo sapiens
ctatttctagtagaaagaaaa

SEQ ID NO: 6138462 - DNA, 12 bp, Homo sapiens
ctatttctagtt

SEQ ID NO: 6138463 - DNA, 14 bp, Homo sapiens
ctatttctatctgc

SEQ ID NO: 6138464 - DNA, 16 bp, Homo sapiens
ctatttctattcctta

SEQ ID NO: 6138465 - DNA, 17 bp, Homo sapiens
ctatttctattccttat

SEQ ID NO: 6138466 - DNA, 14 bp, Homo sapiens
ctatttctctcccc

SEQ ID NO: 6138467 - DNA, 15 bp, Homo sapiens
ctatttctctctttc

SEQ ID NO: 6138468 - DNA, 14 bp, Homo sapiens
ctatttctctgtgt

SEQ ID NO: 6138469 - DNA, 15 bp, Homo sapiens
ctatttctctgtgta

SEQ ID NO: 6138470 - DNA, 14 bp, Homo sapiens
ctatttctctttct

SEQ ID NO: 6138471 - DNA, 17 bp, Homo sapiens
ctatttctctttcttta

SEQ ID NO: 6138472 - DNA, 13 bp, Homo sapiens
ctatttctgatga

SEQ ID NO: 6138473 - DNA, 17 bp, Homo sapiens
ctatttctgatgatgtc

SEQ ID NO: 6138474 - DNA, 12 bp, Homo sapiens
ctatttctgctg

SEQ ID NO: 6138475 - DNA, 20 bp, Homo sapiens
ctatttctgctgaattttca

SEQ ID NO: 6138476 - DNA, 21 bp, Homo sapiens
ctatttctgctgaattttcac

SEQ ID NO: 6138477 - DNA, 18 bp, Homo sapiens
ctatttctggcctcagca

SEQ ID NO: 6138478 - DNA, 13 bp, Homo sapiens
ctatttctgtgtc

SEQ ID NO: 6138479 - DNA, 16 bp, Homo sapiens
ctatttctgtgtccag

SEQ ID NO: 6138480 - DNA, 16 bp, Homo sapiens
ctatttcttaaacact

SEQ ID NO: 6138481 - DNA, 14 bp, Homo sapiens
ctatttcttgaaga

SEQ ID NO: 6138482 - DNA, 15 bp, Homo sapiens
ctatttgaaatacta

SEQ ID NO: 6138483 - DNA, 22 bp, Homo sapiens
ctatttgaaatactaaaagcaa

SEQ ID NO: 6138484 - DNA, 13 bp, Homo sapiens
ctatttgaagaaa

SEQ ID NO: 6138485 - DNA, 14 bp, Homo sapiens
ctatttgaagaaaa

SEQ ID NO: 6138486 - DNA, 23 bp, Homo sapiens
ctatttgaagaaaaaaatgtaca

SEQ ID NO: 6138487 - DNA, 16 bp, Homo sapiens
ctatttgacccccaca

SEQ ID NO: 6138488 - DNA, 12 bp, Homo sapiens
ctatttgactgc

SEQ ID NO: 6138489 - DNA, 14 bp, Homo sapiens
ctatttgactgctt

SEQ ID NO: 6138490 - DNA, 14 bp, Homo sapiens
ctatttgagaagtt

SEQ ID NO: 6138491 - DNA, 18 bp, Homo sapiens
ctatttgagaagttctca

SEQ ID NO: 6138492 - DNA, 20 bp, Homo sapiens
ctatttgagaagttctcaga

SEQ ID NO: 6138493 - DNA, 23 bp, Homo sapiens
ctatttgagcatgcacagctgct

SEQ ID NO: 6138494 - DNA, 19 bp, Homo sapiens
ctatttgatgtaatacttc

SEQ ID NO: 6138495 - DNA, 12 bp, Homo sapiens
ctatttgatttg

SEQ ID NO: 6138496 - DNA, 11 bp, Homo sapiens
ctatttgcaat

SEQ ID NO: 6138497 - DNA, 14 bp, Homo sapiens
ctatttgcagaggc

SEQ ID NO: 6138498 - DNA, 21 bp, Homo sapiens
ctatttgctatctgaactaat

SEQ ID NO: 6138499 - DNA, 13 bp, Homo sapiens
ctatttgctttag

SEQ ID NO: 6138500 - DNA, 12 bp, Homo sapiens
ctatttgtacaa

SEQ ID NO: 6138501 - DNA, 14 bp, Homo sapiens
ctatttgtacaatt

SEQ ID NO: 6138502 - DNA, 15 bp, Homo sapiens
ctatttgtacaattt

SEQ ID NO: 6138503 - DNA, 12 bp, Homo sapiens
ctatttgtctct

SEQ ID NO: 6138504 - DNA, 13 bp, Homo sapiens
ctatttgtctctt

SEQ ID NO: 6138505 - DNA, 18 bp, Homo sapiens
ctatttgtcttctccttc

SEQ ID NO: 6138506 - DNA, 15 bp, Homo sapiens
ctatttgtgactttt

SEQ ID NO: 6138507 - DNA, 16 bp, Homo sapiens
ctatttgtgtaactga

SEQ ID NO: 6138508 - DNA, 16 bp, Homo sapiens
ctatttgtgtgtatgc

SEQ ID NO: 6138509 - DNA, 18 bp, Homo sapiens
ctatttgtttacatgcag

SEQ ID NO: 6138510 - DNA, 20 bp, Homo sapiens
ctatttgtttcattaaagag

SEQ ID NO: 6138511 - DNA, 16 bp, Homo sapiens
ctatttgttttcatgg

SEQ ID NO: 6138512 - DNA, 13 bp, Homo sapiens
ctattttaaaaaa

SEQ ID NO: 6138513 - DNA, 15 bp, Homo sapiens
ctattttaaaaccat

SEQ ID NO: 6138514 - DNA, 16 bp, Homo sapiens
ctattttaaaaccatg

SEQ ID NO: 6138515 - DNA, 18 bp, Homo sapiens
ctattttaaaaccatgca

SEQ ID NO: 6138516 - DNA, 19 bp, Homo sapiens
ctattttaaaattcatgga

SEQ ID NO: 6138517 - DNA, 11 bp, Homo sapiens
ctattttaaga

SEQ ID NO: 6138518 - DNA, 19 bp, Homo sapiens
ctattttaagacgtgaatg

SEQ ID NO: 6138519 - DNA, 18 bp, Homo sapiens
ctattttaataaacactc

SEQ ID NO: 6138520 - DNA, 15 bp, Homo sapiens
ctattttaataaaga

SEQ ID NO: 6138521 - DNA, 12 bp, Homo sapiens
ctattttaatgt

SEQ ID NO: 6138522 - DNA, 22 bp, Homo sapiens
ctattttaatgtatatttgctg

SEQ ID NO: 6138523 - DNA, 14 bp, Homo sapiens
ctattttaattact

SEQ ID NO: 6138524 - DNA, 23 bp, Homo sapiens
ctattttactgtcttaattaagt

SEQ ID NO: 6138525 - DNA, 14 bp, Homo sapiens
ctattttactttgt

SEQ ID NO: 6138526 - DNA, 12 bp, Homo sapiens
ctattttattcc

SEQ ID NO: 6138527 - DNA, 13 bp, Homo sapiens
ctattttcacaat

SEQ ID NO: 6138528 - DNA, 20 bp, Homo sapiens
ctattttcactagggctgag

SEQ ID NO: 6138529 - DNA, 14 bp, Homo sapiens
ctattttcagaatc

SEQ ID NO: 6138530 - DNA, 15 bp, Homo sapiens
ctattttcagaatct

SEQ ID NO: 6138531 - DNA, 16 bp, Homo sapiens
ctattttcagaatctg

SEQ ID NO: 6138532 - DNA, 12 bp, Homo sapiens
ctattttcagat

SEQ ID NO: 6138533 - DNA, 22 bp, Homo sapiens
ctattttcagatgtgaaccatt

SEQ ID NO: 6138534 - DNA, 16 bp, Homo sapiens
ctattttcattttctg

SEQ ID NO: 6138535 - DNA, 21 bp, Homo sapiens
ctgaagtttgataaatagtgt

SEQ ID NO: 6138536 - DNA, 14 bp, Homo sapiens
ctgaagtttttgaa

SEQ ID NO: 6138537 - DNA, 21 bp, Homo sapiens
ctgaagtttttgaaatacctt

SEQ ID NO: 6138538 - DNA, 17 bp, Homo sapiens
ctgaagtttttttgctg

SEQ ID NO: 6138539 - DNA, 23 bp, Homo sapiens
ctgaagtttttttgctgctgcct

SEQ ID NO: 6138540 - DNA, 14 bp, Homo sapiens
ctgaataaaaaaga

SEQ ID NO: 6138541 - DNA, 17 bp, Homo sapiens
ctgaataaaaaagattc

SEQ ID NO: 6138542 - DNA, 23 bp, Homo sapiens
ctgaataaaaaataaataaaatg

SEQ ID NO: 6138543 - DNA, 13 bp, Homo sapiens
ctgaataaaccaa

SEQ ID NO: 6138544 - DNA, 14 bp, Homo sapiens
ctgaataaaccaag

SEQ ID NO: 6138545 - DNA, 14 bp, Homo sapiens
ctgaataaaccagt

SEQ ID NO: 6138546 - DNA, 14 bp, Homo sapiens
ctgaataaagggaa

SEQ ID NO: 6138547 - DNA, 22 bp, Homo sapiens
ctgaataaatacccattgaact

SEQ ID NO: 6138548 - DNA, 12 bp, Homo sapiens
ctgaataaatca

SEQ ID NO: 6138549 - DNA, 14 bp, Homo sapiens
ctgaataaatcatg

SEQ ID NO: 6138550 - DNA, 15 bp, Homo sapiens
ctgaataacaacaat

SEQ ID NO: 6138551 - DNA, 20 bp, Homo sapiens
ctgaataacatttgtgtggt

SEQ ID NO: 6138552 - DNA, 17 bp, Homo sapiens
ctgaataacctgcacag

SEQ ID NO: 6138553 - DNA, 20 bp, Homo sapiens
ctgaataacctgcacaggct

SEQ ID NO: 6138554 - DNA, 18 bp, Homo sapiens
ctgaataagcacttttta

SEQ ID NO: 6138555 - DNA, 11 bp, Homo sapiens
ctgaataataa

SEQ ID NO: 6138556 - DNA, 19 bp, Homo sapiens
ctgaataatgaagattaac

SEQ ID NO: 6138557 - DNA, 14 bp, Homo sapiens
ctgaataatgctac

SEQ ID NO: 6138558 - DNA, 16 bp, Homo sapiens
ctgaataatgctacca

SEQ ID NO: 6138559 - DNA, 13 bp, Homo sapiens
ctgaataatttct

SEQ ID NO: 6138560 - DNA, 19 bp, Homo sapiens
ctgaatacacagtattcag

SEQ ID NO: 6138561 - DNA, 22 bp, Homo sapiens
ctgaataccactctgtaattgc

SEQ ID NO: 6138562 - DNA, 20 bp, Homo sapiens
ctgaataccacttacctcaa

SEQ ID NO: 6138563 - DNA, 17 bp, Homo sapiens
ctgaatacccttttctg

SEQ ID NO: 6138564 - DNA, 20 bp, Homo sapiens
ctgaatacctctttgaaaga

SEQ ID NO: 6138565 - DNA, 15 bp, Homo sapiens
ctgaatagaaatggg

SEQ ID NO: 6138566 - DNA, 16 bp, Homo sapiens
ctgaatagaaatggga

SEQ ID NO: 6138567 - DNA, 16 bp, Homo sapiens
ctgaatagctcccaga

SEQ ID NO: 6138568 - DNA, 22 bp, Homo sapiens
ctgaatagctgtcataaaatga

SEQ ID NO: 6138569 - DNA, 17 bp, Homo sapiens
ctgaataggaaaatgta

SEQ ID NO: 6138570 - DNA, 18 bp, Homo sapiens
ctgaataggaaaatgtac

SEQ ID NO: 6138571 - DNA, 21 bp, Homo sapiens
ctgaataggaaaatgtacata

SEQ ID NO: 6138572 - DNA, 21 bp, Homo sapiens
ctgaataggcgatcacaacgt

SEQ ID NO: 6138573 - DNA, 18 bp, Homo sapiens
ctgaatagttaaaaatta

SEQ ID NO: 6138574 - DNA, 22 bp, Homo sapiens
ctgaatagttaaaaattaaata

SEQ ID NO: 6138575 - DNA, 17 bp, Homo sapiens
ctgaatagttcaggaga

SEQ ID NO: 6138576 - DNA, 15 bp, Homo sapiens
ctgaatatcaactct

SEQ ID NO: 6138577 - DNA, 19 bp, Homo sapiens
ctgaatatcagtcactgtt

SEQ ID NO: 6138578 - DNA, 17 bp, Homo sapiens
ctgaatatcatatgtat

SEQ ID NO: 6138579 - DNA, 15 bp, Homo sapiens
ctgaatatctgttca

SEQ ID NO: 6138580 - DNA, 19 bp, Homo sapiens
ctgaatatgaggcatttgg

SEQ ID NO: 6138581 - DNA, 15 bp, Homo sapiens
ctgaatattaagaaa

SEQ ID NO: 6138582 - DNA, 20 bp, Homo sapiens
ctgaatattaagaaacaatt

SEQ ID NO: 6138583 - DNA, 15 bp, Homo sapiens
ctgaatattaatccc

SEQ ID NO: 6138584 - DNA, 14 bp, Homo sapiens
ctgaatattctaga

SEQ ID NO: 6138585 - DNA, 21 bp, Homo sapiens
ctgaatattgccattatgctt

SEQ ID NO: 6138586 - DNA, 15 bp, Homo sapiens
ctgaatattggacat

SEQ ID NO: 6138587 - DNA, 20 bp, Homo sapiens
ctgaatatttatatttcact

SEQ ID NO: 6138588 - DNA, 15 bp, Homo sapiens
ctgaatcaaagacat

SEQ ID NO: 6138589 - DNA, 14 bp, Homo sapiens
ctgaatcagctgga

SEQ ID NO: 6138590 - DNA, 13 bp, Homo sapiens
ctgaatcatgagc

SEQ ID NO: 6138591 - DNA, 18 bp, Homo sapiens
ctgaatcatgagcctgct

SEQ ID NO: 6138592 - DNA, 14 bp, Homo sapiens
ctgaatcatgtctg

SEQ ID NO: 6138593 - DNA, 16 bp, Homo sapiens
ctgaatcatgtctgta

SEQ ID NO: 6138594 - DNA, 17 bp, Homo sapiens
ctgaatccaaaagaaaa

SEQ ID NO: 6138595 - DNA, 23 bp, Homo sapiens
ctgaatccacctcggagcatggt

SEQ ID NO: 6138596 - DNA, 15 bp, Homo sapiens
ctgaatccagcattg

SEQ ID NO: 6138597 - DNA, 22 bp, Homo sapiens
ctgaatccatatttcaacagag

SEQ ID NO: 6138598 - DNA, 22 bp, Homo sapiens
ctgaatccatcaggacttggga

SEQ ID NO: 6138599 - DNA, 22 bp, Homo sapiens
ctgaatcccctatcccattctg

SEQ ID NO: 6138600 - DNA, 23 bp, Homo sapiens
ctgaatcccggcggaaagcctct

SEQ ID NO: 6138601 - DNA, 22 bp, Homo sapiens
ctgaatcccgtagccagtctag

SEQ ID NO: 6138602 - DNA, 16 bp, Homo sapiens
ctgaatccgtacttgg

SEQ ID NO: 6138603 - DNA, 20 bp, Homo sapiens
ctgaatcctggtaattaaaa

SEQ ID NO: 6138604 - DNA, 14 bp, Homo sapiens
ctgaatccttagaa

SEQ ID NO: 6138605 - DNA, 19 bp, Homo sapiens
ctgaatcgagtgagacaaa

SEQ ID NO: 6138606 - DNA, 12 bp, Homo sapiens
ctgaatctagag

SEQ ID NO: 6138607 - DNA, 14 bp, Homo sapiens
ctgaatctcccaag

SEQ ID NO: 6138608 - DNA, 14 bp, Homo sapiens
ctgaatctcgttga

SEQ ID NO: 6138609 - DNA, 22 bp, Homo sapiens
ctgaatctgaccacagacactc

SEQ ID NO: 6138610 - DNA, 14 bp, Homo sapiens
ctgaatctgagaaa

SEQ ID NO: 6138611 - DNA, 21 bp, Homo sapiens
ctgaatctgataggaaaagaa

SEQ ID NO: 6138612 - DNA, 22 bp, Homo sapiens
ctgaatctgctaccaaaacagt

SEQ ID NO: 6138613 - DNA, 14 bp, Homo sapiens
ctgaatctgtacag

SEQ ID NO: 6138614 - DNA, 23 bp, Homo sapiens
ctgaatcttaatcgatgaatgta

SEQ ID NO: 6138615 - DNA, 23 bp, Homo sapiens
ctgaatcttcaccatctttctga

SEQ ID NO: 6138616 - DNA, 15 bp, Homo sapiens
ctgaatcttctgaaa

SEQ ID NO: 6138617 - DNA, 18 bp, Homo sapiens
ctgaatgaaacccccaca

SEQ ID NO: 6138618 - DNA, 20 bp, Homo sapiens
ctgaatgaaacccccacaca

SEQ ID NO: 6138619 - DNA, 22 bp, Homo sapiens
ctgaatgaaacccccacacaca

SEQ ID NO: 6138620 - DNA, 14 bp, Homo sapiens
ctgaatgaagcagt

SEQ ID NO: 6138621 - DNA, 18 bp, Homo sapiens
ctgaatgaagctgccatc

SEQ ID NO: 6138622 - DNA, 19 bp, Homo sapiens
ctgaatgaatccattggag

SEQ ID NO: 6138623 - DNA, 21 bp, Homo sapiens
ctgaatgacctgcagtcaggg

SEQ ID NO: 6138624 - DNA, 19 bp, Homo sapiens
ctgaatgaggcggagctcc

SEQ ID NO: 6138625 - DNA, 18 bp, Homo sapiens
ctgaatgatcctgtctct

SEQ ID NO: 6138626 - DNA, 13 bp, Homo sapiens
ctgaatgatctat

SEQ ID NO: 6138627 - DNA, 16 bp, Homo sapiens
ctgaatgatcttgtgt

SEQ ID NO: 6138628 - DNA, 23 bp, Homo sapiens
ctgaatgcagggaatgcaatcct

SEQ ID NO: 6138629 - DNA, 18 bp, Homo sapiens
ctgaatgcataaataaat

SEQ ID NO: 6138630 - DNA, 15 bp, Homo sapiens
ctgaatgcctcctgt

SEQ ID NO: 6138631 - DNA, 19 bp, Homo sapiens
ctgaatgcctcctgtgggg

SEQ ID NO: 6138632 - DNA, 20 bp, Homo sapiens
ctgaatgcctcctgtgggga

SEQ ID NO: 6138633 - DNA, 19 bp, Homo sapiens
ctgaatgcctcgctccctt

SEQ ID NO: 6138634 - DNA, 20 bp, Homo sapiens
ctgaatgcctcgctcccttc

SEQ ID NO: 6138635 - DNA, 23 bp, Homo sapiens
ctgaatgcctcgctcccttcaag

SEQ ID NO: 6138636 - DNA, 14 bp, Homo sapiens
ctgaatgctctgta

SEQ ID NO: 6138637 - DNA, 16 bp, Homo sapiens
ctgaatgctgagctga

SEQ ID NO: 6138638 - DNA, 20 bp, Homo sapiens
ctgaatgctgttaatatttc

SEQ ID NO: 6138639 - DNA, 22 bp, Homo sapiens
ctgaatgctgttaatatttcta

SEQ ID NO: 6138640 - DNA, 22 bp, Homo sapiens
ctgaatgcttataggtggcctc

SEQ ID NO: 6138641 - DNA, 15 bp, Homo sapiens
ctgaatgcttctgag

SEQ ID NO: 6138642 - DNA, 17 bp, Homo sapiens
ctgaatgcttctgagag

SEQ ID NO: 6138643 - DNA, 20 bp, Homo sapiens
ctgaatgcttctgagagcaa

SEQ ID NO: 6138644 - DNA, 17 bp, Homo sapiens
ctgaatggaaataaata

SEQ ID NO: 6138645 - DNA, 16 bp, Homo sapiens
ctgaatggactaagat

SEQ ID NO: 6138646 - DNA, 16 bp, Homo sapiens
ctgaatggcatggaga

SEQ ID NO: 6138647 - DNA, 18 bp, Homo sapiens
ctgaatggctttgtcttg

SEQ ID NO: 6138648 - DNA, 19 bp, Homo sapiens
ctgaatggctttgtcttga

SEQ ID NO: 6138649 - DNA, 19 bp, Homo sapiens
ctgaatgggaccctgttga

SEQ ID NO: 6138650 - DNA, 19 bp, Homo sapiens
ctgaatgggatcatgaaag

SEQ ID NO: 6138651 - DNA, 14 bp, Homo sapiens
ctgaatggtccagg

SEQ ID NO: 6138652 - DNA, 18 bp, Homo sapiens
ctgaatggtccagggttg

SEQ ID NO: 6138653 - DNA, 22 bp, Homo sapiens
ctgaatggttccatgcctgagg

SEQ ID NO: 6138654 - DNA, 16 bp, Homo sapiens
ctgaatgtaaaagaaa

SEQ ID NO: 6138655 - DNA, 12 bp, Homo sapiens
ctgaatgtaatt

SEQ ID NO: 6138656 - DNA, 15 bp, Homo sapiens
ctgaatgtaatttgt

SEQ ID NO: 6138657 - DNA, 16 bp, Homo sapiens
ctgaatgtaatttgtg

SEQ ID NO: 6138658 - DNA, 17 bp, Homo sapiens
ctgaatgtaatttgtgt

SEQ ID NO: 6138659 - DNA, 22 bp, Homo sapiens
ctgaatgtaatttgtgtaataa

SEQ ID NO: 6138660 - DNA, 21 bp, Homo sapiens
ctgaatgtagcgtgtaagctt

SEQ ID NO: 6138661 - DNA, 22 bp, Homo sapiens
ctgaatgtagcgtgtaagcttg

SEQ ID NO: 6138662 - DNA, 20 bp, Homo sapiens
ctgaatgtatgtcagtgcta

SEQ ID NO: 6138663 - DNA, 11 bp, Homo sapiens
ctgaatgtatt

SEQ ID NO: 6138664 - DNA, 22 bp, Homo sapiens
ctgaatgtcaaacagtgccaaa

SEQ ID NO: 6138665 - DNA, 22 bp, Homo sapiens
ctgaatgtcattgaaaaactaa

SEQ ID NO: 6138666 - DNA, 13 bp, Homo sapiens
ctgaatgtcccag

SEQ ID NO: 6138667 - DNA, 18 bp, Homo sapiens
ctgaatgtcccagaggct

SEQ ID NO: 6138668 - DNA, 12 bp, Homo sapiens
ctgaatgttctg

SEQ ID NO: 6138669 - DNA, 13 bp, Homo sapiens
ctgaatgttctga

SEQ ID NO: 6138670 - DNA, 16 bp, Homo sapiens
ctgaatgttctgacat

SEQ ID NO: 6138671 - DNA, 23 bp, Homo sapiens
ctgaatgttctgacattaacagt

SEQ ID NO: 6138672 - DNA, 16 bp, Homo sapiens
ctgaatgttgggactg

SEQ ID NO: 6138673 - DNA, 19 bp, Homo sapiens
ctgaatgttgggactgcta

SEQ ID NO: 6138674 - DNA, 22 bp, Homo sapiens
ctgaatgtttaaagatcatgac

SEQ ID NO: 6138675 - DNA, 16 bp, Homo sapiens
ctgaatgtttattcct

SEQ ID NO: 6138676 - DNA, 18 bp, Homo sapiens
ctgaatgtttattccttg

SEQ ID NO: 6138677 - DNA, 19 bp, Homo sapiens
ctgaatgtttattccttga

SEQ ID NO: 6138678 - DNA, 17 bp, Homo sapiens
ctgaatgtttgtgtctg

SEQ ID NO: 6138679 - DNA, 20 bp, Homo sapiens
ctgaatgtttgtgtctgtgg

SEQ ID NO: 6138680 - DNA, 22 bp, Homo sapiens
ctgaatgtttgtgtctgtggtt

SEQ ID NO: 6138681 - DNA, 20 bp, Homo sapiens
ctgaatgtttgtttcagtgc

SEQ ID NO: 6138682 - DNA, 17 bp, Homo sapiens
ctgaatgttttatttat

SEQ ID NO: 6138683 - DNA, 20 bp, Homo sapiens
ctgaatgttttatttatcaa

SEQ ID NO: 6138684 - DNA, 22 bp, Homo sapiens
ctgaattaaaagcccactgtgg

SEQ ID NO: 6138685 - DNA, 18 bp, Homo sapiens
ctgaattaaacatgaaag

SEQ ID NO: 6138686 - DNA, 12 bp, Homo sapiens
ctgaattaaagt

SEQ ID NO: 6138687 - DNA, 14 bp, Homo sapiens
ctgaattaaataaa

SEQ ID NO: 6138688 - DNA, 17 bp, Homo sapiens
ctgaattaatcatctat

SEQ ID NO: 6138689 - DNA, 20 bp, Homo sapiens
ctgaattaatgacagagcca

SEQ ID NO: 6138690 - DNA, 22 bp, Homo sapiens
ctgaattaatgacagagccagt

SEQ ID NO: 6138691 - DNA, 18 bp, Homo sapiens
ctgaattagccaaaacac

SEQ ID NO: 6138692 - DNA, 17 bp, Homo sapiens
ctgaattagtccttgct

SEQ ID NO: 6138693 - DNA, 13 bp, Homo sapiens
ctgaattatgaaa

SEQ ID NO: 6138694 - DNA, 12 bp, Homo sapiens
ctgaattattaa

SEQ ID NO: 6138695 - DNA, 16 bp, Homo sapiens
ctgaattattctggat

SEQ ID NO: 6138696 - DNA, 22 bp, Homo sapiens
ctgaattattttgttgtgattt

SEQ ID NO: 6138697 - DNA, 14 bp, Homo sapiens
ctgaattcaaagct

SEQ ID NO: 6138698 - DNA, 15 bp, Homo sapiens
ctgaattcaaagctt

SEQ ID NO: 6138699 - DNA, 17 bp, Homo sapiens
ctgaattcaaagcttgt

SEQ ID NO: 6138700 - DNA, 19 bp, Homo sapiens
ctgaattcaaagcttgtga

SEQ ID NO: 6138701 - DNA, 20 bp, Homo sapiens
ctgaattcaaagcttgtgaa

SEQ ID NO: 6138702 - DNA, 20 bp, Homo sapiens
ctgaattcaccacagacttt

SEQ ID NO: 6138703 - DNA, 15 bp, Homo sapiens
ctgaattcacctgtg

SEQ ID NO: 6138704 - DNA, 16 bp, Homo sapiens
ctgaattcctttacaa

SEQ ID NO: 6138705 - DNA, 17 bp, Homo sapiens
ctgaattgagaaaagag

SEQ ID NO: 6138706 - DNA, 21 bp, Homo sapiens
ctgaattgagaataagaattt

SEQ ID NO: 6138707 - DNA, 21 bp, Homo sapiens
ctgaattgcccgtttccatac

SEQ ID NO: 6138708 - DNA, 17 bp, Homo sapiens
ctgaattgcctgttcat

SEQ ID NO: 6138709 - DNA, 19 bp, Homo sapiens
ctgaattgctatcatttgg

SEQ ID NO: 6138710 - DNA, 18 bp, Homo sapiens
ctgaattggcttccagat

SEQ ID NO: 6138711 - DNA, 21 bp, Homo sapiens
ctgaattgtatcaatttgttt

SEQ ID NO: 6138712 - DNA, 15 bp, Homo sapiens
ctattttcctctggc

SEQ ID NO: 6138713 - DNA, 18 bp, Homo sapiens
ctattttccttaatcaaa

SEQ ID NO: 6138714 - DNA, 16 bp, Homo sapiens
ctattttctatgtact

SEQ ID NO: 6138715 - DNA, 16 bp, Homo sapiens
ctattttctgaagtga

SEQ ID NO: 6138716 - DNA, 16 bp, Homo sapiens
ctattttctgaccaaa

SEQ ID NO: 6138717 - DNA, 23 bp, Homo sapiens
ctattttgaaaggtcagaatttt

SEQ ID NO: 6138718 - DNA, 13 bp, Homo sapiens
ctattttgaagaa

SEQ ID NO: 6138719 - DNA, 16 bp, Homo sapiens
ctattttgaagaaaac

SEQ ID NO: 6138720 - DNA, 17 bp, Homo sapiens
ctattttgaagaaaaca

SEQ ID NO: 6138721 - DNA, 18 bp, Homo sapiens
ctattttgaagaaaacac

SEQ ID NO: 6138722 - DNA, 12 bp, Homo sapiens
ctattttgaagt

SEQ ID NO: 6138723 - DNA, 17 bp, Homo sapiens
ctattttgtacagacaa

SEQ ID NO: 6138724 - DNA, 17 bp, Homo sapiens
ctattttgtgaagccat

SEQ ID NO: 6138725 - DNA, 16 bp, Homo sapiens
ctattttgtgatgatg

SEQ ID NO: 6138726 - DNA, 15 bp, Homo sapiens
ctatttttaaaaagt

SEQ ID NO: 6138727 - DNA, 17 bp, Homo sapiens
ctatttttaaataattt

SEQ ID NO: 6138728 - DNA, 16 bp, Homo sapiens
ctatttttactgccac

SEQ ID NO: 6138729 - DNA, 17 bp, Homo sapiens
ctatttttactgccact

SEQ ID NO: 6138730 - DNA, 15 bp, Homo sapiens
ctatttttatacact

SEQ ID NO: 6138731 - DNA, 15 bp, Homo sapiens
ctatttttatacagt

SEQ ID NO: 6138732 - DNA, 17 bp, Homo sapiens
ctatttttatacagtga

SEQ ID NO: 6138733 - DNA, 18 bp, Homo sapiens
ctatttttatattctata

SEQ ID NO: 6138734 - DNA, 12 bp, Homo sapiens
ctatttttatca

SEQ ID NO: 6138735 - DNA, 23 bp, Homo sapiens
ctatttttatgatgacaatcaaa

SEQ ID NO: 6138736 - DNA, 14 bp, Homo sapiens
ctatttttattcct

SEQ ID NO: 6138737 - DNA, 13 bp, Homo sapiens
ctatttttcaatc

SEQ ID NO: 6138738 - DNA, 14 bp, Homo sapiens
ctatttttccccct

SEQ ID NO: 6138739 - DNA, 17 bp, Homo sapiens
ctatttttcttctaaaa

SEQ ID NO: 6138740 - DNA, 14 bp, Homo sapiens
ctatttttgactgt

SEQ ID NO: 6138741 - DNA, 13 bp, Homo sapiens
ctatttttggagg

SEQ ID NO: 6138742 - DNA, 20 bp, Homo sapiens
ctatttttggaggtttatta

SEQ ID NO: 6138743 - DNA, 21 bp, Homo sapiens
ctatttttggcagtctgaatt

SEQ ID NO: 6138744 - DNA, 12 bp, Homo sapiens
ctatttttgtac

SEQ ID NO: 6138745 - DNA, 14 bp, Homo sapiens
ctatttttgtagaa

SEQ ID NO: 6138746 - DNA, 22 bp, Homo sapiens
ctatttttgtagatctccatgc

SEQ ID NO: 6138747 - DNA, 12 bp, Homo sapiens
ctatttttgtat

SEQ ID NO: 6138748 - DNA, 15 bp, Homo sapiens
ctatttttgtccttg

SEQ ID NO: 6138749 - DNA, 12 bp, Homo sapiens
ctatttttgtgt

SEQ ID NO: 6138750 - DNA, 14 bp, Homo sapiens
ctatttttgttggg

SEQ ID NO: 6138751 - DNA, 15 bp, Homo sapiens
ctattttttaaagac

SEQ ID NO: 6138752 - DNA, 14 bp, Homo sapiens
ctattttttaagaa

SEQ ID NO: 6138753 - DNA, 14 bp, Homo sapiens
ctattttttaataa

SEQ ID NO: 6138754 - DNA, 20 bp, Homo sapiens
ctattttttacttgttttcg

SEQ ID NO: 6138755 - DNA, 21 bp, Homo sapiens
ctattttttacttgttttcgg

SEQ ID NO: 6138756 - DNA, 21 bp, Homo sapiens
ctattttttatcattgaaaca

SEQ ID NO: 6138757 - DNA, 20 bp, Homo sapiens
ctattttttattttactttt

SEQ ID NO: 6138758 - DNA, 17 bp, Homo sapiens
ctattttttctgaggaa

SEQ ID NO: 6138759 - DNA, 22 bp, Homo sapiens
ctattttttgacacttccattg

SEQ ID NO: 6138760 - DNA, 13 bp, Homo sapiens
ctattttttgtat

SEQ ID NO: 6138761 - DNA, 17 bp, Homo sapiens
ctatttttttaactgaa

SEQ ID NO: 6138762 - DNA, 18 bp, Homo sapiens
ctatttttttaactgaaa

SEQ ID NO: 6138763 - DNA, 17 bp, Homo sapiens
ctatttttttagattga

SEQ ID NO: 6138764 - DNA, 14 bp, Homo sapiens
ctatttttttcaaa

SEQ ID NO: 6138765 - DNA, 23 bp, Homo sapiens
ctatttttttcctaagacatttt

SEQ ID NO: 6138766 - DNA, 15 bp, Homo sapiens
ctatttttttctccc

SEQ ID NO: 6138767 - DNA, 23 bp, Homo sapiens
ctattttttttaaatcaaaaact

SEQ ID NO: 6138768 - DNA, 21 bp, Homo sapiens
ctcaaaaaaaaaaaaatgcac

SEQ ID NO: 6138769 - DNA, 22 bp, Homo sapiens
ctcaaaaaaacaaaaaagactt

SEQ ID NO: 6138770 - DNA, 18 bp, Homo sapiens
ctcaaaaaaagaaaaaga

SEQ ID NO: 6138771 - DNA, 23 bp, Homo sapiens
ctcaaaaacgccctcaagaacat

SEQ ID NO: 6138772 - DNA, 14 bp, Homo sapiens
ctcaaaaagaaatc

SEQ ID NO: 6138773 - DNA, 17 bp, Homo sapiens
ctcaaaaagcagaagga

SEQ ID NO: 6138774 - DNA, 21 bp, Homo sapiens
ctcaaaacacttccagtctgg

SEQ ID NO: 6138775 - DNA, 22 bp, Homo sapiens
ctcaaaacccatctgggctcct

SEQ ID NO: 6138776 - DNA, 13 bp, Homo sapiens
ctcaaaactgcac

SEQ ID NO: 6138777 - DNA, 20 bp, Homo sapiens
ctcaaaactggacagtcact

SEQ ID NO: 6138778 - DNA, 17 bp, Homo sapiens
ctcaaaagaaaatgtgt

SEQ ID NO: 6138779 - DNA, 19 bp, Homo sapiens
ctcaaaagaacttaccccc

SEQ ID NO: 6138780 - DNA, 17 bp, Homo sapiens
ctcaaaagaggttactt

SEQ ID NO: 6138781 - DNA, 18 bp, Homo sapiens
ctcaaaagaggttacttt

SEQ ID NO: 6138782 - DNA, 22 bp, Homo sapiens
ctcaaaagaggttactttagtt

SEQ ID NO: 6138783 - DNA, 17 bp, Homo sapiens
ctcaaaagattgtttta

SEQ ID NO: 6138784 - DNA, 14 bp, Homo sapiens
ctcaaaagcattta

SEQ ID NO: 6138785 - DNA, 21 bp, Homo sapiens
ctcaaaagcatttatcattct

SEQ ID NO: 6138786 - DNA, 14 bp, Homo sapiens
ctcaaaagccaaaa

SEQ ID NO: 6138787 - DNA, 16 bp, Homo sapiens
ctcaaaagccaaaaaa

SEQ ID NO: 6138788 - DNA, 23 bp, Homo sapiens
ctcaaaagccaaaaaatgggaga

SEQ ID NO: 6138789 - DNA, 23 bp, Homo sapiens
ctcaaaaggaaaccaagtggtca

SEQ ID NO: 6138790 - DNA, 13 bp, Homo sapiens
ctcaaaaggagaa

SEQ ID NO: 6138791 - DNA, 22 bp, Homo sapiens
ctcaaaaggagaactgtgctct

SEQ ID NO: 6138792 - DNA, 15 bp, Homo sapiens
ctcaaaagtctattt

SEQ ID NO: 6138793 - DNA, 20 bp, Homo sapiens
ctcaaaataaaaagcctcag

SEQ ID NO: 6138794 - DNA, 23 bp, Homo sapiens
ctcaaaataccatgccatttaaa

SEQ ID NO: 6138795 - DNA, 21 bp, Homo sapiens
ctcaaaatacgtgttcaaaaa

SEQ ID NO: 6138796 - DNA, 18 bp, Homo sapiens
ctcaaaatatttgtacat

SEQ ID NO: 6138797 - DNA, 16 bp, Homo sapiens
ctcaaaatgacagcca

SEQ ID NO: 6138798 - DNA, 21 bp, Homo sapiens
ctcaaaatgatatgtttgagt

SEQ ID NO: 6138799 - DNA, 20 bp, Homo sapiens
ctcaaaatgccacagcccag

SEQ ID NO: 6138800 - DNA, 21 bp, Homo sapiens
ctcaaaatggtgttgagattt

SEQ ID NO: 6138801 - DNA, 13 bp, Homo sapiens
ctcaaaatgtgcc

SEQ ID NO: 6138802 - DNA, 14 bp, Homo sapiens
ctcaaaatgtgtaa

SEQ ID NO: 6138803 - DNA, 18 bp, Homo sapiens
ctcaaaattgcttctaaa

SEQ ID NO: 6138804 - DNA, 13 bp, Homo sapiens
ctcaaacaattga

SEQ ID NO: 6138805 - DNA, 12 bp, Homo sapiens
ctcaaacacaca

SEQ ID NO: 6138806 - DNA, 21 bp, Homo sapiens
ctcaaacacagttacacttgt

SEQ ID NO: 6138807 - DNA, 16 bp, Homo sapiens
ctcaaacactgcaggc

SEQ ID NO: 6138808 - DNA, 19 bp, Homo sapiens
ctcaaacatggaagatgaa

SEQ ID NO: 6138809 - DNA, 18 bp, Homo sapiens
ctcaaaccaaatcactga

SEQ ID NO: 6138810 - DNA, 15 bp, Homo sapiens
ctcaaaccacttgcc

SEQ ID NO: 6138811 - DNA, 15 bp, Homo sapiens
ctcaaaccatatttt

SEQ ID NO: 6138812 - DNA, 20 bp, Homo sapiens
ctcaaaccctccacttctcc

SEQ ID NO: 6138813 - DNA, 14 bp, Homo sapiens
ctcaaaccctgtgg

SEQ ID NO: 6138814 - DNA, 20 bp, Homo sapiens
ctcaaacctccaaaagccct

SEQ ID NO: 6138815 - DNA, 13 bp, Homo sapiens
ctcaaacctcctc

SEQ ID NO: 6138816 - DNA, 15 bp, Homo sapiens
ctcaaacctcctctt

SEQ ID NO: 6138817 - DNA, 18 bp, Homo sapiens
ctcaaacctggagctgag

SEQ ID NO: 6138818 - DNA, 19 bp, Homo sapiens
ctcaaacctggagctgagg

SEQ ID NO: 6138819 - DNA, 21 bp, Homo sapiens
ctcaaacctgtttaaatattt

SEQ ID NO: 6138820 - DNA, 13 bp, Homo sapiens
ctcaaacgtggct

SEQ ID NO: 6138821 - DNA, 15 bp, Homo sapiens
ctcaaacgtggcttt

SEQ ID NO: 6138822 - DNA, 12 bp, Homo sapiens
ctcaaactatga

SEQ ID NO: 6138823 - DNA, 14 bp, Homo sapiens
ctcaaactccccag

SEQ ID NO: 6138824 - DNA, 20 bp, Homo sapiens
ctcaaactcctggactcatg

SEQ ID NO: 6138825 - DNA, 13 bp, Homo sapiens
ctcaaactgagct

SEQ ID NO: 6138826 - DNA, 17 bp, Homo sapiens
ctcaaactgcacatcta

SEQ ID NO: 6138827 - DNA, 13 bp, Homo sapiens
ctcaaacttgtgg

SEQ ID NO: 6138828 - DNA, 16 bp, Homo sapiens
ctcaaagaaagtgtat

SEQ ID NO: 6138829 - DNA, 15 bp, Homo sapiens
ctcaaagaagtactg

SEQ ID NO: 6138830 - DNA, 14 bp, Homo sapiens
ctcaaagagactcc

SEQ ID NO: 6138831 - DNA, 22 bp, Homo sapiens
ctcaaagagactccaagattca

SEQ ID NO: 6138832 - DNA, 19 bp, Homo sapiens
ctcaaagaggccagtactt

SEQ ID NO: 6138833 - DNA, 18 bp, Homo sapiens
ctcaaagagggggctctg

SEQ ID NO: 6138834 - DNA, 20 bp, Homo sapiens
ctcaaagagggggctctgcc

SEQ ID NO: 6138835 - DNA, 21 bp, Homo sapiens
ctcaaagagggggctctgccc

SEQ ID NO: 6138836 - DNA, 15 bp, Homo sapiens
ctcaaagatctttcg

SEQ ID NO: 6138837 - DNA, 18 bp, Homo sapiens
ctcaaagatgatggaaac

SEQ ID NO: 6138838 - DNA, 12 bp, Homo sapiens
ctcaaagatgca

SEQ ID NO: 6138839 - DNA, 18 bp, Homo sapiens
ctcaaagatgcattttta

SEQ ID NO: 6138840 - DNA, 15 bp, Homo sapiens
ctcaaagatgtactg

SEQ ID NO: 6138841 - DNA, 16 bp, Homo sapiens
ctcaaagatgtactga

SEQ ID NO: 6138842 - DNA, 22 bp, Homo sapiens
ctcaaagatgtactgagaggag

SEQ ID NO: 6138843 - DNA, 20 bp, Homo sapiens
ctcaaagcaacccgctggag

SEQ ID NO: 6138844 - DNA, 16 bp, Homo sapiens
ctcaaagcatcaaata

SEQ ID NO: 6138845 - DNA, 20 bp, Homo sapiens
ctcaaagcatgggattatta

SEQ ID NO: 6138846 - DNA, 22 bp, Homo sapiens
ctcaaagccccattaactgctt

SEQ ID NO: 6138847 - DNA, 23 bp, Homo sapiens
ctcaaagcccccacttctctcca

SEQ ID NO: 6138848 - DNA, 22 bp, Homo sapiens
ctcaaagcggtttaaccacatt

SEQ ID NO: 6138849 - DNA, 15 bp, Homo sapiens
ctcaaaggagaaaaa

SEQ ID NO: 6138850 - DNA, 15 bp, Homo sapiens
ctcaaaggagctttc

SEQ ID NO: 6138851 - DNA, 22 bp, Homo sapiens
ctcaaaggccaggttgctaaga

SEQ ID NO: 6138852 - DNA, 17 bp, Homo sapiens
ctcaaaggtttggaagg

SEQ ID NO: 6138853 - DNA, 19 bp, Homo sapiens
ctcaaaggtttggaaggag

SEQ ID NO: 6138854 - DNA, 14 bp, Homo sapiens
ctcaaagtctgcaa

SEQ ID NO: 6138855 - DNA, 15 bp, Homo sapiens
ctcaaagtctgcaac

SEQ ID NO: 6138856 - DNA, 21 bp, Homo sapiens
ctcaaagtttgacaggaacct

SEQ ID NO: 6138857 - DNA, 12 bp, Homo sapiens
ctcaaagttttg

SEQ ID NO: 6138858 - DNA, 14 bp, Homo sapiens
ctcaaagttttgaa

SEQ ID NO: 6138859 - DNA, 19 bp, Homo sapiens
ctcaaataaaaagtgcttt

SEQ ID NO: 6138860 - DNA, 15 bp, Homo sapiens
ctcaaataataataa

SEQ ID NO: 6138861 - DNA, 21 bp, Homo sapiens
ctcaaataatatttttttcct

SEQ ID NO: 6138862 - DNA, 17 bp, Homo sapiens
ctcaaatacacatttgc

SEQ ID NO: 6138863 - DNA, 18 bp, Homo sapiens
ctcaaatacacatttgct

SEQ ID NO: 6138864 - DNA, 14 bp, Homo sapiens
ctcaaatacatgca

SEQ ID NO: 6138865 - DNA, 20 bp, Homo sapiens
ctcaaatacatgcacagtca

SEQ ID NO: 6138866 - DNA, 21 bp, Homo sapiens
ctcaaatcagtgataattggt

SEQ ID NO: 6138867 - DNA, 15 bp, Homo sapiens
ctcaaatccaaaatg

SEQ ID NO: 6138868 - DNA, 13 bp, Homo sapiens
ctcaaatccactg

SEQ ID NO: 6138869 - DNA, 15 bp, Homo sapiens
ctcaaatccaggacc

SEQ ID NO: 6138870 - DNA, 16 bp, Homo sapiens
ctcaaatccaggaccc

SEQ ID NO: 6138871 - DNA, 22 bp, Homo sapiens
ctcaaatccaggaccctgccag

SEQ ID NO: 6138872 - DNA, 19 bp, Homo sapiens
ctcaaatcgtccagcgacc

SEQ ID NO: 6138873 - DNA, 13 bp, Homo sapiens
ctcaaatctattc

SEQ ID NO: 6138874 - DNA, 15 bp, Homo sapiens
ctcaaatctgaggga

SEQ ID NO: 6138875 - DNA, 20 bp, Homo sapiens
ctcaaatctgcttcatccaa

SEQ ID NO: 6138876 - DNA, 21 bp, Homo sapiens
ctcaaatcttttagtcattat

SEQ ID NO: 6138877 - DNA, 17 bp, Homo sapiens
ctcaaatgacccaaaga

SEQ ID NO: 6138878 - DNA, 16 bp, Homo sapiens
ctcaaatgagtaacat

SEQ ID NO: 6138879 - DNA, 20 bp, Homo sapiens
ctcaaatgagtaacatttgc

SEQ ID NO: 6138880 - DNA, 18 bp, Homo sapiens
ctcaaatgctaaatgcaa

SEQ ID NO: 6138881 - DNA, 20 bp, Homo sapiens
ctcaaatgctagaagctgtc

SEQ ID NO: 6138882 - DNA, 23 bp, Homo sapiens
ctcaaatgctggcaaatccaggc

SEQ ID NO: 6138883 - DNA, 17 bp, Homo sapiens
ctcaaatggggccagat

SEQ ID NO: 6138884 - DNA, 21 bp, Homo sapiens
ctcaaatggggccagatccag

SEQ ID NO: 6138885 - DNA, 17 bp, Homo sapiens
ctcaaatggtgtcatgg

SEQ ID NO: 6138886 - DNA, 21 bp, Homo sapiens
ctcaaatggtgtcatggctga

SEQ ID NO: 6138887 - DNA, 14 bp, Homo sapiens
ctcaaatgtatatt

SEQ ID NO: 6138888 - DNA, 17 bp, Homo sapiens
ctcaaatgtcagagcta

SEQ ID NO: 6138889 - DNA, 18 bp, Homo sapiens
ctcaaatgtcagagctat

SEQ ID NO: 6138890 - DNA, 16 bp, Homo sapiens
ctcaaatgttctaagt

SEQ ID NO: 6138891 - DNA, 17 bp, Homo sapiens
ctgaattgttatgtaaa

SEQ ID NO: 6138892 - DNA, 20 bp, Homo sapiens
ctgaattgttatgtaaacat

SEQ ID NO: 6138893 - DNA, 16 bp, Homo sapiens
ctgaattgttgaaact

SEQ ID NO: 6138894 - DNA, 14 bp, Homo sapiens
ctgaattgttgggg

SEQ ID NO: 6138895 - DNA, 14 bp, Homo sapiens
ctgaattgtttata

SEQ ID NO: 6138896 - DNA, 23 bp, Homo sapiens
ctgaatttaaatagcttttttct

SEQ ID NO: 6138897 - DNA, 16 bp, Homo sapiens
ctgaatttataaaaat

SEQ ID NO: 6138898 - DNA, 17 bp, Homo sapiens
ctgaatttatctttgat

SEQ ID NO: 6138899 - DNA, 20 bp, Homo sapiens
ctgaatttatctttgataac

SEQ ID NO: 6138900 - DNA, 14 bp, Homo sapiens
ctgaatttcaaaca

SEQ ID NO: 6138901 - DNA, 13 bp, Homo sapiens
ctgaatttccttt

SEQ ID NO: 6138902 - DNA, 13 bp, Homo sapiens
ctgaatttctatg

SEQ ID NO: 6138903 - DNA, 18 bp, Homo sapiens
ctgaatttctatggcata

SEQ ID NO: 6138904 - DNA, 13 bp, Homo sapiens
ctgaatttcttct

SEQ ID NO: 6138905 - DNA, 19 bp, Homo sapiens
ctgaatttcttcttttcct

SEQ ID NO: 6138906 - DNA, 12 bp, Homo sapiens
ctgaatttcttt

SEQ ID NO: 6138907 - DNA, 21 bp, Homo sapiens
ctgaatttctttgatttaact

SEQ ID NO: 6138908 - DNA, 12 bp, Homo sapiens
ctgaatttgcaa

SEQ ID NO: 6138909 - DNA, 14 bp, Homo sapiens
ctgaatttgcaaag

SEQ ID NO: 6138910 - DNA, 15 bp, Homo sapiens
ctgaatttgcaaagt

SEQ ID NO: 6138911 - DNA, 16 bp, Homo sapiens
ctgaatttgcaaagta

SEQ ID NO: 6138912 - DNA, 19 bp, Homo sapiens
ctgaatttgggcctcttgt

SEQ ID NO: 6138913 - DNA, 14 bp, Homo sapiens
ctgaatttgtatat

SEQ ID NO: 6138914 - DNA, 23 bp, Homo sapiens
ctgaatttgtcgggttctcccat

SEQ ID NO: 6138915 - DNA, 16 bp, Homo sapiens
ctgaattttaaatgtt

SEQ ID NO: 6138916 - DNA, 20 bp, Homo sapiens
ctgaattttcacatgaacat

SEQ ID NO: 6138917 - DNA, 14 bp, Homo sapiens
ctgaattttggtaa

SEQ ID NO: 6138918 - DNA, 12 bp, Homo sapiens
ctgaatttttca

SEQ ID NO: 6138919 - DNA, 15 bp, Homo sapiens
ctgaatttttttgta

SEQ ID NO: 6138920 - DNA, 18 bp, Homo sapiens
ctgacaaaaagtttccat

SEQ ID NO: 6138921 - DNA, 18 bp, Homo sapiens
ctgacaaaaatattttcc

SEQ ID NO: 6138922 - DNA, 16 bp, Homo sapiens
ctgacaaaatacttgt

SEQ ID NO: 6138923 - DNA, 21 bp, Homo sapiens
ctgacaaaatggggcagaaga

SEQ ID NO: 6138924 - DNA, 18 bp, Homo sapiens
ctgacaaacgtccccagc

SEQ ID NO: 6138925 - DNA, 16 bp, Homo sapiens
ctgacaaaggtggtaa

SEQ ID NO: 6138926 - DNA, 22 bp, Homo sapiens
ctgacaaagtcatcccctctca

SEQ ID NO: 6138927 - DNA, 15 bp, Homo sapiens
ctgacaaatcaagtt

SEQ ID NO: 6138928 - DNA, 21 bp, Homo sapiens
ctgacaaattcaaaagagaga

SEQ ID NO: 6138929 - DNA, 18 bp, Homo sapiens
ctgacaacagacttctga

SEQ ID NO: 6138930 - DNA, 19 bp, Homo sapiens
ctgacaacagacttctgaa

SEQ ID NO: 6138931 - DNA, 15 bp, Homo sapiens
ctgacaacagcctga

SEQ ID NO: 6138932 - DNA, 15 bp, Homo sapiens
ctgacaacctgtgca

SEQ ID NO: 6138933 - DNA, 16 bp, Homo sapiens
ctgacaacctgtgcag

SEQ ID NO: 6138934 - DNA, 15 bp, Homo sapiens
ctgacaacgtctctt

SEQ ID NO: 6138935 - DNA, 14 bp, Homo sapiens
ctgacaacttctga

SEQ ID NO: 6138936 - DNA, 13 bp, Homo sapiens
ctgacaacttgaa

SEQ ID NO: 6138937 - DNA, 14 bp, Homo sapiens
ctgacaagaagctc

SEQ ID NO: 6138938 - DNA, 17 bp, Homo sapiens
ctgacaagataaaggaa

SEQ ID NO: 6138939 - DNA, 15 bp, Homo sapiens
ctgacaagctggcca

SEQ ID NO: 6138940 - DNA, 16 bp, Homo sapiens
ctgacaagctggccaa

SEQ ID NO: 6138941 - DNA, 20 bp, Homo sapiens
ctgacaagctggccaaagtc

SEQ ID NO: 6138942 - DNA, 23 bp, Homo sapiens
ctgacaagctggccaaagtcact

SEQ ID NO: 6138943 - DNA, 13 bp, Homo sapiens
ctgacaaggccag

SEQ ID NO: 6138944 - DNA, 12 bp, Homo sapiens
ctgacaagggct

SEQ ID NO: 6138945 - DNA, 13 bp, Homo sapiens
ctgacaataaaga

SEQ ID NO: 6138946 - DNA, 14 bp, Homo sapiens
ctgacaataaagat

SEQ ID NO: 6138947 - DNA, 13 bp, Homo sapiens
ctgacaatcaact

SEQ ID NO: 6138948 - DNA, 14 bp, Homo sapiens
ctgacaatgctgcc

SEQ ID NO: 6138949 - DNA, 16 bp, Homo sapiens
ctgacaatgctgccat

SEQ ID NO: 6138950 - DNA, 19 bp, Homo sapiens
ctgacaatgctgccatgcc

SEQ ID NO: 6138951 - DNA, 24 bp, Homo sapiens
ctgacaatgctgccatgcccacca

SEQ ID NO: 6138952 - DNA, 15 bp, Homo sapiens
ctgacaatggcagct

SEQ ID NO: 6138953 - DNA, 18 bp, Homo sapiens
ctgacaatggcagctaga

SEQ ID NO: 6138954 - DNA, 19 bp, Homo sapiens
ctgacaatttgtgatatct

SEQ ID NO: 6138955 - DNA, 22 bp, Homo sapiens
ctgacaattttacctattctga

SEQ ID NO: 6138956 - DNA, 23 bp, Homo sapiens
ctgacaattttacctattctgaa

SEQ ID NO: 6138957 - DNA, 13 bp, Homo sapiens
ctgacacaaagga

SEQ ID NO: 6138958 - DNA, 15 bp, Homo sapiens
ctgacacaaaggaag

SEQ ID NO: 6138959 - DNA, 21 bp, Homo sapiens
ctgacacacagctctgtcctg

SEQ ID NO: 6138960 - DNA, 16 bp, Homo sapiens
ctgacacacctgcagc

SEQ ID NO: 6138961 - DNA, 10 bp, Homo sapiens
ctgacacagg

SEQ ID NO: 6138962 - DNA, 15 bp, Homo sapiens
ctgacacaggccagc

SEQ ID NO: 6138963 - DNA, 17 bp, Homo sapiens
ctgacacaggccagccc

SEQ ID NO: 6138964 - DNA, 21 bp, Homo sapiens
ctgacacaggccagccccatc

SEQ ID NO: 6138965 - DNA, 23 bp, Homo sapiens
ctgacacaggccagccttggcac

SEQ ID NO: 6138966 - DNA, 14 bp, Homo sapiens
ctgacacagtaaaa

SEQ ID NO: 6138967 - DNA, 20 bp, Homo sapiens
ctgacacatatcattctgtg

SEQ ID NO: 6138968 - DNA, 16 bp, Homo sapiens
ctgacacatcagcatg

SEQ ID NO: 6138969 - DNA, 14 bp, Homo sapiens
ctgacacatgctct

SEQ ID NO: 6138970 - DNA, 20 bp, Homo sapiens
ctgacaccatgtgcaaactg

SEQ ID NO: 6138971 - DNA, 13 bp, Homo sapiens
ctgacacccatgt

SEQ ID NO: 6138972 - DNA, 21 bp, Homo sapiens
ctgacacccatgtttctctgg

SEQ ID NO: 6138973 - DNA, 17 bp, Homo sapiens
ctgacaccccacttagc

SEQ ID NO: 6138974 - DNA, 14 bp, Homo sapiens
ctgacaccccctcc

SEQ ID NO: 6138975 - DNA, 17 bp, Homo sapiens
ctgacacccttctccca

SEQ ID NO: 6138976 - DNA, 19 bp, Homo sapiens
ctgacacctaactcttctt

SEQ ID NO: 6138977 - DNA, 15 bp, Homo sapiens
ctgacacctaccatg

SEQ ID NO: 6138978 - DNA, 19 bp, Homo sapiens
ctgacacctaccatgctgc

SEQ ID NO: 6138979 - DNA, 14 bp, Homo sapiens
ctgacacctcactg

SEQ ID NO: 6138980 - DNA, 21 bp, Homo sapiens
ctgacacctgccgctgcttga

SEQ ID NO: 6138981 - DNA, 19 bp, Homo sapiens
ctgacacctttgcaggcat

SEQ ID NO: 6138982 - DNA, 14 bp, Homo sapiens
ctgacacgtccacc

SEQ ID NO: 6138983 - DNA, 22 bp, Homo sapiens
ctgacacgtgatggaccaaagc

SEQ ID NO: 6138984 - DNA, 17 bp, Homo sapiens
ctgacactaaccagagt

SEQ ID NO: 6138985 - DNA, 20 bp, Homo sapiens
ctgacactcaataaacagtc

SEQ ID NO: 6138986 - DNA, 19 bp, Homo sapiens
ctgacactgcgaactctca

SEQ ID NO: 6138987 - DNA, 13 bp, Homo sapiens
ctgacactgcggg

SEQ ID NO: 6138988 - DNA, 13 bp, Homo sapiens
ctgacactgctgg

SEQ ID NO: 6138989 - DNA, 20 bp, Homo sapiens
ctgacactgctggagaggcc

SEQ ID NO: 6138990 - DNA, 21 bp, Homo sapiens
ctgacactgctggagaggccc

SEQ ID NO: 6138991 - DNA, 17 bp, Homo sapiens
ctgacactgtgaccctg

SEQ ID NO: 6138992 - DNA, 18 bp, Homo sapiens
ctgacactgtgaccctgg

SEQ ID NO: 6138993 - DNA, 20 bp, Homo sapiens
ctgacactgtgtaagaagct

SEQ ID NO: 6138994 - DNA, 21 bp, Homo sapiens
ctgacacttgtggtatagtat

SEQ ID NO: 6138995 - DNA, 19 bp, Homo sapiens
ctgacactttaattaccaa

SEQ ID NO: 6138996 - DNA, 18 bp, Homo sapiens
ctgacactttctgctgga

SEQ ID NO: 6138997 - DNA, 19 bp, Homo sapiens
ctgacagaaagattttcct

SEQ ID NO: 6138998 - DNA, 14 bp, Homo sapiens
ctgacagaaggact

SEQ ID NO: 6138999 - DNA, 16 bp, Homo sapiens
ctgacagaaggtgcca

SEQ ID NO: 6139000 - DNA, 21 bp, Homo sapiens
ctgacagaaggtgccacttta

SEQ ID NO: 6139001 - DNA, 18 bp, Homo sapiens
ctgacagacacaggcccg

SEQ ID NO: 6139002 - DNA, 19 bp, Homo sapiens
ctgacagacagccctccat

SEQ ID NO: 6139003 - DNA, 15 bp, Homo sapiens
ctgacagactcactg

SEQ ID NO: 6139004 - DNA, 16 bp, Homo sapiens
ctgacagactcactgg

SEQ ID NO: 6139005 - DNA, 20 bp, Homo sapiens
ctgacagagcaggtctgcag

SEQ ID NO: 6139006 - DNA, 12 bp, Homo sapiens
ctgacagagccc

SEQ ID NO: 6139007 - DNA, 13 bp, Homo sapiens
ctgacagagccct

SEQ ID NO: 6139008 - DNA, 17 bp, Homo sapiens
ctgacagagctctgggt

SEQ ID NO: 6139009 - DNA, 23 bp, Homo sapiens
ctgacagatacatagatggacca

SEQ ID NO: 6139010 - DNA, 18 bp, Homo sapiens
ctgacagatgcctggtga

SEQ ID NO: 6139011 - DNA, 21 bp, Homo sapiens
ctgacagatgcctggtgagca

SEQ ID NO: 6139012 - DNA, 19 bp, Homo sapiens
ctgacagattgacagggac

SEQ ID NO: 6139013 - DNA, 11 bp, Homo sapiens
ctgacagattt

SEQ ID NO: 6139014 - DNA, 15 bp, Homo sapiens
ctgacagcactcctc

SEQ ID NO: 6139015 - DNA, 16 bp, Homo sapiens
ctgacagcagcatctc

SEQ ID NO: 6139016 - DNA, 16 bp, Homo sapiens
ctgacagcagcctgtg

SEQ ID NO: 6139017 - DNA, 18 bp, Homo sapiens
ctgacagcagcctgtgag

SEQ ID NO: 6139018 - DNA, 19 bp, Homo sapiens
ctgacagcagcctgtgagg

SEQ ID NO: 6139019 - DNA, 13 bp, Homo sapiens
ctgacagcatcct

SEQ ID NO: 6139020 - DNA, 23 bp, Homo sapiens
ctgacagccacaccgtggcagct

SEQ ID NO: 6139021 - DNA, 14 bp, Homo sapiens
ctgacagccagaac

SEQ ID NO: 6139022 - DNA, 20 bp, Homo sapiens
ctgacagcccaacttccaga

SEQ ID NO: 6139023 - DNA, 21 bp, Homo sapiens
ctgacagcccaacttccagag

SEQ ID NO: 6139024 - DNA, 12 bp, Homo sapiens
ctgacagcctcc

SEQ ID NO: 6139025 - DNA, 20 bp, Homo sapiens
ctgacagcctcccaccccca

SEQ ID NO: 6139026 - DNA, 16 bp, Homo sapiens
ctgacagcctcctagg

SEQ ID NO: 6139027 - DNA, 17 bp, Homo sapiens
ctgacagcctcctaggc

SEQ ID NO: 6139028 - DNA, 13 bp, Homo sapiens
ctgacagcctggg

SEQ ID NO: 6139029 - DNA, 14 bp, Homo sapiens
ctgacagcctgggg

SEQ ID NO: 6139030 - DNA, 17 bp, Homo sapiens
ctgacagcctggggggg

SEQ ID NO: 6139031 - DNA, 14 bp, Homo sapiens
ctgacagccttccc

SEQ ID NO: 6139032 - DNA, 20 bp, Homo sapiens
ctgacagcgccatgtgtgtc

SEQ ID NO: 6139033 - DNA, 23 bp, Homo sapiens
ctgacagcgccatgtgtgtcagc

SEQ ID NO: 6139034 - DNA, 16 bp, Homo sapiens
ctgacagctgctccta

SEQ ID NO: 6139035 - DNA, 18 bp, Homo sapiens
ctgacagcttgagaaggt

SEQ ID NO: 6139036 - DNA, 17 bp, Homo sapiens
ctgacaggaaagtggat

SEQ ID NO: 6139037 - DNA, 11 bp, Homo sapiens
ctgacaggaag

SEQ ID NO: 6139038 - DNA, 12 bp, Homo sapiens
ctgacaggaaga

SEQ ID NO: 6139039 - DNA, 20 bp, Homo sapiens
ctgacaggaagactggagac

SEQ ID NO: 6139040 - DNA, 21 bp, Homo sapiens
ctgacaggaagactggagact

SEQ ID NO: 6139041 - DNA, 18 bp, Homo sapiens
ctgacaggatgtggcact

SEQ ID NO: 6139042 - DNA, 20 bp, Homo sapiens
ctgacaggatgtggcactgc

SEQ ID NO: 6139043 - DNA, 16 bp, Homo sapiens
ctgacaggcaatgctg

SEQ ID NO: 6139044 - DNA, 18 bp, Homo sapiens
ctgacaggcaatgctggc

SEQ ID NO: 6139045 - DNA, 20 bp, Homo sapiens
ctgacaggcagcctggacat

SEQ ID NO: 6139046 - DNA, 14 bp, Homo sapiens
ctgacaggccttcc

SEQ ID NO: 6139047 - DNA, 16 bp, Homo sapiens
ctgacaggccttcctc

SEQ ID NO: 6139048 - DNA, 17 bp, Homo sapiens
ctgacaggctgtgactc

SEQ ID NO: 6139049 - DNA, 23 bp, Homo sapiens
ctgacaggctgtgactcttctct

SEQ ID NO: 6139050 - DNA, 19 bp, Homo sapiens
ctgacagggacatgccctg

SEQ ID NO: 6139051 - DNA, 21 bp, Homo sapiens
ctgacagggacatgccctgtg

SEQ ID NO: 6139052 - DNA, 12 bp, Homo sapiens
ctgacagggagc

SEQ ID NO: 6139053 - DNA, 14 bp, Homo sapiens
ctgacagggagcag

SEQ ID NO: 6139054 - DNA, 17 bp, Homo sapiens
ctgacagggagcagccc

SEQ ID NO: 6139055 - DNA, 17 bp, Homo sapiens
ctgacagggccagtgca

SEQ ID NO: 6139056 - DNA, 23 bp, Homo sapiens
ctgacagggcccagttaaatatg

SEQ ID NO: 6139057 - DNA, 20 bp, Homo sapiens
ctgacaggttcccagcagct

SEQ ID NO: 6139058 - DNA, 16 bp, Homo sapiens
ctgacagtagctctta

SEQ ID NO: 6139059 - DNA, 18 bp, Homo sapiens
ctgacagtagctcttaga

SEQ ID NO: 6139060 - DNA, 19 bp, Homo sapiens
ctgacagtagctcttagac

SEQ ID NO: 6139061 - DNA, 15 bp, Homo sapiens
ctgacagtcagctgt

SEQ ID NO: 6139062 - DNA, 18 bp, Homo sapiens
ctgacagtcagctgtggg

SEQ ID NO: 6139063 - DNA, 17 bp, Homo sapiens
ctgacagtcctctccac

SEQ ID NO: 6139064 - DNA, 15 bp, Homo sapiens
ctgacagtctcaaat

SEQ ID NO: 6139065 - DNA, 12 bp, Homo sapiens
ctgacagtgttt

SEQ ID NO: 6139066 - DNA, 16 bp, Homo sapiens
ctgacagtttttctgt

SEQ ID NO: 6139067 - DNA, 20 bp, Homo sapiens
ctgacataaacccatctgta

SEQ ID NO: 6139068 - DNA, 22 bp, Homo sapiens
ctgacataaacccatctgtaat

SEQ ID NO: 6139069 - DNA, 16 bp, Homo sapiens
ctgacatattatgcct

SEQ ID NO: 6139070 - DNA, 22 bp, Homo sapiens
ctgacatattatgcctgaatga

SEQ ID NO: 6139071 - DNA, 13 bp, Homo sapiens
ctcaaatgttttc

SEQ ID NO: 6139072 - DNA, 17 bp, Homo sapiens
ctcaaatgttttctgca

SEQ ID NO: 6139073 - DNA, 15 bp, Homo sapiens
ctcaaattcagctct

SEQ ID NO: 6139074 - DNA, 17 bp, Homo sapiens
ctcaaattcagctctga

SEQ ID NO: 6139075 - DNA, 13 bp, Homo sapiens
ctcaaattttttg

SEQ ID NO: 6139076 - DNA, 15 bp, Homo sapiens
ctcaacaaagcacag

SEQ ID NO: 6139077 - DNA, 23 bp, Homo sapiens
ctcaacaacaaaccaaaacagaa

SEQ ID NO: 6139078 - DNA, 16 bp, Homo sapiens
ctcaacaacaatttta

SEQ ID NO: 6139079 - DNA, 17 bp, Homo sapiens
ctcaacaacatgtcaaa

SEQ ID NO: 6139080 - DNA, 19 bp, Homo sapiens
ctcaacaagggagagacct

SEQ ID NO: 6139081 - DNA, 23 bp, Homo sapiens
ctcaacaagggagagacctcatc

SEQ ID NO: 6139082 - DNA, 14 bp, Homo sapiens
ctcaacaataaaga

SEQ ID NO: 6139083 - DNA, 18 bp, Homo sapiens
ctcaacaataaagactga

SEQ ID NO: 6139084 - DNA, 22 bp, Homo sapiens
ctcaacaccatgattcctttaa

SEQ ID NO: 6139085 - DNA, 14 bp, Homo sapiens
ctcaacacccagtt

SEQ ID NO: 6139086 - DNA, 12 bp, Homo sapiens
ctcaacaccctg

SEQ ID NO: 6139087 - DNA, 17 bp, Homo sapiens
ctcaacaccctgcttct

SEQ ID NO: 6139088 - DNA, 20 bp, Homo sapiens
ctcaacaccctgcttctccc

SEQ ID NO: 6139089 - DNA, 21 bp, Homo sapiens
ctcaacaccctgcttctcccg

SEQ ID NO: 6139090 - DNA, 13 bp, Homo sapiens
ctcaacagatctg

SEQ ID NO: 6139091 - DNA, 14 bp, Homo sapiens
ctcaacagatctgt

SEQ ID NO: 6139092 - DNA, 13 bp, Homo sapiens
ctcaacagcagga

SEQ ID NO: 6139093 - DNA, 20 bp, Homo sapiens
ctcaacagcaggaggcacag

SEQ ID NO: 6139094 - DNA, 24 bp, Homo sapiens
ctcaacagcaggaggcacagcagt

SEQ ID NO: 6139095 - DNA, 15 bp, Homo sapiens
ctcaacaggcccagg

SEQ ID NO: 6139096 - DNA, 17 bp, Homo sapiens
ctcaacaggcccaggga

SEQ ID NO: 6139097 - DNA, 20 bp, Homo sapiens
ctcaacaggcccagggaggg

SEQ ID NO: 6139098 - DNA, 21 bp, Homo sapiens
ctcaacaggcctcagggctcc

SEQ ID NO: 6139099 - DNA, 18 bp, Homo sapiens
ctcaacataacataagct

SEQ ID NO: 6139100 - DNA, 23 bp, Homo sapiens
ctcaacatactgtaatcaaaagg

SEQ ID NO: 6139101 - DNA, 18 bp, Homo sapiens
ctcaacatgtgtttctga

SEQ ID NO: 6139102 - DNA, 18 bp, Homo sapiens
ctcaacatttcagtgttt

SEQ ID NO: 6139103 - DNA, 14 bp, Homo sapiens
ctcaaccaaatggt

SEQ ID NO: 6139104 - DNA, 12 bp, Homo sapiens
ctcaaccactgt

SEQ ID NO: 6139105 - DNA, 14 bp, Homo sapiens
ctcaaccactgtgg

SEQ ID NO: 6139106 - DNA, 13 bp, Homo sapiens
ctcaacccagagg

SEQ ID NO: 6139107 - DNA, 20 bp, Homo sapiens
ctcaacccattgttgtcaag

SEQ ID NO: 6139108 - DNA, 22 bp, Homo sapiens
ctcaacccccatttctatttat

SEQ ID NO: 6139109 - DNA, 21 bp, Homo sapiens
ctcaacccccctcccagacag

SEQ ID NO: 6139110 - DNA, 21 bp, Homo sapiens
ctcaacccctcccctccatcc

SEQ ID NO: 6139111 - DNA, 23 bp, Homo sapiens
ctcaacccctcccctccatccct

SEQ ID NO: 6139112 - DNA, 18 bp, Homo sapiens
ctcaaccctccgttcctc

SEQ ID NO: 6139113 - DNA, 18 bp, Homo sapiens
ctcaaccgcacatgtgcc

SEQ ID NO: 6139114 - DNA, 22 bp, Homo sapiens
ctcaacctaccaccccttcctg

SEQ ID NO: 6139115 - DNA, 23 bp, Homo sapiens
ctcaacctaccaccccttcctgt

SEQ ID NO: 6139116 - DNA, 16 bp, Homo sapiens
ctcaacctaccctggt

SEQ ID NO: 6139117 - DNA, 13 bp, Homo sapiens
ctcaacctcatcc

SEQ ID NO: 6139118 - DNA, 17 bp, Homo sapiens
ctcaacctcctgggcta

SEQ ID NO: 6139119 - DNA, 14 bp, Homo sapiens
ctcaacctctctcc

SEQ ID NO: 6139120 - DNA, 15 bp, Homo sapiens
ctcaacctctctcct

SEQ ID NO: 6139121 - DNA, 16 bp, Homo sapiens
ctcaacctctctcctt

SEQ ID NO: 6139122 - DNA, 21 bp, Homo sapiens
ctcaacctgtaaattatttta

SEQ ID NO: 6139123 - DNA, 16 bp, Homo sapiens
ctcaaccttaagacct

SEQ ID NO: 6139124 - DNA, 15 bp, Homo sapiens
ctcaaccttggcctt

SEQ ID NO: 6139125 - DNA, 22 bp, Homo sapiens
ctcaaccttggccttctcccct

SEQ ID NO: 6139126 - DNA, 16 bp, Homo sapiens
ctcaaccttgtaaatt

SEQ ID NO: 6139127 - DNA, 16 bp, Homo sapiens
ctcaacgcctccccct

SEQ ID NO: 6139128 - DNA, 22 bp, Homo sapiens
ctcaacgcctccccctccccca

SEQ ID NO: 6139129 - DNA, 18 bp, Homo sapiens
ctcaacggtctggcaggg

SEQ ID NO: 6139130 - DNA, 23 bp, Homo sapiens
ctcaacggtctggcagggcagca

SEQ ID NO: 6139131 - DNA, 15 bp, Homo sapiens
ctcaacgtattgttt

SEQ ID NO: 6139132 - DNA, 22 bp, Homo sapiens
ctcaactaaagaatagtgcctc

SEQ ID NO: 6139133 - DNA, 18 bp, Homo sapiens
ctcaactaatttttgtat

SEQ ID NO: 6139134 - DNA, 14 bp, Homo sapiens
ctcaactactcagc

SEQ ID NO: 6139135 - DNA, 15 bp, Homo sapiens
ctcaactactcagct

SEQ ID NO: 6139136 - DNA, 18 bp, Homo sapiens
ctcaactagcagatacag

SEQ ID NO: 6139137 - DNA, 15 bp, Homo sapiens
ctcaactccaggatt

SEQ ID NO: 6139138 - DNA, 23 bp, Homo sapiens
ctcaactccgtgcttaaccaaag

SEQ ID NO: 6139139 - DNA, 14 bp, Homo sapiens
ctcaactcctccca

SEQ ID NO: 6139140 - DNA, 20 bp, Homo sapiens
ctcaactcgggggcgcctgg

SEQ ID NO: 6139141 - DNA, 21 bp, Homo sapiens
ctcaactcgggggcgcctgga

SEQ ID NO: 6139142 - DNA, 19 bp, Homo sapiens
ctcaactctcctccagagt

SEQ ID NO: 6139143 - DNA, 17 bp, Homo sapiens
ctcaactctgagcccat

SEQ ID NO: 6139144 - DNA, 18 bp, Homo sapiens
ctcaactctgagcccata

SEQ ID NO: 6139145 - DNA, 14 bp, Homo sapiens
ctcaactctgctga

SEQ ID NO: 6139146 - DNA, 18 bp, Homo sapiens
ctcaactctgctgagggt

SEQ ID NO: 6139147 - DNA, 19 bp, Homo sapiens
ctcaactctgctgagggtc

SEQ ID NO: 6139148 - DNA, 21 bp, Homo sapiens
ctcaactgagaagccaagcct

SEQ ID NO: 6139149 - DNA, 19 bp, Homo sapiens
ctcaactgagggccaggga

SEQ ID NO: 6139150 - DNA, 13 bp, Homo sapiens
ctcaactgcctac

SEQ ID NO: 6139151 - DNA, 23 bp, Homo sapiens
ctcaactgcctactccaaaatgt

SEQ ID NO: 6139152 - DNA, 15 bp, Homo sapiens
ctcaactgcctcagc

SEQ ID NO: 6139153 - DNA, 21 bp, Homo sapiens
ctcaactgctcttttatactg

SEQ ID NO: 6139154 - DNA, 20 bp, Homo sapiens
ctcaactgtcccaaggaggg

SEQ ID NO: 6139155 - DNA, 20 bp, Homo sapiens
ctcaactttggttcctgtga

SEQ ID NO: 6139156 - DNA, 16 bp, Homo sapiens
ctcaacttttttccct

SEQ ID NO: 6139157 - DNA, 22 bp, Homo sapiens
ctcaagaaacaatgtctgggga

SEQ ID NO: 6139158 - DNA, 15 bp, Homo sapiens
ctcaagaacaaacac

SEQ ID NO: 6139159 - DNA, 17 bp, Homo sapiens
ctcaagaacaaacagaa

SEQ ID NO: 6139160 - DNA, 18 bp, Homo sapiens
ctcaagaagaaagtgttc

SEQ ID NO: 6139161 - DNA, 19 bp, Homo sapiens
ctcaagaagaagaggggca

SEQ ID NO: 6139162 - DNA, 21 bp, Homo sapiens
ctcaagaatctagaagatgtg

SEQ ID NO: 6139163 - DNA, 18 bp, Homo sapiens
ctcaagaccaaatggaaa

SEQ ID NO: 6139164 - DNA, 16 bp, Homo sapiens
ctcaagaccagagacc

SEQ ID NO: 6139165 - DNA, 15 bp, Homo sapiens
ctcaagaccaggctg

SEQ ID NO: 6139166 - DNA, 21 bp, Homo sapiens
ctcaagaccctcgagattaac

SEQ ID NO: 6139167 - DNA, 20 bp, Homo sapiens
ctcaagacttatggaacagg

SEQ ID NO: 6139168 - DNA, 15 bp, Homo sapiens
ctcaagactttagct

SEQ ID NO: 6139169 - DNA, 22 bp, Homo sapiens
ctcaagactttgatccttggaa

SEQ ID NO: 6139170 - DNA, 16 bp, Homo sapiens
ctcaagaggaatgaaa

SEQ ID NO: 6139171 - DNA, 18 bp, Homo sapiens
ctcaagaggaatgaaaaa

SEQ ID NO: 6139172 - DNA, 17 bp, Homo sapiens
ctcaagaggcagagttc

SEQ ID NO: 6139173 - DNA, 18 bp, Homo sapiens
ctcaagagtgctgagaac

SEQ ID NO: 6139174 - DNA, 17 bp, Homo sapiens
ctcaagatactgctact

SEQ ID NO: 6139175 - DNA, 21 bp, Homo sapiens
ctcaagatactgctactgtaa

SEQ ID NO: 6139176 - DNA, 22 bp, Homo sapiens
ctcaagatattcaggtggccag

SEQ ID NO: 6139177 - DNA, 16 bp, Homo sapiens
ctcaagatgacagctc

SEQ ID NO: 6139178 - DNA, 18 bp, Homo sapiens
ctcaagatgacagctctt

SEQ ID NO: 6139179 - DNA, 21 bp, Homo sapiens
ctcaagatgggggcagggctg

SEQ ID NO: 6139180 - DNA, 15 bp, Homo sapiens
ctcaagattcccagg

SEQ ID NO: 6139181 - DNA, 17 bp, Homo sapiens
ctcaagattcccaggag

SEQ ID NO: 6139182 - DNA, 16 bp, Homo sapiens
ctcaagattctacttg

SEQ ID NO: 6139183 - DNA, 16 bp, Homo sapiens
ctcaagatttgaccaa

SEQ ID NO: 6139184 - DNA, 17 bp, Homo sapiens
ctcaagcaagatgagct

SEQ ID NO: 6139185 - DNA, 19 bp, Homo sapiens
ctcaagcaaggaagcagag

SEQ ID NO: 6139186 - DNA, 23 bp, Homo sapiens
ctcaagcaagtttaatcaatgat

SEQ ID NO: 6139187 - DNA, 12 bp, Homo sapiens
ctcaagcaataa

SEQ ID NO: 6139188 - DNA, 21 bp, Homo sapiens
ctcaagcaataattgtttcca

SEQ ID NO: 6139189 - DNA, 22 bp, Homo sapiens
ctcaagcaatccacctgccttg

SEQ ID NO: 6139190 - DNA, 23 bp, Homo sapiens
ctcaagcaatccacctgccttgg

SEQ ID NO: 6139191 - DNA, 23 bp, Homo sapiens
ctcaagcaatcctcctgcctcag

SEQ ID NO: 6139192 - DNA, 19 bp, Homo sapiens
ctcaagcaatccttctgcc

SEQ ID NO: 6139193 - DNA, 23 bp, Homo sapiens
ctcaagcaatccttctgccttgg

SEQ ID NO: 6139194 - DNA, 14 bp, Homo sapiens
ctcaagcagcaaaa

SEQ ID NO: 6139195 - DNA, 23 bp, Homo sapiens
ctcaagcagcaaaatccttactt

SEQ ID NO: 6139196 - DNA, 22 bp, Homo sapiens
ctcaagcagcgaccgccccctc

SEQ ID NO: 6139197 - DNA, 14 bp, Homo sapiens
ctcaagcagtctac

SEQ ID NO: 6139198 - DNA, 15 bp, Homo sapiens
ctcaagcagttctcc

SEQ ID NO: 6139199 - DNA, 22 bp, Homo sapiens
ctcaagccaagcagccaagctc

SEQ ID NO: 6139200 - DNA, 20 bp, Homo sapiens
ctcaagccaatcccctcctt

SEQ ID NO: 6139201 - DNA, 21 bp, Homo sapiens
ctcaagccaccagatgtgaca

SEQ ID NO: 6139202 - DNA, 22 bp, Homo sapiens
ctcaagccagccccctccagct

SEQ ID NO: 6139203 - DNA, 16 bp, Homo sapiens
ctcaagccagcctgta

SEQ ID NO: 6139204 - DNA, 19 bp, Homo sapiens
ctcaagccaggagaccctg

SEQ ID NO: 6139205 - DNA, 13 bp, Homo sapiens
ctcaagccccagc

SEQ ID NO: 6139206 - DNA, 14 bp, Homo sapiens
ctcaagccccagca

SEQ ID NO: 6139207 - DNA, 17 bp, Homo sapiens
ctcaagccccagcagcc

SEQ ID NO: 6139208 - DNA, 18 bp, Homo sapiens
ctcaagccccatttcctc

SEQ ID NO: 6139209 - DNA, 14 bp, Homo sapiens
ctcaagccctgagg

SEQ ID NO: 6139210 - DNA, 12 bp, Homo sapiens
ctcaagccctgc

SEQ ID NO: 6139211 - DNA, 15 bp, Homo sapiens
ctcaagccgcaagct

SEQ ID NO: 6139212 - DNA, 20 bp, Homo sapiens
ctcaagccgcaagctctcag

SEQ ID NO: 6139213 - DNA, 21 bp, Homo sapiens
ctcaagccgtggccggggtcc

SEQ ID NO: 6139214 - DNA, 20 bp, Homo sapiens
ctcaagcctgtgggcagcat

SEQ ID NO: 6139215 - DNA, 23 bp, Homo sapiens
ctcaagcgatccctcccctcagc

SEQ ID NO: 6139216 - DNA, 17 bp, Homo sapiens
ctcaagctagtgtttct

SEQ ID NO: 6139217 - DNA, 19 bp, Homo sapiens
ctcaagctagtgtttctag

SEQ ID NO: 6139218 - DNA, 20 bp, Homo sapiens
ctcaagctcttccttactcc

SEQ ID NO: 6139219 - DNA, 21 bp, Homo sapiens
ctcaagctttcccgcccagcc

SEQ ID NO: 6139220 - DNA, 20 bp, Homo sapiens
ctcaagctttcctgctgtct

SEQ ID NO: 6139221 - DNA, 13 bp, Homo sapiens
ctcaaggaaaaga

SEQ ID NO: 6139222 - DNA, 16 bp, Homo sapiens
ctcaaggaagagccag

SEQ ID NO: 6139223 - DNA, 18 bp, Homo sapiens
ctcaaggaagagccagcc

SEQ ID NO: 6139224 - DNA, 13 bp, Homo sapiens
ctcaaggaatctt

SEQ ID NO: 6139225 - DNA, 21 bp, Homo sapiens
ctcaaggaatctttaagcaga

SEQ ID NO: 6139226 - DNA, 21 bp, Homo sapiens
ctcaaggagaggcaaagaaag

SEQ ID NO: 6139227 - DNA, 20 bp, Homo sapiens
ctcaaggataccttcttatt

SEQ ID NO: 6139228 - DNA, 12 bp, Homo sapiens
ctcaaggattca

SEQ ID NO: 6139229 - DNA, 14 bp, Homo sapiens
ctcaaggattgatt

SEQ ID NO: 6139230 - DNA, 21 bp, Homo sapiens
ctcaaggccaccttggaggag

SEQ ID NO: 6139231 - DNA, 15 bp, Homo sapiens
ctcaaggcctcccac

SEQ ID NO: 6139232 - DNA, 19 bp, Homo sapiens
ctcaaggcctcccacagtg

SEQ ID NO: 6139233 - DNA, 14 bp, Homo sapiens
ctcaaggctgtgca

SEQ ID NO: 6139234 - DNA, 18 bp, Homo sapiens
ctcaagggaaaggcaagc

SEQ ID NO: 6139235 - DNA, 19 bp, Homo sapiens
ctcaagggaaaggcaagct

SEQ ID NO: 6139236 - DNA, 23 bp, Homo sapiens
ctcaagggaaaggcaagcttgag

SEQ ID NO: 6139237 - DNA, 15 bp, Homo sapiens
ctcaagggacaggga

SEQ ID NO: 6139238 - DNA, 21 bp, Homo sapiens
ctcaagggctagcatccctga

SEQ ID NO: 6139239 - DNA, 19 bp, Homo sapiens
ctcaagggtggcaggtcac

SEQ ID NO: 6139240 - DNA, 23 bp, Homo sapiens
ctcaagggtggcaggtcactgtc

SEQ ID NO: 6139241 - DNA, 20 bp, Homo sapiens
ctcaaggttactgggagtgt

SEQ ID NO: 6139242 - DNA, 19 bp, Homo sapiens
ctcaaggttttaggttcta

SEQ ID NO: 6139243 - DNA, 23 bp, Homo sapiens
ctcaaggttttaggttctaaagt

SEQ ID NO: 6139244 - DNA, 19 bp, Homo sapiens
ctcaagtaaaacaaatgaa

SEQ ID NO: 6139245 - DNA, 20 bp, Homo sapiens
ctcaagtaaaacaaatgaaa

SEQ ID NO: 6139246 - DNA, 16 bp, Homo sapiens
ctcaagtaaaagaaaa

SEQ ID NO: 6139247 - DNA, 14 bp, Homo sapiens
ctgacatattcaag

SEQ ID NO: 6139248 - DNA, 18 bp, Homo sapiens
ctgacatattcaagtgat

SEQ ID NO: 6139249 - DNA, 13 bp, Homo sapiens
ctgacatcaaaaa

SEQ ID NO: 6139250 - DNA, 19 bp, Homo sapiens
ctgacatcaagtgtaatta

SEQ ID NO: 6139251 - DNA, 16 bp, Homo sapiens
ctgacatcacagcagc

SEQ ID NO: 6139252 - DNA, 18 bp, Homo sapiens
ctgacatcacagcagcct

SEQ ID NO: 6139253 - DNA, 23 bp, Homo sapiens
ctgacatcacagcagcctccaac

SEQ ID NO: 6139254 - DNA, 19 bp, Homo sapiens
ctgacatcagaggtatctt

SEQ ID NO: 6139255 - DNA, 22 bp, Homo sapiens
ctgacatcagcactttaccaga

SEQ ID NO: 6139256 - DNA, 14 bp, Homo sapiens
ctgacatcccttcc

SEQ ID NO: 6139257 - DNA, 19 bp, Homo sapiens
ctgacatcccttcctggaa

SEQ ID NO: 6139258 - DNA, 16 bp, Homo sapiens
ctgacatctgtgtttc

SEQ ID NO: 6139259 - DNA, 21 bp, Homo sapiens
ctgacatctgtgtttcaagtg

SEQ ID NO: 6139260 - DNA, 22 bp, Homo sapiens
ctgacatgccatccttccagca

SEQ ID NO: 6139261 - DNA, 15 bp, Homo sapiens
ctgacatgccctccc

SEQ ID NO: 6139262 - DNA, 19 bp, Homo sapiens
ctgacatgccctcccttct

SEQ ID NO: 6139263 - DNA, 15 bp, Homo sapiens
ctgacatgctcacac

SEQ ID NO: 6139264 - DNA, 17 bp, Homo sapiens
ctgacatgctcacacat

SEQ ID NO: 6139265 - DNA, 23 bp, Homo sapiens
ctgacatggtgctgtgtgtgagc

SEQ ID NO: 6139266 - DNA, 23 bp, Homo sapiens
ctgacatgtaccccctttccctt

SEQ ID NO: 6139267 - DNA, 21 bp, Homo sapiens
ctgacatgtggggccaggtca

SEQ ID NO: 6139268 - DNA, 23 bp, Homo sapiens
ctgacatgtttcacaacaggcat

SEQ ID NO: 6139269 - DNA, 20 bp, Homo sapiens
ctgacatgtttgtgctctgt

SEQ ID NO: 6139270 - DNA, 14 bp, Homo sapiens
ctgacattaacagt

SEQ ID NO: 6139271 - DNA, 15 bp, Homo sapiens
ctgacattaacagtt

SEQ ID NO: 6139272 - DNA, 20 bp, Homo sapiens
ctgacattaacagttttcca

SEQ ID NO: 6139273 - DNA, 21 bp, Homo sapiens
ctgacattaacagttttccat

SEQ ID NO: 6139274 - DNA, 16 bp, Homo sapiens
ctgacattcacctgcc

SEQ ID NO: 6139275 - DNA, 18 bp, Homo sapiens
ctgacattccttgctgaa

SEQ ID NO: 6139276 - DNA, 19 bp, Homo sapiens
ctgacattctcaggaagcc

SEQ ID NO: 6139277 - DNA, 14 bp, Homo sapiens
ctgacattgccaaa

SEQ ID NO: 6139278 - DNA, 17 bp, Homo sapiens
ctgacattgccaaaaag

SEQ ID NO: 6139279 - DNA, 14 bp, Homo sapiens
ctgacattgctcca

SEQ ID NO: 6139280 - DNA, 22 bp, Homo sapiens
ctgacattgttggccaaagcca

SEQ ID NO: 6139281 - DNA, 18 bp, Homo sapiens
ctgacatttcttctagtg

SEQ ID NO: 6139282 - DNA, 18 bp, Homo sapiens
ctgacatttggagtgttc

SEQ ID NO: 6139283 - DNA, 21 bp, Homo sapiens
ctgacatttggagtgttcccc

SEQ ID NO: 6139284 - DNA, 21 bp, Homo sapiens
ctgacattttctttcatgggc

SEQ ID NO: 6139285 - DNA, 16 bp, Homo sapiens
ctgaccaaaaccagag

SEQ ID NO: 6139286 - DNA, 17 bp, Homo sapiens
ctgaccaaaaccagagg

SEQ ID NO: 6139287 - DNA, 17 bp, Homo sapiens
ctgaccaaaatgtgttt

SEQ ID NO: 6139288 - DNA, 18 bp, Homo sapiens
ctgaccaaagactgcaga

SEQ ID NO: 6139289 - DNA, 23 bp, Homo sapiens
ctgaccaaaggaaggcacccttg

SEQ ID NO: 6139290 - DNA, 13 bp, Homo sapiens
ctgaccaacaggc

SEQ ID NO: 6139291 - DNA, 14 bp, Homo sapiens
ctgaccaacaggct

SEQ ID NO: 6139292 - DNA, 15 bp, Homo sapiens
ctgaccaacaggctg

SEQ ID NO: 6139293 - DNA, 23 bp, Homo sapiens
ctgaccaagcggctcaagaataa

SEQ ID NO: 6139294 - DNA, 20 bp, Homo sapiens
ctgaccaagggctgacttct

SEQ ID NO: 6139295 - DNA, 20 bp, Homo sapiens
ctgaccaatattgtacagtt

SEQ ID NO: 6139296 - DNA, 14 bp, Homo sapiens
ctgaccaattgtgc

SEQ ID NO: 6139297 - DNA, 21 bp, Homo sapiens
ctgaccaattgtgctgccatt

SEQ ID NO: 6139298 - DNA, 22 bp, Homo sapiens
ctgaccaattgtgctgccattt

SEQ ID NO: 6139299 - DNA, 15 bp, Homo sapiens
ctgaccacacgcggg

SEQ ID NO: 6139300 - DNA, 19 bp, Homo sapiens
ctgaccacagacactcctg

SEQ ID NO: 6139301 - DNA, 12 bp, Homo sapiens
ctgaccaccctc

SEQ ID NO: 6139302 - DNA, 14 bp, Homo sapiens
ctgaccaccctccc

SEQ ID NO: 6139303 - DNA, 19 bp, Homo sapiens
ctgaccaccctgcctgtgg

SEQ ID NO: 6139304 - DNA, 22 bp, Homo sapiens
ctgaccaccctgcctgtggagg

SEQ ID NO: 6139305 - DNA, 17 bp, Homo sapiens
ctgaccacttgaggcct

SEQ ID NO: 6139306 - DNA, 13 bp, Homo sapiens
ctgaccagagaat

SEQ ID NO: 6139307 - DNA, 19 bp, Homo sapiens
ctgaccagagaatgcacct

SEQ ID NO: 6139308 - DNA, 23 bp, Homo sapiens
ctgaccagagaatgcacctcttg

SEQ ID NO: 6139309 - DNA, 13 bp, Homo sapiens
ctgaccagcagcg

SEQ ID NO: 6139310 - DNA, 23 bp, Homo sapiens
ctgaccagcctccatgctgcctc

SEQ ID NO: 6139311 - DNA, 19 bp, Homo sapiens
ctgaccagcggctgctcaa

SEQ ID NO: 6139312 - DNA, 13 bp, Homo sapiens
ctgaccagctccc

SEQ ID NO: 6139313 - DNA, 14 bp, Homo sapiens
ctgaccagctcccc

SEQ ID NO: 6139314 - DNA, 20 bp, Homo sapiens
ctgaccagctccccctccct

SEQ ID NO: 6139315 - DNA, 21 bp, Homo sapiens
ctgaccagctccccctccctc

SEQ ID NO: 6139316 - DNA, 22 bp, Homo sapiens
ctgaccagctccccctccctcc

SEQ ID NO: 6139317 - DNA, 15 bp, Homo sapiens
ctgaccagctggagt

SEQ ID NO: 6139318 - DNA, 17 bp, Homo sapiens
ctgaccagctggagtga

SEQ ID NO: 6139319 - DNA, 18 bp, Homo sapiens
ctgaccagctggagtgag

SEQ ID NO: 6139320 - DNA, 23 bp, Homo sapiens
ctgaccagctggagtgagggcct

SEQ ID NO: 6139321 - DNA, 20 bp, Homo sapiens
ctgaccaggatggagcaagc

SEQ ID NO: 6139322 - DNA, 19 bp, Homo sapiens
ctgaccaggcccaaggagg

SEQ ID NO: 6139323 - DNA, 17 bp, Homo sapiens
ctgaccataacagtgcc

SEQ ID NO: 6139324 - DNA, 19 bp, Homo sapiens
ctgaccataatcctagccc

SEQ ID NO: 6139325 - DNA, 15 bp, Homo sapiens
ctgaccatccactct

SEQ ID NO: 6139326 - DNA, 23 bp, Homo sapiens
ctgaccatccactctaccctccc

SEQ ID NO: 6139327 - DNA, 15 bp, Homo sapiens
ctgaccatctgtgac

SEQ ID NO: 6139328 - DNA, 13 bp, Homo sapiens
ctgacccaaagca

SEQ ID NO: 6139329 - DNA, 14 bp, Homo sapiens
ctgacccaacaccc

SEQ ID NO: 6139330 - DNA, 19 bp, Homo sapiens
ctgacccaacacccccgac

SEQ ID NO: 6139331 - DNA, 13 bp, Homo sapiens
ctgacccaactgg

SEQ ID NO: 6139332 - DNA, 14 bp, Homo sapiens
ctgacccaactggg

SEQ ID NO: 6139333 - DNA, 17 bp, Homo sapiens
ctgacccaagaggtggg

SEQ ID NO: 6139334 - DNA, 13 bp, Homo sapiens
ctgacccaataaa

SEQ ID NO: 6139335 - DNA, 17 bp, Homo sapiens
ctgacccaccaaggtct

SEQ ID NO: 6139336 - DNA, 14 bp, Homo sapiens
ctgacccacggggc

SEQ ID NO: 6139337 - DNA, 17 bp, Homo sapiens
ctgacccacggggcagt

SEQ ID NO: 6139338 - DNA, 14 bp, Homo sapiens
ctgacccactgctt

SEQ ID NO: 6139339 - DNA, 16 bp, Homo sapiens
ctgacccagagtggag

SEQ ID NO: 6139340 - DNA, 22 bp, Homo sapiens
ctgacccagagtggagtctgag

SEQ ID NO: 6139341 - DNA, 12 bp, Homo sapiens
ctgacccagcat

SEQ ID NO: 6139342 - DNA, 13 bp, Homo sapiens
ctgacccagcatc

SEQ ID NO: 6139343 - DNA, 18 bp, Homo sapiens
ctgacccagcatctccca

SEQ ID NO: 6139344 - DNA, 21 bp, Homo sapiens
ctgacccagcatctcccagca

SEQ ID NO: 6139345 - DNA, 15 bp, Homo sapiens
ctgacccagcctgtt

SEQ ID NO: 6139346 - DNA, 13 bp, Homo sapiens
ctgacccaggaat

SEQ ID NO: 6139347 - DNA, 14 bp, Homo sapiens
ctgacccaggccgc

SEQ ID NO: 6139348 - DNA, 18 bp, Homo sapiens
ctgacccaggccgcagct

SEQ ID NO: 6139349 - DNA, 21 bp, Homo sapiens
ctgacccaggccgcagctctt

SEQ ID NO: 6139350 - DNA, 23 bp, Homo sapiens
ctgacccaggccgcagctcttgc

SEQ ID NO: 6139351 - DNA, 20 bp, Homo sapiens
ctgacccagggactctccaa

SEQ ID NO: 6139352 - DNA, 13 bp, Homo sapiens
ctgacccagtccc

SEQ ID NO: 6139353 - DNA, 15 bp, Homo sapiens
ctgacccagtccctg

SEQ ID NO: 6139354 - DNA, 16 bp, Homo sapiens
ctgacccagtccctgg

SEQ ID NO: 6139355 - DNA, 17 bp, Homo sapiens
ctgacccagtccctggg

SEQ ID NO: 6139356 - DNA, 18 bp, Homo sapiens
ctgacccagtccctgggg

SEQ ID NO: 6139357 - DNA, 20 bp, Homo sapiens
ctgacccagtgcccccactg

SEQ ID NO: 6139358 - DNA, 23 bp, Homo sapiens
ctgacccagtgcccccactgacc

SEQ ID NO: 6139359 - DNA, 12 bp, Homo sapiens
ctgacccagtgt

SEQ ID NO: 6139360 - DNA, 13 bp, Homo sapiens
ctgacccatgctg

SEQ ID NO: 6139361 - DNA, 15 bp, Homo sapiens
ctgacccatgctgcc

SEQ ID NO: 6139362 - DNA, 17 bp, Homo sapiens
ctgacccatgctgccct

SEQ ID NO: 6139363 - DNA, 21 bp, Homo sapiens
ctgacccatgctgccctgtga

SEQ ID NO: 6139364 - DNA, 19 bp, Homo sapiens
ctgacccattcacatttta

SEQ ID NO: 6139365 - DNA, 13 bp, Homo sapiens
ctgaccccaaggg

SEQ ID NO: 6139366 - DNA, 21 bp, Homo sapiens
ctgaccccaagggggctgctg

SEQ ID NO: 6139367 - DNA, 14 bp, Homo sapiens
ctgaccccagccca

SEQ ID NO: 6139368 - DNA, 15 bp, Homo sapiens
ctgaccccaggaagt

SEQ ID NO: 6139369 - DNA, 16 bp, Homo sapiens
ctgaccccatcaccta

SEQ ID NO: 6139370 - DNA, 16 bp, Homo sapiens
ctgacccccatctgag

SEQ ID NO: 6139371 - DNA, 21 bp, Homo sapiens
ctgacccccatctgagctggg

SEQ ID NO: 6139372 - DNA, 13 bp, Homo sapiens
ctgacccccatgt

SEQ ID NO: 6139373 - DNA, 14 bp, Homo sapiens
ctgacccccctcag

SEQ ID NO: 6139374 - DNA, 19 bp, Homo sapiens
ctgacccccctcaggaccc

SEQ ID NO: 6139375 - DNA, 15 bp, Homo sapiens
ctgaccccctccccc

SEQ ID NO: 6139376 - DNA, 17 bp, Homo sapiens
ctgaccccctcccccca

SEQ ID NO: 6139377 - DNA, 16 bp, Homo sapiens
ctgaccccctcccctg

SEQ ID NO: 6139378 - DNA, 17 bp, Homo sapiens
ctgaccccgacctcaga

SEQ ID NO: 6139379 - DNA, 19 bp, Homo sapiens
ctgaccccgagaagtgctc

SEQ ID NO: 6139380 - DNA, 20 bp, Homo sapiens
ctgaccccgagaagtgctct

SEQ ID NO: 6139381 - DNA, 15 bp, Homo sapiens
ctgaccccgccatgc

SEQ ID NO: 6139382 - DNA, 16 bp, Homo sapiens
ctgacccctccctgca

SEQ ID NO: 6139383 - DNA, 18 bp, Homo sapiens
ctgacccctccctgcagg

SEQ ID NO: 6139384 - DNA, 16 bp, Homo sapiens
ctgacccctcctcact

SEQ ID NO: 6139385 - DNA, 17 bp, Homo sapiens
ctgacccctcctcactg

SEQ ID NO: 6139386 - DNA, 15 bp, Homo sapiens
ctgacccctctggtg

SEQ ID NO: 6139387 - DNA, 13 bp, Homo sapiens
ctgacccctgcct

SEQ ID NO: 6139388 - DNA, 14 bp, Homo sapiens
ctgacccctgcctg

SEQ ID NO: 6139389 - DNA, 16 bp, Homo sapiens
ctgacccctgctcagt

SEQ ID NO: 6139390 - DNA, 14 bp, Homo sapiens
ctgacccctgtgtg

SEQ ID NO: 6139391 - DNA, 15 bp, Homo sapiens
ctgacccctgtgtga

SEQ ID NO: 6139392 - DNA, 17 bp, Homo sapiens
ctgaccccttgctccct

SEQ ID NO: 6139393 - DNA, 17 bp, Homo sapiens
ctgacccggaggaaagg

SEQ ID NO: 6139394 - DNA, 18 bp, Homo sapiens
ctgacccggattggccct

SEQ ID NO: 6139395 - DNA, 19 bp, Homo sapiens
ctgacccggattggccctg

SEQ ID NO: 6139396 - DNA, 21 bp, Homo sapiens
ctgacccggattggccctgcc

SEQ ID NO: 6139397 - DNA, 17 bp, Homo sapiens
ctgaccctatgggtcta

SEQ ID NO: 6139398 - DNA, 15 bp, Homo sapiens
ctgaccctcaggcac

SEQ ID NO: 6139399 - DNA, 13 bp, Homo sapiens
ctgaccctcccag

SEQ ID NO: 6139400 - DNA, 18 bp, Homo sapiens
ctgaccctccgctgcaga

SEQ ID NO: 6139401 - DNA, 20 bp, Homo sapiens
ctgaccctcctccactccac

SEQ ID NO: 6139402 - DNA, 13 bp, Homo sapiens
ctgaccctcctgt

SEQ ID NO: 6139403 - DNA, 14 bp, Homo sapiens
ctgaccctcctgtt

SEQ ID NO: 6139404 - DNA, 17 bp, Homo sapiens
ctgaccctcctgttgca

SEQ ID NO: 6139405 - DNA, 22 bp, Homo sapiens
ctgaccctcctgttgcacccag

SEQ ID NO: 6139406 - DNA, 23 bp, Homo sapiens
ctgaccctcctgttgcacccagc

SEQ ID NO: 6139407 - DNA, 14 bp, Homo sapiens
ctgaccctgctcct

SEQ ID NO: 6139408 - DNA, 19 bp, Homo sapiens
ctgaccctgcttcaaatat

SEQ ID NO: 6139409 - DNA, 14 bp, Homo sapiens
ctgaccctggagcg

SEQ ID NO: 6139410 - DNA, 13 bp, Homo sapiens
ctgaccctgggcc

SEQ ID NO: 6139411 - DNA, 14 bp, Homo sapiens
ctgaccctgggcct

SEQ ID NO: 6139412 - DNA, 17 bp, Homo sapiens
ctgaccctgggcctgga

SEQ ID NO: 6139413 - DNA, 18 bp, Homo sapiens
ctgaccctgggcctggag

SEQ ID NO: 6139414 - DNA, 18 bp, Homo sapiens
ctgaccctgtgatgcctg

SEQ ID NO: 6139415 - DNA, 16 bp, Homo sapiens
ctgaccctgtgcccca

SEQ ID NO: 6139416 - DNA, 18 bp, Homo sapiens
ctgacccttccacagtca

SEQ ID NO: 6139417 - DNA, 17 bp, Homo sapiens
ctgacccttccagacat

SEQ ID NO: 6139418 - DNA, 19 bp, Homo sapiens
ctgacccttctccaaaggc

SEQ ID NO: 6139419 - DNA, 23 bp, Homo sapiens
ctgacccttctccaaaggctctg

SEQ ID NO: 6139420 - DNA, 14 bp, Homo sapiens
ctgacccttgggcc

SEQ ID NO: 6139421 - DNA, 20 bp, Homo sapiens
ctgacccttgggcctgggcc

SEQ ID NO: 6139422 - DNA, 20 bp, Homo sapiens
ctgaccgaaacagcgctggg

SEQ ID NO: 6139423 - DNA, 13 bp, Homo sapiens
ctgaccgaaggga

SEQ ID NO: 6139424 - DNA, 22 bp, Homo sapiens
ctgaccgatgtgtctcccagaa

SEQ ID NO: 6139425 - DNA, 19 bp, Homo sapiens
ctgaccgccgcttccagct

SEQ ID NO: 6139426 - DNA, 22 bp, Homo sapiens
ctcaagtacccattctgttttc

SEQ ID NO: 6139427 - DNA, 20 bp, Homo sapiens
ctcaagtagaaaagcagtcc

SEQ ID NO: 6139428 - DNA, 14 bp, Homo sapiens
ctcaagtagcattt

SEQ ID NO: 6139429 - DNA, 15 bp, Homo sapiens
ctcaagtagcattta

SEQ ID NO: 6139430 - DNA, 18 bp, Homo sapiens
ctcaagtagcatttactg

SEQ ID NO: 6139431 - DNA, 20 bp, Homo sapiens
ctcaagtctagaaaccagta

SEQ ID NO: 6139432 - DNA, 17 bp, Homo sapiens
ctcaagtcttccctgat

SEQ ID NO: 6139433 - DNA, 16 bp, Homo sapiens
ctcaagtctttctctt

SEQ ID NO: 6139434 - DNA, 12 bp, Homo sapiens
ctcaagtgatag

SEQ ID NO: 6139435 - DNA, 18 bp, Homo sapiens
ctcaagtgatccacctgc

SEQ ID NO: 6139436 - DNA, 16 bp, Homo sapiens
ctcaagtgatcctcac

SEQ ID NO: 6139437 - DNA, 23 bp, Homo sapiens
ctcaagtgatctgtccacctcgg

SEQ ID NO: 6139438 - DNA, 18 bp, Homo sapiens
ctcaagtgattctcctgc

SEQ ID NO: 6139439 - DNA, 21 bp, Homo sapiens
ctcaagtgattctcctgcctc

SEQ ID NO: 6139440 - DNA, 17 bp, Homo sapiens
ctcaagtgcaaggacca

SEQ ID NO: 6139441 - DNA, 21 bp, Homo sapiens
ctcaagtgcaatgccccctcc

SEQ ID NO: 6139442 - DNA, 19 bp, Homo sapiens
ctcaagtgccattcatcct

SEQ ID NO: 6139443 - DNA, 13 bp, Homo sapiens
ctcaagtgtcacc

SEQ ID NO: 6139444 - DNA, 20 bp, Homo sapiens
ctcaagttatttcatgcgca

SEQ ID NO: 6139445 - DNA, 15 bp, Homo sapiens
ctcaagttcaaggac

SEQ ID NO: 6139446 - DNA, 13 bp, Homo sapiens
ctcaagttcacca

SEQ ID NO: 6139447 - DNA, 17 bp, Homo sapiens
ctcaagttccagtgcag

SEQ ID NO: 6139448 - DNA, 24 bp, Homo sapiens
ctcaagttccagtgcagagatcct

SEQ ID NO: 6139449 - DNA, 14 bp, Homo sapiens
ctcaagttgtttaa

SEQ ID NO: 6139450 - DNA, 14 bp, Homo sapiens
ctcaagtttaaaag

SEQ ID NO: 6139451 - DNA, 18 bp, Homo sapiens
ctcaagtttatgtctcag

SEQ ID NO: 6139452 - DNA, 13 bp, Homo sapiens
ctcaataaaagaa

SEQ ID NO: 6139453 - DNA, 13 bp, Homo sapiens
ctcaataaaatca

SEQ ID NO: 6139454 - DNA, 22 bp, Homo sapiens
ctcaataaaatcatgtacattt

SEQ ID NO: 6139455 - DNA, 13 bp, Homo sapiens
ctcaataaacagt

SEQ ID NO: 6139456 - DNA, 21 bp, Homo sapiens
ctcaataaacatttcatttcc

SEQ ID NO: 6139457 - DNA, 15 bp, Homo sapiens
ctcaataaacttgtg

SEQ ID NO: 6139458 - DNA, 14 bp, Homo sapiens
ctcaataaagctcg

SEQ ID NO: 6139459 - DNA, 14 bp, Homo sapiens
ctcaataaaggtca

SEQ ID NO: 6139460 - DNA, 15 bp, Homo sapiens
ctcaataaaggtcat

SEQ ID NO: 6139461 - DNA, 14 bp, Homo sapiens
ctcaataaagtaca

SEQ ID NO: 6139462 - DNA, 20 bp, Homo sapiens
ctcaataaagtgctttaaaa

SEQ ID NO: 6139463 - DNA, 21 bp, Homo sapiens
ctcaataaatgtgtgttgact

SEQ ID NO: 6139464 - DNA, 18 bp, Homo sapiens
ctcaataaattgcaacat

SEQ ID NO: 6139465 - DNA, 14 bp, Homo sapiens
ctcaataagccttg

SEQ ID NO: 6139466 - DNA, 15 bp, Homo sapiens
ctcaatactacctct

SEQ ID NO: 6139467 - DNA, 19 bp, Homo sapiens
ctcaatactacctctgaat

SEQ ID NO: 6139468 - DNA, 17 bp, Homo sapiens
ctcaatactctctgagt

SEQ ID NO: 6139469 - DNA, 18 bp, Homo sapiens
ctcaatagctccaagctg

SEQ ID NO: 6139470 - DNA, 19 bp, Homo sapiens
ctcaatagctccaagctgt

SEQ ID NO: 6139471 - DNA, 14 bp, Homo sapiens
ctcaatagttctta

SEQ ID NO: 6139472 - DNA, 16 bp, Homo sapiens
ctcaatatataataaa

SEQ ID NO: 6139473 - DNA, 18 bp, Homo sapiens
ctcaatatgatcttgata

SEQ ID NO: 6139474 - DNA, 12 bp, Homo sapiens
ctcaatattaaa

SEQ ID NO: 6139475 - DNA, 16 bp, Homo sapiens
ctcaatattcaataaa

SEQ ID NO: 6139476 - DNA, 13 bp, Homo sapiens
ctcaatattttcc

SEQ ID NO: 6139477 - DNA, 14 bp, Homo sapiens
ctcaatcactgctc

SEQ ID NO: 6139478 - DNA, 13 bp, Homo sapiens
ctcaatcagtgca

SEQ ID NO: 6139479 - DNA, 19 bp, Homo sapiens
ctcaatcatgggaatttta

SEQ ID NO: 6139480 - DNA, 15 bp, Homo sapiens
ctcaatccaccttca

SEQ ID NO: 6139481 - DNA, 16 bp, Homo sapiens
ctcaatcccacatacg

SEQ ID NO: 6139482 - DNA, 14 bp, Homo sapiens
ctcaatcctaattt

SEQ ID NO: 6139483 - DNA, 23 bp, Homo sapiens
ctcaatcctaatttctcctccct

SEQ ID NO: 6139484 - DNA, 14 bp, Homo sapiens
ctcaatcctctaag

SEQ ID NO: 6139485 - DNA, 17 bp, Homo sapiens
ctcaatctaaggccttc

SEQ ID NO: 6139486 - DNA, 19 bp, Homo sapiens
ctcaatctccagggctcca

SEQ ID NO: 6139487 - DNA, 14 bp, Homo sapiens
ctcaatctgcagcc

SEQ ID NO: 6139488 - DNA, 20 bp, Homo sapiens
ctcaatgaaaccttcctctt

SEQ ID NO: 6139489 - DNA, 21 bp, Homo sapiens
ctcaatgaaaccttcctcttg

SEQ ID NO: 6139490 - DNA, 19 bp, Homo sapiens
ctcaatgaaccataaattc

SEQ ID NO: 6139491 - DNA, 20 bp, Homo sapiens
ctcaatgaaccataaattca

SEQ ID NO: 6139492 - DNA, 16 bp, Homo sapiens
ctcaatgaagccagct

SEQ ID NO: 6139493 - DNA, 13 bp, Homo sapiens
ctcaatgagcatg

SEQ ID NO: 6139494 - DNA, 15 bp, Homo sapiens
ctcaatgagcatgtt

SEQ ID NO: 6139495 - DNA, 23 bp, Homo sapiens
ctcaatgcaaatagtagacattt

SEQ ID NO: 6139496 - DNA, 18 bp, Homo sapiens
ctcaatgcaacctctgcc

SEQ ID NO: 6139497 - DNA, 19 bp, Homo sapiens
ctcaatgcaacctctgccc

SEQ ID NO: 6139498 - DNA, 21 bp, Homo sapiens
ctcaatgcaagccccaacttt

SEQ ID NO: 6139499 - DNA, 22 bp, Homo sapiens
ctcaatgcaagccccaactttc

SEQ ID NO: 6139500 - DNA, 13 bp, Homo sapiens
ctcaatgcactga

SEQ ID NO: 6139501 - DNA, 15 bp, Homo sapiens
ctcaatgcactgaca

SEQ ID NO: 6139502 - DNA, 14 bp, Homo sapiens
ctcaatgcagtcag

SEQ ID NO: 6139503 - DNA, 22 bp, Homo sapiens
ctcaatgcattgtcttgtggag

SEQ ID NO: 6139504 - DNA, 20 bp, Homo sapiens
ctcaatgccaggcagtgcag

SEQ ID NO: 6139505 - DNA, 17 bp, Homo sapiens
ctcaatgcccagtaaaa

SEQ ID NO: 6139506 - DNA, 22 bp, Homo sapiens
ctcaatgcccagtaaaatttca

SEQ ID NO: 6139507 - DNA, 14 bp, Homo sapiens
ctcaatgccctgcc

SEQ ID NO: 6139508 - DNA, 19 bp, Homo sapiens
ctcaatgctttatttgtaa

SEQ ID NO: 6139509 - DNA, 17 bp, Homo sapiens
ctcaatggactggaagg

SEQ ID NO: 6139510 - DNA, 18 bp, Homo sapiens
ctcaatggacttcaaatt

SEQ ID NO: 6139511 - DNA, 16 bp, Homo sapiens
ctcaatggagaatata

SEQ ID NO: 6139512 - DNA, 22 bp, Homo sapiens
ctcaatggcctaaaactggcct

SEQ ID NO: 6139513 - DNA, 22 bp, Homo sapiens
ctcaatggtgctataataaata

SEQ ID NO: 6139514 - DNA, 15 bp, Homo sapiens
ctcaatgtccccctc

SEQ ID NO: 6139515 - DNA, 19 bp, Homo sapiens
ctcaatgtccccctcaccc

SEQ ID NO: 6139516 - DNA, 20 bp, Homo sapiens
ctcaatgtgaatcagaccct

SEQ ID NO: 6139517 - DNA, 16 bp, Homo sapiens
ctcaatgtgaccaggg

SEQ ID NO: 6139518 - DNA, 18 bp, Homo sapiens
ctcaatgtgaccaggggt

SEQ ID NO: 6139519 - DNA, 21 bp, Homo sapiens
ctcaatgtgcaataacttgtg

SEQ ID NO: 6139520 - DNA, 20 bp, Homo sapiens
ctcaatgtggaaaaaatatt

SEQ ID NO: 6139521 - DNA, 19 bp, Homo sapiens
ctcaatgttactatctgct

SEQ ID NO: 6139522 - DNA, 12 bp, Homo sapiens
ctcaatgtttga

SEQ ID NO: 6139523 - DNA, 18 bp, Homo sapiens
ctcaatgtttgtaataat

SEQ ID NO: 6139524 - DNA, 13 bp, Homo sapiens
ctcaattacagag

SEQ ID NO: 6139525 - DNA, 16 bp, Homo sapiens
ctcaattatttgcata

SEQ ID NO: 6139526 - DNA, 19 bp, Homo sapiens
ctcaattcatatttatgaa

SEQ ID NO: 6139527 - DNA, 12 bp, Homo sapiens
ctcaattccaac

SEQ ID NO: 6139528 - DNA, 15 bp, Homo sapiens
ctcaattccagggaa

SEQ ID NO: 6139529 - DNA, 11 bp, Homo sapiens
ctcaattctgt

SEQ ID NO: 6139530 - DNA, 21 bp, Homo sapiens
ctcaattgaaagcttttaaaa

SEQ ID NO: 6139531 - DNA, 12 bp, Homo sapiens
ctcaatttcaat

SEQ ID NO: 6139532 - DNA, 13 bp, Homo sapiens
ctcaatttcagca

SEQ ID NO: 6139533 - DNA, 19 bp, Homo sapiens
ctcaatttcctcatctggg

SEQ ID NO: 6139534 - DNA, 15 bp, Homo sapiens
ctcaatttctcccca

SEQ ID NO: 6139535 - DNA, 16 bp, Homo sapiens
ctcaatttctccccag

SEQ ID NO: 6139536 - DNA, 18 bp, Homo sapiens
ctcaatttgaaacacaag

SEQ ID NO: 6139537 - DNA, 17 bp, Homo sapiens
ctcaattttcactgtgt

SEQ ID NO: 6139538 - DNA, 18 bp, Homo sapiens
ctcaattttggtttttct

SEQ ID NO: 6139539 - DNA, 15 bp, Homo sapiens
ctcaattttgtattt

SEQ ID NO: 6139540 - DNA, 19 bp, Homo sapiens
ctcaattttgtatttaatg

SEQ ID NO: 6139541 - DNA, 12 bp, Homo sapiens
ctcaatttttgg

SEQ ID NO: 6139542 - DNA, 16 bp, Homo sapiens
ctcaatttttgtctca

SEQ ID NO: 6139543 - DNA, 20 bp, Homo sapiens
ctcaatttttgtctcagaag

SEQ ID NO: 6139544 - DNA, 16 bp, Homo sapiens
ctcaattttttcaaat

SEQ ID NO: 6139545 - DNA, 23 bp, Homo sapiens
ctcacaaaaaggcaaatattgaa

SEQ ID NO: 6139546 - DNA, 22 bp, Homo sapiens
ctcacaaaacatattttacatc

SEQ ID NO: 6139547 - DNA, 11 bp, Homo sapiens
ctcacaaaaga

SEQ ID NO: 6139548 - DNA, 17 bp, Homo sapiens
ctcacaaaatcacttta

SEQ ID NO: 6139549 - DNA, 18 bp, Homo sapiens
ctcacaaaatcactttaa

SEQ ID NO: 6139550 - DNA, 17 bp, Homo sapiens
ctcacaaatgctgtggt

SEQ ID NO: 6139551 - DNA, 13 bp, Homo sapiens
ctcacaacccctg

SEQ ID NO: 6139552 - DNA, 17 bp, Homo sapiens
ctcacaacctgaaccta

SEQ ID NO: 6139553 - DNA, 13 bp, Homo sapiens
ctcacaactcctt

SEQ ID NO: 6139554 - DNA, 23 bp, Homo sapiens
ctcacaacttagtgtaatatacc

SEQ ID NO: 6139555 - DNA, 15 bp, Homo sapiens
ctcacaagccagcca

SEQ ID NO: 6139556 - DNA, 17 bp, Homo sapiens
ctcacaagcctcttctg

SEQ ID NO: 6139557 - DNA, 16 bp, Homo sapiens
ctcacaagcgctccca

SEQ ID NO: 6139558 - DNA, 21 bp, Homo sapiens
ctcacaagcgctcccagcctg

SEQ ID NO: 6139559 - DNA, 22 bp, Homo sapiens
ctcacaagcgctcccagcctgc

SEQ ID NO: 6139560 - DNA, 13 bp, Homo sapiens
ctcacaaggcagc

SEQ ID NO: 6139561 - DNA, 21 bp, Homo sapiens
ctcacaaggcagcaaggcccg

SEQ ID NO: 6139562 - DNA, 19 bp, Homo sapiens
ctcacaaggcccaggagac

SEQ ID NO: 6139563 - DNA, 14 bp, Homo sapiens
ctcacaagtgaaaa

SEQ ID NO: 6139564 - DNA, 23 bp, Homo sapiens
ctcacaatgttgctagttttttg

SEQ ID NO: 6139565 - DNA, 23 bp, Homo sapiens
ctcacaattgttgactaaaatgc

SEQ ID NO: 6139566 - DNA, 20 bp, Homo sapiens
ctcacaatttaaaatatttc

SEQ ID NO: 6139567 - DNA, 13 bp, Homo sapiens
ctcacacacacag

SEQ ID NO: 6139568 - DNA, 17 bp, Homo sapiens
ctcacacaccctgaggt

SEQ ID NO: 6139569 - DNA, 16 bp, Homo sapiens
ctcacacacctctgcc

SEQ ID NO: 6139570 - DNA, 17 bp, Homo sapiens
ctcacacacggaggcca

SEQ ID NO: 6139571 - DNA, 14 bp, Homo sapiens
ctcacacagccagg

SEQ ID NO: 6139572 - DNA, 16 bp, Homo sapiens
ctcacacagccaggtg

SEQ ID NO: 6139573 - DNA, 22 bp, Homo sapiens
ctcacacaggcatttcctgggt

SEQ ID NO: 6139574 - DNA, 15 bp, Homo sapiens
ctcacacatcctgtc

SEQ ID NO: 6139575 - DNA, 20 bp, Homo sapiens
ctcacaccactagcctcagg

SEQ ID NO: 6139576 - DNA, 13 bp, Homo sapiens
ctcacacccaccg

SEQ ID NO: 6139577 - DNA, 17 bp, Homo sapiens
ctcacacccacctgctg

SEQ ID NO: 6139578 - DNA, 12 bp, Homo sapiens
ctcacacccctg

SEQ ID NO: 6139579 - DNA, 13 bp, Homo sapiens
ctcacacccctgt

SEQ ID NO: 6139580 - DNA, 15 bp, Homo sapiens
ctcacacccctgtcc

SEQ ID NO: 6139581 - DNA, 16 bp, Homo sapiens
ctcacacccctgtccc

SEQ ID NO: 6139582 - DNA, 22 bp, Homo sapiens
ctcacaccctaataagtccaca

SEQ ID NO: 6139583 - DNA, 20 bp, Homo sapiens
ctcacaccctaccttcccca

SEQ ID NO: 6139584 - DNA, 22 bp, Homo sapiens
ctcacaccctaccttccccaga

SEQ ID NO: 6139585 - DNA, 15 bp, Homo sapiens
ctcacaccctggacg

SEQ ID NO: 6139586 - DNA, 21 bp, Homo sapiens
ctcacaccgcgtctggtgaca

SEQ ID NO: 6139587 - DNA, 16 bp, Homo sapiens
ctcacaccggcactgt

SEQ ID NO: 6139588 - DNA, 20 bp, Homo sapiens
ctcacaccggcactgtgcac

SEQ ID NO: 6139589 - DNA, 16 bp, Homo sapiens
ctcacacctcactctt

SEQ ID NO: 6139590 - DNA, 19 bp, Homo sapiens
ctcacacctcactctttat

SEQ ID NO: 6139591 - DNA, 18 bp, Homo sapiens
ctcacacctcccttcatc

SEQ ID NO: 6139592 - DNA, 16 bp, Homo sapiens
ctcacacctgtccttc

SEQ ID NO: 6139593 - DNA, 18 bp, Homo sapiens
ctcacacctgtccttctc

SEQ ID NO: 6139594 - DNA, 15 bp, Homo sapiens
ctcacactactgtat

SEQ ID NO: 6139595 - DNA, 20 bp, Homo sapiens
ctcacactactgtatttcat

SEQ ID NO: 6139596 - DNA, 13 bp, Homo sapiens
ctcacactcaccc

SEQ ID NO: 6139597 - DNA, 23 bp, Homo sapiens
ctcacactcatgcattgtcctct

SEQ ID NO: 6139598 - DNA, 10 bp, Homo sapiens
ctcacactcc

SEQ ID NO: 6139599 - DNA, 19 bp, Homo sapiens
ctcacactccagtggcaga

SEQ ID NO: 6139600 - DNA, 18 bp, Homo sapiens
ctcacactcccctagggg

SEQ ID NO: 6139601 - DNA, 13 bp, Homo sapiens
ctcacactcctcc

SEQ ID NO: 6139602 - DNA, 19 bp, Homo sapiens
ctcacactcctcctgccag

SEQ ID NO: 6139603 - DNA, 20 bp, Homo sapiens
ctcacactcctcctgccagc

SEQ ID NO: 6139604 - DNA, 16 bp, Homo sapiens
ctcacactctctgcag

SEQ ID NO: 6139605 - DNA, 12 bp, Homo sapiens
ctcacactgaga

SEQ ID NO: 6139606 - DNA, 14 bp, Homo sapiens
ctgaccgctgccca

SEQ ID NO: 6139607 - DNA, 17 bp, Homo sapiens
ctgaccgctgcccaggt

SEQ ID NO: 6139608 - DNA, 19 bp, Homo sapiens
ctgaccggaatggtcaaat

SEQ ID NO: 6139609 - DNA, 22 bp, Homo sapiens
ctgaccgggcttcctccctcca

SEQ ID NO: 6139610 - DNA, 16 bp, Homo sapiens
ctgaccggtgctttta

SEQ ID NO: 6139611 - DNA, 11 bp, Homo sapiens
ctgaccgtgac

SEQ ID NO: 6139612 - DNA, 23 bp, Homo sapiens
ctgaccgttttcacttgtctcct

SEQ ID NO: 6139613 - DNA, 19 bp, Homo sapiens
ctgacctagaccagtttgc

SEQ ID NO: 6139614 - DNA, 22 bp, Homo sapiens
ctgacctagaccagtttgcatg

SEQ ID NO: 6139615 - DNA, 21 bp, Homo sapiens
ctgacctataacctgtaggaa

SEQ ID NO: 6139616 - DNA, 12 bp, Homo sapiens
ctgacctcaaat

SEQ ID NO: 6139617 - DNA, 12 bp, Homo sapiens
ctgacctcacct

SEQ ID NO: 6139618 - DNA, 13 bp, Homo sapiens
ctgacctcacctg

SEQ ID NO: 6139619 - DNA, 17 bp, Homo sapiens
ctgacctcactgtcctg

SEQ ID NO: 6139620 - DNA, 14 bp, Homo sapiens
ctgacctccacagc

SEQ ID NO: 6139621 - DNA, 21 bp, Homo sapiens
ctgacctccagtcctgctggc

SEQ ID NO: 6139622 - DNA, 24 bp, Homo sapiens
ctgacctccagtcctgctggcctg

SEQ ID NO: 6139623 - DNA, 16 bp, Homo sapiens
ctgacctcccaactct

SEQ ID NO: 6139624 - DNA, 16 bp, Homo sapiens
ctgacctcccagccct

SEQ ID NO: 6139625 - DNA, 18 bp, Homo sapiens
ctgacctcccagccctat

SEQ ID NO: 6139626 - DNA, 18 bp, Homo sapiens
ctgacctcccagcctttc

SEQ ID NO: 6139627 - DNA, 17 bp, Homo sapiens
ctgacctccccctcctt

SEQ ID NO: 6139628 - DNA, 16 bp, Homo sapiens
ctgacctccgccatcc

SEQ ID NO: 6139629 - DNA, 17 bp, Homo sapiens
ctgacctccgccatcca

SEQ ID NO: 6139630 - DNA, 22 bp, Homo sapiens
ctgacctcctggactgtaggac

SEQ ID NO: 6139631 - DNA, 20 bp, Homo sapiens
ctgacctcgtgatgggcccg

SEQ ID NO: 6139632 - DNA, 24 bp, Homo sapiens
ctgacctcgtgatttgcctgcctg

SEQ ID NO: 6139633 - DNA, 17 bp, Homo sapiens
ctgacctctgaagagct

SEQ ID NO: 6139634 - DNA, 19 bp, Homo sapiens
ctgacctctgaagagctga

SEQ ID NO: 6139635 - DNA, 18 bp, Homo sapiens
ctgacctctgctgagtgc

SEQ ID NO: 6139636 - DNA, 24 bp, Homo sapiens
ctgacctctgctgagtgctgggca

SEQ ID NO: 6139637 - DNA, 20 bp, Homo sapiens
ctgacctcttgctgtctctg

SEQ ID NO: 6139638 - DNA, 21 bp, Homo sapiens
ctgacctcttgctgtctctgc

SEQ ID NO: 6139639 - DNA, 14 bp, Homo sapiens
ctgacctgagactg

SEQ ID NO: 6139640 - DNA, 19 bp, Homo sapiens
ctgacctgagcggcaccct

SEQ ID NO: 6139641 - DNA, 20 bp, Homo sapiens
ctgacctgatcacctctggc

SEQ ID NO: 6139642 - DNA, 15 bp, Homo sapiens
ctgacctgcccatgt

SEQ ID NO: 6139643 - DNA, 16 bp, Homo sapiens
ctgacctgcccatgtc

SEQ ID NO: 6139644 - DNA, 13 bp, Homo sapiens
ctgacctgccccc

SEQ ID NO: 6139645 - DNA, 21 bp, Homo sapiens
ctgacctgcccctgccgcctg

SEQ ID NO: 6139646 - DNA, 18 bp, Homo sapiens
ctgacctgcctctcacac

SEQ ID NO: 6139647 - DNA, 20 bp, Homo sapiens
ctgacctgctccgccaggaa

SEQ ID NO: 6139648 - DNA, 14 bp, Homo sapiens
ctgacctgctgacc

SEQ ID NO: 6139649 - DNA, 15 bp, Homo sapiens
ctgacctgctgacct

SEQ ID NO: 6139650 - DNA, 20 bp, Homo sapiens
ctgacctgctgacctgtgca

SEQ ID NO: 6139651 - DNA, 12 bp, Homo sapiens
ctgacctgctgt

SEQ ID NO: 6139652 - DNA, 13 bp, Homo sapiens
ctgacctgctgtg

SEQ ID NO: 6139653 - DNA, 14 bp, Homo sapiens
ctgacctgctgtgg

SEQ ID NO: 6139654 - DNA, 18 bp, Homo sapiens
ctgacctggatatccatg

SEQ ID NO: 6139655 - DNA, 16 bp, Homo sapiens
ctgacctggcacagaa

SEQ ID NO: 6139656 - DNA, 13 bp, Homo sapiens
ctgacctgggccc

SEQ ID NO: 6139657 - DNA, 23 bp, Homo sapiens
ctgacctgggcccacagagcctg

SEQ ID NO: 6139658 - DNA, 20 bp, Homo sapiens
ctgacctggtgggagcacct

SEQ ID NO: 6139659 - DNA, 21 bp, Homo sapiens
ctgacctggttgtccaggtct

SEQ ID NO: 6139660 - DNA, 15 bp, Homo sapiens
ctgacctgtcatgcc

SEQ ID NO: 6139661 - DNA, 17 bp, Homo sapiens
ctgacctgtcatgcccc

SEQ ID NO: 6139662 - DNA, 20 bp, Homo sapiens
ctgacctgtcatgcccccct

SEQ ID NO: 6139663 - DNA, 22 bp, Homo sapiens
ctgacctgtcatgcccccctca

SEQ ID NO: 6139664 - DNA, 23 bp, Homo sapiens
ctgacctgtcatgcccccctcaa

SEQ ID NO: 6139665 - DNA, 12 bp, Homo sapiens
ctgacctgtttt

SEQ ID NO: 6139666 - DNA, 20 bp, Homo sapiens
ctgaccttagcgttctggac

SEQ ID NO: 6139667 - DNA, 21 bp, Homo sapiens
ctgaccttagcgttctggact

SEQ ID NO: 6139668 - DNA, 14 bp, Homo sapiens
ctgaccttcacagg

SEQ ID NO: 6139669 - DNA, 21 bp, Homo sapiens
ctgaccttcacccagagctgc

SEQ ID NO: 6139670 - DNA, 15 bp, Homo sapiens
ctgaccttcagctca

SEQ ID NO: 6139671 - DNA, 16 bp, Homo sapiens
ctgaccttcctcgcag

SEQ ID NO: 6139672 - DNA, 17 bp, Homo sapiens
ctgaccttcctcgcaga

SEQ ID NO: 6139673 - DNA, 18 bp, Homo sapiens
ctgaccttcctcgcagag

SEQ ID NO: 6139674 - DNA, 23 bp, Homo sapiens
ctgaccttcctcgcagagaggcc

SEQ ID NO: 6139675 - DNA, 22 bp, Homo sapiens
ctgaccttcggcagtggctggg

SEQ ID NO: 6139676 - DNA, 23 bp, Homo sapiens
ctgaccttcggcagtggctgggg

SEQ ID NO: 6139677 - DNA, 21 bp, Homo sapiens
ctgaccttctccagggacaga

SEQ ID NO: 6139678 - DNA, 20 bp, Homo sapiens
ctgaccttgaactcctgggc

SEQ ID NO: 6139679 - DNA, 21 bp, Homo sapiens
ctgaccttgaactcctgggct

SEQ ID NO: 6139680 - DNA, 21 bp, Homo sapiens
ctgaccttggagagacacagc

SEQ ID NO: 6139681 - DNA, 20 bp, Homo sapiens
ctgaccttggaggaatgaca

SEQ ID NO: 6139682 - DNA, 18 bp, Homo sapiens
ctgaccttggctgactgg

SEQ ID NO: 6139683 - DNA, 17 bp, Homo sapiens
ctgaccttgggtcctga

SEQ ID NO: 6139684 - DNA, 14 bp, Homo sapiens
ctgaccttgtgatc

SEQ ID NO: 6139685 - DNA, 14 bp, Homo sapiens
ctgacctttaactg

SEQ ID NO: 6139686 - DNA, 16 bp, Homo sapiens
ctgacctttaactgag

SEQ ID NO: 6139687 - DNA, 20 bp, Homo sapiens
ctgacgaaactggccccgga

SEQ ID NO: 6139688 - DNA, 17 bp, Homo sapiens
ctgacgaagaagcaact

SEQ ID NO: 6139689 - DNA, 21 bp, Homo sapiens
ctgacgacactgaagaatcaa

SEQ ID NO: 6139690 - DNA, 23 bp, Homo sapiens
ctgacgacttgagtgctcagtag

SEQ ID NO: 6139691 - DNA, 12 bp, Homo sapiens
ctgacgagagat

SEQ ID NO: 6139692 - DNA, 13 bp, Homo sapiens
ctgacgaggctgg

SEQ ID NO: 6139693 - DNA, 15 bp, Homo sapiens
ctgacgaggctgggc

SEQ ID NO: 6139694 - DNA, 15 bp, Homo sapiens
ctgacgatcttcccc

SEQ ID NO: 6139695 - DNA, 16 bp, Homo sapiens
ctgacgcaacccacgt

SEQ ID NO: 6139696 - DNA, 18 bp, Homo sapiens
ctgacgcaatgaaaagtc

SEQ ID NO: 6139697 - DNA, 14 bp, Homo sapiens
ctgacgcaccactg

SEQ ID NO: 6139698 - DNA, 13 bp, Homo sapiens
ctgacgcagcctg

SEQ ID NO: 6139699 - DNA, 15 bp, Homo sapiens
ctgacgccaataata

SEQ ID NO: 6139700 - DNA, 13 bp, Homo sapiens
ctgacgccctgcg

SEQ ID NO: 6139701 - DNA, 14 bp, Homo sapiens
ctgacgccctgcgt

SEQ ID NO: 6139702 - DNA, 22 bp, Homo sapiens
ctgacgccctgcgttggagcca

SEQ ID NO: 6139703 - DNA, 14 bp, Homo sapiens
ctgacgctcagccc

SEQ ID NO: 6139704 - DNA, 18 bp, Homo sapiens
ctgacgctcagccccagg

SEQ ID NO: 6139705 - DNA, 15 bp, Homo sapiens
ctgacgcttgtgaca

SEQ ID NO: 6139706 - DNA, 18 bp, Homo sapiens
ctgacgcttgtgacagtg

SEQ ID NO: 6139707 - DNA, 20 bp, Homo sapiens
ctgacgcttgtgacagtgcc

SEQ ID NO: 6139708 - DNA, 23 bp, Homo sapiens
ctgacgcttgtgacagtgcctct

SEQ ID NO: 6139709 - DNA, 21 bp, Homo sapiens
ctgacggaagccaacttggct

SEQ ID NO: 6139710 - DNA, 22 bp, Homo sapiens
ctgacggaagccaacttggctt

SEQ ID NO: 6139711 - DNA, 14 bp, Homo sapiens
ctgacggactcatg

SEQ ID NO: 6139712 - DNA, 15 bp, Homo sapiens
ctgacggccagggag

SEQ ID NO: 6139713 - DNA, 20 bp, Homo sapiens
ctgacggccagggagaagct

SEQ ID NO: 6139714 - DNA, 15 bp, Homo sapiens
ctgacggccctgcaa

SEQ ID NO: 6139715 - DNA, 16 bp, Homo sapiens
ctgacggccctgcaat

SEQ ID NO: 6139716 - DNA, 17 bp, Homo sapiens
ctgacggccctgcaatg

SEQ ID NO: 6139717 - DNA, 22 bp, Homo sapiens
ctgacggcgcctttttggcctg

SEQ ID NO: 6139718 - DNA, 23 bp, Homo sapiens
ctgacggcgcctttttggcctgt

SEQ ID NO: 6139719 - DNA, 13 bp, Homo sapiens
ctgacggctgggg

SEQ ID NO: 6139720 - DNA, 14 bp, Homo sapiens
ctgacggctgggga

SEQ ID NO: 6139721 - DNA, 20 bp, Homo sapiens
ctgacggctggggacccacc

SEQ ID NO: 6139722 - DNA, 20 bp, Homo sapiens
ctgacggctgtgtatttctg

SEQ ID NO: 6139723 - DNA, 21 bp, Homo sapiens
ctgacggctgtgtatttctgt

SEQ ID NO: 6139724 - DNA, 22 bp, Homo sapiens
ctgacggctgtgtatttctgta

SEQ ID NO: 6139725 - DNA, 17 bp, Homo sapiens
ctgacgggaggccccag

SEQ ID NO: 6139726 - DNA, 19 bp, Homo sapiens
ctgacgggaggccccagct

SEQ ID NO: 6139727 - DNA, 22 bp, Homo sapiens
ctgacgggaggccccagctctg

SEQ ID NO: 6139728 - DNA, 15 bp, Homo sapiens
ctgacggtttctccc

SEQ ID NO: 6139729 - DNA, 20 bp, Homo sapiens
ctgacgtcagcgcaccaaaa

SEQ ID NO: 6139730 - DNA, 13 bp, Homo sapiens
ctgacgtccacct

SEQ ID NO: 6139731 - DNA, 21 bp, Homo sapiens
ctgacgtctgaagcttgactc

SEQ ID NO: 6139732 - DNA, 22 bp, Homo sapiens
ctgacgtctgaagcttgactcc

SEQ ID NO: 6139733 - DNA, 13 bp, Homo sapiens
ctgacgtctgcca

SEQ ID NO: 6139734 - DNA, 21 bp, Homo sapiens
ctgacgtctgccaccagcgcc

SEQ ID NO: 6139735 - DNA, 22 bp, Homo sapiens
ctgacgtctgccaccagcgccc

SEQ ID NO: 6139736 - DNA, 17 bp, Homo sapiens
ctgacgtgccttttgca

SEQ ID NO: 6139737 - DNA, 12 bp, Homo sapiens
ctgacgtgggca

SEQ ID NO: 6139738 - DNA, 18 bp, Homo sapiens
ctgacgtgggcatcattt

SEQ ID NO: 6139739 - DNA, 13 bp, Homo sapiens
ctgacgttccggg

SEQ ID NO: 6139740 - DNA, 18 bp, Homo sapiens
ctgacgtttgacaccagg

SEQ ID NO: 6139741 - DNA, 22 bp, Homo sapiens
ctgactaaaaatacttaaattt

SEQ ID NO: 6139742 - DNA, 18 bp, Homo sapiens
ctgactaaactaccacct

SEQ ID NO: 6139743 - DNA, 20 bp, Homo sapiens
ctgactaaactaccacctca

SEQ ID NO: 6139744 - DNA, 15 bp, Homo sapiens
ctgactaaacttttt

SEQ ID NO: 6139745 - DNA, 19 bp, Homo sapiens
ctgactaaactttttttct

SEQ ID NO: 6139746 - DNA, 13 bp, Homo sapiens
ctgactaaatttg

SEQ ID NO: 6139747 - DNA, 14 bp, Homo sapiens
ctgactaaccattg

SEQ ID NO: 6139748 - DNA, 16 bp, Homo sapiens
ctgactaaccattgat

SEQ ID NO: 6139749 - DNA, 20 bp, Homo sapiens
ctgactaagccccgtctgac

SEQ ID NO: 6139750 - DNA, 15 bp, Homo sapiens
ctgactaagcctttg

SEQ ID NO: 6139751 - DNA, 18 bp, Homo sapiens
ctgactaagcctttgact

SEQ ID NO: 6139752 - DNA, 21 bp, Homo sapiens
ctgactaccagctaactccag

SEQ ID NO: 6139753 - DNA, 17 bp, Homo sapiens
ctgactacggaactgca

SEQ ID NO: 6139754 - DNA, 20 bp, Homo sapiens
ctgactacggaactgcacac

SEQ ID NO: 6139755 - DNA, 21 bp, Homo sapiens
ctgactacggaactgcacact

SEQ ID NO: 6139756 - DNA, 20 bp, Homo sapiens
ctgactactactctgccaat

SEQ ID NO: 6139757 - DNA, 17 bp, Homo sapiens
ctgactactggctctca

SEQ ID NO: 6139758 - DNA, 22 bp, Homo sapiens
ctgactactgggcaaagagtgt

SEQ ID NO: 6139759 - DNA, 18 bp, Homo sapiens
ctgactagagtgatgact

SEQ ID NO: 6139760 - DNA, 19 bp, Homo sapiens
ctgactagagtgatgactg

SEQ ID NO: 6139761 - DNA, 18 bp, Homo sapiens
ctgactagggagccatgt

SEQ ID NO: 6139762 - DNA, 16 bp, Homo sapiens
ctgactagtagatttc

SEQ ID NO: 6139763 - DNA, 22 bp, Homo sapiens
ctgactataccaactgggcctc

SEQ ID NO: 6139764 - DNA, 17 bp, Homo sapiens
ctgactatattttccct

SEQ ID NO: 6139765 - DNA, 23 bp, Homo sapiens
ctgactattatgttgttagagaa

SEQ ID NO: 6139766 - DNA, 18 bp, Homo sapiens
ctgactattcttgatgta

SEQ ID NO: 6139767 - DNA, 21 bp, Homo sapiens
ctgactcaattatttgcatat

SEQ ID NO: 6139768 - DNA, 13 bp, Homo sapiens
ctgactcacaaga

SEQ ID NO: 6139769 - DNA, 16 bp, Homo sapiens
ctgactcacaagaaga

SEQ ID NO: 6139770 - DNA, 19 bp, Homo sapiens
ctgactcagctaatgtcac

SEQ ID NO: 6139771 - DNA, 14 bp, Homo sapiens
ctgactcagggctc

SEQ ID NO: 6139772 - DNA, 16 bp, Homo sapiens
ctgactcagggctcct

SEQ ID NO: 6139773 - DNA, 19 bp, Homo sapiens
ctgactcagggctcctggg

SEQ ID NO: 6139774 - DNA, 14 bp, Homo sapiens
ctgactcagtgcag

SEQ ID NO: 6139775 - DNA, 16 bp, Homo sapiens
ctgactcagtgcaggg

SEQ ID NO: 6139776 - DNA, 23 bp, Homo sapiens
ctgactcagtgtctgcctttaaa

SEQ ID NO: 6139777 - DNA, 18 bp, Homo sapiens
ctgactccaaagctgttc

SEQ ID NO: 6139778 - DNA, 23 bp, Homo sapiens
ctgactccactcaaagagggtga

SEQ ID NO: 6139779 - DNA, 14 bp, Homo sapiens
ctgactccagagtc

SEQ ID NO: 6139780 - DNA, 20 bp, Homo sapiens
ctgactccagagtctgagcc

SEQ ID NO: 6139781 - DNA, 21 bp, Homo sapiens
ctgactccagagtctgagccc

SEQ ID NO: 6139782 - DNA, 19 bp, Homo sapiens
ctgactccatatggaggcc

SEQ ID NO: 6139783 - DNA, 13 bp, Homo sapiens
ctcacactgagaa

SEQ ID NO: 6139784 - DNA, 20 bp, Homo sapiens
ctcacactgagaatgtaaga

SEQ ID NO: 6139785 - DNA, 14 bp, Homo sapiens
ctcacactgatggg

SEQ ID NO: 6139786 - DNA, 15 bp, Homo sapiens
ctcacactgctgtcc

SEQ ID NO: 6139787 - DNA, 14 bp, Homo sapiens
ctcacactggccac

SEQ ID NO: 6139788 - DNA, 15 bp, Homo sapiens
ctcacactggcgtct

SEQ ID NO: 6139789 - DNA, 19 bp, Homo sapiens
ctcacactggtctgctgtc

SEQ ID NO: 6139790 - DNA, 22 bp, Homo sapiens
ctcacacttactgtaagacatt

SEQ ID NO: 6139791 - DNA, 12 bp, Homo sapiens
ctcacacttttt

SEQ ID NO: 6139792 - DNA, 13 bp, Homo sapiens
ctcacagaaatga

SEQ ID NO: 6139793 - DNA, 17 bp, Homo sapiens
ctcacagaacccttgga

SEQ ID NO: 6139794 - DNA, 18 bp, Homo sapiens
ctcacagacaggacccct

SEQ ID NO: 6139795 - DNA, 20 bp, Homo sapiens
ctcacagacaggacccctgc

SEQ ID NO: 6139796 - DNA, 22 bp, Homo sapiens
ctcacagacaggacccctgcag

SEQ ID NO: 6139797 - DNA, 17 bp, Homo sapiens
ctcacagacctggagcc

SEQ ID NO: 6139798 - DNA, 22 bp, Homo sapiens
ctcacagacctggagcccctgg

SEQ ID NO: 6139799 - DNA, 23 bp, Homo sapiens
ctcacagacctggagcccctggg

SEQ ID NO: 6139800 - DNA, 20 bp, Homo sapiens
ctcacagactcttccaccag

SEQ ID NO: 6139801 - DNA, 22 bp, Homo sapiens
ctcacagactcttccaccagag

SEQ ID NO: 6139802 - DNA, 17 bp, Homo sapiens
ctcacagagaagctcct

SEQ ID NO: 6139803 - DNA, 20 bp, Homo sapiens
ctcacagagaagctcctgct

SEQ ID NO: 6139804 - DNA, 16 bp, Homo sapiens
ctcacagagacacagg

SEQ ID NO: 6139805 - DNA, 22 bp, Homo sapiens
ctcacagagtcaaggcctgctc

SEQ ID NO: 6139806 - DNA, 17 bp, Homo sapiens
ctcacagatgctggcct

SEQ ID NO: 6139807 - DNA, 22 bp, Homo sapiens
ctcacagatgctggcctcttgg

SEQ ID NO: 6139808 - DNA, 16 bp, Homo sapiens
ctcacagcaaacctct

SEQ ID NO: 6139809 - DNA, 14 bp, Homo sapiens
ctcacagcacagag

SEQ ID NO: 6139810 - DNA, 15 bp, Homo sapiens
ctcacagcacagaga

SEQ ID NO: 6139811 - DNA, 20 bp, Homo sapiens
ctcacagcacatgctggcca

SEQ ID NO: 6139812 - DNA, 19 bp, Homo sapiens
ctcacagcacatttgttaa

SEQ ID NO: 6139813 - DNA, 20 bp, Homo sapiens
ctcacagcagtcacaggccc

SEQ ID NO: 6139814 - DNA, 14 bp, Homo sapiens
ctcacagcagtgag

SEQ ID NO: 6139815 - DNA, 18 bp, Homo sapiens
ctcacagcagtgagactg

SEQ ID NO: 6139816 - DNA, 19 bp, Homo sapiens
ctcacagcagtgagactgg

SEQ ID NO: 6139817 - DNA, 18 bp, Homo sapiens
ctcacagccaccacctgg

SEQ ID NO: 6139818 - DNA, 13 bp, Homo sapiens
ctcacagcctctc

SEQ ID NO: 6139819 - DNA, 21 bp, Homo sapiens
ctcacagcctctgacccctcc

SEQ ID NO: 6139820 - DNA, 19 bp, Homo sapiens
ctcacagccttggctcctg

SEQ ID NO: 6139821 - DNA, 22 bp, Homo sapiens
ctcacagctatgcaaaaagcta

SEQ ID NO: 6139822 - DNA, 13 bp, Homo sapiens
ctcacagctgagt

SEQ ID NO: 6139823 - DNA, 15 bp, Homo sapiens
ctcacagctgagttg

SEQ ID NO: 6139824 - DNA, 10 bp, Homo sapiens
ctcacaggac

SEQ ID NO: 6139825 - DNA, 21 bp, Homo sapiens
ctcacaggcagctctgagccg

SEQ ID NO: 6139826 - DNA, 19 bp, Homo sapiens
ctcacaggcctctcttttc

SEQ ID NO: 6139827 - DNA, 21 bp, Homo sapiens
ctcacaggcctctcttttccc

SEQ ID NO: 6139828 - DNA, 13 bp, Homo sapiens
ctcacagggcagg

SEQ ID NO: 6139829 - DNA, 21 bp, Homo sapiens
ctcacaggttcacccagcgcc

SEQ ID NO: 6139830 - DNA, 19 bp, Homo sapiens
ctcacaggttggaagagaa

SEQ ID NO: 6139831 - DNA, 22 bp, Homo sapiens
ctcacagtacagcatgtgcctt

SEQ ID NO: 6139832 - DNA, 22 bp, Homo sapiens
ctcacagtattgctcacccagt

SEQ ID NO: 6139833 - DNA, 17 bp, Homo sapiens
ctcacagtcccactgtg

SEQ ID NO: 6139834 - DNA, 23 bp, Homo sapiens
ctcacagtccttaccagcagagc

SEQ ID NO: 6139835 - DNA, 20 bp, Homo sapiens
ctcacagtctctttaatctt

SEQ ID NO: 6139836 - DNA, 23 bp, Homo sapiens
ctcacagtgacaccatttgtcct

SEQ ID NO: 6139837 - DNA, 14 bp, Homo sapiens
ctcacagtgaccct

SEQ ID NO: 6139838 - DNA, 19 bp, Homo sapiens
ctcacagtgacccttccca

SEQ ID NO: 6139839 - DNA, 21 bp, Homo sapiens
ctcacagtgttgcccaggctg

SEQ ID NO: 6139840 - DNA, 13 bp, Homo sapiens
ctcacagttatta

SEQ ID NO: 6139841 - DNA, 18 bp, Homo sapiens
ctcacagttcctcgccct

SEQ ID NO: 6139842 - DNA, 19 bp, Homo sapiens
ctcacagttcctcgccctg

SEQ ID NO: 6139843 - DNA, 15 bp, Homo sapiens
ctcacataaaaaaga

SEQ ID NO: 6139844 - DNA, 22 bp, Homo sapiens
ctcacatacccacacattccag

SEQ ID NO: 6139845 - DNA, 14 bp, Homo sapiens
ctcacatactgact

SEQ ID NO: 6139846 - DNA, 15 bp, Homo sapiens
ctcacatattattgg

SEQ ID NO: 6139847 - DNA, 17 bp, Homo sapiens
ctcacatattcatcagc

SEQ ID NO: 6139848 - DNA, 13 bp, Homo sapiens
ctcacatcatgta

SEQ ID NO: 6139849 - DNA, 14 bp, Homo sapiens
ctcacatccatcta

SEQ ID NO: 6139850 - DNA, 16 bp, Homo sapiens
ctcacatcctcctgcc

SEQ ID NO: 6139851 - DNA, 17 bp, Homo sapiens
ctcacatcctcctgccc

SEQ ID NO: 6139852 - DNA, 16 bp, Homo sapiens
ctcacatctttaactt

SEQ ID NO: 6139853 - DNA, 13 bp, Homo sapiens
ctcacatgcccgc

SEQ ID NO: 6139854 - DNA, 23 bp, Homo sapiens
ctcacatgctggacaggtctggg

SEQ ID NO: 6139855 - DNA, 12 bp, Homo sapiens
ctcacatgggac

SEQ ID NO: 6139856 - DNA, 13 bp, Homo sapiens
ctcacatgggact

SEQ ID NO: 6139857 - DNA, 16 bp, Homo sapiens
ctcacatggtttacat

SEQ ID NO: 6139858 - DNA, 19 bp, Homo sapiens
ctcacatggtttacatcct

SEQ ID NO: 6139859 - DNA, 22 bp, Homo sapiens
ctcacatgtcagtaccttcaaa

SEQ ID NO: 6139860 - DNA, 16 bp, Homo sapiens
ctcacattacacacac

SEQ ID NO: 6139861 - DNA, 23 bp, Homo sapiens
ctcacattccctctcatccaggt

SEQ ID NO: 6139862 - DNA, 15 bp, Homo sapiens
ctcacattgctgtat

SEQ ID NO: 6139863 - DNA, 13 bp, Homo sapiens
ctcacatttgtga

SEQ ID NO: 6139864 - DNA, 16 bp, Homo sapiens
ctcacattttctcagt

SEQ ID NO: 6139865 - DNA, 18 bp, Homo sapiens
ctcaccaacttgccacat

SEQ ID NO: 6139866 - DNA, 23 bp, Homo sapiens
ctcaccaaggatcggactctgcc

SEQ ID NO: 6139867 - DNA, 18 bp, Homo sapiens
ctcaccaataacttcaga

SEQ ID NO: 6139868 - DNA, 23 bp, Homo sapiens
ctcaccaataacttcagagaagt

SEQ ID NO: 6139869 - DNA, 23 bp, Homo sapiens
ctcaccaattccacttcctgccc

SEQ ID NO: 6139870 - DNA, 17 bp, Homo sapiens
ctcaccacaacctccac

SEQ ID NO: 6139871 - DNA, 15 bp, Homo sapiens
ctcaccacacccagg

SEQ ID NO: 6139872 - DNA, 14 bp, Homo sapiens
ctcaccacccactt

SEQ ID NO: 6139873 - DNA, 13 bp, Homo sapiens
ctcaccaccccca

SEQ ID NO: 6139874 - DNA, 12 bp, Homo sapiens
ctcaccacctgc

SEQ ID NO: 6139875 - DNA, 16 bp, Homo sapiens
ctcaccacctgcctct

SEQ ID NO: 6139876 - DNA, 22 bp, Homo sapiens
ctcaccacgatgacgcctctgg

SEQ ID NO: 6139877 - DNA, 17 bp, Homo sapiens
ctcaccactaccagcca

SEQ ID NO: 6139878 - DNA, 16 bp, Homo sapiens
ctcaccagaattattt

SEQ ID NO: 6139879 - DNA, 16 bp, Homo sapiens
ctcaccagccccactg

SEQ ID NO: 6139880 - DNA, 18 bp, Homo sapiens
ctcaccagccccactgcc

SEQ ID NO: 6139881 - DNA, 20 bp, Homo sapiens
ctcaccagccccccgcgcgc

SEQ ID NO: 6139882 - DNA, 12 bp, Homo sapiens
ctcaccagccct

SEQ ID NO: 6139883 - DNA, 19 bp, Homo sapiens
ctcaccagccctagctgtc

SEQ ID NO: 6139884 - DNA, 17 bp, Homo sapiens
ctcaccagccctgcagc

SEQ ID NO: 6139885 - DNA, 13 bp, Homo sapiens
ctcaccagctcag

SEQ ID NO: 6139886 - DNA, 15 bp, Homo sapiens
ctcaccagctcagcc

SEQ ID NO: 6139887 - DNA, 15 bp, Homo sapiens
ctcaccaggcctggc

SEQ ID NO: 6139888 - DNA, 19 bp, Homo sapiens
ctcaccaggcctggcctct

SEQ ID NO: 6139889 - DNA, 21 bp, Homo sapiens
ctcaccaggcctggcctctgg

SEQ ID NO: 6139890 - DNA, 22 bp, Homo sapiens
ctcaccaggcctggcctctggg

SEQ ID NO: 6139891 - DNA, 22 bp, Homo sapiens
ctcaccaggggcaggcacagca

SEQ ID NO: 6139892 - DNA, 23 bp, Homo sapiens
ctcaccaggggcaggcacagcac

SEQ ID NO: 6139893 - DNA, 23 bp, Homo sapiens
ctcaccagggtccgcaccagctg

SEQ ID NO: 6139894 - DNA, 20 bp, Homo sapiens
ctcaccagtcccatgctggc

SEQ ID NO: 6139895 - DNA, 20 bp, Homo sapiens
ctcaccagtgtcccctccac

SEQ ID NO: 6139896 - DNA, 23 bp, Homo sapiens
ctcaccagtgtcccctccactgt

SEQ ID NO: 6139897 - DNA, 15 bp, Homo sapiens
ctcaccatcatcatc

SEQ ID NO: 6139898 - DNA, 14 bp, Homo sapiens
ctcaccatccagtg

SEQ ID NO: 6139899 - DNA, 12 bp, Homo sapiens
ctcaccattcca

SEQ ID NO: 6139900 - DNA, 18 bp, Homo sapiens
ctcaccatttcatccata

SEQ ID NO: 6139901 - DNA, 18 bp, Homo sapiens
ctcaccatttccccaggg

SEQ ID NO: 6139902 - DNA, 19 bp, Homo sapiens
ctcaccatttccccagggc

SEQ ID NO: 6139903 - DNA, 20 bp, Homo sapiens
ctcaccatttccccagggca

SEQ ID NO: 6139904 - DNA, 17 bp, Homo sapiens
ctcaccatttggatcct

SEQ ID NO: 6139905 - DNA, 13 bp, Homo sapiens
ctcacccacaccc

SEQ ID NO: 6139906 - DNA, 14 bp, Homo sapiens
ctcacccaccagct

SEQ ID NO: 6139907 - DNA, 16 bp, Homo sapiens
ctcacccaccagctcc

SEQ ID NO: 6139908 - DNA, 19 bp, Homo sapiens
ctcacccaccagctccaca

SEQ ID NO: 6139909 - DNA, 18 bp, Homo sapiens
ctcacccactctggtggc

SEQ ID NO: 6139910 - DNA, 22 bp, Homo sapiens
ctcacccactttggcctccgtt

SEQ ID NO: 6139911 - DNA, 12 bp, Homo sapiens
ctcacccagaag

SEQ ID NO: 6139912 - DNA, 15 bp, Homo sapiens
ctcacccagaaggaa

SEQ ID NO: 6139913 - DNA, 14 bp, Homo sapiens
ctcacccagatcag

SEQ ID NO: 6139914 - DNA, 19 bp, Homo sapiens
ctcacccaggacctctggg

SEQ ID NO: 6139915 - DNA, 17 bp, Homo sapiens
ctcacccaggcaatctt

SEQ ID NO: 6139916 - DNA, 14 bp, Homo sapiens
ctcacccagggccc

SEQ ID NO: 6139917 - DNA, 15 bp, Homo sapiens
ctcacccagtcacct

SEQ ID NO: 6139918 - DNA, 19 bp, Homo sapiens
ctcacccagtcacctcccc

SEQ ID NO: 6139919 - DNA, 20 bp, Homo sapiens
ctcacccatcccacccctcc

SEQ ID NO: 6139920 - DNA, 21 bp, Homo sapiens
ctcacccatcccacccctcca

SEQ ID NO: 6139921 - DNA, 21 bp, Homo sapiens
ctcacccatgcaagcagagga

SEQ ID NO: 6139922 - DNA, 22 bp, Homo sapiens
ctcacccatgcaagcagaggac

SEQ ID NO: 6139923 - DNA, 17 bp, Homo sapiens
ctcacccattgtctcat

SEQ ID NO: 6139924 - DNA, 15 bp, Homo sapiens
ctcaccccaaggggt

SEQ ID NO: 6139925 - DNA, 14 bp, Homo sapiens
ctcaccccaatccc

SEQ ID NO: 6139926 - DNA, 21 bp, Homo sapiens
ctcaccccaatccctgccact

SEQ ID NO: 6139927 - DNA, 14 bp, Homo sapiens
ctcaccccactcct

SEQ ID NO: 6139928 - DNA, 15 bp, Homo sapiens
ctcaccccactcctg

SEQ ID NO: 6139929 - DNA, 18 bp, Homo sapiens
ctcaccccactcctgtca

SEQ ID NO: 6139930 - DNA, 23 bp, Homo sapiens
ctcaccccagactcctgactgtc

SEQ ID NO: 6139931 - DNA, 14 bp, Homo sapiens
ctcaccccagcctc

SEQ ID NO: 6139932 - DNA, 13 bp, Homo sapiens
ctcaccccagctc

SEQ ID NO: 6139933 - DNA, 14 bp, Homo sapiens
ctcaccccaggata

SEQ ID NO: 6139934 - DNA, 12 bp, Homo sapiens
ctcaccccagtg

SEQ ID NO: 6139935 - DNA, 21 bp, Homo sapiens
ctcacccccaaggggcagtct

SEQ ID NO: 6139936 - DNA, 16 bp, Homo sapiens
ctcacccccacccctg

SEQ ID NO: 6139937 - DNA, 22 bp, Homo sapiens
ctcaccccccgacctggctgag

SEQ ID NO: 6139938 - DNA, 15 bp, Homo sapiens
ctcaccccctcccac

SEQ ID NO: 6139939 - DNA, 18 bp, Homo sapiens
ctcaccccctcccacccc

SEQ ID NO: 6139940 - DNA, 23 bp, Homo sapiens
ctcaccccctcccacccccagcc

SEQ ID NO: 6139941 - DNA, 18 bp, Homo sapiens
ctcaccccctcctggcaa

SEQ ID NO: 6139942 - DNA, 21 bp, Homo sapiens
ctcaccccctcgggtctcctc

SEQ ID NO: 6139943 - DNA, 16 bp, Homo sapiens
ctcacccccttctcca

SEQ ID NO: 6139944 - DNA, 17 bp, Homo sapiens
ctcacccccttctccat

SEQ ID NO: 6139945 - DNA, 21 bp, Homo sapiens
ctcacccccttctccatccac

SEQ ID NO: 6139946 - DNA, 16 bp, Homo sapiens
ctcaccccgaggccct

SEQ ID NO: 6139947 - DNA, 13 bp, Homo sapiens
ctcaccccggcag

SEQ ID NO: 6139948 - DNA, 16 bp, Homo sapiens
ctcaccccgtctgggg

SEQ ID NO: 6139949 - DNA, 17 bp, Homo sapiens
ctcacccctagccctgg

SEQ ID NO: 6139950 - DNA, 18 bp, Homo sapiens
ctcacccctcccctggga

SEQ ID NO: 6139951 - DNA, 15 bp, Homo sapiens
ctcacccctccttgg

SEQ ID NO: 6139952 - DNA, 18 bp, Homo sapiens
ctcacccctctcccccgc

SEQ ID NO: 6139953 - DNA, 13 bp, Homo sapiens
ctcacccctgccc

SEQ ID NO: 6139954 - DNA, 16 bp, Homo sapiens
ctcacccctgcccctg

SEQ ID NO: 6139955 - DNA, 18 bp, Homo sapiens
ctcacccctgcccctgtg

SEQ ID NO: 6139956 - DNA, 15 bp, Homo sapiens
ctcacccctgccctg

SEQ ID NO: 6139957 - DNA, 15 bp, Homo sapiens
ctcacccctgggcag

SEQ ID NO: 6139958 - DNA, 18 bp, Homo sapiens
ctcacccctgggcaggcg

SEQ ID NO: 6139959 - DNA, 20 bp, Homo sapiens
ctcacccctggttctcatct

SEQ ID NO: 6139960 - DNA, 20 bp, Homo sapiens
ctcacccctgtcctcactgc

SEQ ID NO: 6139961 - DNA, 19 bp, Homo sapiens
ctgactcccaaagagctgc

SEQ ID NO: 6139962 - DNA, 21 bp, Homo sapiens
ctgactcccaaagagctgcct

SEQ ID NO: 6139963 - DNA, 22 bp, Homo sapiens
ctgactcccaaagagctgccta

SEQ ID NO: 6139964 - DNA, 22 bp, Homo sapiens
ctgactcccatgcaagtagctg

SEQ ID NO: 6139965 - DNA, 20 bp, Homo sapiens
ctgactccctccccacccaa

SEQ ID NO: 6139966 - DNA, 23 bp, Homo sapiens
ctgactccctccccacccaagag

SEQ ID NO: 6139967 - DNA, 23 bp, Homo sapiens
ctgactccctgtgggggtggcca

SEQ ID NO: 6139968 - DNA, 19 bp, Homo sapiens
ctgactcctcagtccctct

SEQ ID NO: 6139969 - DNA, 12 bp, Homo sapiens
ctgactcctctg

SEQ ID NO: 6139970 - DNA, 13 bp, Homo sapiens
ctgactcctctgg

SEQ ID NO: 6139971 - DNA, 17 bp, Homo sapiens
ctgactcctctggcttt

SEQ ID NO: 6139972 - DNA, 21 bp, Homo sapiens
ctgactcctctggctttccca

SEQ ID NO: 6139973 - DNA, 15 bp, Homo sapiens
ctgactcctggtcct

SEQ ID NO: 6139974 - DNA, 13 bp, Homo sapiens
ctgactccttaga

SEQ ID NO: 6139975 - DNA, 23 bp, Homo sapiens
ctgactcggcagtgtgcagtggt

SEQ ID NO: 6139976 - DNA, 16 bp, Homo sapiens
ctgactcggtttctcc

SEQ ID NO: 6139977 - DNA, 18 bp, Homo sapiens
ctgactcggtttctccaa

SEQ ID NO: 6139978 - DNA, 20 bp, Homo sapiens
ctgactcgtctgactgtgtg

SEQ ID NO: 6139979 - DNA, 14 bp, Homo sapiens
ctgactctaaaata

SEQ ID NO: 6139980 - DNA, 21 bp, Homo sapiens
ctgactctaggtgcccttgga

SEQ ID NO: 6139981 - DNA, 14 bp, Homo sapiens
ctgactctcaaatc

SEQ ID NO: 6139982 - DNA, 15 bp, Homo sapiens
ctgactctccaggga

SEQ ID NO: 6139983 - DNA, 15 bp, Homo sapiens
ctgactctctgagct

SEQ ID NO: 6139984 - DNA, 21 bp, Homo sapiens
ctgactctctgagctggggag

SEQ ID NO: 6139985 - DNA, 17 bp, Homo sapiens
ctgactctgaaatctga

SEQ ID NO: 6139986 - DNA, 15 bp, Homo sapiens
ctgactctgccccct

SEQ ID NO: 6139987 - DNA, 20 bp, Homo sapiens
ctgactctgccccctgctgg

SEQ ID NO: 6139988 - DNA, 18 bp, Homo sapiens
ctgactctggaccatgct

SEQ ID NO: 6139989 - DNA, 15 bp, Homo sapiens
ctgactctgtgctga

SEQ ID NO: 6139990 - DNA, 16 bp, Homo sapiens
ctgactctgtgctgag

SEQ ID NO: 6139991 - DNA, 16 bp, Homo sapiens
ctgactctgttattga

SEQ ID NO: 6139992 - DNA, 12 bp, Homo sapiens
ctgactcttgcc

SEQ ID NO: 6139993 - DNA, 23 bp, Homo sapiens
ctgactctttttggactcagccc

SEQ ID NO: 6139994 - DNA, 21 bp, Homo sapiens
ctgactgaaagtagggggctt

SEQ ID NO: 6139995 - DNA, 14 bp, Homo sapiens
ctgactgaaggaaa

SEQ ID NO: 6139996 - DNA, 14 bp, Homo sapiens
ctgactgaatgcag

SEQ ID NO: 6139997 - DNA, 15 bp, Homo sapiens
ctgactgacacaggc

SEQ ID NO: 6139998 - DNA, 21 bp, Homo sapiens
ctgactgacacaggccagccc

SEQ ID NO: 6139999 - DNA, 17 bp, Homo sapiens
ctgactgagcaggctgt

SEQ ID NO: 6140000 - DNA, 15 bp, Homo sapiens
ctgactgaggcctgc

SEQ ID NO: 6140001 - DNA, 16 bp, Homo sapiens
ctgactgatgctttca

SEQ ID NO: 6140002 - DNA, 21 bp, Homo sapiens
ctgactgatggtttggaaaat

SEQ ID NO: 6140003 - DNA, 21 bp, Homo sapiens
ctgactgcaccagcgccccca

SEQ ID NO: 6140004 - DNA, 18 bp, Homo sapiens
ctgactgccaagccagat

SEQ ID NO: 6140005 - DNA, 20 bp, Homo sapiens
ctgactgccaagccagattc

SEQ ID NO: 6140006 - DNA, 14 bp, Homo sapiens
ctgactgcccagca

SEQ ID NO: 6140007 - DNA, 21 bp, Homo sapiens
ctgactggatggtccagtgtc

SEQ ID NO: 6140008 - DNA, 21 bp, Homo sapiens
ctgactggattcattctcata

SEQ ID NO: 6140009 - DNA, 12 bp, Homo sapiens
ctgactggcaaa

SEQ ID NO: 6140010 - DNA, 18 bp, Homo sapiens
ctgactggcaaaggacca

SEQ ID NO: 6140011 - DNA, 17 bp, Homo sapiens
ctgactggcaccaacac

SEQ ID NO: 6140012 - DNA, 21 bp, Homo sapiens
ctgactggccaaacccttgct

SEQ ID NO: 6140013 - DNA, 12 bp, Homo sapiens
ctgactggccag

SEQ ID NO: 6140014 - DNA, 12 bp, Homo sapiens
ctgactggcctg

SEQ ID NO: 6140015 - DNA, 19 bp, Homo sapiens
ctgactgggaaggacataa

SEQ ID NO: 6140016 - DNA, 23 bp, Homo sapiens
ctgactgggactcccagctggag

SEQ ID NO: 6140017 - DNA, 15 bp, Homo sapiens
ctgactgggccacag

SEQ ID NO: 6140018 - DNA, 21 bp, Homo sapiens
ctgactgggccacagccccga

SEQ ID NO: 6140019 - DNA, 15 bp, Homo sapiens
ctgactgggccaggg

SEQ ID NO: 6140020 - DNA, 12 bp, Homo sapiens
ctgactggggct

SEQ ID NO: 6140021 - DNA, 16 bp, Homo sapiens
ctgactgggggcctct

SEQ ID NO: 6140022 - DNA, 19 bp, Homo sapiens
ctgactgggggcctctgcc

SEQ ID NO: 6140023 - DNA, 20 bp, Homo sapiens
ctgactgggggcctctgcct

SEQ ID NO: 6140024 - DNA, 20 bp, Homo sapiens
ctgactggttaacagcagtc

SEQ ID NO: 6140025 - DNA, 19 bp, Homo sapiens
ctgactggtttctcctggt

SEQ ID NO: 6140026 - DNA, 19 bp, Homo sapiens
ctgactgtaacatattctg

SEQ ID NO: 6140027 - DNA, 19 bp, Homo sapiens
ctgactgtaacgattgaca

SEQ ID NO: 6140028 - DNA, 17 bp, Homo sapiens
ctgactgtagcacggag

SEQ ID NO: 6140029 - DNA, 16 bp, Homo sapiens
ctgactgtcagggagg

SEQ ID NO: 6140030 - DNA, 17 bp, Homo sapiens
ctgactgtcagggaggg

SEQ ID NO: 6140031 - DNA, 18 bp, Homo sapiens
ctgactgtcagggagggc

SEQ ID NO: 6140032 - DNA, 14 bp, Homo sapiens
ctgactgtccagga

SEQ ID NO: 6140033 - DNA, 13 bp, Homo sapiens
ctgactgtccctg

SEQ ID NO: 6140034 - DNA, 18 bp, Homo sapiens
ctgactgtccctgccaat

SEQ ID NO: 6140035 - DNA, 21 bp, Homo sapiens
ctgactgtcctctcccctcca

SEQ ID NO: 6140036 - DNA, 15 bp, Homo sapiens
ctgactgtgcccaag

SEQ ID NO: 6140037 - DNA, 19 bp, Homo sapiens
ctgactgtggccccctccg

SEQ ID NO: 6140038 - DNA, 18 bp, Homo sapiens
ctgactgttgccccccag

SEQ ID NO: 6140039 - DNA, 18 bp, Homo sapiens
ctgactgtttatttaagg

SEQ ID NO: 6140040 - DNA, 19 bp, Homo sapiens
ctgactgtttatttaagga

SEQ ID NO: 6140041 - DNA, 20 bp, Homo sapiens
ctgactgtttatttaaggat

SEQ ID NO: 6140042 - DNA, 21 bp, Homo sapiens
ctgactgtttatttaaggatg

SEQ ID NO: 6140043 - DNA, 22 bp, Homo sapiens
ctgactgtttatttaaggatgg

SEQ ID NO: 6140044 - DNA, 23 bp, Homo sapiens
ctgactgtttatttaaggatgga

SEQ ID NO: 6140045 - DNA, 18 bp, Homo sapiens
ctgacttaagcaaaagaa

SEQ ID NO: 6140046 - DNA, 20 bp, Homo sapiens
ctgacttagcaggaatttaa

SEQ ID NO: 6140047 - DNA, 18 bp, Homo sapiens
ctgacttagcctaaacaa

SEQ ID NO: 6140048 - DNA, 20 bp, Homo sapiens
ctgacttagcctcctcccaa

SEQ ID NO: 6140049 - DNA, 14 bp, Homo sapiens
ctgacttaggtttc

SEQ ID NO: 6140050 - DNA, 23 bp, Homo sapiens
ctgacttcagggaaggtgaaaca

SEQ ID NO: 6140051 - DNA, 20 bp, Homo sapiens
ctgacttcaggggctgcccg

SEQ ID NO: 6140052 - DNA, 22 bp, Homo sapiens
ctgacttcaggggctgcccgct

SEQ ID NO: 6140053 - DNA, 23 bp, Homo sapiens
ctgacttcagtgggactcggtga

SEQ ID NO: 6140054 - DNA, 14 bp, Homo sapiens
ctgacttcatctgg

SEQ ID NO: 6140055 - DNA, 23 bp, Homo sapiens
ctgacttcccaagccctggtgac

SEQ ID NO: 6140056 - DNA, 19 bp, Homo sapiens
ctgacttcccagctggcag

SEQ ID NO: 6140057 - DNA, 23 bp, Homo sapiens
ctgacttccctggaggagaagta

SEQ ID NO: 6140058 - DNA, 13 bp, Homo sapiens
ctgacttctaagt

SEQ ID NO: 6140059 - DNA, 15 bp, Homo sapiens
ctgacttctaagtaa

SEQ ID NO: 6140060 - DNA, 18 bp, Homo sapiens
ctgacttctaatatcatt

SEQ ID NO: 6140061 - DNA, 13 bp, Homo sapiens
ctgacttctcccc

SEQ ID NO: 6140062 - DNA, 20 bp, Homo sapiens
ctgacttctcccccgccctg

SEQ ID NO: 6140063 - DNA, 12 bp, Homo sapiens
ctgacttctgcc

SEQ ID NO: 6140064 - DNA, 14 bp, Homo sapiens
ctgacttctggaga

SEQ ID NO: 6140065 - DNA, 15 bp, Homo sapiens
ctgacttctggagat

SEQ ID NO: 6140066 - DNA, 22 bp, Homo sapiens
ctgacttgagtgttccttttta

SEQ ID NO: 6140067 - DNA, 15 bp, Homo sapiens
ctgacttgctgtgtg

SEQ ID NO: 6140068 - DNA, 21 bp, Homo sapiens
ctgacttggatcccaaagcaa

SEQ ID NO: 6140069 - DNA, 14 bp, Homo sapiens
ctgacttggcactt

SEQ ID NO: 6140070 - DNA, 15 bp, Homo sapiens
ctgacttggcactta

SEQ ID NO: 6140071 - DNA, 17 bp, Homo sapiens
ctgacttggctggtgtg

SEQ ID NO: 6140072 - DNA, 12 bp, Homo sapiens
ctgacttgggga

SEQ ID NO: 6140073 - DNA, 16 bp, Homo sapiens
ctgacttggttctgaa

SEQ ID NO: 6140074 - DNA, 17 bp, Homo sapiens
ctgacttggttctgaag

SEQ ID NO: 6140075 - DNA, 22 bp, Homo sapiens
ctgacttgtatctgtccgtgga

SEQ ID NO: 6140076 - DNA, 22 bp, Homo sapiens
ctgacttgtgttcatgtggagt

SEQ ID NO: 6140077 - DNA, 13 bp, Homo sapiens
ctgactttacact

SEQ ID NO: 6140078 - DNA, 14 bp, Homo sapiens
ctgactttacttgt

SEQ ID NO: 6140079 - DNA, 18 bp, Homo sapiens
ctgactttctgattactg

SEQ ID NO: 6140080 - DNA, 19 bp, Homo sapiens
ctgactttcttttttgata

SEQ ID NO: 6140081 - DNA, 12 bp, Homo sapiens
ctgactttgaat

SEQ ID NO: 6140082 - DNA, 18 bp, Homo sapiens
ctgactttgaatttatat

SEQ ID NO: 6140083 - DNA, 21 bp, Homo sapiens
ctgactttgaatttatataaa

SEQ ID NO: 6140084 - DNA, 18 bp, Homo sapiens
ctgactttgctctttctt

SEQ ID NO: 6140085 - DNA, 14 bp, Homo sapiens
ctgactttgcttgc

SEQ ID NO: 6140086 - DNA, 23 bp, Homo sapiens
ctgactttgttgccttatcttga

SEQ ID NO: 6140087 - DNA, 20 bp, Homo sapiens
ctgacttttagccaccaggt

SEQ ID NO: 6140088 - DNA, 17 bp, Homo sapiens
ctgacttttccaaataa

SEQ ID NO: 6140089 - DNA, 23 bp, Homo sapiens
ctgacttttccaaataaacattt

SEQ ID NO: 6140090 - DNA, 15 bp, Homo sapiens
ctgacttttctgacc

SEQ ID NO: 6140091 - DNA, 23 bp, Homo sapiens
ctgactttttccattttttaaat

SEQ ID NO: 6140092 - DNA, 14 bp, Homo sapiens
ctgactttttctgt

SEQ ID NO: 6140093 - DNA, 15 bp, Homo sapiens
ctgactttttctgtg

SEQ ID NO: 6140094 - DNA, 15 bp, Homo sapiens
ctgactttttgtttc

SEQ ID NO: 6140095 - DNA, 12 bp, Homo sapiens
ctgagaaaaaaa

SEQ ID NO: 6140096 - DNA, 19 bp, Homo sapiens
ctgagaaaacgaaactgct

SEQ ID NO: 6140097 - DNA, 10 bp, Homo sapiens
ctgagaaaag

SEQ ID NO: 6140098 - DNA, 21 bp, Homo sapiens
ctgagaaaagctttgaaccct

SEQ ID NO: 6140099 - DNA, 22 bp, Homo sapiens
ctgagaaaatgtaaggattctg

SEQ ID NO: 6140100 - DNA, 19 bp, Homo sapiens
ctgagaaacgtccatctct

SEQ ID NO: 6140101 - DNA, 21 bp, Homo sapiens
ctgagaaacgtccatctctct

SEQ ID NO: 6140102 - DNA, 20 bp, Homo sapiens
ctgagaaagactattcaaac

SEQ ID NO: 6140103 - DNA, 23 bp, Homo sapiens
ctgagaaagactattcaaacagt

SEQ ID NO: 6140104 - DNA, 17 bp, Homo sapiens
ctgagaaagcccacctg

SEQ ID NO: 6140105 - DNA, 18 bp, Homo sapiens
ctgagaaagcccacctgg

SEQ ID NO: 6140106 - DNA, 21 bp, Homo sapiens
ctgagaaagcccacctgggct

SEQ ID NO: 6140107 - DNA, 17 bp, Homo sapiens
ctgagaaaggtgaggag

SEQ ID NO: 6140108 - DNA, 17 bp, Homo sapiens
ctgagaaataggtatca

SEQ ID NO: 6140109 - DNA, 13 bp, Homo sapiens
ctgagaaatgggg

SEQ ID NO: 6140110 - DNA, 19 bp, Homo sapiens
ctgagaaatggggtggaat

SEQ ID NO: 6140111 - DNA, 11 bp, Homo sapiens
ctgagaacact

SEQ ID NO: 6140112 - DNA, 15 bp, Homo sapiens
ctgagaacactgtga

SEQ ID NO: 6140113 - DNA, 17 bp, Homo sapiens
ctgagaacactgtgaaa

SEQ ID NO: 6140114 - DNA, 22 bp, Homo sapiens
ctgagaacactgtgaaaacatt

SEQ ID NO: 6140115 - DNA, 22 bp, Homo sapiens
ctgagaacagatctccaaagct

SEQ ID NO: 6140116 - DNA, 13 bp, Homo sapiens
ctgagaaccaaaa

SEQ ID NO: 6140117 - DNA, 14 bp, Homo sapiens
ctgagaaccaaaag

SEQ ID NO: 6140118 - DNA, 18 bp, Homo sapiens
ctgagaaccctgcgtggg

SEQ ID NO: 6140119 - DNA, 12 bp, Homo sapiens
ctgagaacctgg

SEQ ID NO: 6140120 - DNA, 17 bp, Homo sapiens
ctgagaacctggccttc

SEQ ID NO: 6140121 - DNA, 18 bp, Homo sapiens
ctgagaacctggccttca

SEQ ID NO: 6140122 - DNA, 20 bp, Homo sapiens
ctgagaactcgttcacctcc

SEQ ID NO: 6140123 - DNA, 15 bp, Homo sapiens
ctgagaagaagctga

SEQ ID NO: 6140124 - DNA, 18 bp, Homo sapiens
ctgagaagaagctgagga

SEQ ID NO: 6140125 - DNA, 19 bp, Homo sapiens
ctgagaagaagctgaggat

SEQ ID NO: 6140126 - DNA, 18 bp, Homo sapiens
ctgagaagaagtggctgc

SEQ ID NO: 6140127 - DNA, 20 bp, Homo sapiens
ctgagaagaagtggctgcca

SEQ ID NO: 6140128 - DNA, 14 bp, Homo sapiens
ctgagaagaggaac

SEQ ID NO: 6140129 - DNA, 23 bp, Homo sapiens
ctgagaagaggaaccgttttaca

SEQ ID NO: 6140130 - DNA, 18 bp, Homo sapiens
ctgagaagaggtccttgg

SEQ ID NO: 6140131 - DNA, 18 bp, Homo sapiens
ctgagaagagtcgagtga

SEQ ID NO: 6140132 - DNA, 20 bp, Homo sapiens
ctgagaagatggcactgtcc

SEQ ID NO: 6140133 - DNA, 23 bp, Homo sapiens
ctgagaagatggcactgtccagg

SEQ ID NO: 6140134 - DNA, 22 bp, Homo sapiens
ctgagaagatgttaattacttt

SEQ ID NO: 6140135 - DNA, 17 bp, Homo sapiens
ctgagaagccaagcctg

SEQ ID NO: 6140136 - DNA, 18 bp, Homo sapiens
ctgagaagcctcatggga

SEQ ID NO: 6140137 - DNA, 15 bp, Homo sapiens
ctgagaagcgctgcc

SEQ ID NO: 6140138 - DNA, 14 bp, Homo sapiens
ctcacccgaggctg

SEQ ID NO: 6140139 - DNA, 21 bp, Homo sapiens
ctcacccgccccactccctcc

SEQ ID NO: 6140140 - DNA, 14 bp, Homo sapiens
ctcacccgctgccc

SEQ ID NO: 6140141 - DNA, 16 bp, Homo sapiens
ctcacccgctgcccag

SEQ ID NO: 6140142 - DNA, 15 bp, Homo sapiens
ctcacccggcctctt

SEQ ID NO: 6140143 - DNA, 16 bp, Homo sapiens
ctcaccctactctgga

SEQ ID NO: 6140144 - DNA, 10 bp, Homo sapiens
ctcaccctcc

SEQ ID NO: 6140145 - DNA, 22 bp, Homo sapiens
ctcaccctcccaagtagctggg

SEQ ID NO: 6140146 - DNA, 18 bp, Homo sapiens
ctcaccctcctagcctgc

SEQ ID NO: 6140147 - DNA, 12 bp, Homo sapiens
ctcaccctctgt

SEQ ID NO: 6140148 - DNA, 15 bp, Homo sapiens
ctcaccctctgtccc

SEQ ID NO: 6140149 - DNA, 20 bp, Homo sapiens
ctcaccctctgtccccacga

SEQ ID NO: 6140150 - DNA, 15 bp, Homo sapiens
ctcaccctgccttat

SEQ ID NO: 6140151 - DNA, 15 bp, Homo sapiens
ctcaccctgctacac

SEQ ID NO: 6140152 - DNA, 14 bp, Homo sapiens
ctcaccctgctcct

SEQ ID NO: 6140153 - DNA, 20 bp, Homo sapiens
ctcaccctgcttggggcctg

SEQ ID NO: 6140154 - DNA, 23 bp, Homo sapiens
ctcaccctgcttggggcctggcg

SEQ ID NO: 6140155 - DNA, 23 bp, Homo sapiens
ctcaccctgggagccagtcctcc

SEQ ID NO: 6140156 - DNA, 13 bp, Homo sapiens
ctcaccctgtggg

SEQ ID NO: 6140157 - DNA, 23 bp, Homo sapiens
ctcaccctgtgggaccgcctggc

SEQ ID NO: 6140158 - DNA, 12 bp, Homo sapiens
ctcacccttccc

SEQ ID NO: 6140159 - DNA, 13 bp, Homo sapiens
ctcacccttcccg

SEQ ID NO: 6140160 - DNA, 14 bp, Homo sapiens
ctcacccttcctgg

SEQ ID NO: 6140161 - DNA, 20 bp, Homo sapiens
ctcacccttcctggcccagg

SEQ ID NO: 6140162 - DNA, 21 bp, Homo sapiens
ctcacccttcctggcccaggc

SEQ ID NO: 6140163 - DNA, 19 bp, Homo sapiens
ctcacccttggcccatccc

SEQ ID NO: 6140164 - DNA, 15 bp, Homo sapiens
ctcaccgactcacct

SEQ ID NO: 6140165 - DNA, 13 bp, Homo sapiens
ctcaccgcccatc

SEQ ID NO: 6140166 - DNA, 14 bp, Homo sapiens
ctcaccgcccatca

SEQ ID NO: 6140167 - DNA, 14 bp, Homo sapiens
ctcaccgctggccc

SEQ ID NO: 6140168 - DNA, 18 bp, Homo sapiens
ctcaccgcttccctcctg

SEQ ID NO: 6140169 - DNA, 15 bp, Homo sapiens
ctcaccggcatgctg

SEQ ID NO: 6140170 - DNA, 17 bp, Homo sapiens
ctcaccggcatgctggc

SEQ ID NO: 6140171 - DNA, 23 bp, Homo sapiens
ctcaccggcatgctggcctgtgg

SEQ ID NO: 6140172 - DNA, 19 bp, Homo sapiens
ctcaccgtgcagagctgca

SEQ ID NO: 6140173 - DNA, 21 bp, Homo sapiens
ctcaccgtgctgtcttctggt

SEQ ID NO: 6140174 - DNA, 12 bp, Homo sapiens
ctcaccgtggat

SEQ ID NO: 6140175 - DNA, 20 bp, Homo sapiens
ctcacctaaaccctctgtga

SEQ ID NO: 6140176 - DNA, 17 bp, Homo sapiens
ctcacctaactcatact

SEQ ID NO: 6140177 - DNA, 22 bp, Homo sapiens
ctcacctagacaaccagaggct

SEQ ID NO: 6140178 - DNA, 13 bp, Homo sapiens
ctcacctagagcc

SEQ ID NO: 6140179 - DNA, 15 bp, Homo sapiens
ctcacctagagccag

SEQ ID NO: 6140180 - DNA, 18 bp, Homo sapiens
ctcacctagagccagacc

SEQ ID NO: 6140181 - DNA, 15 bp, Homo sapiens
ctcacctagcctgat

SEQ ID NO: 6140182 - DNA, 14 bp, Homo sapiens
ctcacctcagagca

SEQ ID NO: 6140183 - DNA, 16 bp, Homo sapiens
ctcacctcagagcagg

SEQ ID NO: 6140184 - DNA, 12 bp, Homo sapiens
ctcacctcagga

SEQ ID NO: 6140185 - DNA, 19 bp, Homo sapiens
ctcacctcaggaccccaga

SEQ ID NO: 6140186 - DNA, 17 bp, Homo sapiens
ctcacctcatgcccacc

SEQ ID NO: 6140187 - DNA, 14 bp, Homo sapiens
ctcacctcccaggg

SEQ ID NO: 6140188 - DNA, 15 bp, Homo sapiens
ctcacctcccagggc

SEQ ID NO: 6140189 - DNA, 16 bp, Homo sapiens
ctcacctcccagggct

SEQ ID NO: 6140190 - DNA, 13 bp, Homo sapiens
ctcacctcctgct

SEQ ID NO: 6140191 - DNA, 19 bp, Homo sapiens
ctcacctctacccaaaccc

SEQ ID NO: 6140192 - DNA, 18 bp, Homo sapiens
ctcacctctaggcctcag

SEQ ID NO: 6140193 - DNA, 23 bp, Homo sapiens
ctcacctctaggtccccatactc

SEQ ID NO: 6140194 - DNA, 16 bp, Homo sapiens
ctcacctctccaggtg

SEQ ID NO: 6140195 - DNA, 13 bp, Homo sapiens
ctcacctctccct

SEQ ID NO: 6140196 - DNA, 15 bp, Homo sapiens
ctcacctctcccttg

SEQ ID NO: 6140197 - DNA, 16 bp, Homo sapiens
ctcacctctctctaag

SEQ ID NO: 6140198 - DNA, 11 bp, Homo sapiens
ctcacctctga

SEQ ID NO: 6140199 - DNA, 12 bp, Homo sapiens
ctcacctctgat

SEQ ID NO: 6140200 - DNA, 15 bp, Homo sapiens
ctcacctctgcctca

SEQ ID NO: 6140201 - DNA, 15 bp, Homo sapiens
ctcacctctggactg

SEQ ID NO: 6140202 - DNA, 12 bp, Homo sapiens
ctcacctgacct

SEQ ID NO: 6140203 - DNA, 17 bp, Homo sapiens
ctcacctgagacctcca

SEQ ID NO: 6140204 - DNA, 20 bp, Homo sapiens
ctcacctgagacctccactc

SEQ ID NO: 6140205 - DNA, 14 bp, Homo sapiens
ctcacctgcagaga

SEQ ID NO: 6140206 - DNA, 16 bp, Homo sapiens
ctcacctgcagagaaa

SEQ ID NO: 6140207 - DNA, 18 bp, Homo sapiens
ctcacctgccggctctgg

SEQ ID NO: 6140208 - DNA, 19 bp, Homo sapiens
ctcacctgccggctctggg

SEQ ID NO: 6140209 - DNA, 23 bp, Homo sapiens
ctcacctgccggctctgggctgg

SEQ ID NO: 6140210 - DNA, 19 bp, Homo sapiens
ctcacctgcgcaagtgcct

SEQ ID NO: 6140211 - DNA, 16 bp, Homo sapiens
ctcacctgctccagga

SEQ ID NO: 6140212 - DNA, 19 bp, Homo sapiens
ctcacctgctggcccctca

SEQ ID NO: 6140213 - DNA, 21 bp, Homo sapiens
ctcacctgctggcccctcacc

SEQ ID NO: 6140214 - DNA, 21 bp, Homo sapiens
ctcacctggaggcaagaggga

SEQ ID NO: 6140215 - DNA, 16 bp, Homo sapiens
ctcacctggcttccca

SEQ ID NO: 6140216 - DNA, 17 bp, Homo sapiens
ctcacctggcttcccag

SEQ ID NO: 6140217 - DNA, 18 bp, Homo sapiens
ctcacctggcttcccagg

SEQ ID NO: 6140218 - DNA, 21 bp, Homo sapiens
ctcacctggcttcccaggacc

SEQ ID NO: 6140219 - DNA, 19 bp, Homo sapiens
ctcacctgggcacctgggg

SEQ ID NO: 6140220 - DNA, 20 bp, Homo sapiens
ctcacctgggcagggatgat

SEQ ID NO: 6140221 - DNA, 16 bp, Homo sapiens
ctcacctgggcctttc

SEQ ID NO: 6140222 - DNA, 17 bp, Homo sapiens
ctcacctgggcctttcc

SEQ ID NO: 6140223 - DNA, 11 bp, Homo sapiens
ctcacctgggg

SEQ ID NO: 6140224 - DNA, 21 bp, Homo sapiens
ctcacctggggctgctggcct

SEQ ID NO: 6140225 - DNA, 20 bp, Homo sapiens
ctcacctgggttccccaccc

SEQ ID NO: 6140226 - DNA, 14 bp, Homo sapiens
ctcacctggtcctc

SEQ ID NO: 6140227 - DNA, 23 bp, Homo sapiens
ctcacctggtcctccgcctactg

SEQ ID NO: 6140228 - DNA, 21 bp, Homo sapiens
ctcacctgtactattgcagac

SEQ ID NO: 6140229 - DNA, 22 bp, Homo sapiens
ctcacctgtcgcacccactgtg

SEQ ID NO: 6140230 - DNA, 17 bp, Homo sapiens
ctcacctgtgtgcccag

SEQ ID NO: 6140231 - DNA, 22 bp, Homo sapiens
ctcacctgtgtgcccagcacct

SEQ ID NO: 6140232 - DNA, 15 bp, Homo sapiens
ctcacctgttgctta

SEQ ID NO: 6140233 - DNA, 22 bp, Homo sapiens
ctcacctgttgcttacaatttt

SEQ ID NO: 6140234 - DNA, 15 bp, Homo sapiens
ctcaccttcctcatc

SEQ ID NO: 6140235 - DNA, 13 bp, Homo sapiens
ctcaccttcctgt

SEQ ID NO: 6140236 - DNA, 14 bp, Homo sapiens
ctcaccttctgagt

SEQ ID NO: 6140237 - DNA, 14 bp, Homo sapiens
ctcaccttctgttt

SEQ ID NO: 6140238 - DNA, 19 bp, Homo sapiens
ctcaccttgcaacacacag

SEQ ID NO: 6140239 - DNA, 21 bp, Homo sapiens
ctcaccttgcaacacacagac

SEQ ID NO: 6140240 - DNA, 17 bp, Homo sapiens
ctcaccttggcaccaga

SEQ ID NO: 6140241 - DNA, 17 bp, Homo sapiens
ctcaccttgggctgggg

SEQ ID NO: 6140242 - DNA, 15 bp, Homo sapiens
ctcaccttggggcct

SEQ ID NO: 6140243 - DNA, 21 bp, Homo sapiens
ctcaccttgtgctggggacag

SEQ ID NO: 6140244 - DNA, 21 bp, Homo sapiens
ctcacctttagaacaggagac

SEQ ID NO: 6140245 - DNA, 20 bp, Homo sapiens
ctcacctttcccacagtctc

SEQ ID NO: 6140246 - DNA, 19 bp, Homo sapiens
ctcacctttctccactggg

SEQ ID NO: 6140247 - DNA, 16 bp, Homo sapiens
ctcacctttgcaaagt

SEQ ID NO: 6140248 - DNA, 18 bp, Homo sapiens
ctcacgagtcatccagaa

SEQ ID NO: 6140249 - DNA, 14 bp, Homo sapiens
ctcacgattccagt

SEQ ID NO: 6140250 - DNA, 19 bp, Homo sapiens
ctcacgcacctcccatcct

SEQ ID NO: 6140251 - DNA, 17 bp, Homo sapiens
ctcacgcccagcctcct

SEQ ID NO: 6140252 - DNA, 22 bp, Homo sapiens
ctcacgcccagcctcctcccac

SEQ ID NO: 6140253 - DNA, 15 bp, Homo sapiens
ctcacgccccgctgt

SEQ ID NO: 6140254 - DNA, 20 bp, Homo sapiens
ctcacgccccgctgtgtcct

SEQ ID NO: 6140255 - DNA, 21 bp, Homo sapiens
ctcacgcctgtaatcccagca

SEQ ID NO: 6140256 - DNA, 15 bp, Homo sapiens
ctcacgcgttctggg

SEQ ID NO: 6140257 - DNA, 13 bp, Homo sapiens
ctcacgctcagca

SEQ ID NO: 6140258 - DNA, 17 bp, Homo sapiens
ctcacgctcccccgcag

SEQ ID NO: 6140259 - DNA, 16 bp, Homo sapiens
ctcacgctgacagcct

SEQ ID NO: 6140260 - DNA, 17 bp, Homo sapiens
ctcacgctgacagcctc

SEQ ID NO: 6140261 - DNA, 22 bp, Homo sapiens
ctcacgctgccatttccctgaa

SEQ ID NO: 6140262 - DNA, 13 bp, Homo sapiens
ctcacgcttcaca

SEQ ID NO: 6140263 - DNA, 13 bp, Homo sapiens
ctcacgctttgtt

SEQ ID NO: 6140264 - DNA, 21 bp, Homo sapiens
ctcacggctgcacctgcaggg

SEQ ID NO: 6140265 - DNA, 14 bp, Homo sapiens
ctcacgggccctgc

SEQ ID NO: 6140266 - DNA, 22 bp, Homo sapiens
ctcacgggccctgccccagccc

SEQ ID NO: 6140267 - DNA, 17 bp, Homo sapiens
ctcacggggcctccaac

SEQ ID NO: 6140268 - DNA, 20 bp, Homo sapiens
ctcacggggttggctgttcc

SEQ ID NO: 6140269 - DNA, 22 bp, Homo sapiens
ctcacggggttggctgttccag

SEQ ID NO: 6140270 - DNA, 23 bp, Homo sapiens
ctcacggggttggctgttccaga

SEQ ID NO: 6140271 - DNA, 13 bp, Homo sapiens
ctcacgtaatgca

SEQ ID NO: 6140272 - DNA, 21 bp, Homo sapiens
ctcacgtaatgcattgcctgt

SEQ ID NO: 6140273 - DNA, 19 bp, Homo sapiens
ctcacgtatttcacagagc

SEQ ID NO: 6140274 - DNA, 17 bp, Homo sapiens
ctcacgtctctgccgcc

SEQ ID NO: 6140275 - DNA, 23 bp, Homo sapiens
ctcacgtgcaggacagctcttga

SEQ ID NO: 6140276 - DNA, 22 bp, Homo sapiens
ctcacgtggggagcggtggctg

SEQ ID NO: 6140277 - DNA, 13 bp, Homo sapiens
ctcacgtgtgtga

SEQ ID NO: 6140278 - DNA, 20 bp, Homo sapiens
ctcactaaagcatgaaatgt

SEQ ID NO: 6140279 - DNA, 15 bp, Homo sapiens
ctcactaacaaagaa

SEQ ID NO: 6140280 - DNA, 18 bp, Homo sapiens
ctcactaagccccggcac

SEQ ID NO: 6140281 - DNA, 17 bp, Homo sapiens
ctcactaatttttgtat

SEQ ID NO: 6140282 - DNA, 16 bp, Homo sapiens
ctcactacctcctcag

SEQ ID NO: 6140283 - DNA, 13 bp, Homo sapiens
ctcactactgaac

SEQ ID NO: 6140284 - DNA, 21 bp, Homo sapiens
ctcactactgaacacatgtgt

SEQ ID NO: 6140285 - DNA, 21 bp, Homo sapiens
ctcactagccatgctttatgt

SEQ ID NO: 6140286 - DNA, 23 bp, Homo sapiens
ctcactagccatgctttatgtgg

SEQ ID NO: 6140287 - DNA, 17 bp, Homo sapiens
ctcactagctccccaat

SEQ ID NO: 6140288 - DNA, 23 bp, Homo sapiens
ctcactagctccccaatccctga

SEQ ID NO: 6140289 - DNA, 21 bp, Homo sapiens
ctcactagtttttcctgtgca

SEQ ID NO: 6140290 - DNA, 16 bp, Homo sapiens
ctcactatatatattt

SEQ ID NO: 6140291 - DNA, 14 bp, Homo sapiens
ctcactatgctgct

SEQ ID NO: 6140292 - DNA, 23 bp, Homo sapiens
ctcactatggtatgctggccagc

SEQ ID NO: 6140293 - DNA, 23 bp, Homo sapiens
ctcactatggtgccaatggaacc

SEQ ID NO: 6140294 - DNA, 16 bp, Homo sapiens
ctcactatgtttctca

SEQ ID NO: 6140295 - DNA, 19 bp, Homo sapiens
ctcactatgtttctcagac

SEQ ID NO: 6140296 - DNA, 19 bp, Homo sapiens
ctcactattcttggaccat

SEQ ID NO: 6140297 - DNA, 13 bp, Homo sapiens
ctcactcaagcct

SEQ ID NO: 6140298 - DNA, 15 bp, Homo sapiens
ctcactcaagcctga

SEQ ID NO: 6140299 - DNA, 21 bp, Homo sapiens
ctcactcaagcctgagagaag

SEQ ID NO: 6140300 - DNA, 18 bp, Homo sapiens
ctcactcaagttcaagga

SEQ ID NO: 6140301 - DNA, 19 bp, Homo sapiens
ctcactcaagttcaaggac

SEQ ID NO: 6140302 - DNA, 17 bp, Homo sapiens
ctcactcaattttccct

SEQ ID NO: 6140303 - DNA, 15 bp, Homo sapiens
ctcactcactctggg

SEQ ID NO: 6140304 - DNA, 16 bp, Homo sapiens
ctcactcagcaccact

SEQ ID NO: 6140305 - DNA, 19 bp, Homo sapiens
ctcactcagcacttggccc

SEQ ID NO: 6140306 - DNA, 22 bp, Homo sapiens
ctcactcagccaccctgagttg

SEQ ID NO: 6140307 - DNA, 18 bp, Homo sapiens
ctcactcagctctgaaag

SEQ ID NO: 6140308 - DNA, 21 bp, Homo sapiens
ctcactcaggaaccctggaga

SEQ ID NO: 6140309 - DNA, 20 bp, Homo sapiens
ctcactcagtaaaacataat

SEQ ID NO: 6140310 - DNA, 23 bp, Homo sapiens
ctcactccaagaccaccagggtc

SEQ ID NO: 6140311 - DNA, 15 bp, Homo sapiens
ctcactccacactgg

SEQ ID NO: 6140312 - DNA, 21 bp, Homo sapiens
ctcactccacagagtgagcca

SEQ ID NO: 6140313 - DNA, 12 bp, Homo sapiens
ctcactccaccc

SEQ ID NO: 6140314 - DNA, 14 bp, Homo sapiens
ctcactccactccc

SEQ ID NO: 6140315 - DNA, 16 bp, Homo sapiens
ctcactccactcccct

SEQ ID NO: 6140316 - DNA, 16 bp, Homo sapiens
ctgagaagcgctgccc

SEQ ID NO: 6140317 - DNA, 21 bp, Homo sapiens
ctgagaagcgctgccctgtga

SEQ ID NO: 6140318 - DNA, 22 bp, Homo sapiens
ctgagaagcgctgccctgtgag

SEQ ID NO: 6140319 - DNA, 13 bp, Homo sapiens
ctgagaagctctg

SEQ ID NO: 6140320 - DNA, 14 bp, Homo sapiens
ctgagaagctgctc

SEQ ID NO: 6140321 - DNA, 15 bp, Homo sapiens
ctgagaagctgctcc

SEQ ID NO: 6140322 - DNA, 21 bp, Homo sapiens
ctgagaagctgctccaggcct

SEQ ID NO: 6140323 - DNA, 18 bp, Homo sapiens
ctgagaaggcaggcctcc

SEQ ID NO: 6140324 - DNA, 16 bp, Homo sapiens
ctgagaaggccccagg

SEQ ID NO: 6140325 - DNA, 18 bp, Homo sapiens
ctgagaaggccccagggc

SEQ ID NO: 6140326 - DNA, 19 bp, Homo sapiens
ctgagaaggccccagggca

SEQ ID NO: 6140327 - DNA, 21 bp, Homo sapiens
ctgagaaggcgaggagagtgg

SEQ ID NO: 6140328 - DNA, 21 bp, Homo sapiens
ctgagaaggctaaagaagaca

SEQ ID NO: 6140329 - DNA, 14 bp, Homo sapiens
ctgagaaggggcag

SEQ ID NO: 6140330 - DNA, 23 bp, Homo sapiens
ctgagaaggtccttaatgatccg

SEQ ID NO: 6140331 - DNA, 16 bp, Homo sapiens
ctgagaatagaaggaa

SEQ ID NO: 6140332 - DNA, 23 bp, Homo sapiens
ctgagaatagaaggaaactagct

SEQ ID NO: 6140333 - DNA, 18 bp, Homo sapiens
ctgagaatatatgctttt

SEQ ID NO: 6140334 - DNA, 16 bp, Homo sapiens
ctgagaatcagactga

SEQ ID NO: 6140335 - DNA, 16 bp, Homo sapiens
ctgagaatctgggggt

SEQ ID NO: 6140336 - DNA, 18 bp, Homo sapiens
ctgagaatctgggggtga

SEQ ID NO: 6140337 - DNA, 18 bp, Homo sapiens
ctgagaatgagtgggaat

SEQ ID NO: 6140338 - DNA, 22 bp, Homo sapiens
ctgagaatgagtgggaatccgg

SEQ ID NO: 6140339 - DNA, 17 bp, Homo sapiens
ctgagaatgtaagaact

SEQ ID NO: 6140340 - DNA, 16 bp, Homo sapiens
ctgagaattgagggga

SEQ ID NO: 6140341 - DNA, 21 bp, Homo sapiens
ctgagaattgtgttatttcac

SEQ ID NO: 6140342 - DNA, 18 bp, Homo sapiens
ctgagaatttaattttta

SEQ ID NO: 6140343 - DNA, 20 bp, Homo sapiens
ctgagacaaatggaggcctg

SEQ ID NO: 6140344 - DNA, 15 bp, Homo sapiens
ctgagacaatgcctt

SEQ ID NO: 6140345 - DNA, 13 bp, Homo sapiens
ctgagacacatgg

SEQ ID NO: 6140346 - DNA, 19 bp, Homo sapiens
ctgagacacgatgccgaga

SEQ ID NO: 6140347 - DNA, 13 bp, Homo sapiens
ctgagacactgaa

SEQ ID NO: 6140348 - DNA, 14 bp, Homo sapiens
ctgagacactgaag

SEQ ID NO: 6140349 - DNA, 19 bp, Homo sapiens
ctgagacagagagccaagc

SEQ ID NO: 6140350 - DNA, 12 bp, Homo sapiens
ctgagacagcac

SEQ ID NO: 6140351 - DNA, 16 bp, Homo sapiens
ctgagacagcaccact

SEQ ID NO: 6140352 - DNA, 18 bp, Homo sapiens
ctgagacagcaccactgc

SEQ ID NO: 6140353 - DNA, 15 bp, Homo sapiens
ctgagacagcccggg

SEQ ID NO: 6140354 - DNA, 13 bp, Homo sapiens
ctgagacaggaga

SEQ ID NO: 6140355 - DNA, 15 bp, Homo sapiens
ctgagacaggagaat

SEQ ID NO: 6140356 - DNA, 14 bp, Homo sapiens
ctgagacaggcagt

SEQ ID NO: 6140357 - DNA, 14 bp, Homo sapiens
ctgagacaggtgcc

SEQ ID NO: 6140358 - DNA, 19 bp, Homo sapiens
ctgagacatccctgattct

SEQ ID NO: 6140359 - DNA, 21 bp, Homo sapiens
ctgagaccaaggctttctcta

SEQ ID NO: 6140360 - DNA, 21 bp, Homo sapiens
ctgagaccaagtctctctaag

SEQ ID NO: 6140361 - DNA, 19 bp, Homo sapiens
ctgagaccacccccaaaca

SEQ ID NO: 6140362 - DNA, 23 bp, Homo sapiens
ctgagaccacggtccaatccagc

SEQ ID NO: 6140363 - DNA, 15 bp, Homo sapiens
ctgagaccactgagt

SEQ ID NO: 6140364 - DNA, 17 bp, Homo sapiens
ctgagaccagggtggcc

SEQ ID NO: 6140365 - DNA, 19 bp, Homo sapiens
ctgagaccagggtggccac

SEQ ID NO: 6140366 - DNA, 22 bp, Homo sapiens
ctgagaccagggtggccacaca

SEQ ID NO: 6140367 - DNA, 13 bp, Homo sapiens
ctgagaccagtgt

SEQ ID NO: 6140368 - DNA, 22 bp, Homo sapiens
ctgagaccagttgggagcactg

SEQ ID NO: 6140369 - DNA, 17 bp, Homo sapiens
ctgagacccaggactcc

SEQ ID NO: 6140370 - DNA, 21 bp, Homo sapiens
ctgagacccaggactcctccc

SEQ ID NO: 6140371 - DNA, 17 bp, Homo sapiens
ctgagacccctggcctc

SEQ ID NO: 6140372 - DNA, 21 bp, Homo sapiens
ctgagacccctggcctccggc

SEQ ID NO: 6140373 - DNA, 14 bp, Homo sapiens
ctgagaccctactg

SEQ ID NO: 6140374 - DNA, 20 bp, Homo sapiens
ctgagaccctactgaagtgg

SEQ ID NO: 6140375 - DNA, 22 bp, Homo sapiens
ctgagaccctactgaagtggct

SEQ ID NO: 6140376 - DNA, 16 bp, Homo sapiens
ctgagacccttattta

SEQ ID NO: 6140377 - DNA, 19 bp, Homo sapiens
ctgagacccttttctcagg

SEQ ID NO: 6140378 - DNA, 21 bp, Homo sapiens
ctgagacctctagagaaaaga

SEQ ID NO: 6140379 - DNA, 18 bp, Homo sapiens
ctgagaccttcaggcctt

SEQ ID NO: 6140380 - DNA, 16 bp, Homo sapiens
ctgagaccttgatgag

SEQ ID NO: 6140381 - DNA, 13 bp, Homo sapiens
ctgagaccttgct

SEQ ID NO: 6140382 - DNA, 22 bp, Homo sapiens
ctgagacggatggaaggagaga

SEQ ID NO: 6140383 - DNA, 14 bp, Homo sapiens
ctgagacggcagag

SEQ ID NO: 6140384 - DNA, 17 bp, Homo sapiens
ctgagacgggcatcgca

SEQ ID NO: 6140385 - DNA, 21 bp, Homo sapiens
ctgagacgggcatcgcaggag

SEQ ID NO: 6140386 - DNA, 16 bp, Homo sapiens
ctgagacgtcatgagg

SEQ ID NO: 6140387 - DNA, 13 bp, Homo sapiens
ctgagactacagg

SEQ ID NO: 6140388 - DNA, 19 bp, Homo sapiens
ctgagactcacaggaagga

SEQ ID NO: 6140389 - DNA, 14 bp, Homo sapiens
ctgagactcagaca

SEQ ID NO: 6140390 - DNA, 13 bp, Homo sapiens
ctgagactccaga

SEQ ID NO: 6140391 - DNA, 20 bp, Homo sapiens
ctgagactccagaatctgct

SEQ ID NO: 6140392 - DNA, 18 bp, Homo sapiens
ctgagactccagacctga

SEQ ID NO: 6140393 - DNA, 19 bp, Homo sapiens
ctgagactccggggagcgc

SEQ ID NO: 6140394 - DNA, 23 bp, Homo sapiens
ctgagactccggggagcgcccgc

SEQ ID NO: 6140395 - DNA, 19 bp, Homo sapiens
ctgagactcgcgacaatgc

SEQ ID NO: 6140396 - DNA, 19 bp, Homo sapiens
ctgagactctttagagcag

SEQ ID NO: 6140397 - DNA, 19 bp, Homo sapiens
ctgagactggaaaaggtgg

SEQ ID NO: 6140398 - DNA, 20 bp, Homo sapiens
ctgagactggaaaaggtgga

SEQ ID NO: 6140399 - DNA, 20 bp, Homo sapiens
ctgagactggcacttagccc

SEQ ID NO: 6140400 - DNA, 19 bp, Homo sapiens
ctgagacttgttcttggtt

SEQ ID NO: 6140401 - DNA, 18 bp, Homo sapiens
ctgagactttcccctctc

SEQ ID NO: 6140402 - DNA, 19 bp, Homo sapiens
ctgagactttcccctctcg

SEQ ID NO: 6140403 - DNA, 14 bp, Homo sapiens
ctgagagaccagac

SEQ ID NO: 6140404 - DNA, 16 bp, Homo sapiens
ctgagagaccatctcc

SEQ ID NO: 6140405 - DNA, 19 bp, Homo sapiens
ctgagagaccatctcctat

SEQ ID NO: 6140406 - DNA, 20 bp, Homo sapiens
ctgagagaccatctcctatc

SEQ ID NO: 6140407 - DNA, 16 bp, Homo sapiens
ctgagagaccctggcc

SEQ ID NO: 6140408 - DNA, 18 bp, Homo sapiens
ctgagagaccctggcctc

SEQ ID NO: 6140409 - DNA, 18 bp, Homo sapiens
ctgagagacctgccctct

SEQ ID NO: 6140410 - DNA, 21 bp, Homo sapiens
ctgagagacctgccctctctg

SEQ ID NO: 6140411 - DNA, 22 bp, Homo sapiens
ctgagagacctgccctctctgc

SEQ ID NO: 6140412 - DNA, 20 bp, Homo sapiens
ctgagagacctgtgtgaact

SEQ ID NO: 6140413 - DNA, 18 bp, Homo sapiens
ctgagagagaatagagct

SEQ ID NO: 6140414 - DNA, 21 bp, Homo sapiens
ctgagagagaatagagctgcc

SEQ ID NO: 6140415 - DNA, 22 bp, Homo sapiens
ctgagagagaatagagctgcca

SEQ ID NO: 6140416 - DNA, 22 bp, Homo sapiens
ctgagagaggccattctttccc

SEQ ID NO: 6140417 - DNA, 19 bp, Homo sapiens
ctgagagaggctaaaatgt

SEQ ID NO: 6140418 - DNA, 20 bp, Homo sapiens
ctgagagaggctaaaatgtt

SEQ ID NO: 6140419 - DNA, 21 bp, Homo sapiens
ctgagagaggctaaaatgttt

SEQ ID NO: 6140420 - DNA, 23 bp, Homo sapiens
ctgagagaggctaaaatgttttc

SEQ ID NO: 6140421 - DNA, 19 bp, Homo sapiens
ctgagagatgcagaaatat

SEQ ID NO: 6140422 - DNA, 14 bp, Homo sapiens
ctgagagcagatgg

SEQ ID NO: 6140423 - DNA, 17 bp, Homo sapiens
ctgagagcatgtggggg

SEQ ID NO: 6140424 - DNA, 12 bp, Homo sapiens
ctgagagccagg

SEQ ID NO: 6140425 - DNA, 15 bp, Homo sapiens
ctgagagccccagct

SEQ ID NO: 6140426 - DNA, 14 bp, Homo sapiens
ctgagagccctgct

SEQ ID NO: 6140427 - DNA, 16 bp, Homo sapiens
ctgagagccctgctgt

SEQ ID NO: 6140428 - DNA, 19 bp, Homo sapiens
ctgagagccggccgtggaa

SEQ ID NO: 6140429 - DNA, 22 bp, Homo sapiens
ctgagagccggccgtggaagga

SEQ ID NO: 6140430 - DNA, 20 bp, Homo sapiens
ctgagagcgaattgtgtgga

SEQ ID NO: 6140431 - DNA, 22 bp, Homo sapiens
ctgagagctctctcttctctgt

SEQ ID NO: 6140432 - DNA, 15 bp, Homo sapiens
ctgagagctgctcct

SEQ ID NO: 6140433 - DNA, 16 bp, Homo sapiens
ctgagagctgctcctt

SEQ ID NO: 6140434 - DNA, 17 bp, Homo sapiens
ctgagagctgctccttt

SEQ ID NO: 6140435 - DNA, 18 bp, Homo sapiens
ctgagagctgctcctttg

SEQ ID NO: 6140436 - DNA, 21 bp, Homo sapiens
ctgagagctgggctttcctct

SEQ ID NO: 6140437 - DNA, 13 bp, Homo sapiens
ctgagagctgttt

SEQ ID NO: 6140438 - DNA, 20 bp, Homo sapiens
ctgagaggaagatgaagaga

SEQ ID NO: 6140439 - DNA, 18 bp, Homo sapiens
ctgagaggaggggtaaat

SEQ ID NO: 6140440 - DNA, 20 bp, Homo sapiens
ctgagaggaggggtaaatat

SEQ ID NO: 6140441 - DNA, 22 bp, Homo sapiens
ctgagaggaggggtaaatatat

SEQ ID NO: 6140442 - DNA, 23 bp, Homo sapiens
ctgagaggaggggtaaatatatg

SEQ ID NO: 6140443 - DNA, 21 bp, Homo sapiens
ctgagaggcaccagtccagca

SEQ ID NO: 6140444 - DNA, 15 bp, Homo sapiens
ctgagaggcaggcat

SEQ ID NO: 6140445 - DNA, 13 bp, Homo sapiens
ctgagaggccctg

SEQ ID NO: 6140446 - DNA, 22 bp, Homo sapiens
ctgagaggctctccgtgcaggc

SEQ ID NO: 6140447 - DNA, 17 bp, Homo sapiens
ctgagagggctcgaggg

SEQ ID NO: 6140448 - DNA, 13 bp, Homo sapiens
ctgagagggctgt

SEQ ID NO: 6140449 - DNA, 17 bp, Homo sapiens
ctgagagggctgtggct

SEQ ID NO: 6140450 - DNA, 19 bp, Homo sapiens
ctgagagggctgtggctgg

SEQ ID NO: 6140451 - DNA, 21 bp, Homo sapiens
ctgagagggtgtgggtgccct

SEQ ID NO: 6140452 - DNA, 13 bp, Homo sapiens
ctgagaggtgagg

SEQ ID NO: 6140453 - DNA, 16 bp, Homo sapiens
ctgagaggttagaatg

SEQ ID NO: 6140454 - DNA, 11 bp, Homo sapiens
ctgagaggttt

SEQ ID NO: 6140455 - DNA, 20 bp, Homo sapiens
ctgagagtatttaggcagat

SEQ ID NO: 6140456 - DNA, 18 bp, Homo sapiens
ctgagagtcagctctctg

SEQ ID NO: 6140457 - DNA, 22 bp, Homo sapiens
ctgagagtctagattctctggc

SEQ ID NO: 6140458 - DNA, 23 bp, Homo sapiens
ctgagagtgccccactgcactcc

SEQ ID NO: 6140459 - DNA, 15 bp, Homo sapiens
ctgagagtggggcta

SEQ ID NO: 6140460 - DNA, 19 bp, Homo sapiens
ctgagagttggctcaggca

SEQ ID NO: 6140461 - DNA, 21 bp, Homo sapiens
ctgagagttggctcaggcaga

SEQ ID NO: 6140462 - DNA, 14 bp, Homo sapiens
ctgagagtttagtt

SEQ ID NO: 6140463 - DNA, 15 bp, Homo sapiens
ctgagagtttagttg

SEQ ID NO: 6140464 - DNA, 14 bp, Homo sapiens
ctgagagtttcctc

SEQ ID NO: 6140465 - DNA, 21 bp, Homo sapiens
ctgagataagaaaagcctgaa

SEQ ID NO: 6140466 - DNA, 19 bp, Homo sapiens
ctgagatacatacagaatt

SEQ ID NO: 6140467 - DNA, 23 bp, Homo sapiens
ctgagatactgaagtgcagctca

SEQ ID NO: 6140468 - DNA, 18 bp, Homo sapiens
ctgagatacttcccaaag

SEQ ID NO: 6140469 - DNA, 20 bp, Homo sapiens
ctgagatacttcccaaagcc

SEQ ID NO: 6140470 - DNA, 12 bp, Homo sapiens
ctgagatatgaa

SEQ ID NO: 6140471 - DNA, 15 bp, Homo sapiens
ctgagatatgaacat

SEQ ID NO: 6140472 - DNA, 23 bp, Homo sapiens
ctgagatatgaacatattgttga

SEQ ID NO: 6140473 - DNA, 17 bp, Homo sapiens
ctgagatatggcattgc

SEQ ID NO: 6140474 - DNA, 13 bp, Homo sapiens
ctgagatccagag

SEQ ID NO: 6140475 - DNA, 16 bp, Homo sapiens
ctgagatccagagagg

SEQ ID NO: 6140476 - DNA, 18 bp, Homo sapiens
ctgagatccagagaggct

SEQ ID NO: 6140477 - DNA, 14 bp, Homo sapiens
ctgagatcccctga

SEQ ID NO: 6140478 - DNA, 21 bp, Homo sapiens
ctgagatcccctgagccccag

SEQ ID NO: 6140479 - DNA, 19 bp, Homo sapiens
ctgagatcgtgccactgca

SEQ ID NO: 6140480 - DNA, 20 bp, Homo sapiens
ctgagatctgcacagtcaga

SEQ ID NO: 6140481 - DNA, 18 bp, Homo sapiens
ctgagatgaaccctggca

SEQ ID NO: 6140482 - DNA, 21 bp, Homo sapiens
ctgagatgagaggggagagct

SEQ ID NO: 6140483 - DNA, 15 bp, Homo sapiens
ctgagatgagcccca

SEQ ID NO: 6140484 - DNA, 17 bp, Homo sapiens
ctgagatgcaaatgtca

SEQ ID NO: 6140485 - DNA, 11 bp, Homo sapiens
ctgagatgcta

SEQ ID NO: 6140486 - DNA, 17 bp, Homo sapiens
ctgagatgctaatttat

SEQ ID NO: 6140487 - DNA, 22 bp, Homo sapiens
ctgagatgctgggagggctgaa

SEQ ID NO: 6140488 - DNA, 14 bp, Homo sapiens
ctgagatgctgggc

SEQ ID NO: 6140489 - DNA, 15 bp, Homo sapiens
ctgagatgctgggct

SEQ ID NO: 6140490 - DNA, 15 bp, Homo sapiens
ctgagatggaaaagt

SEQ ID NO: 6140491 - DNA, 14 bp, Homo sapiens
ctgagatggagctg

SEQ ID NO: 6140492 - DNA, 15 bp, Homo sapiens
ctgagatggagctgc

SEQ ID NO: 6140493 - DNA, 14 bp, Homo sapiens
ctcactccagccaa

SEQ ID NO: 6140494 - DNA, 16 bp, Homo sapiens
ctcactccagccaaag

SEQ ID NO: 6140495 - DNA, 18 bp, Homo sapiens
ctcactccagccaaagaa

SEQ ID NO: 6140496 - DNA, 13 bp, Homo sapiens
ctcactccagccc

SEQ ID NO: 6140497 - DNA, 19 bp, Homo sapiens
ctcactccccactccccca

SEQ ID NO: 6140498 - DNA, 20 bp, Homo sapiens
ctcactccccagcctgggcc

SEQ ID NO: 6140499 - DNA, 15 bp, Homo sapiens
ctcactccccaggga

SEQ ID NO: 6140500 - DNA, 16 bp, Homo sapiens
ctcactccccagggag

SEQ ID NO: 6140501 - DNA, 12 bp, Homo sapiens
ctcactccccat

SEQ ID NO: 6140502 - DNA, 12 bp, Homo sapiens
ctcactcccctc

SEQ ID NO: 6140503 - DNA, 22 bp, Homo sapiens
ctcactcccctcctttcccaac

SEQ ID NO: 6140504 - DNA, 23 bp, Homo sapiens
ctcactcccgctgagcccactct

SEQ ID NO: 6140505 - DNA, 13 bp, Homo sapiens
ctcactccctaaa

SEQ ID NO: 6140506 - DNA, 19 bp, Homo sapiens
ctcactccctaaagccctc

SEQ ID NO: 6140507 - DNA, 21 bp, Homo sapiens
ctcactcccttcccataagct

SEQ ID NO: 6140508 - DNA, 12 bp, Homo sapiens
ctcactcccttt

SEQ ID NO: 6140509 - DNA, 17 bp, Homo sapiens
ctcactcctacctggta

SEQ ID NO: 6140510 - DNA, 18 bp, Homo sapiens
ctcactcctaggagagcc

SEQ ID NO: 6140511 - DNA, 23 bp, Homo sapiens
ctcactcctaggagagccaacct

SEQ ID NO: 6140512 - DNA, 12 bp, Homo sapiens
ctcactcctgag

SEQ ID NO: 6140513 - DNA, 20 bp, Homo sapiens
ctcactcctgagacccctgg

SEQ ID NO: 6140514 - DNA, 12 bp, Homo sapiens
ctcactcctgcc

SEQ ID NO: 6140515 - DNA, 14 bp, Homo sapiens
ctcactcctgcctc

SEQ ID NO: 6140516 - DNA, 20 bp, Homo sapiens
ctcactcctgttacttacct

SEQ ID NO: 6140517 - DNA, 14 bp, Homo sapiens
ctcactccttttaa

SEQ ID NO: 6140518 - DNA, 22 bp, Homo sapiens
ctcactcgggtttctctgtggc

SEQ ID NO: 6140519 - DNA, 13 bp, Homo sapiens
ctcactctcagga

SEQ ID NO: 6140520 - DNA, 21 bp, Homo sapiens
ctcactctcaggaaatgctga

SEQ ID NO: 6140521 - DNA, 21 bp, Homo sapiens
ctcactctccccagtcctcag

SEQ ID NO: 6140522 - DNA, 15 bp, Homo sapiens
ctcactctcttcctt

SEQ ID NO: 6140523 - DNA, 15 bp, Homo sapiens
ctcactctgccaggg

SEQ ID NO: 6140524 - DNA, 22 bp, Homo sapiens
ctcactctgctaccttgcccca

SEQ ID NO: 6140525 - DNA, 19 bp, Homo sapiens
ctcactctggcagcctcag

SEQ ID NO: 6140526 - DNA, 12 bp, Homo sapiens
ctcactctggcc

SEQ ID NO: 6140527 - DNA, 14 bp, Homo sapiens
ctcactctggcctc

SEQ ID NO: 6140528 - DNA, 15 bp, Homo sapiens
ctcactctggcctca

SEQ ID NO: 6140529 - DNA, 15 bp, Homo sapiens
ctcactctgggtgcc

SEQ ID NO: 6140530 - DNA, 13 bp, Homo sapiens
ctcactctgtcag

SEQ ID NO: 6140531 - DNA, 15 bp, Homo sapiens
ctcactctgtcagcc

SEQ ID NO: 6140532 - DNA, 14 bp, Homo sapiens
ctcactctgtccct

SEQ ID NO: 6140533 - DNA, 22 bp, Homo sapiens
ctcactctgtcgctcaggctgg

SEQ ID NO: 6140534 - DNA, 23 bp, Homo sapiens
ctcactctgttgaccaggctgga

SEQ ID NO: 6140535 - DNA, 16 bp, Homo sapiens
ctcactcttgccaacc

SEQ ID NO: 6140536 - DNA, 13 bp, Homo sapiens
ctcactctttctt

SEQ ID NO: 6140537 - DNA, 18 bp, Homo sapiens
ctcactgaaaacatctgg

SEQ ID NO: 6140538 - DNA, 23 bp, Homo sapiens
ctcactgaaacatggctgtgttt

SEQ ID NO: 6140539 - DNA, 20 bp, Homo sapiens
ctcactgaaacctctgcctt

SEQ ID NO: 6140540 - DNA, 16 bp, Homo sapiens
ctcactgaactccacc

SEQ ID NO: 6140541 - DNA, 12 bp, Homo sapiens
ctcactgaagcc

SEQ ID NO: 6140542 - DNA, 15 bp, Homo sapiens
ctcactgaaggacct

SEQ ID NO: 6140543 - DNA, 17 bp, Homo sapiens
ctcactgaatcttcacg

SEQ ID NO: 6140544 - DNA, 22 bp, Homo sapiens
ctcactgagaagattgtgaata

SEQ ID NO: 6140545 - DNA, 19 bp, Homo sapiens
ctcactgagaggcctggag

SEQ ID NO: 6140546 - DNA, 16 bp, Homo sapiens
ctcactgaggaaggga

SEQ ID NO: 6140547 - DNA, 17 bp, Homo sapiens
ctcactgaggccatcag

SEQ ID NO: 6140548 - DNA, 20 bp, Homo sapiens
ctcactgaggccatcagggc

SEQ ID NO: 6140549 - DNA, 22 bp, Homo sapiens
ctcactgatatattttccaggg

SEQ ID NO: 6140550 - DNA, 15 bp, Homo sapiens
ctcactgattctcta

SEQ ID NO: 6140551 - DNA, 14 bp, Homo sapiens
ctcactgcaacctc

SEQ ID NO: 6140552 - DNA, 19 bp, Homo sapiens
ctcactgcaacctccacct

SEQ ID NO: 6140553 - DNA, 21 bp, Homo sapiens
ctcactgcaacctccgcctct

SEQ ID NO: 6140554 - DNA, 20 bp, Homo sapiens
ctcactgcaacctctgcctc

SEQ ID NO: 6140555 - DNA, 21 bp, Homo sapiens
ctcactgcaacctctgcctcc

SEQ ID NO: 6140556 - DNA, 22 bp, Homo sapiens
ctcactgcaacctctgcctccc

SEQ ID NO: 6140557 - DNA, 18 bp, Homo sapiens
ctcactgcaaccttcacc

SEQ ID NO: 6140558 - DNA, 19 bp, Homo sapiens
ctcactgcaagctctgcct

SEQ ID NO: 6140559 - DNA, 16 bp, Homo sapiens
ctcactgcagcctctg

SEQ ID NO: 6140560 - DNA, 15 bp, Homo sapiens
ctcactgcagccttg

SEQ ID NO: 6140561 - DNA, 16 bp, Homo sapiens
ctcactgcagccttga

SEQ ID NO: 6140562 - DNA, 16 bp, Homo sapiens
ctcactgcatctttct

SEQ ID NO: 6140563 - DNA, 23 bp, Homo sapiens
ctcactgcatctttctcttccca

SEQ ID NO: 6140564 - DNA, 21 bp, Homo sapiens
ctcactgccactaaaatccac

SEQ ID NO: 6140565 - DNA, 18 bp, Homo sapiens
ctcactgccaggccagcc

SEQ ID NO: 6140566 - DNA, 21 bp, Homo sapiens
ctcactgccatggaattccct

SEQ ID NO: 6140567 - DNA, 22 bp, Homo sapiens
ctcactgccatggaattccctc

SEQ ID NO: 6140568 - DNA, 22 bp, Homo sapiens
ctcactgccccaccagccacct

SEQ ID NO: 6140569 - DNA, 20 bp, Homo sapiens
ctcactgcccgcacaccctc

SEQ ID NO: 6140570 - DNA, 16 bp, Homo sapiens
ctcactgcctgcagct

SEQ ID NO: 6140571 - DNA, 20 bp, Homo sapiens
ctcactgcctgcagctgaga

SEQ ID NO: 6140572 - DNA, 21 bp, Homo sapiens
ctcactgcctggtaaaattaa

SEQ ID NO: 6140573 - DNA, 22 bp, Homo sapiens
ctcactgctaagaatatttgaa

SEQ ID NO: 6140574 - DNA, 14 bp, Homo sapiens
ctcactgctcaaga

SEQ ID NO: 6140575 - DNA, 20 bp, Homo sapiens
ctcactgctcaagaagacat

SEQ ID NO: 6140576 - DNA, 21 bp, Homo sapiens
ctcactgctcaagaagacatg

SEQ ID NO: 6140577 - DNA, 17 bp, Homo sapiens
ctcactgctccctgaag

SEQ ID NO: 6140578 - DNA, 12 bp, Homo sapiens
ctcactgctgtc

SEQ ID NO: 6140579 - DNA, 17 bp, Homo sapiens
ctcactgctgtcagcca

SEQ ID NO: 6140580 - DNA, 13 bp, Homo sapiens
ctcactgcttctg

SEQ ID NO: 6140581 - DNA, 20 bp, Homo sapiens
ctcactggcagccccagcac

SEQ ID NO: 6140582 - DNA, 21 bp, Homo sapiens
ctcactggccagtagctgcca

SEQ ID NO: 6140583 - DNA, 20 bp, Homo sapiens
ctcactggcctgccatgcca

SEQ ID NO: 6140584 - DNA, 15 bp, Homo sapiens
ctcactggctctcct

SEQ ID NO: 6140585 - DNA, 20 bp, Homo sapiens
ctcactggctggactggagg

SEQ ID NO: 6140586 - DNA, 13 bp, Homo sapiens
ctcactggctggg

SEQ ID NO: 6140587 - DNA, 15 bp, Homo sapiens
ctcactggctgggag

SEQ ID NO: 6140588 - DNA, 15 bp, Homo sapiens
ctcactggctggggc

SEQ ID NO: 6140589 - DNA, 17 bp, Homo sapiens
ctcactggctggggcag

SEQ ID NO: 6140590 - DNA, 22 bp, Homo sapiens
ctcactggctggggcagagggg

SEQ ID NO: 6140591 - DNA, 18 bp, Homo sapiens
ctcactgggaagctccca

SEQ ID NO: 6140592 - DNA, 20 bp, Homo sapiens
ctcactgggaagctcccacc

SEQ ID NO: 6140593 - DNA, 18 bp, Homo sapiens
ctcactgggcctttccag

SEQ ID NO: 6140594 - DNA, 15 bp, Homo sapiens
ctcactgggtgtggc

SEQ ID NO: 6140595 - DNA, 19 bp, Homo sapiens
ctcactggtccatttctca

SEQ ID NO: 6140596 - DNA, 22 bp, Homo sapiens
ctcactggtgcatttaaaatgg

SEQ ID NO: 6140597 - DNA, 23 bp, Homo sapiens
ctcactggttttacttacaaaaa

SEQ ID NO: 6140598 - DNA, 21 bp, Homo sapiens
ctcactggttttggccacccc

SEQ ID NO: 6140599 - DNA, 22 bp, Homo sapiens
ctcactggttttggccacccct

SEQ ID NO: 6140600 - DNA, 21 bp, Homo sapiens
ctcactgtattagagcgccag

SEQ ID NO: 6140601 - DNA, 23 bp, Homo sapiens
ctcactgtattagagcgccagct

SEQ ID NO: 6140602 - DNA, 17 bp, Homo sapiens
ctcactgtcagtcccac

SEQ ID NO: 6140603 - DNA, 18 bp, Homo sapiens
ctcactgtcatctgccag

SEQ ID NO: 6140604 - DNA, 19 bp, Homo sapiens
ctcactgtcatctgccagg

SEQ ID NO: 6140605 - DNA, 22 bp, Homo sapiens
ctcactgtccaatatgaaaacc

SEQ ID NO: 6140606 - DNA, 12 bp, Homo sapiens
ctcactgtcctg

SEQ ID NO: 6140607 - DNA, 13 bp, Homo sapiens
ctcactgtctgag

SEQ ID NO: 6140608 - DNA, 15 bp, Homo sapiens
ctcactgtctgctgg

SEQ ID NO: 6140609 - DNA, 18 bp, Homo sapiens
ctcactgtctgctggcaa

SEQ ID NO: 6140610 - DNA, 11 bp, Homo sapiens
ctcactgtgac

SEQ ID NO: 6140611 - DNA, 22 bp, Homo sapiens
ctcactgtgatcaatattttta

SEQ ID NO: 6140612 - DNA, 23 bp, Homo sapiens
ctcactgtgggaaggccagctgc

SEQ ID NO: 6140613 - DNA, 20 bp, Homo sapiens
ctcactgttccctctgctcc

SEQ ID NO: 6140614 - DNA, 21 bp, Homo sapiens
ctcactgttccctctgctcct

SEQ ID NO: 6140615 - DNA, 17 bp, Homo sapiens
ctcactgttgcagtggc

SEQ ID NO: 6140616 - DNA, 14 bp, Homo sapiens
ctcactgttgccca

SEQ ID NO: 6140617 - DNA, 16 bp, Homo sapiens
ctcactgttgcccagg

SEQ ID NO: 6140618 - DNA, 17 bp, Homo sapiens
ctcactgttgcccaggc

SEQ ID NO: 6140619 - DNA, 18 bp, Homo sapiens
ctcactgttgcccaggct

SEQ ID NO: 6140620 - DNA, 21 bp, Homo sapiens
ctcacttaaacaatgtcctct

SEQ ID NO: 6140621 - DNA, 22 bp, Homo sapiens
ctcacttaattctcattatgaa

SEQ ID NO: 6140622 - DNA, 23 bp, Homo sapiens
ctcacttacataaagctcccttg

SEQ ID NO: 6140623 - DNA, 14 bp, Homo sapiens
ctcacttataccaa

SEQ ID NO: 6140624 - DNA, 15 bp, Homo sapiens
ctcacttatctgata

SEQ ID NO: 6140625 - DNA, 15 bp, Homo sapiens
ctcacttcaatgaac

SEQ ID NO: 6140626 - DNA, 14 bp, Homo sapiens
ctcacttcaccctg

SEQ ID NO: 6140627 - DNA, 15 bp, Homo sapiens
ctcacttcagttgtg

SEQ ID NO: 6140628 - DNA, 21 bp, Homo sapiens
ctcacttcagttgtggcctca

SEQ ID NO: 6140629 - DNA, 13 bp, Homo sapiens
ctcacttccctgg

SEQ ID NO: 6140630 - DNA, 16 bp, Homo sapiens
ctcacttccctgggaa

SEQ ID NO: 6140631 - DNA, 21 bp, Homo sapiens
ctcacttcctttgcccttcct

SEQ ID NO: 6140632 - DNA, 13 bp, Homo sapiens
ctcacttctaaat

SEQ ID NO: 6140633 - DNA, 14 bp, Homo sapiens
ctcacttctaaatt

SEQ ID NO: 6140634 - DNA, 24 bp, Homo sapiens
ctcacttctagatctcagccattc

SEQ ID NO: 6140635 - DNA, 20 bp, Homo sapiens
ctcacttctgggcttcatct

SEQ ID NO: 6140636 - DNA, 17 bp, Homo sapiens
ctcacttcttccatcca

SEQ ID NO: 6140637 - DNA, 20 bp, Homo sapiens
ctcacttgatgtttcctgga

SEQ ID NO: 6140638 - DNA, 21 bp, Homo sapiens
ctcacttgatgtttcctggaa

SEQ ID NO: 6140639 - DNA, 14 bp, Homo sapiens
ctcacttgattcat

SEQ ID NO: 6140640 - DNA, 18 bp, Homo sapiens
ctcacttgattcatctct

SEQ ID NO: 6140641 - DNA, 23 bp, Homo sapiens
ctcacttgccattgccaggagat

SEQ ID NO: 6140642 - DNA, 15 bp, Homo sapiens
ctcacttgcccacac

SEQ ID NO: 6140643 - DNA, 14 bp, Homo sapiens
ctcacttgccttag

SEQ ID NO: 6140644 - DNA, 17 bp, Homo sapiens
ctcacttggctgtctga

SEQ ID NO: 6140645 - DNA, 18 bp, Homo sapiens
ctcacttgttttatttaa

SEQ ID NO: 6140646 - DNA, 14 bp, Homo sapiens
ctcactttacataa

SEQ ID NO: 6140647 - DNA, 11 bp, Homo sapiens
ctcactttcca

SEQ ID NO: 6140648 - DNA, 14 bp, Homo sapiens
ctcactttccaccc

SEQ ID NO: 6140649 - DNA, 21 bp, Homo sapiens
ctcactttggttttggggtgt

SEQ ID NO: 6140650 - DNA, 12 bp, Homo sapiens
ctcactttgtaa

SEQ ID NO: 6140651 - DNA, 23 bp, Homo sapiens
ctcacttttcaatttgtcatgtt

SEQ ID NO: 6140652 - DNA, 23 bp, Homo sapiens
ctcacttttcacttgtcttgctc

SEQ ID NO: 6140653 - DNA, 16 bp, Homo sapiens
ctcacttttcatcctt

SEQ ID NO: 6140654 - DNA, 15 bp, Homo sapiens
ctcacttttcatctg

SEQ ID NO: 6140655 - DNA, 14 bp, Homo sapiens
ctcacttttcccac

SEQ ID NO: 6140656 - DNA, 17 bp, Homo sapiens
ctcacttttcccactcc

SEQ ID NO: 6140657 - DNA, 18 bp, Homo sapiens
ctcacttttcccactcca

SEQ ID NO: 6140658 - DNA, 19 bp, Homo sapiens
ctcacttttgaatctataa

SEQ ID NO: 6140659 - DNA, 19 bp, Homo sapiens
ctcacttttggaaggtgac

SEQ ID NO: 6140660 - DNA, 18 bp, Homo sapiens
ctcactttttacccagaa

SEQ ID NO: 6140661 - DNA, 14 bp, Homo sapiens
ctcacttttttata

SEQ ID NO: 6140662 - DNA, 18 bp, Homo sapiens
ctcagaaacactggggct

SEQ ID NO: 6140663 - DNA, 19 bp, Homo sapiens
ctcagaaacactggggctg

SEQ ID NO: 6140664 - DNA, 21 bp, Homo sapiens
ctcagaaacactggggctggc

SEQ ID NO: 6140665 - DNA, 18 bp, Homo sapiens
ctcagaaactccatgatg

SEQ ID NO: 6140666 - DNA, 16 bp, Homo sapiens
ctcagaaactcccctg

SEQ ID NO: 6140667 - DNA, 19 bp, Homo sapiens
ctcagaaactcccctgggg

SEQ ID NO: 6140668 - DNA, 20 bp, Homo sapiens
ctcagaaagaagtcagttaa

SEQ ID NO: 6140669 - DNA, 17 bp, Homo sapiens
ctcagaaagaggtctcc

SEQ ID NO: 6140670 - DNA, 21 bp, Homo sapiens
ctgagatggatggacagacag

SEQ ID NO: 6140671 - DNA, 15 bp, Homo sapiens
ctgagatggccctct

SEQ ID NO: 6140672 - DNA, 17 bp, Homo sapiens
ctgagatggccctctgg

SEQ ID NO: 6140673 - DNA, 13 bp, Homo sapiens
ctgagattacagg

SEQ ID NO: 6140674 - DNA, 16 bp, Homo sapiens
ctgagattacaggtgt

SEQ ID NO: 6140675 - DNA, 14 bp, Homo sapiens
ctgagattccagaa

SEQ ID NO: 6140676 - DNA, 17 bp, Homo sapiens
ctgagattctgggaaag

SEQ ID NO: 6140677 - DNA, 21 bp, Homo sapiens
ctgagattctgggaaaggtgc

SEQ ID NO: 6140678 - DNA, 14 bp, Homo sapiens
ctgagattgtgttt

SEQ ID NO: 6140679 - DNA, 15 bp, Homo sapiens
ctgagatttattaaa

SEQ ID NO: 6140680 - DNA, 17 bp, Homo sapiens
ctgagatttattaaaga

SEQ ID NO: 6140681 - DNA, 15 bp, Homo sapiens
ctgagatttcacagg

SEQ ID NO: 6140682 - DNA, 22 bp, Homo sapiens
ctgagatttcatctgctctcct

SEQ ID NO: 6140683 - DNA, 20 bp, Homo sapiens
ctgagatttcttaaatcttt

SEQ ID NO: 6140684 - DNA, 18 bp, Homo sapiens
ctgagatttgtaaatctt

SEQ ID NO: 6140685 - DNA, 22 bp, Homo sapiens
ctgagatttttgatatctcaat

SEQ ID NO: 6140686 - DNA, 18 bp, Homo sapiens
ctgagcaaacaccagtga

SEQ ID NO: 6140687 - DNA, 23 bp, Homo sapiens
ctgagcaacagagtgagaccctg

SEQ ID NO: 6140688 - DNA, 23 bp, Homo sapiens
ctgagcaacctcttcagctggga

SEQ ID NO: 6140689 - DNA, 20 bp, Homo sapiens
ctgagcaactgtgcagcacc

SEQ ID NO: 6140690 - DNA, 18 bp, Homo sapiens
ctgagcaagaccctgtct

SEQ ID NO: 6140691 - DNA, 20 bp, Homo sapiens
ctgagcaagaccctgtctct

SEQ ID NO: 6140692 - DNA, 18 bp, Homo sapiens
ctgagcaagacgccctct

SEQ ID NO: 6140693 - DNA, 20 bp, Homo sapiens
ctgagcaagacgccctctcg

SEQ ID NO: 6140694 - DNA, 12 bp, Homo sapiens
ctgagcaagagc

SEQ ID NO: 6140695 - DNA, 15 bp, Homo sapiens
ctgagcaagagctgg

SEQ ID NO: 6140696 - DNA, 17 bp, Homo sapiens
ctgagcaagagctggca

SEQ ID NO: 6140697 - DNA, 20 bp, Homo sapiens
ctgagcaagagctggcaaag

SEQ ID NO: 6140698 - DNA, 22 bp, Homo sapiens
ctgagcaagatcttgtctccac

SEQ ID NO: 6140699 - DNA, 14 bp, Homo sapiens
ctgagcaaggagtt

SEQ ID NO: 6140700 - DNA, 24 bp, Homo sapiens
ctgagcaaggagtttaaatgagac

SEQ ID NO: 6140701 - DNA, 13 bp, Homo sapiens
ctgagcaataact

SEQ ID NO: 6140702 - DNA, 17 bp, Homo sapiens
ctgagcacacaacaggc

SEQ ID NO: 6140703 - DNA, 21 bp, Homo sapiens
ctgagcacagacggaggaagc

SEQ ID NO: 6140704 - DNA, 15 bp, Homo sapiens
ctgagcacaggtgac

SEQ ID NO: 6140705 - DNA, 18 bp, Homo sapiens
ctgagcacagtcaggggc

SEQ ID NO: 6140706 - DNA, 20 bp, Homo sapiens
ctgagcacatagtgtcctgc

SEQ ID NO: 6140707 - DNA, 14 bp, Homo sapiens
ctgagcaccccctc

SEQ ID NO: 6140708 - DNA, 13 bp, Homo sapiens
ctgagcacccgct

SEQ ID NO: 6140709 - DNA, 18 bp, Homo sapiens
ctgagcacccgctgacat

SEQ ID NO: 6140710 - DNA, 17 bp, Homo sapiens
ctgagcaccgtgtcaag

SEQ ID NO: 6140711 - DNA, 18 bp, Homo sapiens
ctgagcacctcccagccc

SEQ ID NO: 6140712 - DNA, 14 bp, Homo sapiens
ctgagcacctctca

SEQ ID NO: 6140713 - DNA, 15 bp, Homo sapiens
ctgagcacctctcag

SEQ ID NO: 6140714 - DNA, 16 bp, Homo sapiens
ctgagcacctctcaga

SEQ ID NO: 6140715 - DNA, 21 bp, Homo sapiens
ctgagcacctctcagagcaag

SEQ ID NO: 6140716 - DNA, 16 bp, Homo sapiens
ctgagcacgctaccaa

SEQ ID NO: 6140717 - DNA, 14 bp, Homo sapiens
ctgagcactcctgg

SEQ ID NO: 6140718 - DNA, 14 bp, Homo sapiens
ctgagcactgccag

SEQ ID NO: 6140719 - DNA, 19 bp, Homo sapiens
ctgagcactgccaggaggg

SEQ ID NO: 6140720 - DNA, 12 bp, Homo sapiens
ctgagcactgtt

SEQ ID NO: 6140721 - DNA, 20 bp, Homo sapiens
ctgagcactgtttatacact

SEQ ID NO: 6140722 - DNA, 19 bp, Homo sapiens
ctgagcagaatactggtct

SEQ ID NO: 6140723 - DNA, 22 bp, Homo sapiens
ctgagcagacagggcgtcctct

SEQ ID NO: 6140724 - DNA, 22 bp, Homo sapiens
ctgagcagactggtgagcagac

SEQ ID NO: 6140725 - DNA, 22 bp, Homo sapiens
ctgagcagagtcttgctacctc

SEQ ID NO: 6140726 - DNA, 21 bp, Homo sapiens
ctgagcagatcgtgccgtgga

SEQ ID NO: 6140727 - DNA, 18 bp, Homo sapiens
ctgagcagcccagcacaa

SEQ ID NO: 6140728 - DNA, 11 bp, Homo sapiens
ctgagcagccg

SEQ ID NO: 6140729 - DNA, 17 bp, Homo sapiens
ctgagcagccgccagct

SEQ ID NO: 6140730 - DNA, 18 bp, Homo sapiens
ctgagcagccgccagctg

SEQ ID NO: 6140731 - DNA, 20 bp, Homo sapiens
ctgagcagccgccagctggg

SEQ ID NO: 6140732 - DNA, 22 bp, Homo sapiens
ctgagcagccgccagctgggag

SEQ ID NO: 6140733 - DNA, 20 bp, Homo sapiens
ctgagcagcctctgccaggc

SEQ ID NO: 6140734 - DNA, 21 bp, Homo sapiens
ctgagcagcctctgccaggcc

SEQ ID NO: 6140735 - DNA, 24 bp, Homo sapiens
ctgagcagcctctgccaggcctgt

SEQ ID NO: 6140736 - DNA, 15 bp, Homo sapiens
ctgagcagcctctgg

SEQ ID NO: 6140737 - DNA, 17 bp, Homo sapiens
ctgagcagcctctggac

SEQ ID NO: 6140738 - DNA, 12 bp, Homo sapiens
ctgagcaggcca

SEQ ID NO: 6140739 - DNA, 23 bp, Homo sapiens
ctgagcaggccacacttcaaact

SEQ ID NO: 6140740 - DNA, 20 bp, Homo sapiens
ctgagcaggcccgacagaga

SEQ ID NO: 6140741 - DNA, 16 bp, Homo sapiens
ctgagcagggatctgc

SEQ ID NO: 6140742 - DNA, 12 bp, Homo sapiens
ctgagcagggcc

SEQ ID NO: 6140743 - DNA, 13 bp, Homo sapiens
ctgagcagggccg

SEQ ID NO: 6140744 - DNA, 16 bp, Homo sapiens
ctgagcaggggcaggc

SEQ ID NO: 6140745 - DNA, 18 bp, Homo sapiens
ctgagcaggggcaggcgc

SEQ ID NO: 6140746 - DNA, 18 bp, Homo sapiens
ctgagcaggggcccctgg

SEQ ID NO: 6140747 - DNA, 13 bp, Homo sapiens
ctgagcagggtcc

SEQ ID NO: 6140748 - DNA, 18 bp, Homo sapiens
ctgagcagggtccacagc

SEQ ID NO: 6140749 - DNA, 21 bp, Homo sapiens
ctgagcagggtccacagctgg

SEQ ID NO: 6140750 - DNA, 22 bp, Homo sapiens
ctgagcagggtccacagctgga

SEQ ID NO: 6140751 - DNA, 23 bp, Homo sapiens
ctgagcagggtccacagctggaa

SEQ ID NO: 6140752 - DNA, 14 bp, Homo sapiens
ctgagcaggtacat

SEQ ID NO: 6140753 - DNA, 21 bp, Homo sapiens
ctgagcaggtacatttctgat

SEQ ID NO: 6140754 - DNA, 17 bp, Homo sapiens
ctgagcagtgatattct

SEQ ID NO: 6140755 - DNA, 19 bp, Homo sapiens
ctgagcagtgcctcttgtc

SEQ ID NO: 6140756 - DNA, 17 bp, Homo sapiens
ctgagcagttgttatat

SEQ ID NO: 6140757 - DNA, 22 bp, Homo sapiens
ctgagcagtttcattgtgatca

SEQ ID NO: 6140758 - DNA, 21 bp, Homo sapiens
ctgagcagttttccaggaggc

SEQ ID NO: 6140759 - DNA, 20 bp, Homo sapiens
ctgagcatccagacctgagc

SEQ ID NO: 6140760 - DNA, 15 bp, Homo sapiens
ctgagcatcctggtt

SEQ ID NO: 6140761 - DNA, 21 bp, Homo sapiens
ctgagcatgatgggaataggg

SEQ ID NO: 6140762 - DNA, 20 bp, Homo sapiens
ctgagcatggggcgctccca

SEQ ID NO: 6140763 - DNA, 22 bp, Homo sapiens
ctgagcatggggcgctcccact

SEQ ID NO: 6140764 - DNA, 16 bp, Homo sapiens
ctgagcattcaggcag

SEQ ID NO: 6140765 - DNA, 18 bp, Homo sapiens
ctgagcattcaggcagca

SEQ ID NO: 6140766 - DNA, 22 bp, Homo sapiens
ctgagcattcaggcagcactga

SEQ ID NO: 6140767 - DNA, 23 bp, Homo sapiens
ctgagccaaacacactgtaaata

SEQ ID NO: 6140768 - DNA, 23 bp, Homo sapiens
ctgagccaaagccagagtggcca

SEQ ID NO: 6140769 - DNA, 15 bp, Homo sapiens
ctgagccaaccttgc

SEQ ID NO: 6140770 - DNA, 22 bp, Homo sapiens
ctgagccaagctagaattccct

SEQ ID NO: 6140771 - DNA, 17 bp, Homo sapiens
ctgagccaaggaggcct

SEQ ID NO: 6140772 - DNA, 17 bp, Homo sapiens
ctgagccaagggaggga

SEQ ID NO: 6140773 - DNA, 22 bp, Homo sapiens
ctgagccaagggagggaagggc

SEQ ID NO: 6140774 - DNA, 19 bp, Homo sapiens
ctgagccacactgaaaagg

SEQ ID NO: 6140775 - DNA, 19 bp, Homo sapiens
ctgagccacagcagcattt

SEQ ID NO: 6140776 - DNA, 20 bp, Homo sapiens
ctgagccacagtggggccca

SEQ ID NO: 6140777 - DNA, 21 bp, Homo sapiens
ctgagccacagtggggcccat

SEQ ID NO: 6140778 - DNA, 21 bp, Homo sapiens
ctgagccaccgcgagggcctg

SEQ ID NO: 6140779 - DNA, 14 bp, Homo sapiens
ctgagccacctgcc

SEQ ID NO: 6140780 - DNA, 17 bp, Homo sapiens
ctgagccacggaccgca

SEQ ID NO: 6140781 - DNA, 13 bp, Homo sapiens
ctgagccactgga

SEQ ID NO: 6140782 - DNA, 16 bp, Homo sapiens
ctgagccagaaacgca

SEQ ID NO: 6140783 - DNA, 22 bp, Homo sapiens
ctgagccagaaacgcagattgg

SEQ ID NO: 6140784 - DNA, 13 bp, Homo sapiens
ctgagccagatta

SEQ ID NO: 6140785 - DNA, 15 bp, Homo sapiens
ctgagccagattaca

SEQ ID NO: 6140786 - DNA, 20 bp, Homo sapiens
ctgagccagattccccagga

SEQ ID NO: 6140787 - DNA, 20 bp, Homo sapiens
ctgagccagatttcactctc

SEQ ID NO: 6140788 - DNA, 21 bp, Homo sapiens
ctgagccagatttcactctcc

SEQ ID NO: 6140789 - DNA, 14 bp, Homo sapiens
ctgagccaggagcc

SEQ ID NO: 6140790 - DNA, 19 bp, Homo sapiens
ctgagccaggagcctcctg

SEQ ID NO: 6140791 - DNA, 18 bp, Homo sapiens
ctgagccagggtctccag

SEQ ID NO: 6140792 - DNA, 22 bp, Homo sapiens
ctgagccagggtctccagaaag

SEQ ID NO: 6140793 - DNA, 17 bp, Homo sapiens
ctgagccatcatttcct

SEQ ID NO: 6140794 - DNA, 22 bp, Homo sapiens
ctgagccatccagcatgaaaga

SEQ ID NO: 6140795 - DNA, 14 bp, Homo sapiens
ctgagccatgagga

SEQ ID NO: 6140796 - DNA, 15 bp, Homo sapiens
ctgagccatgaggag

SEQ ID NO: 6140797 - DNA, 15 bp, Homo sapiens
ctgagcccaaccagg

SEQ ID NO: 6140798 - DNA, 22 bp, Homo sapiens
ctgagcccaaccaggccctgcc

SEQ ID NO: 6140799 - DNA, 13 bp, Homo sapiens
ctgagcccaaccc

SEQ ID NO: 6140800 - DNA, 21 bp, Homo sapiens
ctgagcccaagctaagccatc

SEQ ID NO: 6140801 - DNA, 10 bp, Homo sapiens
ctgagcccac

SEQ ID NO: 6140802 - DNA, 22 bp, Homo sapiens
ctgagcccaccagggacacctc

SEQ ID NO: 6140803 - DNA, 12 bp, Homo sapiens
ctgagcccactg

SEQ ID NO: 6140804 - DNA, 16 bp, Homo sapiens
ctgagcccagagaagc

SEQ ID NO: 6140805 - DNA, 17 bp, Homo sapiens
ctgagcccagagaagct

SEQ ID NO: 6140806 - DNA, 13 bp, Homo sapiens
ctgagcccagcca

SEQ ID NO: 6140807 - DNA, 14 bp, Homo sapiens
ctgagcccagccac

SEQ ID NO: 6140808 - DNA, 16 bp, Homo sapiens
ctgagcccagccacct

SEQ ID NO: 6140809 - DNA, 20 bp, Homo sapiens
ctgagcccagccacctccca

SEQ ID NO: 6140810 - DNA, 15 bp, Homo sapiens
ctgagcccagctgcc

SEQ ID NO: 6140811 - DNA, 23 bp, Homo sapiens
ctgagcccaggagctgagtcacc

SEQ ID NO: 6140812 - DNA, 19 bp, Homo sapiens
ctgagcccaggccgttccc

SEQ ID NO: 6140813 - DNA, 12 bp, Homo sapiens
ctgagcccaggg

SEQ ID NO: 6140814 - DNA, 15 bp, Homo sapiens
ctgagcccagggagg

SEQ ID NO: 6140815 - DNA, 16 bp, Homo sapiens
ctgagcccatgttctg

SEQ ID NO: 6140816 - DNA, 23 bp, Homo sapiens
ctgagccccacctctccaagtct

SEQ ID NO: 6140817 - DNA, 12 bp, Homo sapiens
ctgagccccagc

SEQ ID NO: 6140818 - DNA, 15 bp, Homo sapiens
ctgagccccagggag

SEQ ID NO: 6140819 - DNA, 21 bp, Homo sapiens
ctgagccccagggtgcccaga

SEQ ID NO: 6140820 - DNA, 12 bp, Homo sapiens
ctgagcccccac

SEQ ID NO: 6140821 - DNA, 13 bp, Homo sapiens
ctgagcccccacc

SEQ ID NO: 6140822 - DNA, 14 bp, Homo sapiens
ctgagcccccaccg

SEQ ID NO: 6140823 - DNA, 17 bp, Homo sapiens
ctgagcccccagcttcc

SEQ ID NO: 6140824 - DNA, 23 bp, Homo sapiens
ctgagcccccagcttccagcagg

SEQ ID NO: 6140825 - DNA, 17 bp, Homo sapiens
ctgagcccccggctagt

SEQ ID NO: 6140826 - DNA, 17 bp, Homo sapiens
ctgagccccctctcctg

SEQ ID NO: 6140827 - DNA, 14 bp, Homo sapiens
ctgagccccctgag

SEQ ID NO: 6140828 - DNA, 20 bp, Homo sapiens
ctgagccccctgcacccacc

SEQ ID NO: 6140829 - DNA, 21 bp, Homo sapiens
ctgagccccctgtgcccaccc

SEQ ID NO: 6140830 - DNA, 18 bp, Homo sapiens
ctgagccccgcagacctc

SEQ ID NO: 6140831 - DNA, 21 bp, Homo sapiens
ctgagccccgcagacctcccc

SEQ ID NO: 6140832 - DNA, 20 bp, Homo sapiens
ctgagccccgccctcttcct

SEQ ID NO: 6140833 - DNA, 22 bp, Homo sapiens
ctgagccccgccctcttcctga

SEQ ID NO: 6140834 - DNA, 13 bp, Homo sapiens
ctgagcccctacc

SEQ ID NO: 6140835 - DNA, 16 bp, Homo sapiens
ctgagcccctcctctc

SEQ ID NO: 6140836 - DNA, 19 bp, Homo sapiens
ctgagcccctcctctcctc

SEQ ID NO: 6140837 - DNA, 15 bp, Homo sapiens
ctgagcccctggtct

SEQ ID NO: 6140838 - DNA, 13 bp, Homo sapiens
ctgagcccctgtc

SEQ ID NO: 6140839 - DNA, 15 bp, Homo sapiens
ctgagcccctgtcta

SEQ ID NO: 6140840 - DNA, 22 bp, Homo sapiens
ctgagcccctgtctagagaggg

SEQ ID NO: 6140841 - DNA, 23 bp, Homo sapiens
ctgagcccctgtctagagaggga

SEQ ID NO: 6140842 - DNA, 13 bp, Homo sapiens
ctgagccccttcc

SEQ ID NO: 6140843 - DNA, 19 bp, Homo sapiens
ctgagccccttccttgctc

SEQ ID NO: 6140844 - DNA, 22 bp, Homo sapiens
ctgagcccctttgcctgtcaag

SEQ ID NO: 6140845 - DNA, 20 bp, Homo sapiens
ctgagcccggaaactccaca

SEQ ID NO: 6140846 - DNA, 23 bp, Homo sapiens
ctgagcccggccctcccccagct

SEQ ID NO: 6140847 - DNA, 21 bp, Homo sapiens
ctcagaaagaggtctccccat

SEQ ID NO: 6140848 - DNA, 22 bp, Homo sapiens
ctcagaaagatttgatgggcca

SEQ ID NO: 6140849 - DNA, 17 bp, Homo sapiens
ctcagaaagccaacatg

SEQ ID NO: 6140850 - DNA, 13 bp, Homo sapiens
ctcagaaaggcaa

SEQ ID NO: 6140851 - DNA, 10 bp, Homo sapiens
ctcagaaagt

SEQ ID NO: 6140852 - DNA, 20 bp, Homo sapiens
ctcagaaagtgcagcatgga

SEQ ID NO: 6140853 - DNA, 15 bp, Homo sapiens
ctcagaaagtgcctg

SEQ ID NO: 6140854 - DNA, 16 bp, Homo sapiens
ctcagaaagtgcctga

SEQ ID NO: 6140855 - DNA, 17 bp, Homo sapiens
ctcagaaatctgtttga

SEQ ID NO: 6140856 - DNA, 19 bp, Homo sapiens
ctcagaaatggacaaagaa

SEQ ID NO: 6140857 - DNA, 17 bp, Homo sapiens
ctcagaaatttttattt

SEQ ID NO: 6140858 - DNA, 17 bp, Homo sapiens
ctcagaacatactgatt

SEQ ID NO: 6140859 - DNA, 21 bp, Homo sapiens
ctcagaacatactgattggga

SEQ ID NO: 6140860 - DNA, 17 bp, Homo sapiens
ctcagaaccaaatcttt

SEQ ID NO: 6140861 - DNA, 14 bp, Homo sapiens
ctcagaaccacagc

SEQ ID NO: 6140862 - DNA, 23 bp, Homo sapiens
ctcagaaccatttaagagactct

SEQ ID NO: 6140863 - DNA, 13 bp, Homo sapiens
ctcagaacccagg

SEQ ID NO: 6140864 - DNA, 14 bp, Homo sapiens
ctcagaacccttgg

SEQ ID NO: 6140865 - DNA, 14 bp, Homo sapiens
ctcagaaccttgtc

SEQ ID NO: 6140866 - DNA, 18 bp, Homo sapiens
ctcagaaccttgtcccag

SEQ ID NO: 6140867 - DNA, 23 bp, Homo sapiens
ctcagaaccttgtcccagccagt

SEQ ID NO: 6140868 - DNA, 17 bp, Homo sapiens
ctcagaacttgctgctg

SEQ ID NO: 6140869 - DNA, 19 bp, Homo sapiens
ctcagaacttgctgctgtc

SEQ ID NO: 6140870 - DNA, 13 bp, Homo sapiens
ctcagaagaaaga

SEQ ID NO: 6140871 - DNA, 13 bp, Homo sapiens
ctcagaagcacag

SEQ ID NO: 6140872 - DNA, 13 bp, Homo sapiens
ctcagaagccagt

SEQ ID NO: 6140873 - DNA, 17 bp, Homo sapiens
ctcagaagccagtctgc

SEQ ID NO: 6140874 - DNA, 20 bp, Homo sapiens
ctcagaagccagtctgcgtc

SEQ ID NO: 6140875 - DNA, 15 bp, Homo sapiens
ctcagaagcctcgac

SEQ ID NO: 6140876 - DNA, 17 bp, Homo sapiens
ctcagaagcctctgggt

SEQ ID NO: 6140877 - DNA, 13 bp, Homo sapiens
ctcagaagcctgg

SEQ ID NO: 6140878 - DNA, 16 bp, Homo sapiens
ctcagaagcctggggg

SEQ ID NO: 6140879 - DNA, 20 bp, Homo sapiens
ctcagaagcctgggggcctg

SEQ ID NO: 6140880 - DNA, 13 bp, Homo sapiens
ctcagaagccttc

SEQ ID NO: 6140881 - DNA, 13 bp, Homo sapiens
ctcagaaggcagg

SEQ ID NO: 6140882 - DNA, 14 bp, Homo sapiens
ctcagaaggctctt

SEQ ID NO: 6140883 - DNA, 15 bp, Homo sapiens
ctcagaagtgaaaaa

SEQ ID NO: 6140884 - DNA, 22 bp, Homo sapiens
ctcagaagtgaaaatcttggag

SEQ ID NO: 6140885 - DNA, 22 bp, Homo sapiens
ctcagaagtgcatctggagaga

SEQ ID NO: 6140886 - DNA, 16 bp, Homo sapiens
ctcagaataactacct

SEQ ID NO: 6140887 - DNA, 17 bp, Homo sapiens
ctcagaataactacctc

SEQ ID NO: 6140888 - DNA, 20 bp, Homo sapiens
ctcagaataactacctcctc

SEQ ID NO: 6140889 - DNA, 21 bp, Homo sapiens
ctcagaataactacctcctca

SEQ ID NO: 6140890 - DNA, 19 bp, Homo sapiens
ctcagaataaggcaggcat

SEQ ID NO: 6140891 - DNA, 18 bp, Homo sapiens
ctcagaatattgtctgcc

SEQ ID NO: 6140892 - DNA, 15 bp, Homo sapiens
ctcagaatccaaaga

SEQ ID NO: 6140893 - DNA, 11 bp, Homo sapiens
ctcagaatcta

SEQ ID NO: 6140894 - DNA, 17 bp, Homo sapiens
ctcagaatctcaaataa

SEQ ID NO: 6140895 - DNA, 20 bp, Homo sapiens
ctcagaatgggggctttcgg

SEQ ID NO: 6140896 - DNA, 17 bp, Homo sapiens
ctcagaatgtaaaagaa

SEQ ID NO: 6140897 - DNA, 20 bp, Homo sapiens
ctcagaattcggtgtgctgc

SEQ ID NO: 6140898 - DNA, 19 bp, Homo sapiens
ctcagaattgcacatctaa

SEQ ID NO: 6140899 - DNA, 16 bp, Homo sapiens
ctcagacacctagact

SEQ ID NO: 6140900 - DNA, 19 bp, Homo sapiens
ctcagacagccccctgccc

SEQ ID NO: 6140901 - DNA, 14 bp, Homo sapiens
ctcagacatttata

SEQ ID NO: 6140902 - DNA, 14 bp, Homo sapiens
ctcagaccagagaa

SEQ ID NO: 6140903 - DNA, 15 bp, Homo sapiens
ctcagaccagagaag

SEQ ID NO: 6140904 - DNA, 18 bp, Homo sapiens
ctcagaccagctcccaga

SEQ ID NO: 6140905 - DNA, 19 bp, Homo sapiens
ctcagaccagctcccagat

SEQ ID NO: 6140906 - DNA, 22 bp, Homo sapiens
ctcagaccaggtggaattactt

SEQ ID NO: 6140907 - DNA, 13 bp, Homo sapiens
ctcagacccagcg

SEQ ID NO: 6140908 - DNA, 12 bp, Homo sapiens
ctcagacccagg

SEQ ID NO: 6140909 - DNA, 18 bp, Homo sapiens
ctcagacccaggagtcca

SEQ ID NO: 6140910 - DNA, 20 bp, Homo sapiens
ctcagacccaggagtccagc

SEQ ID NO: 6140911 - DNA, 22 bp, Homo sapiens
ctcagacccaggagtccagccc

SEQ ID NO: 6140912 - DNA, 20 bp, Homo sapiens
ctcagacccaggggtccagg

SEQ ID NO: 6140913 - DNA, 12 bp, Homo sapiens
ctcagaccccac

SEQ ID NO: 6140914 - DNA, 15 bp, Homo sapiens
ctcagacccccactc

SEQ ID NO: 6140915 - DNA, 16 bp, Homo sapiens
ctcagacccccactct

SEQ ID NO: 6140916 - DNA, 23 bp, Homo sapiens
ctcagacccccactctcattccc

SEQ ID NO: 6140917 - DNA, 16 bp, Homo sapiens
ctcagaccccctcagc

SEQ ID NO: 6140918 - DNA, 21 bp, Homo sapiens
ctcagacccctcagccccagc

SEQ ID NO: 6140919 - DNA, 14 bp, Homo sapiens
ctcagaccctgctt

SEQ ID NO: 6140920 - DNA, 23 bp, Homo sapiens
ctcagacccttgaagatgtagct

SEQ ID NO: 6140921 - DNA, 15 bp, Homo sapiens
ctcagaccctttctt

SEQ ID NO: 6140922 - DNA, 16 bp, Homo sapiens
ctcagaccgtcttcct

SEQ ID NO: 6140923 - DNA, 17 bp, Homo sapiens
ctcagaccgtcttcctc

SEQ ID NO: 6140924 - DNA, 21 bp, Homo sapiens
ctcagaccgtcttcctccaac

SEQ ID NO: 6140925 - DNA, 22 bp, Homo sapiens
ctcagaccgtcttcctccaacc

SEQ ID NO: 6140926 - DNA, 23 bp, Homo sapiens
ctcagaccgtcttcctccaaccc

SEQ ID NO: 6140927 - DNA, 11 bp, Homo sapiens
ctcagacctcc

SEQ ID NO: 6140928 - DNA, 14 bp, Homo sapiens
ctcagacgactagc

SEQ ID NO: 6140929 - DNA, 16 bp, Homo sapiens
ctcagacgactagccc

SEQ ID NO: 6140930 - DNA, 22 bp, Homo sapiens
ctcagacgactagcccaggacc

SEQ ID NO: 6140931 - DNA, 21 bp, Homo sapiens
ctcagacgagacaccctaact

SEQ ID NO: 6140932 - DNA, 23 bp, Homo sapiens
ctcagacgagacaccctaactct

SEQ ID NO: 6140933 - DNA, 22 bp, Homo sapiens
ctcagacggtggaatatttgga

SEQ ID NO: 6140934 - DNA, 12 bp, Homo sapiens
ctcagactcaga

SEQ ID NO: 6140935 - DNA, 14 bp, Homo sapiens
ctcagactcagagg

SEQ ID NO: 6140936 - DNA, 19 bp, Homo sapiens
ctcagactcagaggtccag

SEQ ID NO: 6140937 - DNA, 23 bp, Homo sapiens
ctcagactcctggcttcatgtgg

SEQ ID NO: 6140938 - DNA, 16 bp, Homo sapiens
ctcagactctaaacac

SEQ ID NO: 6140939 - DNA, 18 bp, Homo sapiens
ctcagactctaagaaaga

SEQ ID NO: 6140940 - DNA, 19 bp, Homo sapiens
ctcagactctaagaaagaa

SEQ ID NO: 6140941 - DNA, 16 bp, Homo sapiens
ctcagactgatttctt

SEQ ID NO: 6140942 - DNA, 17 bp, Homo sapiens
ctcagactgatttcttg

SEQ ID NO: 6140943 - DNA, 18 bp, Homo sapiens
ctcagactgcacccagga

SEQ ID NO: 6140944 - DNA, 21 bp, Homo sapiens
ctcagactgcacccaggaggg

SEQ ID NO: 6140945 - DNA, 16 bp, Homo sapiens
ctcagactgccaaaga

SEQ ID NO: 6140946 - DNA, 14 bp, Homo sapiens
ctcagactgctcaa

SEQ ID NO: 6140947 - DNA, 13 bp, Homo sapiens
ctcagactgggca

SEQ ID NO: 6140948 - DNA, 22 bp, Homo sapiens
ctcagactgggcactggggcct

SEQ ID NO: 6140949 - DNA, 17 bp, Homo sapiens
ctcagacttttgtacat

SEQ ID NO: 6140950 - DNA, 17 bp, Homo sapiens
ctcagagaaggaaaaga

SEQ ID NO: 6140951 - DNA, 23 bp, Homo sapiens
ctcagagacaccaaactgccaaa

SEQ ID NO: 6140952 - DNA, 12 bp, Homo sapiens
ctcagagacagc

SEQ ID NO: 6140953 - DNA, 19 bp, Homo sapiens
ctcagagaccagcactcag

SEQ ID NO: 6140954 - DNA, 24 bp, Homo sapiens
ctcagagaccagcactcagcctca

SEQ ID NO: 6140955 - DNA, 22 bp, Homo sapiens
ctcagagactgcaagctgcttg

SEQ ID NO: 6140956 - DNA, 22 bp, Homo sapiens
ctcagagaggacaaaataaagt

SEQ ID NO: 6140957 - DNA, 13 bp, Homo sapiens
ctcagagaggcat

SEQ ID NO: 6140958 - DNA, 18 bp, Homo sapiens
ctcagagagggtgggagt

SEQ ID NO: 6140959 - DNA, 19 bp, Homo sapiens
ctcagagagggtgggagtg

SEQ ID NO: 6140960 - DNA, 23 bp, Homo sapiens
ctcagagagggtgggagtgggcc

SEQ ID NO: 6140961 - DNA, 23 bp, Homo sapiens
ctcagagagtacactgtgtctct

SEQ ID NO: 6140962 - DNA, 20 bp, Homo sapiens
ctcagagagttgtctgtcca

SEQ ID NO: 6140963 - DNA, 19 bp, Homo sapiens
ctcagagatattgtgagga

SEQ ID NO: 6140964 - DNA, 17 bp, Homo sapiens
ctcagagatctcccttc

SEQ ID NO: 6140965 - DNA, 18 bp, Homo sapiens
ctcagagatctcccttct

SEQ ID NO: 6140966 - DNA, 19 bp, Homo sapiens
ctcagagatctcccttctc

SEQ ID NO: 6140967 - DNA, 17 bp, Homo sapiens
ctcagagcaagcctttg

SEQ ID NO: 6140968 - DNA, 14 bp, Homo sapiens
ctcagagcagagca

SEQ ID NO: 6140969 - DNA, 14 bp, Homo sapiens
ctcagagcagcaga

SEQ ID NO: 6140970 - DNA, 19 bp, Homo sapiens
ctcagagcagcctctgtcc

SEQ ID NO: 6140971 - DNA, 14 bp, Homo sapiens
ctcagagcatgatg

SEQ ID NO: 6140972 - DNA, 20 bp, Homo sapiens
ctcagagcatttaaggaaac

SEQ ID NO: 6140973 - DNA, 14 bp, Homo sapiens
ctcagagccccgca

SEQ ID NO: 6140974 - DNA, 20 bp, Homo sapiens
ctcagagccccgccccaccc

SEQ ID NO: 6140975 - DNA, 17 bp, Homo sapiens
ctcagagcccctccctg

SEQ ID NO: 6140976 - DNA, 14 bp, Homo sapiens
ctcagagccctgcc

SEQ ID NO: 6140977 - DNA, 15 bp, Homo sapiens
ctcagagccctgccc

SEQ ID NO: 6140978 - DNA, 18 bp, Homo sapiens
ctcagagccctgccctgc

SEQ ID NO: 6140979 - DNA, 13 bp, Homo sapiens
ctcagagcctcag

SEQ ID NO: 6140980 - DNA, 18 bp, Homo sapiens
ctcagagcctcagcttct

SEQ ID NO: 6140981 - DNA, 12 bp, Homo sapiens
ctcagagcctga

SEQ ID NO: 6140982 - DNA, 14 bp, Homo sapiens
ctcagagcctgacc

SEQ ID NO: 6140983 - DNA, 23 bp, Homo sapiens
ctcagagcgccaggaagccagag

SEQ ID NO: 6140984 - DNA, 16 bp, Homo sapiens
ctcagagctccacaga

SEQ ID NO: 6140985 - DNA, 15 bp, Homo sapiens
ctcagagctctctct

SEQ ID NO: 6140986 - DNA, 14 bp, Homo sapiens
ctcagagctgcggg

SEQ ID NO: 6140987 - DNA, 18 bp, Homo sapiens
ctcagagctgcgggctga

SEQ ID NO: 6140988 - DNA, 17 bp, Homo sapiens
ctcagagctgctgagca

SEQ ID NO: 6140989 - DNA, 22 bp, Homo sapiens
ctcagagctgctgagcaggaac

SEQ ID NO: 6140990 - DNA, 13 bp, Homo sapiens
ctcagagcttcct

SEQ ID NO: 6140991 - DNA, 16 bp, Homo sapiens
ctcagagcttcctggg

SEQ ID NO: 6140992 - DNA, 18 bp, Homo sapiens
ctcagagcttcctgggga

SEQ ID NO: 6140993 - DNA, 23 bp, Homo sapiens
ctcagagcttcctggggaccaag

SEQ ID NO: 6140994 - DNA, 16 bp, Homo sapiens
ctcagagcttgaagat

SEQ ID NO: 6140995 - DNA, 22 bp, Homo sapiens
ctcagagctttaaaagtatctt

SEQ ID NO: 6140996 - DNA, 12 bp, Homo sapiens
ctcagagctttg

SEQ ID NO: 6140997 - DNA, 13 bp, Homo sapiens
ctcagagctttgt

SEQ ID NO: 6140998 - DNA, 20 bp, Homo sapiens
ctcagagctttgtcacttgc

SEQ ID NO: 6140999 - DNA, 23 bp, Homo sapiens
ctcagagcttttcgaactgtgct

SEQ ID NO: 6141000 - DNA, 13 bp, Homo sapiens
ctcagaggaatat

SEQ ID NO: 6141001 - DNA, 17 bp, Homo sapiens
ctcagaggacccacctg

SEQ ID NO: 6141002 - DNA, 19 bp, Homo sapiens
ctcagaggaccctttccag

SEQ ID NO: 6141003 - DNA, 22 bp, Homo sapiens
ctcagaggagctctaccctgct

SEQ ID NO: 6141004 - DNA, 20 bp, Homo sapiens
ctcagaggagtctgggaagg

SEQ ID NO: 6141005 - DNA, 18 bp, Homo sapiens
ctcagaggcagcaggagg

SEQ ID NO: 6141006 - DNA, 18 bp, Homo sapiens
ctcagaggccacttgctt

SEQ ID NO: 6141007 - DNA, 13 bp, Homo sapiens
ctcagaggcccag

SEQ ID NO: 6141008 - DNA, 18 bp, Homo sapiens
ctcagaggcccaggaatc

SEQ ID NO: 6141009 - DNA, 19 bp, Homo sapiens
ctcagaggcccccagtggg

SEQ ID NO: 6141010 - DNA, 24 bp, Homo sapiens
ctcagaggccccttgctgctggct

SEQ ID NO: 6141011 - DNA, 14 bp, Homo sapiens
ctcagaggccttgg

SEQ ID NO: 6141012 - DNA, 19 bp, Homo sapiens
ctcagaggcgcactgtgac

SEQ ID NO: 6141013 - DNA, 23 bp, Homo sapiens
ctcagaggctgacactgacattt

SEQ ID NO: 6141014 - DNA, 16 bp, Homo sapiens
ctcagaggctgggagc

SEQ ID NO: 6141015 - DNA, 16 bp, Homo sapiens
ctcagaggctgttctt

SEQ ID NO: 6141016 - DNA, 21 bp, Homo sapiens
ctcagagggaaggctctctgg

SEQ ID NO: 6141017 - DNA, 18 bp, Homo sapiens
ctcagagggataaggcag

SEQ ID NO: 6141018 - DNA, 17 bp, Homo sapiens
ctcagaggggcctcatc

SEQ ID NO: 6141019 - DNA, 19 bp, Homo sapiens
ctcagagggggactgctgc

SEQ ID NO: 6141020 - DNA, 21 bp, Homo sapiens
ctcagagggtagccttgattt

SEQ ID NO: 6141021 - DNA, 21 bp, Homo sapiens
ctcagagggttgttctcctag

SEQ ID NO: 6141022 - DNA, 13 bp, Homo sapiens
ctcagaggtccag

SEQ ID NO: 6141023 - DNA, 17 bp, Homo sapiens
ctcagaggtccaggccc

SEQ ID NO: 6141024 - DNA, 17 bp, Homo sapiens
ctcagagtatggagctc

SEQ ID NO: 6141025 - DNA, 18 bp, Homo sapiens
ctgagcccgggctgcctg

SEQ ID NO: 6141026 - DNA, 20 bp, Homo sapiens
ctgagcccggtaagagcaaa

SEQ ID NO: 6141027 - DNA, 23 bp, Homo sapiens
ctgagccctactccctgcagatg

SEQ ID NO: 6141028 - DNA, 20 bp, Homo sapiens
ctgagccctccctcttccca

SEQ ID NO: 6141029 - DNA, 22 bp, Homo sapiens
ctgagccctccctcttcccagc

SEQ ID NO: 6141030 - DNA, 12 bp, Homo sapiens
ctgagccctctc

SEQ ID NO: 6141031 - DNA, 17 bp, Homo sapiens
ctgagccctctcactcc

SEQ ID NO: 6141032 - DNA, 22 bp, Homo sapiens
ctgagccctctcactccagcca

SEQ ID NO: 6141033 - DNA, 12 bp, Homo sapiens
ctgagccctggc

SEQ ID NO: 6141034 - DNA, 15 bp, Homo sapiens
ctgagccctgtaccc

SEQ ID NO: 6141035 - DNA, 20 bp, Homo sapiens
ctgagccctgtacccacccc

SEQ ID NO: 6141036 - DNA, 22 bp, Homo sapiens
ctgagccctgtacccaccccag

SEQ ID NO: 6141037 - DNA, 13 bp, Homo sapiens
ctgagcccttgca

SEQ ID NO: 6141038 - DNA, 23 bp, Homo sapiens
ctgagccgaacatgttatttaac

SEQ ID NO: 6141039 - DNA, 19 bp, Homo sapiens
ctgagccgaagctgcgggg

SEQ ID NO: 6141040 - DNA, 18 bp, Homo sapiens
ctgagcctactgtctcct

SEQ ID NO: 6141041 - DNA, 23 bp, Homo sapiens
ctgagcctactgtctccttccca

SEQ ID NO: 6141042 - DNA, 23 bp, Homo sapiens
ctgagcctcaaccttctggggga

SEQ ID NO: 6141043 - DNA, 16 bp, Homo sapiens
ctgagcctcacagcag

SEQ ID NO: 6141044 - DNA, 19 bp, Homo sapiens
ctgagcctcacagcagtga

SEQ ID NO: 6141045 - DNA, 13 bp, Homo sapiens
ctgagcctcacct

SEQ ID NO: 6141046 - DNA, 10 bp, Homo sapiens
ctgagcctct

SEQ ID NO: 6141047 - DNA, 13 bp, Homo sapiens
ctgagcctctttt

SEQ ID NO: 6141048 - DNA, 13 bp, Homo sapiens
ctgagcctgaggc

SEQ ID NO: 6141049 - DNA, 15 bp, Homo sapiens
ctgagcctgcaggga

SEQ ID NO: 6141050 - DNA, 18 bp, Homo sapiens
ctgagcctgcagggaagc

SEQ ID NO: 6141051 - DNA, 15 bp, Homo sapiens
ctgagcctgccccag

SEQ ID NO: 6141052 - DNA, 22 bp, Homo sapiens
ctgagcctgccccagctgggct

SEQ ID NO: 6141053 - DNA, 19 bp, Homo sapiens
ctgagcctgccgagcaacc

SEQ ID NO: 6141054 - DNA, 12 bp, Homo sapiens
ctgagcctgctt

SEQ ID NO: 6141055 - DNA, 23 bp, Homo sapiens
ctgagcctggcaggtcccctgcc

SEQ ID NO: 6141056 - DNA, 13 bp, Homo sapiens
ctgagcctggcca

SEQ ID NO: 6141057 - DNA, 14 bp, Homo sapiens
ctgagcctggccag

SEQ ID NO: 6141058 - DNA, 19 bp, Homo sapiens
ctgagcctggccatgtcct

SEQ ID NO: 6141059 - DNA, 22 bp, Homo sapiens
ctgagcctggcccatagaaaca

SEQ ID NO: 6141060 - DNA, 12 bp, Homo sapiens
ctgagcctggtc

SEQ ID NO: 6141061 - DNA, 16 bp, Homo sapiens
ctgagcctgtctctcc

SEQ ID NO: 6141062 - DNA, 16 bp, Homo sapiens
ctgagcctgtgggtcc

SEQ ID NO: 6141063 - DNA, 16 bp, Homo sapiens
ctgagcctgtgtcctg

SEQ ID NO: 6141064 - DNA, 20 bp, Homo sapiens
ctgagccttagtttcagctg

SEQ ID NO: 6141065 - DNA, 17 bp, Homo sapiens
ctgagccttcagtcttg

SEQ ID NO: 6141066 - DNA, 17 bp, Homo sapiens
ctgagcgaggaaaaaca

SEQ ID NO: 6141067 - DNA, 18 bp, Homo sapiens
ctgagcgaggaaaaacaa

SEQ ID NO: 6141068 - DNA, 20 bp, Homo sapiens
ctgagcgaggagatgctcct

SEQ ID NO: 6141069 - DNA, 13 bp, Homo sapiens
ctgagcgcaagcc

SEQ ID NO: 6141070 - DNA, 17 bp, Homo sapiens
ctgagcgcaagccacag

SEQ ID NO: 6141071 - DNA, 20 bp, Homo sapiens
ctgagcgcaagccacagcct

SEQ ID NO: 6141072 - DNA, 21 bp, Homo sapiens
ctgagcgcaagccacagcctg

SEQ ID NO: 6141073 - DNA, 22 bp, Homo sapiens
ctgagcgcaagccacagcctgt

SEQ ID NO: 6141074 - DNA, 19 bp, Homo sapiens
ctgagcgcccccgagccct

SEQ ID NO: 6141075 - DNA, 22 bp, Homo sapiens
ctgagcgcctccatccaaggcc

SEQ ID NO: 6141076 - DNA, 14 bp, Homo sapiens
ctgagcgcctgcag

SEQ ID NO: 6141077 - DNA, 21 bp, Homo sapiens
ctgagcgcctggatttctggt

SEQ ID NO: 6141078 - DNA, 16 bp, Homo sapiens
ctgagcgctgtggact

SEQ ID NO: 6141079 - DNA, 16 bp, Homo sapiens
ctgagcggcaccctgg

SEQ ID NO: 6141080 - DNA, 19 bp, Homo sapiens
ctgagcggccgcagagact

SEQ ID NO: 6141081 - DNA, 21 bp, Homo sapiens
ctgagcggccgcagagactgg

SEQ ID NO: 6141082 - DNA, 14 bp, Homo sapiens
ctgagcggccgcct

SEQ ID NO: 6141083 - DNA, 17 bp, Homo sapiens
ctgagcggccgcctgtc

SEQ ID NO: 6141084 - DNA, 18 bp, Homo sapiens
ctgagcggcgcagagccc

SEQ ID NO: 6141085 - DNA, 21 bp, Homo sapiens
ctgagcggcgcagagccctcc

SEQ ID NO: 6141086 - DNA, 14 bp, Homo sapiens
ctgagcgggaggca

SEQ ID NO: 6141087 - DNA, 16 bp, Homo sapiens
ctgagcgggagtcagg

SEQ ID NO: 6141088 - DNA, 14 bp, Homo sapiens
ctgagcgtggaagg

SEQ ID NO: 6141089 - DNA, 16 bp, Homo sapiens
ctgagcgtggaagggg

SEQ ID NO: 6141090 - DNA, 18 bp, Homo sapiens
ctgagcgtttaaagtact

SEQ ID NO: 6141091 - DNA, 23 bp, Homo sapiens
ctgagcgtttaaagtactgagca

SEQ ID NO: 6141092 - DNA, 15 bp, Homo sapiens
ctgagctagaaccct

SEQ ID NO: 6141093 - DNA, 15 bp, Homo sapiens
ctgagctagcctcca

SEQ ID NO: 6141094 - DNA, 20 bp, Homo sapiens
ctgagctagctagcgcaccg

SEQ ID NO: 6141095 - DNA, 19 bp, Homo sapiens
ctgagctagtgtcacctgc

SEQ ID NO: 6141096 - DNA, 23 bp, Homo sapiens
ctgagctagttggttgaattttt

SEQ ID NO: 6141097 - DNA, 16 bp, Homo sapiens
ctgagctatttcatct

SEQ ID NO: 6141098 - DNA, 17 bp, Homo sapiens
ctgagctattttcctct

SEQ ID NO: 6141099 - DNA, 19 bp, Homo sapiens
ctgagctattttcctctgg

SEQ ID NO: 6141100 - DNA, 20 bp, Homo sapiens
ctgagctattttcctctggc

SEQ ID NO: 6141101 - DNA, 22 bp, Homo sapiens
ctgagctattttcctctggccg

SEQ ID NO: 6141102 - DNA, 24 bp, Homo sapiens
ctgagctattttcctctggccgca

SEQ ID NO: 6141103 - DNA, 14 bp, Homo sapiens
ctgagctcacaagg

SEQ ID NO: 6141104 - DNA, 20 bp, Homo sapiens
ctgagctcacatgggactgg

SEQ ID NO: 6141105 - DNA, 15 bp, Homo sapiens
ctgagctcagcgtgg

SEQ ID NO: 6141106 - DNA, 17 bp, Homo sapiens
ctgagctcaggctgagc

SEQ ID NO: 6141107 - DNA, 20 bp, Homo sapiens
ctgagctcaggctgagccca

SEQ ID NO: 6141108 - DNA, 23 bp, Homo sapiens
ctgagctcaggctgagcccagcc

SEQ ID NO: 6141109 - DNA, 18 bp, Homo sapiens
ctgagctcattaataaaa

SEQ ID NO: 6141110 - DNA, 23 bp, Homo sapiens
ctgagctcatttggggaccacag

SEQ ID NO: 6141111 - DNA, 14 bp, Homo sapiens
ctgagctccaccct

SEQ ID NO: 6141112 - DNA, 19 bp, Homo sapiens
ctgagctccaccctcccct

SEQ ID NO: 6141113 - DNA, 13 bp, Homo sapiens
ctgagctccacct

SEQ ID NO: 6141114 - DNA, 17 bp, Homo sapiens
ctgagctccacctctgg

SEQ ID NO: 6141115 - DNA, 18 bp, Homo sapiens
ctgagctccacctctggt

SEQ ID NO: 6141116 - DNA, 16 bp, Homo sapiens
ctgagctccagccacc

SEQ ID NO: 6141117 - DNA, 17 bp, Homo sapiens
ctgagctccagctcctt

SEQ ID NO: 6141118 - DNA, 22 bp, Homo sapiens
ctgagctccagctcctttgggc

SEQ ID NO: 6141119 - DNA, 22 bp, Homo sapiens
ctgagctccatgtgccccctct

SEQ ID NO: 6141120 - DNA, 14 bp, Homo sapiens
ctgagctcccacct

SEQ ID NO: 6141121 - DNA, 21 bp, Homo sapiens
ctgagctcccacctcccttcc

SEQ ID NO: 6141122 - DNA, 22 bp, Homo sapiens
ctgagctcccacctcccttccc

SEQ ID NO: 6141123 - DNA, 20 bp, Homo sapiens
ctgagctccccaccacccca

SEQ ID NO: 6141124 - DNA, 20 bp, Homo sapiens
ctgagctcccccttcccagt

SEQ ID NO: 6141125 - DNA, 15 bp, Homo sapiens
ctgagctcctctggg

SEQ ID NO: 6141126 - DNA, 22 bp, Homo sapiens
ctgagctcctgctgcggaggag

SEQ ID NO: 6141127 - DNA, 17 bp, Homo sapiens
ctgagctcctgtcccct

SEQ ID NO: 6141128 - DNA, 22 bp, Homo sapiens
ctgagctcctgtcccctgctac

SEQ ID NO: 6141129 - DNA, 18 bp, Homo sapiens
ctgagctcgcagcccccg

SEQ ID NO: 6141130 - DNA, 22 bp, Homo sapiens
ctgagctcgcagcccccgcgcc

SEQ ID NO: 6141131 - DNA, 19 bp, Homo sapiens
ctgagctcggggacaggtg

SEQ ID NO: 6141132 - DNA, 21 bp, Homo sapiens
ctgagctcggggggctctgcc

SEQ ID NO: 6141133 - DNA, 18 bp, Homo sapiens
ctgagctcggtggaccca

SEQ ID NO: 6141134 - DNA, 22 bp, Homo sapiens
ctgagctcggtggacccaggga

SEQ ID NO: 6141135 - DNA, 23 bp, Homo sapiens
ctgagctcgtgatctgcccgcct

SEQ ID NO: 6141136 - DNA, 12 bp, Homo sapiens
ctgagctctcca

SEQ ID NO: 6141137 - DNA, 14 bp, Homo sapiens
ctgagctctccagg

SEQ ID NO: 6141138 - DNA, 17 bp, Homo sapiens
ctgagctctccaggcca

SEQ ID NO: 6141139 - DNA, 18 bp, Homo sapiens
ctgagctctccaggccag

SEQ ID NO: 6141140 - DNA, 13 bp, Homo sapiens
ctgagctctctga

SEQ ID NO: 6141141 - DNA, 13 bp, Homo sapiens
ctgagctctgacc

SEQ ID NO: 6141142 - DNA, 16 bp, Homo sapiens
ctgagctctgagaggc

SEQ ID NO: 6141143 - DNA, 19 bp, Homo sapiens
ctgagctctgagaggccct

SEQ ID NO: 6141144 - DNA, 22 bp, Homo sapiens
ctgagctcttgctatctctcaa

SEQ ID NO: 6141145 - DNA, 16 bp, Homo sapiens
ctgagctgagccaggc

SEQ ID NO: 6141146 - DNA, 12 bp, Homo sapiens
ctgagctgaggc

SEQ ID NO: 6141147 - DNA, 18 bp, Homo sapiens
ctgagctgaggcagcagt

SEQ ID NO: 6141148 - DNA, 19 bp, Homo sapiens
ctgagctgagtggccagcc

SEQ ID NO: 6141149 - DNA, 14 bp, Homo sapiens
ctgagctgcagcct

SEQ ID NO: 6141150 - DNA, 22 bp, Homo sapiens
ctgagctgcagcctggctggtc

SEQ ID NO: 6141151 - DNA, 21 bp, Homo sapiens
ctgagctgcagctgagcctga

SEQ ID NO: 6141152 - DNA, 15 bp, Homo sapiens
ctgagctgccagtgg

SEQ ID NO: 6141153 - DNA, 15 bp, Homo sapiens
ctgagctgccatcca

SEQ ID NO: 6141154 - DNA, 15 bp, Homo sapiens
ctgagctgcccctgc

SEQ ID NO: 6141155 - DNA, 18 bp, Homo sapiens
ctgagctgcccctgctgc

SEQ ID NO: 6141156 - DNA, 18 bp, Homo sapiens
ctgagctgctaaaataaa

SEQ ID NO: 6141157 - DNA, 13 bp, Homo sapiens
ctgagctgctctg

SEQ ID NO: 6141158 - DNA, 14 bp, Homo sapiens
ctgagctgcttcac

SEQ ID NO: 6141159 - DNA, 20 bp, Homo sapiens
ctgagctgcttcactaggga

SEQ ID NO: 6141160 - DNA, 23 bp, Homo sapiens
ctgagctggcattggtctgctga

SEQ ID NO: 6141161 - DNA, 13 bp, Homo sapiens
ctgagctggccag

SEQ ID NO: 6141162 - DNA, 18 bp, Homo sapiens
ctgagctggccctttcca

SEQ ID NO: 6141163 - DNA, 20 bp, Homo sapiens
ctgagctggcctcacctggg

SEQ ID NO: 6141164 - DNA, 14 bp, Homo sapiens
ctgagctggcctct

SEQ ID NO: 6141165 - DNA, 16 bp, Homo sapiens
ctgagctgggcaccac

SEQ ID NO: 6141166 - DNA, 14 bp, Homo sapiens
ctgagctggggaag

SEQ ID NO: 6141167 - DNA, 13 bp, Homo sapiens
ctgagctggggag

SEQ ID NO: 6141168 - DNA, 18 bp, Homo sapiens
ctgagctggggagggagg

SEQ ID NO: 6141169 - DNA, 21 bp, Homo sapiens
ctgagctggggaggtgggagg

SEQ ID NO: 6141170 - DNA, 22 bp, Homo sapiens
ctgagctggggaggtgggaggc

SEQ ID NO: 6141171 - DNA, 12 bp, Homo sapiens
ctgagctggggc

SEQ ID NO: 6141172 - DNA, 13 bp, Homo sapiens
ctgagctggggcc

SEQ ID NO: 6141173 - DNA, 15 bp, Homo sapiens
ctgagctggggccac

SEQ ID NO: 6141174 - DNA, 19 bp, Homo sapiens
ctgagctggggcctggaga

SEQ ID NO: 6141175 - DNA, 22 bp, Homo sapiens
ctgagctggggcctggagaggg

SEQ ID NO: 6141176 - DNA, 19 bp, Homo sapiens
ctgagctgtccagtggagg

SEQ ID NO: 6141177 - DNA, 20 bp, Homo sapiens
ctgagctgtccagtggaggg

SEQ ID NO: 6141178 - DNA, 14 bp, Homo sapiens
ctgagctgtcccaa

SEQ ID NO: 6141179 - DNA, 15 bp, Homo sapiens
ctgagctgtcccaag

SEQ ID NO: 6141180 - DNA, 23 bp, Homo sapiens
ctgagctgtcccaagtcctccgg

SEQ ID NO: 6141181 - DNA, 24 bp, Homo sapiens
ctgagctgtcgctgcctccatggc

SEQ ID NO: 6141182 - DNA, 11 bp, Homo sapiens
ctgagctgtga

SEQ ID NO: 6141183 - DNA, 19 bp, Homo sapiens
ctgagctgtgacattgctg

SEQ ID NO: 6141184 - DNA, 22 bp, Homo sapiens
ctgagctgtgacattgctggtc

SEQ ID NO: 6141185 - DNA, 17 bp, Homo sapiens
ctgagctgtgacccaga

SEQ ID NO: 6141186 - DNA, 13 bp, Homo sapiens
ctgagctgtgcca

SEQ ID NO: 6141187 - DNA, 21 bp, Homo sapiens
ctgagctgtgccagctgcttc

SEQ ID NO: 6141188 - DNA, 16 bp, Homo sapiens
ctgagcttaaataaca

SEQ ID NO: 6141189 - DNA, 17 bp, Homo sapiens
ctgagcttagccttgtg

SEQ ID NO: 6141190 - DNA, 22 bp, Homo sapiens
ctgagcttagccttgtgccctg

SEQ ID NO: 6141191 - DNA, 22 bp, Homo sapiens
ctgagcttcggttctccagaat

SEQ ID NO: 6141192 - DNA, 23 bp, Homo sapiens
ctgagcttcggttctccagaatg

SEQ ID NO: 6141193 - DNA, 20 bp, Homo sapiens
ctgagcttgagctcccctgg

SEQ ID NO: 6141194 - DNA, 14 bp, Homo sapiens
ctgagcttggaagc

SEQ ID NO: 6141195 - DNA, 15 bp, Homo sapiens
ctgagcttggaggaa

SEQ ID NO: 6141196 - DNA, 12 bp, Homo sapiens
ctgagcttggcc

SEQ ID NO: 6141197 - DNA, 16 bp, Homo sapiens
ctgagcttggccagaa

SEQ ID NO: 6141198 - DNA, 17 bp, Homo sapiens
ctgagcttggccctatt

SEQ ID NO: 6141199 - DNA, 10 bp, Homo sapiens
ctgagcttta

SEQ ID NO: 6141200 - DNA, 11 bp, Homo sapiens
ctgagctttat

SEQ ID NO: 6141201 - DNA, 20 bp, Homo sapiens
ctgagctttccggggaggag

SEQ ID NO: 6141202 - DNA, 20 bp, Homo sapiens
ctcagagtcaccacttcctc

SEQ ID NO: 6141203 - DNA, 11 bp, Homo sapiens
ctcagagtcca

SEQ ID NO: 6141204 - DNA, 16 bp, Homo sapiens
ctcagagtccactgtg

SEQ ID NO: 6141205 - DNA, 15 bp, Homo sapiens
ctcagagtccaggcc

SEQ ID NO: 6141206 - DNA, 18 bp, Homo sapiens
ctcagagtccaggcccca

SEQ ID NO: 6141207 - DNA, 16 bp, Homo sapiens
ctcagagtcccaggac

SEQ ID NO: 6141208 - DNA, 17 bp, Homo sapiens
ctcagagtcggaacgga

SEQ ID NO: 6141209 - DNA, 18 bp, Homo sapiens
ctcagagtgaagagtgaa

SEQ ID NO: 6141210 - DNA, 21 bp, Homo sapiens
ctcagagtgaagagtgaagag

SEQ ID NO: 6141211 - DNA, 23 bp, Homo sapiens
ctcagagtgaccctcagctgtca

SEQ ID NO: 6141212 - DNA, 20 bp, Homo sapiens
ctcagagtgcaagaagtctg

SEQ ID NO: 6141213 - DNA, 22 bp, Homo sapiens
ctcagataaggtaaaatgccat

SEQ ID NO: 6141214 - DNA, 14 bp, Homo sapiens
ctcagatatttata

SEQ ID NO: 6141215 - DNA, 20 bp, Homo sapiens
ctcagatcaccccagcctca

SEQ ID NO: 6141216 - DNA, 20 bp, Homo sapiens
ctcagatcactactgcagtc

SEQ ID NO: 6141217 - DNA, 17 bp, Homo sapiens
ctcagatcactgcaacc

SEQ ID NO: 6141218 - DNA, 15 bp, Homo sapiens
ctcagatccagggac

SEQ ID NO: 6141219 - DNA, 18 bp, Homo sapiens
ctcagatccagggacaga

SEQ ID NO: 6141220 - DNA, 20 bp, Homo sapiens
ctcagatccagggacagagg

SEQ ID NO: 6141221 - DNA, 22 bp, Homo sapiens
ctcagatccagggacagaggcc

SEQ ID NO: 6141222 - DNA, 15 bp, Homo sapiens
ctcagatcccagggt

SEQ ID NO: 6141223 - DNA, 15 bp, Homo sapiens
ctcagatccctcggt

SEQ ID NO: 6141224 - DNA, 16 bp, Homo sapiens
ctcagatcctcctcat

SEQ ID NO: 6141225 - DNA, 12 bp, Homo sapiens
ctcagatcctgg

SEQ ID NO: 6141226 - DNA, 15 bp, Homo sapiens
ctcagatcctgggca

SEQ ID NO: 6141227 - DNA, 20 bp, Homo sapiens
ctcagatcctgggcatgatg

SEQ ID NO: 6141228 - DNA, 14 bp, Homo sapiens
ctcagatccttggt

SEQ ID NO: 6141229 - DNA, 19 bp, Homo sapiens
ctcagatcggccacagggc

SEQ ID NO: 6141230 - DNA, 15 bp, Homo sapiens
ctcagatctcatcag

SEQ ID NO: 6141231 - DNA, 20 bp, Homo sapiens
ctcagatctgcactcctgtc

SEQ ID NO: 6141232 - DNA, 18 bp, Homo sapiens
ctcagatgacctgaggaa

SEQ ID NO: 6141233 - DNA, 17 bp, Homo sapiens
ctcagatgatctctcca

SEQ ID NO: 6141234 - DNA, 21 bp, Homo sapiens
ctcagatgatgccagctgtct

SEQ ID NO: 6141235 - DNA, 18 bp, Homo sapiens
ctcagatgatggggtcag

SEQ ID NO: 6141236 - DNA, 22 bp, Homo sapiens
ctcagatgatggggtcagcagg

SEQ ID NO: 6141237 - DNA, 22 bp, Homo sapiens
ctcagatgcgttcgcctctggc

SEQ ID NO: 6141238 - DNA, 19 bp, Homo sapiens
ctcagatgctcaaagttgt

SEQ ID NO: 6141239 - DNA, 22 bp, Homo sapiens
ctcagatgctggtcatcctggg

SEQ ID NO: 6141240 - DNA, 14 bp, Homo sapiens
ctcagatggagaca

SEQ ID NO: 6141241 - DNA, 21 bp, Homo sapiens
ctcagatggagacattggatg

SEQ ID NO: 6141242 - DNA, 13 bp, Homo sapiens
ctcagatggcagc

SEQ ID NO: 6141243 - DNA, 15 bp, Homo sapiens
ctcagatgggaattg

SEQ ID NO: 6141244 - DNA, 16 bp, Homo sapiens
ctcagatgttaaaata

SEQ ID NO: 6141245 - DNA, 23 bp, Homo sapiens
ctcagatgttaaaataaatggtt

SEQ ID NO: 6141246 - DNA, 19 bp, Homo sapiens
ctcagattagatgtgccaa

SEQ ID NO: 6141247 - DNA, 17 bp, Homo sapiens
ctcagattatttttcct

SEQ ID NO: 6141248 - DNA, 15 bp, Homo sapiens
ctcagattcccccca

SEQ ID NO: 6141249 - DNA, 21 bp, Homo sapiens
ctcagattccttcccatggag

SEQ ID NO: 6141250 - DNA, 22 bp, Homo sapiens
ctcagattcttcattgaggatt

SEQ ID NO: 6141251 - DNA, 18 bp, Homo sapiens
ctcagattgactaaataa

SEQ ID NO: 6141252 - DNA, 16 bp, Homo sapiens
ctcagattgggattaa

SEQ ID NO: 6141253 - DNA, 15 bp, Homo sapiens
ctcagattgtaatat

SEQ ID NO: 6141254 - DNA, 16 bp, Homo sapiens
ctcagatttaaaacaa

SEQ ID NO: 6141255 - DNA, 21 bp, Homo sapiens
ctcagatttaagccttacaaa

SEQ ID NO: 6141256 - DNA, 17 bp, Homo sapiens
ctcagatttccacagag

SEQ ID NO: 6141257 - DNA, 21 bp, Homo sapiens
ctcagatttccattgtgtggc

SEQ ID NO: 6141258 - DNA, 17 bp, Homo sapiens
ctcagatttctgaggaa

SEQ ID NO: 6141259 - DNA, 15 bp, Homo sapiens
ctcagattttattat

SEQ ID NO: 6141260 - DNA, 19 bp, Homo sapiens
ctcagcaaaagatgcttct

SEQ ID NO: 6141261 - DNA, 18 bp, Homo sapiens
ctcagcaaacccaaagat

SEQ ID NO: 6141262 - DNA, 17 bp, Homo sapiens
ctcagcaaatcctcttc

SEQ ID NO: 6141263 - DNA, 23 bp, Homo sapiens
ctcagcaactgttagctgggaag

SEQ ID NO: 6141264 - DNA, 17 bp, Homo sapiens
ctcagcaagctgcccag

SEQ ID NO: 6141265 - DNA, 18 bp, Homo sapiens
ctcagcaaggggctctgc

SEQ ID NO: 6141266 - DNA, 20 bp, Homo sapiens
ctcagcaaggggctgcttct

SEQ ID NO: 6141267 - DNA, 15 bp, Homo sapiens
ctcagcaaggtgtga

SEQ ID NO: 6141268 - DNA, 16 bp, Homo sapiens
ctcagcaagtgtacag

SEQ ID NO: 6141269 - DNA, 19 bp, Homo sapiens
ctcagcaatagggtgcagt

SEQ ID NO: 6141270 - DNA, 21 bp, Homo sapiens
ctcagcacaatctgtaaattt

SEQ ID NO: 6141271 - DNA, 13 bp, Homo sapiens
ctcagcacagact

SEQ ID NO: 6141272 - DNA, 17 bp, Homo sapiens
ctcagcacagagatggg

SEQ ID NO: 6141273 - DNA, 22 bp, Homo sapiens
ctcagcacattcgggaccaata

SEQ ID NO: 6141274 - DNA, 16 bp, Homo sapiens
ctcagcaccaagagca

SEQ ID NO: 6141275 - DNA, 22 bp, Homo sapiens
ctcagcaccacattgcctcatt

SEQ ID NO: 6141276 - DNA, 21 bp, Homo sapiens
ctcagcaccactcaagaccaa

SEQ ID NO: 6141277 - DNA, 18 bp, Homo sapiens
ctcagcacccccttctct

SEQ ID NO: 6141278 - DNA, 21 bp, Homo sapiens
ctcagcacccctagcatgaac

SEQ ID NO: 6141279 - DNA, 15 bp, Homo sapiens
ctcagcaccccttcc

SEQ ID NO: 6141280 - DNA, 17 bp, Homo sapiens
ctcagcaccccttccat

SEQ ID NO: 6141281 - DNA, 21 bp, Homo sapiens
ctcagcactaattagtgtcca

SEQ ID NO: 6141282 - DNA, 13 bp, Homo sapiens
ctcagcactctgg

SEQ ID NO: 6141283 - DNA, 16 bp, Homo sapiens
ctcagcactgcctgct

SEQ ID NO: 6141284 - DNA, 18 bp, Homo sapiens
ctcagcactgcctgctcc

SEQ ID NO: 6141285 - DNA, 12 bp, Homo sapiens
ctcagcacttgg

SEQ ID NO: 6141286 - DNA, 17 bp, Homo sapiens
ctcagcagaggcagtgg

SEQ ID NO: 6141287 - DNA, 21 bp, Homo sapiens
ctcagcagaggcagtggccac

SEQ ID NO: 6141288 - DNA, 12 bp, Homo sapiens
ctcagcagagtg

SEQ ID NO: 6141289 - DNA, 20 bp, Homo sapiens
ctcagcagcagagagccctg

SEQ ID NO: 6141290 - DNA, 19 bp, Homo sapiens
ctcagcagccccaccccac

SEQ ID NO: 6141291 - DNA, 13 bp, Homo sapiens
ctcagcagccccc

SEQ ID NO: 6141292 - DNA, 20 bp, Homo sapiens
ctcagcagccctagcggctg

SEQ ID NO: 6141293 - DNA, 14 bp, Homo sapiens
ctcagcagccctcc

SEQ ID NO: 6141294 - DNA, 15 bp, Homo sapiens
ctcagcagccctcct

SEQ ID NO: 6141295 - DNA, 23 bp, Homo sapiens
ctcagcagccgccttaagctgat

SEQ ID NO: 6141296 - DNA, 18 bp, Homo sapiens
ctcagcagcgaccacccc

SEQ ID NO: 6141297 - DNA, 23 bp, Homo sapiens
ctcagcagcgaccacccctgcct

SEQ ID NO: 6141298 - DNA, 19 bp, Homo sapiens
ctcagcaggaacctgtact

SEQ ID NO: 6141299 - DNA, 12 bp, Homo sapiens
ctcagcaggcca

SEQ ID NO: 6141300 - DNA, 12 bp, Homo sapiens
ctcagcagggct

SEQ ID NO: 6141301 - DNA, 18 bp, Homo sapiens
ctcagcagggctggtcac

SEQ ID NO: 6141302 - DNA, 20 bp, Homo sapiens
ctcagcagggctggtcacct

SEQ ID NO: 6141303 - DNA, 17 bp, Homo sapiens
ctcagcataagtaaaca

SEQ ID NO: 6141304 - DNA, 23 bp, Homo sapiens
ctcagcatatatataaaatacac

SEQ ID NO: 6141305 - DNA, 14 bp, Homo sapiens
ctcagcatatttgt

SEQ ID NO: 6141306 - DNA, 16 bp, Homo sapiens
ctcagcatatttgtat

SEQ ID NO: 6141307 - DNA, 12 bp, Homo sapiens
ctcagcatccca

SEQ ID NO: 6141308 - DNA, 16 bp, Homo sapiens
ctcagcatcctggcac

SEQ ID NO: 6141309 - DNA, 17 bp, Homo sapiens
ctcagcatcctggcacc

SEQ ID NO: 6141310 - DNA, 15 bp, Homo sapiens
ctcagcattacctct

SEQ ID NO: 6141311 - DNA, 19 bp, Homo sapiens
ctcagcattgtcagcctga

SEQ ID NO: 6141312 - DNA, 18 bp, Homo sapiens
ctcagcatttccttccag

SEQ ID NO: 6141313 - DNA, 15 bp, Homo sapiens
ctcagcatttctttt

SEQ ID NO: 6141314 - DNA, 20 bp, Homo sapiens
ctcagcatttgattaacatt

SEQ ID NO: 6141315 - DNA, 16 bp, Homo sapiens
ctcagccaaacacaga

SEQ ID NO: 6141316 - DNA, 18 bp, Homo sapiens
ctcagccaaacacagagc

SEQ ID NO: 6141317 - DNA, 17 bp, Homo sapiens
ctcagccaaatttcctg

SEQ ID NO: 6141318 - DNA, 19 bp, Homo sapiens
ctcagccaaatttcctgtt

SEQ ID NO: 6141319 - DNA, 23 bp, Homo sapiens
ctcagccaaatttcctgtttgaa

SEQ ID NO: 6141320 - DNA, 13 bp, Homo sapiens
ctcagccaagcac

SEQ ID NO: 6141321 - DNA, 14 bp, Homo sapiens
ctcagccaagcaca

SEQ ID NO: 6141322 - DNA, 18 bp, Homo sapiens
ctcagccaagcacagtgg

SEQ ID NO: 6141323 - DNA, 12 bp, Homo sapiens
ctcagccaagct

SEQ ID NO: 6141324 - DNA, 13 bp, Homo sapiens
ctcagccaagctt

SEQ ID NO: 6141325 - DNA, 22 bp, Homo sapiens
ctcagccacaaaactctgtcag

SEQ ID NO: 6141326 - DNA, 14 bp, Homo sapiens
ctcagccacaaagc

SEQ ID NO: 6141327 - DNA, 21 bp, Homo sapiens
ctcagccacaaagccccccag

SEQ ID NO: 6141328 - DNA, 24 bp, Homo sapiens
ctcagccacaaagccccccagctc

SEQ ID NO: 6141329 - DNA, 17 bp, Homo sapiens
ctcagccacacccaggc

SEQ ID NO: 6141330 - DNA, 15 bp, Homo sapiens
ctcagccacagcctg

SEQ ID NO: 6141331 - DNA, 16 bp, Homo sapiens
ctcagccaccctgagt

SEQ ID NO: 6141332 - DNA, 17 bp, Homo sapiens
ctcagccaccctgagtt

SEQ ID NO: 6141333 - DNA, 14 bp, Homo sapiens
ctcagccacccttg

SEQ ID NO: 6141334 - DNA, 22 bp, Homo sapiens
ctcagccacgcctctctcagcc

SEQ ID NO: 6141335 - DNA, 12 bp, Homo sapiens
ctcagccactcc

SEQ ID NO: 6141336 - DNA, 16 bp, Homo sapiens
ctcagccactcccagg

SEQ ID NO: 6141337 - DNA, 20 bp, Homo sapiens
ctcagccactcccaggggcc

SEQ ID NO: 6141338 - DNA, 21 bp, Homo sapiens
ctcagccactcccaggggcct

SEQ ID NO: 6141339 - DNA, 17 bp, Homo sapiens
ctcagccactgtcacag

SEQ ID NO: 6141340 - DNA, 18 bp, Homo sapiens
ctcagccactgtcacagg

SEQ ID NO: 6141341 - DNA, 21 bp, Homo sapiens
ctcagccactgtcacaggcat

SEQ ID NO: 6141342 - DNA, 22 bp, Homo sapiens
ctcagccactgtcacaggcata

SEQ ID NO: 6141343 - DNA, 16 bp, Homo sapiens
ctcagccagccccatc

SEQ ID NO: 6141344 - DNA, 23 bp, Homo sapiens
ctcagccagcccgtgtgtataat

SEQ ID NO: 6141345 - DNA, 12 bp, Homo sapiens
ctcagccagcct

SEQ ID NO: 6141346 - DNA, 13 bp, Homo sapiens
ctcagccagctgc

SEQ ID NO: 6141347 - DNA, 14 bp, Homo sapiens
ctcagccagctgcc

SEQ ID NO: 6141348 - DNA, 18 bp, Homo sapiens
ctcagccaggtgctgtga

SEQ ID NO: 6141349 - DNA, 16 bp, Homo sapiens
ctcagccatccgcaga

SEQ ID NO: 6141350 - DNA, 18 bp, Homo sapiens
ctcagccatttccccctc

SEQ ID NO: 6141351 - DNA, 21 bp, Homo sapiens
ctcagccatttccccctcctc

SEQ ID NO: 6141352 - DNA, 23 bp, Homo sapiens
ctcagccatttccccctcctcag

SEQ ID NO: 6141353 - DNA, 21 bp, Homo sapiens
ctcagccatttctaagcagat

SEQ ID NO: 6141354 - DNA, 11 bp, Homo sapiens
ctcagcccaac

SEQ ID NO: 6141355 - DNA, 21 bp, Homo sapiens
ctcagcccacatagtgatggt

SEQ ID NO: 6141356 - DNA, 11 bp, Homo sapiens
ctcagcccacc

SEQ ID NO: 6141357 - DNA, 17 bp, Homo sapiens
ctcagcccacccccctc

SEQ ID NO: 6141358 - DNA, 19 bp, Homo sapiens
ctcagcccacctgcaccca

SEQ ID NO: 6141359 - DNA, 13 bp, Homo sapiens
ctcagcccagctg

SEQ ID NO: 6141360 - DNA, 14 bp, Homo sapiens
ctcagcccagctgg

SEQ ID NO: 6141361 - DNA, 15 bp, Homo sapiens
ctcagcccagctggc

SEQ ID NO: 6141362 - DNA, 17 bp, Homo sapiens
ctcagcccagctggcca

SEQ ID NO: 6141363 - DNA, 20 bp, Homo sapiens
ctcagcccagctggccacct

SEQ ID NO: 6141364 - DNA, 17 bp, Homo sapiens
ctcagcccaggtctcct

SEQ ID NO: 6141365 - DNA, 17 bp, Homo sapiens
ctcagcccatcccctgc

SEQ ID NO: 6141366 - DNA, 21 bp, Homo sapiens
ctcagcccatcccctgcctct

SEQ ID NO: 6141367 - DNA, 11 bp, Homo sapiens
ctcagccccag

SEQ ID NO: 6141368 - DNA, 14 bp, Homo sapiens
ctcagccccagacc

SEQ ID NO: 6141369 - DNA, 15 bp, Homo sapiens
ctcagccccagacct

SEQ ID NO: 6141370 - DNA, 17 bp, Homo sapiens
ctcagccccagacctgc

SEQ ID NO: 6141371 - DNA, 18 bp, Homo sapiens
ctcagccccagcccagcc

SEQ ID NO: 6141372 - DNA, 23 bp, Homo sapiens
ctcagccccagcttatctcctcc

SEQ ID NO: 6141373 - DNA, 13 bp, Homo sapiens
ctcagccccaggc

SEQ ID NO: 6141374 - DNA, 16 bp, Homo sapiens
ctcagccccaggccag

SEQ ID NO: 6141375 - DNA, 18 bp, Homo sapiens
ctcagccccaggccagct

SEQ ID NO: 6141376 - DNA, 21 bp, Homo sapiens
ctcagccccaggccagctgcg

SEQ ID NO: 6141377 - DNA, 18 bp, Homo sapiens
ctcagccccatcgcccca

SEQ ID NO: 6141378 - DNA, 15 bp, Homo sapiens
ctcagcccccaggat

SEQ ID NO: 6141379 - DNA, 21 bp, Homo sapiens
ctcagcccccaggatctgggt

SEQ ID NO: 6141380 - DNA, 22 bp, Homo sapiens
ctgagctttccggggaggagcc

SEQ ID NO: 6141381 - DNA, 21 bp, Homo sapiens
ctgagctttggggacagttgg

SEQ ID NO: 6141382 - DNA, 13 bp, Homo sapiens
ctgagctttgtta

SEQ ID NO: 6141383 - DNA, 19 bp, Homo sapiens
ctgagcttttcatggaagt

SEQ ID NO: 6141384 - DNA, 20 bp, Homo sapiens
ctgagcttttcatggaagtg

SEQ ID NO: 6141385 - DNA, 20 bp, Homo sapiens
ctgaggaaaatggaagacct

SEQ ID NO: 6141386 - DNA, 16 bp, Homo sapiens
ctgaggaaaggccagc

SEQ ID NO: 6141387 - DNA, 17 bp, Homo sapiens
ctgaggaaaggccagct

SEQ ID NO: 6141388 - DNA, 20 bp, Homo sapiens
ctgaggaaaggccagctggc

SEQ ID NO: 6141389 - DNA, 18 bp, Homo sapiens
ctgaggaagaacggggct

SEQ ID NO: 6141390 - DNA, 21 bp, Homo sapiens
ctgaggaagacaagtgatgct

SEQ ID NO: 6141391 - DNA, 15 bp, Homo sapiens
ctgaggaagcagttg

SEQ ID NO: 6141392 - DNA, 21 bp, Homo sapiens
ctgaggaagctgttggggggc

SEQ ID NO: 6141393 - DNA, 22 bp, Homo sapiens
ctgaggaagctgttggggggct

SEQ ID NO: 6141394 - DNA, 23 bp, Homo sapiens
ctgaggaagctgttggggggctg

SEQ ID NO: 6141395 - DNA, 21 bp, Homo sapiens
ctgaggaaggaggggaagctg

SEQ ID NO: 6141396 - DNA, 23 bp, Homo sapiens
ctgaggaaggaggggaagctgca

SEQ ID NO: 6141397 - DNA, 15 bp, Homo sapiens
ctgaggaagggagac

SEQ ID NO: 6141398 - DNA, 20 bp, Homo sapiens
ctgaggaagttttgcatgca

SEQ ID NO: 6141399 - DNA, 12 bp, Homo sapiens
ctgaggaataaa

SEQ ID NO: 6141400 - DNA, 17 bp, Homo sapiens
ctgaggaatccagaccc

SEQ ID NO: 6141401 - DNA, 20 bp, Homo sapiens
ctgaggaatccagacccggc

SEQ ID NO: 6141402 - DNA, 21 bp, Homo sapiens
ctgaggaatgcggttcagggc

SEQ ID NO: 6141403 - DNA, 18 bp, Homo sapiens
ctgaggaattctgtatag

SEQ ID NO: 6141404 - DNA, 14 bp, Homo sapiens
ctgaggacaaagtg

SEQ ID NO: 6141405 - DNA, 17 bp, Homo sapiens
ctgaggacacaccccac

SEQ ID NO: 6141406 - DNA, 17 bp, Homo sapiens
ctgaggacacagatccc

SEQ ID NO: 6141407 - DNA, 22 bp, Homo sapiens
ctgaggacaccagtgaaagaag

SEQ ID NO: 6141408 - DNA, 23 bp, Homo sapiens
ctgaggacactaaccacgctgga

SEQ ID NO: 6141409 - DNA, 11 bp, Homo sapiens
ctgaggacaga

SEQ ID NO: 6141410 - DNA, 21 bp, Homo sapiens
ctgaggacagaaagaccctga

SEQ ID NO: 6141411 - DNA, 14 bp, Homo sapiens
ctgaggacagctgt

SEQ ID NO: 6141412 - DNA, 17 bp, Homo sapiens
ctgaggacagctgtcct

SEQ ID NO: 6141413 - DNA, 17 bp, Homo sapiens
ctgaggacaggccccca

SEQ ID NO: 6141414 - DNA, 23 bp, Homo sapiens
ctgaggacaggggcatctctggg

SEQ ID NO: 6141415 - DNA, 14 bp, Homo sapiens
ctgaggaccagcca

SEQ ID NO: 6141416 - DNA, 22 bp, Homo sapiens
ctgaggaccctcagccccagga

SEQ ID NO: 6141417 - DNA, 23 bp, Homo sapiens
ctgaggaccctcagccccaggag

SEQ ID NO: 6141418 - DNA, 21 bp, Homo sapiens
ctgaggaccgccccaaccctc

SEQ ID NO: 6141419 - DNA, 16 bp, Homo sapiens
ctgaggacctctcagc

SEQ ID NO: 6141420 - DNA, 9 bp, Homo sapiens
ctgaggacg

SEQ ID NO: 6141421 - DNA, 23 bp, Homo sapiens
ctgaggacgagacccccatccag

SEQ ID NO: 6141422 - DNA, 22 bp, Homo sapiens
ctgaggacggggcagagctgag

SEQ ID NO: 6141423 - DNA, 14 bp, Homo sapiens
ctgaggactctgga

SEQ ID NO: 6141424 - DNA, 22 bp, Homo sapiens
ctgaggagaagctgatccagtt

SEQ ID NO: 6141425 - DNA, 13 bp, Homo sapiens
ctgaggagacaga

SEQ ID NO: 6141426 - DNA, 14 bp, Homo sapiens
ctgaggagacagaa

SEQ ID NO: 6141427 - DNA, 15 bp, Homo sapiens
ctgaggagacagaaa

SEQ ID NO: 6141428 - DNA, 17 bp, Homo sapiens
ctgaggagatgaccagg

SEQ ID NO: 6141429 - DNA, 22 bp, Homo sapiens
ctgaggagatgaccagggatgc

SEQ ID NO: 6141430 - DNA, 14 bp, Homo sapiens
ctgaggagcaaagc

SEQ ID NO: 6141431 - DNA, 21 bp, Homo sapiens
ctgaggagcagcaggaggggg

SEQ ID NO: 6141432 - DNA, 16 bp, Homo sapiens
ctgaggagcagccagg

SEQ ID NO: 6141433 - DNA, 22 bp, Homo sapiens
ctgaggagcagccaggacccgc

SEQ ID NO: 6141434 - DNA, 19 bp, Homo sapiens
ctgaggagcagcccacctg

SEQ ID NO: 6141435 - DNA, 21 bp, Homo sapiens
ctgaggagcagcccacctgct

SEQ ID NO: 6141436 - DNA, 13 bp, Homo sapiens
ctgaggagcccac

SEQ ID NO: 6141437 - DNA, 21 bp, Homo sapiens
ctgaggagccctgaggacctc

SEQ ID NO: 6141438 - DNA, 14 bp, Homo sapiens
ctgaggagctagtg

SEQ ID NO: 6141439 - DNA, 13 bp, Homo sapiens
ctgaggagctttg

SEQ ID NO: 6141440 - DNA, 23 bp, Homo sapiens
ctgaggaggaggacacagcacaa

SEQ ID NO: 6141441 - DNA, 14 bp, Homo sapiens
ctgaggaggcctcc

SEQ ID NO: 6141442 - DNA, 15 bp, Homo sapiens
ctgaggaggcctcca

SEQ ID NO: 6141443 - DNA, 19 bp, Homo sapiens
ctgaggaggcctccatctc

SEQ ID NO: 6141444 - DNA, 16 bp, Homo sapiens
ctgaggagggccctga

SEQ ID NO: 6141445 - DNA, 20 bp, Homo sapiens
ctgaggagggccctgaggaa

SEQ ID NO: 6141446 - DNA, 20 bp, Homo sapiens
ctgaggagggggaggacgga

SEQ ID NO: 6141447 - DNA, 16 bp, Homo sapiens
ctgaggaggtgctgca

SEQ ID NO: 6141448 - DNA, 16 bp, Homo sapiens
ctgaggagtagctgag

SEQ ID NO: 6141449 - DNA, 21 bp, Homo sapiens
ctgaggagtagctgagaggaa

SEQ ID NO: 6141450 - DNA, 23 bp, Homo sapiens
ctgaggagtagctgagaggaaga

SEQ ID NO: 6141451 - DNA, 12 bp, Homo sapiens
ctgaggagtcca

SEQ ID NO: 6141452 - DNA, 16 bp, Homo sapiens
ctgaggagtctgaggt

SEQ ID NO: 6141453 - DNA, 19 bp, Homo sapiens
ctgaggagtgatgggcaag

SEQ ID NO: 6141454 - DNA, 21 bp, Homo sapiens
ctgaggagtggagttctctgt

SEQ ID NO: 6141455 - DNA, 14 bp, Homo sapiens
ctgaggagtgtcct

SEQ ID NO: 6141456 - DNA, 18 bp, Homo sapiens
ctgaggagtgtcctgtct

SEQ ID NO: 6141457 - DNA, 15 bp, Homo sapiens
ctgaggataactcaa

SEQ ID NO: 6141458 - DNA, 18 bp, Homo sapiens
ctgaggataccccaaagt

SEQ ID NO: 6141459 - DNA, 17 bp, Homo sapiens
ctgaggatataagcttt

SEQ ID NO: 6141460 - DNA, 18 bp, Homo sapiens
ctgaggatcccctgtccc

SEQ ID NO: 6141461 - DNA, 19 bp, Homo sapiens
ctgaggatcccctgtcccc

SEQ ID NO: 6141462 - DNA, 23 bp, Homo sapiens
ctgaggatcccctgtcccctggg

SEQ ID NO: 6141463 - DNA, 20 bp, Homo sapiens
ctgaggatcctcacaggagc

SEQ ID NO: 6141464 - DNA, 23 bp, Homo sapiens
ctgaggatgacccggggcagctg

SEQ ID NO: 6141465 - DNA, 16 bp, Homo sapiens
ctgaggatgagctgga

SEQ ID NO: 6141466 - DNA, 14 bp, Homo sapiens
ctgaggatgctgag

SEQ ID NO: 6141467 - DNA, 14 bp, Homo sapiens
ctgaggatggcctg

SEQ ID NO: 6141468 - DNA, 18 bp, Homo sapiens
ctgaggatgggtcagagc

SEQ ID NO: 6141469 - DNA, 11 bp, Homo sapiens
ctgaggatgtt

SEQ ID NO: 6141470 - DNA, 17 bp, Homo sapiens
ctgaggatttcaagcct

SEQ ID NO: 6141471 - DNA, 18 bp, Homo sapiens
ctgaggatttcctggagt

SEQ ID NO: 6141472 - DNA, 20 bp, Homo sapiens
ctgaggatttcctggagtgc

SEQ ID NO: 6141473 - DNA, 22 bp, Homo sapiens
ctgaggatttcctggagtgccc

SEQ ID NO: 6141474 - DNA, 14 bp, Homo sapiens
ctgaggcaaccccc

SEQ ID NO: 6141475 - DNA, 17 bp, Homo sapiens
ctgaggcaaccccctcg

SEQ ID NO: 6141476 - DNA, 18 bp, Homo sapiens
ctgaggcaaggcccagac

SEQ ID NO: 6141477 - DNA, 21 bp, Homo sapiens
ctgaggcaaggcccagacctg

SEQ ID NO: 6141478 - DNA, 20 bp, Homo sapiens
ctgaggcacaagaatcactt

SEQ ID NO: 6141479 - DNA, 15 bp, Homo sapiens
ctgaggcagaacctg

SEQ ID NO: 6141480 - DNA, 21 bp, Homo sapiens
ctgaggcagaacctggtggct

SEQ ID NO: 6141481 - DNA, 14 bp, Homo sapiens
ctgaggcagccttg

SEQ ID NO: 6141482 - DNA, 15 bp, Homo sapiens
ctgaggcagccttgg

SEQ ID NO: 6141483 - DNA, 16 bp, Homo sapiens
ctgaggcagccttggg

SEQ ID NO: 6141484 - DNA, 21 bp, Homo sapiens
ctgaggcaggagaactacttg

SEQ ID NO: 6141485 - DNA, 15 bp, Homo sapiens
ctgaggcaggagaat

SEQ ID NO: 6141486 - DNA, 16 bp, Homo sapiens
ctgaggcaggagaatc

SEQ ID NO: 6141487 - DNA, 17 bp, Homo sapiens
ctgaggcaggagactgg

SEQ ID NO: 6141488 - DNA, 16 bp, Homo sapiens
ctgaggcagggaagtc

SEQ ID NO: 6141489 - DNA, 17 bp, Homo sapiens
ctgaggcaggtccccag

SEQ ID NO: 6141490 - DNA, 20 bp, Homo sapiens
ctgaggcaggtgagaaccca

SEQ ID NO: 6141491 - DNA, 21 bp, Homo sapiens
ctgaggcaggtgagaacccag

SEQ ID NO: 6141492 - DNA, 16 bp, Homo sapiens
ctgaggcatcctctga

SEQ ID NO: 6141493 - DNA, 21 bp, Homo sapiens
ctgaggccacactcagcacaa

SEQ ID NO: 6141494 - DNA, 24 bp, Homo sapiens
ctgaggccacactcagcacaaggc

SEQ ID NO: 6141495 - DNA, 19 bp, Homo sapiens
ctgaggccacccactgacc

SEQ ID NO: 6141496 - DNA, 17 bp, Homo sapiens
ctgaggccagaaaggtg

SEQ ID NO: 6141497 - DNA, 15 bp, Homo sapiens
ctgaggccagaggaa

SEQ ID NO: 6141498 - DNA, 18 bp, Homo sapiens
ctgaggccagaggaaggg

SEQ ID NO: 6141499 - DNA, 20 bp, Homo sapiens
ctgaggccagcctggcctcc

SEQ ID NO: 6141500 - DNA, 16 bp, Homo sapiens
ctgaggccatcagggc

SEQ ID NO: 6141501 - DNA, 20 bp, Homo sapiens
ctgaggccatcagggccctg

SEQ ID NO: 6141502 - DNA, 22 bp, Homo sapiens
ctgaggccatcagggccctgcc

SEQ ID NO: 6141503 - DNA, 19 bp, Homo sapiens
ctgaggccattccctgtag

SEQ ID NO: 6141504 - DNA, 13 bp, Homo sapiens
ctgaggcccagag

SEQ ID NO: 6141505 - DNA, 16 bp, Homo sapiens
ctgaggcccagagagc

SEQ ID NO: 6141506 - DNA, 18 bp, Homo sapiens
ctgaggcccagagagctg

SEQ ID NO: 6141507 - DNA, 15 bp, Homo sapiens
ctgaggcccagaggg

SEQ ID NO: 6141508 - DNA, 13 bp, Homo sapiens
ctgaggcccagtg

SEQ ID NO: 6141509 - DNA, 11 bp, Homo sapiens
ctgaggcccat

SEQ ID NO: 6141510 - DNA, 19 bp, Homo sapiens
ctgaggcccatggccacat

SEQ ID NO: 6141511 - DNA, 15 bp, Homo sapiens
ctgaggccccaggtg

SEQ ID NO: 6141512 - DNA, 22 bp, Homo sapiens
ctgaggcccctaggtgcccagg

SEQ ID NO: 6141513 - DNA, 15 bp, Homo sapiens
ctgaggcccctgcct

SEQ ID NO: 6141514 - DNA, 21 bp, Homo sapiens
ctgaggccccttctaggtggc

SEQ ID NO: 6141515 - DNA, 13 bp, Homo sapiens
ctgaggccctgtg

SEQ ID NO: 6141516 - DNA, 18 bp, Homo sapiens
ctgaggcctatgcagaca

SEQ ID NO: 6141517 - DNA, 17 bp, Homo sapiens
ctgaggcctcatccctc

SEQ ID NO: 6141518 - DNA, 12 bp, Homo sapiens
ctgaggcctcca

SEQ ID NO: 6141519 - DNA, 14 bp, Homo sapiens
ctgaggcctccaag

SEQ ID NO: 6141520 - DNA, 15 bp, Homo sapiens
ctgaggcctccaagg

SEQ ID NO: 6141521 - DNA, 13 bp, Homo sapiens
ctgaggcctccct

SEQ ID NO: 6141522 - DNA, 17 bp, Homo sapiens
ctgaggcctctcagaaa

SEQ ID NO: 6141523 - DNA, 14 bp, Homo sapiens
ctgaggcctgagac

SEQ ID NO: 6141524 - DNA, 20 bp, Homo sapiens
ctgaggcctgagacccagga

SEQ ID NO: 6141525 - DNA, 17 bp, Homo sapiens
ctgaggcctgagcgctc

SEQ ID NO: 6141526 - DNA, 17 bp, Homo sapiens
ctgaggcctgaggcctg

SEQ ID NO: 6141527 - DNA, 23 bp, Homo sapiens
ctgaggcctgaggcctgtgcctg

SEQ ID NO: 6141528 - DNA, 17 bp, Homo sapiens
ctgaggcctgccccctg

SEQ ID NO: 6141529 - DNA, 23 bp, Homo sapiens
ctgaggcctgccccctgggctgg

SEQ ID NO: 6141530 - DNA, 15 bp, Homo sapiens
ctgaggcctggactt

SEQ ID NO: 6141531 - DNA, 19 bp, Homo sapiens
ctgaggcctggactttcct

SEQ ID NO: 6141532 - DNA, 17 bp, Homo sapiens
ctgaggcctgtgcctgt

SEQ ID NO: 6141533 - DNA, 14 bp, Homo sapiens
ctgaggccttccag

SEQ ID NO: 6141534 - DNA, 12 bp, Homo sapiens
ctgaggccttgt

SEQ ID NO: 6141535 - DNA, 21 bp, Homo sapiens
ctgaggccttgtgtgtcaggc

SEQ ID NO: 6141536 - DNA, 22 bp, Homo sapiens
ctgaggccttgtgtgtcaggcc

SEQ ID NO: 6141537 - DNA, 22 bp, Homo sapiens
ctgaggcgagaagggctgcttc

SEQ ID NO: 6141538 - DNA, 16 bp, Homo sapiens
ctgaggcggagcccag

SEQ ID NO: 6141539 - DNA, 21 bp, Homo sapiens
ctgaggcggaggctgtgctcc

SEQ ID NO: 6141540 - DNA, 18 bp, Homo sapiens
ctgaggcgggtggatcac

SEQ ID NO: 6141541 - DNA, 13 bp, Homo sapiens
ctgaggctcaaga

SEQ ID NO: 6141542 - DNA, 18 bp, Homo sapiens
ctgaggctcaagaggccc

SEQ ID NO: 6141543 - DNA, 19 bp, Homo sapiens
ctgaggctcaagaggccca

SEQ ID NO: 6141544 - DNA, 21 bp, Homo sapiens
ctgaggctccacttggtctgt

SEQ ID NO: 6141545 - DNA, 15 bp, Homo sapiens
ctgaggctctctaag

SEQ ID NO: 6141546 - DNA, 22 bp, Homo sapiens
ctgaggctctctaagaaaagag

SEQ ID NO: 6141547 - DNA, 16 bp, Homo sapiens
ctgaggctgagaaagc

SEQ ID NO: 6141548 - DNA, 12 bp, Homo sapiens
ctgaggctgagg

SEQ ID NO: 6141549 - DNA, 15 bp, Homo sapiens
ctgaggctgaggcag

SEQ ID NO: 6141550 - DNA, 14 bp, Homo sapiens
ctgaggctgcatct

SEQ ID NO: 6141551 - DNA, 11 bp, Homo sapiens
ctgaggctgcc

SEQ ID NO: 6141552 - DNA, 21 bp, Homo sapiens
ctgaggctgccccaggggcac

SEQ ID NO: 6141553 - DNA, 18 bp, Homo sapiens
ctgaggctggactccaga

SEQ ID NO: 6141554 - DNA, 11 bp, Homo sapiens
ctgaggctggc

SEQ ID NO: 6141555 - DNA, 12 bp, Homo sapiens
ctgaggctggca

SEQ ID NO: 6141556 - DNA, 13 bp, Homo sapiens
ctgaggctggcac

SEQ ID NO: 6141557 - DNA, 17 bp, Homo sapiens
ctgaggctggcatcctg

SEQ ID NO: 6141558 - DNA, 18 bp, Homo sapiens
ctcagcccccaggccagg

SEQ ID NO: 6141559 - DNA, 17 bp, Homo sapiens
ctcagccccgcgtggaa

SEQ ID NO: 6141560 - DNA, 16 bp, Homo sapiens
ctcagccccggccact

SEQ ID NO: 6141561 - DNA, 18 bp, Homo sapiens
ctcagccccggccactcc

SEQ ID NO: 6141562 - DNA, 23 bp, Homo sapiens
ctcagccccggccactccctgcc

SEQ ID NO: 6141563 - DNA, 19 bp, Homo sapiens
ctcagccccgggcctgcct

SEQ ID NO: 6141564 - DNA, 20 bp, Homo sapiens
ctcagccccgggcctgcctc

SEQ ID NO: 6141565 - DNA, 19 bp, Homo sapiens
ctcagcccctacccctgcc

SEQ ID NO: 6141566 - DNA, 20 bp, Homo sapiens
ctcagcccctacccctgccc

SEQ ID NO: 6141567 - DNA, 21 bp, Homo sapiens
ctcagcccctacccctgccct

SEQ ID NO: 6141568 - DNA, 20 bp, Homo sapiens
ctcagcccctagcagagcgt

SEQ ID NO: 6141569 - DNA, 17 bp, Homo sapiens
ctcagcccctcagagaa

SEQ ID NO: 6141570 - DNA, 18 bp, Homo sapiens
ctcagcccctcttgcccc

SEQ ID NO: 6141571 - DNA, 19 bp, Homo sapiens
ctcagcccgcttggccacc

SEQ ID NO: 6141572 - DNA, 12 bp, Homo sapiens
ctcagcccggga

SEQ ID NO: 6141573 - DNA, 18 bp, Homo sapiens
ctcagcccgggatcctga

SEQ ID NO: 6141574 - DNA, 20 bp, Homo sapiens
ctcagccctccctgcccctc

SEQ ID NO: 6141575 - DNA, 21 bp, Homo sapiens
ctcagccctccctgcccctcc

SEQ ID NO: 6141576 - DNA, 12 bp, Homo sapiens
ctcagccctcgg

SEQ ID NO: 6141577 - DNA, 17 bp, Homo sapiens
ctcagccctctcttgcc

SEQ ID NO: 6141578 - DNA, 18 bp, Homo sapiens
ctcagccctctcttgcca

SEQ ID NO: 6141579 - DNA, 18 bp, Homo sapiens
ctcagccctgactggtgc

SEQ ID NO: 6141580 - DNA, 15 bp, Homo sapiens
ctcagccctgagcta

SEQ ID NO: 6141581 - DNA, 15 bp, Homo sapiens
ctcagccctgaggtg

SEQ ID NO: 6141582 - DNA, 21 bp, Homo sapiens
ctcagccctgctccctgcctc

SEQ ID NO: 6141583 - DNA, 20 bp, Homo sapiens
ctcagccctggaggtgccag

SEQ ID NO: 6141584 - DNA, 20 bp, Homo sapiens
ctcagccctggccctgccca

SEQ ID NO: 6141585 - DNA, 15 bp, Homo sapiens
ctcagccctggcctg

SEQ ID NO: 6141586 - DNA, 20 bp, Homo sapiens
ctcagccctggcctggctgg

SEQ ID NO: 6141587 - DNA, 21 bp, Homo sapiens
ctcagccctggcctggctggg

SEQ ID NO: 6141588 - DNA, 23 bp, Homo sapiens
ctcagccggcgtggcaaatataa

SEQ ID NO: 6141589 - DNA, 19 bp, Homo sapiens
ctcagccgtagggtggcac

SEQ ID NO: 6141590 - DNA, 18 bp, Homo sapiens
ctcagcctacagcagtgt

SEQ ID NO: 6141591 - DNA, 20 bp, Homo sapiens
ctcagcctcaataagccttg

SEQ ID NO: 6141592 - DNA, 14 bp, Homo sapiens
ctcagcctcatcct

SEQ ID NO: 6141593 - DNA, 22 bp, Homo sapiens
ctcagcctcatcctccccagga

SEQ ID NO: 6141594 - DNA, 21 bp, Homo sapiens
ctcagcctccaatgcattggc

SEQ ID NO: 6141595 - DNA, 22 bp, Homo sapiens
ctcagcctccaatgcattggcc

SEQ ID NO: 6141596 - DNA, 15 bp, Homo sapiens
ctcagcctccactcc

SEQ ID NO: 6141597 - DNA, 18 bp, Homo sapiens
ctcagcctccagagtagc

SEQ ID NO: 6141598 - DNA, 12 bp, Homo sapiens
ctcagcctccca

SEQ ID NO: 6141599 - DNA, 18 bp, Homo sapiens
ctcagcctcccaaagtgc

SEQ ID NO: 6141600 - DNA, 21 bp, Homo sapiens
ctcagcctcccaaagtgctgg

SEQ ID NO: 6141601 - DNA, 22 bp, Homo sapiens
ctcagcctcccaaagtgctggg

SEQ ID NO: 6141602 - DNA, 18 bp, Homo sapiens
ctcagcctcccaagtaac

SEQ ID NO: 6141603 - DNA, 14 bp, Homo sapiens
ctcagcctcccagg

SEQ ID NO: 6141604 - DNA, 12 bp, Homo sapiens
ctcagcctcccc

SEQ ID NO: 6141605 - DNA, 14 bp, Homo sapiens
ctcagcctcccccc

SEQ ID NO: 6141606 - DNA, 14 bp, Homo sapiens
ctcagcctccccct

SEQ ID NO: 6141607 - DNA, 16 bp, Homo sapiens
ctcagcctccccctgc

SEQ ID NO: 6141608 - DNA, 21 bp, Homo sapiens
ctcagcctcccgaatagctgg

SEQ ID NO: 6141609 - DNA, 20 bp, Homo sapiens
ctcagcctccggagtagctg

SEQ ID NO: 6141610 - DNA, 22 bp, Homo sapiens
ctcagcctccggatgacacaaa

SEQ ID NO: 6141611 - DNA, 18 bp, Homo sapiens
ctcagcctcctcatctgg

SEQ ID NO: 6141612 - DNA, 12 bp, Homo sapiens
ctcagcctcctg

SEQ ID NO: 6141613 - DNA, 17 bp, Homo sapiens
ctcagcctcctgagcct

SEQ ID NO: 6141614 - DNA, 16 bp, Homo sapiens
ctcagcctcctgggta

SEQ ID NO: 6141615 - DNA, 16 bp, Homo sapiens
ctcagcctctgcaact

SEQ ID NO: 6141616 - DNA, 15 bp, Homo sapiens
ctcagcctctgccag

SEQ ID NO: 6141617 - DNA, 18 bp, Homo sapiens
ctcagcctctgctggaga

SEQ ID NO: 6141618 - DNA, 14 bp, Homo sapiens
ctcagcctcttctc

SEQ ID NO: 6141619 - DNA, 17 bp, Homo sapiens
ctcagcctgcaccctct

SEQ ID NO: 6141620 - DNA, 13 bp, Homo sapiens
ctcagcctgccca

SEQ ID NO: 6141621 - DNA, 22 bp, Homo sapiens
ctcagcctgcctgaagagagga

SEQ ID NO: 6141622 - DNA, 16 bp, Homo sapiens
ctcagcctgcctggga

SEQ ID NO: 6141623 - DNA, 15 bp, Homo sapiens
ctcagcctgctgccc

SEQ ID NO: 6141624 - DNA, 19 bp, Homo sapiens
ctcagcctgctgcccaggc

SEQ ID NO: 6141625 - DNA, 20 bp, Homo sapiens
ctcagcctgctttcctgcag

SEQ ID NO: 6141626 - DNA, 13 bp, Homo sapiens
ctcagcctggaga

SEQ ID NO: 6141627 - DNA, 14 bp, Homo sapiens
ctcagcctggagag

SEQ ID NO: 6141628 - DNA, 17 bp, Homo sapiens
ctcagcctggagaggcc

SEQ ID NO: 6141629 - DNA, 19 bp, Homo sapiens
ctcagcctggagaggcctg

SEQ ID NO: 6141630 - DNA, 20 bp, Homo sapiens
ctcagcctggagaggcctgg

SEQ ID NO: 6141631 - DNA, 16 bp, Homo sapiens
ctcagcctggccagac

SEQ ID NO: 6141632 - DNA, 19 bp, Homo sapiens
ctcagcctggccagacaca

SEQ ID NO: 6141633 - DNA, 19 bp, Homo sapiens
ctcagcctgggcccctcag

SEQ ID NO: 6141634 - DNA, 21 bp, Homo sapiens
ctcagcctgggcgctggtcct

SEQ ID NO: 6141635 - DNA, 14 bp, Homo sapiens
ctcagcctggggct

SEQ ID NO: 6141636 - DNA, 22 bp, Homo sapiens
ctcagcctggggctctctgacc

SEQ ID NO: 6141637 - DNA, 19 bp, Homo sapiens
ctcagcctggtgggcctcc

SEQ ID NO: 6141638 - DNA, 14 bp, Homo sapiens
ctcagcctgtgctg

SEQ ID NO: 6141639 - DNA, 17 bp, Homo sapiens
ctcagcctgttccttcc

SEQ ID NO: 6141640 - DNA, 23 bp, Homo sapiens
ctcagcctgttccttcctgcaga

SEQ ID NO: 6141641 - DNA, 21 bp, Homo sapiens
ctcagccttaagaaagctata

SEQ ID NO: 6141642 - DNA, 16 bp, Homo sapiens
ctcagccttcagacag

SEQ ID NO: 6141643 - DNA, 20 bp, Homo sapiens
ctcagccttccaactagctg

SEQ ID NO: 6141644 - DNA, 22 bp, Homo sapiens
ctcagccttccaactagctggg

SEQ ID NO: 6141645 - DNA, 14 bp, Homo sapiens
ctcagccttgcaca

SEQ ID NO: 6141646 - DNA, 16 bp, Homo sapiens
ctcagccttgcacacc

SEQ ID NO: 6141647 - DNA, 22 bp, Homo sapiens
ctcagccttgcacacccactgc

SEQ ID NO: 6141648 - DNA, 15 bp, Homo sapiens
ctcagccttgccaga

SEQ ID NO: 6141649 - DNA, 17 bp, Homo sapiens
ctcagccttgccagaga

SEQ ID NO: 6141650 - DNA, 20 bp, Homo sapiens
ctcagccttgccagagatcc

SEQ ID NO: 6141651 - DNA, 21 bp, Homo sapiens
ctcagccttgccagagatcca

SEQ ID NO: 6141652 - DNA, 19 bp, Homo sapiens
ctcagccttgctgctctgc

SEQ ID NO: 6141653 - DNA, 20 bp, Homo sapiens
ctcagccttgctgctctgcg

SEQ ID NO: 6141654 - DNA, 11 bp, Homo sapiens
ctcagccttgg

SEQ ID NO: 6141655 - DNA, 16 bp, Homo sapiens
ctcagccttggaagca

SEQ ID NO: 6141656 - DNA, 14 bp, Homo sapiens
ctcagcgaatgaat

SEQ ID NO: 6141657 - DNA, 16 bp, Homo sapiens
ctcagcgcaggctgca

SEQ ID NO: 6141658 - DNA, 21 bp, Homo sapiens
ctcagcgcaggctgcagagcc

SEQ ID NO: 6141659 - DNA, 13 bp, Homo sapiens
ctcagcgctccct

SEQ ID NO: 6141660 - DNA, 22 bp, Homo sapiens
ctcagcgctccctgtcgcctgc

SEQ ID NO: 6141661 - DNA, 17 bp, Homo sapiens
ctcagcgctgcccacac

SEQ ID NO: 6141662 - DNA, 19 bp, Homo sapiens
ctcagcgctgcccacacca

SEQ ID NO: 6141663 - DNA, 13 bp, Homo sapiens
ctcagcggagggg

SEQ ID NO: 6141664 - DNA, 17 bp, Homo sapiens
ctcagcgggagtctcct

SEQ ID NO: 6141665 - DNA, 18 bp, Homo sapiens
ctcagcgggagtctcctc

SEQ ID NO: 6141666 - DNA, 13 bp, Homo sapiens
ctcagcggggaca

SEQ ID NO: 6141667 - DNA, 16 bp, Homo sapiens
ctcagcggggacagct

SEQ ID NO: 6141668 - DNA, 19 bp, Homo sapiens
ctcagcggggacagctcct

SEQ ID NO: 6141669 - DNA, 19 bp, Homo sapiens
ctcagcgtctccccatgct

SEQ ID NO: 6141670 - DNA, 14 bp, Homo sapiens
ctcagcgttttgag

SEQ ID NO: 6141671 - DNA, 19 bp, Homo sapiens
ctcagctacccactatcct

SEQ ID NO: 6141672 - DNA, 16 bp, Homo sapiens
ctcagctactcaggag

SEQ ID NO: 6141673 - DNA, 18 bp, Homo sapiens
ctcagctactcaggaggc

SEQ ID NO: 6141674 - DNA, 14 bp, Homo sapiens
ctcagctagctctg

SEQ ID NO: 6141675 - DNA, 22 bp, Homo sapiens
ctcagctataattctgttatat

SEQ ID NO: 6141676 - DNA, 22 bp, Homo sapiens
ctcagctcaccacaacctccac

SEQ ID NO: 6141677 - DNA, 20 bp, Homo sapiens
ctcagctcactgcaacctcc

SEQ ID NO: 6141678 - DNA, 19 bp, Homo sapiens
ctcagctcactgcaagctc

SEQ ID NO: 6141679 - DNA, 14 bp, Homo sapiens
ctcagctcactgtg

SEQ ID NO: 6141680 - DNA, 16 bp, Homo sapiens
ctcagctcagctgggc

SEQ ID NO: 6141681 - DNA, 14 bp, Homo sapiens
ctcagctcatccat

SEQ ID NO: 6141682 - DNA, 13 bp, Homo sapiens
ctcagctccagaa

SEQ ID NO: 6141683 - DNA, 22 bp, Homo sapiens
ctcagctccagaataccttctt

SEQ ID NO: 6141684 - DNA, 23 bp, Homo sapiens
ctcagctccagaataccttcttc

SEQ ID NO: 6141685 - DNA, 13 bp, Homo sapiens
ctcagctcccaca

SEQ ID NO: 6141686 - DNA, 18 bp, Homo sapiens
ctcagctcccacaagcct

SEQ ID NO: 6141687 - DNA, 20 bp, Homo sapiens
ctcagctcccacaagcctct

SEQ ID NO: 6141688 - DNA, 14 bp, Homo sapiens
ctcagctcccaggc

SEQ ID NO: 6141689 - DNA, 15 bp, Homo sapiens
ctcagctcccaggcc

SEQ ID NO: 6141690 - DNA, 16 bp, Homo sapiens
ctcagctcccatttct

SEQ ID NO: 6141691 - DNA, 17 bp, Homo sapiens
ctcagctcccatttcta

SEQ ID NO: 6141692 - DNA, 19 bp, Homo sapiens
ctcagctccccagagtcct

SEQ ID NO: 6141693 - DNA, 16 bp, Homo sapiens
ctcagctccctgaccc

SEQ ID NO: 6141694 - DNA, 22 bp, Homo sapiens
ctcagctccctgcctgtttccc

SEQ ID NO: 6141695 - DNA, 12 bp, Homo sapiens
ctcagctcgctg

SEQ ID NO: 6141696 - DNA, 19 bp, Homo sapiens
ctcagctcgctgcccaggg

SEQ ID NO: 6141697 - DNA, 19 bp, Homo sapiens
ctcagctcggggagcctta

SEQ ID NO: 6141698 - DNA, 20 bp, Homo sapiens
ctcagctctaggctgttctg

SEQ ID NO: 6141699 - DNA, 13 bp, Homo sapiens
ctcagctctctgg

SEQ ID NO: 6141700 - DNA, 13 bp, Homo sapiens
ctcagctctggct

SEQ ID NO: 6141701 - DNA, 14 bp, Homo sapiens
ctcagctctgggag

SEQ ID NO: 6141702 - DNA, 15 bp, Homo sapiens
ctcagctctgggaga

SEQ ID NO: 6141703 - DNA, 18 bp, Homo sapiens
ctcagctctgggagagga

SEQ ID NO: 6141704 - DNA, 18 bp, Homo sapiens
ctcagctcttccatgatg

SEQ ID NO: 6141705 - DNA, 15 bp, Homo sapiens
ctcagctgacccggc

SEQ ID NO: 6141706 - DNA, 19 bp, Homo sapiens
ctcagctgacccggcctct

SEQ ID NO: 6141707 - DNA, 14 bp, Homo sapiens
ctcagctgcacatt

SEQ ID NO: 6141708 - DNA, 17 bp, Homo sapiens
ctcagctgcacattcct

SEQ ID NO: 6141709 - DNA, 21 bp, Homo sapiens
ctcagctgcacattcctggcc

SEQ ID NO: 6141710 - DNA, 22 bp, Homo sapiens
ctcagctgcacattcctggccc

SEQ ID NO: 6141711 - DNA, 11 bp, Homo sapiens
ctcagctgcat

SEQ ID NO: 6141712 - DNA, 17 bp, Homo sapiens
ctcagctgcatctgata

SEQ ID NO: 6141713 - DNA, 14 bp, Homo sapiens
ctcagctgcatgga

SEQ ID NO: 6141714 - DNA, 19 bp, Homo sapiens
ctcagctgcatggagcctg

SEQ ID NO: 6141715 - DNA, 21 bp, Homo sapiens
ctcagctgcatggagcctgga

SEQ ID NO: 6141716 - DNA, 14 bp, Homo sapiens
ctcagctgccaagc

SEQ ID NO: 6141717 - DNA, 13 bp, Homo sapiens
ctcagctgcccat

SEQ ID NO: 6141718 - DNA, 18 bp, Homo sapiens
ctcagctgcccatcccag

SEQ ID NO: 6141719 - DNA, 13 bp, Homo sapiens
ctcagctgcctca

SEQ ID NO: 6141720 - DNA, 16 bp, Homo sapiens
ctcagctgcctcactt

SEQ ID NO: 6141721 - DNA, 17 bp, Homo sapiens
ctcagctgcctcctgcg

SEQ ID NO: 6141722 - DNA, 14 bp, Homo sapiens
ctcagctgctcgca

SEQ ID NO: 6141723 - DNA, 17 bp, Homo sapiens
ctcagctgctcgcacag

SEQ ID NO: 6141724 - DNA, 18 bp, Homo sapiens
ctcagctgctcgcacaga

SEQ ID NO: 6141725 - DNA, 14 bp, Homo sapiens
ctcagctgctggat

SEQ ID NO: 6141726 - DNA, 16 bp, Homo sapiens
ctcagctgctggatga

SEQ ID NO: 6141727 - DNA, 17 bp, Homo sapiens
ctcagctgctggatgac

SEQ ID NO: 6141728 - DNA, 22 bp, Homo sapiens
ctcagctgctggatgacttgag

SEQ ID NO: 6141729 - DNA, 19 bp, Homo sapiens
ctcagctggaagtctacct

SEQ ID NO: 6141730 - DNA, 17 bp, Homo sapiens
ctcagctggcagtgcaa

SEQ ID NO: 6141731 - DNA, 19 bp, Homo sapiens
ctcagctggcggaacctgg

SEQ ID NO: 6141732 - DNA, 23 bp, Homo sapiens
ctcagctggctgagacactgaag

SEQ ID NO: 6141733 - DNA, 21 bp, Homo sapiens
ctcagctgggccactcctctt

SEQ ID NO: 6141734 - DNA, 21 bp, Homo sapiens
ctcagctggtcctgaccagga

SEQ ID NO: 6141735 - DNA, 20 bp, Homo sapiens
ctcagctggttactcagggt

SEQ ID NO: 6141736 - DNA, 24 bp, Homo sapiens
ctgaggctggcatcctggctggct

SEQ ID NO: 6141737 - DNA, 16 bp, Homo sapiens
ctgaggctggctgggg

SEQ ID NO: 6141738 - DNA, 18 bp, Homo sapiens
ctgaggctggctgggggc

SEQ ID NO: 6141739 - DNA, 13 bp, Homo sapiens
ctgaggctgggct

SEQ ID NO: 6141740 - DNA, 15 bp, Homo sapiens
ctgaggctgggctcc

SEQ ID NO: 6141741 - DNA, 20 bp, Homo sapiens
ctgaggctgggggagagccg

SEQ ID NO: 6141742 - DNA, 15 bp, Homo sapiens
ctgaggctgtgagca

SEQ ID NO: 6141743 - DNA, 19 bp, Homo sapiens
ctgaggctgtggtcacagc

SEQ ID NO: 6141744 - DNA, 20 bp, Homo sapiens
ctgaggctgtggtcacagcg

SEQ ID NO: 6141745 - DNA, 17 bp, Homo sapiens
ctgaggcttaggcctct

SEQ ID NO: 6141746 - DNA, 14 bp, Homo sapiens
ctgaggcttccaga

SEQ ID NO: 6141747 - DNA, 13 bp, Homo sapiens
ctgaggcttgggc

SEQ ID NO: 6141748 - DNA, 14 bp, Homo sapiens
ctgaggcttgggcc

SEQ ID NO: 6141749 - DNA, 20 bp, Homo sapiens
ctgaggcttgggcccagtag

SEQ ID NO: 6141750 - DNA, 18 bp, Homo sapiens
ctgaggctttggatttga

SEQ ID NO: 6141751 - DNA, 21 bp, Homo sapiens
ctgaggctttggtacccccaa

SEQ ID NO: 6141752 - DNA, 16 bp, Homo sapiens
ctgagggaaagtgcat

SEQ ID NO: 6141753 - DNA, 16 bp, Homo sapiens
ctgagggaaatgtttt

SEQ ID NO: 6141754 - DNA, 18 bp, Homo sapiens
ctgagggaaatgttttgt

SEQ ID NO: 6141755 - DNA, 22 bp, Homo sapiens
ctgagggaaatgttttgtaaac

SEQ ID NO: 6141756 - DNA, 14 bp, Homo sapiens
ctgagggaagccca

SEQ ID NO: 6141757 - DNA, 20 bp, Homo sapiens
ctgagggaagcccacccgcc

SEQ ID NO: 6141758 - DNA, 23 bp, Homo sapiens
ctgagggaagcccacccgcccca

SEQ ID NO: 6141759 - DNA, 21 bp, Homo sapiens
ctgagggacatatcagtgacc

SEQ ID NO: 6141760 - DNA, 12 bp, Homo sapiens
ctgagggaccaa

SEQ ID NO: 6141761 - DNA, 19 bp, Homo sapiens
ctgagggaccaactgggcc

SEQ ID NO: 6141762 - DNA, 18 bp, Homo sapiens
ctgagggaccagccaaga

SEQ ID NO: 6141763 - DNA, 16 bp, Homo sapiens
ctgagggaccttggag

SEQ ID NO: 6141764 - DNA, 18 bp, Homo sapiens
ctgagggaccttggagag

SEQ ID NO: 6141765 - DNA, 19 bp, Homo sapiens
ctgagggaccttggagagc

SEQ ID NO: 6141766 - DNA, 20 bp, Homo sapiens
ctgagggaccttggagagct

SEQ ID NO: 6141767 - DNA, 23 bp, Homo sapiens
ctgagggaccttggagagctcag

SEQ ID NO: 6141768 - DNA, 20 bp, Homo sapiens
ctgagggacgagcagagcgc

SEQ ID NO: 6141769 - DNA, 21 bp, Homo sapiens
ctgagggactctgaagcctct

SEQ ID NO: 6141770 - DNA, 13 bp, Homo sapiens
ctgagggagcctg

SEQ ID NO: 6141771 - DNA, 22 bp, Homo sapiens
ctgagggaggacctggggcaca

SEQ ID NO: 6141772 - DNA, 13 bp, Homo sapiens
ctgagggaggagg

SEQ ID NO: 6141773 - DNA, 17 bp, Homo sapiens
ctgagggaggaggccac

SEQ ID NO: 6141774 - DNA, 18 bp, Homo sapiens
ctgagggaggaggccacc

SEQ ID NO: 6141775 - DNA, 20 bp, Homo sapiens
ctgagggatggactgatgct

SEQ ID NO: 6141776 - DNA, 15 bp, Homo sapiens
ctgagggattctatt

SEQ ID NO: 6141777 - DNA, 23 bp, Homo sapiens
ctgagggattttagcctcttccc

SEQ ID NO: 6141778 - DNA, 12 bp, Homo sapiens
ctgagggcaaat

SEQ ID NO: 6141779 - DNA, 19 bp, Homo sapiens
ctgagggcagactggggca

SEQ ID NO: 6141780 - DNA, 14 bp, Homo sapiens
ctgagggcagagag

SEQ ID NO: 6141781 - DNA, 16 bp, Homo sapiens
ctgagggcagagaggt

SEQ ID NO: 6141782 - DNA, 13 bp, Homo sapiens
ctgagggcagtgc

SEQ ID NO: 6141783 - DNA, 14 bp, Homo sapiens
ctgagggccacact

SEQ ID NO: 6141784 - DNA, 15 bp, Homo sapiens
ctgagggccacacta

SEQ ID NO: 6141785 - DNA, 15 bp, Homo sapiens
ctgagggccagggac

SEQ ID NO: 6141786 - DNA, 18 bp, Homo sapiens
ctgagggccagggaccca

SEQ ID NO: 6141787 - DNA, 13 bp, Homo sapiens
ctgagggcccctc

SEQ ID NO: 6141788 - DNA, 17 bp, Homo sapiens
ctgagggcccctctgcc

SEQ ID NO: 6141789 - DNA, 18 bp, Homo sapiens
ctgagggcccctctgccc

SEQ ID NO: 6141790 - DNA, 21 bp, Homo sapiens
ctgagggcccctctgcccagc

SEQ ID NO: 6141791 - DNA, 16 bp, Homo sapiens
ctgagggccctgtgga

SEQ ID NO: 6141792 - DNA, 12 bp, Homo sapiens
ctgagggccctt

SEQ ID NO: 6141793 - DNA, 15 bp, Homo sapiens
ctgagggcctgctgg

SEQ ID NO: 6141794 - DNA, 16 bp, Homo sapiens
ctgagggcctggtcac

SEQ ID NO: 6141795 - DNA, 21 bp, Homo sapiens
ctgagggctaattctgggaag

SEQ ID NO: 6141796 - DNA, 22 bp, Homo sapiens
ctgagggctaattctgggaagg

SEQ ID NO: 6141797 - DNA, 13 bp, Homo sapiens
ctgagggctcctc

SEQ ID NO: 6141798 - DNA, 16 bp, Homo sapiens
ctgagggctcctccat

SEQ ID NO: 6141799 - DNA, 18 bp, Homo sapiens
ctgagggctcctccatgg

SEQ ID NO: 6141800 - DNA, 23 bp, Homo sapiens
ctgagggctcctccatggtgctg

SEQ ID NO: 6141801 - DNA, 16 bp, Homo sapiens
ctgagggctgatcttt

SEQ ID NO: 6141802 - DNA, 21 bp, Homo sapiens
ctgagggctgccagcagcccc

SEQ ID NO: 6141803 - DNA, 22 bp, Homo sapiens
ctgagggctgccagcagccccg

SEQ ID NO: 6141804 - DNA, 22 bp, Homo sapiens
ctgaggggaggatcactggagc

SEQ ID NO: 6141805 - DNA, 23 bp, Homo sapiens
ctgaggggaggatcactggagcc

SEQ ID NO: 6141806 - DNA, 22 bp, Homo sapiens
ctgaggggaggcacctccaggc

SEQ ID NO: 6141807 - DNA, 17 bp, Homo sapiens
ctgaggggattctctac

SEQ ID NO: 6141808 - DNA, 22 bp, Homo sapiens
ctgaggggcaacgaagaaaaaa

SEQ ID NO: 6141809 - DNA, 11 bp, Homo sapiens
ctgaggggcag

SEQ ID NO: 6141810 - DNA, 16 bp, Homo sapiens
ctgaggggcagcctgc

SEQ ID NO: 6141811 - DNA, 12 bp, Homo sapiens
ctgaggggcagg

SEQ ID NO: 6141812 - DNA, 15 bp, Homo sapiens
ctgaggggcagggag

SEQ ID NO: 6141813 - DNA, 14 bp, Homo sapiens
ctgaggggcagggc

SEQ ID NO: 6141814 - DNA, 16 bp, Homo sapiens
ctgaggggcagggccg

SEQ ID NO: 6141815 - DNA, 20 bp, Homo sapiens
ctgaggggcatctgcccctc

SEQ ID NO: 6141816 - DNA, 13 bp, Homo sapiens
ctgaggggccagg

SEQ ID NO: 6141817 - DNA, 14 bp, Homo sapiens
ctgaggggccaggg

SEQ ID NO: 6141818 - DNA, 16 bp, Homo sapiens
ctgaggggcctgccac

SEQ ID NO: 6141819 - DNA, 17 bp, Homo sapiens
ctgaggggcctgcgccc

SEQ ID NO: 6141820 - DNA, 19 bp, Homo sapiens
ctgaggggcctgcgcccag

SEQ ID NO: 6141821 - DNA, 20 bp, Homo sapiens
ctgaggggcctgcgcccaga

SEQ ID NO: 6141822 - DNA, 22 bp, Homo sapiens
ctgaggggcctgcgcccagagc

SEQ ID NO: 6141823 - DNA, 18 bp, Homo sapiens
ctgaggggctaccaggaa

SEQ ID NO: 6141824 - DNA, 14 bp, Homo sapiens
ctgaggggctgggc

SEQ ID NO: 6141825 - DNA, 19 bp, Homo sapiens
ctgaggggctggggagggg

SEQ ID NO: 6141826 - DNA, 16 bp, Homo sapiens
ctgaggggggatccag

SEQ ID NO: 6141827 - DNA, 20 bp, Homo sapiens
ctgagggggtgggggtgccg

SEQ ID NO: 6141828 - DNA, 21 bp, Homo sapiens
ctgagggggtgggggtgccgc

SEQ ID NO: 6141829 - DNA, 13 bp, Homo sapiens
ctgagggtccacc

SEQ ID NO: 6141830 - DNA, 16 bp, Homo sapiens
ctgagggtccacctgg

SEQ ID NO: 6141831 - DNA, 17 bp, Homo sapiens
ctgagggtccacctgga

SEQ ID NO: 6141832 - DNA, 22 bp, Homo sapiens
ctgagggtccacctggagagta

SEQ ID NO: 6141833 - DNA, 21 bp, Homo sapiens
ctgagggtccccacctgggac

SEQ ID NO: 6141834 - DNA, 17 bp, Homo sapiens
ctgagggtcgtgggaaa

SEQ ID NO: 6141835 - DNA, 22 bp, Homo sapiens
ctgagggtcgtgggaaagggga

SEQ ID NO: 6141836 - DNA, 16 bp, Homo sapiens
ctgagggtctgggatc

SEQ ID NO: 6141837 - DNA, 17 bp, Homo sapiens
ctgagggtctggtgcca

SEQ ID NO: 6141838 - DNA, 15 bp, Homo sapiens
ctgagggtgcccttt

SEQ ID NO: 6141839 - DNA, 14 bp, Homo sapiens
ctgagggtgggctt

SEQ ID NO: 6141840 - DNA, 17 bp, Homo sapiens
ctgagggttaatttcta

SEQ ID NO: 6141841 - DNA, 20 bp, Homo sapiens
ctgagggtttccaccttggc

SEQ ID NO: 6141842 - DNA, 15 bp, Homo sapiens
ctgaggtacaggatg

SEQ ID NO: 6141843 - DNA, 16 bp, Homo sapiens
ctgaggtacctttcca

SEQ ID NO: 6141844 - DNA, 19 bp, Homo sapiens
ctgaggtatggccatgccc

SEQ ID NO: 6141845 - DNA, 22 bp, Homo sapiens
ctgaggtcaataaagcagagcc

SEQ ID NO: 6141846 - DNA, 23 bp, Homo sapiens
ctgaggtcaataaagcagagcca

SEQ ID NO: 6141847 - DNA, 19 bp, Homo sapiens
ctgaggtcaggagttcaag

SEQ ID NO: 6141848 - DNA, 14 bp, Homo sapiens
ctgaggtcagggag

SEQ ID NO: 6141849 - DNA, 19 bp, Homo sapiens
ctgaggtcatctgtaaaat

SEQ ID NO: 6141850 - DNA, 20 bp, Homo sapiens
ctgaggtcatctgtaaaata

SEQ ID NO: 6141851 - DNA, 20 bp, Homo sapiens
ctgaggtcccctcgtcccat

SEQ ID NO: 6141852 - DNA, 14 bp, Homo sapiens
ctgaggtcctgagc

SEQ ID NO: 6141853 - DNA, 15 bp, Homo sapiens
ctgaggtcctgagca

SEQ ID NO: 6141854 - DNA, 20 bp, Homo sapiens
ctgaggtcctgagcactgcc

SEQ ID NO: 6141855 - DNA, 14 bp, Homo sapiens
ctgaggtctcacct

SEQ ID NO: 6141856 - DNA, 19 bp, Homo sapiens
ctgaggtctcgctgatgct

SEQ ID NO: 6141857 - DNA, 14 bp, Homo sapiens
ctgaggtctggctg

SEQ ID NO: 6141858 - DNA, 17 bp, Homo sapiens
ctgaggtgaaagggagc

SEQ ID NO: 6141859 - DNA, 19 bp, Homo sapiens
ctgaggtgaaagggagcta

SEQ ID NO: 6141860 - DNA, 16 bp, Homo sapiens
ctgaggtgcactggga

SEQ ID NO: 6141861 - DNA, 18 bp, Homo sapiens
ctgaggtgcactgggagg

SEQ ID NO: 6141862 - DNA, 15 bp, Homo sapiens
ctgaggtgcccactc

SEQ ID NO: 6141863 - DNA, 23 bp, Homo sapiens
ctgaggtgcccactccgccagcc

SEQ ID NO: 6141864 - DNA, 15 bp, Homo sapiens
ctgaggtgcccagga

SEQ ID NO: 6141865 - DNA, 19 bp, Homo sapiens
ctgaggtgcccaggagaag

SEQ ID NO: 6141866 - DNA, 11 bp, Homo sapiens
ctgaggtgcct

SEQ ID NO: 6141867 - DNA, 20 bp, Homo sapiens
ctgaggtgcctcccagtggc

SEQ ID NO: 6141868 - DNA, 21 bp, Homo sapiens
ctgaggtgcctcccagtggcc

SEQ ID NO: 6141869 - DNA, 15 bp, Homo sapiens
ctgaggtgcctgctc

SEQ ID NO: 6141870 - DNA, 21 bp, Homo sapiens
ctgaggtgcctgctcaggtgc

SEQ ID NO: 6141871 - DNA, 22 bp, Homo sapiens
ctgaggtgcctgctcaggtgct

SEQ ID NO: 6141872 - DNA, 19 bp, Homo sapiens
ctgaggtgcctgtcccacc

SEQ ID NO: 6141873 - DNA, 14 bp, Homo sapiens
ctgaggtgggagca

SEQ ID NO: 6141874 - DNA, 22 bp, Homo sapiens
ctgaggtgggaggatctcttga

SEQ ID NO: 6141875 - DNA, 14 bp, Homo sapiens
ctgaggtgggccca

SEQ ID NO: 6141876 - DNA, 15 bp, Homo sapiens
ctgaggtgggcccag

SEQ ID NO: 6141877 - DNA, 17 bp, Homo sapiens
ctgaggtgggccttcca

SEQ ID NO: 6141878 - DNA, 18 bp, Homo sapiens
ctgaggtgggccttccat

SEQ ID NO: 6141879 - DNA, 15 bp, Homo sapiens
ctgaggtgggctggg

SEQ ID NO: 6141880 - DNA, 17 bp, Homo sapiens
ctgaggtggggaaggag

SEQ ID NO: 6141881 - DNA, 19 bp, Homo sapiens
ctgaggtggggaaggaggg

SEQ ID NO: 6141882 - DNA, 13 bp, Homo sapiens
ctgaggtggtgga

SEQ ID NO: 6141883 - DNA, 14 bp, Homo sapiens
ctgaggtggtggac

SEQ ID NO: 6141884 - DNA, 15 bp, Homo sapiens
ctgaggtggtggaca

SEQ ID NO: 6141885 - DNA, 15 bp, Homo sapiens
ctgaggtgtctggcc

SEQ ID NO: 6141886 - DNA, 16 bp, Homo sapiens
ctgaggtgtctggcct

SEQ ID NO: 6141887 - DNA, 17 bp, Homo sapiens
ctgaggtgtctggcctg

SEQ ID NO: 6141888 - DNA, 18 bp, Homo sapiens
ctgaggtgtgggggctgc

SEQ ID NO: 6141889 - DNA, 19 bp, Homo sapiens
ctgaggtgtgggggctgca

SEQ ID NO: 6141890 - DNA, 24 bp, Homo sapiens
ctgaggttagcccaatggagaaat

SEQ ID NO: 6141891 - DNA, 14 bp, Homo sapiens
ctgaggttcctctg

SEQ ID NO: 6141892 - DNA, 17 bp, Homo sapiens
ctgaggttcctctgcct

SEQ ID NO: 6141893 - DNA, 19 bp, Homo sapiens
ctgaggttcctctgcctgc

SEQ ID NO: 6141894 - DNA, 22 bp, Homo sapiens
ctgaggttgggaaggcacctgc

SEQ ID NO: 6141895 - DNA, 18 bp, Homo sapiens
ctgaggttttgaataaaa

SEQ ID NO: 6141896 - DNA, 21 bp, Homo sapiens
ctgagtaaaaaagctgtgtgc

SEQ ID NO: 6141897 - DNA, 18 bp, Homo sapiens
ctgagtaaacagatattt

SEQ ID NO: 6141898 - DNA, 12 bp, Homo sapiens
ctgagtaaattg

SEQ ID NO: 6141899 - DNA, 22 bp, Homo sapiens
ctgagtaatcgcttaaagatgt

SEQ ID NO: 6141900 - DNA, 20 bp, Homo sapiens
ctgagtaattaataaagaaa

SEQ ID NO: 6141901 - DNA, 12 bp, Homo sapiens
ctgagtacaatt

SEQ ID NO: 6141902 - DNA, 14 bp, Homo sapiens
ctgagtaccagggg

SEQ ID NO: 6141903 - DNA, 21 bp, Homo sapiens
ctgagtaccaggggctgggct

SEQ ID NO: 6141904 - DNA, 16 bp, Homo sapiens
ctgagtactccacact

SEQ ID NO: 6141905 - DNA, 17 bp, Homo sapiens
ctgagtactctttctct

SEQ ID NO: 6141906 - DNA, 20 bp, Homo sapiens
ctgagtactggaataaacag

SEQ ID NO: 6141907 - DNA, 14 bp, Homo sapiens
ctgagtagaaaggc

SEQ ID NO: 6141908 - DNA, 20 bp, Homo sapiens
ctgagtagaaaggcctttaa

SEQ ID NO: 6141909 - DNA, 18 bp, Homo sapiens
ctgagtagatgcgcagcc

SEQ ID NO: 6141910 - DNA, 22 bp, Homo sapiens
ctgagtagatgcgcagccccat

SEQ ID NO: 6141911 - DNA, 20 bp, Homo sapiens
ctgagtagatgggactacag

SEQ ID NO: 6141912 - DNA, 16 bp, Homo sapiens
ctgagtagcagaaaac

SEQ ID NO: 6141913 - DNA, 17 bp, Homo sapiens
ctgagtagctctcctga

SEQ ID NO: 6141914 - DNA, 22 bp, Homo sapiens
ctcagctggttactcagggttc

SEQ ID NO: 6141915 - DNA, 23 bp, Homo sapiens
ctcagctggttactcagggttca

SEQ ID NO: 6141916 - DNA, 18 bp, Homo sapiens
ctcagctgtcctgcagca

SEQ ID NO: 6141917 - DNA, 20 bp, Homo sapiens
ctcagctgtcgggggccact

SEQ ID NO: 6141918 - DNA, 19 bp, Homo sapiens
ctcagctgtgccttccctt

SEQ ID NO: 6141919 - DNA, 14 bp, Homo sapiens
ctcagctgtggctg

SEQ ID NO: 6141920 - DNA, 15 bp, Homo sapiens
ctcagctgtggctgg

SEQ ID NO: 6141921 - DNA, 18 bp, Homo sapiens
ctcagctgtggtcccacc

SEQ ID NO: 6141922 - DNA, 19 bp, Homo sapiens
ctcagctgtggtcccaccc

SEQ ID NO: 6141923 - DNA, 21 bp, Homo sapiens
ctcagctgtggtcccacccag

SEQ ID NO: 6141924 - DNA, 22 bp, Homo sapiens
ctcagctgtggtcccacccagg

SEQ ID NO: 6141925 - DNA, 19 bp, Homo sapiens
ctcagctgttcagattgga

SEQ ID NO: 6141926 - DNA, 18 bp, Homo sapiens
ctcagcttcatttccgtg

SEQ ID NO: 6141927 - DNA, 22 bp, Homo sapiens
ctcagcttcccaagtagctgag

SEQ ID NO: 6141928 - DNA, 22 bp, Homo sapiens
ctcagcttccccaacacgcagg

SEQ ID NO: 6141929 - DNA, 18 bp, Homo sapiens
ctcagcttccccagtagc

SEQ ID NO: 6141930 - DNA, 19 bp, Homo sapiens
ctcagcttccccagtagct

SEQ ID NO: 6141931 - DNA, 14 bp, Homo sapiens
ctcagcttcctacc

SEQ ID NO: 6141932 - DNA, 19 bp, Homo sapiens
ctcagcttcggggccggtg

SEQ ID NO: 6141933 - DNA, 22 bp, Homo sapiens
ctcagcttcggggccggtgagg

SEQ ID NO: 6141934 - DNA, 13 bp, Homo sapiens
ctcagcttcttct

SEQ ID NO: 6141935 - DNA, 16 bp, Homo sapiens
ctcagcttgcagctgg

SEQ ID NO: 6141936 - DNA, 17 bp, Homo sapiens
ctcagcttggataacca

SEQ ID NO: 6141937 - DNA, 14 bp, Homo sapiens
ctcagcttgtgcct

SEQ ID NO: 6141938 - DNA, 15 bp, Homo sapiens
ctcagcttgtgcctt

SEQ ID NO: 6141939 - DNA, 18 bp, Homo sapiens
ctcagcttgtgccttgta

SEQ ID NO: 6141940 - DNA, 13 bp, Homo sapiens
ctcagcttttgat

SEQ ID NO: 6141941 - DNA, 15 bp, Homo sapiens
ctcaggaaagaatag

SEQ ID NO: 6141942 - DNA, 20 bp, Homo sapiens
ctcaggaaagaatagaaaga

SEQ ID NO: 6141943 - DNA, 22 bp, Homo sapiens
ctcaggaaatcaaatatgcaaa

SEQ ID NO: 6141944 - DNA, 18 bp, Homo sapiens
ctcaggaaatggcttttc

SEQ ID NO: 6141945 - DNA, 13 bp, Homo sapiens
ctcaggaacagaa

SEQ ID NO: 6141946 - DNA, 20 bp, Homo sapiens
ctcaggaacccaccctctcc

SEQ ID NO: 6141947 - DNA, 21 bp, Homo sapiens
ctcaggaacccaccctctcca

SEQ ID NO: 6141948 - DNA, 13 bp, Homo sapiens
ctcaggaactttt

SEQ ID NO: 6141949 - DNA, 14 bp, Homo sapiens
ctcaggaagaaacc

SEQ ID NO: 6141950 - DNA, 18 bp, Homo sapiens
ctcaggaagaaaccccaa

SEQ ID NO: 6141951 - DNA, 20 bp, Homo sapiens
ctcaggaagaaaccccaagc

SEQ ID NO: 6141952 - DNA, 22 bp, Homo sapiens
ctcaggaagaaaccccaagcag

SEQ ID NO: 6141953 - DNA, 12 bp, Homo sapiens
ctcaggaagaac

SEQ ID NO: 6141954 - DNA, 16 bp, Homo sapiens
ctcaggaagagctatg

SEQ ID NO: 6141955 - DNA, 21 bp, Homo sapiens
ctcaggaagagctatggccca

SEQ ID NO: 6141956 - DNA, 14 bp, Homo sapiens
ctcaggaaggacat

SEQ ID NO: 6141957 - DNA, 16 bp, Homo sapiens
ctcaggaaggacatgg

SEQ ID NO: 6141958 - DNA, 19 bp, Homo sapiens
ctcaggaagtccagccact

SEQ ID NO: 6141959 - DNA, 16 bp, Homo sapiens
ctcaggaatgggctgt

SEQ ID NO: 6141960 - DNA, 17 bp, Homo sapiens
ctcaggaattcagtgcc

SEQ ID NO: 6141961 - DNA, 18 bp, Homo sapiens
ctcaggaattcagtgcct

SEQ ID NO: 6141962 - DNA, 14 bp, Homo sapiens
ctcaggacacaggc

SEQ ID NO: 6141963 - DNA, 18 bp, Homo sapiens
ctcaggacacaggcctgt

SEQ ID NO: 6141964 - DNA, 18 bp, Homo sapiens
ctcaggacagaacagtgt

SEQ ID NO: 6141965 - DNA, 14 bp, Homo sapiens
ctcaggacagatgc

SEQ ID NO: 6141966 - DNA, 16 bp, Homo sapiens
ctcaggacagatgcca

SEQ ID NO: 6141967 - DNA, 21 bp, Homo sapiens
ctcaggacagcatcccttccc

SEQ ID NO: 6141968 - DNA, 22 bp, Homo sapiens
ctcaggaccaaagctttcatgt

SEQ ID NO: 6141969 - DNA, 18 bp, Homo sapiens
ctcaggaccaccctgcca

SEQ ID NO: 6141970 - DNA, 23 bp, Homo sapiens
ctcaggaccaccctgccaaggca

SEQ ID NO: 6141971 - DNA, 12 bp, Homo sapiens
ctcaggaccagg

SEQ ID NO: 6141972 - DNA, 19 bp, Homo sapiens
ctcaggacccaggccctcc

SEQ ID NO: 6141973 - DNA, 17 bp, Homo sapiens
ctcaggacccatccctg

SEQ ID NO: 6141974 - DNA, 13 bp, Homo sapiens
ctcaggaccctcg

SEQ ID NO: 6141975 - DNA, 14 bp, Homo sapiens
ctcaggaccctcgc

SEQ ID NO: 6141976 - DNA, 17 bp, Homo sapiens
ctcaggaccctcgctgg

SEQ ID NO: 6141977 - DNA, 19 bp, Homo sapiens
ctcaggaccctcgctggcc

SEQ ID NO: 6141978 - DNA, 12 bp, Homo sapiens
ctcaggacctag

SEQ ID NO: 6141979 - DNA, 20 bp, Homo sapiens
ctcaggacctctgtaggcag

SEQ ID NO: 6141980 - DNA, 22 bp, Homo sapiens
ctcaggacctgggacctcccct

SEQ ID NO: 6141981 - DNA, 20 bp, Homo sapiens
ctcaggacggaaggtcagtt

SEQ ID NO: 6141982 - DNA, 14 bp, Homo sapiens
ctcaggactccagc

SEQ ID NO: 6141983 - DNA, 17 bp, Homo sapiens
ctcaggactccagccca

SEQ ID NO: 6141984 - DNA, 19 bp, Homo sapiens
ctcaggactgcaacaggct

SEQ ID NO: 6141985 - DNA, 12 bp, Homo sapiens
ctcaggagaagc

SEQ ID NO: 6141986 - DNA, 23 bp, Homo sapiens
ctcaggagaattcatgtctgcct

SEQ ID NO: 6141987 - DNA, 18 bp, Homo sapiens
ctcaggagagacccctcc

SEQ ID NO: 6141988 - DNA, 19 bp, Homo sapiens
ctcaggagagacccctccc

SEQ ID NO: 6141989 - DNA, 23 bp, Homo sapiens
ctcaggagagagcttcctgtttc

SEQ ID NO: 6141990 - DNA, 22 bp, Homo sapiens
ctcaggagagagtctaagataa

SEQ ID NO: 6141991 - DNA, 15 bp, Homo sapiens
ctcaggagagggcct

SEQ ID NO: 6141992 - DNA, 19 bp, Homo sapiens
ctcaggagagggccttccc

SEQ ID NO: 6141993 - DNA, 20 bp, Homo sapiens
ctcaggagagggccttcccc

SEQ ID NO: 6141994 - DNA, 18 bp, Homo sapiens
ctcaggagagtgtgcaac

SEQ ID NO: 6141995 - DNA, 16 bp, Homo sapiens
ctcaggagatggaggg

SEQ ID NO: 6141996 - DNA, 20 bp, Homo sapiens
ctcaggagatggagggcttg

SEQ ID NO: 6141997 - DNA, 22 bp, Homo sapiens
ctcaggagatggagggcttggc

SEQ ID NO: 6141998 - DNA, 12 bp, Homo sapiens
ctcaggagcaca

SEQ ID NO: 6141999 - DNA, 13 bp, Homo sapiens
ctcaggagcacag

SEQ ID NO: 6142000 - DNA, 18 bp, Homo sapiens
ctcaggagcacagccata

SEQ ID NO: 6142001 - DNA, 19 bp, Homo sapiens
ctcaggagcacagccatag

SEQ ID NO: 6142002 - DNA, 18 bp, Homo sapiens
ctcaggagcacaggcagc

SEQ ID NO: 6142003 - DNA, 22 bp, Homo sapiens
ctcaggagccctgggaggctct

SEQ ID NO: 6142004 - DNA, 21 bp, Homo sapiens
ctcaggagccgaagcccaggg

SEQ ID NO: 6142005 - DNA, 12 bp, Homo sapiens
ctcaggaggagg

SEQ ID NO: 6142006 - DNA, 13 bp, Homo sapiens
ctcaggaggaggc

SEQ ID NO: 6142007 - DNA, 16 bp, Homo sapiens
ctcaggaggcaggacc

SEQ ID NO: 6142008 - DNA, 20 bp, Homo sapiens
ctcaggaggccgaggcagga

SEQ ID NO: 6142009 - DNA, 19 bp, Homo sapiens
ctcaggaggcgcccttggc

SEQ ID NO: 6142010 - DNA, 13 bp, Homo sapiens
ctcaggaggctga

SEQ ID NO: 6142011 - DNA, 18 bp, Homo sapiens
ctcaggaggctgagacag

SEQ ID NO: 6142012 - DNA, 22 bp, Homo sapiens
ctcaggaggctgagacaggaga

SEQ ID NO: 6142013 - DNA, 15 bp, Homo sapiens
ctcaggaggctgagg

SEQ ID NO: 6142014 - DNA, 18 bp, Homo sapiens
ctcaggaggctgaggcac

SEQ ID NO: 6142015 - DNA, 20 bp, Homo sapiens
ctcaggaggctgaggcagaa

SEQ ID NO: 6142016 - DNA, 23 bp, Homo sapiens
ctcaggaggctgaggcagaagaa

SEQ ID NO: 6142017 - DNA, 20 bp, Homo sapiens
ctcaggaggctgaggcagga

SEQ ID NO: 6142018 - DNA, 13 bp, Homo sapiens
ctcaggagggcag

SEQ ID NO: 6142019 - DNA, 17 bp, Homo sapiens
ctcaggagggcaggctg

SEQ ID NO: 6142020 - DNA, 23 bp, Homo sapiens
ctcaggagggtgacgcccagctc

SEQ ID NO: 6142021 - DNA, 13 bp, Homo sapiens
ctcaggagtctgc

SEQ ID NO: 6142022 - DNA, 15 bp, Homo sapiens
ctcaggagtctgcca

SEQ ID NO: 6142023 - DNA, 23 bp, Homo sapiens
ctcaggagtggggttgggggaca

SEQ ID NO: 6142024 - DNA, 19 bp, Homo sapiens
ctcaggagtttgagaccag

SEQ ID NO: 6142025 - DNA, 18 bp, Homo sapiens
ctcaggatccaagctaag

SEQ ID NO: 6142026 - DNA, 16 bp, Homo sapiens
ctcaggatgagggaaa

SEQ ID NO: 6142027 - DNA, 20 bp, Homo sapiens
ctcaggatgagggaaaagaa

SEQ ID NO: 6142028 - DNA, 14 bp, Homo sapiens
ctcaggatgcccag

SEQ ID NO: 6142029 - DNA, 15 bp, Homo sapiens
ctcaggatgcccagg

SEQ ID NO: 6142030 - DNA, 16 bp, Homo sapiens
ctcaggatgcccaggg

SEQ ID NO: 6142031 - DNA, 18 bp, Homo sapiens
ctcaggatgggaagaaaa

SEQ ID NO: 6142032 - DNA, 23 bp, Homo sapiens
ctcaggatgggaagaaaaaggaa

SEQ ID NO: 6142033 - DNA, 18 bp, Homo sapiens
ctcaggatgtcctttgtg

SEQ ID NO: 6142034 - DNA, 20 bp, Homo sapiens
ctcaggattgctaggagctc

SEQ ID NO: 6142035 - DNA, 15 bp, Homo sapiens
ctcaggatttcattg

SEQ ID NO: 6142036 - DNA, 20 bp, Homo sapiens
ctcaggatttcattgactga

SEQ ID NO: 6142037 - DNA, 13 bp, Homo sapiens
ctcaggcaagccc

SEQ ID NO: 6142038 - DNA, 14 bp, Homo sapiens
ctcaggcaagcccc

SEQ ID NO: 6142039 - DNA, 16 bp, Homo sapiens
ctcaggcaagcccctc

SEQ ID NO: 6142040 - DNA, 19 bp, Homo sapiens
ctcaggcaagcccctcagc

SEQ ID NO: 6142041 - DNA, 20 bp, Homo sapiens
ctcaggcaagcccctcagcc

SEQ ID NO: 6142042 - DNA, 15 bp, Homo sapiens
ctcaggcacaccttg

SEQ ID NO: 6142043 - DNA, 17 bp, Homo sapiens
ctcaggcacaccttgca

SEQ ID NO: 6142044 - DNA, 23 bp, Homo sapiens
ctcaggcagacaagagctgctgt

SEQ ID NO: 6142045 - DNA, 21 bp, Homo sapiens
ctcaggcagaggatgttctgg

SEQ ID NO: 6142046 - DNA, 15 bp, Homo sapiens
ctcaggcagcctgtg

SEQ ID NO: 6142047 - DNA, 14 bp, Homo sapiens
ctcaggcagctcaa

SEQ ID NO: 6142048 - DNA, 23 bp, Homo sapiens
ctcaggcataggcctgggtgctg

SEQ ID NO: 6142049 - DNA, 19 bp, Homo sapiens
ctcaggccaaactcacctg

SEQ ID NO: 6142050 - DNA, 21 bp, Homo sapiens
ctcaggccaaactcacctgcc

SEQ ID NO: 6142051 - DNA, 21 bp, Homo sapiens
ctcaggccaaagacctcccaa

SEQ ID NO: 6142052 - DNA, 20 bp, Homo sapiens
ctcaggccaagaaacgtctt

SEQ ID NO: 6142053 - DNA, 17 bp, Homo sapiens
ctcaggccaagcccaat

SEQ ID NO: 6142054 - DNA, 16 bp, Homo sapiens
ctcaggccaagggacc

SEQ ID NO: 6142055 - DNA, 19 bp, Homo sapiens
ctcaggccaagggaccagg

SEQ ID NO: 6142056 - DNA, 20 bp, Homo sapiens
ctcaggccacagtggggctg

SEQ ID NO: 6142057 - DNA, 15 bp, Homo sapiens
ctcaggccaccacag

SEQ ID NO: 6142058 - DNA, 16 bp, Homo sapiens
ctcaggccaccacaga

SEQ ID NO: 6142059 - DNA, 13 bp, Homo sapiens
ctcaggccacctg

SEQ ID NO: 6142060 - DNA, 23 bp, Homo sapiens
ctcaggccacctgcccccttctc

SEQ ID NO: 6142061 - DNA, 14 bp, Homo sapiens
ctcaggccagctgc

SEQ ID NO: 6142062 - DNA, 18 bp, Homo sapiens
ctcaggccagctgcttgg

SEQ ID NO: 6142063 - DNA, 21 bp, Homo sapiens
ctcaggccagctgcttgggct

SEQ ID NO: 6142064 - DNA, 20 bp, Homo sapiens
ctcaggccagtaatcccagt

SEQ ID NO: 6142065 - DNA, 15 bp, Homo sapiens
ctcaggccagtgcca

SEQ ID NO: 6142066 - DNA, 18 bp, Homo sapiens
ctcaggccagtgccagga

SEQ ID NO: 6142067 - DNA, 16 bp, Homo sapiens
ctcaggccattcccca

SEQ ID NO: 6142068 - DNA, 12 bp, Homo sapiens
ctcaggcccaga

SEQ ID NO: 6142069 - DNA, 23 bp, Homo sapiens
ctcaggcccagaattgcagttca

SEQ ID NO: 6142070 - DNA, 13 bp, Homo sapiens
ctcaggcccagct

SEQ ID NO: 6142071 - DNA, 18 bp, Homo sapiens
ctcaggcccagctgctcc

SEQ ID NO: 6142072 - DNA, 20 bp, Homo sapiens
ctcaggcccccacctggctc

SEQ ID NO: 6142073 - DNA, 21 bp, Homo sapiens
ctcaggcccccacctggctca

SEQ ID NO: 6142074 - DNA, 20 bp, Homo sapiens
ctcaggccccgggcttccct

SEQ ID NO: 6142075 - DNA, 14 bp, Homo sapiens
ctcaggccgagagc

SEQ ID NO: 6142076 - DNA, 15 bp, Homo sapiens
ctcaggccgagagcc

SEQ ID NO: 6142077 - DNA, 13 bp, Homo sapiens
ctcaggccgggct

SEQ ID NO: 6142078 - DNA, 17 bp, Homo sapiens
ctcaggcctaggaggcc

SEQ ID NO: 6142079 - DNA, 15 bp, Homo sapiens
ctcaggcctcacctg

SEQ ID NO: 6142080 - DNA, 20 bp, Homo sapiens
ctcaggcctcacctggcttc

SEQ ID NO: 6142081 - DNA, 23 bp, Homo sapiens
ctcaggcctcacctggcttccca

SEQ ID NO: 6142082 - DNA, 14 bp, Homo sapiens
ctcaggcctcccta

SEQ ID NO: 6142083 - DNA, 17 bp, Homo sapiens
ctcaggcctccctagca

SEQ ID NO: 6142084 - DNA, 18 bp, Homo sapiens
ctcaggcctccctagcac

SEQ ID NO: 6142085 - DNA, 13 bp, Homo sapiens
ctcaggcctctgc

SEQ ID NO: 6142086 - DNA, 17 bp, Homo sapiens
ctcaggcctctgcagaa

SEQ ID NO: 6142087 - DNA, 13 bp, Homo sapiens
ctcaggcctctgt

SEQ ID NO: 6142088 - DNA, 14 bp, Homo sapiens
ctcaggcctgccaa

SEQ ID NO: 6142089 - DNA, 15 bp, Homo sapiens
ctcaggcctgccaat

SEQ ID NO: 6142090 - DNA, 23 bp, Homo sapiens
ctcaggcctgccaatgccacagc

SEQ ID NO: 6142091 - DNA, 17 bp, Homo sapiens
ctgagtagctctgcctt

SEQ ID NO: 6142092 - DNA, 13 bp, Homo sapiens
ctgagtagtggcc

SEQ ID NO: 6142093 - DNA, 14 bp, Homo sapiens
ctgagtagtggcca

SEQ ID NO: 6142094 - DNA, 18 bp, Homo sapiens
ctgagtagtggccactgg

SEQ ID NO: 6142095 - DNA, 21 bp, Homo sapiens
ctgagtatctcctcgcaagct

SEQ ID NO: 6142096 - DNA, 18 bp, Homo sapiens
ctgagtatgtaacttgca

SEQ ID NO: 6142097 - DNA, 23 bp, Homo sapiens
ctgagtattaaaatgtatgcatg

SEQ ID NO: 6142098 - DNA, 12 bp, Homo sapiens
ctgagtcaaatc

SEQ ID NO: 6142099 - DNA, 13 bp, Homo sapiens
ctgagtcaaatcc

SEQ ID NO: 6142100 - DNA, 14 bp, Homo sapiens
ctgagtcaaatcca

SEQ ID NO: 6142101 - DNA, 15 bp, Homo sapiens
ctgagtcaaatccag

SEQ ID NO: 6142102 - DNA, 18 bp, Homo sapiens
ctgagtcaaatccagtgg

SEQ ID NO: 6142103 - DNA, 19 bp, Homo sapiens
ctgagtcaaatccagtggt

SEQ ID NO: 6142104 - DNA, 21 bp, Homo sapiens
ctgagtcaaatccagtggtgg

SEQ ID NO: 6142105 - DNA, 20 bp, Homo sapiens
ctgagtcaatgcgcaaaatg

SEQ ID NO: 6142106 - DNA, 19 bp, Homo sapiens
ctgagtcacaggtgtggga

SEQ ID NO: 6142107 - DNA, 20 bp, Homo sapiens
ctgagtcacaggtgtgggat

SEQ ID NO: 6142108 - DNA, 17 bp, Homo sapiens
ctgagtcaccaggaatg

SEQ ID NO: 6142109 - DNA, 22 bp, Homo sapiens
ctgagtcacccatgaagacagg

SEQ ID NO: 6142110 - DNA, 13 bp, Homo sapiens
ctgagtcacgctg

SEQ ID NO: 6142111 - DNA, 14 bp, Homo sapiens
ctgagtcactcaca

SEQ ID NO: 6142112 - DNA, 22 bp, Homo sapiens
ctgagtcagctgaccccctccc

SEQ ID NO: 6142113 - DNA, 17 bp, Homo sapiens
ctgagtcaggacttgaa

SEQ ID NO: 6142114 - DNA, 16 bp, Homo sapiens
ctgagtcagggcccag

SEQ ID NO: 6142115 - DNA, 21 bp, Homo sapiens
ctgagtcagtgctctcagctg

SEQ ID NO: 6142116 - DNA, 23 bp, Homo sapiens
ctgagtcagtgctctcagctggc

SEQ ID NO: 6142117 - DNA, 17 bp, Homo sapiens
ctgagtcatctgttagg

SEQ ID NO: 6142118 - DNA, 14 bp, Homo sapiens
ctgagtcatgtctt

SEQ ID NO: 6142119 - DNA, 17 bp, Homo sapiens
ctgagtccactgctcca

SEQ ID NO: 6142120 - DNA, 12 bp, Homo sapiens
ctgagtccagaa

SEQ ID NO: 6142121 - DNA, 14 bp, Homo sapiens
ctgagtccagaatg

SEQ ID NO: 6142122 - DNA, 16 bp, Homo sapiens
ctgagtccagagcttg

SEQ ID NO: 6142123 - DNA, 17 bp, Homo sapiens
ctgagtccagagcttgt

SEQ ID NO: 6142124 - DNA, 15 bp, Homo sapiens
ctgagtccagctccc

SEQ ID NO: 6142125 - DNA, 16 bp, Homo sapiens
ctgagtccatgaaaat

SEQ ID NO: 6142126 - DNA, 17 bp, Homo sapiens
ctgagtccatgaaaata

SEQ ID NO: 6142127 - DNA, 18 bp, Homo sapiens
ctgagtccatgaaaatac

SEQ ID NO: 6142128 - DNA, 16 bp, Homo sapiens
ctgagtcccctcagct

SEQ ID NO: 6142129 - DNA, 19 bp, Homo sapiens
ctgagtcccctccaggaag

SEQ ID NO: 6142130 - DNA, 20 bp, Homo sapiens
ctgagtcccctccaggaaga

SEQ ID NO: 6142131 - DNA, 17 bp, Homo sapiens
ctgagtccctggcaaga

SEQ ID NO: 6142132 - DNA, 13 bp, Homo sapiens
ctgagtccgacct

SEQ ID NO: 6142133 - DNA, 14 bp, Homo sapiens
ctgagtccgcctgc

SEQ ID NO: 6142134 - DNA, 20 bp, Homo sapiens
ctgagtcctcattgttcaga

SEQ ID NO: 6142135 - DNA, 22 bp, Homo sapiens
ctgagtcctcattgttcagaaa

SEQ ID NO: 6142136 - DNA, 16 bp, Homo sapiens
ctgagtcctgagactt

SEQ ID NO: 6142137 - DNA, 13 bp, Homo sapiens
ctgagtcctgggg

SEQ ID NO: 6142138 - DNA, 12 bp, Homo sapiens
ctgagtcctggt

SEQ ID NO: 6142139 - DNA, 16 bp, Homo sapiens
ctgagtcctggtccct

SEQ ID NO: 6142140 - DNA, 17 bp, Homo sapiens
ctgagtcctggtccctc

SEQ ID NO: 6142141 - DNA, 18 bp, Homo sapiens
ctgagtcctggtccctct

SEQ ID NO: 6142142 - DNA, 19 bp, Homo sapiens
ctgagtcctggtttcctgg

SEQ ID NO: 6142143 - DNA, 18 bp, Homo sapiens
ctgagtcctgtctctgcc

SEQ ID NO: 6142144 - DNA, 20 bp, Homo sapiens
ctgagtcctgtctctgcctg

SEQ ID NO: 6142145 - DNA, 12 bp, Homo sapiens
ctgagtcctgtt

SEQ ID NO: 6142146 - DNA, 20 bp, Homo sapiens
ctgagtcctttccaggggcc

SEQ ID NO: 6142147 - DNA, 22 bp, Homo sapiens
ctgagtcctttccaggggccaa

SEQ ID NO: 6142148 - DNA, 20 bp, Homo sapiens
ctgagtcggctgggcagggc

SEQ ID NO: 6142149 - DNA, 20 bp, Homo sapiens
ctgagtcgtgacctgctagg

SEQ ID NO: 6142150 - DNA, 20 bp, Homo sapiens
ctgagtctagatacagaagc

SEQ ID NO: 6142151 - DNA, 14 bp, Homo sapiens
ctgagtctatgttc

SEQ ID NO: 6142152 - DNA, 21 bp, Homo sapiens
ctgagtctcattcctctgtcc

SEQ ID NO: 6142153 - DNA, 15 bp, Homo sapiens
ctgagtctccagggc

SEQ ID NO: 6142154 - DNA, 16 bp, Homo sapiens
ctgagtctccagggcc

SEQ ID NO: 6142155 - DNA, 13 bp, Homo sapiens
ctgagtctcctgt

SEQ ID NO: 6142156 - DNA, 14 bp, Homo sapiens
ctgagtctcctgtg

SEQ ID NO: 6142157 - DNA, 14 bp, Homo sapiens
ctgagtctctgaat

SEQ ID NO: 6142158 - DNA, 16 bp, Homo sapiens
ctgagtctgaaggctg

SEQ ID NO: 6142159 - DNA, 18 bp, Homo sapiens
ctgagtctgaaggctggg

SEQ ID NO: 6142160 - DNA, 19 bp, Homo sapiens
ctgagtctgaaggctgggt

SEQ ID NO: 6142161 - DNA, 14 bp, Homo sapiens
ctgagtctgagtcc

SEQ ID NO: 6142162 - DNA, 22 bp, Homo sapiens
ctgagtctgagtcctgtctctg

SEQ ID NO: 6142163 - DNA, 14 bp, Homo sapiens
ctgagtctggacct

SEQ ID NO: 6142164 - DNA, 18 bp, Homo sapiens
ctgagtctggcaaacatg

SEQ ID NO: 6142165 - DNA, 20 bp, Homo sapiens
ctgagtctggcaaacatgtg

SEQ ID NO: 6142166 - DNA, 16 bp, Homo sapiens
ctgagtctggctaggg

SEQ ID NO: 6142167 - DNA, 17 bp, Homo sapiens
ctgagtctggctagggg

SEQ ID NO: 6142168 - DNA, 20 bp, Homo sapiens
ctgagtctgttctggtaatc

SEQ ID NO: 6142169 - DNA, 14 bp, Homo sapiens
ctgagtcttggcct

SEQ ID NO: 6142170 - DNA, 19 bp, Homo sapiens
ctgagtcttttcattgcta

SEQ ID NO: 6142171 - DNA, 14 bp, Homo sapiens
ctgagtgaaaaatc

SEQ ID NO: 6142172 - DNA, 11 bp, Homo sapiens
ctgagtgaaca

SEQ ID NO: 6142173 - DNA, 13 bp, Homo sapiens
ctgagtgaacctg

SEQ ID NO: 6142174 - DNA, 18 bp, Homo sapiens
ctgagtgaacctgtataa

SEQ ID NO: 6142175 - DNA, 19 bp, Homo sapiens
ctgagtgaagcaaaaacta

SEQ ID NO: 6142176 - DNA, 18 bp, Homo sapiens
ctgagtgaaggaaatgaa

SEQ ID NO: 6142177 - DNA, 16 bp, Homo sapiens
ctgagtgaagtccagt

SEQ ID NO: 6142178 - DNA, 21 bp, Homo sapiens
ctgagtgaatgagtaaataaa

SEQ ID NO: 6142179 - DNA, 23 bp, Homo sapiens
ctgagtgaatgagtaaataaact

SEQ ID NO: 6142180 - DNA, 13 bp, Homo sapiens
ctgagtgaatgtt

SEQ ID NO: 6142181 - DNA, 14 bp, Homo sapiens
ctgagtgaatgtta

SEQ ID NO: 6142182 - DNA, 20 bp, Homo sapiens
ctgagtgacacaagcacttt

SEQ ID NO: 6142183 - DNA, 14 bp, Homo sapiens
ctgagtgacagagc

SEQ ID NO: 6142184 - DNA, 16 bp, Homo sapiens
ctgagtgacatgggtg

SEQ ID NO: 6142185 - DNA, 13 bp, Homo sapiens
ctgagtgactgta

SEQ ID NO: 6142186 - DNA, 22 bp, Homo sapiens
ctgagtgactgtaggcagggaa

SEQ ID NO: 6142187 - DNA, 20 bp, Homo sapiens
ctgagtgagaggggaggcca

SEQ ID NO: 6142188 - DNA, 14 bp, Homo sapiens
ctgagtgagggcat

SEQ ID NO: 6142189 - DNA, 22 bp, Homo sapiens
ctgagtgagggcatagaagtta

SEQ ID NO: 6142190 - DNA, 21 bp, Homo sapiens
ctgagtgaggtgttgcagccc

SEQ ID NO: 6142191 - DNA, 16 bp, Homo sapiens
ctgagtgagttttact

SEQ ID NO: 6142192 - DNA, 22 bp, Homo sapiens
ctgagtgatactttaagttaaa

SEQ ID NO: 6142193 - DNA, 13 bp, Homo sapiens
ctgagtgcactcc

SEQ ID NO: 6142194 - DNA, 15 bp, Homo sapiens
ctgagtgcactcctg

SEQ ID NO: 6142195 - DNA, 16 bp, Homo sapiens
ctgagtgcactcctgg

SEQ ID NO: 6142196 - DNA, 19 bp, Homo sapiens
ctgagtgcactcctggtga

SEQ ID NO: 6142197 - DNA, 14 bp, Homo sapiens
ctgagtgcactggc

SEQ ID NO: 6142198 - DNA, 17 bp, Homo sapiens
ctgagtgcactggcagg

SEQ ID NO: 6142199 - DNA, 12 bp, Homo sapiens
ctgagtgcagcc

SEQ ID NO: 6142200 - DNA, 18 bp, Homo sapiens
ctgagtgcagccaaaggg

SEQ ID NO: 6142201 - DNA, 14 bp, Homo sapiens
ctgagtgcaggccc

SEQ ID NO: 6142202 - DNA, 16 bp, Homo sapiens
ctgagtgcaggcccac

SEQ ID NO: 6142203 - DNA, 17 bp, Homo sapiens
ctgagtgcaggcccacc

SEQ ID NO: 6142204 - DNA, 13 bp, Homo sapiens
ctgagtgcctggc

SEQ ID NO: 6142205 - DNA, 18 bp, Homo sapiens
ctgagtgccttctgtggg

SEQ ID NO: 6142206 - DNA, 20 bp, Homo sapiens
ctgagtgccttctgtgggga

SEQ ID NO: 6142207 - DNA, 23 bp, Homo sapiens
ctgagtgccttctgtggggactc

SEQ ID NO: 6142208 - DNA, 16 bp, Homo sapiens
ctgagtgccttttggt

SEQ ID NO: 6142209 - DNA, 21 bp, Homo sapiens
ctgagtgcgaccaccacttga

SEQ ID NO: 6142210 - DNA, 22 bp, Homo sapiens
ctgagtgcgggctgaggccaga

SEQ ID NO: 6142211 - DNA, 16 bp, Homo sapiens
ctgagtgctatgtgtg

SEQ ID NO: 6142212 - DNA, 20 bp, Homo sapiens
ctgagtgctatgtgtgctta

SEQ ID NO: 6142213 - DNA, 21 bp, Homo sapiens
ctgagtgctgaggttgggaag

SEQ ID NO: 6142214 - DNA, 20 bp, Homo sapiens
ctgagtggaatgcagggaag

SEQ ID NO: 6142215 - DNA, 17 bp, Homo sapiens
ctgagtggcagcagccc

SEQ ID NO: 6142216 - DNA, 15 bp, Homo sapiens
ctgagtggccagcca

SEQ ID NO: 6142217 - DNA, 15 bp, Homo sapiens
ctgagtggcgcaagg

SEQ ID NO: 6142218 - DNA, 16 bp, Homo sapiens
ctgagtggctcgtgtt

SEQ ID NO: 6142219 - DNA, 22 bp, Homo sapiens
ctgagtggcttcactcctgctg

SEQ ID NO: 6142220 - DNA, 22 bp, Homo sapiens
ctgagtggcttgtgattctggg

SEQ ID NO: 6142221 - DNA, 21 bp, Homo sapiens
ctgagtgggaaccggaaacct

SEQ ID NO: 6142222 - DNA, 17 bp, Homo sapiens
ctgagtgggaagcccat

SEQ ID NO: 6142223 - DNA, 21 bp, Homo sapiens
ctgagtgggaagcccatcctg

SEQ ID NO: 6142224 - DNA, 13 bp, Homo sapiens
ctgagtgggctgg

SEQ ID NO: 6142225 - DNA, 18 bp, Homo sapiens
ctgagtgggctgggccct

SEQ ID NO: 6142226 - DNA, 16 bp, Homo sapiens
ctgagtggggagcagt

SEQ ID NO: 6142227 - DNA, 18 bp, Homo sapiens
ctgagtggggcttcctgg

SEQ ID NO: 6142228 - DNA, 19 bp, Homo sapiens
ctgagtggtgaggggccac

SEQ ID NO: 6142229 - DNA, 21 bp, Homo sapiens
ctgagtggtgaggggccactg

SEQ ID NO: 6142230 - DNA, 17 bp, Homo sapiens
ctgagtgtacagagtgg

SEQ ID NO: 6142231 - DNA, 22 bp, Homo sapiens
ctgagtgtcatgaagtgcacag

SEQ ID NO: 6142232 - DNA, 13 bp, Homo sapiens
ctgagtgtcccaa

SEQ ID NO: 6142233 - DNA, 14 bp, Homo sapiens
ctgagtgtctctgc

SEQ ID NO: 6142234 - DNA, 15 bp, Homo sapiens
ctgagtgtctctgcc

SEQ ID NO: 6142235 - DNA, 16 bp, Homo sapiens
ctgagtgtctctgcct

SEQ ID NO: 6142236 - DNA, 22 bp, Homo sapiens
ctgagtgtctctgcctggagca

SEQ ID NO: 6142237 - DNA, 22 bp, Homo sapiens
ctgagtgtgagaccctgttcta

SEQ ID NO: 6142238 - DNA, 12 bp, Homo sapiens
ctgagtgtggga

SEQ ID NO: 6142239 - DNA, 23 bp, Homo sapiens
ctgagtgtgggagtgcagagaaa

SEQ ID NO: 6142240 - DNA, 16 bp, Homo sapiens
ctgagtgttcaaacta

SEQ ID NO: 6142241 - DNA, 15 bp, Homo sapiens
ctgagtgtttggaaa

SEQ ID NO: 6142242 - DNA, 15 bp, Homo sapiens
ctgagttacttgtct

SEQ ID NO: 6142243 - DNA, 22 bp, Homo sapiens
ctgagttacttgtctgaggcct

SEQ ID NO: 6142244 - DNA, 23 bp, Homo sapiens
ctgagttacttgtctgaggcctc

SEQ ID NO: 6142245 - DNA, 18 bp, Homo sapiens
ctgagttaggttccagca

SEQ ID NO: 6142246 - DNA, 13 bp, Homo sapiens
ctgagttataaat

SEQ ID NO: 6142247 - DNA, 14 bp, Homo sapiens
ctgagttataaata

SEQ ID NO: 6142248 - DNA, 14 bp, Homo sapiens
ctgagttcccaaag

SEQ ID NO: 6142249 - DNA, 15 bp, Homo sapiens
ctgagttcccgggag

SEQ ID NO: 6142250 - DNA, 19 bp, Homo sapiens
ctgagttccttataagaat

SEQ ID NO: 6142251 - DNA, 22 bp, Homo sapiens
ctgagttccttataagaattaa

SEQ ID NO: 6142252 - DNA, 23 bp, Homo sapiens
ctgagttctggttcatgcagaca

SEQ ID NO: 6142253 - DNA, 19 bp, Homo sapiens
ctgagttcttgtgtcctgg

SEQ ID NO: 6142254 - DNA, 21 bp, Homo sapiens
ctgagttgaggggcttccctc

SEQ ID NO: 6142255 - DNA, 18 bp, Homo sapiens
ctgagttgccaagacaaa

SEQ ID NO: 6142256 - DNA, 19 bp, Homo sapiens
ctgagttgcttcttcttgt

SEQ ID NO: 6142257 - DNA, 23 bp, Homo sapiens
ctgagttggcagaccgggccccc

SEQ ID NO: 6142258 - DNA, 22 bp, Homo sapiens
ctgagttggcgttgtgggcagg

SEQ ID NO: 6142259 - DNA, 16 bp, Homo sapiens
ctgagttgggcagcca

SEQ ID NO: 6142260 - DNA, 17 bp, Homo sapiens
ctgagttgggcagccag

SEQ ID NO: 6142261 - DNA, 21 bp, Homo sapiens
ctgagttgggcagccaggagt

SEQ ID NO: 6142262 - DNA, 23 bp, Homo sapiens
ctgagttgggggtgtggctctgc

SEQ ID NO: 6142263 - DNA, 23 bp, Homo sapiens
ctgagttgtactggttagattca

SEQ ID NO: 6142264 - DNA, 14 bp, Homo sapiens
ctgagttgtgcctc

SEQ ID NO: 6142265 - DNA, 21 bp, Homo sapiens
ctgagttgtgcctcatttatt

SEQ ID NO: 6142266 - DNA, 11 bp, Homo sapiens
ctgagttgttc

SEQ ID NO: 6142267 - DNA, 14 bp, Homo sapiens
ctgagttgttctaa

SEQ ID NO: 6142268 - DNA, 15 bp, Homo sapiens
ctgagtttaccattt

SEQ ID NO: 6142269 - DNA, 23 bp, Homo sapiens
ctgagtttaccatttgtaataaa

SEQ ID NO: 6142270 - DNA, 14 bp, Homo sapiens
ctcaggcctggccc

SEQ ID NO: 6142271 - DNA, 16 bp, Homo sapiens
ctcaggcctggccctt

SEQ ID NO: 6142272 - DNA, 20 bp, Homo sapiens
ctcaggcctgggggctgggc

SEQ ID NO: 6142273 - DNA, 22 bp, Homo sapiens
ctcaggcctgtgcccactccct

SEQ ID NO: 6142274 - DNA, 14 bp, Homo sapiens
ctcaggcgcagccc

SEQ ID NO: 6142275 - DNA, 17 bp, Homo sapiens
ctcaggcgcagccctag

SEQ ID NO: 6142276 - DNA, 18 bp, Homo sapiens
ctcaggcgcctggcacat

SEQ ID NO: 6142277 - DNA, 20 bp, Homo sapiens
ctcaggcgggcaccaaggca

SEQ ID NO: 6142278 - DNA, 13 bp, Homo sapiens
ctcaggctactgc

SEQ ID NO: 6142279 - DNA, 23 bp, Homo sapiens
ctcaggctaggccagcaggggct

SEQ ID NO: 6142280 - DNA, 17 bp, Homo sapiens
ctcaggctcaagttttt

SEQ ID NO: 6142281 - DNA, 10 bp, Homo sapiens
ctcaggctcc

SEQ ID NO: 6142282 - DNA, 18 bp, Homo sapiens
ctcaggctccccaagact

SEQ ID NO: 6142283 - DNA, 15 bp, Homo sapiens
ctcaggctccccaga

SEQ ID NO: 6142284 - DNA, 11 bp, Homo sapiens
ctcaggctccg

SEQ ID NO: 6142285 - DNA, 11 bp, Homo sapiens
ctcaggctctg

SEQ ID NO: 6142286 - DNA, 14 bp, Homo sapiens
ctcaggctctgcac

SEQ ID NO: 6142287 - DNA, 14 bp, Homo sapiens
ctcaggctctgccc

SEQ ID NO: 6142288 - DNA, 16 bp, Homo sapiens
ctcaggctctgccctg

SEQ ID NO: 6142289 - DNA, 17 bp, Homo sapiens
ctcaggctctgccctgc

SEQ ID NO: 6142290 - DNA, 19 bp, Homo sapiens
ctcaggctctgccctgccc

SEQ ID NO: 6142291 - DNA, 16 bp, Homo sapiens
ctcaggctctgctggt

SEQ ID NO: 6142292 - DNA, 13 bp, Homo sapiens
ctcaggctgagcc

SEQ ID NO: 6142293 - DNA, 18 bp, Homo sapiens
ctcaggctgagcccagcc

SEQ ID NO: 6142294 - DNA, 22 bp, Homo sapiens
ctcaggctgagcccagccacct

SEQ ID NO: 6142295 - DNA, 23 bp, Homo sapiens
ctcaggctgcagctggacagagg

SEQ ID NO: 6142296 - DNA, 13 bp, Homo sapiens
ctcaggctgcctg

SEQ ID NO: 6142297 - DNA, 15 bp, Homo sapiens
ctcaggctgcctgag

SEQ ID NO: 6142298 - DNA, 11 bp, Homo sapiens
ctcaggctgct

SEQ ID NO: 6142299 - DNA, 15 bp, Homo sapiens
ctcaggctgctggag

SEQ ID NO: 6142300 - DNA, 24 bp, Homo sapiens
ctcaggctgctggggcctcagacg

SEQ ID NO: 6142301 - DNA, 19 bp, Homo sapiens
ctcaggctggagtgcagtg

SEQ ID NO: 6142302 - DNA, 15 bp, Homo sapiens
ctcaggctggcatct

SEQ ID NO: 6142303 - DNA, 21 bp, Homo sapiens
ctcaggctggcatctccccca

SEQ ID NO: 6142304 - DNA, 13 bp, Homo sapiens
ctcaggctggtct

SEQ ID NO: 6142305 - DNA, 14 bp, Homo sapiens
ctcaggctgtgctt

SEQ ID NO: 6142306 - DNA, 17 bp, Homo sapiens
ctcagggaaaagcagct

SEQ ID NO: 6142307 - DNA, 20 bp, Homo sapiens
ctcagggaaaagcagctctc

SEQ ID NO: 6142308 - DNA, 16 bp, Homo sapiens
ctcagggaaatggcct

SEQ ID NO: 6142309 - DNA, 17 bp, Homo sapiens
ctcagggaaatggcctt

SEQ ID NO: 6142310 - DNA, 18 bp, Homo sapiens
ctcagggaaatggccttc

SEQ ID NO: 6142311 - DNA, 22 bp, Homo sapiens
ctcagggaaatggccttcccgc

SEQ ID NO: 6142312 - DNA, 23 bp, Homo sapiens
ctcagggaaatggccttcccgcc

SEQ ID NO: 6142313 - DNA, 21 bp, Homo sapiens
ctcagggaactgaccctcagg

SEQ ID NO: 6142314 - DNA, 15 bp, Homo sapiens
ctcagggaagcccag

SEQ ID NO: 6142315 - DNA, 16 bp, Homo sapiens
ctcagggaagcccagc

SEQ ID NO: 6142316 - DNA, 17 bp, Homo sapiens
ctcagggaagcccagct

SEQ ID NO: 6142317 - DNA, 20 bp, Homo sapiens
ctcagggaagcccagctcca

SEQ ID NO: 6142318 - DNA, 23 bp, Homo sapiens
ctcagggaagcccagctccaggg

SEQ ID NO: 6142319 - DNA, 17 bp, Homo sapiens
ctcagggacaacatttt

SEQ ID NO: 6142320 - DNA, 14 bp, Homo sapiens
ctcagggacagagc

SEQ ID NO: 6142321 - DNA, 15 bp, Homo sapiens
ctcagggacagagcc

SEQ ID NO: 6142322 - DNA, 16 bp, Homo sapiens
ctcagggacagagcca

SEQ ID NO: 6142323 - DNA, 16 bp, Homo sapiens
ctcagggaccaaggag

SEQ ID NO: 6142324 - DNA, 23 bp, Homo sapiens
ctcagggaccaaggagatgggga

SEQ ID NO: 6142325 - DNA, 18 bp, Homo sapiens
ctcagggaccacagcaag

SEQ ID NO: 6142326 - DNA, 11 bp, Homo sapiens
ctcagggaccg

SEQ ID NO: 6142327 - DNA, 20 bp, Homo sapiens
ctcagggaccggtgctgcag

SEQ ID NO: 6142328 - DNA, 22 bp, Homo sapiens
ctcagggaccggtgctgcagga

SEQ ID NO: 6142329 - DNA, 21 bp, Homo sapiens
ctcagggactcatctttccct

SEQ ID NO: 6142330 - DNA, 23 bp, Homo sapiens
ctcagggactcatctttccctcc

SEQ ID NO: 6142331 - DNA, 18 bp, Homo sapiens
ctcagggagcagggaagg

SEQ ID NO: 6142332 - DNA, 11 bp, Homo sapiens
ctcagggaggg

SEQ ID NO: 6142333 - DNA, 12 bp, Homo sapiens
ctcagggaggga

SEQ ID NO: 6142334 - DNA, 13 bp, Homo sapiens
ctcagggagggag

SEQ ID NO: 6142335 - DNA, 14 bp, Homo sapiens
ctcagggcaaagcc

SEQ ID NO: 6142336 - DNA, 18 bp, Homo sapiens
ctcagggcaaagccaggt

SEQ ID NO: 6142337 - DNA, 16 bp, Homo sapiens
ctcagggcacgcagga

SEQ ID NO: 6142338 - DNA, 10 bp, Homo sapiens
ctcagggcag

SEQ ID NO: 6142339 - DNA, 11 bp, Homo sapiens
ctcagggcagc

SEQ ID NO: 6142340 - DNA, 19 bp, Homo sapiens
ctcagggcagcctgcctgg

SEQ ID NO: 6142341 - DNA, 20 bp, Homo sapiens
ctcagggcagcgccaggctg

SEQ ID NO: 6142342 - DNA, 16 bp, Homo sapiens
ctcagggcagctgcct

SEQ ID NO: 6142343 - DNA, 19 bp, Homo sapiens
ctcagggcagctgcctggc

SEQ ID NO: 6142344 - DNA, 15 bp, Homo sapiens
ctcagggcatgctta

SEQ ID NO: 6142345 - DNA, 23 bp, Homo sapiens
ctcagggccaagccggcccaacc

SEQ ID NO: 6142346 - DNA, 16 bp, Homo sapiens
ctcagggccaggccca

SEQ ID NO: 6142347 - DNA, 23 bp, Homo sapiens
ctcagggccaggcccaggcctca

SEQ ID NO: 6142348 - DNA, 21 bp, Homo sapiens
ctcagggccaggcctctccct

SEQ ID NO: 6142349 - DNA, 20 bp, Homo sapiens
ctcagggccatgcctgcccc

SEQ ID NO: 6142350 - DNA, 14 bp, Homo sapiens
ctcagggcccacct

SEQ ID NO: 6142351 - DNA, 16 bp, Homo sapiens
ctcagggcccacctcc

SEQ ID NO: 6142352 - DNA, 14 bp, Homo sapiens
ctcagggccccagc

SEQ ID NO: 6142353 - DNA, 16 bp, Homo sapiens
ctcagggccccagcac

SEQ ID NO: 6142354 - DNA, 19 bp, Homo sapiens
ctcagggccgagaggacag

SEQ ID NO: 6142355 - DNA, 13 bp, Homo sapiens
ctcagggcctcag

SEQ ID NO: 6142356 - DNA, 14 bp, Homo sapiens
ctcagggcctcagg

SEQ ID NO: 6142357 - DNA, 15 bp, Homo sapiens
ctcagggcctcaggc

SEQ ID NO: 6142358 - DNA, 14 bp, Homo sapiens
ctcagggcctggca

SEQ ID NO: 6142359 - DNA, 15 bp, Homo sapiens
ctcagggcgctcaga

SEQ ID NO: 6142360 - DNA, 18 bp, Homo sapiens
ctcagggcgctcagacgg

SEQ ID NO: 6142361 - DNA, 15 bp, Homo sapiens
ctcagggctcctgcc

SEQ ID NO: 6142362 - DNA, 16 bp, Homo sapiens
ctcagggctgacacgt

SEQ ID NO: 6142363 - DNA, 15 bp, Homo sapiens
ctcagggctggagcc

SEQ ID NO: 6142364 - DNA, 13 bp, Homo sapiens
ctcagggctggat

SEQ ID NO: 6142365 - DNA, 14 bp, Homo sapiens
ctcagggctggccc

SEQ ID NO: 6142366 - DNA, 19 bp, Homo sapiens
ctcagggctgtcccagccc

SEQ ID NO: 6142367 - DNA, 20 bp, Homo sapiens
ctcagggcttctcctctgct

SEQ ID NO: 6142368 - DNA, 12 bp, Homo sapiens
ctcaggggaccc

SEQ ID NO: 6142369 - DNA, 19 bp, Homo sapiens
ctcaggggaccccactccc

SEQ ID NO: 6142370 - DNA, 20 bp, Homo sapiens
ctcaggggatcggctgggaa

SEQ ID NO: 6142371 - DNA, 20 bp, Homo sapiens
ctcaggggatgtttacctgg

SEQ ID NO: 6142372 - DNA, 13 bp, Homo sapiens
ctcaggggcaggt

SEQ ID NO: 6142373 - DNA, 15 bp, Homo sapiens
ctcaggggcaggtgg

SEQ ID NO: 6142374 - DNA, 20 bp, Homo sapiens
ctcaggggcaggtggtggag

SEQ ID NO: 6142375 - DNA, 17 bp, Homo sapiens
ctcaggggccagaggaa

SEQ ID NO: 6142376 - DNA, 21 bp, Homo sapiens
ctcaggggcctcaggggagcc

SEQ ID NO: 6142377 - DNA, 20 bp, Homo sapiens
ctcaggggcctctctcctgc

SEQ ID NO: 6142378 - DNA, 17 bp, Homo sapiens
ctcaggggcctgcccag

SEQ ID NO: 6142379 - DNA, 17 bp, Homo sapiens
ctcaggggcctggaggt

SEQ ID NO: 6142380 - DNA, 15 bp, Homo sapiens
ctcaggggctgtttg

SEQ ID NO: 6142381 - DNA, 19 bp, Homo sapiens
ctcaggggctgtttgagga

SEQ ID NO: 6142382 - DNA, 15 bp, Homo sapiens
ctcagggggccagct

SEQ ID NO: 6142383 - DNA, 16 bp, Homo sapiens
ctcagggggccagctg

SEQ ID NO: 6142384 - DNA, 17 bp, Homo sapiens
ctcagggggccagctgg

SEQ ID NO: 6142385 - DNA, 18 bp, Homo sapiens
ctcagggggccagctggg

SEQ ID NO: 6142386 - DNA, 19 bp, Homo sapiens
ctcagggggcgcctgtggt

SEQ ID NO: 6142387 - DNA, 19 bp, Homo sapiens
ctcagggggtaggagagca

SEQ ID NO: 6142388 - DNA, 24 bp, Homo sapiens
ctcagggggtaggagagcactgcc

SEQ ID NO: 6142389 - DNA, 19 bp, Homo sapiens
ctcaggggtcactgaggcc

SEQ ID NO: 6142390 - DNA, 21 bp, Homo sapiens
ctcaggggtctgagctccagc

SEQ ID NO: 6142391 - DNA, 20 bp, Homo sapiens
ctcaggggtgctggggcaga

SEQ ID NO: 6142392 - DNA, 21 bp, Homo sapiens
ctcaggggtgctggggcagag

SEQ ID NO: 6142393 - DNA, 18 bp, Homo sapiens
ctcaggggtggagaagtg

SEQ ID NO: 6142394 - DNA, 16 bp, Homo sapiens
ctcaggggtgtgcctg

SEQ ID NO: 6142395 - DNA, 17 bp, Homo sapiens
ctcagggtaagctgctc

SEQ ID NO: 6142396 - DNA, 18 bp, Homo sapiens
ctcagggtcaaagacaga

SEQ ID NO: 6142397 - DNA, 18 bp, Homo sapiens
ctcagggtcactgtcctt

SEQ ID NO: 6142398 - DNA, 20 bp, Homo sapiens
ctcagggtccctcaggacca

SEQ ID NO: 6142399 - DNA, 14 bp, Homo sapiens
ctcagggtccctgg

SEQ ID NO: 6142400 - DNA, 20 bp, Homo sapiens
ctcagggtccctggtggcag

SEQ ID NO: 6142401 - DNA, 17 bp, Homo sapiens
ctcagggtcctgccctc

SEQ ID NO: 6142402 - DNA, 17 bp, Homo sapiens
ctcagggtctctgctgc

SEQ ID NO: 6142403 - DNA, 16 bp, Homo sapiens
ctcagggtgcagaggt

SEQ ID NO: 6142404 - DNA, 16 bp, Homo sapiens
ctcagggtggtctctt

SEQ ID NO: 6142405 - DNA, 20 bp, Homo sapiens
ctcagggttcatctgtccat

SEQ ID NO: 6142406 - DNA, 14 bp, Homo sapiens
ctcagggttggcca

SEQ ID NO: 6142407 - DNA, 21 bp, Homo sapiens
ctcagggttttggggtcctgg

SEQ ID NO: 6142408 - DNA, 14 bp, Homo sapiens
ctcaggtaaatctt

SEQ ID NO: 6142409 - DNA, 19 bp, Homo sapiens
ctcaggtacagagaaggaa

SEQ ID NO: 6142410 - DNA, 16 bp, Homo sapiens
ctcaggtacagcgggc

SEQ ID NO: 6142411 - DNA, 21 bp, Homo sapiens
ctcaggtacggagaagaatag

SEQ ID NO: 6142412 - DNA, 23 bp, Homo sapiens
ctcaggtagaaggttgacacagt

SEQ ID NO: 6142413 - DNA, 15 bp, Homo sapiens
ctcaggtagccacca

SEQ ID NO: 6142414 - DNA, 19 bp, Homo sapiens
ctcaggtagggagctaagg

SEQ ID NO: 6142415 - DNA, 18 bp, Homo sapiens
ctcaggtcagctgggagc

SEQ ID NO: 6142416 - DNA, 20 bp, Homo sapiens
ctcaggtcagggtgaggatg

SEQ ID NO: 6142417 - DNA, 12 bp, Homo sapiens
ctcaggtccagc

SEQ ID NO: 6142418 - DNA, 15 bp, Homo sapiens
ctcaggtcctgctgc

SEQ ID NO: 6142419 - DNA, 14 bp, Homo sapiens
ctcaggtctgaatc

SEQ ID NO: 6142420 - DNA, 15 bp, Homo sapiens
ctcaggtctgtaact

SEQ ID NO: 6142421 - DNA, 20 bp, Homo sapiens
ctcaggtctgtaactgccca

SEQ ID NO: 6142422 - DNA, 22 bp, Homo sapiens
ctcaggtgacggactcagactc

SEQ ID NO: 6142423 - DNA, 16 bp, Homo sapiens
ctcaggtgactggagc

SEQ ID NO: 6142424 - DNA, 22 bp, Homo sapiens
ctcaggtgactggagcccgagg

SEQ ID NO: 6142425 - DNA, 16 bp, Homo sapiens
ctcaggtgagaagcag

SEQ ID NO: 6142426 - DNA, 19 bp, Homo sapiens
ctcaggtgagaagcagagg

SEQ ID NO: 6142427 - DNA, 20 bp, Homo sapiens
ctcaggtgagaagcagagga

SEQ ID NO: 6142428 - DNA, 20 bp, Homo sapiens
ctcaggtgatccacctgcct

SEQ ID NO: 6142429 - DNA, 23 bp, Homo sapiens
ctcaggtgatccgcccacctcag

SEQ ID NO: 6142430 - DNA, 21 bp, Homo sapiens
ctcaggtgatctgcccgcctc

SEQ ID NO: 6142431 - DNA, 13 bp, Homo sapiens
ctcaggtgcacac

SEQ ID NO: 6142432 - DNA, 21 bp, Homo sapiens
ctcaggtgccactccctgagc

SEQ ID NO: 6142433 - DNA, 13 bp, Homo sapiens
ctcaggtgcctta

SEQ ID NO: 6142434 - DNA, 16 bp, Homo sapiens
ctcaggtgcgtgccac

SEQ ID NO: 6142435 - DNA, 17 bp, Homo sapiens
ctcaggtgctatgtccc

SEQ ID NO: 6142436 - DNA, 21 bp, Homo sapiens
ctcaggtgctatgtcccaaga

SEQ ID NO: 6142437 - DNA, 13 bp, Homo sapiens
ctcaggtgctggg

SEQ ID NO: 6142438 - DNA, 13 bp, Homo sapiens
ctcaggtggcatt

SEQ ID NO: 6142439 - DNA, 17 bp, Homo sapiens
ctcaggtggcatttgca

SEQ ID NO: 6142440 - DNA, 18 bp, Homo sapiens
ctcaggtggcatttgcag

SEQ ID NO: 6142441 - DNA, 20 bp, Homo sapiens
ctcaggtggccagcctggat

SEQ ID NO: 6142442 - DNA, 21 bp, Homo sapiens
ctcaggtggccagcctggatc

SEQ ID NO: 6142443 - DNA, 13 bp, Homo sapiens
ctcaggtgggcgt

SEQ ID NO: 6142444 - DNA, 18 bp, Homo sapiens
ctcaggtggggagtccag

SEQ ID NO: 6142445 - DNA, 17 bp, Homo sapiens
ctcaggtgtagctgagc

SEQ ID NO: 6142446 - DNA, 20 bp, Homo sapiens
ctcaggtgtagctgagctgt

SEQ ID NO: 6142447 - DNA, 15 bp, Homo sapiens
ctcaggtgtccctgc

SEQ ID NO: 6142448 - DNA, 16 bp, Homo sapiens
ctcaggtgtccctgca

SEQ ID NO: 6142449 - DNA, 14 bp, Homo sapiens
ctgagtttcccttc

SEQ ID NO: 6142450 - DNA, 15 bp, Homo sapiens
ctgagtttcccttcc

SEQ ID NO: 6142451 - DNA, 12 bp, Homo sapiens
ctgagtttccta

SEQ ID NO: 6142452 - DNA, 20 bp, Homo sapiens
ctgagtttcctatgggaaca

SEQ ID NO: 6142453 - DNA, 15 bp, Homo sapiens
ctgagtttgggagag

SEQ ID NO: 6142454 - DNA, 22 bp, Homo sapiens
ctgagtttgggagagtggtgag

SEQ ID NO: 6142455 - DNA, 22 bp, Homo sapiens
ctgagtttgtggtgatcgcaca

SEQ ID NO: 6142456 - DNA, 14 bp, Homo sapiens
ctgagttttaccaa

SEQ ID NO: 6142457 - DNA, 11 bp, Homo sapiens
ctgagttttcc

SEQ ID NO: 6142458 - DNA, 21 bp, Homo sapiens
ctgagttttctctttgtgggg

SEQ ID NO: 6142459 - DNA, 17 bp, Homo sapiens
ctgagttttgatgctgt

SEQ ID NO: 6142460 - DNA, 19 bp, Homo sapiens
ctgagttttgtgtttgttg

SEQ ID NO: 6142461 - DNA, 13 bp, Homo sapiens
ctgataaaaatga

SEQ ID NO: 6142462 - DNA, 17 bp, Homo sapiens
ctgataaacattaaaca

SEQ ID NO: 6142463 - DNA, 21 bp, Homo sapiens
ctgataaaccaaaattgagca

SEQ ID NO: 6142464 - DNA, 14 bp, Homo sapiens
ctgataaactgacg

SEQ ID NO: 6142465 - DNA, 21 bp, Homo sapiens
ctgataaagatgagtgagcat

SEQ ID NO: 6142466 - DNA, 19 bp, Homo sapiens
ctgataactagatggtgct

SEQ ID NO: 6142467 - DNA, 17 bp, Homo sapiens
ctgataacttggggagg

SEQ ID NO: 6142468 - DNA, 15 bp, Homo sapiens
ctgataagactgttt

SEQ ID NO: 6142469 - DNA, 16 bp, Homo sapiens
ctgataaggaaacttt

SEQ ID NO: 6142470 - DNA, 20 bp, Homo sapiens
ctgataagggagagggaaat

SEQ ID NO: 6142471 - DNA, 14 bp, Homo sapiens
ctgataataattga

SEQ ID NO: 6142472 - DNA, 21 bp, Homo sapiens
ctgataatatgtttgaggtta

SEQ ID NO: 6142473 - DNA, 20 bp, Homo sapiens
ctgataatgatttgctcttt

SEQ ID NO: 6142474 - DNA, 21 bp, Homo sapiens
ctgataattgtgtattttctt

SEQ ID NO: 6142475 - DNA, 18 bp, Homo sapiens
ctgataatttattgtctt

SEQ ID NO: 6142476 - DNA, 17 bp, Homo sapiens
ctgataattttaaattc

SEQ ID NO: 6142477 - DNA, 22 bp, Homo sapiens
ctgatacagaaaagttgaattt

SEQ ID NO: 6142478 - DNA, 18 bp, Homo sapiens
ctgatacataaaaattaa

SEQ ID NO: 6142479 - DNA, 13 bp, Homo sapiens
ctgatacatctgt

SEQ ID NO: 6142480 - DNA, 17 bp, Homo sapiens
ctgataccaaagagaca

SEQ ID NO: 6142481 - DNA, 19 bp, Homo sapiens
ctgataccaaagagacagg

SEQ ID NO: 6142482 - DNA, 12 bp, Homo sapiens
ctgatacctcaa

SEQ ID NO: 6142483 - DNA, 17 bp, Homo sapiens
ctgatacctgcctggga

SEQ ID NO: 6142484 - DNA, 17 bp, Homo sapiens
ctgatactatctcttgt

SEQ ID NO: 6142485 - DNA, 15 bp, Homo sapiens
ctgatactattcaat

SEQ ID NO: 6142486 - DNA, 12 bp, Homo sapiens
ctgatactgggt

SEQ ID NO: 6142487 - DNA, 19 bp, Homo sapiens
ctgatactgggtctgcgat

SEQ ID NO: 6142488 - DNA, 21 bp, Homo sapiens
ctgatacttatttataacatt

SEQ ID NO: 6142489 - DNA, 23 bp, Homo sapiens
ctgatagaaatggtttcctctgg

SEQ ID NO: 6142490 - DNA, 24 bp, Homo sapiens
ctgatagaagaaggactgaagaaa

SEQ ID NO: 6142491 - DNA, 16 bp, Homo sapiens
ctgatagagtttaaca

SEQ ID NO: 6142492 - DNA, 22 bp, Homo sapiens
ctgatagagtttaacagatatt

SEQ ID NO: 6142493 - DNA, 16 bp, Homo sapiens
ctgatagcgttggaat

SEQ ID NO: 6142494 - DNA, 18 bp, Homo sapiens
ctgatagctaagtgagtt

SEQ ID NO: 6142495 - DNA, 22 bp, Homo sapiens
ctgatagctacccacagagcaa

SEQ ID NO: 6142496 - DNA, 15 bp, Homo sapiens
ctgatagctctttgg

SEQ ID NO: 6142497 - DNA, 19 bp, Homo sapiens
ctgatagctgtttcaaatg

SEQ ID NO: 6142498 - DNA, 18 bp, Homo sapiens
ctgatagcttacactgag

SEQ ID NO: 6142499 - DNA, 16 bp, Homo sapiens
ctgataggaaaagaag

SEQ ID NO: 6142500 - DNA, 14 bp, Homo sapiens
ctgataggaggggg

SEQ ID NO: 6142501 - DNA, 23 bp, Homo sapiens
ctgatagggtttgtgacagggcg

SEQ ID NO: 6142502 - DNA, 19 bp, Homo sapiens
ctgatagtcacctgctggt

SEQ ID NO: 6142503 - DNA, 15 bp, Homo sapiens
ctgatagttactgtt

SEQ ID NO: 6142504 - DNA, 18 bp, Homo sapiens
ctgatagttactgttgtg

SEQ ID NO: 6142505 - DNA, 14 bp, Homo sapiens
ctgatataaattct

SEQ ID NO: 6142506 - DNA, 19 bp, Homo sapiens
ctgatatacaattagagat

SEQ ID NO: 6142507 - DNA, 21 bp, Homo sapiens
ctgatatatgtgtttttcaca

SEQ ID NO: 6142508 - DNA, 15 bp, Homo sapiens
ctgatatcaacagct

SEQ ID NO: 6142509 - DNA, 15 bp, Homo sapiens
ctgatatcacgggcc

SEQ ID NO: 6142510 - DNA, 21 bp, Homo sapiens
ctgatatcacgggcccgctca

SEQ ID NO: 6142511 - DNA, 19 bp, Homo sapiens
ctgatatctgtttgcttct

SEQ ID NO: 6142512 - DNA, 22 bp, Homo sapiens
ctgatatgatttaaaacatgta

SEQ ID NO: 6142513 - DNA, 23 bp, Homo sapiens
ctgatatgatttaaaacatgtaa

SEQ ID NO: 6142514 - DNA, 15 bp, Homo sapiens
ctgatattaagtaat

SEQ ID NO: 6142515 - DNA, 14 bp, Homo sapiens
ctgatattaatcaa

SEQ ID NO: 6142516 - DNA, 20 bp, Homo sapiens
ctgatattaatttatcagat

SEQ ID NO: 6142517 - DNA, 16 bp, Homo sapiens
ctgatattatggcaag

SEQ ID NO: 6142518 - DNA, 18 bp, Homo sapiens
ctgatattatttcttctc

SEQ ID NO: 6142519 - DNA, 20 bp, Homo sapiens
ctgatattcaaacacacagt

SEQ ID NO: 6142520 - DNA, 14 bp, Homo sapiens
ctgatattgaagta

SEQ ID NO: 6142521 - DNA, 19 bp, Homo sapiens
ctgatattgccgcactagg

SEQ ID NO: 6142522 - DNA, 18 bp, Homo sapiens
ctgatatttgctggagtg

SEQ ID NO: 6142523 - DNA, 17 bp, Homo sapiens
ctgatattttacctctt

SEQ ID NO: 6142524 - DNA, 15 bp, Homo sapiens
ctgatcaaaaataaa

SEQ ID NO: 6142525 - DNA, 18 bp, Homo sapiens
ctgatcaaaaataaacta

SEQ ID NO: 6142526 - DNA, 20 bp, Homo sapiens
ctgatcaaaaataaactagt

SEQ ID NO: 6142527 - DNA, 22 bp, Homo sapiens
ctgatcaaaaataaactagttt

SEQ ID NO: 6142528 - DNA, 16 bp, Homo sapiens
ctgatcaacaatttgg

SEQ ID NO: 6142529 - DNA, 12 bp, Homo sapiens
ctgatcaaggcc

SEQ ID NO: 6142530 - DNA, 17 bp, Homo sapiens
ctgatcaaggtgctctt

SEQ ID NO: 6142531 - DNA, 22 bp, Homo sapiens
ctgatcaagtcaccggagcttt

SEQ ID NO: 6142532 - DNA, 19 bp, Homo sapiens
ctgatcacccccctgctta

SEQ ID NO: 6142533 - DNA, 17 bp, Homo sapiens
ctgatcacctctggctt

SEQ ID NO: 6142534 - DNA, 23 bp, Homo sapiens
ctgatcacctctggctttgtctc

SEQ ID NO: 6142535 - DNA, 15 bp, Homo sapiens
ctgatcacctgccct

SEQ ID NO: 6142536 - DNA, 15 bp, Homo sapiens
ctgatcagaatttta

SEQ ID NO: 6142537 - DNA, 14 bp, Homo sapiens
ctgatcagagccgt

SEQ ID NO: 6142538 - DNA, 21 bp, Homo sapiens
ctgatcagaggcatttgagca

SEQ ID NO: 6142539 - DNA, 12 bp, Homo sapiens
ctgatcagaggt

SEQ ID NO: 6142540 - DNA, 17 bp, Homo sapiens
ctgatcaggcttcctgg

SEQ ID NO: 6142541 - DNA, 18 bp, Homo sapiens
ctgatcatcgccagaggt

SEQ ID NO: 6142542 - DNA, 17 bp, Homo sapiens
ctgatcatgcattgttg

SEQ ID NO: 6142543 - DNA, 20 bp, Homo sapiens
ctgatcatggtcagctcaca

SEQ ID NO: 6142544 - DNA, 21 bp, Homo sapiens
ctgatcatggtcagctcacac

SEQ ID NO: 6142545 - DNA, 17 bp, Homo sapiens
ctgatcatttgcagctg

SEQ ID NO: 6142546 - DNA, 21 bp, Homo sapiens
ctgatcatttgcagctgctgg

SEQ ID NO: 6142547 - DNA, 16 bp, Homo sapiens
ctgatccagtttccgg

SEQ ID NO: 6142548 - DNA, 20 bp, Homo sapiens
ctgatccagttttgtttgga

SEQ ID NO: 6142549 - DNA, 20 bp, Homo sapiens
ctgatcccaccccctcctcc

SEQ ID NO: 6142550 - DNA, 15 bp, Homo sapiens
ctgatcccactccta

SEQ ID NO: 6142551 - DNA, 18 bp, Homo sapiens
ctgatcccactcctagga

SEQ ID NO: 6142552 - DNA, 20 bp, Homo sapiens
ctgatcccagacccattcct

SEQ ID NO: 6142553 - DNA, 18 bp, Homo sapiens
ctgatcccagagagcccg

SEQ ID NO: 6142554 - DNA, 20 bp, Homo sapiens
ctgatcccagtttctgctgt

SEQ ID NO: 6142555 - DNA, 16 bp, Homo sapiens
ctgatccccatgccta

SEQ ID NO: 6142556 - DNA, 22 bp, Homo sapiens
ctgatcccccagatgcagggct

SEQ ID NO: 6142557 - DNA, 13 bp, Homo sapiens
ctgatccctctac

SEQ ID NO: 6142558 - DNA, 15 bp, Homo sapiens
ctgatccctctacag

SEQ ID NO: 6142559 - DNA, 17 bp, Homo sapiens
ctgatccctctgggggc

SEQ ID NO: 6142560 - DNA, 19 bp, Homo sapiens
ctgatccctgaacccctgg

SEQ ID NO: 6142561 - DNA, 14 bp, Homo sapiens
ctgatccctgctct

SEQ ID NO: 6142562 - DNA, 16 bp, Homo sapiens
ctgatccctgctctct

SEQ ID NO: 6142563 - DNA, 17 bp, Homo sapiens
ctgatccctggccactg

SEQ ID NO: 6142564 - DNA, 21 bp, Homo sapiens
ctgatccggctgctcctccag

SEQ ID NO: 6142565 - DNA, 23 bp, Homo sapiens
ctgatcctaaccctgggctccct

SEQ ID NO: 6142566 - DNA, 16 bp, Homo sapiens
ctgatcctaagaattt

SEQ ID NO: 6142567 - DNA, 21 bp, Homo sapiens
ctgatcctagttccaccatca

SEQ ID NO: 6142568 - DNA, 20 bp, Homo sapiens
ctgatcctcagcccctccag

SEQ ID NO: 6142569 - DNA, 21 bp, Homo sapiens
ctgatcctgaacaagaaagag

SEQ ID NO: 6142570 - DNA, 15 bp, Homo sapiens
ctgatcctgctccag

SEQ ID NO: 6142571 - DNA, 21 bp, Homo sapiens
ctgatcctgctccagcagcac

SEQ ID NO: 6142572 - DNA, 17 bp, Homo sapiens
ctgatcctgctgacctc

SEQ ID NO: 6142573 - DNA, 16 bp, Homo sapiens
ctgatcgccttcccca

SEQ ID NO: 6142574 - DNA, 17 bp, Homo sapiens
ctgatcgggataacaaa

SEQ ID NO: 6142575 - DNA, 22 bp, Homo sapiens
ctgatcgtgacgctgaataaat

SEQ ID NO: 6142576 - DNA, 15 bp, Homo sapiens
ctgatctaacaaaat

SEQ ID NO: 6142577 - DNA, 19 bp, Homo sapiens
ctgatctaacaaaataagg

SEQ ID NO: 6142578 - DNA, 12 bp, Homo sapiens
ctgatctattta

SEQ ID NO: 6142579 - DNA, 15 bp, Homo sapiens
ctgatctcagggaag

SEQ ID NO: 6142580 - DNA, 21 bp, Homo sapiens
ctgatctcagggaagcccagc

SEQ ID NO: 6142581 - DNA, 23 bp, Homo sapiens
ctgatctcagggaagcccagctc

SEQ ID NO: 6142582 - DNA, 16 bp, Homo sapiens
ctgatctccgcagagg

SEQ ID NO: 6142583 - DNA, 18 bp, Homo sapiens
ctgatctctcagccccaa

SEQ ID NO: 6142584 - DNA, 14 bp, Homo sapiens
ctgatctctcgtga

SEQ ID NO: 6142585 - DNA, 13 bp, Homo sapiens
ctgatctcttcct

SEQ ID NO: 6142586 - DNA, 14 bp, Homo sapiens
ctgatctcttcctg

SEQ ID NO: 6142587 - DNA, 16 bp, Homo sapiens
ctgatctcttcctgtt

SEQ ID NO: 6142588 - DNA, 18 bp, Homo sapiens
ctgatctgacatccccac

SEQ ID NO: 6142589 - DNA, 20 bp, Homo sapiens
ctgatctgatgcaagcaaga

SEQ ID NO: 6142590 - DNA, 11 bp, Homo sapiens
ctgatctgccc

SEQ ID NO: 6142591 - DNA, 12 bp, Homo sapiens
ctgatctgccca

SEQ ID NO: 6142592 - DNA, 23 bp, Homo sapiens
ctgatctgcccatcgtgaagaag

SEQ ID NO: 6142593 - DNA, 13 bp, Homo sapiens
ctgatctggaccc

SEQ ID NO: 6142594 - DNA, 13 bp, Homo sapiens
ctgatctggccca

SEQ ID NO: 6142595 - DNA, 15 bp, Homo sapiens
ctgatctggctgcag

SEQ ID NO: 6142596 - DNA, 12 bp, Homo sapiens
ctgatctgggtt

SEQ ID NO: 6142597 - DNA, 13 bp, Homo sapiens
ctgatctggtttg

SEQ ID NO: 6142598 - DNA, 13 bp, Homo sapiens
ctgatctgtactt

SEQ ID NO: 6142599 - DNA, 18 bp, Homo sapiens
ctgatctgtactttgtgt

SEQ ID NO: 6142600 - DNA, 21 bp, Homo sapiens
ctgatctgtactttgtgttta

SEQ ID NO: 6142601 - DNA, 21 bp, Homo sapiens
ctgatctgtataaaaatgtaa

SEQ ID NO: 6142602 - DNA, 20 bp, Homo sapiens
ctgatctgtgctttccagct

SEQ ID NO: 6142603 - DNA, 13 bp, Homo sapiens
ctgatctgttata

SEQ ID NO: 6142604 - DNA, 14 bp, Homo sapiens
ctgatctgttatag

SEQ ID NO: 6142605 - DNA, 20 bp, Homo sapiens
ctgatcttggaaaaacagcg

SEQ ID NO: 6142606 - DNA, 14 bp, Homo sapiens
ctgatctttgcaaa

SEQ ID NO: 6142607 - DNA, 18 bp, Homo sapiens
ctgatctttgtatattac

SEQ ID NO: 6142608 - DNA, 18 bp, Homo sapiens
ctgatcttttaaaatcat

SEQ ID NO: 6142609 - DNA, 16 bp, Homo sapiens
ctgatctttttataca

SEQ ID NO: 6142610 - DNA, 13 bp, Homo sapiens
ctgatgaaaataa

SEQ ID NO: 6142611 - DNA, 14 bp, Homo sapiens
ctgatgaaaataaa

SEQ ID NO: 6142612 - DNA, 23 bp, Homo sapiens
ctgatgaaaatattctgattggt

SEQ ID NO: 6142613 - DNA, 14 bp, Homo sapiens
ctgatgaaaatgaa

SEQ ID NO: 6142614 - DNA, 19 bp, Homo sapiens
ctgatgaaaccttgaagtt

SEQ ID NO: 6142615 - DNA, 13 bp, Homo sapiens
ctgatgaaatctg

SEQ ID NO: 6142616 - DNA, 19 bp, Homo sapiens
ctgatgaaatctgctagaa

SEQ ID NO: 6142617 - DNA, 20 bp, Homo sapiens
ctgatgaaatctgctagaaa

SEQ ID NO: 6142618 - DNA, 20 bp, Homo sapiens
ctgatgaacttattctgtag

SEQ ID NO: 6142619 - DNA, 17 bp, Homo sapiens
ctgatgaagaagggggt

SEQ ID NO: 6142620 - DNA, 20 bp, Homo sapiens
ctgatgaagaagggggtggg

SEQ ID NO: 6142621 - DNA, 19 bp, Homo sapiens
ctgatgaagttaagcacaa

SEQ ID NO: 6142622 - DNA, 15 bp, Homo sapiens
ctgatgaatcactgt

SEQ ID NO: 6142623 - DNA, 24 bp, Homo sapiens
ctgatgacaaacccaggagtttgt

SEQ ID NO: 6142624 - DNA, 18 bp, Homo sapiens
ctgatgacaataaagctt

SEQ ID NO: 6142625 - DNA, 20 bp, Homo sapiens
ctgatgacaataaagcttgt

SEQ ID NO: 6142626 - DNA, 14 bp, Homo sapiens
ctgatgacactgag

SEQ ID NO: 6142627 - DNA, 19 bp, Homo sapiens
ctcaggttcacagcagctt

SEQ ID NO: 6142628 - DNA, 14 bp, Homo sapiens
ctcaggttccagaa

SEQ ID NO: 6142629 - DNA, 18 bp, Homo sapiens
ctcaggttccagaacagc

SEQ ID NO: 6142630 - DNA, 12 bp, Homo sapiens
ctcaggttccta

SEQ ID NO: 6142631 - DNA, 14 bp, Homo sapiens
ctcaggttctattt

SEQ ID NO: 6142632 - DNA, 19 bp, Homo sapiens
ctcaggttggcggcagaca

SEQ ID NO: 6142633 - DNA, 22 bp, Homo sapiens
ctcaggttgtagtaaagaaatt

SEQ ID NO: 6142634 - DNA, 13 bp, Homo sapiens
ctcaggtttctgg

SEQ ID NO: 6142635 - DNA, 19 bp, Homo sapiens
ctcaggtttctggacaaga

SEQ ID NO: 6142636 - DNA, 18 bp, Homo sapiens
ctcaggtttgtcctggtc

SEQ ID NO: 6142637 - DNA, 20 bp, Homo sapiens
ctcaggtttgtcctggtcat

SEQ ID NO: 6142638 - DNA, 15 bp, Homo sapiens
ctcaggtttgttttg

SEQ ID NO: 6142639 - DNA, 13 bp, Homo sapiens
ctcagtaaaagca

SEQ ID NO: 6142640 - DNA, 12 bp, Homo sapiens
ctcagtaaacgg

SEQ ID NO: 6142641 - DNA, 20 bp, Homo sapiens
ctcagtaaacgggaacatgc

SEQ ID NO: 6142642 - DNA, 16 bp, Homo sapiens
ctcagtaaagcacttg

SEQ ID NO: 6142643 - DNA, 20 bp, Homo sapiens
ctcagtaaatgtacaactgc

SEQ ID NO: 6142644 - DNA, 16 bp, Homo sapiens
ctcagtaacagtgcag

SEQ ID NO: 6142645 - DNA, 20 bp, Homo sapiens
ctcagtaagtatctggagga

SEQ ID NO: 6142646 - DNA, 21 bp, Homo sapiens
ctcagtaagtatctggaggaa

SEQ ID NO: 6142647 - DNA, 19 bp, Homo sapiens
ctcagtaatttagaaatca

SEQ ID NO: 6142648 - DNA, 13 bp, Homo sapiens
ctcagtaatttgt

SEQ ID NO: 6142649 - DNA, 20 bp, Homo sapiens
ctcagtacctcccctccccg

SEQ ID NO: 6142650 - DNA, 15 bp, Homo sapiens
ctcagtacctgtgtt

SEQ ID NO: 6142651 - DNA, 18 bp, Homo sapiens
ctcagtactttggaggcc

SEQ ID NO: 6142652 - DNA, 20 bp, Homo sapiens
ctcagtagctgaacctgtct

SEQ ID NO: 6142653 - DNA, 22 bp, Homo sapiens
ctcagtaggtctgaaggcctcc

SEQ ID NO: 6142654 - DNA, 23 bp, Homo sapiens
ctcagtaggtctgaaggcctcca

SEQ ID NO: 6142655 - DNA, 13 bp, Homo sapiens
ctcagtagtccct

SEQ ID NO: 6142656 - DNA, 18 bp, Homo sapiens
ctcagtatatttaaactc

SEQ ID NO: 6142657 - DNA, 20 bp, Homo sapiens
ctcagtatgctttccctgag

SEQ ID NO: 6142658 - DNA, 21 bp, Homo sapiens
ctcagtatgctttccctgagg

SEQ ID NO: 6142659 - DNA, 23 bp, Homo sapiens
ctcagtatgtgggggcttcatct

SEQ ID NO: 6142660 - DNA, 22 bp, Homo sapiens
ctcagtattgagacactgtcaa

SEQ ID NO: 6142661 - DNA, 13 bp, Homo sapiens
ctcagtatttatg

SEQ ID NO: 6142662 - DNA, 17 bp, Homo sapiens
ctcagtatttatgtaat

SEQ ID NO: 6142663 - DNA, 19 bp, Homo sapiens
ctcagtatttatgtaattt

SEQ ID NO: 6142664 - DNA, 21 bp, Homo sapiens
ctcagtcacccccacttccca

SEQ ID NO: 6142665 - DNA, 17 bp, Homo sapiens
ctcagtcactttttccc

SEQ ID NO: 6142666 - DNA, 18 bp, Homo sapiens
ctcagtcactttttcccc

SEQ ID NO: 6142667 - DNA, 15 bp, Homo sapiens
ctcagtcagtgcact

SEQ ID NO: 6142668 - DNA, 15 bp, Homo sapiens
ctcagtcatgcataa

SEQ ID NO: 6142669 - DNA, 16 bp, Homo sapiens
ctcagtcatgcataaa

SEQ ID NO: 6142670 - DNA, 23 bp, Homo sapiens
ctcagtcatgcataaatatgcag

SEQ ID NO: 6142671 - DNA, 13 bp, Homo sapiens
ctcagtccactgt

SEQ ID NO: 6142672 - DNA, 19 bp, Homo sapiens
ctcagtccagatgccttcc

SEQ ID NO: 6142673 - DNA, 15 bp, Homo sapiens
ctcagtccatagcag

SEQ ID NO: 6142674 - DNA, 21 bp, Homo sapiens
ctcagtcccaaatccttccca

SEQ ID NO: 6142675 - DNA, 22 bp, Homo sapiens
ctcagtccctccctcctggctc

SEQ ID NO: 6142676 - DNA, 16 bp, Homo sapiens
ctcagtcctaatttga

SEQ ID NO: 6142677 - DNA, 17 bp, Homo sapiens
ctcagtcctcccctcac

SEQ ID NO: 6142678 - DNA, 20 bp, Homo sapiens
ctcagtcctcccctcacagc

SEQ ID NO: 6142679 - DNA, 21 bp, Homo sapiens
ctcagtcctcccctcacagcc

SEQ ID NO: 6142680 - DNA, 13 bp, Homo sapiens
ctcagtcctggaa

SEQ ID NO: 6142681 - DNA, 15 bp, Homo sapiens
ctcagtctaaggtct

SEQ ID NO: 6142682 - DNA, 22 bp, Homo sapiens
ctcagtctcacctgccggctct

SEQ ID NO: 6142683 - DNA, 13 bp, Homo sapiens
ctcagtctccctt

SEQ ID NO: 6142684 - DNA, 15 bp, Homo sapiens
ctcagtctccctttc

SEQ ID NO: 6142685 - DNA, 14 bp, Homo sapiens
ctcagtctctgagc

SEQ ID NO: 6142686 - DNA, 14 bp, Homo sapiens
ctcagtctcttcca

SEQ ID NO: 6142687 - DNA, 17 bp, Homo sapiens
ctcagtctggcccttcc

SEQ ID NO: 6142688 - DNA, 19 bp, Homo sapiens
ctcagtctgtcacccaggc

SEQ ID NO: 6142689 - DNA, 21 bp, Homo sapiens
ctcagtctgtcacccaggctg

SEQ ID NO: 6142690 - DNA, 22 bp, Homo sapiens
ctcagtctgtcacccaggctgg

SEQ ID NO: 6142691 - DNA, 14 bp, Homo sapiens
ctcagtctgttcac

SEQ ID NO: 6142692 - DNA, 18 bp, Homo sapiens
ctcagtctgttcactgca

SEQ ID NO: 6142693 - DNA, 21 bp, Homo sapiens
ctcagtctgttcactgcattc

SEQ ID NO: 6142694 - DNA, 20 bp, Homo sapiens
ctcagtcttccctagggctg

SEQ ID NO: 6142695 - DNA, 23 bp, Homo sapiens
ctcagtcttccctagggctgggt

SEQ ID NO: 6142696 - DNA, 14 bp, Homo sapiens
ctcagtgaagacta

SEQ ID NO: 6142697 - DNA, 19 bp, Homo sapiens
ctcagtgaaggcccatgaa

SEQ ID NO: 6142698 - DNA, 15 bp, Homo sapiens
ctcagtgaagttgct

SEQ ID NO: 6142699 - DNA, 14 bp, Homo sapiens
ctcagtgaccagtg

SEQ ID NO: 6142700 - DNA, 13 bp, Homo sapiens
ctcagtgacccat

SEQ ID NO: 6142701 - DNA, 20 bp, Homo sapiens
ctcagtgaccctggctcctt

SEQ ID NO: 6142702 - DNA, 18 bp, Homo sapiens
ctcagtgagatcagtcag

SEQ ID NO: 6142703 - DNA, 22 bp, Homo sapiens
ctcagtgagatcagtcagctcc

SEQ ID NO: 6142704 - DNA, 18 bp, Homo sapiens
ctcagtgagcctcctgtg

SEQ ID NO: 6142705 - DNA, 16 bp, Homo sapiens
ctcagtgagctggaga

SEQ ID NO: 6142706 - DNA, 15 bp, Homo sapiens
ctcagtgattcgctt

SEQ ID NO: 6142707 - DNA, 18 bp, Homo sapiens
ctcagtgcaaaatgtctt

SEQ ID NO: 6142708 - DNA, 14 bp, Homo sapiens
ctcagtgcagcaat

SEQ ID NO: 6142709 - DNA, 12 bp, Homo sapiens
ctcagtgcagcc

SEQ ID NO: 6142710 - DNA, 21 bp, Homo sapiens
ctcagtgcagggacagcctgc

SEQ ID NO: 6142711 - DNA, 17 bp, Homo sapiens
ctcagtgcatttgtgct

SEQ ID NO: 6142712 - DNA, 13 bp, Homo sapiens
ctcagtgccacct

SEQ ID NO: 6142713 - DNA, 23 bp, Homo sapiens
ctcagtgccacttgacattcctt

SEQ ID NO: 6142714 - DNA, 12 bp, Homo sapiens
ctcagtgcctcc

SEQ ID NO: 6142715 - DNA, 13 bp, Homo sapiens
ctcagtgcctcca

SEQ ID NO: 6142716 - DNA, 13 bp, Homo sapiens
ctcagtgcctcct

SEQ ID NO: 6142717 - DNA, 13 bp, Homo sapiens
ctcagtgccttct

SEQ ID NO: 6142718 - DNA, 14 bp, Homo sapiens
ctcagtgccttctc

SEQ ID NO: 6142719 - DNA, 16 bp, Homo sapiens
ctcagtgccttctctc

SEQ ID NO: 6142720 - DNA, 17 bp, Homo sapiens
ctcagtgccttctctca

SEQ ID NO: 6142721 - DNA, 13 bp, Homo sapiens
ctcagtgcctttt

SEQ ID NO: 6142722 - DNA, 18 bp, Homo sapiens
ctcagtgctcggcagtca

SEQ ID NO: 6142723 - DNA, 13 bp, Homo sapiens
ctcagtgctctcc

SEQ ID NO: 6142724 - DNA, 21 bp, Homo sapiens
ctcagtgctctcctaccccac

SEQ ID NO: 6142725 - DNA, 20 bp, Homo sapiens
ctcagtgcttatgtcatagc

SEQ ID NO: 6142726 - DNA, 19 bp, Homo sapiens
ctcagtgcttgggctccac

SEQ ID NO: 6142727 - DNA, 21 bp, Homo sapiens
ctcagtggacactcagaccag

SEQ ID NO: 6142728 - DNA, 24 bp, Homo sapiens
ctcagtggacagtgctgttgaaga

SEQ ID NO: 6142729 - DNA, 13 bp, Homo sapiens
ctcagtggcagca

SEQ ID NO: 6142730 - DNA, 22 bp, Homo sapiens
ctcagtggcccatggcatttta

SEQ ID NO: 6142731 - DNA, 18 bp, Homo sapiens
ctcagtggcttcatctgt

SEQ ID NO: 6142732 - DNA, 22 bp, Homo sapiens
ctcagtgggctgtttctgctta

SEQ ID NO: 6142733 - DNA, 20 bp, Homo sapiens
ctcagtggggctggcatcaa

SEQ ID NO: 6142734 - DNA, 18 bp, Homo sapiens
ctcagtggtgtgtgaagt

SEQ ID NO: 6142735 - DNA, 12 bp, Homo sapiens
ctcagtgtattt

SEQ ID NO: 6142736 - DNA, 16 bp, Homo sapiens
ctcagtgtcagcactc

SEQ ID NO: 6142737 - DNA, 17 bp, Homo sapiens
ctcagtgtcatttatga

SEQ ID NO: 6142738 - DNA, 22 bp, Homo sapiens
ctcagtgtccagcttccaaagc

SEQ ID NO: 6142739 - DNA, 20 bp, Homo sapiens
ctcagtgtcctcaggggcct

SEQ ID NO: 6142740 - DNA, 19 bp, Homo sapiens
ctcagtgtcctcatctata

SEQ ID NO: 6142741 - DNA, 19 bp, Homo sapiens
ctcagtgtgaagcctgtcg

SEQ ID NO: 6142742 - DNA, 22 bp, Homo sapiens
ctcagtgtgtgtgtgtggtcca

SEQ ID NO: 6142743 - DNA, 22 bp, Homo sapiens
ctcagtgttaatactgagaaaa

SEQ ID NO: 6142744 - DNA, 21 bp, Homo sapiens
ctcagtgttggtatattttat

SEQ ID NO: 6142745 - DNA, 17 bp, Homo sapiens
ctcagtgttttggactc

SEQ ID NO: 6142746 - DNA, 22 bp, Homo sapiens
ctcagttaaatctttgaagaat

SEQ ID NO: 6142747 - DNA, 16 bp, Homo sapiens
ctcagttacacaggaa

SEQ ID NO: 6142748 - DNA, 18 bp, Homo sapiens
ctcagttcaacctggtgg

SEQ ID NO: 6142749 - DNA, 16 bp, Homo sapiens
ctcagttcaatgagca

SEQ ID NO: 6142750 - DNA, 18 bp, Homo sapiens
ctcagttcatccattcta

SEQ ID NO: 6142751 - DNA, 16 bp, Homo sapiens
ctcagttccaggcctg

SEQ ID NO: 6142752 - DNA, 18 bp, Homo sapiens
ctcagttcccagacagct

SEQ ID NO: 6142753 - DNA, 17 bp, Homo sapiens
ctcagttcccagctccc

SEQ ID NO: 6142754 - DNA, 20 bp, Homo sapiens
ctcagttcccagctcccccc

SEQ ID NO: 6142755 - DNA, 15 bp, Homo sapiens
ctcagttcccttggc

SEQ ID NO: 6142756 - DNA, 19 bp, Homo sapiens
ctcagttcccttggcctca

SEQ ID NO: 6142757 - DNA, 20 bp, Homo sapiens
ctcagttcccttggcctcag

SEQ ID NO: 6142758 - DNA, 22 bp, Homo sapiens
ctcagttcccttggcctcagaa

SEQ ID NO: 6142759 - DNA, 20 bp, Homo sapiens
ctcagttccgatttcccagg

SEQ ID NO: 6142760 - DNA, 21 bp, Homo sapiens
ctcagttcctgcagcagagcc

SEQ ID NO: 6142761 - DNA, 13 bp, Homo sapiens
ctcagttccttca

SEQ ID NO: 6142762 - DNA, 19 bp, Homo sapiens
ctcagttctagtctctctg

SEQ ID NO: 6142763 - DNA, 20 bp, Homo sapiens
ctcagttctagtctctctgg

SEQ ID NO: 6142764 - DNA, 12 bp, Homo sapiens
ctcagttctcaa

SEQ ID NO: 6142765 - DNA, 13 bp, Homo sapiens
ctcagttctcaaa

SEQ ID NO: 6142766 - DNA, 16 bp, Homo sapiens
ctcagttctcttcact

SEQ ID NO: 6142767 - DNA, 20 bp, Homo sapiens
ctcagttcttggcctgctag

SEQ ID NO: 6142768 - DNA, 19 bp, Homo sapiens
ctcagttgagaaacagttc

SEQ ID NO: 6142769 - DNA, 16 bp, Homo sapiens
ctcagttgattttctg

SEQ ID NO: 6142770 - DNA, 20 bp, Homo sapiens
ctcagttgattttctggatt

SEQ ID NO: 6142771 - DNA, 14 bp, Homo sapiens
ctcagttggaaata

SEQ ID NO: 6142772 - DNA, 17 bp, Homo sapiens
ctcagttggcctctgcc

SEQ ID NO: 6142773 - DNA, 18 bp, Homo sapiens
ctcagttggcctctgccc

SEQ ID NO: 6142774 - DNA, 19 bp, Homo sapiens
ctcagttggcctctgcccc

SEQ ID NO: 6142775 - DNA, 16 bp, Homo sapiens
ctcagttgtagaatgt

SEQ ID NO: 6142776 - DNA, 14 bp, Homo sapiens
ctcagttgttctga

SEQ ID NO: 6142777 - DNA, 15 bp, Homo sapiens
ctcagttgtttgctt

SEQ ID NO: 6142778 - DNA, 17 bp, Homo sapiens
ctcagttgtttgcttct

SEQ ID NO: 6142779 - DNA, 22 bp, Homo sapiens
ctcagttgtttgcttcttgcca

SEQ ID NO: 6142780 - DNA, 14 bp, Homo sapiens
ctcagtttacatct

SEQ ID NO: 6142781 - DNA, 19 bp, Homo sapiens
ctcagtttcacaagtgagc

SEQ ID NO: 6142782 - DNA, 12 bp, Homo sapiens
ctcagtttcata

SEQ ID NO: 6142783 - DNA, 15 bp, Homo sapiens
ctcagtttcatatat

SEQ ID NO: 6142784 - DNA, 14 bp, Homo sapiens
ctcagtttccccat

SEQ ID NO: 6142785 - DNA, 19 bp, Homo sapiens
ctcagtttctccatcagct

SEQ ID NO: 6142786 - DNA, 14 bp, Homo sapiens
ctcagtttctctgg

SEQ ID NO: 6142787 - DNA, 15 bp, Homo sapiens
ctcagtttctgcctg

SEQ ID NO: 6142788 - DNA, 17 bp, Homo sapiens
ctcagtttctgcctggg

SEQ ID NO: 6142789 - DNA, 15 bp, Homo sapiens
ctcagtttcttgctt

SEQ ID NO: 6142790 - DNA, 15 bp, Homo sapiens
ctcagtttggctgta

SEQ ID NO: 6142791 - DNA, 21 bp, Homo sapiens
ctcagtttggctgtaatttaa

SEQ ID NO: 6142792 - DNA, 22 bp, Homo sapiens
ctcagtttggctgtaatttaat

SEQ ID NO: 6142793 - DNA, 22 bp, Homo sapiens
ctcagtttggtagtgccccacc

SEQ ID NO: 6142794 - DNA, 22 bp, Homo sapiens
ctcagtttgtgtgtcttaatta

SEQ ID NO: 6142795 - DNA, 16 bp, Homo sapiens
ctcagttttccttctg

SEQ ID NO: 6142796 - DNA, 17 bp, Homo sapiens
ctcagtttttaagagta

SEQ ID NO: 6142797 - DNA, 15 bp, Homo sapiens
ctcagtttttgctga

SEQ ID NO: 6142798 - DNA, 14 bp, Homo sapiens
ctcataaaaagcaa

SEQ ID NO: 6142799 - DNA, 16 bp, Homo sapiens
ctcataaaaataaaag

SEQ ID NO: 6142800 - DNA, 22 bp, Homo sapiens
ctcataaaactgtgactaggca

SEQ ID NO: 6142801 - DNA, 14 bp, Homo sapiens
ctcataaacatttg

SEQ ID NO: 6142802 - DNA, 19 bp, Homo sapiens
ctcataaacctgttttgca

SEQ ID NO: 6142803 - DNA, 17 bp, Homo sapiens
ctcataaagatggcttt

SEQ ID NO: 6142804 - DNA, 21 bp, Homo sapiens
ctcataaagatgttaaatgga

SEQ ID NO: 6142805 - DNA, 15 bp, Homo sapiens
ctgatgacactgaga

SEQ ID NO: 6142806 - DNA, 16 bp, Homo sapiens
ctgatgacgcctgtct

SEQ ID NO: 6142807 - DNA, 18 bp, Homo sapiens
ctgatgacgcctgtctgt

SEQ ID NO: 6142808 - DNA, 17 bp, Homo sapiens
ctgatgagaacaagcta

SEQ ID NO: 6142809 - DNA, 16 bp, Homo sapiens
ctgatgagaatttata

SEQ ID NO: 6142810 - DNA, 18 bp, Homo sapiens
ctgatgagactccactca

SEQ ID NO: 6142811 - DNA, 19 bp, Homo sapiens
ctgatgagagaatgtggaa

SEQ ID NO: 6142812 - DNA, 21 bp, Homo sapiens
ctgatgagagaatgtggaaat

SEQ ID NO: 6142813 - DNA, 14 bp, Homo sapiens
ctgatgagatacat

SEQ ID NO: 6142814 - DNA, 22 bp, Homo sapiens
ctgatgagcaagaattataaca

SEQ ID NO: 6142815 - DNA, 23 bp, Homo sapiens
ctgatgagcacatctctctgccc

SEQ ID NO: 6142816 - DNA, 17 bp, Homo sapiens
ctgatgaggatcagagc

SEQ ID NO: 6142817 - DNA, 17 bp, Homo sapiens
ctgatgagggcacctct

SEQ ID NO: 6142818 - DNA, 20 bp, Homo sapiens
ctgatgagtaaactgaggcc

SEQ ID NO: 6142819 - DNA, 23 bp, Homo sapiens
ctgatgagtgattgacacacagc

SEQ ID NO: 6142820 - DNA, 19 bp, Homo sapiens
ctgatgagtttcactgtac

SEQ ID NO: 6142821 - DNA, 20 bp, Homo sapiens
ctgatgagtttcactgtact

SEQ ID NO: 6142822 - DNA, 23 bp, Homo sapiens
ctgatgatcaaaacctgtgccag

SEQ ID NO: 6142823 - DNA, 12 bp, Homo sapiens
ctgatgatgctg

SEQ ID NO: 6142824 - DNA, 15 bp, Homo sapiens
ctgatgatggaaggg

SEQ ID NO: 6142825 - DNA, 12 bp, Homo sapiens
ctgatgatgtcg

SEQ ID NO: 6142826 - DNA, 22 bp, Homo sapiens
ctgatgatgtctcttgtagaag

SEQ ID NO: 6142827 - DNA, 21 bp, Homo sapiens
ctgatgatgttctgaaatgga

SEQ ID NO: 6142828 - DNA, 20 bp, Homo sapiens
ctgatgatttgtttttgtat

SEQ ID NO: 6142829 - DNA, 15 bp, Homo sapiens
ctgatgattttcctt

SEQ ID NO: 6142830 - DNA, 17 bp, Homo sapiens
ctgatgattttcctttt

SEQ ID NO: 6142831 - DNA, 21 bp, Homo sapiens
ctgatgcaaggattacagaaa

SEQ ID NO: 6142832 - DNA, 21 bp, Homo sapiens
ctgatgcaatgtatggctttt

SEQ ID NO: 6142833 - DNA, 18 bp, Homo sapiens
ctgatgcagaactttctc

SEQ ID NO: 6142834 - DNA, 14 bp, Homo sapiens
ctgatgcagacaca

SEQ ID NO: 6142835 - DNA, 15 bp, Homo sapiens
ctgatgcagacacag

SEQ ID NO: 6142836 - DNA, 15 bp, Homo sapiens
ctgatgcagcctgtg

SEQ ID NO: 6142837 - DNA, 13 bp, Homo sapiens
ctgatgcaggtca

SEQ ID NO: 6142838 - DNA, 21 bp, Homo sapiens
ctgatgcaggtcagcccatgg

SEQ ID NO: 6142839 - DNA, 17 bp, Homo sapiens
ctgatgcagtgccctag

SEQ ID NO: 6142840 - DNA, 14 bp, Homo sapiens
ctgatgcatcagaa

SEQ ID NO: 6142841 - DNA, 16 bp, Homo sapiens
ctgatgcattcccggt

SEQ ID NO: 6142842 - DNA, 14 bp, Homo sapiens
ctgatgccaaagct

SEQ ID NO: 6142843 - DNA, 15 bp, Homo sapiens
ctgatgccaaagctg

SEQ ID NO: 6142844 - DNA, 17 bp, Homo sapiens
ctgatgccaaagctgct

SEQ ID NO: 6142845 - DNA, 18 bp, Homo sapiens
ctgatgccaatactagtc

SEQ ID NO: 6142846 - DNA, 14 bp, Homo sapiens
ctgatgccatgttt

SEQ ID NO: 6142847 - DNA, 20 bp, Homo sapiens
ctgatgcccaccgaggagcc

SEQ ID NO: 6142848 - DNA, 14 bp, Homo sapiens
ctgatgccccttcc

SEQ ID NO: 6142849 - DNA, 15 bp, Homo sapiens
ctgatgccccttccc

SEQ ID NO: 6142850 - DNA, 19 bp, Homo sapiens
ctgatgccccttccccaag

SEQ ID NO: 6142851 - DNA, 18 bp, Homo sapiens
ctgatgccctcttctcct

SEQ ID NO: 6142852 - DNA, 20 bp, Homo sapiens
ctgatgccgtgatcctgagc

SEQ ID NO: 6142853 - DNA, 18 bp, Homo sapiens
ctgatgcctgaatgtatc

SEQ ID NO: 6142854 - DNA, 21 bp, Homo sapiens
ctgatgcgaaaacttgaatct

SEQ ID NO: 6142855 - DNA, 16 bp, Homo sapiens
ctgatgcgctgggatc

SEQ ID NO: 6142856 - DNA, 12 bp, Homo sapiens
ctgatgctccct

SEQ ID NO: 6142857 - DNA, 18 bp, Homo sapiens
ctgatgctccctcccctg

SEQ ID NO: 6142858 - DNA, 21 bp, Homo sapiens
ctgatgctccctcccctgccc

SEQ ID NO: 6142859 - DNA, 22 bp, Homo sapiens
ctgatgctccctcccctgccct

SEQ ID NO: 6142860 - DNA, 24 bp, Homo sapiens
ctgatgctccctcccctgccctgg

SEQ ID NO: 6142861 - DNA, 13 bp, Homo sapiens
ctgatgctcctga

SEQ ID NO: 6142862 - DNA, 14 bp, Homo sapiens
ctgatgctgaaata

SEQ ID NO: 6142863 - DNA, 16 bp, Homo sapiens
ctgatgctgagattct

SEQ ID NO: 6142864 - DNA, 18 bp, Homo sapiens
ctgatgctgaggatgatt

SEQ ID NO: 6142865 - DNA, 12 bp, Homo sapiens
ctgatgctgccc

SEQ ID NO: 6142866 - DNA, 14 bp, Homo sapiens
ctgatgctgccccg

SEQ ID NO: 6142867 - DNA, 19 bp, Homo sapiens
ctgatgctgccccgttccc

SEQ ID NO: 6142868 - DNA, 15 bp, Homo sapiens
ctgatgctgggctgg

SEQ ID NO: 6142869 - DNA, 16 bp, Homo sapiens
ctgatgctgggctggg

SEQ ID NO: 6142870 - DNA, 17 bp, Homo sapiens
ctgatgctgggctgggt

SEQ ID NO: 6142871 - DNA, 19 bp, Homo sapiens
ctgatgctgggctgggtgc

SEQ ID NO: 6142872 - DNA, 22 bp, Homo sapiens
ctgatgctggggacacagcatc

SEQ ID NO: 6142873 - DNA, 16 bp, Homo sapiens
ctgatgctgttctctt

SEQ ID NO: 6142874 - DNA, 20 bp, Homo sapiens
ctgatgcttaataaacgcag

SEQ ID NO: 6142875 - DNA, 19 bp, Homo sapiens
ctgatgcttacatctggaa

SEQ ID NO: 6142876 - DNA, 18 bp, Homo sapiens
ctgatgcttcttcagaga

SEQ ID NO: 6142877 - DNA, 22 bp, Homo sapiens
ctgatgctttgcttcaaatcca

SEQ ID NO: 6142878 - DNA, 18 bp, Homo sapiens
ctgatggaaacaaagtgg

SEQ ID NO: 6142879 - DNA, 13 bp, Homo sapiens
ctgatggaagcac

SEQ ID NO: 6142880 - DNA, 16 bp, Homo sapiens
ctgatggaatgtgcca

SEQ ID NO: 6142881 - DNA, 18 bp, Homo sapiens
ctgatggaatgtgccacc

SEQ ID NO: 6142882 - DNA, 13 bp, Homo sapiens
ctgatggaccctc

SEQ ID NO: 6142883 - DNA, 22 bp, Homo sapiens
ctgatggaccgggtgggcctgg

SEQ ID NO: 6142884 - DNA, 15 bp, Homo sapiens
ctgatggagaggaga

SEQ ID NO: 6142885 - DNA, 15 bp, Homo sapiens
ctgatggagagtgag

SEQ ID NO: 6142886 - DNA, 16 bp, Homo sapiens
ctgatggagtgtgcag

SEQ ID NO: 6142887 - DNA, 22 bp, Homo sapiens
ctgatggatcccgaagaatgga

SEQ ID NO: 6142888 - DNA, 21 bp, Homo sapiens
ctgatggattccaaaccagga

SEQ ID NO: 6142889 - DNA, 15 bp, Homo sapiens
ctgatggccaagggg

SEQ ID NO: 6142890 - DNA, 12 bp, Homo sapiens
ctgatggccagg

SEQ ID NO: 6142891 - DNA, 19 bp, Homo sapiens
ctgatggcccctccagcac

SEQ ID NO: 6142892 - DNA, 20 bp, Homo sapiens
ctgatggcccctccagcaca

SEQ ID NO: 6142893 - DNA, 12 bp, Homo sapiens
ctgatggccctc

SEQ ID NO: 6142894 - DNA, 20 bp, Homo sapiens
ctgatggccttaatttcctt

SEQ ID NO: 6142895 - DNA, 21 bp, Homo sapiens
ctgatggcctttggacccagg

SEQ ID NO: 6142896 - DNA, 23 bp, Homo sapiens
ctgatggcctttggacccagggc

SEQ ID NO: 6142897 - DNA, 13 bp, Homo sapiens
ctgatggctcaag

SEQ ID NO: 6142898 - DNA, 12 bp, Homo sapiens
ctgatggctgcc

SEQ ID NO: 6142899 - DNA, 14 bp, Homo sapiens
ctgatggcttgaca

SEQ ID NO: 6142900 - DNA, 17 bp, Homo sapiens
ctgatggcttgacatgt

SEQ ID NO: 6142901 - DNA, 19 bp, Homo sapiens
ctgatggcttgacatgtgc

SEQ ID NO: 6142902 - DNA, 13 bp, Homo sapiens
ctgatgggaagga

SEQ ID NO: 6142903 - DNA, 21 bp, Homo sapiens
ctgatgggaaggaggggagcc

SEQ ID NO: 6142904 - DNA, 20 bp, Homo sapiens
ctgatgggaataaaagtatt

SEQ ID NO: 6142905 - DNA, 22 bp, Homo sapiens
ctgatgggaataaaagtattaa

SEQ ID NO: 6142906 - DNA, 24 bp, Homo sapiens
ctgatgggcaacccccagcctgct

SEQ ID NO: 6142907 - DNA, 15 bp, Homo sapiens
ctgatgggctggggc

SEQ ID NO: 6142908 - DNA, 17 bp, Homo sapiens
ctgatgggctggggcag

SEQ ID NO: 6142909 - DNA, 19 bp, Homo sapiens
ctgatgggctggggcaggg

SEQ ID NO: 6142910 - DNA, 17 bp, Homo sapiens
ctgatgggtcctgctgc

SEQ ID NO: 6142911 - DNA, 18 bp, Homo sapiens
ctgatgggtcctgctgct

SEQ ID NO: 6142912 - DNA, 20 bp, Homo sapiens
ctgatgggtgccctttcctg

SEQ ID NO: 6142913 - DNA, 16 bp, Homo sapiens
ctgatggtcagctccc

SEQ ID NO: 6142914 - DNA, 18 bp, Homo sapiens
ctgatggtcttaaatgct

SEQ ID NO: 6142915 - DNA, 23 bp, Homo sapiens
ctgatggtcttaaatgctcattt

SEQ ID NO: 6142916 - DNA, 17 bp, Homo sapiens
ctgatggtgaaaccaaa

SEQ ID NO: 6142917 - DNA, 17 bp, Homo sapiens
ctgatggtgagctggga

SEQ ID NO: 6142918 - DNA, 19 bp, Homo sapiens
ctgatggtgcaatgacctt

SEQ ID NO: 6142919 - DNA, 16 bp, Homo sapiens
ctgatggtgctcacga

SEQ ID NO: 6142920 - DNA, 19 bp, Homo sapiens
ctgatggtgctgctcaggc

SEQ ID NO: 6142921 - DNA, 13 bp, Homo sapiens
ctgatggtggggc

SEQ ID NO: 6142922 - DNA, 15 bp, Homo sapiens
ctgatggttaaataa

SEQ ID NO: 6142923 - DNA, 16 bp, Homo sapiens
ctgatggttgctttga

SEQ ID NO: 6142924 - DNA, 22 bp, Homo sapiens
ctgatggttgctttgagcccac

SEQ ID NO: 6142925 - DNA, 24 bp, Homo sapiens
ctgatggttgctttgagcccacag

SEQ ID NO: 6142926 - DNA, 17 bp, Homo sapiens
ctgatggtttggaaaat

SEQ ID NO: 6142927 - DNA, 17 bp, Homo sapiens
ctgatgtaaatgaagta

SEQ ID NO: 6142928 - DNA, 20 bp, Homo sapiens
ctgatgtactgaattccata

SEQ ID NO: 6142929 - DNA, 16 bp, Homo sapiens
ctgatgtataatgtaa

SEQ ID NO: 6142930 - DNA, 15 bp, Homo sapiens
ctgatgtatagcttt

SEQ ID NO: 6142931 - DNA, 18 bp, Homo sapiens
ctgatgtatagctttaac

SEQ ID NO: 6142932 - DNA, 17 bp, Homo sapiens
ctgatgtcatcttgagc

SEQ ID NO: 6142933 - DNA, 20 bp, Homo sapiens
ctgatgtccatttgtcccaa

SEQ ID NO: 6142934 - DNA, 15 bp, Homo sapiens
ctgatgtcctcacca

SEQ ID NO: 6142935 - DNA, 21 bp, Homo sapiens
ctgatgtctcctaagcacctg

SEQ ID NO: 6142936 - DNA, 12 bp, Homo sapiens
ctgatgtctcta

SEQ ID NO: 6142937 - DNA, 22 bp, Homo sapiens
ctgatgtcttaacgaataaagg

SEQ ID NO: 6142938 - DNA, 15 bp, Homo sapiens
ctgatgtcttagtga

SEQ ID NO: 6142939 - DNA, 23 bp, Homo sapiens
ctgatgtcttcttgggggcagac

SEQ ID NO: 6142940 - DNA, 13 bp, Homo sapiens
ctgatgtgaaact

SEQ ID NO: 6142941 - DNA, 16 bp, Homo sapiens
ctgatgtgatattctg

SEQ ID NO: 6142942 - DNA, 17 bp, Homo sapiens
ctgatgtggactgtctt

SEQ ID NO: 6142943 - DNA, 15 bp, Homo sapiens
ctgatgtgtgaagtg

SEQ ID NO: 6142944 - DNA, 18 bp, Homo sapiens
ctgatgtgtgttgtcagc

SEQ ID NO: 6142945 - DNA, 16 bp, Homo sapiens
ctgatgtgttgccact

SEQ ID NO: 6142946 - DNA, 16 bp, Homo sapiens
ctgatgttactagcct

SEQ ID NO: 6142947 - DNA, 17 bp, Homo sapiens
ctgatgttaggctgggc

SEQ ID NO: 6142948 - DNA, 22 bp, Homo sapiens
ctgatgttcacctttatatatg

SEQ ID NO: 6142949 - DNA, 14 bp, Homo sapiens
ctgatgttcagtgt

SEQ ID NO: 6142950 - DNA, 19 bp, Homo sapiens
ctgatgttcagtgtaattt

SEQ ID NO: 6142951 - DNA, 16 bp, Homo sapiens
ctgatgttccctccgg

SEQ ID NO: 6142952 - DNA, 13 bp, Homo sapiens
ctgatgttcctag

SEQ ID NO: 6142953 - DNA, 20 bp, Homo sapiens
ctgatgttcctagtgaaaga

SEQ ID NO: 6142954 - DNA, 21 bp, Homo sapiens
ctgatgttcctagtgaaagag

SEQ ID NO: 6142955 - DNA, 15 bp, Homo sapiens
ctgatgttgagctga

SEQ ID NO: 6142956 - DNA, 17 bp, Homo sapiens
ctgatgtttctgtgaaa

SEQ ID NO: 6142957 - DNA, 15 bp, Homo sapiens
ctgatgtttgaagag

SEQ ID NO: 6142958 - DNA, 16 bp, Homo sapiens
ctgatgtttgaagagt

SEQ ID NO: 6142959 - DNA, 13 bp, Homo sapiens
ctgatgttttgat

SEQ ID NO: 6142960 - DNA, 18 bp, Homo sapiens
ctgatgtttttctgtgtt

SEQ ID NO: 6142961 - DNA, 20 bp, Homo sapiens
ctgattaaaaataccttcta

SEQ ID NO: 6142962 - DNA, 17 bp, Homo sapiens
ctgattaaatatttgaa

SEQ ID NO: 6142963 - DNA, 15 bp, Homo sapiens
ctgattaaatgacac

SEQ ID NO: 6142964 - DNA, 17 bp, Homo sapiens
ctgattaaatttaatat

SEQ ID NO: 6142965 - DNA, 18 bp, Homo sapiens
ctgattaacaaataaatt

SEQ ID NO: 6142966 - DNA, 14 bp, Homo sapiens
ctgattacaccagc

SEQ ID NO: 6142967 - DNA, 11 bp, Homo sapiens
ctgattagaaa

SEQ ID NO: 6142968 - DNA, 13 bp, Homo sapiens
ctgattagaaatg

SEQ ID NO: 6142969 - DNA, 22 bp, Homo sapiens
ctgattagaagtataaggtgct

SEQ ID NO: 6142970 - DNA, 14 bp, Homo sapiens
ctgattagataatc

SEQ ID NO: 6142971 - DNA, 17 bp, Homo sapiens
ctgattagctttgtgtt

SEQ ID NO: 6142972 - DNA, 20 bp, Homo sapiens
ctgattagttgacagtatta

SEQ ID NO: 6142973 - DNA, 19 bp, Homo sapiens
ctgattataccatgtgtgc

SEQ ID NO: 6142974 - DNA, 23 bp, Homo sapiens
ctgattattacaacaagcaaact

SEQ ID NO: 6142975 - DNA, 15 bp, Homo sapiens
ctgattattgaatgt

SEQ ID NO: 6142976 - DNA, 19 bp, Homo sapiens
ctgattatttgcagctgcg

SEQ ID NO: 6142977 - DNA, 20 bp, Homo sapiens
ctgattatttgcagctgcga

SEQ ID NO: 6142978 - DNA, 13 bp, Homo sapiens
ctgattattttag

SEQ ID NO: 6142979 - DNA, 15 bp, Homo sapiens
ctgattattttagct

SEQ ID NO: 6142980 - DNA, 20 bp, Homo sapiens
ctgattattttcagaagctg

SEQ ID NO: 6142981 - DNA, 17 bp, Homo sapiens
ctgattattttcttcat

SEQ ID NO: 6142982 - DNA, 17 bp, Homo sapiens
ctgattcaaaagtgaac

SEQ ID NO: 6142983 - DNA, 23 bp, Homo sapiens
ctgattcaaaccaaagctgcctg

SEQ ID NO: 6142984 - DNA, 23 bp, Homo sapiens
ctcataaagatgttaaatggaat

SEQ ID NO: 6142985 - DNA, 15 bp, Homo sapiens
ctcataaaggacact

SEQ ID NO: 6142986 - DNA, 18 bp, Homo sapiens
ctcataaattaatgattc

SEQ ID NO: 6142987 - DNA, 13 bp, Homo sapiens
ctcataacatctt

SEQ ID NO: 6142988 - DNA, 17 bp, Homo sapiens
ctcataacggatcagaa

SEQ ID NO: 6142989 - DNA, 19 bp, Homo sapiens
ctcataacggatcagaaat

SEQ ID NO: 6142990 - DNA, 20 bp, Homo sapiens
ctcataactagagtatgtgt

SEQ ID NO: 6142991 - DNA, 22 bp, Homo sapiens
ctcataactagagtatgtgtat

SEQ ID NO: 6142992 - DNA, 13 bp, Homo sapiens
ctcataagagttt

SEQ ID NO: 6142993 - DNA, 17 bp, Homo sapiens
ctcataaggcatataca

SEQ ID NO: 6142994 - DNA, 17 bp, Homo sapiens
ctcataagtaaatgtct

SEQ ID NO: 6142995 - DNA, 15 bp, Homo sapiens
ctcataatgctttgt

SEQ ID NO: 6142996 - DNA, 16 bp, Homo sapiens
ctcataatgtgaaata

SEQ ID NO: 6142997 - DNA, 21 bp, Homo sapiens
ctcataattcctacagcacta

SEQ ID NO: 6142998 - DNA, 14 bp, Homo sapiens
ctcataattggaat

SEQ ID NO: 6142999 - DNA, 16 bp, Homo sapiens
ctcataattttgcaaa

SEQ ID NO: 6143000 - DNA, 21 bp, Homo sapiens
ctcatacagaaagtgacaagg

SEQ ID NO: 6143001 - DNA, 18 bp, Homo sapiens
ctcataccacatggcttt

SEQ ID NO: 6143002 - DNA, 15 bp, Homo sapiens
ctcataccatctgct

SEQ ID NO: 6143003 - DNA, 22 bp, Homo sapiens
ctcataccatctgctgccccgc

SEQ ID NO: 6143004 - DNA, 18 bp, Homo sapiens
ctcatacccacccccacc

SEQ ID NO: 6143005 - DNA, 15 bp, Homo sapiens
ctcatacccatgcac

SEQ ID NO: 6143006 - DNA, 18 bp, Homo sapiens
ctcatacgtttaaaataa

SEQ ID NO: 6143007 - DNA, 16 bp, Homo sapiens
ctcatactcctgggct

SEQ ID NO: 6143008 - DNA, 14 bp, Homo sapiens
ctcatactgtctgg

SEQ ID NO: 6143009 - DNA, 18 bp, Homo sapiens
ctcatagacactgatctg

SEQ ID NO: 6143010 - DNA, 14 bp, Homo sapiens
ctcatagaggaaat

SEQ ID NO: 6143011 - DNA, 12 bp, Homo sapiens
ctcatagaggtg

SEQ ID NO: 6143012 - DNA, 19 bp, Homo sapiens
ctcatagaggtgagaaaac

SEQ ID NO: 6143013 - DNA, 13 bp, Homo sapiens
ctcatagatgacc

SEQ ID NO: 6143014 - DNA, 19 bp, Homo sapiens
ctcatagcaatacttggag

SEQ ID NO: 6143015 - DNA, 15 bp, Homo sapiens
ctcatagcacatgtt

SEQ ID NO: 6143016 - DNA, 19 bp, Homo sapiens
ctcatagcaggaaatgtag

SEQ ID NO: 6143017 - DNA, 17 bp, Homo sapiens
ctcatagccctcaccct

SEQ ID NO: 6143018 - DNA, 23 bp, Homo sapiens
ctcataggaaaagtacatttaat

SEQ ID NO: 6143019 - DNA, 17 bp, Homo sapiens
ctcatagggatgctgtg

SEQ ID NO: 6143020 - DNA, 22 bp, Homo sapiens
ctcataggttaaaaaaaaaagt

SEQ ID NO: 6143021 - DNA, 21 bp, Homo sapiens
ctcatagtgaacacagcagac

SEQ ID NO: 6143022 - DNA, 17 bp, Homo sapiens
ctcatataattatatgt

SEQ ID NO: 6143023 - DNA, 20 bp, Homo sapiens
ctcatataattatatgttgt

SEQ ID NO: 6143024 - DNA, 23 bp, Homo sapiens
ctcatatatattttaaaaacact

SEQ ID NO: 6143025 - DNA, 10 bp, Homo sapiens
ctcatatatt

SEQ ID NO: 6143026 - DNA, 20 bp, Homo sapiens
ctcatatccataaaattgga

SEQ ID NO: 6143027 - DNA, 20 bp, Homo sapiens
ctcatatcccctatttaaca

SEQ ID NO: 6143028 - DNA, 16 bp, Homo sapiens
ctcatatcttcctcat

SEQ ID NO: 6143029 - DNA, 18 bp, Homo sapiens
ctcatatggcccagtgtc

SEQ ID NO: 6143030 - DNA, 20 bp, Homo sapiens
ctcatatggtctaccagttt

SEQ ID NO: 6143031 - DNA, 15 bp, Homo sapiens
ctcatattcctgcag

SEQ ID NO: 6143032 - DNA, 20 bp, Homo sapiens
ctcatattcctgcagcctgg

SEQ ID NO: 6143033 - DNA, 24 bp, Homo sapiens
ctcatattcctgcagcctggaggc

SEQ ID NO: 6143034 - DNA, 13 bp, Homo sapiens
ctcatattgtgat

SEQ ID NO: 6143035 - DNA, 12 bp, Homo sapiens
ctcatattttgt

SEQ ID NO: 6143036 - DNA, 13 bp, Homo sapiens
ctcatattttgta

SEQ ID NO: 6143037 - DNA, 14 bp, Homo sapiens
ctcatcaacaaaga

SEQ ID NO: 6143038 - DNA, 14 bp, Homo sapiens
ctcatcaactgaat

SEQ ID NO: 6143039 - DNA, 16 bp, Homo sapiens
ctcatcaactgaatga

SEQ ID NO: 6143040 - DNA, 18 bp, Homo sapiens
ctcatcaatggggccagt

SEQ ID NO: 6143041 - DNA, 14 bp, Homo sapiens
ctcatcacacacat

SEQ ID NO: 6143042 - DNA, 13 bp, Homo sapiens
ctcatcacataaa

SEQ ID NO: 6143043 - DNA, 21 bp, Homo sapiens
ctcatcaccaacgtctgtgcc

SEQ ID NO: 6143044 - DNA, 14 bp, Homo sapiens
ctcatcaccatcgt

SEQ ID NO: 6143045 - DNA, 14 bp, Homo sapiens
ctcatcacccagtc

SEQ ID NO: 6143046 - DNA, 15 bp, Homo sapiens
ctcatcacccagtcc

SEQ ID NO: 6143047 - DNA, 20 bp, Homo sapiens
ctcatcacccagtcctggcc

SEQ ID NO: 6143048 - DNA, 16 bp, Homo sapiens
ctcatcaccccagagg

SEQ ID NO: 6143049 - DNA, 16 bp, Homo sapiens
ctcatcacccttccga

SEQ ID NO: 6143050 - DNA, 14 bp, Homo sapiens
ctcatcactcccct

SEQ ID NO: 6143051 - DNA, 16 bp, Homo sapiens
ctcatcactcccctcc

SEQ ID NO: 6143052 - DNA, 20 bp, Homo sapiens
ctcatcactggactgcatgg

SEQ ID NO: 6143053 - DNA, 15 bp, Homo sapiens
ctcatcagaactgaa

SEQ ID NO: 6143054 - DNA, 17 bp, Homo sapiens
ctcatcagccttttcag

SEQ ID NO: 6143055 - DNA, 20 bp, Homo sapiens
ctcatcaggagttccagtgc

SEQ ID NO: 6143056 - DNA, 19 bp, Homo sapiens
ctcatcagtgtcattttct

SEQ ID NO: 6143057 - DNA, 21 bp, Homo sapiens
ctcatcagtgtcattttctgt

SEQ ID NO: 6143058 - DNA, 12 bp, Homo sapiens
ctcatcataaaa

SEQ ID NO: 6143059 - DNA, 14 bp, Homo sapiens
ctcatcataaaata

SEQ ID NO: 6143060 - DNA, 14 bp, Homo sapiens
ctcatcatattcca

SEQ ID NO: 6143061 - DNA, 19 bp, Homo sapiens
ctcatcatattccaaccca

SEQ ID NO: 6143062 - DNA, 23 bp, Homo sapiens
ctcatcatattccaacccagcca

SEQ ID NO: 6143063 - DNA, 14 bp, Homo sapiens
ctcatcatattgta

SEQ ID NO: 6143064 - DNA, 14 bp, Homo sapiens
ctcatcatccaccc

SEQ ID NO: 6143065 - DNA, 17 bp, Homo sapiens
ctcatcatgtctattgt

SEQ ID NO: 6143066 - DNA, 13 bp, Homo sapiens
ctcatcattaata

SEQ ID NO: 6143067 - DNA, 17 bp, Homo sapiens
ctcatcattctctgtct

SEQ ID NO: 6143068 - DNA, 18 bp, Homo sapiens
ctcatcattctctgtctc

SEQ ID NO: 6143069 - DNA, 19 bp, Homo sapiens
ctcatcattctctgtctca

SEQ ID NO: 6143070 - DNA, 15 bp, Homo sapiens
ctcatcatttgcatt

SEQ ID NO: 6143071 - DNA, 14 bp, Homo sapiens
ctcatcatttgtgg

SEQ ID NO: 6143072 - DNA, 15 bp, Homo sapiens
ctcatcatttttata

SEQ ID NO: 6143073 - DNA, 18 bp, Homo sapiens
ctcatccacagaggccag

SEQ ID NO: 6143074 - DNA, 20 bp, Homo sapiens
ctcatccacataccctgacc

SEQ ID NO: 6143075 - DNA, 13 bp, Homo sapiens
ctcatccacccca

SEQ ID NO: 6143076 - DNA, 15 bp, Homo sapiens
ctcatccaccccatc

SEQ ID NO: 6143077 - DNA, 19 bp, Homo sapiens
ctcatccaccccatccctc

SEQ ID NO: 6143078 - DNA, 22 bp, Homo sapiens
ctcatccagggtgttacaaggc

SEQ ID NO: 6143079 - DNA, 18 bp, Homo sapiens
ctcatccaggtcctttcc

SEQ ID NO: 6143080 - DNA, 19 bp, Homo sapiens
ctcatccaggtcctttcct

SEQ ID NO: 6143081 - DNA, 17 bp, Homo sapiens
ctcatccatgcacttta

SEQ ID NO: 6143082 - DNA, 23 bp, Homo sapiens
ctcatccattaatgtagataaag

SEQ ID NO: 6143083 - DNA, 18 bp, Homo sapiens
ctcatccatttcttttat

SEQ ID NO: 6143084 - DNA, 19 bp, Homo sapiens
ctcatccatttcttttata

SEQ ID NO: 6143085 - DNA, 15 bp, Homo sapiens
ctcatcccaaaagct

SEQ ID NO: 6143086 - DNA, 22 bp, Homo sapiens
ctcatcccaacctctttttcct

SEQ ID NO: 6143087 - DNA, 14 bp, Homo sapiens
ctcatcccacgcac

SEQ ID NO: 6143088 - DNA, 16 bp, Homo sapiens
ctcatcccacttcctt

SEQ ID NO: 6143089 - DNA, 21 bp, Homo sapiens
ctcatcccagtcctgatggcc

SEQ ID NO: 6143090 - DNA, 20 bp, Homo sapiens
ctcatcccagtctgatattc

SEQ ID NO: 6143091 - DNA, 21 bp, Homo sapiens
ctcatccccaaactgtagtaa

SEQ ID NO: 6143092 - DNA, 13 bp, Homo sapiens
ctcatccccaggg

SEQ ID NO: 6143093 - DNA, 13 bp, Homo sapiens
ctcatcccccatc

SEQ ID NO: 6143094 - DNA, 15 bp, Homo sapiens
ctcatcccccctgct

SEQ ID NO: 6143095 - DNA, 18 bp, Homo sapiens
ctcatcccccctgctgcc

SEQ ID NO: 6143096 - DNA, 19 bp, Homo sapiens
ctcatcccccctgctgccc

SEQ ID NO: 6143097 - DNA, 19 bp, Homo sapiens
ctcatcccgtgttctcctt

SEQ ID NO: 6143098 - DNA, 14 bp, Homo sapiens
ctcatccctcaact

SEQ ID NO: 6143099 - DNA, 15 bp, Homo sapiens
ctcatccctcaactg

SEQ ID NO: 6143100 - DNA, 16 bp, Homo sapiens
ctcatccctcaactga

SEQ ID NO: 6143101 - DNA, 17 bp, Homo sapiens
ctcatccctcggaagcc

SEQ ID NO: 6143102 - DNA, 19 bp, Homo sapiens
ctcatccctctcacccaga

SEQ ID NO: 6143103 - DNA, 14 bp, Homo sapiens
ctcatccctggact

SEQ ID NO: 6143104 - DNA, 20 bp, Homo sapiens
ctcatccctggtcgtctatc

SEQ ID NO: 6143105 - DNA, 14 bp, Homo sapiens
ctcatcccttgttt

SEQ ID NO: 6143106 - DNA, 22 bp, Homo sapiens
ctcatccgaagatggtggccac

SEQ ID NO: 6143107 - DNA, 14 bp, Homo sapiens
ctcatccgaggcag

SEQ ID NO: 6143108 - DNA, 15 bp, Homo sapiens
ctcatccgaggcagg

SEQ ID NO: 6143109 - DNA, 17 bp, Homo sapiens
ctcatccgaggcagggt

SEQ ID NO: 6143110 - DNA, 12 bp, Homo sapiens
ctcatccgcctg

SEQ ID NO: 6143111 - DNA, 22 bp, Homo sapiens
ctcatcctattacttttcatct

SEQ ID NO: 6143112 - DNA, 16 bp, Homo sapiens
ctcatcctcagatgct

SEQ ID NO: 6143113 - DNA, 13 bp, Homo sapiens
ctcatcctcccaa

SEQ ID NO: 6143114 - DNA, 22 bp, Homo sapiens
ctcatcctcccattgcccagtg

SEQ ID NO: 6143115 - DNA, 14 bp, Homo sapiens
ctcatcctcctcct

SEQ ID NO: 6143116 - DNA, 17 bp, Homo sapiens
ctcatcctcctcctcat

SEQ ID NO: 6143117 - DNA, 13 bp, Homo sapiens
ctcatcctcctgg

SEQ ID NO: 6143118 - DNA, 12 bp, Homo sapiens
ctcatcctcctt

SEQ ID NO: 6143119 - DNA, 14 bp, Homo sapiens
ctcatcctccttct

SEQ ID NO: 6143120 - DNA, 16 bp, Homo sapiens
ctcatcctccttcttc

SEQ ID NO: 6143121 - DNA, 14 bp, Homo sapiens
ctcatcctgaacag

SEQ ID NO: 6143122 - DNA, 14 bp, Homo sapiens
ctcatcctgcaggc

SEQ ID NO: 6143123 - DNA, 14 bp, Homo sapiens
ctcatcctgctctt

SEQ ID NO: 6143124 - DNA, 15 bp, Homo sapiens
ctcatcctgctcttt

SEQ ID NO: 6143125 - DNA, 13 bp, Homo sapiens
ctcatcctgtgtg

SEQ ID NO: 6143126 - DNA, 19 bp, Homo sapiens
ctcatcctgtgtggggagg

SEQ ID NO: 6143127 - DNA, 12 bp, Homo sapiens
ctcatccttaat

SEQ ID NO: 6143128 - DNA, 13 bp, Homo sapiens
ctcatccttgccc

SEQ ID NO: 6143129 - DNA, 19 bp, Homo sapiens
ctcatccttgcccaggtga

SEQ ID NO: 6143130 - DNA, 14 bp, Homo sapiens
ctcatcctttcctc

SEQ ID NO: 6143131 - DNA, 16 bp, Homo sapiens
ctcatcctttcctcta

SEQ ID NO: 6143132 - DNA, 17 bp, Homo sapiens
ctcatccttttctccta

SEQ ID NO: 6143133 - DNA, 24 bp, Homo sapiens
ctcatcctttttaaatgagacttg

SEQ ID NO: 6143134 - DNA, 17 bp, Homo sapiens
ctcatcgccagacaact

SEQ ID NO: 6143135 - DNA, 16 bp, Homo sapiens
ctcatcggaggcccat

SEQ ID NO: 6143136 - DNA, 14 bp, Homo sapiens
ctcatcgggcccag

SEQ ID NO: 6143137 - DNA, 15 bp, Homo sapiens
ctcatcgtcttttag

SEQ ID NO: 6143138 - DNA, 18 bp, Homo sapiens
ctcatctaaaatttttct

SEQ ID NO: 6143139 - DNA, 19 bp, Homo sapiens
ctcatctatgaggaaaggt

SEQ ID NO: 6143140 - DNA, 15 bp, Homo sapiens
ctcatctatgtcata

SEQ ID NO: 6143141 - DNA, 18 bp, Homo sapiens
ctcatctcactgcccagt

SEQ ID NO: 6143142 - DNA, 12 bp, Homo sapiens
ctcatctcagac

SEQ ID NO: 6143143 - DNA, 21 bp, Homo sapiens
ctcatctccaaggatcctctc

SEQ ID NO: 6143144 - DNA, 17 bp, Homo sapiens
ctcatctcccatgtgtg

SEQ ID NO: 6143145 - DNA, 12 bp, Homo sapiens
ctcatctcctga

SEQ ID NO: 6143146 - DNA, 20 bp, Homo sapiens
ctcatctctaacagctcagg

SEQ ID NO: 6143147 - DNA, 22 bp, Homo sapiens
ctcatctctaacagctcaggat

SEQ ID NO: 6143148 - DNA, 14 bp, Homo sapiens
ctcatctctgcctg

SEQ ID NO: 6143149 - DNA, 17 bp, Homo sapiens
ctcatctctgcctgaca

SEQ ID NO: 6143150 - DNA, 12 bp, Homo sapiens
ctcatctctgga

SEQ ID NO: 6143151 - DNA, 20 bp, Homo sapiens
ctcatctctggaaggggcag

SEQ ID NO: 6143152 - DNA, 13 bp, Homo sapiens
ctcatctcttcag

SEQ ID NO: 6143153 - DNA, 12 bp, Homo sapiens
ctcatctcttct

SEQ ID NO: 6143154 - DNA, 21 bp, Homo sapiens
ctcatctgaaatgttacaaaa

SEQ ID NO: 6143155 - DNA, 16 bp, Homo sapiens
ctcatctgagaggctc

SEQ ID NO: 6143156 - DNA, 20 bp, Homo sapiens
ctcatctgagaggctctccg

SEQ ID NO: 6143157 - DNA, 15 bp, Homo sapiens
ctcatctgagccagc

SEQ ID NO: 6143158 - DNA, 13 bp, Homo sapiens
ctcatctgaggca

SEQ ID NO: 6143159 - DNA, 12 bp, Homo sapiens
ctcatctgcagg

SEQ ID NO: 6143160 - DNA, 21 bp, Homo sapiens
ctcatctgcaggacagaggga

SEQ ID NO: 6143161 - DNA, 17 bp, Homo sapiens
ctcatctgccaaaatgt

SEQ ID NO: 6143162 - DNA, 17 bp, Homo sapiens
ctcatctgctcagcagc

SEQ ID NO: 6143163 - DNA, 12 bp, Homo sapiens
ctcatctgctgg

SEQ ID NO: 6143164 - DNA, 14 bp, Homo sapiens
ctcatctgctggtc

SEQ ID NO: 6143165 - DNA, 17 bp, Homo sapiens
ctcatctggagttctca

SEQ ID NO: 6143166 - DNA, 15 bp, Homo sapiens
ctgattcaactaaaa

SEQ ID NO: 6143167 - DNA, 18 bp, Homo sapiens
ctgattcaactaaaaaaa

SEQ ID NO: 6143168 - DNA, 19 bp, Homo sapiens
ctgattcaaggcattattt

SEQ ID NO: 6143169 - DNA, 22 bp, Homo sapiens
ctgattcaataaaatgcactga

SEQ ID NO: 6143170 - DNA, 16 bp, Homo sapiens
ctgattcaatttgatg

SEQ ID NO: 6143171 - DNA, 17 bp, Homo sapiens
ctgattcacatctcatt

SEQ ID NO: 6143172 - DNA, 17 bp, Homo sapiens
ctgattcacctcttcct

SEQ ID NO: 6143173 - DNA, 15 bp, Homo sapiens
ctgattcactgcatg

SEQ ID NO: 6143174 - DNA, 18 bp, Homo sapiens
ctgattcactgcatggct

SEQ ID NO: 6143175 - DNA, 16 bp, Homo sapiens
ctgattcactggcctg

SEQ ID NO: 6143176 - DNA, 20 bp, Homo sapiens
ctgattcactggcctggcgg

SEQ ID NO: 6143177 - DNA, 14 bp, Homo sapiens
ctgattcagcattt

SEQ ID NO: 6143178 - DNA, 14 bp, Homo sapiens
ctgattcagggccc

SEQ ID NO: 6143179 - DNA, 21 bp, Homo sapiens
ctgattcagggcccctgaagt

SEQ ID NO: 6143180 - DNA, 22 bp, Homo sapiens
ctgattcataataaatatctgt

SEQ ID NO: 6143181 - DNA, 17 bp, Homo sapiens
ctgattcatactccttt

SEQ ID NO: 6143182 - DNA, 18 bp, Homo sapiens
ctgattcatactcctttt

SEQ ID NO: 6143183 - DNA, 20 bp, Homo sapiens
ctgattcatagtaaaatacc

SEQ ID NO: 6143184 - DNA, 21 bp, Homo sapiens
ctgattcatagtaaaatacct

SEQ ID NO: 6143185 - DNA, 17 bp, Homo sapiens
ctgattcccaagctctg

SEQ ID NO: 6143186 - DNA, 15 bp, Homo sapiens
ctgattcccctccac

SEQ ID NO: 6143187 - DNA, 20 bp, Homo sapiens
ctgattcccgcatggttttt

SEQ ID NO: 6143188 - DNA, 19 bp, Homo sapiens
ctgattccctctcccaccc

SEQ ID NO: 6143189 - DNA, 16 bp, Homo sapiens
ctgattccgcaccctg

SEQ ID NO: 6143190 - DNA, 16 bp, Homo sapiens
ctgattcctaaggccc

SEQ ID NO: 6143191 - DNA, 23 bp, Homo sapiens
ctgattcctaaggcccagctgcc

SEQ ID NO: 6143192 - DNA, 13 bp, Homo sapiens
ctgattcctctca

SEQ ID NO: 6143193 - DNA, 18 bp, Homo sapiens
ctgattcctttaaaatat

SEQ ID NO: 6143194 - DNA, 23 bp, Homo sapiens
ctgattcctttaaaatatatgtc

SEQ ID NO: 6143195 - DNA, 14 bp, Homo sapiens
ctgattctatgtaa

SEQ ID NO: 6143196 - DNA, 15 bp, Homo sapiens
ctgattctatgtaac

SEQ ID NO: 6143197 - DNA, 14 bp, Homo sapiens
ctgattctcagggt

SEQ ID NO: 6143198 - DNA, 17 bp, Homo sapiens
ctgattctcagggtctc

SEQ ID NO: 6143199 - DNA, 12 bp, Homo sapiens
ctgattctccct

SEQ ID NO: 6143200 - DNA, 18 bp, Homo sapiens
ctgattctcctgtcagag

SEQ ID NO: 6143201 - DNA, 12 bp, Homo sapiens
ctgattctctac

SEQ ID NO: 6143202 - DNA, 13 bp, Homo sapiens
ctgattctgggat

SEQ ID NO: 6143203 - DNA, 13 bp, Homo sapiens
ctgattctgtggc

SEQ ID NO: 6143204 - DNA, 18 bp, Homo sapiens
ctgattcttgattcctgg

SEQ ID NO: 6143205 - DNA, 15 bp, Homo sapiens
ctgattgaaacatga

SEQ ID NO: 6143206 - DNA, 20 bp, Homo sapiens
ctgattgatttgggtttttt

SEQ ID NO: 6143207 - DNA, 17 bp, Homo sapiens
ctgattgctatcagcaa

SEQ ID NO: 6143208 - DNA, 16 bp, Homo sapiens
ctgattgctcccagga

SEQ ID NO: 6143209 - DNA, 18 bp, Homo sapiens
ctgattgctctggaagcc

SEQ ID NO: 6143210 - DNA, 14 bp, Homo sapiens
ctgattggaaaata

SEQ ID NO: 6143211 - DNA, 15 bp, Homo sapiens
ctgattggaaaataa

SEQ ID NO: 6143212 - DNA, 19 bp, Homo sapiens
ctgattggaaaataataaa

SEQ ID NO: 6143213 - DNA, 19 bp, Homo sapiens
ctgattggacctggcccag

SEQ ID NO: 6143214 - DNA, 22 bp, Homo sapiens
ctgattggccactggatcctgc

SEQ ID NO: 6143215 - DNA, 13 bp, Homo sapiens
ctgattggctgct

SEQ ID NO: 6143216 - DNA, 14 bp, Homo sapiens
ctgattggctgctt

SEQ ID NO: 6143217 - DNA, 17 bp, Homo sapiens
ctgattggcttgtagaa

SEQ ID NO: 6143218 - DNA, 20 bp, Homo sapiens
ctgattggcttgtagaattg

SEQ ID NO: 6143219 - DNA, 17 bp, Homo sapiens
ctgattgggaggtgcgt

SEQ ID NO: 6143220 - DNA, 15 bp, Homo sapiens
ctgattgggtgccat

SEQ ID NO: 6143221 - DNA, 19 bp, Homo sapiens
ctgattggtttctcttctc

SEQ ID NO: 6143222 - DNA, 21 bp, Homo sapiens
ctgattggtttctcttctccc

SEQ ID NO: 6143223 - DNA, 20 bp, Homo sapiens
ctgattgtaacgttgctgtg

SEQ ID NO: 6143224 - DNA, 21 bp, Homo sapiens
ctgattgtaacgttgctgtgg

SEQ ID NO: 6143225 - DNA, 17 bp, Homo sapiens
ctgattgtctgaaattt

SEQ ID NO: 6143226 - DNA, 19 bp, Homo sapiens
ctgattgtgccagtgcact

SEQ ID NO: 6143227 - DNA, 23 bp, Homo sapiens
ctgattgtggatcttttcattct

SEQ ID NO: 6143228 - DNA, 15 bp, Homo sapiens
ctgattgttcctccc

SEQ ID NO: 6143229 - DNA, 16 bp, Homo sapiens
ctgatttaaaaagtga

SEQ ID NO: 6143230 - DNA, 16 bp, Homo sapiens
ctgatttaacactttt

SEQ ID NO: 6143231 - DNA, 12 bp, Homo sapiens
ctgatttaatgt

SEQ ID NO: 6143232 - DNA, 14 bp, Homo sapiens
ctgatttaatgttt

SEQ ID NO: 6143233 - DNA, 16 bp, Homo sapiens
ctgatttacatgtatg

SEQ ID NO: 6143234 - DNA, 18 bp, Homo sapiens
ctgatttacatgtatggt

SEQ ID NO: 6143235 - DNA, 20 bp, Homo sapiens
ctgatttacctcttacctgt

SEQ ID NO: 6143236 - DNA, 15 bp, Homo sapiens
ctgatttactaacag

SEQ ID NO: 6143237 - DNA, 18 bp, Homo sapiens
ctgatttactctttggga

SEQ ID NO: 6143238 - DNA, 16 bp, Homo sapiens
ctgatttagatatgca

SEQ ID NO: 6143239 - DNA, 16 bp, Homo sapiens
ctgatttaggagaagc

SEQ ID NO: 6143240 - DNA, 18 bp, Homo sapiens
ctgatttaggagaagcca

SEQ ID NO: 6143241 - DNA, 21 bp, Homo sapiens
ctgatttaggagaagccagga

SEQ ID NO: 6143242 - DNA, 22 bp, Homo sapiens
ctgatttaggagaagccaggaa

SEQ ID NO: 6143243 - DNA, 18 bp, Homo sapiens
ctgatttatggttttttt

SEQ ID NO: 6143244 - DNA, 21 bp, Homo sapiens
ctgatttatggtttttttaag

SEQ ID NO: 6143245 - DNA, 19 bp, Homo sapiens
ctgatttattctggtgtct

SEQ ID NO: 6143246 - DNA, 16 bp, Homo sapiens
ctgatttattgaaatt

SEQ ID NO: 6143247 - DNA, 19 bp, Homo sapiens
ctgatttattgaaattttt

SEQ ID NO: 6143248 - DNA, 21 bp, Homo sapiens
ctgatttattgaaatttttct

SEQ ID NO: 6143249 - DNA, 18 bp, Homo sapiens
ctgatttatttattttgg

SEQ ID NO: 6143250 - DNA, 14 bp, Homo sapiens
ctgatttattttgt

SEQ ID NO: 6143251 - DNA, 17 bp, Homo sapiens
ctgatttattttgtatg

SEQ ID NO: 6143252 - DNA, 18 bp, Homo sapiens
ctgatttattttgtatga

SEQ ID NO: 6143253 - DNA, 14 bp, Homo sapiens
ctgatttcaaatgc

SEQ ID NO: 6143254 - DNA, 16 bp, Homo sapiens
ctgatttcaaatgcag

SEQ ID NO: 6143255 - DNA, 17 bp, Homo sapiens
ctgatttcaaatgcagt

SEQ ID NO: 6143256 - DNA, 15 bp, Homo sapiens
ctgatttcaaggtcc

SEQ ID NO: 6143257 - DNA, 18 bp, Homo sapiens
ctgatttcactcagggtg

SEQ ID NO: 6143258 - DNA, 18 bp, Homo sapiens
ctgatttcagaagagact

SEQ ID NO: 6143259 - DNA, 22 bp, Homo sapiens
ctgatttcagtttttcatttgt

SEQ ID NO: 6143260 - DNA, 24 bp, Homo sapiens
ctgatttcagtttttcatttgttt

SEQ ID NO: 6143261 - DNA, 16 bp, Homo sapiens
ctgatttcataattca

SEQ ID NO: 6143262 - DNA, 17 bp, Homo sapiens
ctgatttccaggcccct

SEQ ID NO: 6143263 - DNA, 14 bp, Homo sapiens
ctgatttcctttgg

SEQ ID NO: 6143264 - DNA, 21 bp, Homo sapiens
ctgatttctagaacccgtgac

SEQ ID NO: 6143265 - DNA, 17 bp, Homo sapiens
ctgatttctagtgtata

SEQ ID NO: 6143266 - DNA, 18 bp, Homo sapiens
ctgatttctagtgtatac

SEQ ID NO: 6143267 - DNA, 23 bp, Homo sapiens
ctgatttctagtgtatactctgt

SEQ ID NO: 6143268 - DNA, 11 bp, Homo sapiens
ctgatttctat

SEQ ID NO: 6143269 - DNA, 18 bp, Homo sapiens
ctgatttctatggctttc

SEQ ID NO: 6143270 - DNA, 14 bp, Homo sapiens
ctgatttctcctgc

SEQ ID NO: 6143271 - DNA, 13 bp, Homo sapiens
ctgatttctgaag

SEQ ID NO: 6143272 - DNA, 13 bp, Homo sapiens
ctgatttcttttc

SEQ ID NO: 6143273 - DNA, 23 bp, Homo sapiens
ctgatttgacatagtctggctgt

SEQ ID NO: 6143274 - DNA, 15 bp, Homo sapiens
ctgatttgagtttcc

SEQ ID NO: 6143275 - DNA, 14 bp, Homo sapiens
ctgatttgcaggat

SEQ ID NO: 6143276 - DNA, 17 bp, Homo sapiens
ctgatttgcaggatttt

SEQ ID NO: 6143277 - DNA, 17 bp, Homo sapiens
ctgatttgcatattcat

SEQ ID NO: 6143278 - DNA, 14 bp, Homo sapiens
ctgatttgctgttt

SEQ ID NO: 6143279 - DNA, 21 bp, Homo sapiens
ctgatttggccgttttgtgaa

SEQ ID NO: 6143280 - DNA, 19 bp, Homo sapiens
ctgatttgggctgaatgta

SEQ ID NO: 6143281 - DNA, 11 bp, Homo sapiens
ctgatttgtcc

SEQ ID NO: 6143282 - DNA, 13 bp, Homo sapiens
ctgatttgtggaa

SEQ ID NO: 6143283 - DNA, 16 bp, Homo sapiens
ctgatttgttccttct

SEQ ID NO: 6143284 - DNA, 23 bp, Homo sapiens
ctgattttaaatgcaaattaaag

SEQ ID NO: 6143285 - DNA, 14 bp, Homo sapiens
ctgattttaacaat

SEQ ID NO: 6143286 - DNA, 17 bp, Homo sapiens
ctgattttaatgaaatc

SEQ ID NO: 6143287 - DNA, 23 bp, Homo sapiens
ctgattttaatgaaatcaaatgt

SEQ ID NO: 6143288 - DNA, 17 bp, Homo sapiens
ctgattttacaaattaa

SEQ ID NO: 6143289 - DNA, 14 bp, Homo sapiens
ctgattttcaaaat

SEQ ID NO: 6143290 - DNA, 15 bp, Homo sapiens
ctgattttctcactg

SEQ ID NO: 6143291 - DNA, 20 bp, Homo sapiens
ctgattttctccacaacact

SEQ ID NO: 6143292 - DNA, 24 bp, Homo sapiens
ctgattttctctggcagcataatt

SEQ ID NO: 6143293 - DNA, 15 bp, Homo sapiens
ctgattttgaccttg

SEQ ID NO: 6143294 - DNA, 16 bp, Homo sapiens
ctgattttgaccttgt

SEQ ID NO: 6143295 - DNA, 20 bp, Homo sapiens
ctgattttgaccttgtattg

SEQ ID NO: 6143296 - DNA, 21 bp, Homo sapiens
ctgattttgaccttgtattga

SEQ ID NO: 6143297 - DNA, 12 bp, Homo sapiens
ctgattttgtat

SEQ ID NO: 6143298 - DNA, 16 bp, Homo sapiens
ctgattttgtatgtaa

SEQ ID NO: 6143299 - DNA, 22 bp, Homo sapiens
ctgatttttaaagtactttctt

SEQ ID NO: 6143300 - DNA, 11 bp, Homo sapiens
ctgatttttat

SEQ ID NO: 6143301 - DNA, 21 bp, Homo sapiens
ctgatttttatgatgatgaaa

SEQ ID NO: 6143302 - DNA, 13 bp, Homo sapiens
ctgatttttcctt

SEQ ID NO: 6143303 - DNA, 17 bp, Homo sapiens
ctgatttttctcttttt

SEQ ID NO: 6143304 - DNA, 14 bp, Homo sapiens
ctgattttttaaga

SEQ ID NO: 6143305 - DNA, 18 bp, Homo sapiens
ctgattttttactggctg

SEQ ID NO: 6143306 - DNA, 13 bp, Homo sapiens
ctgattttttgag

SEQ ID NO: 6143307 - DNA, 19 bp, Homo sapiens
ctgatttttttgttgttgt

SEQ ID NO: 6143308 - DNA, 15 bp, Homo sapiens
ctgattttttttcct

SEQ ID NO: 6143309 - DNA, 20 bp, Homo sapiens
ctgatttttttttccttcag

SEQ ID NO: 6143310 - DNA, 22 bp, Homo sapiens
ctgatttttttttccttcagtg

SEQ ID NO: 6143311 - DNA, 18 bp, Homo sapiens
ctgattttttttttaact

SEQ ID NO: 6143312 - DNA, 22 bp, Homo sapiens
ctgattttttttttaacttgaa

SEQ ID NO: 6143313 - DNA, 16 bp, Homo sapiens
ctgcaaaaaaagcctc

SEQ ID NO: 6143314 - DNA, 18 bp, Homo sapiens
ctgcaaaaaaagcctcca

SEQ ID NO: 6143315 - DNA, 20 bp, Homo sapiens
ctgcaaaaatatttataaaa

SEQ ID NO: 6143316 - DNA, 16 bp, Homo sapiens
ctgcaaaaattatata

SEQ ID NO: 6143317 - DNA, 19 bp, Homo sapiens
ctgcaaaaattatatattg

SEQ ID NO: 6143318 - DNA, 22 bp, Homo sapiens
ctgcaaaaccggcaacctgtaa

SEQ ID NO: 6143319 - DNA, 20 bp, Homo sapiens
ctgcaaaactccaggcagga

SEQ ID NO: 6143320 - DNA, 17 bp, Homo sapiens
ctgcaaaaggactctca

SEQ ID NO: 6143321 - DNA, 18 bp, Homo sapiens
ctgcaaaaggagagactc

SEQ ID NO: 6143322 - DNA, 19 bp, Homo sapiens
ctgcaaaaggcctgtgatc

SEQ ID NO: 6143323 - DNA, 18 bp, Homo sapiens
ctgcaaaatacattattc

SEQ ID NO: 6143324 - DNA, 12 bp, Homo sapiens
ctgcaaaatgag

SEQ ID NO: 6143325 - DNA, 21 bp, Homo sapiens
ctgcaaaatgaggaatgtata

SEQ ID NO: 6143326 - DNA, 23 bp, Homo sapiens
ctgcaaaatgcttttgtgtctac

SEQ ID NO: 6143327 - DNA, 15 bp, Homo sapiens
ctgcaaacacacctt

SEQ ID NO: 6143328 - DNA, 20 bp, Homo sapiens
ctgcaaacagaacagggtca

SEQ ID NO: 6143329 - DNA, 23 bp, Homo sapiens
ctgcaaacatggggttggctggg

SEQ ID NO: 6143330 - DNA, 17 bp, Homo sapiens
ctgcaaaccctgctgcc

SEQ ID NO: 6143331 - DNA, 23 bp, Homo sapiens
ctgcaaacctgctggtggggcag

SEQ ID NO: 6143332 - DNA, 18 bp, Homo sapiens
ctgcaaaccttcctggga

SEQ ID NO: 6143333 - DNA, 23 bp, Homo sapiens
ctgcaaaccttcctgggaggaca

SEQ ID NO: 6143334 - DNA, 18 bp, Homo sapiens
ctgcaaacgctgcctgcc

SEQ ID NO: 6143335 - DNA, 20 bp, Homo sapiens
ctgcaaacgctgcctgccca

SEQ ID NO: 6143336 - DNA, 16 bp, Homo sapiens
ctgcaaactcactgct

SEQ ID NO: 6143337 - DNA, 20 bp, Homo sapiens
ctgcaaactcactgctcaag

SEQ ID NO: 6143338 - DNA, 13 bp, Homo sapiens
ctgcaaactcctt

SEQ ID NO: 6143339 - DNA, 12 bp, Homo sapiens
ctgcaaactggg

SEQ ID NO: 6143340 - DNA, 16 bp, Homo sapiens
ctgcaaactgggaacc

SEQ ID NO: 6143341 - DNA, 14 bp, Homo sapiens
ctgcaaagagaaac

SEQ ID NO: 6143342 - DNA, 22 bp, Homo sapiens
ctgcaaagagttatatgacttc

SEQ ID NO: 6143343 - DNA, 19 bp, Homo sapiens
ctgcaaagcaaaacagact

SEQ ID NO: 6143344 - DNA, 19 bp, Homo sapiens
ctcatctggggagcaggca

SEQ ID NO: 6143345 - DNA, 12 bp, Homo sapiens
ctcatctgtcac

SEQ ID NO: 6143346 - DNA, 13 bp, Homo sapiens
ctcatctgtgcct

SEQ ID NO: 6143347 - DNA, 15 bp, Homo sapiens
ctcatctgtgcctgt

SEQ ID NO: 6143348 - DNA, 22 bp, Homo sapiens
ctcatctgtgcctgtctgtcca

SEQ ID NO: 6143349 - DNA, 21 bp, Homo sapiens
ctcatctgtggagctgccaca

SEQ ID NO: 6143350 - DNA, 16 bp, Homo sapiens
ctcatcttaaaaatat

SEQ ID NO: 6143351 - DNA, 16 bp, Homo sapiens
ctcatcttccccagcc

SEQ ID NO: 6143352 - DNA, 21 bp, Homo sapiens
ctcatcttccccagccctccc

SEQ ID NO: 6143353 - DNA, 17 bp, Homo sapiens
ctcatcttcttcaccat

SEQ ID NO: 6143354 - DNA, 19 bp, Homo sapiens
ctcatcttgaagggcccag

SEQ ID NO: 6143355 - DNA, 13 bp, Homo sapiens
ctcatcttgcctc

SEQ ID NO: 6143356 - DNA, 18 bp, Homo sapiens
ctcatctttccctccttg

SEQ ID NO: 6143357 - DNA, 15 bp, Homo sapiens
ctcatctttcttgat

SEQ ID NO: 6143358 - DNA, 15 bp, Homo sapiens
ctcatcttttcctgc

SEQ ID NO: 6143359 - DNA, 15 bp, Homo sapiens
ctcatgaatgtaaat

SEQ ID NO: 6143360 - DNA, 21 bp, Homo sapiens
ctcatgaatgtaaatttgtac

SEQ ID NO: 6143361 - DNA, 20 bp, Homo sapiens
ctcatgacagccagagcctg

SEQ ID NO: 6143362 - DNA, 15 bp, Homo sapiens
ctcatgacggcctgc

SEQ ID NO: 6143363 - DNA, 17 bp, Homo sapiens
ctcatgacggcctgcct

SEQ ID NO: 6143364 - DNA, 20 bp, Homo sapiens
ctcatgacggcttttgtcag

SEQ ID NO: 6143365 - DNA, 14 bp, Homo sapiens
ctcatgactttata

SEQ ID NO: 6143366 - DNA, 14 bp, Homo sapiens
ctcatgagctcctg

SEQ ID NO: 6143367 - DNA, 17 bp, Homo sapiens
ctcatgagctcctgatc

SEQ ID NO: 6143368 - DNA, 21 bp, Homo sapiens
ctcatgagctgtgttcacaga

SEQ ID NO: 6143369 - DNA, 20 bp, Homo sapiens
ctcatgaggaccagggtgga

SEQ ID NO: 6143370 - DNA, 14 bp, Homo sapiens
ctcatgaggctgag

SEQ ID NO: 6143371 - DNA, 17 bp, Homo sapiens
ctcatgaggctgaggca

SEQ ID NO: 6143372 - DNA, 14 bp, Homo sapiens
ctcatgaggggaga

SEQ ID NO: 6143373 - DNA, 15 bp, Homo sapiens
ctcatgaggggagag

SEQ ID NO: 6143374 - DNA, 19 bp, Homo sapiens
ctcatgaggggagaggaga

SEQ ID NO: 6143375 - DNA, 22 bp, Homo sapiens
ctcatgaggggcccgagcagaa

SEQ ID NO: 6143376 - DNA, 18 bp, Homo sapiens
ctcatgagtgtgccccat

SEQ ID NO: 6143377 - DNA, 18 bp, Homo sapiens
ctcatgataccaccttta

SEQ ID NO: 6143378 - DNA, 21 bp, Homo sapiens
ctcatgataccacctttactg

SEQ ID NO: 6143379 - DNA, 23 bp, Homo sapiens
ctcatgatagaaggctatgggga

SEQ ID NO: 6143380 - DNA, 22 bp, Homo sapiens
ctcatgatcaagatatatgtgt

SEQ ID NO: 6143381 - DNA, 20 bp, Homo sapiens
ctcatgatcttgtgacatat

SEQ ID NO: 6143382 - DNA, 19 bp, Homo sapiens
ctcatgatgcgcttcaaag

SEQ ID NO: 6143383 - DNA, 16 bp, Homo sapiens
ctcatgattccatgcc

SEQ ID NO: 6143384 - DNA, 23 bp, Homo sapiens
ctcatgattttttacaaattatg

SEQ ID NO: 6143385 - DNA, 18 bp, Homo sapiens
ctcatgcaaactgcttta

SEQ ID NO: 6143386 - DNA, 19 bp, Homo sapiens
ctcatgcaaactgctttat

SEQ ID NO: 6143387 - DNA, 22 bp, Homo sapiens
ctcatgcaagacttcactgcag

SEQ ID NO: 6143388 - DNA, 20 bp, Homo sapiens
ctcatgcactgcaaatactt

SEQ ID NO: 6143389 - DNA, 14 bp, Homo sapiens
ctcatgcagccgtg

SEQ ID NO: 6143390 - DNA, 15 bp, Homo sapiens
ctcatgcagccgtga

SEQ ID NO: 6143391 - DNA, 19 bp, Homo sapiens
ctcatgcatagtcccagct

SEQ ID NO: 6143392 - DNA, 18 bp, Homo sapiens
ctcatgcatctccacctg

SEQ ID NO: 6143393 - DNA, 20 bp, Homo sapiens
ctcatgcatctccacctgct

SEQ ID NO: 6143394 - DNA, 22 bp, Homo sapiens
ctcatgcatctccacctgctcc

SEQ ID NO: 6143395 - DNA, 18 bp, Homo sapiens
ctcatgccacaccttctt

SEQ ID NO: 6143396 - DNA, 12 bp, Homo sapiens
ctcatgccatca

SEQ ID NO: 6143397 - DNA, 15 bp, Homo sapiens
ctcatgccatggtct

SEQ ID NO: 6143398 - DNA, 20 bp, Homo sapiens
ctcatgccatggtctttgct

SEQ ID NO: 6143399 - DNA, 15 bp, Homo sapiens
ctcatgccattccag

SEQ ID NO: 6143400 - DNA, 17 bp, Homo sapiens
ctcatgcccaccccctg

SEQ ID NO: 6143401 - DNA, 21 bp, Homo sapiens
ctcatgcccaccccctgccct

SEQ ID NO: 6143402 - DNA, 22 bp, Homo sapiens
ctcatgcccaccccctgccctg

SEQ ID NO: 6143403 - DNA, 14 bp, Homo sapiens
ctcatgcccactcc

SEQ ID NO: 6143404 - DNA, 14 bp, Homo sapiens
ctcatgcccagctc

SEQ ID NO: 6143405 - DNA, 22 bp, Homo sapiens
ctcatgccccctttcagatgtc

SEQ ID NO: 6143406 - DNA, 14 bp, Homo sapiens
ctcatgcccctggc

SEQ ID NO: 6143407 - DNA, 14 bp, Homo sapiens
ctcatgccctgcca

SEQ ID NO: 6143408 - DNA, 15 bp, Homo sapiens
ctcatgccctgccaa

SEQ ID NO: 6143409 - DNA, 19 bp, Homo sapiens
ctcatgccgctgtgtctat

SEQ ID NO: 6143410 - DNA, 20 bp, Homo sapiens
ctcatgcctctgagcttcta

SEQ ID NO: 6143411 - DNA, 20 bp, Homo sapiens
ctcatgcctggcccccctcc

SEQ ID NO: 6143412 - DNA, 21 bp, Homo sapiens
ctcatgcctgtaatcccagca

SEQ ID NO: 6143413 - DNA, 18 bp, Homo sapiens
ctcatgcgtacgtcccac

SEQ ID NO: 6143414 - DNA, 15 bp, Homo sapiens
ctcatgctaatataa

SEQ ID NO: 6143415 - DNA, 13 bp, Homo sapiens
ctcatgctatttc

SEQ ID NO: 6143416 - DNA, 16 bp, Homo sapiens
ctcatgctatttctac

SEQ ID NO: 6143417 - DNA, 14 bp, Homo sapiens
ctcatgctctctat

SEQ ID NO: 6143418 - DNA, 18 bp, Homo sapiens
ctcatgctgacttgcaga

SEQ ID NO: 6143419 - DNA, 19 bp, Homo sapiens
ctcatgctgcccctgcctt

SEQ ID NO: 6143420 - DNA, 18 bp, Homo sapiens
ctcatggaaactggccag

SEQ ID NO: 6143421 - DNA, 22 bp, Homo sapiens
ctcatggaccagtggctggtct

SEQ ID NO: 6143422 - DNA, 23 bp, Homo sapiens
ctcatggaccagtggctggtctc

SEQ ID NO: 6143423 - DNA, 23 bp, Homo sapiens
ctcatggactccaggatcctcct

SEQ ID NO: 6143424 - DNA, 19 bp, Homo sapiens
ctcatggattgccacagct

SEQ ID NO: 6143425 - DNA, 14 bp, Homo sapiens
ctcatggcagctgt

SEQ ID NO: 6143426 - DNA, 21 bp, Homo sapiens
ctcatggcagctgtttctcat

SEQ ID NO: 6143427 - DNA, 17 bp, Homo sapiens
ctcatggcaggattcta

SEQ ID NO: 6143428 - DNA, 15 bp, Homo sapiens
ctcatggccagcgcc

SEQ ID NO: 6143429 - DNA, 16 bp, Homo sapiens
ctcatggcccccaggg

SEQ ID NO: 6143430 - DNA, 22 bp, Homo sapiens
ctcatggcccccaggggcagga

SEQ ID NO: 6143431 - DNA, 23 bp, Homo sapiens
ctcatggcccccaggggcaggac

SEQ ID NO: 6143432 - DNA, 14 bp, Homo sapiens
ctcatggcccctct

SEQ ID NO: 6143433 - DNA, 15 bp, Homo sapiens
ctcatggcccctctg

SEQ ID NO: 6143434 - DNA, 19 bp, Homo sapiens
ctcatggcccctctgacct

SEQ ID NO: 6143435 - DNA, 19 bp, Homo sapiens
ctcatggcgggactggaga

SEQ ID NO: 6143436 - DNA, 18 bp, Homo sapiens
ctcatggctgttatctgt

SEQ ID NO: 6143437 - DNA, 13 bp, Homo sapiens
ctcatggcttggg

SEQ ID NO: 6143438 - DNA, 12 bp, Homo sapiens
ctcatgggaagc

SEQ ID NO: 6143439 - DNA, 21 bp, Homo sapiens
ctcatgggaagcaggacctag

SEQ ID NO: 6143440 - DNA, 19 bp, Homo sapiens
ctcatgggaagtcctggca

SEQ ID NO: 6143441 - DNA, 13 bp, Homo sapiens
ctcatgggacctg

SEQ ID NO: 6143442 - DNA, 20 bp, Homo sapiens
ctcatggggaagcttccatg

SEQ ID NO: 6143443 - DNA, 23 bp, Homo sapiens
ctcatgggtcctagcccttccct

SEQ ID NO: 6143444 - DNA, 19 bp, Homo sapiens
ctcatggtgcatataaata

SEQ ID NO: 6143445 - DNA, 12 bp, Homo sapiens
ctcatgtaaaat

SEQ ID NO: 6143446 - DNA, 11 bp, Homo sapiens
ctcatgtaaca

SEQ ID NO: 6143447 - DNA, 18 bp, Homo sapiens
ctcatgtaacattggtga

SEQ ID NO: 6143448 - DNA, 19 bp, Homo sapiens
ctcatgtaacattggtgaa

SEQ ID NO: 6143449 - DNA, 18 bp, Homo sapiens
ctcatgtagaacaagaaa

SEQ ID NO: 6143450 - DNA, 12 bp, Homo sapiens
ctcatgtagcaa

SEQ ID NO: 6143451 - DNA, 22 bp, Homo sapiens
ctcatgtaggtgagcctgggca

SEQ ID NO: 6143452 - DNA, 23 bp, Homo sapiens
ctcatgtaggtgagcctgggcag

SEQ ID NO: 6143453 - DNA, 12 bp, Homo sapiens
ctcatgtatctt

SEQ ID NO: 6143454 - DNA, 17 bp, Homo sapiens
ctcatgtcatttctcat

SEQ ID NO: 6143455 - DNA, 17 bp, Homo sapiens
ctcatgtccccttcctg

SEQ ID NO: 6143456 - DNA, 13 bp, Homo sapiens
ctcatgtccctcc

SEQ ID NO: 6143457 - DNA, 16 bp, Homo sapiens
ctcatgtccctccagg

SEQ ID NO: 6143458 - DNA, 14 bp, Homo sapiens
ctcatgtcctgctg

SEQ ID NO: 6143459 - DNA, 16 bp, Homo sapiens
ctcatgtcctgctggc

SEQ ID NO: 6143460 - DNA, 17 bp, Homo sapiens
ctcatgtcctgctggct

SEQ ID NO: 6143461 - DNA, 12 bp, Homo sapiens
ctcatgtcctgt

SEQ ID NO: 6143462 - DNA, 17 bp, Homo sapiens
ctcatgtcctgtcctgg

SEQ ID NO: 6143463 - DNA, 20 bp, Homo sapiens
ctcatgtcctgtcctggtcc

SEQ ID NO: 6143464 - DNA, 22 bp, Homo sapiens
ctcatgtcctgtcctggtcctg

SEQ ID NO: 6143465 - DNA, 13 bp, Homo sapiens
ctcatgtctcttt

SEQ ID NO: 6143466 - DNA, 18 bp, Homo sapiens
ctcatgtgactctttcca

SEQ ID NO: 6143467 - DNA, 15 bp, Homo sapiens
ctcatgtgctttgta

SEQ ID NO: 6143468 - DNA, 19 bp, Homo sapiens
ctcatgtgctttgtagctt

SEQ ID NO: 6143469 - DNA, 23 bp, Homo sapiens
ctcatgttaaataggcggggctt

SEQ ID NO: 6143470 - DNA, 18 bp, Homo sapiens
ctcatgttccttttgaaa

SEQ ID NO: 6143471 - DNA, 21 bp, Homo sapiens
ctcatgttccttttgaaattg

SEQ ID NO: 6143472 - DNA, 18 bp, Homo sapiens
ctcatgttctcttcccag

SEQ ID NO: 6143473 - DNA, 20 bp, Homo sapiens
ctcatgttctcttcccaggc

SEQ ID NO: 6143474 - DNA, 21 bp, Homo sapiens
ctcatgttctcttcccaggcc

SEQ ID NO: 6143475 - DNA, 16 bp, Homo sapiens
ctcatgttctgctttc

SEQ ID NO: 6143476 - DNA, 19 bp, Homo sapiens
ctcatgttcttaattctta

SEQ ID NO: 6143477 - DNA, 20 bp, Homo sapiens
ctcatgttgagccagtgggc

SEQ ID NO: 6143478 - DNA, 17 bp, Homo sapiens
ctcatgttgctgaattt

SEQ ID NO: 6143479 - DNA, 13 bp, Homo sapiens
ctcatgttggcca

SEQ ID NO: 6143480 - DNA, 13 bp, Homo sapiens
ctcatgtttatga

SEQ ID NO: 6143481 - DNA, 17 bp, Homo sapiens
ctcatgtttatgaaaat

SEQ ID NO: 6143482 - DNA, 14 bp, Homo sapiens
ctcatgtttggaaa

SEQ ID NO: 6143483 - DNA, 13 bp, Homo sapiens
ctcatgttttata

SEQ ID NO: 6143484 - DNA, 17 bp, Homo sapiens
ctcatgttttcaactgc

SEQ ID NO: 6143485 - DNA, 18 bp, Homo sapiens
ctcatgttttcaactgcc

SEQ ID NO: 6143486 - DNA, 15 bp, Homo sapiens
ctcattaaaatccag

SEQ ID NO: 6143487 - DNA, 18 bp, Homo sapiens
ctcattaaactgattcca

SEQ ID NO: 6143488 - DNA, 15 bp, Homo sapiens
ctcattaaacttttt

SEQ ID NO: 6143489 - DNA, 23 bp, Homo sapiens
ctcattaaccgatgctttaccaa

SEQ ID NO: 6143490 - DNA, 13 bp, Homo sapiens
ctcattaatagct

SEQ ID NO: 6143491 - DNA, 19 bp, Homo sapiens
ctcattaattcaattaaaa

SEQ ID NO: 6143492 - DNA, 18 bp, Homo sapiens
ctcattacagatttagtt

SEQ ID NO: 6143493 - DNA, 20 bp, Homo sapiens
ctcattacagttctttcctc

SEQ ID NO: 6143494 - DNA, 18 bp, Homo sapiens
ctcattacggctcctctc

SEQ ID NO: 6143495 - DNA, 20 bp, Homo sapiens
ctcattactacactggtgtg

SEQ ID NO: 6143496 - DNA, 22 bp, Homo sapiens
ctcattactgcaaattgattgt

SEQ ID NO: 6143497 - DNA, 23 bp, Homo sapiens
ctcattactttaccacccccaca

SEQ ID NO: 6143498 - DNA, 19 bp, Homo sapiens
ctcattagaattaccattt

SEQ ID NO: 6143499 - DNA, 17 bp, Homo sapiens
ctcattaggatggctag

SEQ ID NO: 6143500 - DNA, 23 bp, Homo sapiens
ctcattaggcatggttttgggct

SEQ ID NO: 6143501 - DNA, 20 bp, Homo sapiens
ctcattataaaatgggaaga

SEQ ID NO: 6143502 - DNA, 15 bp, Homo sapiens
ctcattatgaaaaac

SEQ ID NO: 6143503 - DNA, 18 bp, Homo sapiens
ctcattatgaaaaacatc

SEQ ID NO: 6143504 - DNA, 15 bp, Homo sapiens
ctcattatgaagatg

SEQ ID NO: 6143505 - DNA, 18 bp, Homo sapiens
ctcattatgccacttcct

SEQ ID NO: 6143506 - DNA, 22 bp, Homo sapiens
ctcattattaccacttagaaga

SEQ ID NO: 6143507 - DNA, 21 bp, Homo sapiens
ctcattatttatgtccaggtg

SEQ ID NO: 6143508 - DNA, 22 bp, Homo sapiens
ctcattatttatgtccaggtgt

SEQ ID NO: 6143509 - DNA, 15 bp, Homo sapiens
ctcattatttgtgtg

SEQ ID NO: 6143510 - DNA, 23 bp, Homo sapiens
ctcattattttgaggtagaggaa

SEQ ID NO: 6143511 - DNA, 15 bp, Homo sapiens
ctcattcaaaagttg

SEQ ID NO: 6143512 - DNA, 19 bp, Homo sapiens
ctcattcaaaagttgaaat

SEQ ID NO: 6143513 - DNA, 16 bp, Homo sapiens
ctcattcactgtcctg

SEQ ID NO: 6143514 - DNA, 21 bp, Homo sapiens
ctcattcactgtcctggcttt

SEQ ID NO: 6143515 - DNA, 22 bp, Homo sapiens
ctcattcagaagatgcttagct

SEQ ID NO: 6143516 - DNA, 22 bp, Homo sapiens
ctcattcagcagaatgactctg

SEQ ID NO: 6143517 - DNA, 14 bp, Homo sapiens
ctcattcagcatct

SEQ ID NO: 6143518 - DNA, 15 bp, Homo sapiens
ctcattcagcatctg

SEQ ID NO: 6143519 - DNA, 16 bp, Homo sapiens
ctcattcagcatctga

SEQ ID NO: 6143520 - DNA, 14 bp, Homo sapiens
ctcattcagcatgg

SEQ ID NO: 6143521 - DNA, 20 bp, Homo sapiens
ctgcaaagcaaaacagactg

SEQ ID NO: 6143522 - DNA, 23 bp, Homo sapiens
ctgcaaaggacagatccagggac

SEQ ID NO: 6143523 - DNA, 14 bp, Homo sapiens
ctgcaaaggagaag

SEQ ID NO: 6143524 - DNA, 16 bp, Homo sapiens
ctgcaaaggagggcct

SEQ ID NO: 6143525 - DNA, 20 bp, Homo sapiens
ctgcaaaggagggcctcaga

SEQ ID NO: 6143526 - DNA, 23 bp, Homo sapiens
ctgcaaaggcccttgtcattgcc

SEQ ID NO: 6143527 - DNA, 16 bp, Homo sapiens
ctgcaaaggcctgggc

SEQ ID NO: 6143528 - DNA, 17 bp, Homo sapiens
ctgcaaaggcctgggct

SEQ ID NO: 6143529 - DNA, 21 bp, Homo sapiens
ctgcaaagggtatcaggtgct

SEQ ID NO: 6143530 - DNA, 23 bp, Homo sapiens
ctgcaaaggtaataatacagcca

SEQ ID NO: 6143531 - DNA, 22 bp, Homo sapiens
ctgcaaagtacaggtactttgt

SEQ ID NO: 6143532 - DNA, 23 bp, Homo sapiens
ctgcaaagtgattcactgtgctt

SEQ ID NO: 6143533 - DNA, 18 bp, Homo sapiens
ctgcaaagtgcaaatact

SEQ ID NO: 6143534 - DNA, 20 bp, Homo sapiens
ctgcaaagtgttttgtacca

SEQ ID NO: 6143535 - DNA, 16 bp, Homo sapiens
ctgcaaataaagcctt

SEQ ID NO: 6143536 - DNA, 17 bp, Homo sapiens
ctgcaaataaagccttt

SEQ ID NO: 6143537 - DNA, 18 bp, Homo sapiens
ctgcaaataaagcctttt

SEQ ID NO: 6143538 - DNA, 17 bp, Homo sapiens
ctgcaaataaggacagc

SEQ ID NO: 6143539 - DNA, 19 bp, Homo sapiens
ctgcaaatactgtatattc

SEQ ID NO: 6143540 - DNA, 17 bp, Homo sapiens
ctgcaaatagaaaacag

SEQ ID NO: 6143541 - DNA, 20 bp, Homo sapiens
ctgcaaatagtttcaaatga

SEQ ID NO: 6143542 - DNA, 15 bp, Homo sapiens
ctgcaaatcaggctt

SEQ ID NO: 6143543 - DNA, 17 bp, Homo sapiens
ctgcaaatctagtgccg

SEQ ID NO: 6143544 - DNA, 19 bp, Homo sapiens
ctgcaaatctgatggcctt

SEQ ID NO: 6143545 - DNA, 18 bp, Homo sapiens
ctgcaaatgcattgtgaa

SEQ ID NO: 6143546 - DNA, 16 bp, Homo sapiens
ctgcaaattaatgtat

SEQ ID NO: 6143547 - DNA, 18 bp, Homo sapiens
ctgcaaattgtagcccag

SEQ ID NO: 6143548 - DNA, 23 bp, Homo sapiens
ctgcaaatttagtttgttaaagc

SEQ ID NO: 6143549 - DNA, 12 bp, Homo sapiens
ctgcaacaaaaa

SEQ ID NO: 6143550 - DNA, 12 bp, Homo sapiens
ctgcaacactgg

SEQ ID NO: 6143551 - DNA, 15 bp, Homo sapiens
ctgcaacagcctgtt

SEQ ID NO: 6143552 - DNA, 12 bp, Homo sapiens
ctgcaacatgga

SEQ ID NO: 6143553 - DNA, 14 bp, Homo sapiens
ctgcaacatttata

SEQ ID NO: 6143554 - DNA, 21 bp, Homo sapiens
ctgcaaccaaactcccatcag

SEQ ID NO: 6143555 - DNA, 22 bp, Homo sapiens
ctgcaaccaattgaaaagtgtt

SEQ ID NO: 6143556 - DNA, 13 bp, Homo sapiens
ctgcaaccactct

SEQ ID NO: 6143557 - DNA, 18 bp, Homo sapiens
ctgcaaccactctgtggc

SEQ ID NO: 6143558 - DNA, 22 bp, Homo sapiens
ctgcaaccactctgtggccagc

SEQ ID NO: 6143559 - DNA, 23 bp, Homo sapiens
ctgcaaccactctgtggccagcc

SEQ ID NO: 6143560 - DNA, 13 bp, Homo sapiens
ctgcaacccaagt

SEQ ID NO: 6143561 - DNA, 14 bp, Homo sapiens
ctgcaaccctggtg

SEQ ID NO: 6143562 - DNA, 23 bp, Homo sapiens
ctgcaaccctggtgtgctgggcg

SEQ ID NO: 6143563 - DNA, 19 bp, Homo sapiens
ctgcaacctcacctcccgg

SEQ ID NO: 6143564 - DNA, 23 bp, Homo sapiens
ctgcaacctcacctcccgggttc

SEQ ID NO: 6143565 - DNA, 14 bp, Homo sapiens
ctgcaacctccacc

SEQ ID NO: 6143566 - DNA, 18 bp, Homo sapiens
ctgcaacctccacctccg

SEQ ID NO: 6143567 - DNA, 19 bp, Homo sapiens
ctgcaacctccacctccgg

SEQ ID NO: 6143568 - DNA, 14 bp, Homo sapiens
ctgcaacctccgca

SEQ ID NO: 6143569 - DNA, 19 bp, Homo sapiens
ctgcaacctccgcatcccg

SEQ ID NO: 6143570 - DNA, 22 bp, Homo sapiens
ctgcaacctccgcctcttgggt

SEQ ID NO: 6143571 - DNA, 20 bp, Homo sapiens
ctgcaacctccgccttccgg

SEQ ID NO: 6143572 - DNA, 18 bp, Homo sapiens
ctgcaacctctgcctcct

SEQ ID NO: 6143573 - DNA, 19 bp, Homo sapiens
ctgcaaccttcgccacctg

SEQ ID NO: 6143574 - DNA, 20 bp, Homo sapiens
ctgcaaccttgtttattaaa

SEQ ID NO: 6143575 - DNA, 22 bp, Homo sapiens
ctgcaacgctgattcctaaggc

SEQ ID NO: 6143576 - DNA, 17 bp, Homo sapiens
ctgcaacggcttagact

SEQ ID NO: 6143577 - DNA, 13 bp, Homo sapiens
ctgcaactcagcc

SEQ ID NO: 6143578 - DNA, 13 bp, Homo sapiens
ctgcaactccagc

SEQ ID NO: 6143579 - DNA, 14 bp, Homo sapiens
ctgcaactccagcg

SEQ ID NO: 6143580 - DNA, 22 bp, Homo sapiens
ctgcaactccagcgtcctcagc

SEQ ID NO: 6143581 - DNA, 21 bp, Homo sapiens
ctgcaactgctcagctctggt

SEQ ID NO: 6143582 - DNA, 11 bp, Homo sapiens
ctgcaacttaa

SEQ ID NO: 6143583 - DNA, 18 bp, Homo sapiens
ctgcaacttccgcctcct

SEQ ID NO: 6143584 - DNA, 19 bp, Homo sapiens
ctgcaacttccgcctcctg

SEQ ID NO: 6143585 - DNA, 22 bp, Homo sapiens
ctgcaacttccgcctcctgtgt

SEQ ID NO: 6143586 - DNA, 15 bp, Homo sapiens
ctgcaacttctgcct

SEQ ID NO: 6143587 - DNA, 18 bp, Homo sapiens
ctgcaacttgtaaatgtg

SEQ ID NO: 6143588 - DNA, 19 bp, Homo sapiens
ctgcaacttgtaaatgtgg

SEQ ID NO: 6143589 - DNA, 13 bp, Homo sapiens
ctgcaactttttt

SEQ ID NO: 6143590 - DNA, 19 bp, Homo sapiens
ctgcaagaagcgccgactc

SEQ ID NO: 6143591 - DNA, 14 bp, Homo sapiens
ctgcaagaattaaa

SEQ ID NO: 6143592 - DNA, 18 bp, Homo sapiens
ctgcaagaattgaagcag

SEQ ID NO: 6143593 - DNA, 21 bp, Homo sapiens
ctgcaagacacaggctcagca

SEQ ID NO: 6143594 - DNA, 15 bp, Homo sapiens
ctgcaagagaatctg

SEQ ID NO: 6143595 - DNA, 18 bp, Homo sapiens
ctgcaagagccttggtgt

SEQ ID NO: 6143596 - DNA, 15 bp, Homo sapiens
ctgcaagaggctcct

SEQ ID NO: 6143597 - DNA, 18 bp, Homo sapiens
ctgcaagaggctcctgtc

SEQ ID NO: 6143598 - DNA, 18 bp, Homo sapiens
ctgcaagattctgtgggc

SEQ ID NO: 6143599 - DNA, 23 bp, Homo sapiens
ctgcaagattctgtgggcagctg

SEQ ID NO: 6143600 - DNA, 14 bp, Homo sapiens
ctgcaagatttcac

SEQ ID NO: 6143601 - DNA, 20 bp, Homo sapiens
ctgcaagatttcacatcagc

SEQ ID NO: 6143602 - DNA, 17 bp, Homo sapiens
ctgcaagcacagccctt

SEQ ID NO: 6143603 - DNA, 13 bp, Homo sapiens
ctgcaagcagaac

SEQ ID NO: 6143604 - DNA, 18 bp, Homo sapiens
ctgcaagcagggctctgc

SEQ ID NO: 6143605 - DNA, 18 bp, Homo sapiens
ctgcaagcatttttccat

SEQ ID NO: 6143606 - DNA, 12 bp, Homo sapiens
ctgcaagcctgc

SEQ ID NO: 6143607 - DNA, 13 bp, Homo sapiens
ctgcaagctccgc

SEQ ID NO: 6143608 - DNA, 20 bp, Homo sapiens
ctgcaagctctgcctcccgg

SEQ ID NO: 6143609 - DNA, 14 bp, Homo sapiens
ctgcaagctgcttg

SEQ ID NO: 6143610 - DNA, 21 bp, Homo sapiens
ctgcaaggattttttaaaaat

SEQ ID NO: 6143611 - DNA, 17 bp, Homo sapiens
ctgcaaggcaaagtaaa

SEQ ID NO: 6143612 - DNA, 14 bp, Homo sapiens
ctgcaaggcccaca

SEQ ID NO: 6143613 - DNA, 19 bp, Homo sapiens
ctgcaaggcccacaggagg

SEQ ID NO: 6143614 - DNA, 13 bp, Homo sapiens
ctgcaaggccttt

SEQ ID NO: 6143615 - DNA, 16 bp, Homo sapiens
ctgcaaggcctttctg

SEQ ID NO: 6143616 - DNA, 18 bp, Homo sapiens
ctgcaaggcctttctgtg

SEQ ID NO: 6143617 - DNA, 19 bp, Homo sapiens
ctgcaagggacaggaaggt

SEQ ID NO: 6143618 - DNA, 22 bp, Homo sapiens
ctgcaagggctccccactgcct

SEQ ID NO: 6143619 - DNA, 17 bp, Homo sapiens
ctgcaaggtctttggtt

SEQ ID NO: 6143620 - DNA, 22 bp, Homo sapiens
ctgcaaggtgaaacgactcaaa

SEQ ID NO: 6143621 - DNA, 16 bp, Homo sapiens
ctgcaagtcagaggat

SEQ ID NO: 6143622 - DNA, 21 bp, Homo sapiens
ctgcaagtcagaggatggcca

SEQ ID NO: 6143623 - DNA, 19 bp, Homo sapiens
ctgcaagtcagtccaggat

SEQ ID NO: 6143624 - DNA, 22 bp, Homo sapiens
ctgcaagtccatagctgagctg

SEQ ID NO: 6143625 - DNA, 19 bp, Homo sapiens
ctgcaagtccttttgtaaa

SEQ ID NO: 6143626 - DNA, 19 bp, Homo sapiens
ctgcaagtgacatctcttt

SEQ ID NO: 6143627 - DNA, 19 bp, Homo sapiens
ctgcaagtgagcaaacctg

SEQ ID NO: 6143628 - DNA, 22 bp, Homo sapiens
ctgcaagtgagcaaacctgccc

SEQ ID NO: 6143629 - DNA, 13 bp, Homo sapiens
ctgcaagtgcccg

SEQ ID NO: 6143630 - DNA, 22 bp, Homo sapiens
ctgcaagtgcccgccctgcccc

SEQ ID NO: 6143631 - DNA, 20 bp, Homo sapiens
ctgcaagtgctcagggaaat

SEQ ID NO: 6143632 - DNA, 19 bp, Homo sapiens
ctgcaagtgtatctccttt

SEQ ID NO: 6143633 - DNA, 16 bp, Homo sapiens
ctgcaagtgtctggag

SEQ ID NO: 6143634 - DNA, 19 bp, Homo sapiens
ctgcaagttgctctgacct

SEQ ID NO: 6143635 - DNA, 15 bp, Homo sapiens
ctgcaataacagttt

SEQ ID NO: 6143636 - DNA, 17 bp, Homo sapiens
ctgcaataacagtttta

SEQ ID NO: 6143637 - DNA, 14 bp, Homo sapiens
ctgcaataacttct

SEQ ID NO: 6143638 - DNA, 15 bp, Homo sapiens
ctgcaataacttctg

SEQ ID NO: 6143639 - DNA, 16 bp, Homo sapiens
ctgcaataacttctga

SEQ ID NO: 6143640 - DNA, 18 bp, Homo sapiens
ctgcaataacttctgacc

SEQ ID NO: 6143641 - DNA, 18 bp, Homo sapiens
ctgcaataaggggagagt

SEQ ID NO: 6143642 - DNA, 20 bp, Homo sapiens
ctgcaatacattaaaataac

SEQ ID NO: 6143643 - DNA, 14 bp, Homo sapiens
ctgcaatagagact

SEQ ID NO: 6143644 - DNA, 16 bp, Homo sapiens
ctgcaatagagactgt

SEQ ID NO: 6143645 - DNA, 19 bp, Homo sapiens
ctgcaatagagactgtaga

SEQ ID NO: 6143646 - DNA, 21 bp, Homo sapiens
ctgcaatagagactgtagatt

SEQ ID NO: 6143647 - DNA, 13 bp, Homo sapiens
ctgcaatcactgt

SEQ ID NO: 6143648 - DNA, 14 bp, Homo sapiens
ctgcaatcactgtg

SEQ ID NO: 6143649 - DNA, 17 bp, Homo sapiens
ctgcaatcatatgtgat

SEQ ID NO: 6143650 - DNA, 18 bp, Homo sapiens
ctgcaatcatatgtgatc

SEQ ID NO: 6143651 - DNA, 19 bp, Homo sapiens
ctgcaatcatatgtgatct

SEQ ID NO: 6143652 - DNA, 16 bp, Homo sapiens
ctgcaatccaatgcac

SEQ ID NO: 6143653 - DNA, 23 bp, Homo sapiens
ctgcaatcctgtctttctgagca

SEQ ID NO: 6143654 - DNA, 15 bp, Homo sapiens
ctgcaatctccaggg

SEQ ID NO: 6143655 - DNA, 13 bp, Homo sapiens
ctgcaatgaaagg

SEQ ID NO: 6143656 - DNA, 23 bp, Homo sapiens
ctgcaatgaaagtcaaatttact

SEQ ID NO: 6143657 - DNA, 23 bp, Homo sapiens
ctgcaatgactgtggagttccat

SEQ ID NO: 6143658 - DNA, 19 bp, Homo sapiens
ctgcaatgccagtcctgca

SEQ ID NO: 6143659 - DNA, 14 bp, Homo sapiens
ctgcaatgcctaga

SEQ ID NO: 6143660 - DNA, 22 bp, Homo sapiens
ctgcaatgcctagacttcccaa

SEQ ID NO: 6143661 - DNA, 18 bp, Homo sapiens
ctgcaatgcgtcttgtga

SEQ ID NO: 6143662 - DNA, 21 bp, Homo sapiens
ctgcaatggcagcattcccac

SEQ ID NO: 6143663 - DNA, 17 bp, Homo sapiens
ctgcaatgggcactggg

SEQ ID NO: 6143664 - DNA, 21 bp, Homo sapiens
ctgcaatggtgactgatttca

SEQ ID NO: 6143665 - DNA, 20 bp, Homo sapiens
ctgcaatgtatcccttctca

SEQ ID NO: 6143666 - DNA, 23 bp, Homo sapiens
ctgcaattaaagtgatactgaaa

SEQ ID NO: 6143667 - DNA, 14 bp, Homo sapiens
ctgcaattcaaaag

SEQ ID NO: 6143668 - DNA, 18 bp, Homo sapiens
ctgcaattcaaaagttcc

SEQ ID NO: 6143669 - DNA, 24 bp, Homo sapiens
ctgcaattcaaaagttccaagagt

SEQ ID NO: 6143670 - DNA, 15 bp, Homo sapiens
ctgcaattcccctct

SEQ ID NO: 6143671 - DNA, 14 bp, Homo sapiens
ctgcaattccctgg

SEQ ID NO: 6143672 - DNA, 16 bp, Homo sapiens
ctgcaattctacagtt

SEQ ID NO: 6143673 - DNA, 20 bp, Homo sapiens
ctgcaattgcagctcactgc

SEQ ID NO: 6143674 - DNA, 22 bp, Homo sapiens
ctgcaattggcaccgaagccca

SEQ ID NO: 6143675 - DNA, 18 bp, Homo sapiens
ctgcaatttcatatgctg

SEQ ID NO: 6143676 - DNA, 20 bp, Homo sapiens
ctgcaatttccattctttta

SEQ ID NO: 6143677 - DNA, 17 bp, Homo sapiens
ctgcaattttactgtga

SEQ ID NO: 6143678 - DNA, 14 bp, Homo sapiens
ctgcaattttctaa

SEQ ID NO: 6143679 - DNA, 16 bp, Homo sapiens
ctgcacaaaagcagat

SEQ ID NO: 6143680 - DNA, 13 bp, Homo sapiens
ctgcacaaacata

SEQ ID NO: 6143681 - DNA, 18 bp, Homo sapiens
ctgcacaaacatagacag

SEQ ID NO: 6143682 - DNA, 22 bp, Homo sapiens
ctgcacaaacatagacagatgt

SEQ ID NO: 6143683 - DNA, 18 bp, Homo sapiens
ctgcacaaacatgaaaat

SEQ ID NO: 6143684 - DNA, 14 bp, Homo sapiens
ctgcacaacagccc

SEQ ID NO: 6143685 - DNA, 17 bp, Homo sapiens
ctgcacaacagccctgc

SEQ ID NO: 6143686 - DNA, 18 bp, Homo sapiens
ctgcacaagccagggtgt

SEQ ID NO: 6143687 - DNA, 16 bp, Homo sapiens
ctgcacaagctgcacc

SEQ ID NO: 6143688 - DNA, 18 bp, Homo sapiens
ctgcacaagctgcaccct

SEQ ID NO: 6143689 - DNA, 15 bp, Homo sapiens
ctgcacaataaaacc

SEQ ID NO: 6143690 - DNA, 21 bp, Homo sapiens
ctgcacaataactcctcccag

SEQ ID NO: 6143691 - DNA, 13 bp, Homo sapiens
ctgcacaatcagt

SEQ ID NO: 6143692 - DNA, 17 bp, Homo sapiens
ctgcacacaagcccaca

SEQ ID NO: 6143693 - DNA, 22 bp, Homo sapiens
ctgcacacaagcccacagcaca

SEQ ID NO: 6143694 - DNA, 23 bp, Homo sapiens
ctgcacacaagcccacagcacag

SEQ ID NO: 6143695 - DNA, 15 bp, Homo sapiens
ctgcacacacagctc

SEQ ID NO: 6143696 - DNA, 20 bp, Homo sapiens
ctgcacacacctcagaggct

SEQ ID NO: 6143697 - DNA, 18 bp, Homo sapiens
ctgcacacacctccgaga

SEQ ID NO: 6143698 - DNA, 15 bp, Homo sapiens
ctcattcagtattaa

SEQ ID NO: 6143699 - DNA, 13 bp, Homo sapiens
ctcattcatcttg

SEQ ID NO: 6143700 - DNA, 13 bp, Homo sapiens
ctcattcattact

SEQ ID NO: 6143701 - DNA, 13 bp, Homo sapiens
ctcattcatttta

SEQ ID NO: 6143702 - DNA, 22 bp, Homo sapiens
ctcattcattttatattgaaaa

SEQ ID NO: 6143703 - DNA, 16 bp, Homo sapiens
ctcattccaagcactt

SEQ ID NO: 6143704 - DNA, 17 bp, Homo sapiens
ctcattccacactgttg

SEQ ID NO: 6143705 - DNA, 15 bp, Homo sapiens
ctcattccagaggaa

SEQ ID NO: 6143706 - DNA, 13 bp, Homo sapiens
ctcattcccagta

SEQ ID NO: 6143707 - DNA, 17 bp, Homo sapiens
ctcattccccattctgt

SEQ ID NO: 6143708 - DNA, 23 bp, Homo sapiens
ctcattccccggggcgtttcttt

SEQ ID NO: 6143709 - DNA, 14 bp, Homo sapiens
ctcattcccctcgt

SEQ ID NO: 6143710 - DNA, 21 bp, Homo sapiens
ctcattccctcgtctttccca

SEQ ID NO: 6143711 - DNA, 16 bp, Homo sapiens
ctcattcctgcctgtc

SEQ ID NO: 6143712 - DNA, 20 bp, Homo sapiens
ctcattcctgcctgtctcct

SEQ ID NO: 6143713 - DNA, 12 bp, Homo sapiens
ctcattcctgtt

SEQ ID NO: 6143714 - DNA, 18 bp, Homo sapiens
ctcattctaatgatggcc

SEQ ID NO: 6143715 - DNA, 20 bp, Homo sapiens
ctcattctaatgatggccca

SEQ ID NO: 6143716 - DNA, 17 bp, Homo sapiens
ctcattctagcaccttg

SEQ ID NO: 6143717 - DNA, 17 bp, Homo sapiens
ctcattctatcggccag

SEQ ID NO: 6143718 - DNA, 20 bp, Homo sapiens
ctcattctcagagtaaaata

SEQ ID NO: 6143719 - DNA, 14 bp, Homo sapiens
ctcattctctttct

SEQ ID NO: 6143720 - DNA, 16 bp, Homo sapiens
ctcattctgcaccttg

SEQ ID NO: 6143721 - DNA, 18 bp, Homo sapiens
ctcattctgcatcctggc

SEQ ID NO: 6143722 - DNA, 22 bp, Homo sapiens
ctcattctggttccctgctgcg

SEQ ID NO: 6143723 - DNA, 22 bp, Homo sapiens
ctcattctgttgcccaggctgg

SEQ ID NO: 6143724 - DNA, 23 bp, Homo sapiens
ctcattctgttgcccaggctggc

SEQ ID NO: 6143725 - DNA, 13 bp, Homo sapiens
ctcattcttctgt

SEQ ID NO: 6143726 - DNA, 16 bp, Homo sapiens
ctcattctttgaacat

SEQ ID NO: 6143727 - DNA, 19 bp, Homo sapiens
ctcattctttgaacatgaa

SEQ ID NO: 6143728 - DNA, 10 bp, Homo sapiens
ctcattgaaa

SEQ ID NO: 6143729 - DNA, 13 bp, Homo sapiens
ctcattgaaatgt

SEQ ID NO: 6143730 - DNA, 14 bp, Homo sapiens
ctcattgaaatgtc

SEQ ID NO: 6143731 - DNA, 13 bp, Homo sapiens
ctcattgaatcct

SEQ ID NO: 6143732 - DNA, 15 bp, Homo sapiens
ctcattgaatcctca

SEQ ID NO: 6143733 - DNA, 18 bp, Homo sapiens
ctcattgacaagaactga

SEQ ID NO: 6143734 - DNA, 18 bp, Homo sapiens
ctcattgaccgtgctggc

SEQ ID NO: 6143735 - DNA, 17 bp, Homo sapiens
ctcattgacctgaggcc

SEQ ID NO: 6143736 - DNA, 21 bp, Homo sapiens
ctcattgagaattcaaatcct

SEQ ID NO: 6143737 - DNA, 24 bp, Homo sapiens
ctcattgatcacagatgtgcccag

SEQ ID NO: 6143738 - DNA, 19 bp, Homo sapiens
ctcattgcagatcccagcc

SEQ ID NO: 6143739 - DNA, 19 bp, Homo sapiens
ctcattgcagcagataact

SEQ ID NO: 6143740 - DNA, 12 bp, Homo sapiens
ctcattgcattt

SEQ ID NO: 6143741 - DNA, 20 bp, Homo sapiens
ctcattgccagtggtgtcca

SEQ ID NO: 6143742 - DNA, 21 bp, Homo sapiens
ctcattgcccccacctctggt

SEQ ID NO: 6143743 - DNA, 21 bp, Homo sapiens
ctcattgctgcccgtttgtac

SEQ ID NO: 6143744 - DNA, 14 bp, Homo sapiens
ctcattgctgtctt

SEQ ID NO: 6143745 - DNA, 19 bp, Homo sapiens
ctcattgctgtcttgcccc

SEQ ID NO: 6143746 - DNA, 20 bp, Homo sapiens
ctcattggaaatttagcatt

SEQ ID NO: 6143747 - DNA, 23 bp, Homo sapiens
ctcattggccagctcataaaatg

SEQ ID NO: 6143748 - DNA, 22 bp, Homo sapiens
ctcattggggttgcaacaataa

SEQ ID NO: 6143749 - DNA, 15 bp, Homo sapiens
ctcattgtaaacaaa

SEQ ID NO: 6143750 - DNA, 12 bp, Homo sapiens
ctcattgtagag

SEQ ID NO: 6143751 - DNA, 18 bp, Homo sapiens
ctcattgtataagccccg

SEQ ID NO: 6143752 - DNA, 19 bp, Homo sapiens
ctcattgtcacctctgtga

SEQ ID NO: 6143753 - DNA, 19 bp, Homo sapiens
ctcattgtctgtgtagagt

SEQ ID NO: 6143754 - DNA, 19 bp, Homo sapiens
ctcattgtgccaagccttc

SEQ ID NO: 6143755 - DNA, 20 bp, Homo sapiens
ctcattgtgccaagccttct

SEQ ID NO: 6143756 - DNA, 13 bp, Homo sapiens
ctcattgttctgt

SEQ ID NO: 6143757 - DNA, 15 bp, Homo sapiens
ctcattgtttttccc

SEQ ID NO: 6143758 - DNA, 13 bp, Homo sapiens
ctcatttaaaaca

SEQ ID NO: 6143759 - DNA, 19 bp, Homo sapiens
ctcatttaaaatgtaaact

SEQ ID NO: 6143760 - DNA, 23 bp, Homo sapiens
ctcatttaaacccaatcagatgc

SEQ ID NO: 6143761 - DNA, 14 bp, Homo sapiens
ctcatttaaagtat

SEQ ID NO: 6143762 - DNA, 20 bp, Homo sapiens
ctcatttaaagtattttatt

SEQ ID NO: 6143763 - DNA, 14 bp, Homo sapiens
ctcatttaatataa

SEQ ID NO: 6143764 - DNA, 22 bp, Homo sapiens
ctcatttaatatttttcaaaat

SEQ ID NO: 6143765 - DNA, 16 bp, Homo sapiens
ctcatttaatcccagg

SEQ ID NO: 6143766 - DNA, 22 bp, Homo sapiens
ctcatttaatcctcccttcctc

SEQ ID NO: 6143767 - DNA, 21 bp, Homo sapiens
ctcatttagcattgaaataat

SEQ ID NO: 6143768 - DNA, 16 bp, Homo sapiens
ctcatttagcctgtcc

SEQ ID NO: 6143769 - DNA, 18 bp, Homo sapiens
ctcatttagcctgtcctg

SEQ ID NO: 6143770 - DNA, 22 bp, Homo sapiens
ctcatttataatgtagcagctc

SEQ ID NO: 6143771 - DNA, 21 bp, Homo sapiens
ctcatttatgttatttatgat

SEQ ID NO: 6143772 - DNA, 22 bp, Homo sapiens
ctcatttatttccatattaaaa

SEQ ID NO: 6143773 - DNA, 17 bp, Homo sapiens
ctcatttcacagccttt

SEQ ID NO: 6143774 - DNA, 19 bp, Homo sapiens
ctcatttcacccctccctt

SEQ ID NO: 6143775 - DNA, 16 bp, Homo sapiens
ctcatttcatctcatt

SEQ ID NO: 6143776 - DNA, 15 bp, Homo sapiens
ctcatttccatacca

SEQ ID NO: 6143777 - DNA, 16 bp, Homo sapiens
ctcatttctaaaagaa

SEQ ID NO: 6143778 - DNA, 20 bp, Homo sapiens
ctcatttctttgtctttttc

SEQ ID NO: 6143779 - DNA, 15 bp, Homo sapiens
ctcatttgaatgctt

SEQ ID NO: 6143780 - DNA, 18 bp, Homo sapiens
ctcatttgcaaacctcag

SEQ ID NO: 6143781 - DNA, 20 bp, Homo sapiens
ctcatttggggtagctagag

SEQ ID NO: 6143782 - DNA, 19 bp, Homo sapiens
ctcatttggtctgccagaa

SEQ ID NO: 6143783 - DNA, 21 bp, Homo sapiens
ctcatttgtcacacactttgg

SEQ ID NO: 6143784 - DNA, 17 bp, Homo sapiens
ctcatttgttaaaatta

SEQ ID NO: 6143785 - DNA, 13 bp, Homo sapiens
ctcattttaatgt

SEQ ID NO: 6143786 - DNA, 17 bp, Homo sapiens
ctcattttaggcctcct

SEQ ID NO: 6143787 - DNA, 18 bp, Homo sapiens
ctcattttcatcttcttc

SEQ ID NO: 6143788 - DNA, 12 bp, Homo sapiens
ctcattttcctg

SEQ ID NO: 6143789 - DNA, 23 bp, Homo sapiens
ctcattttctacgtcatgtattt

SEQ ID NO: 6143790 - DNA, 13 bp, Homo sapiens
ctcattttctggt

SEQ ID NO: 6143791 - DNA, 16 bp, Homo sapiens
ctcattttctttagga

SEQ ID NO: 6143792 - DNA, 21 bp, Homo sapiens
ctcattttgcttcccatctga

SEQ ID NO: 6143793 - DNA, 14 bp, Homo sapiens
ctcatttttcatac

SEQ ID NO: 6143794 - DNA, 18 bp, Homo sapiens
ctcatttttcattagata

SEQ ID NO: 6143795 - DNA, 23 bp, Homo sapiens
ctcatttttgccatacatcagtt

SEQ ID NO: 6143796 - DNA, 14 bp, Homo sapiens
ctcattttttcctg

SEQ ID NO: 6143797 - DNA, 19 bp, Homo sapiens
ctcattttttcctgagaac

SEQ ID NO: 6143798 - DNA, 18 bp, Homo sapiens
ctcatttttttaatttat

SEQ ID NO: 6143799 - DNA, 22 bp, Homo sapiens
ctcatttttttttttgtttctg

SEQ ID NO: 6143800 - DNA, 23 bp, Homo sapiens
ctccaaaaaaaaaaaaaatacaa

SEQ ID NO: 6143801 - DNA, 16 bp, Homo sapiens
ctccaaaaaagaaaca

SEQ ID NO: 6143802 - DNA, 15 bp, Homo sapiens
ctccaaaaacagtaa

SEQ ID NO: 6143803 - DNA, 14 bp, Homo sapiens
ctccaaaaagaaaa

SEQ ID NO: 6143804 - DNA, 14 bp, Homo sapiens
ctccaaaaagaaat

SEQ ID NO: 6143805 - DNA, 15 bp, Homo sapiens
ctccaaaaagaaata

SEQ ID NO: 6143806 - DNA, 16 bp, Homo sapiens
ctccaaaaagaaatat

SEQ ID NO: 6143807 - DNA, 20 bp, Homo sapiens
ctccaaaacacaagggagga

SEQ ID NO: 6143808 - DNA, 22 bp, Homo sapiens
ctccaaaacacttatcctcctg

SEQ ID NO: 6143809 - DNA, 14 bp, Homo sapiens
ctccaaaacatttc

SEQ ID NO: 6143810 - DNA, 15 bp, Homo sapiens
ctccaaaacatttct

SEQ ID NO: 6143811 - DNA, 20 bp, Homo sapiens
ctccaaaacccatgtgggaa

SEQ ID NO: 6143812 - DNA, 19 bp, Homo sapiens
ctccaaaacttagacccat

SEQ ID NO: 6143813 - DNA, 15 bp, Homo sapiens
ctccaaaagcactta

SEQ ID NO: 6143814 - DNA, 21 bp, Homo sapiens
ctccaaaatattaacattctt

SEQ ID NO: 6143815 - DNA, 14 bp, Homo sapiens
ctccaaacactggg

SEQ ID NO: 6143816 - DNA, 16 bp, Homo sapiens
ctccaaacactgggct

SEQ ID NO: 6143817 - DNA, 15 bp, Homo sapiens
ctccaaaccctcgag

SEQ ID NO: 6143818 - DNA, 17 bp, Homo sapiens
ctccaaaccctcgaggc

SEQ ID NO: 6143819 - DNA, 16 bp, Homo sapiens
ctccaaacctccagcc

SEQ ID NO: 6143820 - DNA, 22 bp, Homo sapiens
ctccaaacctcctgttagctgt

SEQ ID NO: 6143821 - DNA, 18 bp, Homo sapiens
ctccaaactcctgcctgt

SEQ ID NO: 6143822 - DNA, 21 bp, Homo sapiens
ctccaaactgactcttaagaa

SEQ ID NO: 6143823 - DNA, 12 bp, Homo sapiens
ctccaaagaaat

SEQ ID NO: 6143824 - DNA, 14 bp, Homo sapiens
ctccaaagccccac

SEQ ID NO: 6143825 - DNA, 14 bp, Homo sapiens
ctccaaaggaaatc

SEQ ID NO: 6143826 - DNA, 16 bp, Homo sapiens
ctccaaaggggctgct

SEQ ID NO: 6143827 - DNA, 21 bp, Homo sapiens
ctccaaagtaatgtagcatga

SEQ ID NO: 6143828 - DNA, 22 bp, Homo sapiens
ctccaaagtattgtacaaataa

SEQ ID NO: 6143829 - DNA, 23 bp, Homo sapiens
ctccaaagtcataattgcattga

SEQ ID NO: 6143830 - DNA, 13 bp, Homo sapiens
ctccaaagtccac

SEQ ID NO: 6143831 - DNA, 16 bp, Homo sapiens
ctccaaagtctctgga

SEQ ID NO: 6143832 - DNA, 16 bp, Homo sapiens
ctccaaagtcttgata

SEQ ID NO: 6143833 - DNA, 16 bp, Homo sapiens
ctccaaagttatccag

SEQ ID NO: 6143834 - DNA, 18 bp, Homo sapiens
ctccaaatcaaggatctt

SEQ ID NO: 6143835 - DNA, 20 bp, Homo sapiens
ctccaaatcaaggatctttt

SEQ ID NO: 6143836 - DNA, 15 bp, Homo sapiens
ctccaaatgagatct

SEQ ID NO: 6143837 - DNA, 13 bp, Homo sapiens
ctccaaatgtcct

SEQ ID NO: 6143838 - DNA, 14 bp, Homo sapiens
ctccaaatgtctac

SEQ ID NO: 6143839 - DNA, 15 bp, Homo sapiens
ctccaaatttaacca

SEQ ID NO: 6143840 - DNA, 20 bp, Homo sapiens
ctccaacaataaagagctca

SEQ ID NO: 6143841 - DNA, 23 bp, Homo sapiens
ctccaacaccaagcacagcagcc

SEQ ID NO: 6143842 - DNA, 14 bp, Homo sapiens
ctccaacagacacc

SEQ ID NO: 6143843 - DNA, 20 bp, Homo sapiens
ctccaacagacaccctccac

SEQ ID NO: 6143844 - DNA, 19 bp, Homo sapiens
ctccaacatcacagcccag

SEQ ID NO: 6143845 - DNA, 12 bp, Homo sapiens
ctccaaccactg

SEQ ID NO: 6143846 - DNA, 17 bp, Homo sapiens
ctccaaccactgtgcca

SEQ ID NO: 6143847 - DNA, 18 bp, Homo sapiens
ctccaaccccccagcact

SEQ ID NO: 6143848 - DNA, 18 bp, Homo sapiens
ctccaacccctcgcccag

SEQ ID NO: 6143849 - DNA, 20 bp, Homo sapiens
ctccaacccctcgcccagtc

SEQ ID NO: 6143850 - DNA, 13 bp, Homo sapiens
ctccaaccctgcc

SEQ ID NO: 6143851 - DNA, 22 bp, Homo sapiens
ctccaaccctgccgtcaccacc

SEQ ID NO: 6143852 - DNA, 19 bp, Homo sapiens
ctccaacctaacctgtgtc

SEQ ID NO: 6143853 - DNA, 13 bp, Homo sapiens
ctccaacctggag

SEQ ID NO: 6143854 - DNA, 19 bp, Homo sapiens
ctccaacctggaggctgga

SEQ ID NO: 6143855 - DNA, 18 bp, Homo sapiens
ctccaacctggggggcag

SEQ ID NO: 6143856 - DNA, 17 bp, Homo sapiens
ctccaaccttctgccct

SEQ ID NO: 6143857 - DNA, 18 bp, Homo sapiens
ctccaaccttctgccctc

SEQ ID NO: 6143858 - DNA, 17 bp, Homo sapiens
ctccaacgttaaaagac

SEQ ID NO: 6143859 - DNA, 15 bp, Homo sapiens
ctccaactcagagca

SEQ ID NO: 6143860 - DNA, 23 bp, Homo sapiens
ctccaactcctgacttcatgatc

SEQ ID NO: 6143861 - DNA, 17 bp, Homo sapiens
ctccaactctctctgtg

SEQ ID NO: 6143862 - DNA, 19 bp, Homo sapiens
ctccaactgcctaaggccc

SEQ ID NO: 6143863 - DNA, 18 bp, Homo sapiens
ctccaactttattttgaa

SEQ ID NO: 6143864 - DNA, 18 bp, Homo sapiens
ctccaagaagccctcctt

SEQ ID NO: 6143865 - DNA, 22 bp, Homo sapiens
ctccaagaagccctccttgcca

SEQ ID NO: 6143866 - DNA, 21 bp, Homo sapiens
ctccaagaatacagaaaatgc

SEQ ID NO: 6143867 - DNA, 15 bp, Homo sapiens
ctccaagaatgctga

SEQ ID NO: 6143868 - DNA, 16 bp, Homo sapiens
ctccaagaatgctgaa

SEQ ID NO: 6143869 - DNA, 13 bp, Homo sapiens
ctccaagaatttc

SEQ ID NO: 6143870 - DNA, 16 bp, Homo sapiens
ctccaagacagcagca

SEQ ID NO: 6143871 - DNA, 19 bp, Homo sapiens
ctccaagacagcagcagcc

SEQ ID NO: 6143872 - DNA, 23 bp, Homo sapiens
ctccaagacagcagcagcctgca

SEQ ID NO: 6143873 - DNA, 21 bp, Homo sapiens
ctccaagacagccatacttcc

SEQ ID NO: 6143874 - DNA, 22 bp, Homo sapiens
ctccaagaccttctccttcacc

SEQ ID NO: 6143875 - DNA, 16 bp, Homo sapiens
ctccaagaggctgagg

SEQ ID NO: 6143876 - DNA, 16 bp, Homo sapiens
ctgcacacacctgcac

SEQ ID NO: 6143877 - DNA, 17 bp, Homo sapiens
ctgcacacacctgcaca

SEQ ID NO: 6143878 - DNA, 18 bp, Homo sapiens
ctgcacacacctgcacac

SEQ ID NO: 6143879 - DNA, 14 bp, Homo sapiens
ctgcacacacctgg

SEQ ID NO: 6143880 - DNA, 15 bp, Homo sapiens
ctgcacacagacggc

SEQ ID NO: 6143881 - DNA, 21 bp, Homo sapiens
ctgcacacagacggcctaggg

SEQ ID NO: 6143882 - DNA, 14 bp, Homo sapiens
ctgcacacaggaca

SEQ ID NO: 6143883 - DNA, 18 bp, Homo sapiens
ctgcacacaggacagcgg

SEQ ID NO: 6143884 - DNA, 15 bp, Homo sapiens
ctgcacacagtgact

SEQ ID NO: 6143885 - DNA, 19 bp, Homo sapiens
ctgcacacataacacacat

SEQ ID NO: 6143886 - DNA, 20 bp, Homo sapiens
ctgcacaccaaggccctgca

SEQ ID NO: 6143887 - DNA, 23 bp, Homo sapiens
ctgcacaccagcccagctcccgt

SEQ ID NO: 6143888 - DNA, 14 bp, Homo sapiens
ctgcacacccctgc

SEQ ID NO: 6143889 - DNA, 14 bp, Homo sapiens
ctgcacaccctggg

SEQ ID NO: 6143890 - DNA, 12 bp, Homo sapiens
ctgcacactctc

SEQ ID NO: 6143891 - DNA, 22 bp, Homo sapiens
ctgcacagaaacttgaactcca

SEQ ID NO: 6143892 - DNA, 14 bp, Homo sapiens
ctgcacagaagaca

SEQ ID NO: 6143893 - DNA, 17 bp, Homo sapiens
ctgcacagaagggctct

SEQ ID NO: 6143894 - DNA, 16 bp, Homo sapiens
ctgcacagacaagcag

SEQ ID NO: 6143895 - DNA, 17 bp, Homo sapiens
ctgcacagacaagcagc

SEQ ID NO: 6143896 - DNA, 18 bp, Homo sapiens
ctgcacagacaagcagcc

SEQ ID NO: 6143897 - DNA, 22 bp, Homo sapiens
ctgcacagagcaagtcctcact

SEQ ID NO: 6143898 - DNA, 23 bp, Homo sapiens
ctgcacagagctctccagctcca

SEQ ID NO: 6143899 - DNA, 17 bp, Homo sapiens
ctgcacagatacctcat

SEQ ID NO: 6143900 - DNA, 18 bp, Homo sapiens
ctgcacagatacctcatc

SEQ ID NO: 6143901 - DNA, 15 bp, Homo sapiens
ctgcacagattccca

SEQ ID NO: 6143902 - DNA, 19 bp, Homo sapiens
ctgcacagattcccaggcc

SEQ ID NO: 6143903 - DNA, 16 bp, Homo sapiens
ctgcacagcaggacct

SEQ ID NO: 6143904 - DNA, 19 bp, Homo sapiens
ctgcacagcaggacctgtg

SEQ ID NO: 6143905 - DNA, 12 bp, Homo sapiens
ctgcacagccca

SEQ ID NO: 6143906 - DNA, 18 bp, Homo sapiens
ctgcacagcccaaccagg

SEQ ID NO: 6143907 - DNA, 13 bp, Homo sapiens
ctgcacagcctct

SEQ ID NO: 6143908 - DNA, 11 bp, Homo sapiens
ctgcacagctt

SEQ ID NO: 6143909 - DNA, 14 bp, Homo sapiens
ctgcacagcttttc

SEQ ID NO: 6143910 - DNA, 18 bp, Homo sapiens
ctgcacagcttttccaaa

SEQ ID NO: 6143911 - DNA, 19 bp, Homo sapiens
ctgcacagcttttccaaaa

SEQ ID NO: 6143912 - DNA, 21 bp, Homo sapiens
ctgcacagcttttccaaaata

SEQ ID NO: 6143913 - DNA, 19 bp, Homo sapiens
ctgcacaggagaattaccc

SEQ ID NO: 6143914 - DNA, 22 bp, Homo sapiens
ctgcacaggcacacagggcccg

SEQ ID NO: 6143915 - DNA, 17 bp, Homo sapiens
ctgcacaggcttgctgt

SEQ ID NO: 6143916 - DNA, 21 bp, Homo sapiens
ctgcacagggcagctgggccc

SEQ ID NO: 6143917 - DNA, 17 bp, Homo sapiens
ctgcacaggtctctgtt

SEQ ID NO: 6143918 - DNA, 19 bp, Homo sapiens
ctgcacaggtctctgttta

SEQ ID NO: 6143919 - DNA, 18 bp, Homo sapiens
ctgcacagtcagaaggac

SEQ ID NO: 6143920 - DNA, 22 bp, Homo sapiens
ctgcacagtcagaaggacggca

SEQ ID NO: 6143921 - DNA, 18 bp, Homo sapiens
ctgcacagtgacttctga

SEQ ID NO: 6143922 - DNA, 12 bp, Homo sapiens
ctgcacagtgct

SEQ ID NO: 6143923 - DNA, 14 bp, Homo sapiens
ctgcacagtgctgt

SEQ ID NO: 6143924 - DNA, 18 bp, Homo sapiens
ctgcacagtgctgttggt

SEQ ID NO: 6143925 - DNA, 15 bp, Homo sapiens
ctgcacagtttagaa

SEQ ID NO: 6143926 - DNA, 20 bp, Homo sapiens
ctgcacagtttagaacagag

SEQ ID NO: 6143927 - DNA, 21 bp, Homo sapiens
ctgcacagtttagaacagagg

SEQ ID NO: 6143928 - DNA, 14 bp, Homo sapiens
ctgcacataatttg

SEQ ID NO: 6143929 - DNA, 22 bp, Homo sapiens
ctgcacataatttgcataaagg

SEQ ID NO: 6143930 - DNA, 15 bp, Homo sapiens
ctgcacatacagatg

SEQ ID NO: 6143931 - DNA, 16 bp, Homo sapiens
ctgcacatagcagact

SEQ ID NO: 6143932 - DNA, 16 bp, Homo sapiens
ctgcacatctacacac

SEQ ID NO: 6143933 - DNA, 17 bp, Homo sapiens
ctgcacatctacacaca

SEQ ID NO: 6143934 - DNA, 18 bp, Homo sapiens
ctgcacatctgtaaatct

SEQ ID NO: 6143935 - DNA, 14 bp, Homo sapiens
ctgcacatgaagaa

SEQ ID NO: 6143936 - DNA, 23 bp, Homo sapiens
ctgcacatgaatcccacccacat

SEQ ID NO: 6143937 - DNA, 15 bp, Homo sapiens
ctgcacatgactaca

SEQ ID NO: 6143938 - DNA, 12 bp, Homo sapiens
ctgcacatgagt

SEQ ID NO: 6143939 - DNA, 16 bp, Homo sapiens
ctgcacatgatttcac

SEQ ID NO: 6143940 - DNA, 18 bp, Homo sapiens
ctgcacatgatttcacaa

SEQ ID NO: 6143941 - DNA, 18 bp, Homo sapiens
ctgcacatggcctgagca

SEQ ID NO: 6143942 - DNA, 13 bp, Homo sapiens
ctgcacatgtgcc

SEQ ID NO: 6143943 - DNA, 20 bp, Homo sapiens
ctgcacatgtgccacacagt

SEQ ID NO: 6143944 - DNA, 15 bp, Homo sapiens
ctgcacattcctggc

SEQ ID NO: 6143945 - DNA, 14 bp, Homo sapiens
ctgcacattgcctg

SEQ ID NO: 6143946 - DNA, 22 bp, Homo sapiens
ctgcacattgcctgttctgctt

SEQ ID NO: 6143947 - DNA, 22 bp, Homo sapiens
ctgcacattgggtggggctcct

SEQ ID NO: 6143948 - DNA, 12 bp, Homo sapiens
ctgcacattgtt

SEQ ID NO: 6143949 - DNA, 13 bp, Homo sapiens
ctgcaccaaacct

SEQ ID NO: 6143950 - DNA, 13 bp, Homo sapiens
ctgcaccaaccca

SEQ ID NO: 6143951 - DNA, 20 bp, Homo sapiens
ctgcaccaacctcactgccc

SEQ ID NO: 6143952 - DNA, 19 bp, Homo sapiens
ctgcaccaagcacccactg

SEQ ID NO: 6143953 - DNA, 15 bp, Homo sapiens
ctgcaccaccatgcc

SEQ ID NO: 6143954 - DNA, 13 bp, Homo sapiens
ctgcaccagagca

SEQ ID NO: 6143955 - DNA, 20 bp, Homo sapiens
ctgcaccagagcaacctctc

SEQ ID NO: 6143956 - DNA, 22 bp, Homo sapiens
ctgcaccagagtgaaagggcta

SEQ ID NO: 6143957 - DNA, 14 bp, Homo sapiens
ctgcaccagcaggt

SEQ ID NO: 6143958 - DNA, 18 bp, Homo sapiens
ctgcaccagcgcccccag

SEQ ID NO: 6143959 - DNA, 19 bp, Homo sapiens
ctgcaccagcgcccccaga

SEQ ID NO: 6143960 - DNA, 13 bp, Homo sapiens
ctgcaccaggcca

SEQ ID NO: 6143961 - DNA, 16 bp, Homo sapiens
ctgcaccaggccatca

SEQ ID NO: 6143962 - DNA, 18 bp, Homo sapiens
ctgcaccaggccatcagc

SEQ ID NO: 6143963 - DNA, 17 bp, Homo sapiens
ctgcaccatcacacatg

SEQ ID NO: 6143964 - DNA, 20 bp, Homo sapiens
ctgcaccatgctgctgggga

SEQ ID NO: 6143965 - DNA, 18 bp, Homo sapiens
ctgcacccacccctgccc

SEQ ID NO: 6143966 - DNA, 22 bp, Homo sapiens
ctgcacccacctacttagatat

SEQ ID NO: 6143967 - DNA, 12 bp, Homo sapiens
ctgcacccagaa

SEQ ID NO: 6143968 - DNA, 20 bp, Homo sapiens
ctgcacccagctccaggggc

SEQ ID NO: 6143969 - DNA, 14 bp, Homo sapiens
ctgcacccagtgaa

SEQ ID NO: 6143970 - DNA, 16 bp, Homo sapiens
ctgcaccccacaggat

SEQ ID NO: 6143971 - DNA, 23 bp, Homo sapiens
ctgcaccccagcgtcaggcctac

SEQ ID NO: 6143972 - DNA, 15 bp, Homo sapiens
ctgcacccccctggg

SEQ ID NO: 6143973 - DNA, 17 bp, Homo sapiens
ctgcacccccctgggct

SEQ ID NO: 6143974 - DNA, 17 bp, Homo sapiens
ctgcacccccctgtgcc

SEQ ID NO: 6143975 - DNA, 18 bp, Homo sapiens
ctgcacccccctgtgcct

SEQ ID NO: 6143976 - DNA, 14 bp, Homo sapiens
ctgcaccccctcct

SEQ ID NO: 6143977 - DNA, 22 bp, Homo sapiens
ctgcacccctgcccccaggtga

SEQ ID NO: 6143978 - DNA, 17 bp, Homo sapiens
ctgcaccccttcctggg

SEQ ID NO: 6143979 - DNA, 19 bp, Homo sapiens
ctgcaccccttctctcctc

SEQ ID NO: 6143980 - DNA, 20 bp, Homo sapiens
ctgcaccctcaacctcctgg

SEQ ID NO: 6143981 - DNA, 13 bp, Homo sapiens
ctgcaccctccac

SEQ ID NO: 6143982 - DNA, 14 bp, Homo sapiens
ctgcaccctccaca

SEQ ID NO: 6143983 - DNA, 19 bp, Homo sapiens
ctgcaccctccacaggagc

SEQ ID NO: 6143984 - DNA, 17 bp, Homo sapiens
ctgcaccctccctccga

SEQ ID NO: 6143985 - DNA, 14 bp, Homo sapiens
ctgcaccctctgct

SEQ ID NO: 6143986 - DNA, 12 bp, Homo sapiens
ctgcaccctgcg

SEQ ID NO: 6143987 - DNA, 21 bp, Homo sapiens
ctgcaccctgcgcctccagag

SEQ ID NO: 6143988 - DNA, 22 bp, Homo sapiens
ctgcaccctgcgcctccagagg

SEQ ID NO: 6143989 - DNA, 18 bp, Homo sapiens
ctgcaccctggaaagggg

SEQ ID NO: 6143990 - DNA, 22 bp, Homo sapiens
ctgcaccctgtatggagctaga

SEQ ID NO: 6143991 - DNA, 21 bp, Homo sapiens
ctgcacccttccacagctggc

SEQ ID NO: 6143992 - DNA, 16 bp, Homo sapiens
ctgcacccttccctct

SEQ ID NO: 6143993 - DNA, 18 bp, Homo sapiens
ctgcacccttccctcttc

SEQ ID NO: 6143994 - DNA, 13 bp, Homo sapiens
ctgcacccttcct

SEQ ID NO: 6143995 - DNA, 13 bp, Homo sapiens
ctgcacccttctt

SEQ ID NO: 6143996 - DNA, 17 bp, Homo sapiens
ctgcacccttcttttct

SEQ ID NO: 6143997 - DNA, 20 bp, Homo sapiens
ctgcacccttcttttctcat

SEQ ID NO: 6143998 - DNA, 22 bp, Homo sapiens
ctgcacccttcttttctcatgt

SEQ ID NO: 6143999 - DNA, 14 bp, Homo sapiens
ctgcaccgacccga

SEQ ID NO: 6144000 - DNA, 18 bp, Homo sapiens
ctgcaccgccgcagaagc

SEQ ID NO: 6144001 - DNA, 15 bp, Homo sapiens
ctgcaccggacagtc

SEQ ID NO: 6144002 - DNA, 15 bp, Homo sapiens
ctgcaccggctggcc

SEQ ID NO: 6144003 - DNA, 23 bp, Homo sapiens
ctgcaccggctggcctggcccct

SEQ ID NO: 6144004 - DNA, 18 bp, Homo sapiens
ctgcaccggggcctgggc

SEQ ID NO: 6144005 - DNA, 15 bp, Homo sapiens
ctgcacctcattcca

SEQ ID NO: 6144006 - DNA, 14 bp, Homo sapiens
ctgcacctcccccc

SEQ ID NO: 6144007 - DNA, 20 bp, Homo sapiens
ctgcacctccccccactgca

SEQ ID NO: 6144008 - DNA, 19 bp, Homo sapiens
ctgcacctccgcttgccag

SEQ ID NO: 6144009 - DNA, 24 bp, Homo sapiens
ctgcacctcctaccctcccaccag

SEQ ID NO: 6144010 - DNA, 17 bp, Homo sapiens
ctgcacctctccagctc

SEQ ID NO: 6144011 - DNA, 13 bp, Homo sapiens
ctgcacctctgga

SEQ ID NO: 6144012 - DNA, 17 bp, Homo sapiens
ctgcacctctggctaga

SEQ ID NO: 6144013 - DNA, 19 bp, Homo sapiens
ctgcacctgcagggagcag

SEQ ID NO: 6144014 - DNA, 16 bp, Homo sapiens
ctgcacctgccagcct

SEQ ID NO: 6144015 - DNA, 18 bp, Homo sapiens
ctgcacctgccagcctgg

SEQ ID NO: 6144016 - DNA, 19 bp, Homo sapiens
ctgcacctgccagcctggc

SEQ ID NO: 6144017 - DNA, 15 bp, Homo sapiens
ctgcacctgcccagc

SEQ ID NO: 6144018 - DNA, 13 bp, Homo sapiens
ctgcacctgcccc

SEQ ID NO: 6144019 - DNA, 14 bp, Homo sapiens
ctgcacctgccccg

SEQ ID NO: 6144020 - DNA, 13 bp, Homo sapiens
ctgcacctgcctc

SEQ ID NO: 6144021 - DNA, 15 bp, Homo sapiens
ctgcacctgcgcctg

SEQ ID NO: 6144022 - DNA, 17 bp, Homo sapiens
ctgcacctgctgcgtcc

SEQ ID NO: 6144023 - DNA, 23 bp, Homo sapiens
ctgcacctgctgcgtccccactc

SEQ ID NO: 6144024 - DNA, 22 bp, Homo sapiens
ctgcacctgctgtcagcctggc

SEQ ID NO: 6144025 - DNA, 15 bp, Homo sapiens
ctgcacctgcttctc

SEQ ID NO: 6144026 - DNA, 17 bp, Homo sapiens
ctgcacctggcctgggc

SEQ ID NO: 6144027 - DNA, 18 bp, Homo sapiens
ctgcacctggcctgggcc

SEQ ID NO: 6144028 - DNA, 20 bp, Homo sapiens
ctgcacctggcctgggccac

SEQ ID NO: 6144029 - DNA, 20 bp, Homo sapiens
ctgcacctgtctcatagcct

SEQ ID NO: 6144030 - DNA, 14 bp, Homo sapiens
ctgcacctgtgcag

SEQ ID NO: 6144031 - DNA, 14 bp, Homo sapiens
ctgcaccttagaaa

SEQ ID NO: 6144032 - DNA, 14 bp, Homo sapiens
ctgcaccttcccca

SEQ ID NO: 6144033 - DNA, 11 bp, Homo sapiens
ctgcaccttgg

SEQ ID NO: 6144034 - DNA, 15 bp, Homo sapiens
ctgcaccttgggcac

SEQ ID NO: 6144035 - DNA, 22 bp, Homo sapiens
ctgcacctttcggcagaggaac

SEQ ID NO: 6144036 - DNA, 20 bp, Homo sapiens
ctgcacgaagtggctgatgg

SEQ ID NO: 6144037 - DNA, 14 bp, Homo sapiens
ctgcacgacccctg

SEQ ID NO: 6144038 - DNA, 15 bp, Homo sapiens
ctgcacgctcccctc

SEQ ID NO: 6144039 - DNA, 19 bp, Homo sapiens
ctgcacgctgcccaggggc

SEQ ID NO: 6144040 - DNA, 16 bp, Homo sapiens
ctgcacgggatgcgtg

SEQ ID NO: 6144041 - DNA, 20 bp, Homo sapiens
ctgcacggtgaatggctttg

SEQ ID NO: 6144042 - DNA, 18 bp, Homo sapiens
ctgcacggtgggccttgc

SEQ ID NO: 6144043 - DNA, 20 bp, Homo sapiens
ctgcacgtaggttccccaga

SEQ ID NO: 6144044 - DNA, 22 bp, Homo sapiens
ctgcacgtaggttccccagaga

SEQ ID NO: 6144045 - DNA, 15 bp, Homo sapiens
ctgcacgtcaccctc

SEQ ID NO: 6144046 - DNA, 19 bp, Homo sapiens
ctgcacgtcaccctcctga

SEQ ID NO: 6144047 - DNA, 12 bp, Homo sapiens
ctgcacgtcatg

SEQ ID NO: 6144048 - DNA, 20 bp, Homo sapiens
ctgcacgtgcacacacctgc

SEQ ID NO: 6144049 - DNA, 21 bp, Homo sapiens
ctgcacgtgcacacacctgca

SEQ ID NO: 6144050 - DNA, 14 bp, Homo sapiens
ctgcacgttcataa

SEQ ID NO: 6144051 - DNA, 17 bp, Homo sapiens
ctgcacgttgctgaagg

SEQ ID NO: 6144052 - DNA, 18 bp, Homo sapiens
ctgcacgttgctgaaggt

SEQ ID NO: 6144053 - DNA, 19 bp, Homo sapiens
ctgcactaaagccagcctg

SEQ ID NO: 6144054 - DNA, 23 bp, Homo sapiens
ctgcactaaagccagcctgacct

SEQ ID NO: 6144055 - DNA, 17 bp, Homo sapiens
ctgcactaacagagtgg

SEQ ID NO: 6144056 - DNA, 13 bp, Homo sapiens
ctgcactaagaga

SEQ ID NO: 6144057 - DNA, 16 bp, Homo sapiens
ctgcactactcctctg

SEQ ID NO: 6144058 - DNA, 16 bp, Homo sapiens
ctgcactactgacatg

SEQ ID NO: 6144059 - DNA, 13 bp, Homo sapiens
ctgcactaggact

SEQ ID NO: 6144060 - DNA, 23 bp, Homo sapiens
ctgcactatagcctaggtgacag

SEQ ID NO: 6144061 - DNA, 14 bp, Homo sapiens
ctgcactcacaggc

SEQ ID NO: 6144062 - DNA, 15 bp, Homo sapiens
ctgcactcacaggct

SEQ ID NO: 6144063 - DNA, 15 bp, Homo sapiens
ctgcactcagattta

SEQ ID NO: 6144064 - DNA, 19 bp, Homo sapiens
ctgcactcatagggtgctc

SEQ ID NO: 6144065 - DNA, 20 bp, Homo sapiens
ctgcactccaatctgggtga

SEQ ID NO: 6144066 - DNA, 11 bp, Homo sapiens
ctgcactccag

SEQ ID NO: 6144067 - DNA, 13 bp, Homo sapiens
ctgcactccagaa

SEQ ID NO: 6144068 - DNA, 12 bp, Homo sapiens
ctgcactccagc

SEQ ID NO: 6144069 - DNA, 18 bp, Homo sapiens
ctgcactccagcctgggg

SEQ ID NO: 6144070 - DNA, 21 bp, Homo sapiens
ctgcactccagcctgggtgac

SEQ ID NO: 6144071 - DNA, 20 bp, Homo sapiens
ctgcactccagtctgggtga

SEQ ID NO: 6144072 - DNA, 12 bp, Homo sapiens
ctgcactccatg

SEQ ID NO: 6144073 - DNA, 15 bp, Homo sapiens
ctgcactccatggcc

SEQ ID NO: 6144074 - DNA, 19 bp, Homo sapiens
ctgcactccatggccaccc

SEQ ID NO: 6144075 - DNA, 21 bp, Homo sapiens
ctgcactccatggccaccccg

SEQ ID NO: 6144076 - DNA, 23 bp, Homo sapiens
ctgcactcccccagttcccgggc

SEQ ID NO: 6144077 - DNA, 17 bp, Homo sapiens
ctgcactcccctgctgg

SEQ ID NO: 6144078 - DNA, 15 bp, Homo sapiens
ctgcactcccgacct

SEQ ID NO: 6144079 - DNA, 15 bp, Homo sapiens
ctgcactccctggcc

SEQ ID NO: 6144080 - DNA, 20 bp, Homo sapiens
ctgcactccggcctgatgac

SEQ ID NO: 6144081 - DNA, 13 bp, Homo sapiens
ctgcactcctgga

SEQ ID NO: 6144082 - DNA, 14 bp, Homo sapiens
ctgcactcctgtct

SEQ ID NO: 6144083 - DNA, 17 bp, Homo sapiens
ctgcactctaaactgca

SEQ ID NO: 6144084 - DNA, 19 bp, Homo sapiens
ctgcactctaaactgcaaa

SEQ ID NO: 6144085 - DNA, 13 bp, Homo sapiens
ctgcactctagcc

SEQ ID NO: 6144086 - DNA, 15 bp, Homo sapiens
ctgcactctgtgccc

SEQ ID NO: 6144087 - DNA, 17 bp, Homo sapiens
ctgcactctgtgcccat

SEQ ID NO: 6144088 - DNA, 21 bp, Homo sapiens
ctgcactctgtgcccatgggc

SEQ ID NO: 6144089 - DNA, 22 bp, Homo sapiens
ctgcactctgtgcccatgggca

SEQ ID NO: 6144090 - DNA, 13 bp, Homo sapiens
ctgcactcttgta

SEQ ID NO: 6144091 - DNA, 21 bp, Homo sapiens
ctgcactcttgtacaaaagaa

SEQ ID NO: 6144092 - DNA, 12 bp, Homo sapiens
ctgcactgaaaa

SEQ ID NO: 6144093 - DNA, 14 bp, Homo sapiens
ctgcactgaaaagg

SEQ ID NO: 6144094 - DNA, 17 bp, Homo sapiens
ctgcactgaaacctgag

SEQ ID NO: 6144095 - DNA, 22 bp, Homo sapiens
ctgcactgaatggctgacctga

SEQ ID NO: 6144096 - DNA, 20 bp, Homo sapiens
ctgcactgacccacagcctc

SEQ ID NO: 6144097 - DNA, 14 bp, Homo sapiens
ctgcactgagaggg

SEQ ID NO: 6144098 - DNA, 14 bp, Homo sapiens
ctgcactgaggatt

SEQ ID NO: 6144099 - DNA, 11 bp, Homo sapiens
ctgcactgagt

SEQ ID NO: 6144100 - DNA, 18 bp, Homo sapiens
ctgcactgatgctgcccc

SEQ ID NO: 6144101 - DNA, 12 bp, Homo sapiens
ctgcactgcagt

SEQ ID NO: 6144102 - DNA, 12 bp, Homo sapiens
ctgcactgctgt

SEQ ID NO: 6144103 - DNA, 18 bp, Homo sapiens
ctgcactggagccacagg

SEQ ID NO: 6144104 - DNA, 14 bp, Homo sapiens
ctgcactgggaagg

SEQ ID NO: 6144105 - DNA, 18 bp, Homo sapiens
ctgcactgggaaggaaac

SEQ ID NO: 6144106 - DNA, 13 bp, Homo sapiens
ctgcactgtcctg

SEQ ID NO: 6144107 - DNA, 15 bp, Homo sapiens
ctgcactgtcctgct

SEQ ID NO: 6144108 - DNA, 19 bp, Homo sapiens
ctgcactgtcctgctccac

SEQ ID NO: 6144109 - DNA, 16 bp, Homo sapiens
ctgcactgttgctgac

SEQ ID NO: 6144110 - DNA, 19 bp, Homo sapiens
ctgcactgttgctgactac

SEQ ID NO: 6144111 - DNA, 16 bp, Homo sapiens
ctgcacttacttgctt

SEQ ID NO: 6144112 - DNA, 15 bp, Homo sapiens
ctgcacttcatatct

SEQ ID NO: 6144113 - DNA, 14 bp, Homo sapiens
ctgcacttctgttc

SEQ ID NO: 6144114 - DNA, 15 bp, Homo sapiens
ctgcacttctgttcc

SEQ ID NO: 6144115 - DNA, 16 bp, Homo sapiens
ctgcacttctgttcca

SEQ ID NO: 6144116 - DNA, 18 bp, Homo sapiens
ctgcacttgcagactcta

SEQ ID NO: 6144117 - DNA, 13 bp, Homo sapiens
ctgcacttggcct

SEQ ID NO: 6144118 - DNA, 18 bp, Homo sapiens
ctgcacttggcctcagct

SEQ ID NO: 6144119 - DNA, 20 bp, Homo sapiens
ctgcacttgggggctcagca

SEQ ID NO: 6144120 - DNA, 23 bp, Homo sapiens
ctgcacttgggggctcagcaagg

SEQ ID NO: 6144121 - DNA, 21 bp, Homo sapiens
ctgcactttccaatgccacag

SEQ ID NO: 6144122 - DNA, 22 bp, Homo sapiens
ctgcactttgggtttttaactc

SEQ ID NO: 6144123 - DNA, 14 bp, Homo sapiens
ctgcactttgttta

SEQ ID NO: 6144124 - DNA, 19 bp, Homo sapiens
ctgcactttgtttagaaaa

SEQ ID NO: 6144125 - DNA, 20 bp, Homo sapiens
ctgcactttgtttagaaaaa

SEQ ID NO: 6144126 - DNA, 10 bp, Homo sapiens
ctgcactttt

SEQ ID NO: 6144127 - DNA, 21 bp, Homo sapiens
ctgcacttttagccagagatg

SEQ ID NO: 6144128 - DNA, 11 bp, Homo sapiens
ctgcacttttt

SEQ ID NO: 6144129 - DNA, 20 bp, Homo sapiens
ctgcagaaaaagaatgtgtc

SEQ ID NO: 6144130 - DNA, 21 bp, Homo sapiens
ctgcagaacagcatcatgtca

SEQ ID NO: 6144131 - DNA, 20 bp, Homo sapiens
ctgcagaacagcttcatgtt

SEQ ID NO: 6144132 - DNA, 19 bp, Homo sapiens
ctgcagaacatatcaaaat

SEQ ID NO: 6144133 - DNA, 22 bp, Homo sapiens
ctgcagaacatcgatatgtata

SEQ ID NO: 6144134 - DNA, 12 bp, Homo sapiens
ctgcagaaccca

SEQ ID NO: 6144135 - DNA, 15 bp, Homo sapiens
ctgcagaacccacca

SEQ ID NO: 6144136 - DNA, 18 bp, Homo sapiens
ctgcagaacccccaggtg

SEQ ID NO: 6144137 - DNA, 19 bp, Homo sapiens
ctgcagaacccccaggtgg

SEQ ID NO: 6144138 - DNA, 21 bp, Homo sapiens
ctgcagaacccccaggtggcc

SEQ ID NO: 6144139 - DNA, 21 bp, Homo sapiens
ctgcagaaccggagagccagc

SEQ ID NO: 6144140 - DNA, 22 bp, Homo sapiens
ctgcagaaccggagagccagct

SEQ ID NO: 6144141 - DNA, 18 bp, Homo sapiens
ctgcagaactcctccaaa

SEQ ID NO: 6144142 - DNA, 15 bp, Homo sapiens
ctgcagaagcaaggg

SEQ ID NO: 6144143 - DNA, 13 bp, Homo sapiens
ctgcagaagccaa

SEQ ID NO: 6144144 - DNA, 14 bp, Homo sapiens
ctgcagaagccaga

SEQ ID NO: 6144145 - DNA, 15 bp, Homo sapiens
ctgcagaagccagaa

SEQ ID NO: 6144146 - DNA, 16 bp, Homo sapiens
ctgcagaagccagaag

SEQ ID NO: 6144147 - DNA, 20 bp, Homo sapiens
ctgcagaaggaaaaatgtgt

SEQ ID NO: 6144148 - DNA, 19 bp, Homo sapiens
ctgcagaaggccaagaatc

SEQ ID NO: 6144149 - DNA, 19 bp, Homo sapiens
ctgcagacaagtcttgctg

SEQ ID NO: 6144150 - DNA, 18 bp, Homo sapiens
ctgcagacacctggactg

SEQ ID NO: 6144151 - DNA, 19 bp, Homo sapiens
ctgcagacacctggactga

SEQ ID NO: 6144152 - DNA, 22 bp, Homo sapiens
ctgcagacacctggactgagcc

SEQ ID NO: 6144153 - DNA, 14 bp, Homo sapiens
ctgcagacacgcct

SEQ ID NO: 6144154 - DNA, 14 bp, Homo sapiens
ctgcagacattctc

SEQ ID NO: 6144155 - DNA, 15 bp, Homo sapiens
ctgcagacattctca

SEQ ID NO: 6144156 - DNA, 18 bp, Homo sapiens
ctgcagacattctcaaag

SEQ ID NO: 6144157 - DNA, 19 bp, Homo sapiens
ctgcagacctcaagccatc

SEQ ID NO: 6144158 - DNA, 16 bp, Homo sapiens
ctgcagacctcactgt

SEQ ID NO: 6144159 - DNA, 15 bp, Homo sapiens
ctgcagacctggctg

SEQ ID NO: 6144160 - DNA, 16 bp, Homo sapiens
ctgcagacctggctgg

SEQ ID NO: 6144161 - DNA, 19 bp, Homo sapiens
ctgcagacctggctgggcc

SEQ ID NO: 6144162 - DNA, 22 bp, Homo sapiens
ctgcagacctggctgggcctgg

SEQ ID NO: 6144163 - DNA, 21 bp, Homo sapiens
ctgcagacgggaatgcctagg

SEQ ID NO: 6144164 - DNA, 19 bp, Homo sapiens
ctgcagacgtctggccctg

SEQ ID NO: 6144165 - DNA, 15 bp, Homo sapiens
ctgcagactcactgt

SEQ ID NO: 6144166 - DNA, 11 bp, Homo sapiens
ctgcagactcc

SEQ ID NO: 6144167 - DNA, 21 bp, Homo sapiens
ctgcagactcgttctcgtgac

SEQ ID NO: 6144168 - DNA, 14 bp, Homo sapiens
ctgcagactgctag

SEQ ID NO: 6144169 - DNA, 18 bp, Homo sapiens
ctgcagacttcccagcta

SEQ ID NO: 6144170 - DNA, 20 bp, Homo sapiens
ctgcagagaaacgcgctcct

SEQ ID NO: 6144171 - DNA, 21 bp, Homo sapiens
ctgcagagaaacttaagcaaa

SEQ ID NO: 6144172 - DNA, 22 bp, Homo sapiens
ctgcagagaaacttaagcaaag

SEQ ID NO: 6144173 - DNA, 19 bp, Homo sapiens
ctgcagagactaatgttgg

SEQ ID NO: 6144174 - DNA, 13 bp, Homo sapiens
ctgcagagcaata

SEQ ID NO: 6144175 - DNA, 15 bp, Homo sapiens
ctgcagagcaataac

SEQ ID NO: 6144176 - DNA, 16 bp, Homo sapiens
ctgcagagcaataaca

SEQ ID NO: 6144177 - DNA, 18 bp, Homo sapiens
ctgcagagcaataacact

SEQ ID NO: 6144178 - DNA, 13 bp, Homo sapiens
ctgcagagcacac

SEQ ID NO: 6144179 - DNA, 19 bp, Homo sapiens
ctgcagagcagcagcacct

SEQ ID NO: 6144180 - DNA, 22 bp, Homo sapiens
ctgcagagcagcagcacctttc

SEQ ID NO: 6144181 - DNA, 20 bp, Homo sapiens
ctgcagagcaggaaacatga

SEQ ID NO: 6144182 - DNA, 23 bp, Homo sapiens
ctgcagagcagtgggcctggcca

SEQ ID NO: 6144183 - DNA, 13 bp, Homo sapiens
ctgcagagcccgg

SEQ ID NO: 6144184 - DNA, 15 bp, Homo sapiens
ctgcagagcccggcc

SEQ ID NO: 6144185 - DNA, 12 bp, Homo sapiens
ctgcagagcctg

SEQ ID NO: 6144186 - DNA, 15 bp, Homo sapiens
ctgcagagctatggt

SEQ ID NO: 6144187 - DNA, 17 bp, Homo sapiens
ctgcagagctgacccag

SEQ ID NO: 6144188 - DNA, 12 bp, Homo sapiens
ctgcagagctgc

SEQ ID NO: 6144189 - DNA, 21 bp, Homo sapiens
ctgcagagctggggggaaggc

SEQ ID NO: 6144190 - DNA, 23 bp, Homo sapiens
ctgcagaggacagagctggctgt

SEQ ID NO: 6144191 - DNA, 16 bp, Homo sapiens
ctgcagaggaccacag

SEQ ID NO: 6144192 - DNA, 14 bp, Homo sapiens
ctgcagaggagcca

SEQ ID NO: 6144193 - DNA, 11 bp, Homo sapiens
ctgcagaggca

SEQ ID NO: 6144194 - DNA, 14 bp, Homo sapiens
ctgcagagggagac

SEQ ID NO: 6144195 - DNA, 13 bp, Homo sapiens
ctgcagagggcac

SEQ ID NO: 6144196 - DNA, 23 bp, Homo sapiens
ctgcagaggggaaaccagtgtag

SEQ ID NO: 6144197 - DNA, 14 bp, Homo sapiens
ctgcagaggggcag

SEQ ID NO: 6144198 - DNA, 20 bp, Homo sapiens
ctgcagaggggctttctgga

SEQ ID NO: 6144199 - DNA, 22 bp, Homo sapiens
ctgcagaggggctttctggaga

SEQ ID NO: 6144200 - DNA, 23 bp, Homo sapiens
ctgcagaggggctttctggagag

SEQ ID NO: 6144201 - DNA, 16 bp, Homo sapiens
ctgcagaggtctgtgc

SEQ ID NO: 6144202 - DNA, 17 bp, Homo sapiens
ctgcagagtctgcccca

SEQ ID NO: 6144203 - DNA, 15 bp, Homo sapiens
ctgcagagttctcct

SEQ ID NO: 6144204 - DNA, 20 bp, Homo sapiens
ctgcagagttctcctggagg

SEQ ID NO: 6144205 - DNA, 15 bp, Homo sapiens
ctgcagagtttggat

SEQ ID NO: 6144206 - DNA, 18 bp, Homo sapiens
ctgcagatagaaagcatt

SEQ ID NO: 6144207 - DNA, 19 bp, Homo sapiens
ctgcagatagccagacaca

SEQ ID NO: 6144208 - DNA, 20 bp, Homo sapiens
ctgcagatagccagacacat

SEQ ID NO: 6144209 - DNA, 14 bp, Homo sapiens
ctgcagatagccca

SEQ ID NO: 6144210 - DNA, 17 bp, Homo sapiens
ctgcagatagcccagga

SEQ ID NO: 6144211 - DNA, 20 bp, Homo sapiens
ctgcagatagtgcctctgca

SEQ ID NO: 6144212 - DNA, 16 bp, Homo sapiens
ctgcagatcttccgtg

SEQ ID NO: 6144213 - DNA, 17 bp, Homo sapiens
ctgcagatcttccgtgg

SEQ ID NO: 6144214 - DNA, 14 bp, Homo sapiens
ctgcagatgccacc

SEQ ID NO: 6144215 - DNA, 19 bp, Homo sapiens
ctgcagatgccaccctagc

SEQ ID NO: 6144216 - DNA, 22 bp, Homo sapiens
ctgcagatgccaccctagccaa

SEQ ID NO: 6144217 - DNA, 20 bp, Homo sapiens
ctgcagattctgagcaaagg

SEQ ID NO: 6144218 - DNA, 21 bp, Homo sapiens
ctgcagattctgagcaaaggc

SEQ ID NO: 6144219 - DNA, 15 bp, Homo sapiens
ctgcagattctgatt

SEQ ID NO: 6144220 - DNA, 16 bp, Homo sapiens
ctgcagatttctcacc

SEQ ID NO: 6144221 - DNA, 17 bp, Homo sapiens
ctgcagatttgggctgg

SEQ ID NO: 6144222 - DNA, 17 bp, Homo sapiens
ctgcagcaaacactcca

SEQ ID NO: 6144223 - DNA, 18 bp, Homo sapiens
ctgcagcaactcccacga

SEQ ID NO: 6144224 - DNA, 15 bp, Homo sapiens
ctgcagcaataaagc

SEQ ID NO: 6144225 - DNA, 18 bp, Homo sapiens
ctgcagcacattgccctg

SEQ ID NO: 6144226 - DNA, 15 bp, Homo sapiens
ctgcagcaccgtggg

SEQ ID NO: 6144227 - DNA, 12 bp, Homo sapiens
ctgcagcacctc

SEQ ID NO: 6144228 - DNA, 17 bp, Homo sapiens
ctgcagcacctccaggc

SEQ ID NO: 6144229 - DNA, 20 bp, Homo sapiens
ctgcagcacgcggccttgtc

SEQ ID NO: 6144230 - DNA, 21 bp, Homo sapiens
ctgcagcacgcggccttgtct

SEQ ID NO: 6144231 - DNA, 19 bp, Homo sapiens
ctgcagcacggacaataaa

SEQ ID NO: 6144232 - DNA, 20 bp, Homo sapiens
ctgcagcacggacaataaac

SEQ ID NO: 6144233 - DNA, 13 bp, Homo sapiens
ctgcagcagagcc

SEQ ID NO: 6144234 - DNA, 13 bp, Homo sapiens
ctgcagcagaggc

SEQ ID NO: 6144235 - DNA, 15 bp, Homo sapiens
aaatgggcctgcctg

SEQ ID NO: 6144236 - DNA, 19 bp, Homo sapiens
aaatgggcctgcctgcctc

SEQ ID NO: 6144237 - DNA, 19 bp, Homo sapiens
aaatggggaactcccccag

SEQ ID NO: 6144238 - DNA, 21 bp, Homo sapiens
aaatggggataataatactga

SEQ ID NO: 6144239 - DNA, 17 bp, Homo sapiens
aaatggggccagatcca

SEQ ID NO: 6144240 - DNA, 21 bp, Homo sapiens
aaatggggccagatccagcct

SEQ ID NO: 6144241 - DNA, 23 bp, Homo sapiens
aaatgggggcggctggaaagagg

SEQ ID NO: 6144242 - DNA, 18 bp, Homo sapiens
aaatgggggtgcatttga

SEQ ID NO: 6144243 - DNA, 22 bp, Homo sapiens
aaatggggtttgggcccctcag

SEQ ID NO: 6144244 - DNA, 19 bp, Homo sapiens
aaatgggtagagaaacact

SEQ ID NO: 6144245 - DNA, 15 bp, Homo sapiens
aaatgggtcttttat

SEQ ID NO: 6144246 - DNA, 20 bp, Homo sapiens
aaatgggtcttttataggaa

SEQ ID NO: 6144247 - DNA, 20 bp, Homo sapiens
aaatgggtgaaaaatggtaa

SEQ ID NO: 6144248 - DNA, 20 bp, Homo sapiens
aaatgggttggtgcttctaa

SEQ ID NO: 6144249 - DNA, 13 bp, Homo sapiens
aaatggtaaaatt

SEQ ID NO: 6144250 - DNA, 14 bp, Homo sapiens
aaatggtaatataa

SEQ ID NO: 6144251 - DNA, 18 bp, Homo sapiens
aaatggtactgtacagct

SEQ ID NO: 6144252 - DNA, 16 bp, Homo sapiens
aaatggtagcatttta

SEQ ID NO: 6144253 - DNA, 22 bp, Homo sapiens
aaatggtagctgaaaaaactat

SEQ ID NO: 6144254 - DNA, 19 bp, Homo sapiens
aaatggtaggcatttccta

SEQ ID NO: 6144255 - DNA, 23 bp, Homo sapiens
aaatggtataaaaggttgccaaa

SEQ ID NO: 6144256 - DNA, 17 bp, Homo sapiens
aaatggtatcaaaatta

SEQ ID NO: 6144257 - DNA, 20 bp, Homo sapiens
aaatggtattttttgtgaat

SEQ ID NO: 6144258 - DNA, 18 bp, Homo sapiens
aaatggtcatggggatga

SEQ ID NO: 6144259 - DNA, 14 bp, Homo sapiens
aaatggtccaggag

SEQ ID NO: 6144260 - DNA, 20 bp, Homo sapiens
aaatggtctctaacatttcc

SEQ ID NO: 6144261 - DNA, 20 bp, Homo sapiens
aaatggtgagcgatcattta

SEQ ID NO: 6144262 - DNA, 21 bp, Homo sapiens
aaatggtgagcgatcatttat

SEQ ID NO: 6144263 - DNA, 11 bp, Homo sapiens
aaatggtgcct

SEQ ID NO: 6144264 - DNA, 17 bp, Homo sapiens
aaatggtggcttcagct

SEQ ID NO: 6144265 - DNA, 22 bp, Homo sapiens
aaatggtggttgtttcttccaa

SEQ ID NO: 6144266 - DNA, 16 bp, Homo sapiens
aaatggtggtttgtca

SEQ ID NO: 6144267 - DNA, 14 bp, Homo sapiens
aaatggtgtacata

SEQ ID NO: 6144268 - DNA, 16 bp, Homo sapiens
aaatggtgtacataat

SEQ ID NO: 6144269 - DNA, 14 bp, Homo sapiens
aaatggtgtcataa

SEQ ID NO: 6144270 - DNA, 19 bp, Homo sapiens
aaatggtgttttcatgtaa

SEQ ID NO: 6144271 - DNA, 19 bp, Homo sapiens
aaatggttaaaagaggttt

SEQ ID NO: 6144272 - DNA, 16 bp, Homo sapiens
aaatggttatgtgcat

SEQ ID NO: 6144273 - DNA, 23 bp, Homo sapiens
aaatggttcagaattaaactttt

SEQ ID NO: 6144274 - DNA, 16 bp, Homo sapiens
aaatggttcatatttt

SEQ ID NO: 6144275 - DNA, 20 bp, Homo sapiens
aaatggttgatggaaaataa

SEQ ID NO: 6144276 - DNA, 21 bp, Homo sapiens
aaatggttgatggaaaataaa

SEQ ID NO: 6144277 - DNA, 13 bp, Homo sapiens
aaatggttgtatt

SEQ ID NO: 6144278 - DNA, 14 bp, Homo sapiens
aaatggttgtatta

SEQ ID NO: 6144279 - DNA, 17 bp, Homo sapiens
aaatggttgtattagat

SEQ ID NO: 6144280 - DNA, 20 bp, Homo sapiens
aaatggttgtattagatgtt

SEQ ID NO: 6144281 - DNA, 22 bp, Homo sapiens
aaatggttgtattagatgttct

SEQ ID NO: 6144282 - DNA, 18 bp, Homo sapiens
aaatggttgtcacctctc

SEQ ID NO: 6144283 - DNA, 21 bp, Homo sapiens
aaatggttgtctgggtcaata

SEQ ID NO: 6144284 - DNA, 23 bp, Homo sapiens
aaatggtttatagccctgtgaag

SEQ ID NO: 6144285 - DNA, 23 bp, Homo sapiens
aaatggtttattttgtattgtgg

SEQ ID NO: 6144286 - DNA, 16 bp, Homo sapiens
aaatggtttcctctgg

SEQ ID NO: 6144287 - DNA, 21 bp, Homo sapiens
aaatggtttctcattaaactc

SEQ ID NO: 6144288 - DNA, 20 bp, Homo sapiens
aaatggtttggtgcttttta

SEQ ID NO: 6144289 - DNA, 13 bp, Homo sapiens
aaatggtttttgt

SEQ ID NO: 6144290 - DNA, 12 bp, Homo sapiens
aaatggtttttt

SEQ ID NO: 6144291 - DNA, 12 bp, Homo sapiens
aaatgtaaaaaa

SEQ ID NO: 6144292 - DNA, 16 bp, Homo sapiens
aaatgtaaaaaacaaa

SEQ ID NO: 6144293 - DNA, 19 bp, Homo sapiens
aaatgtaaaaataataatt

SEQ ID NO: 6144294 - DNA, 16 bp, Homo sapiens
aaatgtaaaaatgaag

SEQ ID NO: 6144295 - DNA, 17 bp, Homo sapiens
aaatgtaaaaatgaagg

SEQ ID NO: 6144296 - DNA, 18 bp, Homo sapiens
aaatgtaaaaatgaagga

SEQ ID NO: 6144297 - DNA, 15 bp, Homo sapiens
aaatgtaaaatattt

SEQ ID NO: 6144298 - DNA, 18 bp, Homo sapiens
aaatgtaaaatatttata

SEQ ID NO: 6144299 - DNA, 22 bp, Homo sapiens
aaatgtaaaatcctacagtgaa

SEQ ID NO: 6144300 - DNA, 11 bp, Homo sapiens
aaatgtaaact

SEQ ID NO: 6144301 - DNA, 20 bp, Homo sapiens
aaatgtaaactgtttcttta

SEQ ID NO: 6144302 - DNA, 13 bp, Homo sapiens
aaatgtaaagcca

SEQ ID NO: 6144303 - DNA, 14 bp, Homo sapiens
aaatgtaaaggagg

SEQ ID NO: 6144304 - DNA, 15 bp, Homo sapiens
aaatgtaaaggaggg

SEQ ID NO: 6144305 - DNA, 15 bp, Homo sapiens
aaatgtaaatattct

SEQ ID NO: 6144306 - DNA, 17 bp, Homo sapiens
aaatgtaaatattctat

SEQ ID NO: 6144307 - DNA, 16 bp, Homo sapiens
aaatgtaacatcataa

SEQ ID NO: 6144308 - DNA, 13 bp, Homo sapiens
aaatgtaacatga

SEQ ID NO: 6144309 - DNA, 14 bp, Homo sapiens
aaatgtaacatgaa

SEQ ID NO: 6144310 - DNA, 15 bp, Homo sapiens
aaatgtaacatgaag

SEQ ID NO: 6144311 - DNA, 23 bp, Homo sapiens
aaatgtaactgtgccagttcttt

SEQ ID NO: 6144312 - DNA, 14 bp, Homo sapiens
aaatgtaactgtta

SEQ ID NO: 6144313 - DNA, 18 bp, Homo sapiens
aaatgtaactgttaccat

SEQ ID NO: 6144314 - DNA, 15 bp, Homo sapiens
aaatgtaagaaagca

SEQ ID NO: 6144315 - DNA, 14 bp, Homo sapiens
aaatgtaagatcgt

SEQ ID NO: 6144316 - DNA, 21 bp, Homo sapiens
aaatgtaagattatagattct

SEQ ID NO: 6144317 - DNA, 14 bp, Homo sapiens
aaatgtaagcaaag

SEQ ID NO: 6144318 - DNA, 13 bp, Homo sapiens
aaatgtaaggctg

SEQ ID NO: 6144319 - DNA, 20 bp, Homo sapiens
aaatgtaaggctgtgtaaga

SEQ ID NO: 6144320 - DNA, 20 bp, Homo sapiens
aaatgtaatactggaataat

SEQ ID NO: 6144321 - DNA, 15 bp, Homo sapiens
aaatgtaatagccaa

SEQ ID NO: 6144322 - DNA, 20 bp, Homo sapiens
aaatgtaatagccaaaccca

SEQ ID NO: 6144323 - DNA, 18 bp, Homo sapiens
aaatgtaatataatgtat

SEQ ID NO: 6144324 - DNA, 21 bp, Homo sapiens
aaatgtaatataatgtatttt

SEQ ID NO: 6144325 - DNA, 16 bp, Homo sapiens
aaatgtaatgtcagac

SEQ ID NO: 6144326 - DNA, 22 bp, Homo sapiens
aaatgtaattaactgtaaactt

SEQ ID NO: 6144327 - DNA, 17 bp, Homo sapiens
aaatgtaattataagct

SEQ ID NO: 6144328 - DNA, 13 bp, Homo sapiens
aaatgtaatttaa

SEQ ID NO: 6144329 - DNA, 18 bp, Homo sapiens
aaatgtacagatatgcaa

SEQ ID NO: 6144330 - DNA, 13 bp, Homo sapiens
aaatgtacatgta

SEQ ID NO: 6144331 - DNA, 14 bp, Homo sapiens
aaatgtacatgtat

SEQ ID NO: 6144332 - DNA, 16 bp, Homo sapiens
aaatgtacatgtatta

SEQ ID NO: 6144333 - DNA, 19 bp, Homo sapiens
aaatgtacatttccaaatg

SEQ ID NO: 6144334 - DNA, 19 bp, Homo sapiens
aaatgtacccgagcacata

SEQ ID NO: 6144335 - DNA, 22 bp, Homo sapiens
aaatgtaccgatgatactgttt

SEQ ID NO: 6144336 - DNA, 20 bp, Homo sapiens
aaatgtaccttcagaataag

SEQ ID NO: 6144337 - DNA, 20 bp, Homo sapiens
aaatgtacgtcatttgtgca

SEQ ID NO: 6144338 - DNA, 18 bp, Homo sapiens
aaatgtactacatttgca

SEQ ID NO: 6144339 - DNA, 15 bp, Homo sapiens
aaatgtacttttgga

SEQ ID NO: 6144340 - DNA, 19 bp, Homo sapiens
aaatgtagaaacttaaaca

SEQ ID NO: 6144341 - DNA, 18 bp, Homo sapiens
aaatgtagaaattcttca

SEQ ID NO: 6144342 - DNA, 14 bp, Homo sapiens
aaatgtagaagaaa

SEQ ID NO: 6144343 - DNA, 18 bp, Homo sapiens
aaatgtagaagaaagcaa

SEQ ID NO: 6144344 - DNA, 18 bp, Homo sapiens
aaatgtagacaaagtgaa

SEQ ID NO: 6144345 - DNA, 18 bp, Homo sapiens
aaatgtagcgacagcatt

SEQ ID NO: 6144346 - DNA, 19 bp, Homo sapiens
aaatgtagcgacagcattt

SEQ ID NO: 6144347 - DNA, 17 bp, Homo sapiens
aaatgtagcttcagtca

SEQ ID NO: 6144348 - DNA, 21 bp, Homo sapiens
aaatgtagcttcagtcattaa

SEQ ID NO: 6144349 - DNA, 19 bp, Homo sapiens
aaatgtagcttttatgtga

SEQ ID NO: 6144350 - DNA, 19 bp, Homo sapiens
aaatgtaggatcaaaaggc

SEQ ID NO: 6144351 - DNA, 21 bp, Homo sapiens
aaatgtaggcatcatgcatgt

SEQ ID NO: 6144352 - DNA, 20 bp, Homo sapiens
aaatgtaggcttagtttgtg

SEQ ID NO: 6144353 - DNA, 20 bp, Homo sapiens
aaatgtagttctgctccaga

SEQ ID NO: 6144354 - DNA, 17 bp, Homo sapiens
aaatgtagttttgtata

SEQ ID NO: 6144355 - DNA, 13 bp, Homo sapiens
aaatgtataaata

SEQ ID NO: 6144356 - DNA, 17 bp, Homo sapiens
aaatgtataaatataca

SEQ ID NO: 6144357 - DNA, 19 bp, Homo sapiens
aaatgtataaatatacagt

SEQ ID NO: 6144358 - DNA, 21 bp, Homo sapiens
aaatgtataaatatacagtat

SEQ ID NO: 6144359 - DNA, 13 bp, Homo sapiens
aaatgtataaatt

SEQ ID NO: 6144360 - DNA, 17 bp, Homo sapiens
aaatgtatatatgtata

SEQ ID NO: 6144361 - DNA, 13 bp, Homo sapiens
aaatgtatatatt

SEQ ID NO: 6144362 - DNA, 21 bp, Homo sapiens
aaatgtatatgttatttttgg

SEQ ID NO: 6144363 - DNA, 17 bp, Homo sapiens
aaatgtatatttaactt

SEQ ID NO: 6144364 - DNA, 22 bp, Homo sapiens
aaatgtatcatttttgtgcaca

SEQ ID NO: 6144365 - DNA, 20 bp, Homo sapiens
aaatgtatcctgataaacat

SEQ ID NO: 6144366 - DNA, 21 bp, Homo sapiens
aaatgtatcctgataaacatt

SEQ ID NO: 6144367 - DNA, 15 bp, Homo sapiens
aaatgtatctaagaa

SEQ ID NO: 6144368 - DNA, 20 bp, Homo sapiens
aaatgtatctaagaataata

SEQ ID NO: 6144369 - DNA, 14 bp, Homo sapiens
aaatgtatctgaat

SEQ ID NO: 6144370 - DNA, 14 bp, Homo sapiens
aaatgtatcttcca

SEQ ID NO: 6144371 - DNA, 13 bp, Homo sapiens
aaatgtatgcatg

SEQ ID NO: 6144372 - DNA, 16 bp, Homo sapiens
aaatgtatgcatgttg

SEQ ID NO: 6144373 - DNA, 21 bp, Homo sapiens
aaatgtatgttggtttagcgt

SEQ ID NO: 6144374 - DNA, 17 bp, Homo sapiens
aaatgtattaactgaaa

SEQ ID NO: 6144375 - DNA, 23 bp, Homo sapiens
aaatgtattatgtcctgtgagat

SEQ ID NO: 6144376 - DNA, 16 bp, Homo sapiens
aaatgtattattgtaa

SEQ ID NO: 6144377 - DNA, 15 bp, Homo sapiens
aaatgtattcaaata

SEQ ID NO: 6144378 - DNA, 16 bp, Homo sapiens
aaatgtattcattctt

SEQ ID NO: 6144379 - DNA, 14 bp, Homo sapiens
aaatgtattccttt

SEQ ID NO: 6144380 - DNA, 17 bp, Homo sapiens
aaatgtattggcacagt

SEQ ID NO: 6144381 - DNA, 18 bp, Homo sapiens
aaatgtattttatgttat

SEQ ID NO: 6144382 - DNA, 21 bp, Homo sapiens
aaatgtattttatgttatata

SEQ ID NO: 6144383 - DNA, 14 bp, Homo sapiens
aaatgtattttgaa

SEQ ID NO: 6144384 - DNA, 17 bp, Homo sapiens
aaatgtattttgaagaa

SEQ ID NO: 6144385 - DNA, 23 bp, Homo sapiens
aaatgtcaagaaattctgctgtt

SEQ ID NO: 6144386 - DNA, 13 bp, Homo sapiens
aaatgtcaattta

SEQ ID NO: 6144387 - DNA, 20 bp, Homo sapiens
aaatgtcacacttgtttctt

SEQ ID NO: 6144388 - DNA, 17 bp, Homo sapiens
aaatgtcacagaagcag

SEQ ID NO: 6144389 - DNA, 14 bp, Homo sapiens
aaatgtcacagtaa

SEQ ID NO: 6144390 - DNA, 22 bp, Homo sapiens
aaatgtcactgaagtgattgaa

SEQ ID NO: 6144391 - DNA, 17 bp, Homo sapiens
aaatgtcactgttataa

SEQ ID NO: 6144392 - DNA, 23 bp, Homo sapiens
aaatgtcagtagtgctaatgcat

SEQ ID NO: 6144393 - DNA, 15 bp, Homo sapiens
aaatgtcagttgaaa

SEQ ID NO: 6144394 - DNA, 13 bp, Homo sapiens
aaatgtcataaat

SEQ ID NO: 6144395 - DNA, 14 bp, Homo sapiens
aaatgtcataaatt

SEQ ID NO: 6144396 - DNA, 16 bp, Homo sapiens
aaatgtcatcaaatat

SEQ ID NO: 6144397 - DNA, 18 bp, Homo sapiens
aaatgtcatgctgcctta

SEQ ID NO: 6144398 - DNA, 18 bp, Homo sapiens
aaatgtcattatgtagaa

SEQ ID NO: 6144399 - DNA, 15 bp, Homo sapiens
aaatgtcatttcata

SEQ ID NO: 6144400 - DNA, 22 bp, Homo sapiens
aaatgtccagtaagatcactgt

SEQ ID NO: 6144401 - DNA, 16 bp, Homo sapiens
aaatgtcccaaataaa

SEQ ID NO: 6144402 - DNA, 15 bp, Homo sapiens
aaatgtcctgcatgg

SEQ ID NO: 6144403 - DNA, 22 bp, Homo sapiens
aaatgtcctgtggtgacaggcc

SEQ ID NO: 6144404 - DNA, 19 bp, Homo sapiens
aaatgtcggggttggggtg

SEQ ID NO: 6144405 - DNA, 22 bp, Homo sapiens
aaatgtctaatgtattttattg

SEQ ID NO: 6144406 - DNA, 14 bp, Homo sapiens
aaatgtctactgaa

SEQ ID NO: 6144407 - DNA, 19 bp, Homo sapiens
aaatgtctagttgtaacac

SEQ ID NO: 6144408 - DNA, 24 bp, Homo sapiens
aaatgtctagttgtaacaccatga

SEQ ID NO: 6144409 - DNA, 21 bp, Homo sapiens
aaatgtctatagagaaaaact

SEQ ID NO: 6144410 - DNA, 14 bp, Homo sapiens
aaatgtctgctggt

SEQ ID NO: 6144411 - DNA, 22 bp, Homo sapiens
aaatgtctgtggccttgttctc

SEQ ID NO: 6144412 - DNA, 14 bp, Homo sapiens
aaatgtcttaacaa

SEQ ID NO: 6144413 - DNA, 13 bp, Homo sapiens
ctgcagcagagtg

SEQ ID NO: 6144414 - DNA, 13 bp, Homo sapiens
ctgcagcaggagt

SEQ ID NO: 6144415 - DNA, 15 bp, Homo sapiens
ctgcagcaggcagct

SEQ ID NO: 6144416 - DNA, 22 bp, Homo sapiens
ctgcagcagggcaggaagggga

SEQ ID NO: 6144417 - DNA, 15 bp, Homo sapiens
ctgcagcaggtgctg

SEQ ID NO: 6144418 - DNA, 19 bp, Homo sapiens
ctgcagcatgacctgtgac

SEQ ID NO: 6144419 - DNA, 23 bp, Homo sapiens
ctgcagcatggtccctgccttag

SEQ ID NO: 6144420 - DNA, 18 bp, Homo sapiens
ctgcagcatgttgctgag

SEQ ID NO: 6144421 - DNA, 15 bp, Homo sapiens
ctgcagcattgaagt

SEQ ID NO: 6144422 - DNA, 18 bp, Homo sapiens
ctgcagccaaacagagcc

SEQ ID NO: 6144423 - DNA, 10 bp, Homo sapiens
ctgcagccag

SEQ ID NO: 6144424 - DNA, 12 bp, Homo sapiens
ctgcagccagcc

SEQ ID NO: 6144425 - DNA, 17 bp, Homo sapiens
ctgcagccagcccagcc

SEQ ID NO: 6144426 - DNA, 18 bp, Homo sapiens
ctgcagccagcccagccc

SEQ ID NO: 6144427 - DNA, 22 bp, Homo sapiens
ctgcagccagcccagcccagct

SEQ ID NO: 6144428 - DNA, 23 bp, Homo sapiens
ctgcagccagcccagcccagctg

SEQ ID NO: 6144429 - DNA, 22 bp, Homo sapiens
ctgcagccagctcacgtccagg

SEQ ID NO: 6144430 - DNA, 20 bp, Homo sapiens
ctgcagccaggcctcgcctg

SEQ ID NO: 6144431 - DNA, 22 bp, Homo sapiens
ctgcagccaggcctcgcctgcc

SEQ ID NO: 6144432 - DNA, 14 bp, Homo sapiens
ctgcagccagggct

SEQ ID NO: 6144433 - DNA, 15 bp, Homo sapiens
ctgcagccagggctg

SEQ ID NO: 6144434 - DNA, 16 bp, Homo sapiens
ctgcagccagggctgg

SEQ ID NO: 6144435 - DNA, 18 bp, Homo sapiens
ctgcagccagggctgggg

SEQ ID NO: 6144436 - DNA, 14 bp, Homo sapiens
ctgcagccatccca

SEQ ID NO: 6144437 - DNA, 23 bp, Homo sapiens
ctgcagccatcccgcttagcctg

SEQ ID NO: 6144438 - DNA, 23 bp, Homo sapiens
ctgcagcccaaaacccagggcaa

SEQ ID NO: 6144439 - DNA, 17 bp, Homo sapiens
ctgcagcccacagagga

SEQ ID NO: 6144440 - DNA, 18 bp, Homo sapiens
ctgcagcccacagaggac

SEQ ID NO: 6144441 - DNA, 19 bp, Homo sapiens
ctgcagcccaccagacgtc

SEQ ID NO: 6144442 - DNA, 23 bp, Homo sapiens
ctgcagcccagaacgggcctccc

SEQ ID NO: 6144443 - DNA, 16 bp, Homo sapiens
ctgcagcccagggacc

SEQ ID NO: 6144444 - DNA, 21 bp, Homo sapiens
ctgcagccccacccagatgcc

SEQ ID NO: 6144445 - DNA, 18 bp, Homo sapiens
ctgcagccccagaagaaa

SEQ ID NO: 6144446 - DNA, 15 bp, Homo sapiens
ctgcagccccaggcc

SEQ ID NO: 6144447 - DNA, 17 bp, Homo sapiens
ctgcagccccaggcctc

SEQ ID NO: 6144448 - DNA, 12 bp, Homo sapiens
ctgcagccccct

SEQ ID NO: 6144449 - DNA, 15 bp, Homo sapiens
ctgcagccccctgct

SEQ ID NO: 6144450 - DNA, 19 bp, Homo sapiens
ctgcagcccctaagtgcaa

SEQ ID NO: 6144451 - DNA, 16 bp, Homo sapiens
ctgcagccctgccagt

SEQ ID NO: 6144452 - DNA, 17 bp, Homo sapiens
ctgcagccctggcccat

SEQ ID NO: 6144453 - DNA, 15 bp, Homo sapiens
ctgcagcccttgggc

SEQ ID NO: 6144454 - DNA, 16 bp, Homo sapiens
ctgcagcccttgggca

SEQ ID NO: 6144455 - DNA, 19 bp, Homo sapiens
ctgcagccggaggaggaga

SEQ ID NO: 6144456 - DNA, 20 bp, Homo sapiens
ctgcagccggaggaggagat

SEQ ID NO: 6144457 - DNA, 19 bp, Homo sapiens
ctgcagcctcaacctcctg

SEQ ID NO: 6144458 - DNA, 14 bp, Homo sapiens
ctgcagcctcagga

SEQ ID NO: 6144459 - DNA, 16 bp, Homo sapiens
ctgcagcctcaggact

SEQ ID NO: 6144460 - DNA, 18 bp, Homo sapiens
ctgcagcctcaggactgg

SEQ ID NO: 6144461 - DNA, 21 bp, Homo sapiens
ctgcagcctcatactcctggg

SEQ ID NO: 6144462 - DNA, 14 bp, Homo sapiens
ctgcagcctccact

SEQ ID NO: 6144463 - DNA, 14 bp, Homo sapiens
ctgcagcctccccc

SEQ ID NO: 6144464 - DNA, 22 bp, Homo sapiens
ctgcagcctccgcctcccgggt

SEQ ID NO: 6144465 - DNA, 21 bp, Homo sapiens
ctgcagcctccgcttccctgg

SEQ ID NO: 6144466 - DNA, 16 bp, Homo sapiens
ctgcagcctccggggt

SEQ ID NO: 6144467 - DNA, 17 bp, Homo sapiens
ctgcagcctccggggtt

SEQ ID NO: 6144468 - DNA, 16 bp, Homo sapiens
ctgcagcctcctcctg

SEQ ID NO: 6144469 - DNA, 18 bp, Homo sapiens
ctgcagcctccttctcct

SEQ ID NO: 6144470 - DNA, 21 bp, Homo sapiens
ctgcagcctcgaactcctggg

SEQ ID NO: 6144471 - DNA, 23 bp, Homo sapiens
ctgcagcctcgaactcctgggct

SEQ ID NO: 6144472 - DNA, 14 bp, Homo sapiens
ctgcagcctcggcc

SEQ ID NO: 6144473 - DNA, 14 bp, Homo sapiens
ctgcagcctgcagg

SEQ ID NO: 6144474 - DNA, 19 bp, Homo sapiens
ctgcagcctgcaggacctc

SEQ ID NO: 6144475 - DNA, 22 bp, Homo sapiens
ctgcagcctgctggggctaagc

SEQ ID NO: 6144476 - DNA, 12 bp, Homo sapiens
ctgcagcctggc

SEQ ID NO: 6144477 - DNA, 18 bp, Homo sapiens
ctgcagcctggctggtcc

SEQ ID NO: 6144478 - DNA, 19 bp, Homo sapiens
ctgcagcctggctggtcct

SEQ ID NO: 6144479 - DNA, 15 bp, Homo sapiens
ctgcagcctgggtct

SEQ ID NO: 6144480 - DNA, 19 bp, Homo sapiens
ctgcagccttcatcagaac

SEQ ID NO: 6144481 - DNA, 20 bp, Homo sapiens
ctgcagcctttgcctccccg

SEQ ID NO: 6144482 - DNA, 14 bp, Homo sapiens
ctgcagccttttct

SEQ ID NO: 6144483 - DNA, 19 bp, Homo sapiens
ctgcagccttttctggtcc

SEQ ID NO: 6144484 - DNA, 21 bp, Homo sapiens
ctgcagcgagctgagatcaca

SEQ ID NO: 6144485 - DNA, 15 bp, Homo sapiens
ctgcagcgcctccct

SEQ ID NO: 6144486 - DNA, 18 bp, Homo sapiens
ctgcagcgcctcccttgt

SEQ ID NO: 6144487 - DNA, 14 bp, Homo sapiens
ctgcagcgcgctcc

SEQ ID NO: 6144488 - DNA, 15 bp, Homo sapiens
ctgcagcgcgctcct

SEQ ID NO: 6144489 - DNA, 22 bp, Homo sapiens
ctgcagcggaagggactctggg

SEQ ID NO: 6144490 - DNA, 16 bp, Homo sapiens
ctgcagcggcagagca

SEQ ID NO: 6144491 - DNA, 15 bp, Homo sapiens
ctgcagcggctgccc

SEQ ID NO: 6144492 - DNA, 14 bp, Homo sapiens
ctgcagctaatttg

SEQ ID NO: 6144493 - DNA, 17 bp, Homo sapiens
ctgcagctaatttgtga

SEQ ID NO: 6144494 - DNA, 20 bp, Homo sapiens
ctgcagctatgcgcaatgtg

SEQ ID NO: 6144495 - DNA, 22 bp, Homo sapiens
ctgcagctatgcgcaatgtggc

SEQ ID NO: 6144496 - DNA, 23 bp, Homo sapiens
ctgcagctccctggcttctgtgg

SEQ ID NO: 6144497 - DNA, 16 bp, Homo sapiens
ctgcagctcctctgcc

SEQ ID NO: 6144498 - DNA, 18 bp, Homo sapiens
ctgcagctctcatgctgc

SEQ ID NO: 6144499 - DNA, 13 bp, Homo sapiens
ctgcagctgaccg

SEQ ID NO: 6144500 - DNA, 21 bp, Homo sapiens
ctgcagctgacctctgttgtc

SEQ ID NO: 6144501 - DNA, 18 bp, Homo sapiens
ctgcagctgatccatagg

SEQ ID NO: 6144502 - DNA, 10 bp, Homo sapiens
ctgcagctgc

SEQ ID NO: 6144503 - DNA, 15 bp, Homo sapiens
ctgcagctgcaccag

SEQ ID NO: 6144504 - DNA, 19 bp, Homo sapiens
ctgcagctgcaccatcaca

SEQ ID NO: 6144505 - DNA, 13 bp, Homo sapiens
ctgcagctgccgg

SEQ ID NO: 6144506 - DNA, 11 bp, Homo sapiens
ctgcagctgct

SEQ ID NO: 6144507 - DNA, 12 bp, Homo sapiens
ctgcagctgctg

SEQ ID NO: 6144508 - DNA, 15 bp, Homo sapiens
ctgcagctgctgaag

SEQ ID NO: 6144509 - DNA, 12 bp, Homo sapiens
ctgcagctggaa

SEQ ID NO: 6144510 - DNA, 19 bp, Homo sapiens
ctgcagctggaatgtgcca

SEQ ID NO: 6144511 - DNA, 23 bp, Homo sapiens
ctgcagctggaatgtgccacaga

SEQ ID NO: 6144512 - DNA, 18 bp, Homo sapiens
ctgcagctgggaagagga

SEQ ID NO: 6144513 - DNA, 17 bp, Homo sapiens
ctgcagctgggcagcag

SEQ ID NO: 6144514 - DNA, 14 bp, Homo sapiens
ctgcagctgggccc

SEQ ID NO: 6144515 - DNA, 19 bp, Homo sapiens
ctgcagctgggccccatgc

SEQ ID NO: 6144516 - DNA, 14 bp, Homo sapiens
ctgcagctgggctg

SEQ ID NO: 6144517 - DNA, 14 bp, Homo sapiens
ctgcagctgtgagt

SEQ ID NO: 6144518 - DNA, 11 bp, Homo sapiens
ctgcagcttcc

SEQ ID NO: 6144519 - DNA, 23 bp, Homo sapiens
ctgcagcttcggggcaagtgaga

SEQ ID NO: 6144520 - DNA, 21 bp, Homo sapiens
ctgcagcttctaactggtaaa

SEQ ID NO: 6144521 - DNA, 13 bp, Homo sapiens
ctgcagcttggag

SEQ ID NO: 6144522 - DNA, 12 bp, Homo sapiens
ctgcagcttggg

SEQ ID NO: 6144523 - DNA, 17 bp, Homo sapiens
ctgcagcttgtagccag

SEQ ID NO: 6144524 - DNA, 18 bp, Homo sapiens
ctgcagcttgtagccagc

SEQ ID NO: 6144525 - DNA, 19 bp, Homo sapiens
ctgcagcttgtagccagcc

SEQ ID NO: 6144526 - DNA, 20 bp, Homo sapiens
ctgcagcttgtagccagccg

SEQ ID NO: 6144527 - DNA, 12 bp, Homo sapiens
ctgcagctttac

SEQ ID NO: 6144528 - DNA, 17 bp, Homo sapiens
ctgcagctttctggaaa

SEQ ID NO: 6144529 - DNA, 19 bp, Homo sapiens
ctgcaggaacgagcactgg

SEQ ID NO: 6144530 - DNA, 20 bp, Homo sapiens
ctgcaggaacgagcactggc

SEQ ID NO: 6144531 - DNA, 21 bp, Homo sapiens
ctgcaggaacgagcactggcc

SEQ ID NO: 6144532 - DNA, 14 bp, Homo sapiens
ctgcaggaagaaac

SEQ ID NO: 6144533 - DNA, 18 bp, Homo sapiens
ctgcaggaaggagctgcc

SEQ ID NO: 6144534 - DNA, 15 bp, Homo sapiens
ctgcaggaatcaaaa

SEQ ID NO: 6144535 - DNA, 17 bp, Homo sapiens
ctgcaggaatcacccct

SEQ ID NO: 6144536 - DNA, 14 bp, Homo sapiens
ctgcaggaatgctg

SEQ ID NO: 6144537 - DNA, 14 bp, Homo sapiens
ctgcaggacacaga

SEQ ID NO: 6144538 - DNA, 21 bp, Homo sapiens
ctgcaggacagtcaaggtgat

SEQ ID NO: 6144539 - DNA, 15 bp, Homo sapiens
ctgcaggacattaat

SEQ ID NO: 6144540 - DNA, 21 bp, Homo sapiens
ctgcaggaccctgtcctgcag

SEQ ID NO: 6144541 - DNA, 15 bp, Homo sapiens
ctgcaggacctgcct

SEQ ID NO: 6144542 - DNA, 17 bp, Homo sapiens
ctgcaggacctgcctgt

SEQ ID NO: 6144543 - DNA, 16 bp, Homo sapiens
ctgcaggagcagggcg

SEQ ID NO: 6144544 - DNA, 22 bp, Homo sapiens
ctgcaggagcagtttgccaccc

SEQ ID NO: 6144545 - DNA, 14 bp, Homo sapiens
ctgcaggaggcctg

SEQ ID NO: 6144546 - DNA, 18 bp, Homo sapiens
ctgcaggaggcctgggag

SEQ ID NO: 6144547 - DNA, 13 bp, Homo sapiens
ctgcaggagggca

SEQ ID NO: 6144548 - DNA, 16 bp, Homo sapiens
ctgcaggagtgctggc

SEQ ID NO: 6144549 - DNA, 16 bp, Homo sapiens
ctgcaggagttaaaaa

SEQ ID NO: 6144550 - DNA, 13 bp, Homo sapiens
ctgcaggatcctt

SEQ ID NO: 6144551 - DNA, 20 bp, Homo sapiens
ctgcaggattctcaccagct

SEQ ID NO: 6144552 - DNA, 19 bp, Homo sapiens
ctgcaggcacacacgcctt

SEQ ID NO: 6144553 - DNA, 21 bp, Homo sapiens
ctgcaggcacacacgccttca

SEQ ID NO: 6144554 - DNA, 14 bp, Homo sapiens
ctgcaggcaccgct

SEQ ID NO: 6144555 - DNA, 20 bp, Homo sapiens
ctgcaggcaccgctgggttc

SEQ ID NO: 6144556 - DNA, 21 bp, Homo sapiens
ctgcaggcaccgggctggctg

SEQ ID NO: 6144557 - DNA, 12 bp, Homo sapiens
ctgcaggcagac

SEQ ID NO: 6144558 - DNA, 14 bp, Homo sapiens
ctgcaggcagacac

SEQ ID NO: 6144559 - DNA, 21 bp, Homo sapiens
ctgcaggcagagctggagccc

SEQ ID NO: 6144560 - DNA, 21 bp, Homo sapiens
ctgcaggcagatttactgtcc

SEQ ID NO: 6144561 - DNA, 13 bp, Homo sapiens
ctgcaggcagcca

SEQ ID NO: 6144562 - DNA, 17 bp, Homo sapiens
ctgcaggcagccaggcc

SEQ ID NO: 6144563 - DNA, 15 bp, Homo sapiens
ctgcaggcaggcaga

SEQ ID NO: 6144564 - DNA, 12 bp, Homo sapiens
ctgcaggcaggg

SEQ ID NO: 6144565 - DNA, 17 bp, Homo sapiens
ctgcaggcatcacagct

SEQ ID NO: 6144566 - DNA, 15 bp, Homo sapiens
ctgcaggccaagagc

SEQ ID NO: 6144567 - DNA, 18 bp, Homo sapiens
ctgcaggccaccagctgc

SEQ ID NO: 6144568 - DNA, 23 bp, Homo sapiens
ctgcaggccacccagggaccacg

SEQ ID NO: 6144569 - DNA, 15 bp, Homo sapiens
ctgcaggccactgtg

SEQ ID NO: 6144570 - DNA, 17 bp, Homo sapiens
ctgcaggccacttacct

SEQ ID NO: 6144571 - DNA, 12 bp, Homo sapiens
ctgcaggccagg

SEQ ID NO: 6144572 - DNA, 13 bp, Homo sapiens
ctgcaggccaggc

SEQ ID NO: 6144573 - DNA, 15 bp, Homo sapiens
ctgcaggccaggcca

SEQ ID NO: 6144574 - DNA, 17 bp, Homo sapiens
ctgcaggccaggccagc

SEQ ID NO: 6144575 - DNA, 23 bp, Homo sapiens
ctgcaggccaggccagctgcctc

SEQ ID NO: 6144576 - DNA, 13 bp, Homo sapiens
ctgcaggccagtc

SEQ ID NO: 6144577 - DNA, 12 bp, Homo sapiens
ctgcaggcccca

SEQ ID NO: 6144578 - DNA, 14 bp, Homo sapiens
ctgcaggccccagc

SEQ ID NO: 6144579 - DNA, 17 bp, Homo sapiens
ctgcaggccccagccaa

SEQ ID NO: 6144580 - DNA, 15 bp, Homo sapiens
ctgcaggccctccct

SEQ ID NO: 6144581 - DNA, 16 bp, Homo sapiens
ctgcaggccctggcct

SEQ ID NO: 6144582 - DNA, 23 bp, Homo sapiens
ctgcaggcctaggtgcagctcct

SEQ ID NO: 6144583 - DNA, 13 bp, Homo sapiens
ctgcaggcggggc

SEQ ID NO: 6144584 - DNA, 14 bp, Homo sapiens
ctgcaggcggggct

SEQ ID NO: 6144585 - DNA, 20 bp, Homo sapiens
ctgcaggcggggctcctcct

SEQ ID NO: 6144586 - DNA, 21 bp, Homo sapiens
ctgcaggcggggctcctcctg

SEQ ID NO: 6144587 - DNA, 22 bp, Homo sapiens
ctgcaggcggggctcctcctga

SEQ ID NO: 6144588 - DNA, 22 bp, Homo sapiens
ctgcaggcggtatccagaggtg

SEQ ID NO: 6144589 - DNA, 17 bp, Homo sapiens
ctgcaggcgtgacctga

SEQ ID NO: 6144590 - DNA, 12 bp, Homo sapiens
ctgcaggctcca

SEQ ID NO: 6144591 - DNA, 17 bp, Homo sapiens
ctgcaggctcccgagtg

SEQ ID NO: 6144592 - DNA, 16 bp, Homo sapiens
ctgcaggctgagccac

SEQ ID NO: 6144593 - DNA, 15 bp, Homo sapiens
aaatgtcttaatttt

SEQ ID NO: 6144594 - DNA, 16 bp, Homo sapiens
aaatgtcttatatagc

SEQ ID NO: 6144595 - DNA, 14 bp, Homo sapiens
aaatgtcttcctgg

SEQ ID NO: 6144596 - DNA, 16 bp, Homo sapiens
aaatgtcttctgtatt

SEQ ID NO: 6144597 - DNA, 18 bp, Homo sapiens
aaatgtcttctgtattca

SEQ ID NO: 6144598 - DNA, 13 bp, Homo sapiens
aaatgtcttgtgt

SEQ ID NO: 6144599 - DNA, 17 bp, Homo sapiens
aaatgtcttgtgtattt

SEQ ID NO: 6144600 - DNA, 14 bp, Homo sapiens
aaatgtctttgtaa

SEQ ID NO: 6144601 - DNA, 14 bp, Homo sapiens
aaatgtgaaaaaaa

SEQ ID NO: 6144602 - DNA, 21 bp, Homo sapiens
aaatgtgaaaaaaattattca

SEQ ID NO: 6144603 - DNA, 16 bp, Homo sapiens
aaatgtgaaaaactaa

SEQ ID NO: 6144604 - DNA, 14 bp, Homo sapiens
aaatgtgaaatctc

SEQ ID NO: 6144605 - DNA, 18 bp, Homo sapiens
aaatgtgaaatgctttta

SEQ ID NO: 6144606 - DNA, 17 bp, Homo sapiens
aaatgtgaagatgcatt

SEQ ID NO: 6144607 - DNA, 16 bp, Homo sapiens
aaatgtgaagggtggg

SEQ ID NO: 6144608 - DNA, 10 bp, Homo sapiens
aaatgtgaat

SEQ ID NO: 6144609 - DNA, 21 bp, Homo sapiens
aaatgtgaatggaaacttgga

SEQ ID NO: 6144610 - DNA, 15 bp, Homo sapiens
aaatgtgaattacta

SEQ ID NO: 6144611 - DNA, 16 bp, Homo sapiens
aaatgtgaattactaa

SEQ ID NO: 6144612 - DNA, 22 bp, Homo sapiens
aaatgtgaattactaacttcta

SEQ ID NO: 6144613 - DNA, 13 bp, Homo sapiens
aaatgtgaatttt

SEQ ID NO: 6144614 - DNA, 15 bp, Homo sapiens
aaatgtgaattttta

SEQ ID NO: 6144615 - DNA, 18 bp, Homo sapiens
aaatgtgaatttttattg

SEQ ID NO: 6144616 - DNA, 24 bp, Homo sapiens
aaatgtgactcagcatcacccacc

SEQ ID NO: 6144617 - DNA, 23 bp, Homo sapiens
aaatgtgatgcttataataaaga

SEQ ID NO: 6144618 - DNA, 13 bp, Homo sapiens
aaatgtgattttt

SEQ ID NO: 6144619 - DNA, 17 bp, Homo sapiens
aaatgtgatttttgtaa

SEQ ID NO: 6144620 - DNA, 23 bp, Homo sapiens
aaatgtgcattcttttaaaagac

SEQ ID NO: 6144621 - DNA, 14 bp, Homo sapiens
aaatgtgcattttg

SEQ ID NO: 6144622 - DNA, 16 bp, Homo sapiens
aaatgtgccatactaa

SEQ ID NO: 6144623 - DNA, 22 bp, Homo sapiens
aaatgtgcctattgctagagct

SEQ ID NO: 6144624 - DNA, 23 bp, Homo sapiens
aaatgtgcctcattaagaggcag

SEQ ID NO: 6144625 - DNA, 18 bp, Homo sapiens
aaatgtgccttcattttt

SEQ ID NO: 6144626 - DNA, 11 bp, Homo sapiens
aaatgtgctca

SEQ ID NO: 6144627 - DNA, 16 bp, Homo sapiens
aaatgtgcttcattgt

SEQ ID NO: 6144628 - DNA, 20 bp, Homo sapiens
aaatgtgcttcattgtttga

SEQ ID NO: 6144629 - DNA, 15 bp, Homo sapiens
aaatgtgcttttaaa

SEQ ID NO: 6144630 - DNA, 21 bp, Homo sapiens
aaatgtggaatgatgtatata

SEQ ID NO: 6144631 - DNA, 16 bp, Homo sapiens
aaatgtggatgtgatt

SEQ ID NO: 6144632 - DNA, 20 bp, Homo sapiens
aaatgtggattttgtagatg

SEQ ID NO: 6144633 - DNA, 15 bp, Homo sapiens
aaatgtggcaaaaaa

SEQ ID NO: 6144634 - DNA, 15 bp, Homo sapiens
aaatgtggtcctatt

SEQ ID NO: 6144635 - DNA, 21 bp, Homo sapiens
aaatgtggtcctatttaagcc

SEQ ID NO: 6144636 - DNA, 18 bp, Homo sapiens
aaatgtggtgagaatgca

SEQ ID NO: 6144637 - DNA, 22 bp, Homo sapiens
aaatgtggttttcctgaaatca

SEQ ID NO: 6144638 - DNA, 15 bp, Homo sapiens
aaatgtggtttttga

SEQ ID NO: 6144639 - DNA, 16 bp, Homo sapiens
aaatgtggtttttgat

SEQ ID NO: 6144640 - DNA, 12 bp, Homo sapiens
aaatgtgtaaat

SEQ ID NO: 6144641 - DNA, 20 bp, Homo sapiens
aaatgtgtaattcaaaagat

SEQ ID NO: 6144642 - DNA, 23 bp, Homo sapiens
aaatgtgtaattttgagtacaga

SEQ ID NO: 6144643 - DNA, 13 bp, Homo sapiens
aaatgtgtacata

SEQ ID NO: 6144644 - DNA, 17 bp, Homo sapiens
aaatgtgtataatttta

SEQ ID NO: 6144645 - DNA, 19 bp, Homo sapiens
aaatgtgtatctatttata

SEQ ID NO: 6144646 - DNA, 13 bp, Homo sapiens
aaatgtgtatgtg

SEQ ID NO: 6144647 - DNA, 15 bp, Homo sapiens
aaatgtgtattctgg

SEQ ID NO: 6144648 - DNA, 17 bp, Homo sapiens
aaatgtgtatttcttaa

SEQ ID NO: 6144649 - DNA, 22 bp, Homo sapiens
aaatgtgtatttcttaagaatt

SEQ ID NO: 6144650 - DNA, 20 bp, Homo sapiens
aaatgtgtcagaataggaaa

SEQ ID NO: 6144651 - DNA, 22 bp, Homo sapiens
aaatgtgtgtaaaaaagtgttc

SEQ ID NO: 6144652 - DNA, 18 bp, Homo sapiens
aaatgtgtgtattcttaa

SEQ ID NO: 6144653 - DNA, 19 bp, Homo sapiens
aaatgtgtgtgatgtgaca

SEQ ID NO: 6144654 - DNA, 12 bp, Homo sapiens
aaatgtgttgtt

SEQ ID NO: 6144655 - DNA, 13 bp, Homo sapiens
aaatgtgtttctg

SEQ ID NO: 6144656 - DNA, 18 bp, Homo sapiens
aaatgtgttttgtctttt

SEQ ID NO: 6144657 - DNA, 14 bp, Homo sapiens
aaatgtgtttttca

SEQ ID NO: 6144658 - DNA, 17 bp, Homo sapiens
aaatgtgtttttctata

SEQ ID NO: 6144659 - DNA, 21 bp, Homo sapiens
aaatgtgtttttctatatagt

SEQ ID NO: 6144660 - DNA, 13 bp, Homo sapiens
aaatgttaaaaca

SEQ ID NO: 6144661 - DNA, 19 bp, Homo sapiens
aaatgttaaaagttttata

SEQ ID NO: 6144662 - DNA, 23 bp, Homo sapiens
aaatgttaaaagttttatatgct

SEQ ID NO: 6144663 - DNA, 12 bp, Homo sapiens
aaatgttaaaga

SEQ ID NO: 6144664 - DNA, 14 bp, Homo sapiens
aaatgttaagaaag

SEQ ID NO: 6144665 - DNA, 20 bp, Homo sapiens
aaatgttaagttgatggtga

SEQ ID NO: 6144666 - DNA, 22 bp, Homo sapiens
aaatgttaataaaggtttcgtt

SEQ ID NO: 6144667 - DNA, 14 bp, Homo sapiens
aaatgttacaaaaa

SEQ ID NO: 6144668 - DNA, 16 bp, Homo sapiens
aaatgttacacattaa

SEQ ID NO: 6144669 - DNA, 18 bp, Homo sapiens
aaatgttacatagtgtag

SEQ ID NO: 6144670 - DNA, 19 bp, Homo sapiens
aaatgttacctaattatta

SEQ ID NO: 6144671 - DNA, 17 bp, Homo sapiens
aaatgttacctctgaat

SEQ ID NO: 6144672 - DNA, 23 bp, Homo sapiens
aaatgttactccctgttttagtt

SEQ ID NO: 6144673 - DNA, 21 bp, Homo sapiens
aaatgttacttctgatacttt

SEQ ID NO: 6144674 - DNA, 20 bp, Homo sapiens
aaatgttagacttgtgtgca

SEQ ID NO: 6144675 - DNA, 21 bp, Homo sapiens
aaatgttagacttgtgtgcat

SEQ ID NO: 6144676 - DNA, 12 bp, Homo sapiens
aaatgttagttc

SEQ ID NO: 6144677 - DNA, 13 bp, Homo sapiens
aaatgttagttct

SEQ ID NO: 6144678 - DNA, 14 bp, Homo sapiens
aaatgttagttcta

SEQ ID NO: 6144679 - DNA, 16 bp, Homo sapiens
aaatgttagtttcttg

SEQ ID NO: 6144680 - DNA, 17 bp, Homo sapiens
aaatgttagtttcttgg

SEQ ID NO: 6144681 - DNA, 15 bp, Homo sapiens
aaatgttataaagta

SEQ ID NO: 6144682 - DNA, 21 bp, Homo sapiens
aaatgttatcttatactgtac

SEQ ID NO: 6144683 - DNA, 11 bp, Homo sapiens
aaatgttatga

SEQ ID NO: 6144684 - DNA, 22 bp, Homo sapiens
aaatgttatgactatgtaaact

SEQ ID NO: 6144685 - DNA, 16 bp, Homo sapiens
aaatgttattatctgg

SEQ ID NO: 6144686 - DNA, 18 bp, Homo sapiens
aaatgttattcaataact

SEQ ID NO: 6144687 - DNA, 14 bp, Homo sapiens
aaatgttatttccc

SEQ ID NO: 6144688 - DNA, 22 bp, Homo sapiens
aaatgttatttccctacattaa

SEQ ID NO: 6144689 - DNA, 15 bp, Homo sapiens
aaatgttatttctgc

SEQ ID NO: 6144690 - DNA, 20 bp, Homo sapiens
aaatgttattttttaattat

SEQ ID NO: 6144691 - DNA, 21 bp, Homo sapiens
aaatgttattttttaattatt

SEQ ID NO: 6144692 - DNA, 13 bp, Homo sapiens
aaatgttcatcaa

SEQ ID NO: 6144693 - DNA, 18 bp, Homo sapiens
aaatgttcatcaattccc

SEQ ID NO: 6144694 - DNA, 17 bp, Homo sapiens
aaatgttcattctatga

SEQ ID NO: 6144695 - DNA, 19 bp, Homo sapiens
aaatgttctaagtttctaa

SEQ ID NO: 6144696 - DNA, 21 bp, Homo sapiens
aaatgttctaagtttctaaga

SEQ ID NO: 6144697 - DNA, 21 bp, Homo sapiens
aaatgttctatttaacaactg

SEQ ID NO: 6144698 - DNA, 13 bp, Homo sapiens
aaatgttctgtca

SEQ ID NO: 6144699 - DNA, 11 bp, Homo sapiens
aaatgttcttt

SEQ ID NO: 6144700 - DNA, 22 bp, Homo sapiens
aaatgttgacatgggacatttg

SEQ ID NO: 6144701 - DNA, 22 bp, Homo sapiens
aaatgttgagaagcgtttttaa

SEQ ID NO: 6144702 - DNA, 23 bp, Homo sapiens
aaatgttgatcttccactgcaaa

SEQ ID NO: 6144703 - DNA, 18 bp, Homo sapiens
aaatgttgcacatcattc

SEQ ID NO: 6144704 - DNA, 19 bp, Homo sapiens
aaatgttggaattttcaaa

SEQ ID NO: 6144705 - DNA, 20 bp, Homo sapiens
aaatgttggatttataaatg

SEQ ID NO: 6144706 - DNA, 19 bp, Homo sapiens
aaatgttggtcattttatg

SEQ ID NO: 6144707 - DNA, 13 bp, Homo sapiens
aaatgttgtattg

SEQ ID NO: 6144708 - DNA, 17 bp, Homo sapiens
aaatgtttaaacatttt

SEQ ID NO: 6144709 - DNA, 17 bp, Homo sapiens
aaatgtttaatcatata

SEQ ID NO: 6144710 - DNA, 21 bp, Homo sapiens
aaatgtttacagggagcctcc

SEQ ID NO: 6144711 - DNA, 21 bp, Homo sapiens
aaatgtttacattttctttca

SEQ ID NO: 6144712 - DNA, 18 bp, Homo sapiens
aaatgtttactatagacc

SEQ ID NO: 6144713 - DNA, 18 bp, Homo sapiens
aaatgtttactgtaaatt

SEQ ID NO: 6144714 - DNA, 17 bp, Homo sapiens
aaatgtttatacaataa

SEQ ID NO: 6144715 - DNA, 20 bp, Homo sapiens
aaatgtttatacaataattt

SEQ ID NO: 6144716 - DNA, 15 bp, Homo sapiens
aaatgtttatttaaa

SEQ ID NO: 6144717 - DNA, 17 bp, Homo sapiens
aaatgtttatttaaaag

SEQ ID NO: 6144718 - DNA, 13 bp, Homo sapiens
aaatgtttcaaaa

SEQ ID NO: 6144719 - DNA, 19 bp, Homo sapiens
aaatgtttcaaaatagaca

SEQ ID NO: 6144720 - DNA, 19 bp, Homo sapiens
aaatgtttcactatgattt

SEQ ID NO: 6144721 - DNA, 14 bp, Homo sapiens
aaatgtttcataca

SEQ ID NO: 6144722 - DNA, 13 bp, Homo sapiens
aaatgtttcatga

SEQ ID NO: 6144723 - DNA, 18 bp, Homo sapiens
aaatgtttcatgaagaaa

SEQ ID NO: 6144724 - DNA, 17 bp, Homo sapiens
aaatgtttcattttcat

SEQ ID NO: 6144725 - DNA, 10 bp, Homo sapiens
aaatgtttcc

SEQ ID NO: 6144726 - DNA, 18 bp, Homo sapiens
aaatgtttcccccactcc

SEQ ID NO: 6144727 - DNA, 15 bp, Homo sapiens
aaatgtttccttaaa

SEQ ID NO: 6144728 - DNA, 19 bp, Homo sapiens
aaatgtttccttaaacatg

SEQ ID NO: 6144729 - DNA, 14 bp, Homo sapiens
aaatgtttccttgt

SEQ ID NO: 6144730 - DNA, 18 bp, Homo sapiens
aaatgtttccttttagtt

SEQ ID NO: 6144731 - DNA, 15 bp, Homo sapiens
aaatgtttctgcagt

SEQ ID NO: 6144732 - DNA, 14 bp, Homo sapiens
aaatgtttctgtgt

SEQ ID NO: 6144733 - DNA, 13 bp, Homo sapiens
aaatgtttctttt

SEQ ID NO: 6144734 - DNA, 15 bp, Homo sapiens
aaatgtttcttttaa

SEQ ID NO: 6144735 - DNA, 18 bp, Homo sapiens
aaatgtttcttttaaaga

SEQ ID NO: 6144736 - DNA, 18 bp, Homo sapiens
aaatgtttcttttccctt

SEQ ID NO: 6144737 - DNA, 14 bp, Homo sapiens
aaatgtttcttttg

SEQ ID NO: 6144738 - DNA, 23 bp, Homo sapiens
aaatgtttctttttcttttttga

SEQ ID NO: 6144739 - DNA, 14 bp, Homo sapiens
aaatgtttgacaca

SEQ ID NO: 6144740 - DNA, 10 bp, Homo sapiens
aaatgtttgg

SEQ ID NO: 6144741 - DNA, 12 bp, Homo sapiens
aaatgtttggaa

SEQ ID NO: 6144742 - DNA, 20 bp, Homo sapiens
aaatgtttggaatttaagaa

SEQ ID NO: 6144743 - DNA, 19 bp, Homo sapiens
aaatgtttggatggtttgt

SEQ ID NO: 6144744 - DNA, 18 bp, Homo sapiens
aaatgtttgttatttaca

SEQ ID NO: 6144745 - DNA, 22 bp, Homo sapiens
aaatgtttgttatttacactgg

SEQ ID NO: 6144746 - DNA, 14 bp, Homo sapiens
aaatgttttaatgc

SEQ ID NO: 6144747 - DNA, 18 bp, Homo sapiens
aaatgttttagcaattta

SEQ ID NO: 6144748 - DNA, 12 bp, Homo sapiens
aaatgttttatg

SEQ ID NO: 6144749 - DNA, 19 bp, Homo sapiens
aaatgttttatgacatttt

SEQ ID NO: 6144750 - DNA, 14 bp, Homo sapiens
aaatgttttcagct

SEQ ID NO: 6144751 - DNA, 15 bp, Homo sapiens
aaatgttttcattgg

SEQ ID NO: 6144752 - DNA, 22 bp, Homo sapiens
aaatgttttcattttactggta

SEQ ID NO: 6144753 - DNA, 14 bp, Homo sapiens
aaatgttttgtaaa

SEQ ID NO: 6144754 - DNA, 20 bp, Homo sapiens
aaatgttttgtaaacattta

SEQ ID NO: 6144755 - DNA, 16 bp, Homo sapiens
aaatgttttgtaaact

SEQ ID NO: 6144756 - DNA, 19 bp, Homo sapiens
aaatgttttgtaaactttg

SEQ ID NO: 6144757 - DNA, 21 bp, Homo sapiens
aaatgttttgtaaactttgaa

SEQ ID NO: 6144758 - DNA, 12 bp, Homo sapiens
aaatgtttttaa

SEQ ID NO: 6144759 - DNA, 21 bp, Homo sapiens
aaatgtttttaataaaagaaa

SEQ ID NO: 6144760 - DNA, 17 bp, Homo sapiens
aaatgtttttatttttg

SEQ ID NO: 6144761 - DNA, 23 bp, Homo sapiens
aaatgtttttggtcttttataat

SEQ ID NO: 6144762 - DNA, 12 bp, Homo sapiens
aaattaaaaaaa

SEQ ID NO: 6144763 - DNA, 14 bp, Homo sapiens
aaattaaaaaagaa

SEQ ID NO: 6144764 - DNA, 14 bp, Homo sapiens
aaattaaaaaagat

SEQ ID NO: 6144765 - DNA, 20 bp, Homo sapiens
aaattaaaaaagataaacac

SEQ ID NO: 6144766 - DNA, 15 bp, Homo sapiens
aaattaaaaaagctg

SEQ ID NO: 6144767 - DNA, 18 bp, Homo sapiens
aaattaaaaaatgaaatt

SEQ ID NO: 6144768 - DNA, 16 bp, Homo sapiens
aaattaaaaatttttt

SEQ ID NO: 6144769 - DNA, 15 bp, Homo sapiens
aaattaaaacaaata

SEQ ID NO: 6144770 - DNA, 21 bp, Homo sapiens
aaattaaaagtttgaaaagca

SEQ ID NO: 6144771 - DNA, 13 bp, Homo sapiens
aaattaaaataac

SEQ ID NO: 6144772 - DNA, 16 bp, Homo sapiens
aaattaaaataggcat

SEQ ID NO: 6144773 - DNA, 11 bp, Homo sapiens
ctgcaggctgg

SEQ ID NO: 6144774 - DNA, 16 bp, Homo sapiens
ctgcaggctggggagg

SEQ ID NO: 6144775 - DNA, 15 bp, Homo sapiens
ctgcagggacacggg

SEQ ID NO: 6144776 - DNA, 17 bp, Homo sapiens
ctgcagggactgccagt

SEQ ID NO: 6144777 - DNA, 12 bp, Homo sapiens
ctgcagggagca

SEQ ID NO: 6144778 - DNA, 15 bp, Homo sapiens
ctgcagggagcaact

SEQ ID NO: 6144779 - DNA, 20 bp, Homo sapiens
ctgcagggagcaccacggcc

SEQ ID NO: 6144780 - DNA, 22 bp, Homo sapiens
ctgcagggagcaccacggccag

SEQ ID NO: 6144781 - DNA, 13 bp, Homo sapiens
ctgcagggagcag

SEQ ID NO: 6144782 - DNA, 17 bp, Homo sapiens
ctgcagggagccttctg

SEQ ID NO: 6144783 - DNA, 20 bp, Homo sapiens
ctgcagggagccttctgcca

SEQ ID NO: 6144784 - DNA, 17 bp, Homo sapiens
ctgcagggcacggggac

SEQ ID NO: 6144785 - DNA, 18 bp, Homo sapiens
ctgcagggcacggggacc

SEQ ID NO: 6144786 - DNA, 14 bp, Homo sapiens
ctgcagggcagcct

SEQ ID NO: 6144787 - DNA, 21 bp, Homo sapiens
ctgcagggccaggactgagcc

SEQ ID NO: 6144788 - DNA, 22 bp, Homo sapiens
ctgcagggccatctgactgcca

SEQ ID NO: 6144789 - DNA, 19 bp, Homo sapiens
ctgcagggccatggctcag

SEQ ID NO: 6144790 - DNA, 21 bp, Homo sapiens
ctgcagggccatggctcaggg

SEQ ID NO: 6144791 - DNA, 23 bp, Homo sapiens
ctgcagggccatggctcagggtg

SEQ ID NO: 6144792 - DNA, 22 bp, Homo sapiens
ctgcagggccctcccttttccc

SEQ ID NO: 6144793 - DNA, 19 bp, Homo sapiens
ctgcagggccgcgagaggc

SEQ ID NO: 6144794 - DNA, 13 bp, Homo sapiens
ctgcagggcctct

SEQ ID NO: 6144795 - DNA, 10 bp, Homo sapiens
ctgcagggct

SEQ ID NO: 6144796 - DNA, 19 bp, Homo sapiens
ctgcagggctcccatgggc

SEQ ID NO: 6144797 - DNA, 13 bp, Homo sapiens
ctgcagggctgct

SEQ ID NO: 6144798 - DNA, 18 bp, Homo sapiens
ctgcagggctttaaaatt

SEQ ID NO: 6144799 - DNA, 13 bp, Homo sapiens
ctgcaggggcagg

SEQ ID NO: 6144800 - DNA, 11 bp, Homo sapiens
ctgcaggggcc

SEQ ID NO: 6144801 - DNA, 15 bp, Homo sapiens
ctgcaggggcctctg

SEQ ID NO: 6144802 - DNA, 14 bp, Homo sapiens
ctgcaggggcctgg

SEQ ID NO: 6144803 - DNA, 18 bp, Homo sapiens
ctgcaggggcctggagga

SEQ ID NO: 6144804 - DNA, 17 bp, Homo sapiens
ctgcaggggctctggag

SEQ ID NO: 6144805 - DNA, 18 bp, Homo sapiens
ctgcaggggctctggaga

SEQ ID NO: 6144806 - DNA, 15 bp, Homo sapiens
ctgcagggggaggag

SEQ ID NO: 6144807 - DNA, 20 bp, Homo sapiens
ctgcagggggtgtgtctgct

SEQ ID NO: 6144808 - DNA, 16 bp, Homo sapiens
ctgcagggtgaagcac

SEQ ID NO: 6144809 - DNA, 13 bp, Homo sapiens
ctgcagggtgacg

SEQ ID NO: 6144810 - DNA, 20 bp, Homo sapiens
ctgcagggtgacgcctgaga

SEQ ID NO: 6144811 - DNA, 22 bp, Homo sapiens
ctgcagggtgacgcctgagaca

SEQ ID NO: 6144812 - DNA, 16 bp, Homo sapiens
ctgcagggtggcatct

SEQ ID NO: 6144813 - DNA, 16 bp, Homo sapiens
ctgcagggtggtgctg

SEQ ID NO: 6144814 - DNA, 18 bp, Homo sapiens
ctgcagggtggtgctggg

SEQ ID NO: 6144815 - DNA, 21 bp, Homo sapiens
ctgcagggtggtgctgggact

SEQ ID NO: 6144816 - DNA, 15 bp, Homo sapiens
ctgcaggtacttcct

SEQ ID NO: 6144817 - DNA, 16 bp, Homo sapiens
ctgcaggtacttcctc

SEQ ID NO: 6144818 - DNA, 19 bp, Homo sapiens
ctgcaggtacttcctcctg

SEQ ID NO: 6144819 - DNA, 15 bp, Homo sapiens
ctgcaggtcagttgt

SEQ ID NO: 6144820 - DNA, 20 bp, Homo sapiens
ctgcaggtcagttgtaataa

SEQ ID NO: 6144821 - DNA, 21 bp, Homo sapiens
ctgcaggtcagtttggaatga

SEQ ID NO: 6144822 - DNA, 12 bp, Homo sapiens
ctgcaggtccct

SEQ ID NO: 6144823 - DNA, 13 bp, Homo sapiens
ctgcaggtcccta

SEQ ID NO: 6144824 - DNA, 16 bp, Homo sapiens
ctgcaggtccctaata

SEQ ID NO: 6144825 - DNA, 16 bp, Homo sapiens
ctgcaggtccggggag

SEQ ID NO: 6144826 - DNA, 18 bp, Homo sapiens
ctgcaggtgagcagacag

SEQ ID NO: 6144827 - DNA, 17 bp, Homo sapiens
ctgcaggtgagcaggca

SEQ ID NO: 6144828 - DNA, 18 bp, Homo sapiens
ctgcaggtgagcaggcag

SEQ ID NO: 6144829 - DNA, 13 bp, Homo sapiens
ctgcaggtgccag

SEQ ID NO: 6144830 - DNA, 15 bp, Homo sapiens
ctgcaggtgccaggg

SEQ ID NO: 6144831 - DNA, 21 bp, Homo sapiens
ctgcaggtgccagggcccacc

SEQ ID NO: 6144832 - DNA, 22 bp, Homo sapiens
ctgcaggtgccagggcccaccc

SEQ ID NO: 6144833 - DNA, 15 bp, Homo sapiens
ctgcaggtgctgctg

SEQ ID NO: 6144834 - DNA, 22 bp, Homo sapiens
ctgcaggtgggactttgttgtt

SEQ ID NO: 6144835 - DNA, 13 bp, Homo sapiens
ctgcaggtgggct

SEQ ID NO: 6144836 - DNA, 19 bp, Homo sapiens
ctgcaggtgggctgctgag

SEQ ID NO: 6144837 - DNA, 18 bp, Homo sapiens
ctgcaggtgggctgggcc

SEQ ID NO: 6144838 - DNA, 19 bp, Homo sapiens
ctgcaggtgggctgggccc

SEQ ID NO: 6144839 - DNA, 17 bp, Homo sapiens
ctgcaggttgaagccat

SEQ ID NO: 6144840 - DNA, 21 bp, Homo sapiens
ctgcaggttggaccccagaga

SEQ ID NO: 6144841 - DNA, 15 bp, Homo sapiens
ctgcaggtttctcct

SEQ ID NO: 6144842 - DNA, 19 bp, Homo sapiens
ctgcaggtttgacacgcag

SEQ ID NO: 6144843 - DNA, 13 bp, Homo sapiens
ctgcaggtttgta

SEQ ID NO: 6144844 - DNA, 15 bp, Homo sapiens
ctgcagtaaaacaca

SEQ ID NO: 6144845 - DNA, 16 bp, Homo sapiens
ctgcagtaacactggc

SEQ ID NO: 6144846 - DNA, 23 bp, Homo sapiens
ctgcagtacatacgtctgccagg

SEQ ID NO: 6144847 - DNA, 17 bp, Homo sapiens
ctgcagtagaaggtgcc

SEQ ID NO: 6144848 - DNA, 15 bp, Homo sapiens
ctgcagtagtctctg

SEQ ID NO: 6144849 - DNA, 16 bp, Homo sapiens
ctgcagtattctgtag

SEQ ID NO: 6144850 - DNA, 17 bp, Homo sapiens
ctgcagtatttataaga

SEQ ID NO: 6144851 - DNA, 17 bp, Homo sapiens
ctgcagtcaacagttca

SEQ ID NO: 6144852 - DNA, 18 bp, Homo sapiens
ctgcagtcacatcacaat

SEQ ID NO: 6144853 - DNA, 15 bp, Homo sapiens
ctgcagtcacccctg

SEQ ID NO: 6144854 - DNA, 20 bp, Homo sapiens
ctgcagtcacccctgtctgc

SEQ ID NO: 6144855 - DNA, 19 bp, Homo sapiens
ctgcagtcacttcgtggga

SEQ ID NO: 6144856 - DNA, 22 bp, Homo sapiens
ctgcagtcacttcgtgggatct

SEQ ID NO: 6144857 - DNA, 17 bp, Homo sapiens
ctgcagtcagcacagag

SEQ ID NO: 6144858 - DNA, 18 bp, Homo sapiens
ctgcagtcagggcccaga

SEQ ID NO: 6144859 - DNA, 21 bp, Homo sapiens
ctgcagtcagtcatgatggca

SEQ ID NO: 6144860 - DNA, 16 bp, Homo sapiens
ctgcagtcatctcccc

SEQ ID NO: 6144861 - DNA, 21 bp, Homo sapiens
ctgcagtcccacactgtgcag

SEQ ID NO: 6144862 - DNA, 14 bp, Homo sapiens
ctgcagtcctccgg

SEQ ID NO: 6144863 - DNA, 19 bp, Homo sapiens
ctgcagtcctccggttgca

SEQ ID NO: 6144864 - DNA, 21 bp, Homo sapiens
ctgcagtcctcggcagctccg

SEQ ID NO: 6144865 - DNA, 22 bp, Homo sapiens
ctgcagtcctcggcagctccgg

SEQ ID NO: 6144866 - DNA, 14 bp, Homo sapiens
ctgcagtcctggtg

SEQ ID NO: 6144867 - DNA, 15 bp, Homo sapiens
ctgcagtcgcttgcc

SEQ ID NO: 6144868 - DNA, 17 bp, Homo sapiens
ctgcagtcggcatgcca

SEQ ID NO: 6144869 - DNA, 18 bp, Homo sapiens
ctgcagtcggcatgccag

SEQ ID NO: 6144870 - DNA, 16 bp, Homo sapiens
ctgcagtctcatttct

SEQ ID NO: 6144871 - DNA, 18 bp, Homo sapiens
ctgcagtctcatttctca

SEQ ID NO: 6144872 - DNA, 19 bp, Homo sapiens
ctgcagtctcatttctcat

SEQ ID NO: 6144873 - DNA, 17 bp, Homo sapiens
ctgcagtctctatacca

SEQ ID NO: 6144874 - DNA, 14 bp, Homo sapiens
ctgcagtctgcaga

SEQ ID NO: 6144875 - DNA, 20 bp, Homo sapiens
ctgcagtctggctgagccct

SEQ ID NO: 6144876 - DNA, 15 bp, Homo sapiens
ctgcagtctgtggag

SEQ ID NO: 6144877 - DNA, 18 bp, Homo sapiens
ctgcagtcttctctctgg

SEQ ID NO: 6144878 - DNA, 18 bp, Homo sapiens
ctgcagtgaatttgaata

SEQ ID NO: 6144879 - DNA, 15 bp, Homo sapiens
ctgcagtgaccactt

SEQ ID NO: 6144880 - DNA, 16 bp, Homo sapiens
ctgcagtgaggctgta

SEQ ID NO: 6144881 - DNA, 18 bp, Homo sapiens
ctgcagtgaggggccctc

SEQ ID NO: 6144882 - DNA, 20 bp, Homo sapiens
ctgcagtgaggggccctcca

SEQ ID NO: 6144883 - DNA, 22 bp, Homo sapiens
ctgcagtgaggggccctccatg

SEQ ID NO: 6144884 - DNA, 14 bp, Homo sapiens
ctgcagtgattcag

SEQ ID NO: 6144885 - DNA, 18 bp, Homo sapiens
ctgcagtgccagctccct

SEQ ID NO: 6144886 - DNA, 16 bp, Homo sapiens
ctgcagtgcctggaaa

SEQ ID NO: 6144887 - DNA, 17 bp, Homo sapiens
ctgcagtggagaagaca

SEQ ID NO: 6144888 - DNA, 14 bp, Homo sapiens
ctgcagtggcctga

SEQ ID NO: 6144889 - DNA, 21 bp, Homo sapiens
ctgcagtggcctgatctctgc

SEQ ID NO: 6144890 - DNA, 22 bp, Homo sapiens
ctgcagtgggttctccaaacta

SEQ ID NO: 6144891 - DNA, 15 bp, Homo sapiens
ctgcagtgtgccccc

SEQ ID NO: 6144892 - DNA, 13 bp, Homo sapiens
ctgcagtgttatt

SEQ ID NO: 6144893 - DNA, 18 bp, Homo sapiens
ctgcagtgttcgcttggc

SEQ ID NO: 6144894 - DNA, 20 bp, Homo sapiens
ctgcagtgttcgcttggctc

SEQ ID NO: 6144895 - DNA, 18 bp, Homo sapiens
ctgcagtgttctgtgaat

SEQ ID NO: 6144896 - DNA, 22 bp, Homo sapiens
ctgcagtgttctgtgaatagca

SEQ ID NO: 6144897 - DNA, 13 bp, Homo sapiens
ctgcagttaatta

SEQ ID NO: 6144898 - DNA, 16 bp, Homo sapiens
ctgcagttaattagca

SEQ ID NO: 6144899 - DNA, 15 bp, Homo sapiens
ctgcagttaccacag

SEQ ID NO: 6144900 - DNA, 16 bp, Homo sapiens
ctgcagttaccacagc

SEQ ID NO: 6144901 - DNA, 16 bp, Homo sapiens
ctgcagttagcacaga

SEQ ID NO: 6144902 - DNA, 17 bp, Homo sapiens
ctgcagttagcacagag

SEQ ID NO: 6144903 - DNA, 20 bp, Homo sapiens
ctgcagttagcacagaggat

SEQ ID NO: 6144904 - DNA, 17 bp, Homo sapiens
ctgcagttcgactctgt

SEQ ID NO: 6144905 - DNA, 20 bp, Homo sapiens
ctgcagttcttgtggaagac

SEQ ID NO: 6144906 - DNA, 17 bp, Homo sapiens
ctgcagttgaagagcct

SEQ ID NO: 6144907 - DNA, 14 bp, Homo sapiens
ctgcagttgacttt

SEQ ID NO: 6144908 - DNA, 13 bp, Homo sapiens
ctgcagttgccag

SEQ ID NO: 6144909 - DNA, 17 bp, Homo sapiens
ctgcagttgccagtcac

SEQ ID NO: 6144910 - DNA, 19 bp, Homo sapiens
ctgcagttgccagtcaccc

SEQ ID NO: 6144911 - DNA, 22 bp, Homo sapiens
ctgcagttgccagtcaccccgg

SEQ ID NO: 6144912 - DNA, 22 bp, Homo sapiens
ctgcagtttcctcatctgtcac

SEQ ID NO: 6144913 - DNA, 19 bp, Homo sapiens
ctgcagtttgagacaggag

SEQ ID NO: 6144914 - DNA, 16 bp, Homo sapiens
ctgcagtttggccctg

SEQ ID NO: 6144915 - DNA, 16 bp, Homo sapiens
ctgcagtttgtgaact

SEQ ID NO: 6144916 - DNA, 16 bp, Homo sapiens
ctgcagtttttcccaa

SEQ ID NO: 6144917 - DNA, 20 bp, Homo sapiens
ctgcagtttttttccttcaa

SEQ ID NO: 6144918 - DNA, 22 bp, Homo sapiens
ctgcagtttttttccttcaaga

SEQ ID NO: 6144919 - DNA, 23 bp, Homo sapiens
ctgcagtttttttccttcaagaa

SEQ ID NO: 6144920 - DNA, 12 bp, Homo sapiens
ctgcataaactt

SEQ ID NO: 6144921 - DNA, 14 bp, Homo sapiens
ctgcataaatttgt

SEQ ID NO: 6144922 - DNA, 20 bp, Homo sapiens
ctgcataaatttgtaatata

SEQ ID NO: 6144923 - DNA, 20 bp, Homo sapiens
ctgcataagtgaaaatctta

SEQ ID NO: 6144924 - DNA, 22 bp, Homo sapiens
ctgcataatgtttctggatttc

SEQ ID NO: 6144925 - DNA, 22 bp, Homo sapiens
ctgcataattctgaagttatat

SEQ ID NO: 6144926 - DNA, 14 bp, Homo sapiens
ctgcatacaatctg

SEQ ID NO: 6144927 - DNA, 20 bp, Homo sapiens
ctgcatactttttaaatgta

SEQ ID NO: 6144928 - DNA, 18 bp, Homo sapiens
ctgcatagcgaaataaaa

SEQ ID NO: 6144929 - DNA, 19 bp, Homo sapiens
ctgcatagcgaaataaaaa

SEQ ID NO: 6144930 - DNA, 23 bp, Homo sapiens
ctgcatagcttgcacaacatcct

SEQ ID NO: 6144931 - DNA, 20 bp, Homo sapiens
ctgcataggagtttggagga

SEQ ID NO: 6144932 - DNA, 23 bp, Homo sapiens
ctgcataggagtttggaggaagt

SEQ ID NO: 6144933 - DNA, 14 bp, Homo sapiens
ctgcataggctcct

SEQ ID NO: 6144934 - DNA, 23 bp, Homo sapiens
ctgcataggctccttcctgtggg

SEQ ID NO: 6144935 - DNA, 16 bp, Homo sapiens
ctgcatagtctgttcc

SEQ ID NO: 6144936 - DNA, 16 bp, Homo sapiens
ctgcatatcggaggtg

SEQ ID NO: 6144937 - DNA, 22 bp, Homo sapiens
ctgcatatcggaggtggtggag

SEQ ID NO: 6144938 - DNA, 22 bp, Homo sapiens
ctgcatatgcttctgatggtgt

SEQ ID NO: 6144939 - DNA, 22 bp, Homo sapiens
ctgcatatgttttccacataaa

SEQ ID NO: 6144940 - DNA, 12 bp, Homo sapiens
ctgcatatttct

SEQ ID NO: 6144941 - DNA, 20 bp, Homo sapiens
ctgcatatttctgtatattt

SEQ ID NO: 6144942 - DNA, 14 bp, Homo sapiens
ctgcatcaagactt

SEQ ID NO: 6144943 - DNA, 20 bp, Homo sapiens
ctgcatcaagatgtgacatg

SEQ ID NO: 6144944 - DNA, 13 bp, Homo sapiens
ctgcatcacagcc

SEQ ID NO: 6144945 - DNA, 20 bp, Homo sapiens
ctgcatcacccaatcaataa

SEQ ID NO: 6144946 - DNA, 21 bp, Homo sapiens
ctgcatcacccaggctggagt

SEQ ID NO: 6144947 - DNA, 20 bp, Homo sapiens
ctgcatcagctgctgaaaca

SEQ ID NO: 6144948 - DNA, 18 bp, Homo sapiens
ctgcatcagctttttgta

SEQ ID NO: 6144949 - DNA, 15 bp, Homo sapiens
ctgcatccaggcctg

SEQ ID NO: 6144950 - DNA, 18 bp, Homo sapiens
ctgcatccaggcctgagg

SEQ ID NO: 6144951 - DNA, 12 bp, Homo sapiens
aaattaaacaat

SEQ ID NO: 6144952 - DNA, 16 bp, Homo sapiens
aaattaaacacaaagt

SEQ ID NO: 6144953 - DNA, 13 bp, Homo sapiens
aaattaaacatgc

SEQ ID NO: 6144954 - DNA, 15 bp, Homo sapiens
aaattaaagaaatga

SEQ ID NO: 6144955 - DNA, 13 bp, Homo sapiens
aaattaaagcagc

SEQ ID NO: 6144956 - DNA, 12 bp, Homo sapiens
aaattaaagccc

SEQ ID NO: 6144957 - DNA, 21 bp, Homo sapiens
aaattaaagcctttagtatca

SEQ ID NO: 6144958 - DNA, 15 bp, Homo sapiens
aaattaaagtgctgt

SEQ ID NO: 6144959 - DNA, 16 bp, Homo sapiens
aaattaaatatatgta

SEQ ID NO: 6144960 - DNA, 19 bp, Homo sapiens
aaattaaatatatgtatgt

SEQ ID NO: 6144961 - DNA, 12 bp, Homo sapiens
aaattaaatatt

SEQ ID NO: 6144962 - DNA, 15 bp, Homo sapiens
aaattaaatatttat

SEQ ID NO: 6144963 - DNA, 23 bp, Homo sapiens
aaattaaatctgtccctgagagt

SEQ ID NO: 6144964 - DNA, 12 bp, Homo sapiens
aaattaaatgcc

SEQ ID NO: 6144965 - DNA, 23 bp, Homo sapiens
aaattaaatgccttgtataaaat

SEQ ID NO: 6144966 - DNA, 14 bp, Homo sapiens
aaattaaatggatt

SEQ ID NO: 6144967 - DNA, 22 bp, Homo sapiens
aaattaaattcttattggccaa

SEQ ID NO: 6144968 - DNA, 14 bp, Homo sapiens
aaattaaattgggc

SEQ ID NO: 6144969 - DNA, 16 bp, Homo sapiens
aaattaaattttagat

SEQ ID NO: 6144970 - DNA, 12 bp, Homo sapiens
aaattaacaaga

SEQ ID NO: 6144971 - DNA, 17 bp, Homo sapiens
aaattaacaataaagaa

SEQ ID NO: 6144972 - DNA, 11 bp, Homo sapiens
aaattaacaca

SEQ ID NO: 6144973 - DNA, 12 bp, Homo sapiens
aaattaacactg

SEQ ID NO: 6144974 - DNA, 13 bp, Homo sapiens
aaattaacactgc

SEQ ID NO: 6144975 - DNA, 21 bp, Homo sapiens
aaattaacactgcttgtgttt

SEQ ID NO: 6144976 - DNA, 16 bp, Homo sapiens
aaattaacattatatt

SEQ ID NO: 6144977 - DNA, 20 bp, Homo sapiens
aaattaaccgagacacttta

SEQ ID NO: 6144978 - DNA, 13 bp, Homo sapiens
aaattaactgctc

SEQ ID NO: 6144979 - DNA, 16 bp, Homo sapiens
aaattaacttctattt

SEQ ID NO: 6144980 - DNA, 13 bp, Homo sapiens
aaattaactttta

SEQ ID NO: 6144981 - DNA, 23 bp, Homo sapiens
aaattaacttttataaactttac

SEQ ID NO: 6144982 - DNA, 23 bp, Homo sapiens
aaattaacttttttgtggcaatt

SEQ ID NO: 6144983 - DNA, 13 bp, Homo sapiens
aaattaagaagag

SEQ ID NO: 6144984 - DNA, 14 bp, Homo sapiens
aaattaagaaggca

SEQ ID NO: 6144985 - DNA, 13 bp, Homo sapiens
aaattaagagcat

SEQ ID NO: 6144986 - DNA, 18 bp, Homo sapiens
aaattaagatcctaaact

SEQ ID NO: 6144987 - DNA, 16 bp, Homo sapiens
aaattaagatttcctt

SEQ ID NO: 6144988 - DNA, 13 bp, Homo sapiens
aaattaagcaaat

SEQ ID NO: 6144989 - DNA, 19 bp, Homo sapiens
aaattaaggtgtttgaaaa

SEQ ID NO: 6144990 - DNA, 13 bp, Homo sapiens
aaattaagttgaa

SEQ ID NO: 6144991 - DNA, 14 bp, Homo sapiens
aaattaagttgaaa

SEQ ID NO: 6144992 - DNA, 22 bp, Homo sapiens
aaattaataaatcatgttttga

SEQ ID NO: 6144993 - DNA, 14 bp, Homo sapiens
aaattaatagcttt

SEQ ID NO: 6144994 - DNA, 14 bp, Homo sapiens
aaattaatatcaca

SEQ ID NO: 6144995 - DNA, 15 bp, Homo sapiens
aaattaatcttgctt

SEQ ID NO: 6144996 - DNA, 23 bp, Homo sapiens
aaattaatcttgcttcattgtta

SEQ ID NO: 6144997 - DNA, 15 bp, Homo sapiens
aaattaatctttcta

SEQ ID NO: 6144998 - DNA, 16 bp, Homo sapiens
aaattaatcttttaaa

SEQ ID NO: 6144999 - DNA, 20 bp, Homo sapiens
aaattaatgcagatttctct

SEQ ID NO: 6145000 - DNA, 19 bp, Homo sapiens
aaattaatgtaataaagtg

SEQ ID NO: 6145001 - DNA, 19 bp, Homo sapiens
aaattaattatatttctac

SEQ ID NO: 6145002 - DNA, 18 bp, Homo sapiens
aaattaattctaaactta

SEQ ID NO: 6145003 - DNA, 19 bp, Homo sapiens
aaattaattctaaacttag

SEQ ID NO: 6145004 - DNA, 16 bp, Homo sapiens
aaattaattgaatcta

SEQ ID NO: 6145005 - DNA, 15 bp, Homo sapiens
aaattaattgtgtga

SEQ ID NO: 6145006 - DNA, 12 bp, Homo sapiens
aaattaatttgt

SEQ ID NO: 6145007 - DNA, 13 bp, Homo sapiens
aaattaatttgtg

SEQ ID NO: 6145008 - DNA, 14 bp, Homo sapiens
aaattaatttgtga

SEQ ID NO: 6145009 - DNA, 20 bp, Homo sapiens
aaattaatttgtgaatttgc

SEQ ID NO: 6145010 - DNA, 18 bp, Homo sapiens
aaattaatttgttaatta

SEQ ID NO: 6145011 - DNA, 23 bp, Homo sapiens
aaattaatttgttaattaaatat

SEQ ID NO: 6145012 - DNA, 15 bp, Homo sapiens
aaattacaaaagaga

SEQ ID NO: 6145013 - DNA, 17 bp, Homo sapiens
aaattacaaaaggctcg

SEQ ID NO: 6145014 - DNA, 19 bp, Homo sapiens
aaattacaaagaaaataat

SEQ ID NO: 6145015 - DNA, 12 bp, Homo sapiens
aaattacaacta

SEQ ID NO: 6145016 - DNA, 13 bp, Homo sapiens
aaattacaactaa

SEQ ID NO: 6145017 - DNA, 21 bp, Homo sapiens
aaattacaaggcaatggaaac

SEQ ID NO: 6145018 - DNA, 15 bp, Homo sapiens
aaattacaagtttca

SEQ ID NO: 6145019 - DNA, 16 bp, Homo sapiens
aaattacaattttatc

SEQ ID NO: 6145020 - DNA, 22 bp, Homo sapiens
aaattacacaataaagcagtcc

SEQ ID NO: 6145021 - DNA, 16 bp, Homo sapiens
aaattacacccaaaga

SEQ ID NO: 6145022 - DNA, 22 bp, Homo sapiens
aaattacacccaaagaggtatt

SEQ ID NO: 6145023 - DNA, 16 bp, Homo sapiens
aaattacacccatgca

SEQ ID NO: 6145024 - DNA, 16 bp, Homo sapiens
aaattacagatgtgaa

SEQ ID NO: 6145025 - DNA, 22 bp, Homo sapiens
aaattacagatgtgaaaataaa

SEQ ID NO: 6145026 - DNA, 22 bp, Homo sapiens
aaattacagcttttatggatga

SEQ ID NO: 6145027 - DNA, 16 bp, Homo sapiens
aaattacaggttcctt

SEQ ID NO: 6145028 - DNA, 15 bp, Homo sapiens
aaattacatgcatga

SEQ ID NO: 6145029 - DNA, 18 bp, Homo sapiens
aaattacatgttttttca

SEQ ID NO: 6145030 - DNA, 23 bp, Homo sapiens
aaattacattactgaaaacttca

SEQ ID NO: 6145031 - DNA, 16 bp, Homo sapiens
aaattacattatgccc

SEQ ID NO: 6145032 - DNA, 13 bp, Homo sapiens
aaattacatttcg

SEQ ID NO: 6145033 - DNA, 16 bp, Homo sapiens
aaattacatttgtaat

SEQ ID NO: 6145034 - DNA, 18 bp, Homo sapiens
aaattacatttttaagct

SEQ ID NO: 6145035 - DNA, 19 bp, Homo sapiens
aaattaccagagttgttct

SEQ ID NO: 6145036 - DNA, 18 bp, Homo sapiens
aaattaccagtaaagtgt

SEQ ID NO: 6145037 - DNA, 20 bp, Homo sapiens
aaattaccagtaaagtgtaa

SEQ ID NO: 6145038 - DNA, 18 bp, Homo sapiens
aaattacctgtggatatt

SEQ ID NO: 6145039 - DNA, 17 bp, Homo sapiens
aaattacgtatgcaagt

SEQ ID NO: 6145040 - DNA, 20 bp, Homo sapiens
aaattacgtatgcaagtctg

SEQ ID NO: 6145041 - DNA, 16 bp, Homo sapiens
aaattactaattatct

SEQ ID NO: 6145042 - DNA, 15 bp, Homo sapiens
aaattactacaaaat

SEQ ID NO: 6145043 - DNA, 13 bp, Homo sapiens
aaattactataaa

SEQ ID NO: 6145044 - DNA, 13 bp, Homo sapiens
aaattactccaag

SEQ ID NO: 6145045 - DNA, 15 bp, Homo sapiens
aaattactctttctc

SEQ ID NO: 6145046 - DNA, 15 bp, Homo sapiens
aaattactgataaaa

SEQ ID NO: 6145047 - DNA, 15 bp, Homo sapiens
aaattactgtgtaaa

SEQ ID NO: 6145048 - DNA, 12 bp, Homo sapiens
aaattactgttt

SEQ ID NO: 6145049 - DNA, 18 bp, Homo sapiens
aaattacttagtattgca

SEQ ID NO: 6145050 - DNA, 21 bp, Homo sapiens
aaattacttatcatccacatt

SEQ ID NO: 6145051 - DNA, 22 bp, Homo sapiens
aaattacttctctctatctgga

SEQ ID NO: 6145052 - DNA, 21 bp, Homo sapiens
aaattactttaacattttgga

SEQ ID NO: 6145053 - DNA, 14 bp, Homo sapiens
aaattactttgtga

SEQ ID NO: 6145054 - DNA, 16 bp, Homo sapiens
aaattagaaaaaaaca

SEQ ID NO: 6145055 - DNA, 15 bp, Homo sapiens
aaattagaaaacaaa

SEQ ID NO: 6145056 - DNA, 17 bp, Homo sapiens
aaattagaaaatattct

SEQ ID NO: 6145057 - DNA, 19 bp, Homo sapiens
aaattagaaaatattctct

SEQ ID NO: 6145058 - DNA, 23 bp, Homo sapiens
aaattagaaaccttaatatgtgg

SEQ ID NO: 6145059 - DNA, 15 bp, Homo sapiens
aaattagaaaggaca

SEQ ID NO: 6145060 - DNA, 17 bp, Homo sapiens
aaattagaatagaactt

SEQ ID NO: 6145061 - DNA, 20 bp, Homo sapiens
aaattagactgtgattcaga

SEQ ID NO: 6145062 - DNA, 13 bp, Homo sapiens
aaattagaggaga

SEQ ID NO: 6145063 - DNA, 18 bp, Homo sapiens
aaattagatctagctaat

SEQ ID NO: 6145064 - DNA, 16 bp, Homo sapiens
aaattagatgcatgtt

SEQ ID NO: 6145065 - DNA, 22 bp, Homo sapiens
aaattagccagtaatcctgtag

SEQ ID NO: 6145066 - DNA, 21 bp, Homo sapiens
aaattagcctaagatatactt

SEQ ID NO: 6145067 - DNA, 22 bp, Homo sapiens
aaattagcctaagatatacttg

SEQ ID NO: 6145068 - DNA, 18 bp, Homo sapiens
aaattagctatttctgct

SEQ ID NO: 6145069 - DNA, 17 bp, Homo sapiens
aaattagctgtgtgaaa

SEQ ID NO: 6145070 - DNA, 20 bp, Homo sapiens
aaattagcttttagttttaa

SEQ ID NO: 6145071 - DNA, 13 bp, Homo sapiens
aaattaggaaagt

SEQ ID NO: 6145072 - DNA, 23 bp, Homo sapiens
aaattaggaaagtactgcatgat

SEQ ID NO: 6145073 - DNA, 14 bp, Homo sapiens
aaattaggaataaa

SEQ ID NO: 6145074 - DNA, 16 bp, Homo sapiens
aaattaggactgtata

SEQ ID NO: 6145075 - DNA, 22 bp, Homo sapiens
aaattaggaggctcaacaataa

SEQ ID NO: 6145076 - DNA, 18 bp, Homo sapiens
aaattagggctctaattt

SEQ ID NO: 6145077 - DNA, 16 bp, Homo sapiens
aaattaggttgaaaca

SEQ ID NO: 6145078 - DNA, 17 bp, Homo sapiens
aaattaggttgaaacat

SEQ ID NO: 6145079 - DNA, 18 bp, Homo sapiens
aaattaggttgaaacata

SEQ ID NO: 6145080 - DNA, 19 bp, Homo sapiens
aaattaggttgaaacatat

SEQ ID NO: 6145081 - DNA, 18 bp, Homo sapiens
aaattagtacctcaaagt

SEQ ID NO: 6145082 - DNA, 21 bp, Homo sapiens
aaattagtagtgtgttgataa

SEQ ID NO: 6145083 - DNA, 12 bp, Homo sapiens
aaattagtcttt

SEQ ID NO: 6145084 - DNA, 14 bp, Homo sapiens
aaattagtcttttt

SEQ ID NO: 6145085 - DNA, 21 bp, Homo sapiens
aaattagtgagattaaaaatc

SEQ ID NO: 6145086 - DNA, 16 bp, Homo sapiens
aaattagtttgacact

SEQ ID NO: 6145087 - DNA, 14 bp, Homo sapiens
aaattataaaattg

SEQ ID NO: 6145088 - DNA, 20 bp, Homo sapiens
aaattataactattacagtg

SEQ ID NO: 6145089 - DNA, 22 bp, Homo sapiens
aaattataacttaaaatatttt

SEQ ID NO: 6145090 - DNA, 23 bp, Homo sapiens
aaattataagagacagacacttg

SEQ ID NO: 6145091 - DNA, 16 bp, Homo sapiens
aaattataagatgtca

SEQ ID NO: 6145092 - DNA, 15 bp, Homo sapiens
aaattataaggactg

SEQ ID NO: 6145093 - DNA, 17 bp, Homo sapiens
aaattataagggccctg

SEQ ID NO: 6145094 - DNA, 14 bp, Homo sapiens
aaattataatgtat

SEQ ID NO: 6145095 - DNA, 19 bp, Homo sapiens
aaattataatgtattcata

SEQ ID NO: 6145096 - DNA, 17 bp, Homo sapiens
aaattataattttagtt

SEQ ID NO: 6145097 - DNA, 15 bp, Homo sapiens
aaattatacaatgat

SEQ ID NO: 6145098 - DNA, 14 bp, Homo sapiens
aaattatacataat

SEQ ID NO: 6145099 - DNA, 18 bp, Homo sapiens
aaattatacctgttgctt

SEQ ID NO: 6145100 - DNA, 15 bp, Homo sapiens
aaattatagaaacaa

SEQ ID NO: 6145101 - DNA, 17 bp, Homo sapiens
aaattatagcttttaag

SEQ ID NO: 6145102 - DNA, 22 bp, Homo sapiens
aaattatagttaggcttccatg

SEQ ID NO: 6145103 - DNA, 15 bp, Homo sapiens
aaattatatcaattt

SEQ ID NO: 6145104 - DNA, 17 bp, Homo sapiens
aaattatatgatatgca

SEQ ID NO: 6145105 - DNA, 19 bp, Homo sapiens
aaattatatttaccttttt

SEQ ID NO: 6145106 - DNA, 19 bp, Homo sapiens
aaattatcaaaaagctaat

SEQ ID NO: 6145107 - DNA, 19 bp, Homo sapiens
aaattatcaagctaataaa

SEQ ID NO: 6145108 - DNA, 11 bp, Homo sapiens
aaattatcagt

SEQ ID NO: 6145109 - DNA, 14 bp, Homo sapiens
aaattatcagttat

SEQ ID NO: 6145110 - DNA, 23 bp, Homo sapiens
aaattatccatggtaaaaactag

SEQ ID NO: 6145111 - DNA, 20 bp, Homo sapiens
aaattatctatttgtatata

SEQ ID NO: 6145112 - DNA, 14 bp, Homo sapiens
aaattatctgaata

SEQ ID NO: 6145113 - DNA, 18 bp, Homo sapiens
aaattatctgaatattag

SEQ ID NO: 6145114 - DNA, 19 bp, Homo sapiens
aaattatctgaatattaga

SEQ ID NO: 6145115 - DNA, 14 bp, Homo sapiens
aaattatcttcacc

SEQ ID NO: 6145116 - DNA, 17 bp, Homo sapiens
aaattatcttgatacat

SEQ ID NO: 6145117 - DNA, 22 bp, Homo sapiens
aaattatcttgatacattcaaa

SEQ ID NO: 6145118 - DNA, 13 bp, Homo sapiens
aaattatctttag

SEQ ID NO: 6145119 - DNA, 23 bp, Homo sapiens
aaattatctttagttgaattcca

SEQ ID NO: 6145120 - DNA, 22 bp, Homo sapiens
aaattatgaagctcatatcctt

SEQ ID NO: 6145121 - DNA, 13 bp, Homo sapiens
aaattatgaatga

SEQ ID NO: 6145122 - DNA, 18 bp, Homo sapiens
aaattatgaatgagtttt

SEQ ID NO: 6145123 - DNA, 17 bp, Homo sapiens
aaattatgagatttttt

SEQ ID NO: 6145124 - DNA, 22 bp, Homo sapiens
aaattatgatcctctatttcct

SEQ ID NO: 6145125 - DNA, 21 bp, Homo sapiens
aaattatgcaattcagtgttc

SEQ ID NO: 6145126 - DNA, 17 bp, Homo sapiens
aaattatgctaagaatt

SEQ ID NO: 6145127 - DNA, 13 bp, Homo sapiens
aaattatgctgca

SEQ ID NO: 6145128 - DNA, 21 bp, Homo sapiens
aaattatggaaacagatgaaa

SEQ ID NO: 6145129 - DNA, 18 bp, Homo sapiens
aaattatggaatatcatc

SEQ ID NO: 6145130 - DNA, 13 bp, Homo sapiens
aaattatgtataa

SEQ ID NO: 6145131 - DNA, 19 bp, Homo sapiens
ctgcatccaggcctgaggc

SEQ ID NO: 6145132 - DNA, 21 bp, Homo sapiens
ctgcatccattctcctgagga

SEQ ID NO: 6145133 - DNA, 13 bp, Homo sapiens
ctgcatcccacca

SEQ ID NO: 6145134 - DNA, 16 bp, Homo sapiens
ctgcatcccagcacct

SEQ ID NO: 6145135 - DNA, 17 bp, Homo sapiens
ctgcatcccagcacctg

SEQ ID NO: 6145136 - DNA, 23 bp, Homo sapiens
ctgcatcccagcacctgcctcct

SEQ ID NO: 6145137 - DNA, 23 bp, Homo sapiens
ctgcatcccaggatgctgggtgg

SEQ ID NO: 6145138 - DNA, 19 bp, Homo sapiens
ctgcatccccttccagctc

SEQ ID NO: 6145139 - DNA, 21 bp, Homo sapiens
ctgcatccccttccagctccc

SEQ ID NO: 6145140 - DNA, 15 bp, Homo sapiens
ctgcatccccttggc

SEQ ID NO: 6145141 - DNA, 22 bp, Homo sapiens
ctgcatcccgagcaaccctctg

SEQ ID NO: 6145142 - DNA, 23 bp, Homo sapiens
ctgcatcccgatacctcagccct

SEQ ID NO: 6145143 - DNA, 16 bp, Homo sapiens
ctgcatccctccaccc

SEQ ID NO: 6145144 - DNA, 19 bp, Homo sapiens
ctgcatccctccaccccag

SEQ ID NO: 6145145 - DNA, 22 bp, Homo sapiens
ctgcatccctccaccccagtcc

SEQ ID NO: 6145146 - DNA, 13 bp, Homo sapiens
ctgcatccctgtg

SEQ ID NO: 6145147 - DNA, 17 bp, Homo sapiens
ctgcatccctgtgtcca

SEQ ID NO: 6145148 - DNA, 21 bp, Homo sapiens
ctgcatcccttggcccctctc

SEQ ID NO: 6145149 - DNA, 22 bp, Homo sapiens
ctgcatccggagaattgcctct

SEQ ID NO: 6145150 - DNA, 16 bp, Homo sapiens
ctgcatcctcagcccc

SEQ ID NO: 6145151 - DNA, 17 bp, Homo sapiens
ctgcatcctcagcccca

SEQ ID NO: 6145152 - DNA, 18 bp, Homo sapiens
ctgcatcctcagccccag

SEQ ID NO: 6145153 - DNA, 18 bp, Homo sapiens
ctgcatcctctggagcca

SEQ ID NO: 6145154 - DNA, 20 bp, Homo sapiens
ctgcatcctctggagccagc

SEQ ID NO: 6145155 - DNA, 22 bp, Homo sapiens
ctgcatcctctggagccagccg

SEQ ID NO: 6145156 - DNA, 21 bp, Homo sapiens
ctgcatcctgaggccagtggc

SEQ ID NO: 6145157 - DNA, 23 bp, Homo sapiens
ctgcatcctgaggccagtggccc

SEQ ID NO: 6145158 - DNA, 21 bp, Homo sapiens
ctgcatcctggcttgaaaaac

SEQ ID NO: 6145159 - DNA, 17 bp, Homo sapiens
ctgcatccttcctgggg

SEQ ID NO: 6145160 - DNA, 21 bp, Homo sapiens
ctgcatcgatccccagcctgg

SEQ ID NO: 6145161 - DNA, 19 bp, Homo sapiens
ctgcatctaagcatctggg

SEQ ID NO: 6145162 - DNA, 18 bp, Homo sapiens
ctgcatctaagcccatgg

SEQ ID NO: 6145163 - DNA, 22 bp, Homo sapiens
ctgcatctattctttgtaccat

SEQ ID NO: 6145164 - DNA, 16 bp, Homo sapiens
ctgcatctgaccagca

SEQ ID NO: 6145165 - DNA, 17 bp, Homo sapiens
ctgcatctgaccagcag

SEQ ID NO: 6145166 - DNA, 19 bp, Homo sapiens
ctgcatctgaccagcagcg

SEQ ID NO: 6145167 - DNA, 18 bp, Homo sapiens
ctgcatctggggcccata

SEQ ID NO: 6145168 - DNA, 16 bp, Homo sapiens
ctgcatctgtctgctc

SEQ ID NO: 6145169 - DNA, 18 bp, Homo sapiens
ctgcatctgtctgctctg

SEQ ID NO: 6145170 - DNA, 21 bp, Homo sapiens
ctgcatctgtctgtccttcct

SEQ ID NO: 6145171 - DNA, 15 bp, Homo sapiens
ctgcatcttaacatg

SEQ ID NO: 6145172 - DNA, 15 bp, Homo sapiens
ctgcatcttagttta

SEQ ID NO: 6145173 - DNA, 17 bp, Homo sapiens
ctgcatcttagtttact

SEQ ID NO: 6145174 - DNA, 13 bp, Homo sapiens
ctgcatcttcagt

SEQ ID NO: 6145175 - DNA, 14 bp, Homo sapiens
ctgcatcttcttgc

SEQ ID NO: 6145176 - DNA, 18 bp, Homo sapiens
ctgcatcttgctctgtgg

SEQ ID NO: 6145177 - DNA, 22 bp, Homo sapiens
ctgcatcttgctctgtggcctt

SEQ ID NO: 6145178 - DNA, 23 bp, Homo sapiens
ctgcatcttgctctgtggccttg

SEQ ID NO: 6145179 - DNA, 14 bp, Homo sapiens
ctgcatcttggact

SEQ ID NO: 6145180 - DNA, 16 bp, Homo sapiens
ctgcatcttggggaca

SEQ ID NO: 6145181 - DNA, 18 bp, Homo sapiens
ctgcatcttggttatttc

SEQ ID NO: 6145182 - DNA, 18 bp, Homo sapiens
ctgcatctttctcttccc

SEQ ID NO: 6145183 - DNA, 20 bp, Homo sapiens
ctgcatctttctcttcccat

SEQ ID NO: 6145184 - DNA, 13 bp, Homo sapiens
ctgcatctttttg

SEQ ID NO: 6145185 - DNA, 16 bp, Homo sapiens
ctgcatgaaagcattc

SEQ ID NO: 6145186 - DNA, 22 bp, Homo sapiens
ctgcatgaaagcgttatctctt

SEQ ID NO: 6145187 - DNA, 20 bp, Homo sapiens
ctgcatgacctaccaggaca

SEQ ID NO: 6145188 - DNA, 22 bp, Homo sapiens
ctgcatgacctaccaggacaga

SEQ ID NO: 6145189 - DNA, 23 bp, Homo sapiens
ctgcatgacctatcagtatggtg

SEQ ID NO: 6145190 - DNA, 16 bp, Homo sapiens
ctgcatgagctggcaa

SEQ ID NO: 6145191 - DNA, 16 bp, Homo sapiens
ctgcatgatgtttgcc

SEQ ID NO: 6145192 - DNA, 18 bp, Homo sapiens
ctgcatgattagtgcaat

SEQ ID NO: 6145193 - DNA, 19 bp, Homo sapiens
ctgcatgatttttgccctg

SEQ ID NO: 6145194 - DNA, 19 bp, Homo sapiens
ctgcatgcaaacaagaaac

SEQ ID NO: 6145195 - DNA, 13 bp, Homo sapiens
ctgcatgcaagct

SEQ ID NO: 6145196 - DNA, 15 bp, Homo sapiens
ctgcatgcaagctca

SEQ ID NO: 6145197 - DNA, 16 bp, Homo sapiens
ctgcatgcaagctcag

SEQ ID NO: 6145198 - DNA, 20 bp, Homo sapiens
ctgcatgcaagctcagggtg

SEQ ID NO: 6145199 - DNA, 15 bp, Homo sapiens
ctgcatgcagcaaca

SEQ ID NO: 6145200 - DNA, 23 bp, Homo sapiens
ctgcatgcataatgaaccgttta

SEQ ID NO: 6145201 - DNA, 12 bp, Homo sapiens
ctgcatgcccag

SEQ ID NO: 6145202 - DNA, 13 bp, Homo sapiens
ctgcatgcccaga

SEQ ID NO: 6145203 - DNA, 16 bp, Homo sapiens
ctgcatgcctggcccc

SEQ ID NO: 6145204 - DNA, 21 bp, Homo sapiens
ctgcatgcctggcccctcctc

SEQ ID NO: 6145205 - DNA, 22 bp, Homo sapiens
ctgcatgcctggcccctcctcc

SEQ ID NO: 6145206 - DNA, 23 bp, Homo sapiens
ctgcatgcctggtctttcctctg

SEQ ID NO: 6145207 - DNA, 15 bp, Homo sapiens
ctgcatgcgacagcg

SEQ ID NO: 6145208 - DNA, 18 bp, Homo sapiens
ctgcatgcggcccagccc

SEQ ID NO: 6145209 - DNA, 22 bp, Homo sapiens
ctgcatgcgggcttcctcctgg

SEQ ID NO: 6145210 - DNA, 13 bp, Homo sapiens
ctgcatgctcctc

SEQ ID NO: 6145211 - DNA, 13 bp, Homo sapiens
ctgcatgctctgg

SEQ ID NO: 6145212 - DNA, 12 bp, Homo sapiens
ctgcatgctgct

SEQ ID NO: 6145213 - DNA, 13 bp, Homo sapiens
ctgcatgctgctg

SEQ ID NO: 6145214 - DNA, 18 bp, Homo sapiens
ctgcatgctgctggacag

SEQ ID NO: 6145215 - DNA, 17 bp, Homo sapiens
ctgcatgcttagagcat

SEQ ID NO: 6145216 - DNA, 19 bp, Homo sapiens
ctgcatggacctaacattc

SEQ ID NO: 6145217 - DNA, 21 bp, Homo sapiens
ctgcatggacgcctggctcca

SEQ ID NO: 6145218 - DNA, 13 bp, Homo sapiens
ctgcatggagaag

SEQ ID NO: 6145219 - DNA, 23 bp, Homo sapiens
ctgcatggcagaagcgtctccct

SEQ ID NO: 6145220 - DNA, 22 bp, Homo sapiens
ctgcatggcagggggctgctgc

SEQ ID NO: 6145221 - DNA, 19 bp, Homo sapiens
ctgcatggcatcagactag

SEQ ID NO: 6145222 - DNA, 17 bp, Homo sapiens
ctgcatggcatcctcca

SEQ ID NO: 6145223 - DNA, 21 bp, Homo sapiens
ctgcatggcatcctccagccc

SEQ ID NO: 6145224 - DNA, 22 bp, Homo sapiens
ctgcatggcatcctccagcccc

SEQ ID NO: 6145225 - DNA, 15 bp, Homo sapiens
ctgcatggcttctga

SEQ ID NO: 6145226 - DNA, 21 bp, Homo sapiens
ctgcatgggaaatagcggccc

SEQ ID NO: 6145227 - DNA, 19 bp, Homo sapiens
ctgcatgggccagcccctc

SEQ ID NO: 6145228 - DNA, 12 bp, Homo sapiens
ctgcatggggag

SEQ ID NO: 6145229 - DNA, 17 bp, Homo sapiens
ctgcatggggaggcagc

SEQ ID NO: 6145230 - DNA, 20 bp, Homo sapiens
ctgcatggggaggcagcaga

SEQ ID NO: 6145231 - DNA, 19 bp, Homo sapiens
ctgcatgggggcaccgggc

SEQ ID NO: 6145232 - DNA, 16 bp, Homo sapiens
ctgcatggtcaagcct

SEQ ID NO: 6145233 - DNA, 22 bp, Homo sapiens
ctgcatgtaaaatcttcagctg

SEQ ID NO: 6145234 - DNA, 21 bp, Homo sapiens
ctgcatgtactgtatattaca

SEQ ID NO: 6145235 - DNA, 17 bp, Homo sapiens
ctgcatgtctactcagc

SEQ ID NO: 6145236 - DNA, 12 bp, Homo sapiens
ctgcatgtgact

SEQ ID NO: 6145237 - DNA, 17 bp, Homo sapiens
ctgcatgtgacttctcc

SEQ ID NO: 6145238 - DNA, 16 bp, Homo sapiens
ctgcatgtggcttctc

SEQ ID NO: 6145239 - DNA, 19 bp, Homo sapiens
ctgcatgtggcttctctgt

SEQ ID NO: 6145240 - DNA, 22 bp, Homo sapiens
ctgcatgtgtatatatgtcaaa

SEQ ID NO: 6145241 - DNA, 17 bp, Homo sapiens
ctgcatgtgttgtacaa

SEQ ID NO: 6145242 - DNA, 17 bp, Homo sapiens
ctgcatgttaagtgcca

SEQ ID NO: 6145243 - DNA, 13 bp, Homo sapiens
ctgcatgttacat

SEQ ID NO: 6145244 - DNA, 15 bp, Homo sapiens
ctgcatgttaccatc

SEQ ID NO: 6145245 - DNA, 21 bp, Homo sapiens
ctgcattaataatagctaata

SEQ ID NO: 6145246 - DNA, 17 bp, Homo sapiens
ctgcattacatgtgttt

SEQ ID NO: 6145247 - DNA, 19 bp, Homo sapiens
ctgcattactccttcagct

SEQ ID NO: 6145248 - DNA, 12 bp, Homo sapiens
ctgcattagaaa

SEQ ID NO: 6145249 - DNA, 18 bp, Homo sapiens
ctgcattattctctttta

SEQ ID NO: 6145250 - DNA, 24 bp, Homo sapiens
ctgcattatttgagaagctgctca

SEQ ID NO: 6145251 - DNA, 21 bp, Homo sapiens
ctgcattcacccagacagctc

SEQ ID NO: 6145252 - DNA, 20 bp, Homo sapiens
ctgcattcaggatcaaaccc

SEQ ID NO: 6145253 - DNA, 15 bp, Homo sapiens
ctgcattcattttta

SEQ ID NO: 6145254 - DNA, 23 bp, Homo sapiens
ctgcattcatttttatagcaaca

SEQ ID NO: 6145255 - DNA, 14 bp, Homo sapiens
ctgcattccagagc

SEQ ID NO: 6145256 - DNA, 20 bp, Homo sapiens
ctgcattccccgctgcccaa

SEQ ID NO: 6145257 - DNA, 18 bp, Homo sapiens
ctgcattcgttgctccag

SEQ ID NO: 6145258 - DNA, 19 bp, Homo sapiens
ctgcattctctcccatcct

SEQ ID NO: 6145259 - DNA, 21 bp, Homo sapiens
ctgcattctctcccatcctgg

SEQ ID NO: 6145260 - DNA, 18 bp, Homo sapiens
ctgcattcttctgagcac

SEQ ID NO: 6145261 - DNA, 22 bp, Homo sapiens
ctgcattcttctgatcactgaa

SEQ ID NO: 6145262 - DNA, 16 bp, Homo sapiens
ctgcattctttctgta

SEQ ID NO: 6145263 - DNA, 23 bp, Homo sapiens
ctgcattgaaggcgaggctgccc

SEQ ID NO: 6145264 - DNA, 18 bp, Homo sapiens
ctgcattgacctggaggg

SEQ ID NO: 6145265 - DNA, 14 bp, Homo sapiens
ctgcattgagaagg

SEQ ID NO: 6145266 - DNA, 19 bp, Homo sapiens
ctgcattgagcatattttc

SEQ ID NO: 6145267 - DNA, 23 bp, Homo sapiens
ctgcattgagtccagctttcctt

SEQ ID NO: 6145268 - DNA, 13 bp, Homo sapiens
ctgcattgcctga

SEQ ID NO: 6145269 - DNA, 21 bp, Homo sapiens
ctgcattgctagataaaagct

SEQ ID NO: 6145270 - DNA, 23 bp, Homo sapiens
ctgcattggaactggaggcaggg

SEQ ID NO: 6145271 - DNA, 15 bp, Homo sapiens
ctgcattggcctggc

SEQ ID NO: 6145272 - DNA, 13 bp, Homo sapiens
ctgcattggcttt

SEQ ID NO: 6145273 - DNA, 18 bp, Homo sapiens
ctgcattgggagcatcca

SEQ ID NO: 6145274 - DNA, 14 bp, Homo sapiens
ctgcatttaaaaga

SEQ ID NO: 6145275 - DNA, 17 bp, Homo sapiens
ctgcatttaaaagatac

SEQ ID NO: 6145276 - DNA, 20 bp, Homo sapiens
ctgcatttaaatttgatttc

SEQ ID NO: 6145277 - DNA, 17 bp, Homo sapiens
ctgcatttaagaacaga

SEQ ID NO: 6145278 - DNA, 14 bp, Homo sapiens
ctgcatttagcaca

SEQ ID NO: 6145279 - DNA, 17 bp, Homo sapiens
ctgcatttagctgtatt

SEQ ID NO: 6145280 - DNA, 18 bp, Homo sapiens
ctgcatttagctgtattc

SEQ ID NO: 6145281 - DNA, 23 bp, Homo sapiens
ctgcatttagggagtattctaat

SEQ ID NO: 6145282 - DNA, 17 bp, Homo sapiens
ctgcatttataaatgtg

SEQ ID NO: 6145283 - DNA, 18 bp, Homo sapiens
ctgcatttataaatgtgt

SEQ ID NO: 6145284 - DNA, 19 bp, Homo sapiens
ctgcatttataaatgtgtg

SEQ ID NO: 6145285 - DNA, 20 bp, Homo sapiens
ctgcatttatcttttttcct

SEQ ID NO: 6145286 - DNA, 17 bp, Homo sapiens
ctgcatttcacatgcct

SEQ ID NO: 6145287 - DNA, 14 bp, Homo sapiens
ctgcatttcatatt

SEQ ID NO: 6145288 - DNA, 15 bp, Homo sapiens
ctgcatttcatatta

SEQ ID NO: 6145289 - DNA, 18 bp, Homo sapiens
ctgcatttcatattattt

SEQ ID NO: 6145290 - DNA, 20 bp, Homo sapiens
ctgcatttcatattatttta

SEQ ID NO: 6145291 - DNA, 17 bp, Homo sapiens
ctgcatttcggtggcta

SEQ ID NO: 6145292 - DNA, 18 bp, Homo sapiens
ctgcatttcggtggctag

SEQ ID NO: 6145293 - DNA, 15 bp, Homo sapiens
ctgcatttctcttct

SEQ ID NO: 6145294 - DNA, 14 bp, Homo sapiens
ctgcatttctgagt

SEQ ID NO: 6145295 - DNA, 13 bp, Homo sapiens
ctgcatttgatag

SEQ ID NO: 6145296 - DNA, 15 bp, Homo sapiens
ctgcatttgcctgct

SEQ ID NO: 6145297 - DNA, 22 bp, Homo sapiens
ctgcatttggctggagcccggt

SEQ ID NO: 6145298 - DNA, 20 bp, Homo sapiens
ctgcatttggggcctttccc

SEQ ID NO: 6145299 - DNA, 16 bp, Homo sapiens
ctgcatttgtatattt

SEQ ID NO: 6145300 - DNA, 17 bp, Homo sapiens
ctgcatttgtctggcct

SEQ ID NO: 6145301 - DNA, 13 bp, Homo sapiens
ctgcatttgtgaa

SEQ ID NO: 6145302 - DNA, 15 bp, Homo sapiens
ctgcatttgtgaaat

SEQ ID NO: 6145303 - DNA, 22 bp, Homo sapiens
ctgcatttgtgaaatgatggtg

SEQ ID NO: 6145304 - DNA, 20 bp, Homo sapiens
ctgcattttaagcataatta

SEQ ID NO: 6145305 - DNA, 22 bp, Homo sapiens
ctgcattttaattttaaccaaa

SEQ ID NO: 6145306 - DNA, 14 bp, Homo sapiens
ctgcattttacaca

SEQ ID NO: 6145307 - DNA, 17 bp, Homo sapiens
ctccaagataagcctga

SEQ ID NO: 6145308 - DNA, 19 bp, Homo sapiens
ctccaagataagcctgagc

SEQ ID NO: 6145309 - DNA, 21 bp, Homo sapiens
ctccaagataagcctgagcct

SEQ ID NO: 6145310 - DNA, 13 bp, Homo sapiens
ctccaagattcta

SEQ ID NO: 6145311 - DNA, 15 bp, Homo sapiens
ctccaagattctaga

SEQ ID NO: 6145312 - DNA, 18 bp, Homo sapiens
ctccaagatttcagaagc

SEQ ID NO: 6145313 - DNA, 14 bp, Homo sapiens
ctccaagcatttca

SEQ ID NO: 6145314 - DNA, 15 bp, Homo sapiens
ctccaagccagcaag

SEQ ID NO: 6145315 - DNA, 13 bp, Homo sapiens
ctccaagccagcg

SEQ ID NO: 6145316 - DNA, 15 bp, Homo sapiens
ctccaagccccctgg

SEQ ID NO: 6145317 - DNA, 23 bp, Homo sapiens
ctccaagccccctggcagctgcc

SEQ ID NO: 6145318 - DNA, 21 bp, Homo sapiens
ctccaagccctggggcagggt

SEQ ID NO: 6145319 - DNA, 14 bp, Homo sapiens
ctccaagcctgcct

SEQ ID NO: 6145320 - DNA, 19 bp, Homo sapiens
ctccaagcctgcctcccaa

SEQ ID NO: 6145321 - DNA, 13 bp, Homo sapiens
ctccaagcctggc

SEQ ID NO: 6145322 - DNA, 19 bp, Homo sapiens
ctccaagcctggcacccac

SEQ ID NO: 6145323 - DNA, 20 bp, Homo sapiens
ctccaagcctggcacccacc

SEQ ID NO: 6145324 - DNA, 14 bp, Homo sapiens
ctccaagctgttaa

SEQ ID NO: 6145325 - DNA, 15 bp, Homo sapiens
ctccaagctgttaaa

SEQ ID NO: 6145326 - DNA, 17 bp, Homo sapiens
ctccaaggaaagaacta

SEQ ID NO: 6145327 - DNA, 15 bp, Homo sapiens
ctccaaggactaagg

SEQ ID NO: 6145328 - DNA, 19 bp, Homo sapiens
ctccaaggaggggctgtaa

SEQ ID NO: 6145329 - DNA, 11 bp, Homo sapiens
ctccaaggcaa

SEQ ID NO: 6145330 - DNA, 19 bp, Homo sapiens
ctccaaggcaaatgtccaa

SEQ ID NO: 6145331 - DNA, 19 bp, Homo sapiens
ctccaaggccaggccttgg

SEQ ID NO: 6145332 - DNA, 17 bp, Homo sapiens
ctccaaggctgtcttct

SEQ ID NO: 6145333 - DNA, 16 bp, Homo sapiens
ctccaagggacaggtg

SEQ ID NO: 6145334 - DNA, 18 bp, Homo sapiens
ctccaagggacaggtggg

SEQ ID NO: 6145335 - DNA, 22 bp, Homo sapiens
ctccaagggacaggtgggcctg

SEQ ID NO: 6145336 - DNA, 20 bp, Homo sapiens
ctccaaggggaatcagaact

SEQ ID NO: 6145337 - DNA, 21 bp, Homo sapiens
ctccaagggtttcgactggtc

SEQ ID NO: 6145338 - DNA, 17 bp, Homo sapiens
ctccaaggtcctcttag

SEQ ID NO: 6145339 - DNA, 15 bp, Homo sapiens
ctccaaggtgctctg

SEQ ID NO: 6145340 - DNA, 16 bp, Homo sapiens
ctccaaggtttataaa

SEQ ID NO: 6145341 - DNA, 17 bp, Homo sapiens
ctccaaggtttataaag

SEQ ID NO: 6145342 - DNA, 21 bp, Homo sapiens
ctccaaggtttataaagcaga

SEQ ID NO: 6145343 - DNA, 17 bp, Homo sapiens
ctccaagtcatgggaga

SEQ ID NO: 6145344 - DNA, 15 bp, Homo sapiens
ctccaagtctcagtg

SEQ ID NO: 6145345 - DNA, 19 bp, Homo sapiens
ctccaagtctctctgtgaa

SEQ ID NO: 6145346 - DNA, 14 bp, Homo sapiens
ctccaagtgccaga

SEQ ID NO: 6145347 - DNA, 16 bp, Homo sapiens
ctccaagtgccagagg

SEQ ID NO: 6145348 - DNA, 19 bp, Homo sapiens
ctccaagtgccagaggtgg

SEQ ID NO: 6145349 - DNA, 21 bp, Homo sapiens
ctccaagtgccccctcacctc

SEQ ID NO: 6145350 - DNA, 22 bp, Homo sapiens
ctccaagtgccccctcacctct

SEQ ID NO: 6145351 - DNA, 22 bp, Homo sapiens
ctccaagtgggtcaattcctta

SEQ ID NO: 6145352 - DNA, 23 bp, Homo sapiens
ctccaagtgggtcaattccttag

SEQ ID NO: 6145353 - DNA, 15 bp, Homo sapiens
ctccaataaaggaac

SEQ ID NO: 6145354 - DNA, 16 bp, Homo sapiens
ctccaataaagtgcct

SEQ ID NO: 6145355 - DNA, 21 bp, Homo sapiens
ctccaataaagtgccttctgg

SEQ ID NO: 6145356 - DNA, 22 bp, Homo sapiens
ctccaataaagtgccttctggg

SEQ ID NO: 6145357 - DNA, 19 bp, Homo sapiens
ctccaatatcagtgctcga

SEQ ID NO: 6145358 - DNA, 21 bp, Homo sapiens
ctccaatcaccctacaagatg

SEQ ID NO: 6145359 - DNA, 13 bp, Homo sapiens
ctccaatcctccc

SEQ ID NO: 6145360 - DNA, 15 bp, Homo sapiens
ctccaatcctttcca

SEQ ID NO: 6145361 - DNA, 13 bp, Homo sapiens
ctccaatctggta

SEQ ID NO: 6145362 - DNA, 15 bp, Homo sapiens
ctccaatgctctgga

SEQ ID NO: 6145363 - DNA, 20 bp, Homo sapiens
ctccaatggaaagcttttca

SEQ ID NO: 6145364 - DNA, 23 bp, Homo sapiens
ctccaatggaaagcttttcagtg

SEQ ID NO: 6145365 - DNA, 20 bp, Homo sapiens
ctccaatggggccagcactg

SEQ ID NO: 6145366 - DNA, 19 bp, Homo sapiens
ctccaatggggcggggctt

SEQ ID NO: 6145367 - DNA, 20 bp, Homo sapiens
ctccaatggggcggggcttc

SEQ ID NO: 6145368 - DNA, 11 bp, Homo sapiens
ctccaatgtcg

SEQ ID NO: 6145369 - DNA, 12 bp, Homo sapiens
ctccaatgtcta

SEQ ID NO: 6145370 - DNA, 17 bp, Homo sapiens
ctccaatgtctgctgag

SEQ ID NO: 6145371 - DNA, 19 bp, Homo sapiens
ctccaatgtctgctgagga

SEQ ID NO: 6145372 - DNA, 18 bp, Homo sapiens
ctccaattcccccttaaa

SEQ ID NO: 6145373 - DNA, 18 bp, Homo sapiens
ctccaattctgaaatact

SEQ ID NO: 6145374 - DNA, 23 bp, Homo sapiens
ctccaattctgaaatacttttga

SEQ ID NO: 6145375 - DNA, 14 bp, Homo sapiens
ctccaattggtgct

SEQ ID NO: 6145376 - DNA, 17 bp, Homo sapiens
ctccaattggtgcttca

SEQ ID NO: 6145377 - DNA, 13 bp, Homo sapiens
ctccaattgtaaa

SEQ ID NO: 6145378 - DNA, 16 bp, Homo sapiens
ctccaattgtaaaaaa

SEQ ID NO: 6145379 - DNA, 15 bp, Homo sapiens
ctccaattttttaag

SEQ ID NO: 6145380 - DNA, 19 bp, Homo sapiens
ctccaatttttttttcctt

SEQ ID NO: 6145381 - DNA, 16 bp, Homo sapiens
ctccacaaagagacca

SEQ ID NO: 6145382 - DNA, 18 bp, Homo sapiens
ctccacaaagcaaaggca

SEQ ID NO: 6145383 - DNA, 12 bp, Homo sapiens
ctccacaaatga

SEQ ID NO: 6145384 - DNA, 19 bp, Homo sapiens
ctccacaaatgatgttttc

SEQ ID NO: 6145385 - DNA, 16 bp, Homo sapiens
ctccacaacactgtgt

SEQ ID NO: 6145386 - DNA, 15 bp, Homo sapiens
ctccacaacagcctg

SEQ ID NO: 6145387 - DNA, 22 bp, Homo sapiens
ctccacaacctcttccccccaa

SEQ ID NO: 6145388 - DNA, 21 bp, Homo sapiens
ctccacaaggggattttgctg

SEQ ID NO: 6145389 - DNA, 15 bp, Homo sapiens
ctccacacaagggaa

SEQ ID NO: 6145390 - DNA, 18 bp, Homo sapiens
ctccacacacttcttcca

SEQ ID NO: 6145391 - DNA, 23 bp, Homo sapiens
ctccacacagcagtgtcccctgc

SEQ ID NO: 6145392 - DNA, 22 bp, Homo sapiens
ctccacacaggtgttccgtggg

SEQ ID NO: 6145393 - DNA, 13 bp, Homo sapiens
ctccacacattcc

SEQ ID NO: 6145394 - DNA, 18 bp, Homo sapiens
ctccacacattccagcca

SEQ ID NO: 6145395 - DNA, 21 bp, Homo sapiens
ctccacacattccagccaggc

SEQ ID NO: 6145396 - DNA, 16 bp, Homo sapiens
ctccacaccagctgct

SEQ ID NO: 6145397 - DNA, 17 bp, Homo sapiens
ctccacaccagctgctg

SEQ ID NO: 6145398 - DNA, 15 bp, Homo sapiens
ctccacaccagtggc

SEQ ID NO: 6145399 - DNA, 17 bp, Homo sapiens
ctccacacccaccccct

SEQ ID NO: 6145400 - DNA, 16 bp, Homo sapiens
ctccacacccagcctg

SEQ ID NO: 6145401 - DNA, 17 bp, Homo sapiens
ctccacacccagcctgt

SEQ ID NO: 6145402 - DNA, 19 bp, Homo sapiens
ctccacacccatgactgcc

SEQ ID NO: 6145403 - DNA, 19 bp, Homo sapiens
ctccacacccgcgccccgc

SEQ ID NO: 6145404 - DNA, 17 bp, Homo sapiens
ctccacaccctctccca

SEQ ID NO: 6145405 - DNA, 13 bp, Homo sapiens
ctccacacctgcg

SEQ ID NO: 6145406 - DNA, 16 bp, Homo sapiens
ctccacacctgcggcc

SEQ ID NO: 6145407 - DNA, 15 bp, Homo sapiens
ctccacactcagaaa

SEQ ID NO: 6145408 - DNA, 12 bp, Homo sapiens
ctccacactcca

SEQ ID NO: 6145409 - DNA, 13 bp, Homo sapiens
ctccacactccac

SEQ ID NO: 6145410 - DNA, 14 bp, Homo sapiens
ctccacactccact

SEQ ID NO: 6145411 - DNA, 13 bp, Homo sapiens
ctccacagagagg

SEQ ID NO: 6145412 - DNA, 16 bp, Homo sapiens
ctccacagagaggagg

SEQ ID NO: 6145413 - DNA, 15 bp, Homo sapiens
ctccacagccgcagc

SEQ ID NO: 6145414 - DNA, 13 bp, Homo sapiens
ctccacagcgagg

SEQ ID NO: 6145415 - DNA, 14 bp, Homo sapiens
ctccacagcgaggg

SEQ ID NO: 6145416 - DNA, 16 bp, Homo sapiens
ctccacagcgagggca

SEQ ID NO: 6145417 - DNA, 12 bp, Homo sapiens
ctccacagctgc

SEQ ID NO: 6145418 - DNA, 13 bp, Homo sapiens
ctccacagctgca

SEQ ID NO: 6145419 - DNA, 14 bp, Homo sapiens
ctccacagctgcag

SEQ ID NO: 6145420 - DNA, 15 bp, Homo sapiens
ctccacagctgcagc

SEQ ID NO: 6145421 - DNA, 19 bp, Homo sapiens
ctccacagctgcagcccat

SEQ ID NO: 6145422 - DNA, 17 bp, Homo sapiens
ctccacaggagagactg

SEQ ID NO: 6145423 - DNA, 22 bp, Homo sapiens
ctccacaggagccgcagaggcc

SEQ ID NO: 6145424 - DNA, 16 bp, Homo sapiens
ctccacagtcccccac

SEQ ID NO: 6145425 - DNA, 12 bp, Homo sapiens
ctccacagtgct

SEQ ID NO: 6145426 - DNA, 13 bp, Homo sapiens
ctccacagtgctg

SEQ ID NO: 6145427 - DNA, 16 bp, Homo sapiens
ctccacagtgctgctt

SEQ ID NO: 6145428 - DNA, 23 bp, Homo sapiens
ctccacagttcagtggcagggct

SEQ ID NO: 6145429 - DNA, 21 bp, Homo sapiens
ctccacagttcgacctgcggc

SEQ ID NO: 6145430 - DNA, 20 bp, Homo sapiens
ctccacatcaacattccagg

SEQ ID NO: 6145431 - DNA, 21 bp, Homo sapiens
ctccacatccaccccactgga

SEQ ID NO: 6145432 - DNA, 21 bp, Homo sapiens
ctccacatcccagcagcccaa

SEQ ID NO: 6145433 - DNA, 14 bp, Homo sapiens
ctccacatcctcca

SEQ ID NO: 6145434 - DNA, 15 bp, Homo sapiens
ctccacatcctccac

SEQ ID NO: 6145435 - DNA, 14 bp, Homo sapiens
ctccacatcctgtg

SEQ ID NO: 6145436 - DNA, 21 bp, Homo sapiens
ctccacatctgcatcactcat

SEQ ID NO: 6145437 - DNA, 19 bp, Homo sapiens
ctccacatgctgcctggca

SEQ ID NO: 6145438 - DNA, 21 bp, Homo sapiens
ctccacatgctgcctggcaca

SEQ ID NO: 6145439 - DNA, 15 bp, Homo sapiens
ctccacatttgtttt

SEQ ID NO: 6145440 - DNA, 21 bp, Homo sapiens
ctccaccaaccccgcggccca

SEQ ID NO: 6145441 - DNA, 15 bp, Homo sapiens
ctccaccacaagagc

SEQ ID NO: 6145442 - DNA, 12 bp, Homo sapiens
ctccaccaccac

SEQ ID NO: 6145443 - DNA, 15 bp, Homo sapiens
ctccaccaccactgg

SEQ ID NO: 6145444 - DNA, 14 bp, Homo sapiens
ctccaccaccgccc

SEQ ID NO: 6145445 - DNA, 13 bp, Homo sapiens
ctccaccactgtg

SEQ ID NO: 6145446 - DNA, 14 bp, Homo sapiens
ctccaccagcaagg

SEQ ID NO: 6145447 - DNA, 13 bp, Homo sapiens
ctccaccagcagc

SEQ ID NO: 6145448 - DNA, 15 bp, Homo sapiens
ctccaccagcagcat

SEQ ID NO: 6145449 - DNA, 22 bp, Homo sapiens
ctccaccagcatcacctgcctg

SEQ ID NO: 6145450 - DNA, 11 bp, Homo sapiens
ctccaccagcc

SEQ ID NO: 6145451 - DNA, 19 bp, Homo sapiens
ctccaccagcctgctgaca

SEQ ID NO: 6145452 - DNA, 22 bp, Homo sapiens
ctccaccagcctgctgacagac

SEQ ID NO: 6145453 - DNA, 15 bp, Homo sapiens
ctccaccatccccac

SEQ ID NO: 6145454 - DNA, 16 bp, Homo sapiens
ctccaccatccccacc

SEQ ID NO: 6145455 - DNA, 20 bp, Homo sapiens
ctccaccatcccccaggtga

SEQ ID NO: 6145456 - DNA, 20 bp, Homo sapiens
ctccaccatccccgcacaaa

SEQ ID NO: 6145457 - DNA, 22 bp, Homo sapiens
ctccaccatcgtcttcttggcc

SEQ ID NO: 6145458 - DNA, 20 bp, Homo sapiens
ctccacccaaaccccttccc

SEQ ID NO: 6145459 - DNA, 13 bp, Homo sapiens
ctccacccagagg

SEQ ID NO: 6145460 - DNA, 17 bp, Homo sapiens
ctccacccagaggtctc

SEQ ID NO: 6145461 - DNA, 20 bp, Homo sapiens
ctccacccagaggtctccct

SEQ ID NO: 6145462 - DNA, 15 bp, Homo sapiens
ctccacccagagtag

SEQ ID NO: 6145463 - DNA, 11 bp, Homo sapiens
ctccacccagc

SEQ ID NO: 6145464 - DNA, 13 bp, Homo sapiens
ctccacccagccc

SEQ ID NO: 6145465 - DNA, 14 bp, Homo sapiens
ctccacccatccta

SEQ ID NO: 6145466 - DNA, 12 bp, Homo sapiens
ctccaccccact

SEQ ID NO: 6145467 - DNA, 20 bp, Homo sapiens
ctccaccccactcacagaga

SEQ ID NO: 6145468 - DNA, 11 bp, Homo sapiens
ctccaccccag

SEQ ID NO: 6145469 - DNA, 22 bp, Homo sapiens
ctccaccccaggacgccactca

SEQ ID NO: 6145470 - DNA, 19 bp, Homo sapiens
ctccaccccagtccccggg

SEQ ID NO: 6145471 - DNA, 20 bp, Homo sapiens
ctccaccccagtccccggga

SEQ ID NO: 6145472 - DNA, 18 bp, Homo sapiens
ctccacccccaagaaacc

SEQ ID NO: 6145473 - DNA, 17 bp, Homo sapiens
ctccacccccagctgct

SEQ ID NO: 6145474 - DNA, 14 bp, Homo sapiens
ctccacccccatgt

SEQ ID NO: 6145475 - DNA, 21 bp, Homo sapiens
ctccacccccatgtggcagcc

SEQ ID NO: 6145476 - DNA, 22 bp, Homo sapiens
ctccaccccccactcagtgcct

SEQ ID NO: 6145477 - DNA, 23 bp, Homo sapiens
ctccaccccccactcagtgcctc

SEQ ID NO: 6145478 - DNA, 21 bp, Homo sapiens
ctccaccccccagaacctgtc

SEQ ID NO: 6145479 - DNA, 22 bp, Homo sapiens
ctccaccccccagaacctgtcc

SEQ ID NO: 6145480 - DNA, 23 bp, Homo sapiens
ctccaccccccagaacctgtcct

SEQ ID NO: 6145481 - DNA, 19 bp, Homo sapiens
ctccacccccgccacggcc

SEQ ID NO: 6145482 - DNA, 17 bp, Homo sapiens
ctccaccccctccagct

SEQ ID NO: 6145483 - DNA, 12 bp, Homo sapiens
ctccacccctca

SEQ ID NO: 6145484 - DNA, 15 bp, Homo sapiens
ctccacccctcaagc

SEQ ID NO: 6145485 - DNA, 17 bp, Homo sapiens
ctccacccgtcctccct

SEQ ID NO: 6145486 - DNA, 22 bp, Homo sapiens
ctccacccgtcctccctcagcc

SEQ ID NO: 6145487 - DNA, 20 bp, Homo sapiens
ctgcattttacgtctttgga

SEQ ID NO: 6145488 - DNA, 17 bp, Homo sapiens
ctgcattttcaccccac

SEQ ID NO: 6145489 - DNA, 15 bp, Homo sapiens
ctgcattttcctctt

SEQ ID NO: 6145490 - DNA, 14 bp, Homo sapiens
ctgcattttctcag

SEQ ID NO: 6145491 - DNA, 15 bp, Homo sapiens
ctgcattttctgggt

SEQ ID NO: 6145492 - DNA, 14 bp, Homo sapiens
ctgcattttgctat

SEQ ID NO: 6145493 - DNA, 20 bp, Homo sapiens
ctgcattttgtagcctctct

SEQ ID NO: 6145494 - DNA, 23 bp, Homo sapiens
ctgcattttgtagcctctctttg

SEQ ID NO: 6145495 - DNA, 12 bp, Homo sapiens
ctgcatttttaa

SEQ ID NO: 6145496 - DNA, 18 bp, Homo sapiens
ctgcatttttagaccatt

SEQ ID NO: 6145497 - DNA, 12 bp, Homo sapiens
ctgcatttttca

SEQ ID NO: 6145498 - DNA, 15 bp, Homo sapiens
ctgcatttttcactt

SEQ ID NO: 6145499 - DNA, 22 bp, Homo sapiens
ctgcatttttcactttgctctc

SEQ ID NO: 6145500 - DNA, 15 bp, Homo sapiens
ctgcatttttctgca

SEQ ID NO: 6145501 - DNA, 18 bp, Homo sapiens
ctgcatttttttacctta

SEQ ID NO: 6145502 - DNA, 15 bp, Homo sapiens
ctgccaaaaagaaca

SEQ ID NO: 6145503 - DNA, 19 bp, Homo sapiens
ctgccaaaaagaacaccca

SEQ ID NO: 6145504 - DNA, 22 bp, Homo sapiens
ctgccaaaaccaaattgagctc

SEQ ID NO: 6145505 - DNA, 15 bp, Homo sapiens
ctgccaaaatgcaac

SEQ ID NO: 6145506 - DNA, 16 bp, Homo sapiens
ctgccaaaatgctcta

SEQ ID NO: 6145507 - DNA, 22 bp, Homo sapiens
ctgccaaaatggtacagcttct

SEQ ID NO: 6145508 - DNA, 12 bp, Homo sapiens
ctgccaaacaca

SEQ ID NO: 6145509 - DNA, 17 bp, Homo sapiens
ctgccaaacctcctgtc

SEQ ID NO: 6145510 - DNA, 19 bp, Homo sapiens
ctgccaaacctcctgtcag

SEQ ID NO: 6145511 - DNA, 19 bp, Homo sapiens
ctgccaaaggatgtgatat

SEQ ID NO: 6145512 - DNA, 21 bp, Homo sapiens
ctgccaaagggaaatatcatt

SEQ ID NO: 6145513 - DNA, 13 bp, Homo sapiens
ctgccaaagtagt

SEQ ID NO: 6145514 - DNA, 20 bp, Homo sapiens
ctgccaaagtagtcctggca

SEQ ID NO: 6145515 - DNA, 18 bp, Homo sapiens
ctgccaaagtgcctggga

SEQ ID NO: 6145516 - DNA, 19 bp, Homo sapiens
ctgccaaagtgcctgggaa

SEQ ID NO: 6145517 - DNA, 20 bp, Homo sapiens
ctgccaaagtgcctgggaag

SEQ ID NO: 6145518 - DNA, 12 bp, Homo sapiens
ctgccaaataaa

SEQ ID NO: 6145519 - DNA, 15 bp, Homo sapiens
ctgccaaataaaatg

SEQ ID NO: 6145520 - DNA, 18 bp, Homo sapiens
ctgccaaataaaatgttt

SEQ ID NO: 6145521 - DNA, 20 bp, Homo sapiens
ctgccaaataaaatgtttac

SEQ ID NO: 6145522 - DNA, 18 bp, Homo sapiens
ctgccaaataaacagcta

SEQ ID NO: 6145523 - DNA, 20 bp, Homo sapiens
ctgccaaataaacagctatt

SEQ ID NO: 6145524 - DNA, 21 bp, Homo sapiens
ctgccaaataaacagctattt

SEQ ID NO: 6145525 - DNA, 16 bp, Homo sapiens
ctgccaaataaatcat

SEQ ID NO: 6145526 - DNA, 22 bp, Homo sapiens
ctgccaaataaatcatcctcat

SEQ ID NO: 6145527 - DNA, 21 bp, Homo sapiens
ctgccaacatgaggacagaag

SEQ ID NO: 6145528 - DNA, 23 bp, Homo sapiens
ctgccaacatgaggacagaagga

SEQ ID NO: 6145529 - DNA, 15 bp, Homo sapiens
ctgccaaccatacct

SEQ ID NO: 6145530 - DNA, 21 bp, Homo sapiens
ctgccaaccataccttccttc

SEQ ID NO: 6145531 - DNA, 16 bp, Homo sapiens
ctgccaacctaaaact

SEQ ID NO: 6145532 - DNA, 14 bp, Homo sapiens
ctgccaacctcgct

SEQ ID NO: 6145533 - DNA, 19 bp, Homo sapiens
ctgccaactccatgaccag

SEQ ID NO: 6145534 - DNA, 15 bp, Homo sapiens
ctgccaactccatgt

SEQ ID NO: 6145535 - DNA, 22 bp, Homo sapiens
ctgccaacttcttcagagctga

SEQ ID NO: 6145536 - DNA, 18 bp, Homo sapiens
ctgccaactttccagact

SEQ ID NO: 6145537 - DNA, 19 bp, Homo sapiens
ctgccaactttccagactt

SEQ ID NO: 6145538 - DNA, 15 bp, Homo sapiens
ctgccaacttttagt

SEQ ID NO: 6145539 - DNA, 21 bp, Homo sapiens
ctgccaagactgctgtggcca

SEQ ID NO: 6145540 - DNA, 21 bp, Homo sapiens
ctgccaagagtcaacaggtca

SEQ ID NO: 6145541 - DNA, 13 bp, Homo sapiens
ctgccaagagtcc

SEQ ID NO: 6145542 - DNA, 24 bp, Homo sapiens
ctgccaagcactcgagaccatcct

SEQ ID NO: 6145543 - DNA, 20 bp, Homo sapiens
ctgccaagccaaccctggaa

SEQ ID NO: 6145544 - DNA, 14 bp, Homo sapiens
ctgccaagccagat

SEQ ID NO: 6145545 - DNA, 12 bp, Homo sapiens
ctgccaagccat

SEQ ID NO: 6145546 - DNA, 13 bp, Homo sapiens
ctgccaagccatg

SEQ ID NO: 6145547 - DNA, 14 bp, Homo sapiens
ctgccaaggagcat

SEQ ID NO: 6145548 - DNA, 18 bp, Homo sapiens
ctgccaaggccagagtgg

SEQ ID NO: 6145549 - DNA, 18 bp, Homo sapiens
ctgccaaggccagcccac

SEQ ID NO: 6145550 - DNA, 11 bp, Homo sapiens
ctgccaagggt

SEQ ID NO: 6145551 - DNA, 20 bp, Homo sapiens
ctgccaaggtggagggaagg

SEQ ID NO: 6145552 - DNA, 16 bp, Homo sapiens
ctgccaagtcagttct

SEQ ID NO: 6145553 - DNA, 15 bp, Homo sapiens
ctgccaagtgctctt

SEQ ID NO: 6145554 - DNA, 23 bp, Homo sapiens
ctgccaagtggggatggggcctc

SEQ ID NO: 6145555 - DNA, 14 bp, Homo sapiens
ctgccaataaattc

SEQ ID NO: 6145556 - DNA, 20 bp, Homo sapiens
ctgccaatatcctaataaaa

SEQ ID NO: 6145557 - DNA, 20 bp, Homo sapiens
ctgccaatcggctacccctc

SEQ ID NO: 6145558 - DNA, 14 bp, Homo sapiens
ctgccaatgccaca

SEQ ID NO: 6145559 - DNA, 15 bp, Homo sapiens
ctgccaatgccacag

SEQ ID NO: 6145560 - DNA, 19 bp, Homo sapiens
ctgccaatgccacagccaa

SEQ ID NO: 6145561 - DNA, 22 bp, Homo sapiens
ctgccaatgccatgactgctca

SEQ ID NO: 6145562 - DNA, 14 bp, Homo sapiens
ctgccaatgctcca

SEQ ID NO: 6145563 - DNA, 15 bp, Homo sapiens
ctgccaatgggagct

SEQ ID NO: 6145564 - DNA, 13 bp, Homo sapiens
ctgccaatgtggg

SEQ ID NO: 6145565 - DNA, 17 bp, Homo sapiens
ctgccaatgtgggctgc

SEQ ID NO: 6145566 - DNA, 21 bp, Homo sapiens
ctgccaatgtgggctgcccct

SEQ ID NO: 6145567 - DNA, 19 bp, Homo sapiens
ctgccaattgctaccgaga

SEQ ID NO: 6145568 - DNA, 23 bp, Homo sapiens
ctgccaattgctaccgagaaggt

SEQ ID NO: 6145569 - DNA, 22 bp, Homo sapiens
ctgccacaacagaataaagcag

SEQ ID NO: 6145570 - DNA, 23 bp, Homo sapiens
ctgccacaacagaataaagcagc

SEQ ID NO: 6145571 - DNA, 13 bp, Homo sapiens
ctgccacaagcac

SEQ ID NO: 6145572 - DNA, 15 bp, Homo sapiens
ctgccacaagcacaa

SEQ ID NO: 6145573 - DNA, 15 bp, Homo sapiens
ctgccacacaaacgt

SEQ ID NO: 6145574 - DNA, 23 bp, Homo sapiens
ctgccacacaaacgtatgtaaat

SEQ ID NO: 6145575 - DNA, 12 bp, Homo sapiens
ctgccacacagg

SEQ ID NO: 6145576 - DNA, 15 bp, Homo sapiens
ctgccacacccaggg

SEQ ID NO: 6145577 - DNA, 14 bp, Homo sapiens
ctgccacaccctcc

SEQ ID NO: 6145578 - DNA, 15 bp, Homo sapiens
ctgccacaccctccc

SEQ ID NO: 6145579 - DNA, 18 bp, Homo sapiens
ctgccacaccctccccat

SEQ ID NO: 6145580 - DNA, 18 bp, Homo sapiens
ctgccacacggaagcaag

SEQ ID NO: 6145581 - DNA, 19 bp, Homo sapiens
ctgccacacggaagcaagc

SEQ ID NO: 6145582 - DNA, 20 bp, Homo sapiens
ctgccacacggaagcaagca

SEQ ID NO: 6145583 - DNA, 23 bp, Homo sapiens
ctgccacactcagtcccccacca

SEQ ID NO: 6145584 - DNA, 17 bp, Homo sapiens
ctgccacactgatggct

SEQ ID NO: 6145585 - DNA, 13 bp, Homo sapiens
ctgccacacttca

SEQ ID NO: 6145586 - DNA, 12 bp, Homo sapiens
ctgccacagaga

SEQ ID NO: 6145587 - DNA, 13 bp, Homo sapiens
ctgccacagagag

SEQ ID NO: 6145588 - DNA, 22 bp, Homo sapiens
ctgccacagcctcccctgccag

SEQ ID NO: 6145589 - DNA, 23 bp, Homo sapiens
ctgccacagcctcccctgccagg

SEQ ID NO: 6145590 - DNA, 19 bp, Homo sapiens
ctgccacataataaagtgg

SEQ ID NO: 6145591 - DNA, 20 bp, Homo sapiens
ctgccacatacaggtgctca

SEQ ID NO: 6145592 - DNA, 21 bp, Homo sapiens
ctgccacatacaggtgctcaa

SEQ ID NO: 6145593 - DNA, 16 bp, Homo sapiens
ctgccacatccagctt

SEQ ID NO: 6145594 - DNA, 18 bp, Homo sapiens
ctgccacatccagcttgt

SEQ ID NO: 6145595 - DNA, 23 bp, Homo sapiens
ctgccacatggagccccctctgc

SEQ ID NO: 6145596 - DNA, 18 bp, Homo sapiens
ctgccaccaaatctgtct

SEQ ID NO: 6145597 - DNA, 13 bp, Homo sapiens
ctgccaccacccc

SEQ ID NO: 6145598 - DNA, 22 bp, Homo sapiens
ctgccaccaccctgtcttcctc

SEQ ID NO: 6145599 - DNA, 23 bp, Homo sapiens
ctgccaccaccctgtcttcctct

SEQ ID NO: 6145600 - DNA, 17 bp, Homo sapiens
ctgccaccacgtctgcc

SEQ ID NO: 6145601 - DNA, 19 bp, Homo sapiens
ctgccaccacgtctgccag

SEQ ID NO: 6145602 - DNA, 21 bp, Homo sapiens
ctgccaccagagaccgtcctc

SEQ ID NO: 6145603 - DNA, 22 bp, Homo sapiens
ctgccaccagagaccgtcctca

SEQ ID NO: 6145604 - DNA, 23 bp, Homo sapiens
ctgccaccagcaatgccctgcct

SEQ ID NO: 6145605 - DNA, 16 bp, Homo sapiens
ctgccaccagcccctc

SEQ ID NO: 6145606 - DNA, 15 bp, Homo sapiens
ctgccaccagcgccc

SEQ ID NO: 6145607 - DNA, 16 bp, Homo sapiens
ctgccaccagcgcccc

SEQ ID NO: 6145608 - DNA, 17 bp, Homo sapiens
ctgccaccaggccacct

SEQ ID NO: 6145609 - DNA, 18 bp, Homo sapiens
ctgccaccaggccacctc

SEQ ID NO: 6145610 - DNA, 15 bp, Homo sapiens
ctgccaccagggagc

SEQ ID NO: 6145611 - DNA, 23 bp, Homo sapiens
ctgccaccagggagcttcctggc

SEQ ID NO: 6145612 - DNA, 12 bp, Homo sapiens
ctgccaccagtc

SEQ ID NO: 6145613 - DNA, 19 bp, Homo sapiens
ctgccaccatcctgctgct

SEQ ID NO: 6145614 - DNA, 17 bp, Homo sapiens
ctgccacccacctccct

SEQ ID NO: 6145615 - DNA, 13 bp, Homo sapiens
ctgccacccactc

SEQ ID NO: 6145616 - DNA, 14 bp, Homo sapiens
ctgccacccactca

SEQ ID NO: 6145617 - DNA, 23 bp, Homo sapiens
ctgccacccagccccagccaggg

SEQ ID NO: 6145618 - DNA, 22 bp, Homo sapiens
ctgccacccaggcaggccctgc

SEQ ID NO: 6145619 - DNA, 16 bp, Homo sapiens
ctgccacccccaggtc

SEQ ID NO: 6145620 - DNA, 17 bp, Homo sapiens
ctgccacccccaggtct

SEQ ID NO: 6145621 - DNA, 19 bp, Homo sapiens
ctgccacccccttccctgg

SEQ ID NO: 6145622 - DNA, 14 bp, Homo sapiens
ctgccaccccttcc

SEQ ID NO: 6145623 - DNA, 19 bp, Homo sapiens
ctgccaccccttcctcccc

SEQ ID NO: 6145624 - DNA, 17 bp, Homo sapiens
ctgccaccccttggcac

SEQ ID NO: 6145625 - DNA, 18 bp, Homo sapiens
ctgccacccgcccacccg

SEQ ID NO: 6145626 - DNA, 21 bp, Homo sapiens
ctgccacccgcccacccgcct

SEQ ID NO: 6145627 - DNA, 14 bp, Homo sapiens
ctgccaccctcctg

SEQ ID NO: 6145628 - DNA, 16 bp, Homo sapiens
ctgccaccctcctgcg

SEQ ID NO: 6145629 - DNA, 13 bp, Homo sapiens
ctgccaccctctg

SEQ ID NO: 6145630 - DNA, 16 bp, Homo sapiens
ctgccaccctctgctg

SEQ ID NO: 6145631 - DNA, 17 bp, Homo sapiens
ctgccaccctctgctgc

SEQ ID NO: 6145632 - DNA, 12 bp, Homo sapiens
ctgccaccctgg

SEQ ID NO: 6145633 - DNA, 16 bp, Homo sapiens
ctgccaccctggggag

SEQ ID NO: 6145634 - DNA, 20 bp, Homo sapiens
ctgccaccctggggagaaag

SEQ ID NO: 6145635 - DNA, 19 bp, Homo sapiens
ctgccaccgactgcccagc

SEQ ID NO: 6145636 - DNA, 21 bp, Homo sapiens
ctgccaccgactgcccagcca

SEQ ID NO: 6145637 - DNA, 22 bp, Homo sapiens
ctgccaccgactgcccagccac

SEQ ID NO: 6145638 - DNA, 23 bp, Homo sapiens
ctgccaccgactgcccagccact

SEQ ID NO: 6145639 - DNA, 20 bp, Homo sapiens
ctgccaccgccagaggacaa

SEQ ID NO: 6145640 - DNA, 22 bp, Homo sapiens
ctgccaccgccagaggacaagg

SEQ ID NO: 6145641 - DNA, 23 bp, Homo sapiens
ctgccaccggaggtcactccacc

SEQ ID NO: 6145642 - DNA, 10 bp, Homo sapiens
ctgccacctc

SEQ ID NO: 6145643 - DNA, 11 bp, Homo sapiens
ctgccacctcc

SEQ ID NO: 6145644 - DNA, 22 bp, Homo sapiens
ctgccacctcccctatccaccc

SEQ ID NO: 6145645 - DNA, 16 bp, Homo sapiens
ctgccacctccctgac

SEQ ID NO: 6145646 - DNA, 16 bp, Homo sapiens
ctgccacctcctgcct

SEQ ID NO: 6145647 - DNA, 19 bp, Homo sapiens
ctgccacctcctgcctcag

SEQ ID NO: 6145648 - DNA, 16 bp, Homo sapiens
ctgccacctctcccag

SEQ ID NO: 6145649 - DNA, 18 bp, Homo sapiens
ctgccacctctcccagcc

SEQ ID NO: 6145650 - DNA, 22 bp, Homo sapiens
ctgccacctctcccagccctca

SEQ ID NO: 6145651 - DNA, 14 bp, Homo sapiens
ctgccacctgcaca

SEQ ID NO: 6145652 - DNA, 15 bp, Homo sapiens
ctgccacctgcacag

SEQ ID NO: 6145653 - DNA, 13 bp, Homo sapiens
ctgccacctggac

SEQ ID NO: 6145654 - DNA, 15 bp, Homo sapiens
ctgccacctggaccc

SEQ ID NO: 6145655 - DNA, 22 bp, Homo sapiens
ctgccacctggacccctgcatt

SEQ ID NO: 6145656 - DNA, 16 bp, Homo sapiens
ctgccacctggggcag

SEQ ID NO: 6145657 - DNA, 15 bp, Homo sapiens
ctgccacctgtctgt

SEQ ID NO: 6145658 - DNA, 17 bp, Homo sapiens
ctgccacctgtctgtct

SEQ ID NO: 6145659 - DNA, 15 bp, Homo sapiens
ctgccaccttgtggc

SEQ ID NO: 6145660 - DNA, 22 bp, Homo sapiens
ctgccacgtgccttaggaatac

SEQ ID NO: 6145661 - DNA, 21 bp, Homo sapiens
ctgccacgtggtggcccagct

SEQ ID NO: 6145662 - DNA, 22 bp, Homo sapiens
ctgccacgtggtggcccagctc

SEQ ID NO: 6145663 - DNA, 19 bp, Homo sapiens
ctgccactaaaatccaccc

SEQ ID NO: 6145664 - DNA, 21 bp, Homo sapiens
ctgccactaaaatccacccag

SEQ ID NO: 6145665 - DNA, 20 bp, Homo sapiens
ctccacccgtcctggggtgg

SEQ ID NO: 6145666 - DNA, 23 bp, Homo sapiens
ctccaccctaaagtctcaggtga

SEQ ID NO: 6145667 - DNA, 16 bp, Homo sapiens
ctccaccctccacctt

SEQ ID NO: 6145668 - DNA, 18 bp, Homo sapiens
ctccaccctcccagacct

SEQ ID NO: 6145669 - DNA, 14 bp, Homo sapiens
ctccaccctcccct

SEQ ID NO: 6145670 - DNA, 21 bp, Homo sapiens
ctccaccctccggccagcgag

SEQ ID NO: 6145671 - DNA, 22 bp, Homo sapiens
ctccaccctccggccagcgagt

SEQ ID NO: 6145672 - DNA, 14 bp, Homo sapiens
ctccaccctcctcc

SEQ ID NO: 6145673 - DNA, 15 bp, Homo sapiens
ctccaccctcctcta

SEQ ID NO: 6145674 - DNA, 13 bp, Homo sapiens
ctccaccctctga

SEQ ID NO: 6145675 - DNA, 12 bp, Homo sapiens
ctccaccctgca

SEQ ID NO: 6145676 - DNA, 22 bp, Homo sapiens
ctccaccctgcattttcctctt

SEQ ID NO: 6145677 - DNA, 12 bp, Homo sapiens
ctccaccctgcc

SEQ ID NO: 6145678 - DNA, 16 bp, Homo sapiens
ctccaccctgccctgc

SEQ ID NO: 6145679 - DNA, 19 bp, Homo sapiens
ctccaccctgccctgctga

SEQ ID NO: 6145680 - DNA, 22 bp, Homo sapiens
ctccaccctgccctgctgagca

SEQ ID NO: 6145681 - DNA, 13 bp, Homo sapiens
ctccaccctgctc

SEQ ID NO: 6145682 - DNA, 15 bp, Homo sapiens
ctccaccctggccga

SEQ ID NO: 6145683 - DNA, 15 bp, Homo sapiens
ctccaccctggctgg

SEQ ID NO: 6145684 - DNA, 17 bp, Homo sapiens
ctccaccctgtccccca

SEQ ID NO: 6145685 - DNA, 20 bp, Homo sapiens
ctccaccctgtcccccagct

SEQ ID NO: 6145686 - DNA, 22 bp, Homo sapiens
ctccaccctgtcccccagctct

SEQ ID NO: 6145687 - DNA, 16 bp, Homo sapiens
ctccacccttggcctg

SEQ ID NO: 6145688 - DNA, 23 bp, Homo sapiens
ctccaccgagccacgcagtgcct

SEQ ID NO: 6145689 - DNA, 15 bp, Homo sapiens
ctccaccgagccagc

SEQ ID NO: 6145690 - DNA, 16 bp, Homo sapiens
ctccaccgcagaagga

SEQ ID NO: 6145691 - DNA, 20 bp, Homo sapiens
ctccaccgccatggcttcca

SEQ ID NO: 6145692 - DNA, 14 bp, Homo sapiens
ctccaccgctgcct

SEQ ID NO: 6145693 - DNA, 19 bp, Homo sapiens
ctccaccgctgcctaagtg

SEQ ID NO: 6145694 - DNA, 22 bp, Homo sapiens
ctccaccgggagggacagtctg

SEQ ID NO: 6145695 - DNA, 18 bp, Homo sapiens
ctccacctacacccctgt

SEQ ID NO: 6145696 - DNA, 21 bp, Homo sapiens
ctccacctagtggctgtccag

SEQ ID NO: 6145697 - DNA, 14 bp, Homo sapiens
ctccacctcagcct

SEQ ID NO: 6145698 - DNA, 15 bp, Homo sapiens
ctccacctcagcctt

SEQ ID NO: 6145699 - DNA, 17 bp, Homo sapiens
ctccacctcagccttgg

SEQ ID NO: 6145700 - DNA, 16 bp, Homo sapiens
ctccacctcccaccct

SEQ ID NO: 6145701 - DNA, 23 bp, Homo sapiens
ctccacctccctgcaataaaatg

SEQ ID NO: 6145702 - DNA, 22 bp, Homo sapiens
ctccacctcctctcttggactc

SEQ ID NO: 6145703 - DNA, 13 bp, Homo sapiens
ctccacctcctgg

SEQ ID NO: 6145704 - DNA, 19 bp, Homo sapiens
ctccacctctcacgggccc

SEQ ID NO: 6145705 - DNA, 20 bp, Homo sapiens
ctccacctctggtggctcct

SEQ ID NO: 6145706 - DNA, 14 bp, Homo sapiens
ctccacctctgtgc

SEQ ID NO: 6145707 - DNA, 15 bp, Homo sapiens
ctccacctctgtgca

SEQ ID NO: 6145708 - DNA, 15 bp, Homo sapiens
ctccacctgcagccc

SEQ ID NO: 6145709 - DNA, 13 bp, Homo sapiens
ctccacctgccag

SEQ ID NO: 6145710 - DNA, 14 bp, Homo sapiens
ctccacctgccagg

SEQ ID NO: 6145711 - DNA, 18 bp, Homo sapiens
ctccacctgccagggaca

SEQ ID NO: 6145712 - DNA, 21 bp, Homo sapiens
ctccacctgccagggacagag

SEQ ID NO: 6145713 - DNA, 13 bp, Homo sapiens
ctccacctgtgag

SEQ ID NO: 6145714 - DNA, 14 bp, Homo sapiens
ctccacctgtgaga

SEQ ID NO: 6145715 - DNA, 14 bp, Homo sapiens
ctccacctgtgctt

SEQ ID NO: 6145716 - DNA, 13 bp, Homo sapiens
ctccacctgttca

SEQ ID NO: 6145717 - DNA, 19 bp, Homo sapiens
ctccacctgttcaggagct

SEQ ID NO: 6145718 - DNA, 14 bp, Homo sapiens
ctccaccttcccac

SEQ ID NO: 6145719 - DNA, 18 bp, Homo sapiens
ctccacgatcctgccacc

SEQ ID NO: 6145720 - DNA, 17 bp, Homo sapiens
ctccacgatgcctttga

SEQ ID NO: 6145721 - DNA, 17 bp, Homo sapiens
ctccacgcagctggcag

SEQ ID NO: 6145722 - DNA, 14 bp, Homo sapiens
ctccacgccactgc

SEQ ID NO: 6145723 - DNA, 15 bp, Homo sapiens
ctccacgccactgcc

SEQ ID NO: 6145724 - DNA, 16 bp, Homo sapiens
ctccacgccctgggga

SEQ ID NO: 6145725 - DNA, 19 bp, Homo sapiens
ctccacgcctcctggccag

SEQ ID NO: 6145726 - DNA, 18 bp, Homo sapiens
ctccacgcttagggtctg

SEQ ID NO: 6145727 - DNA, 13 bp, Homo sapiens
ctccacggagagc

SEQ ID NO: 6145728 - DNA, 22 bp, Homo sapiens
ctccacggatgcgtgggcagag

SEQ ID NO: 6145729 - DNA, 23 bp, Homo sapiens
ctccacggatgcgtgggcagagg

SEQ ID NO: 6145730 - DNA, 16 bp, Homo sapiens
ctccacgggctgcgcc

SEQ ID NO: 6145731 - DNA, 18 bp, Homo sapiens
ctccacgggggcctagtg

SEQ ID NO: 6145732 - DNA, 19 bp, Homo sapiens
ctccacgggggcctagtgg

SEQ ID NO: 6145733 - DNA, 22 bp, Homo sapiens
ctccacggtcagatttgctgtt

SEQ ID NO: 6145734 - DNA, 22 bp, Homo sapiens
ctccacggtccgcggcctgcac

SEQ ID NO: 6145735 - DNA, 22 bp, Homo sapiens
ctccacggtgcgtggctgtggc

SEQ ID NO: 6145736 - DNA, 23 bp, Homo sapiens
ctccacggtgcgtggctgtggca

SEQ ID NO: 6145737 - DNA, 18 bp, Homo sapiens
ctccacgtctttcctgct

SEQ ID NO: 6145738 - DNA, 21 bp, Homo sapiens
ctccacgtctttcctgctaca

SEQ ID NO: 6145739 - DNA, 20 bp, Homo sapiens
ctccacgttctgctcatcat

SEQ ID NO: 6145740 - DNA, 22 bp, Homo sapiens
ctccactaaatgagctcctgcg

SEQ ID NO: 6145741 - DNA, 22 bp, Homo sapiens
ctccactaccccacaccagcct

SEQ ID NO: 6145742 - DNA, 16 bp, Homo sapiens
ctccactaccccgact

SEQ ID NO: 6145743 - DNA, 15 bp, Homo sapiens
ctccactactctctt

SEQ ID NO: 6145744 - DNA, 17 bp, Homo sapiens
ctccactactctcttcc

SEQ ID NO: 6145745 - DNA, 20 bp, Homo sapiens
ctccactattttattaaaaa

SEQ ID NO: 6145746 - DNA, 17 bp, Homo sapiens
ctccactcactccagcc

SEQ ID NO: 6145747 - DNA, 20 bp, Homo sapiens
ctccactcactgaagcccag

SEQ ID NO: 6145748 - DNA, 14 bp, Homo sapiens
ctccactcagcaca

SEQ ID NO: 6145749 - DNA, 18 bp, Homo sapiens
ctccactcagcacaatta

SEQ ID NO: 6145750 - DNA, 14 bp, Homo sapiens
ctccactcagctgt

SEQ ID NO: 6145751 - DNA, 15 bp, Homo sapiens
ctccactcagctgtc

SEQ ID NO: 6145752 - DNA, 18 bp, Homo sapiens
ctccactcagctgtcctg

SEQ ID NO: 6145753 - DNA, 23 bp, Homo sapiens
ctccactcagctgtcctgcagca

SEQ ID NO: 6145754 - DNA, 17 bp, Homo sapiens
ctccactcagggctggc

SEQ ID NO: 6145755 - DNA, 20 bp, Homo sapiens
ctccactcagggctggcccg

SEQ ID NO: 6145756 - DNA, 22 bp, Homo sapiens
ctccactcagggctggcccggg

SEQ ID NO: 6145757 - DNA, 16 bp, Homo sapiens
ctccactcaggtgcac

SEQ ID NO: 6145758 - DNA, 18 bp, Homo sapiens
ctccactcaggtgcacac

SEQ ID NO: 6145759 - DNA, 9 bp, Homo sapiens
ctccactcc

SEQ ID NO: 6145760 - DNA, 13 bp, Homo sapiens
ctccactccaagg

SEQ ID NO: 6145761 - DNA, 13 bp, Homo sapiens
ctccactccaagt

SEQ ID NO: 6145762 - DNA, 15 bp, Homo sapiens
ctccactccatccct

SEQ ID NO: 6145763 - DNA, 15 bp, Homo sapiens
ctccactcccacctc

SEQ ID NO: 6145764 - DNA, 14 bp, Homo sapiens
ctccactcccactt

SEQ ID NO: 6145765 - DNA, 17 bp, Homo sapiens
ctccactcccccacctg

SEQ ID NO: 6145766 - DNA, 15 bp, Homo sapiens
ctccactcccctcat

SEQ ID NO: 6145767 - DNA, 16 bp, Homo sapiens
ctccactcccctcatc

SEQ ID NO: 6145768 - DNA, 16 bp, Homo sapiens
ctccactccctgtctg

SEQ ID NO: 6145769 - DNA, 16 bp, Homo sapiens
ctccactcctcccaac

SEQ ID NO: 6145770 - DNA, 15 bp, Homo sapiens
ctccactcctctcaa

SEQ ID NO: 6145771 - DNA, 20 bp, Homo sapiens
ctccactcctctcaactgcc

SEQ ID NO: 6145772 - DNA, 14 bp, Homo sapiens
ctccactcgaccca

SEQ ID NO: 6145773 - DNA, 19 bp, Homo sapiens
ctccactcgacccagaatg

SEQ ID NO: 6145774 - DNA, 17 bp, Homo sapiens
ctccactctagttctag

SEQ ID NO: 6145775 - DNA, 15 bp, Homo sapiens
ctccactctccccca

SEQ ID NO: 6145776 - DNA, 13 bp, Homo sapiens
ctccactctcctt

SEQ ID NO: 6145777 - DNA, 19 bp, Homo sapiens
ctccactctctaccagata

SEQ ID NO: 6145778 - DNA, 15 bp, Homo sapiens
ctccactctgattca

SEQ ID NO: 6145779 - DNA, 17 bp, Homo sapiens
ctccactctgcttctct

SEQ ID NO: 6145780 - DNA, 19 bp, Homo sapiens
ctccactctgtatctatgc

SEQ ID NO: 6145781 - DNA, 17 bp, Homo sapiens
ctccactcttctctcct

SEQ ID NO: 6145782 - DNA, 14 bp, Homo sapiens
ctccactgacctgg

SEQ ID NO: 6145783 - DNA, 17 bp, Homo sapiens
ctccactgacctggaag

SEQ ID NO: 6145784 - DNA, 18 bp, Homo sapiens
ctccactgacctggaaga

SEQ ID NO: 6145785 - DNA, 20 bp, Homo sapiens
ctccactgacctggaagagc

SEQ ID NO: 6145786 - DNA, 18 bp, Homo sapiens
ctccactgccatgtaccc

SEQ ID NO: 6145787 - DNA, 14 bp, Homo sapiens
ctccactgccctct

SEQ ID NO: 6145788 - DNA, 16 bp, Homo sapiens
ctccactgccctggca

SEQ ID NO: 6145789 - DNA, 16 bp, Homo sapiens
ctccactgcctctgga

SEQ ID NO: 6145790 - DNA, 17 bp, Homo sapiens
ctccactgctctcagcc

SEQ ID NO: 6145791 - DNA, 12 bp, Homo sapiens
ctccactgctgg

SEQ ID NO: 6145792 - DNA, 14 bp, Homo sapiens
ctccactggacaga

SEQ ID NO: 6145793 - DNA, 17 bp, Homo sapiens
ctccactggacagaccc

SEQ ID NO: 6145794 - DNA, 21 bp, Homo sapiens
ctccactggacagacccaggt

SEQ ID NO: 6145795 - DNA, 22 bp, Homo sapiens
ctccactggacagacccaggtc

SEQ ID NO: 6145796 - DNA, 13 bp, Homo sapiens
ctccactggcctg

SEQ ID NO: 6145797 - DNA, 18 bp, Homo sapiens
ctccactggcctgcccgt

SEQ ID NO: 6145798 - DNA, 24 bp, Homo sapiens
ctccactggggaatgctcccagct

SEQ ID NO: 6145799 - DNA, 17 bp, Homo sapiens
ctccactggtctgtctt

SEQ ID NO: 6145800 - DNA, 13 bp, Homo sapiens
ctccactgtcacc

SEQ ID NO: 6145801 - DNA, 16 bp, Homo sapiens
ctccactgtgcacacc

SEQ ID NO: 6145802 - DNA, 22 bp, Homo sapiens
ctccactgtgcctttgcaaatc

SEQ ID NO: 6145803 - DNA, 23 bp, Homo sapiens
ctccactgtgcctttgcaaatca

SEQ ID NO: 6145804 - DNA, 14 bp, Homo sapiens
ctccacttcatcca

SEQ ID NO: 6145805 - DNA, 13 bp, Homo sapiens
ctccacttctggt

SEQ ID NO: 6145806 - DNA, 21 bp, Homo sapiens
ctccacttctggtcccctgtg

SEQ ID NO: 6145807 - DNA, 24 bp, Homo sapiens
ctccacttctggtcccctgtggtg

SEQ ID NO: 6145808 - DNA, 21 bp, Homo sapiens
ctccacttcttgttccccact

SEQ ID NO: 6145809 - DNA, 11 bp, Homo sapiens
ctccacttgct

SEQ ID NO: 6145810 - DNA, 19 bp, Homo sapiens
ctccacttggccaaacttt

SEQ ID NO: 6145811 - DNA, 22 bp, Homo sapiens
ctccacttggtctgtgagatgc

SEQ ID NO: 6145812 - DNA, 23 bp, Homo sapiens
ctccacttgtatatatggatcag

SEQ ID NO: 6145813 - DNA, 13 bp, Homo sapiens
ctccactttcagc

SEQ ID NO: 6145814 - DNA, 15 bp, Homo sapiens
ctccactttcagctg

SEQ ID NO: 6145815 - DNA, 19 bp, Homo sapiens
ctccactttcagctgtctt

SEQ ID NO: 6145816 - DNA, 22 bp, Homo sapiens
ctccactttctagccagaggag

SEQ ID NO: 6145817 - DNA, 13 bp, Homo sapiens
ctccactttttct

SEQ ID NO: 6145818 - DNA, 15 bp, Homo sapiens
ctccactttttctta

SEQ ID NO: 6145819 - DNA, 16 bp, Homo sapiens
ctccagaaaaatcaat

SEQ ID NO: 6145820 - DNA, 19 bp, Homo sapiens
ctccagaaaaatcaatcat

SEQ ID NO: 6145821 - DNA, 23 bp, Homo sapiens
ctccagaaaaatcaatcattttc

SEQ ID NO: 6145822 - DNA, 18 bp, Homo sapiens
ctccagaaaaatgaaaag

SEQ ID NO: 6145823 - DNA, 23 bp, Homo sapiens
ctccagaaaaatgaaaagcaata

SEQ ID NO: 6145824 - DNA, 23 bp, Homo sapiens
ctccagaaacagctgcttctccc

SEQ ID NO: 6145825 - DNA, 14 bp, Homo sapiens
ctccagaacccatt

SEQ ID NO: 6145826 - DNA, 21 bp, Homo sapiens
ctccagaaccttactggcact

SEQ ID NO: 6145827 - DNA, 23 bp, Homo sapiens
ctccagaaccttactggcactgt

SEQ ID NO: 6145828 - DNA, 16 bp, Homo sapiens
ctccagaactcttcct

SEQ ID NO: 6145829 - DNA, 17 bp, Homo sapiens
ctccagaagatgccagc

SEQ ID NO: 6145830 - DNA, 20 bp, Homo sapiens
ctccagaagatgccagcttc

SEQ ID NO: 6145831 - DNA, 20 bp, Homo sapiens
ctccagaagcactgggatca

SEQ ID NO: 6145832 - DNA, 14 bp, Homo sapiens
ctccagaagcctct

SEQ ID NO: 6145833 - DNA, 16 bp, Homo sapiens
ctccagaagcctctgg

SEQ ID NO: 6145834 - DNA, 17 bp, Homo sapiens
ctccagaagcctctggc

SEQ ID NO: 6145835 - DNA, 13 bp, Homo sapiens
ctccagaagctgc

SEQ ID NO: 6145836 - DNA, 19 bp, Homo sapiens
ctccagaagctgctccttt

SEQ ID NO: 6145837 - DNA, 21 bp, Homo sapiens
ctccagaataccttcttcgct

SEQ ID NO: 6145838 - DNA, 21 bp, Homo sapiens
ctccagaatctgctgttgcca

SEQ ID NO: 6145839 - DNA, 13 bp, Homo sapiens
ctccagaatggaa

SEQ ID NO: 6145840 - DNA, 16 bp, Homo sapiens
ctccagaatgtaagaa

SEQ ID NO: 6145841 - DNA, 21 bp, Homo sapiens
ctccagaattacccttcctca

SEQ ID NO: 6145842 - DNA, 19 bp, Homo sapiens
ctccagaatttggaaatcc

SEQ ID NO: 6145843 - DNA, 16 bp, Homo sapiens
ctgccactaggctggg

SEQ ID NO: 6145844 - DNA, 18 bp, Homo sapiens
ctgccactaggctgggtg

SEQ ID NO: 6145845 - DNA, 23 bp, Homo sapiens
ctgccactaggctgggtgcccac

SEQ ID NO: 6145846 - DNA, 24 bp, Homo sapiens
ctgccactcacacagccaggtgcc

SEQ ID NO: 6145847 - DNA, 16 bp, Homo sapiens
ctgccactcacccttc

SEQ ID NO: 6145848 - DNA, 19 bp, Homo sapiens
ctgccactcacccttcctg

SEQ ID NO: 6145849 - DNA, 21 bp, Homo sapiens
ctgccactcaggcagcctgtg

SEQ ID NO: 6145850 - DNA, 21 bp, Homo sapiens
ctgccactccagtcctgccac

SEQ ID NO: 6145851 - DNA, 14 bp, Homo sapiens
ctgccactctcctg

SEQ ID NO: 6145852 - DNA, 16 bp, Homo sapiens
ctgccactctctggga

SEQ ID NO: 6145853 - DNA, 20 bp, Homo sapiens
ctgccactctctgggactct

SEQ ID NO: 6145854 - DNA, 15 bp, Homo sapiens
ctgccactctgctgc

SEQ ID NO: 6145855 - DNA, 14 bp, Homo sapiens
ctgccactgacctc

SEQ ID NO: 6145856 - DNA, 15 bp, Homo sapiens
ctgccactgacctca

SEQ ID NO: 6145857 - DNA, 17 bp, Homo sapiens
ctgccactgacctcacc

SEQ ID NO: 6145858 - DNA, 23 bp, Homo sapiens
ctgccactgaggagacagaaagc

SEQ ID NO: 6145859 - DNA, 18 bp, Homo sapiens
ctgccactgaggggggat

SEQ ID NO: 6145860 - DNA, 17 bp, Homo sapiens
ctgccactgcacaccag

SEQ ID NO: 6145861 - DNA, 13 bp, Homo sapiens
ctgccactgccgc

SEQ ID NO: 6145862 - DNA, 13 bp, Homo sapiens
ctgccactgggac

SEQ ID NO: 6145863 - DNA, 20 bp, Homo sapiens
ctgccactgggacggctcct

SEQ ID NO: 6145864 - DNA, 13 bp, Homo sapiens
ctgccactgggca

SEQ ID NO: 6145865 - DNA, 16 bp, Homo sapiens
ctgccactgggcacct

SEQ ID NO: 6145866 - DNA, 18 bp, Homo sapiens
ctgccactgggcacctgc

SEQ ID NO: 6145867 - DNA, 14 bp, Homo sapiens
ctgccactgggctc

SEQ ID NO: 6145868 - DNA, 16 bp, Homo sapiens
ctgccactgggctctg

SEQ ID NO: 6145869 - DNA, 21 bp, Homo sapiens
ctgccactgggctctggacct

SEQ ID NO: 6145870 - DNA, 14 bp, Homo sapiens
ctgccactgtgtgc

SEQ ID NO: 6145871 - DNA, 21 bp, Homo sapiens
ctgccacttattttttgtcaa

SEQ ID NO: 6145872 - DNA, 20 bp, Homo sapiens
ctgccacttctgcgggctcc

SEQ ID NO: 6145873 - DNA, 22 bp, Homo sapiens
ctgccactttcacgtggcctcc

SEQ ID NO: 6145874 - DNA, 19 bp, Homo sapiens
ctgccagaaaaaaataact

SEQ ID NO: 6145875 - DNA, 21 bp, Homo sapiens
ctgccagaagatcccctcagg

SEQ ID NO: 6145876 - DNA, 23 bp, Homo sapiens
ctgccagaagatcccctcaggac

SEQ ID NO: 6145877 - DNA, 13 bp, Homo sapiens
ctgccagaagtgt

SEQ ID NO: 6145878 - DNA, 21 bp, Homo sapiens
ctgccagaagtgtgttttggt

SEQ ID NO: 6145879 - DNA, 19 bp, Homo sapiens
ctgccagacactgagcttc

SEQ ID NO: 6145880 - DNA, 22 bp, Homo sapiens
ctgccagacactgcgccccgcc

SEQ ID NO: 6145881 - DNA, 13 bp, Homo sapiens
ctgccagacatgg

SEQ ID NO: 6145882 - DNA, 22 bp, Homo sapiens
ctgccagactgaaccagagctg

SEQ ID NO: 6145883 - DNA, 13 bp, Homo sapiens
ctgccagagaagc

SEQ ID NO: 6145884 - DNA, 20 bp, Homo sapiens
ctgccagagaagcatcggag

SEQ ID NO: 6145885 - DNA, 15 bp, Homo sapiens
ctgccagagaagtct

SEQ ID NO: 6145886 - DNA, 12 bp, Homo sapiens
ctgccagagcag

SEQ ID NO: 6145887 - DNA, 20 bp, Homo sapiens
ctgccagagcccaagtgcca

SEQ ID NO: 6145888 - DNA, 23 bp, Homo sapiens
ctgccagaggatgctctttccca

SEQ ID NO: 6145889 - DNA, 19 bp, Homo sapiens
ctgccagaggcctggtgcc

SEQ ID NO: 6145890 - DNA, 13 bp, Homo sapiens
ctgccagatgctg

SEQ ID NO: 6145891 - DNA, 21 bp, Homo sapiens
ctgccagatgctgatgttcag

SEQ ID NO: 6145892 - DNA, 14 bp, Homo sapiens
ctgccagcacagag

SEQ ID NO: 6145893 - DNA, 11 bp, Homo sapiens
ctgccagcacc

SEQ ID NO: 6145894 - DNA, 16 bp, Homo sapiens
ctgccagcacccccac

SEQ ID NO: 6145895 - DNA, 12 bp, Homo sapiens
ctgccagcagca

SEQ ID NO: 6145896 - DNA, 15 bp, Homo sapiens
ctgccagcagcagca

SEQ ID NO: 6145897 - DNA, 13 bp, Homo sapiens
ctgccagcaggaa

SEQ ID NO: 6145898 - DNA, 14 bp, Homo sapiens
ctgccagcaggaat

SEQ ID NO: 6145899 - DNA, 16 bp, Homo sapiens
ctgccagcaggaataa

SEQ ID NO: 6145900 - DNA, 17 bp, Homo sapiens
ctgccagcaggaataaa

SEQ ID NO: 6145901 - DNA, 20 bp, Homo sapiens
ctgccagcatttcccttcct

SEQ ID NO: 6145902 - DNA, 15 bp, Homo sapiens
ctgccagccactgtc

SEQ ID NO: 6145903 - DNA, 19 bp, Homo sapiens
ctgccagccactgtcaccg

SEQ ID NO: 6145904 - DNA, 18 bp, Homo sapiens
ctgccagccagcagccag

SEQ ID NO: 6145905 - DNA, 20 bp, Homo sapiens
ctgccagccagcagccagct

SEQ ID NO: 6145906 - DNA, 12 bp, Homo sapiens
ctgccagccatc

SEQ ID NO: 6145907 - DNA, 13 bp, Homo sapiens
ctgccagccatca

SEQ ID NO: 6145908 - DNA, 15 bp, Homo sapiens
ctgccagccatcaca

SEQ ID NO: 6145909 - DNA, 11 bp, Homo sapiens
ctgccagccca

SEQ ID NO: 6145910 - DNA, 12 bp, Homo sapiens
ctgccagcccac

SEQ ID NO: 6145911 - DNA, 17 bp, Homo sapiens
ctgccagcccagaacac

SEQ ID NO: 6145912 - DNA, 13 bp, Homo sapiens
ctgccagcccagc

SEQ ID NO: 6145913 - DNA, 14 bp, Homo sapiens
ctgccagcccagct

SEQ ID NO: 6145914 - DNA, 15 bp, Homo sapiens
ctgccagcccagctg

SEQ ID NO: 6145915 - DNA, 21 bp, Homo sapiens
ctgccagcccagctggccgga

SEQ ID NO: 6145916 - DNA, 23 bp, Homo sapiens
ctgccagcccagctggccggaag

SEQ ID NO: 6145917 - DNA, 13 bp, Homo sapiens
ctgccagccccac

SEQ ID NO: 6145918 - DNA, 12 bp, Homo sapiens
ctgccagcccct

SEQ ID NO: 6145919 - DNA, 16 bp, Homo sapiens
ctgccagccgaccctc

SEQ ID NO: 6145920 - DNA, 19 bp, Homo sapiens
ctgccagccgaccctcctg

SEQ ID NO: 6145921 - DNA, 19 bp, Homo sapiens
ctgccagccgccaccgggg

SEQ ID NO: 6145922 - DNA, 12 bp, Homo sapiens
ctgccagcctga

SEQ ID NO: 6145923 - DNA, 19 bp, Homo sapiens
ctgccagcctgagcggagg

SEQ ID NO: 6145924 - DNA, 19 bp, Homo sapiens
ctgccagcctgaggtgccc

SEQ ID NO: 6145925 - DNA, 15 bp, Homo sapiens
ctgccagcctggctt

SEQ ID NO: 6145926 - DNA, 22 bp, Homo sapiens
ctgccagcctggcttctggagc

SEQ ID NO: 6145927 - DNA, 17 bp, Homo sapiens
ctgccagccttgagccc

SEQ ID NO: 6145928 - DNA, 15 bp, Homo sapiens
ctgccagccttggag

SEQ ID NO: 6145929 - DNA, 19 bp, Homo sapiens
ctgccagcgcatgtgtcct

SEQ ID NO: 6145930 - DNA, 20 bp, Homo sapiens
ctgccagcgcatgtgtcctt

SEQ ID NO: 6145931 - DNA, 13 bp, Homo sapiens
ctgccagctccac

SEQ ID NO: 6145932 - DNA, 18 bp, Homo sapiens
ctgccagctccacagggt

SEQ ID NO: 6145933 - DNA, 19 bp, Homo sapiens
ctgccagctctcaggaccg

SEQ ID NO: 6145934 - DNA, 13 bp, Homo sapiens
ctgccagctctgt

SEQ ID NO: 6145935 - DNA, 14 bp, Homo sapiens
ctgccagctcttcc

SEQ ID NO: 6145936 - DNA, 15 bp, Homo sapiens
ctgccagctcttcct

SEQ ID NO: 6145937 - DNA, 19 bp, Homo sapiens
ctgccagctcttcctagct

SEQ ID NO: 6145938 - DNA, 12 bp, Homo sapiens
ctgccagctgcc

SEQ ID NO: 6145939 - DNA, 15 bp, Homo sapiens
ctgccagctgccttc

SEQ ID NO: 6145940 - DNA, 23 bp, Homo sapiens
ctgccagctgccttcctcatccc

SEQ ID NO: 6145941 - DNA, 16 bp, Homo sapiens
ctgccagctgggccca

SEQ ID NO: 6145942 - DNA, 17 bp, Homo sapiens
ctgccagcttgtgagct

SEQ ID NO: 6145943 - DNA, 20 bp, Homo sapiens
ctgccaggaaacaagggaag

SEQ ID NO: 6145944 - DNA, 21 bp, Homo sapiens
ctgccaggaaacaagggaagg

SEQ ID NO: 6145945 - DNA, 20 bp, Homo sapiens
ctgccaggaagccagcaggc

SEQ ID NO: 6145946 - DNA, 22 bp, Homo sapiens
ctgccaggaagccagcaggctc

SEQ ID NO: 6145947 - DNA, 23 bp, Homo sapiens
ctgccaggacacctgccccagcg

SEQ ID NO: 6145948 - DNA, 17 bp, Homo sapiens
ctgccaggaccccaggt

SEQ ID NO: 6145949 - DNA, 14 bp, Homo sapiens
ctgccaggagcagc

SEQ ID NO: 6145950 - DNA, 15 bp, Homo sapiens
ctgccaggagcagcc

SEQ ID NO: 6145951 - DNA, 18 bp, Homo sapiens
ctgccaggaggacccagg

SEQ ID NO: 6145952 - DNA, 19 bp, Homo sapiens
ctgccaggaggacccaggg

SEQ ID NO: 6145953 - DNA, 20 bp, Homo sapiens
ctgccaggagggacaaagga

SEQ ID NO: 6145954 - DNA, 21 bp, Homo sapiens
ctgccaggagggacaaaggag

SEQ ID NO: 6145955 - DNA, 22 bp, Homo sapiens
ctgccaggagggacaaaggagc

SEQ ID NO: 6145956 - DNA, 16 bp, Homo sapiens
ctgccaggcacaggca

SEQ ID NO: 6145957 - DNA, 17 bp, Homo sapiens
ctgccaggcacaggcag

SEQ ID NO: 6145958 - DNA, 22 bp, Homo sapiens
ctgccaggcacaggcagggcag

SEQ ID NO: 6145959 - DNA, 14 bp, Homo sapiens
ctgccaggcaccat

SEQ ID NO: 6145960 - DNA, 15 bp, Homo sapiens
ctgccaggcaccatc

SEQ ID NO: 6145961 - DNA, 18 bp, Homo sapiens
ctgccaggcaccatctgc

SEQ ID NO: 6145962 - DNA, 16 bp, Homo sapiens
ctgccaggcacctggc

SEQ ID NO: 6145963 - DNA, 17 bp, Homo sapiens
ctgccaggcacctggcc

SEQ ID NO: 6145964 - DNA, 19 bp, Homo sapiens
ctgccaggcacctggcctg

SEQ ID NO: 6145965 - DNA, 20 bp, Homo sapiens
ctgccaggcacctggcctgc

SEQ ID NO: 6145966 - DNA, 12 bp, Homo sapiens
ctgccaggcagg

SEQ ID NO: 6145967 - DNA, 15 bp, Homo sapiens
ctgccaggcaggggt

SEQ ID NO: 6145968 - DNA, 20 bp, Homo sapiens
ctgccaggcaggggtggggg

SEQ ID NO: 6145969 - DNA, 23 bp, Homo sapiens
ctgccaggccagcctccgagagg

SEQ ID NO: 6145970 - DNA, 12 bp, Homo sapiens
ctgccaggccca

SEQ ID NO: 6145971 - DNA, 22 bp, Homo sapiens
ctgccaggcccatctcaggtgc

SEQ ID NO: 6145972 - DNA, 13 bp, Homo sapiens
ctgccaggccccc

SEQ ID NO: 6145973 - DNA, 21 bp, Homo sapiens
ctgccaggcccccaagcctgc

SEQ ID NO: 6145974 - DNA, 15 bp, Homo sapiens
ctgccaggcccccac

SEQ ID NO: 6145975 - DNA, 19 bp, Homo sapiens
ctgccaggcccccaccaca

SEQ ID NO: 6145976 - DNA, 22 bp, Homo sapiens
ctgccaggcccccaccacacat

SEQ ID NO: 6145977 - DNA, 23 bp, Homo sapiens
ctgccaggcccccaccacacatc

SEQ ID NO: 6145978 - DNA, 14 bp, Homo sapiens
ctgccaggccctcc

SEQ ID NO: 6145979 - DNA, 14 bp, Homo sapiens
ctgccaggcctccc

SEQ ID NO: 6145980 - DNA, 22 bp, Homo sapiens
ctgccaggcctccctcgggctg

SEQ ID NO: 6145981 - DNA, 13 bp, Homo sapiens
ctgccaggcggcc

SEQ ID NO: 6145982 - DNA, 19 bp, Homo sapiens
ctgccaggcggccctgggg

SEQ ID NO: 6145983 - DNA, 23 bp, Homo sapiens
ctgccaggcggccctggggaggg

SEQ ID NO: 6145984 - DNA, 21 bp, Homo sapiens
ctgccaggcgttggtgccact

SEQ ID NO: 6145985 - DNA, 17 bp, Homo sapiens
ctgccaggctcccactg

SEQ ID NO: 6145986 - DNA, 23 bp, Homo sapiens
ctgccaggctcccactgcccctg

SEQ ID NO: 6145987 - DNA, 13 bp, Homo sapiens
ctgccaggctcct

SEQ ID NO: 6145988 - DNA, 21 bp, Homo sapiens
ctgccaggctctccctctctg

SEQ ID NO: 6145989 - DNA, 19 bp, Homo sapiens
ctgccaggctgcagggaca

SEQ ID NO: 6145990 - DNA, 16 bp, Homo sapiens
ctgccaggctgcctcc

SEQ ID NO: 6145991 - DNA, 15 bp, Homo sapiens
ctgccaggctgtttc

SEQ ID NO: 6145992 - DNA, 17 bp, Homo sapiens
ctgccagggaagacaga

SEQ ID NO: 6145993 - DNA, 20 bp, Homo sapiens
ctgccagggaagacagagca

SEQ ID NO: 6145994 - DNA, 23 bp, Homo sapiens
ctgccagggaagacagagcaggc

SEQ ID NO: 6145995 - DNA, 20 bp, Homo sapiens
ctgccagggacagagggggt

SEQ ID NO: 6145996 - DNA, 19 bp, Homo sapiens
ctgccagggagacagagct

SEQ ID NO: 6145997 - DNA, 12 bp, Homo sapiens
ctgccagggagc

SEQ ID NO: 6145998 - DNA, 11 bp, Homo sapiens
ctgccagggat

SEQ ID NO: 6145999 - DNA, 20 bp, Homo sapiens
ctgccagggatggcagtggc

SEQ ID NO: 6146000 - DNA, 21 bp, Homo sapiens
ctgccagggatggcagtggct

SEQ ID NO: 6146001 - DNA, 16 bp, Homo sapiens
ctgccagggcagggcc

SEQ ID NO: 6146002 - DNA, 16 bp, Homo sapiens
ctgccagggcccctgt

SEQ ID NO: 6146003 - DNA, 20 bp, Homo sapiens
ctgccagggcccgacctggg

SEQ ID NO: 6146004 - DNA, 13 bp, Homo sapiens
ctgccagggctcg

SEQ ID NO: 6146005 - DNA, 19 bp, Homo sapiens
ctgccagggctcgggcgct

SEQ ID NO: 6146006 - DNA, 20 bp, Homo sapiens
ctgccagggctcgggcgctg

SEQ ID NO: 6146007 - DNA, 14 bp, Homo sapiens
ctgccagggcttcc

SEQ ID NO: 6146008 - DNA, 16 bp, Homo sapiens
ctgccaggggctctgt

SEQ ID NO: 6146009 - DNA, 18 bp, Homo sapiens
ctgccaggggctctgtgg

SEQ ID NO: 6146010 - DNA, 23 bp, Homo sapiens
ctgccaggggctctgtggcaaaa

SEQ ID NO: 6146011 - DNA, 20 bp, Homo sapiens
ctgccagggggcaaggagaa

SEQ ID NO: 6146012 - DNA, 23 bp, Homo sapiens
ctgccagggggtttgaggaccct

SEQ ID NO: 6146013 - DNA, 21 bp, Homo sapiens
ctgccaggggtaacctggcca

SEQ ID NO: 6146014 - DNA, 18 bp, Homo sapiens
ctgccagggtggggctct

SEQ ID NO: 6146015 - DNA, 15 bp, Homo sapiens
ctgccaggttcctgt

SEQ ID NO: 6146016 - DNA, 22 bp, Homo sapiens
ctgccagtccccctgccccagg

SEQ ID NO: 6146017 - DNA, 16 bp, Homo sapiens
ctgccagtcctagctg

SEQ ID NO: 6146018 - DNA, 21 bp, Homo sapiens
ctgccagtcgggagagccagg

SEQ ID NO: 6146019 - DNA, 17 bp, Homo sapiens
ctgccagtgaagtcctt

SEQ ID NO: 6146020 - DNA, 17 bp, Homo sapiens
ctgccagtgcagccact

SEQ ID NO: 6146021 - DNA, 19 bp, Homo sapiens
ctgccagtgcagccactgg

SEQ ID NO: 6146022 - DNA, 14 bp, Homo sapiens
ctgccagtgccagg

SEQ ID NO: 6146023 - DNA, 19 bp, Homo sapiens
ctgccagtgccagggtggg

SEQ ID NO: 6146024 - DNA, 17 bp, Homo sapiens
ctgccagtgcctgggtg

SEQ ID NO: 6146025 - DNA, 14 bp, Homo sapiens
ctgccagtgcctta

SEQ ID NO: 6146026 - DNA, 22 bp, Homo sapiens
ctgccagtggggcctgaggctc

SEQ ID NO: 6146027 - DNA, 22 bp, Homo sapiens
ctgccagtggggtcgtgaggca

SEQ ID NO: 6146028 - DNA, 17 bp, Homo sapiens
ctgccagtgtcctgagc

SEQ ID NO: 6146029 - DNA, 15 bp, Homo sapiens
ctgccagtgtggagt

SEQ ID NO: 6146030 - DNA, 22 bp, Homo sapiens
ctgccagtgtttagaagagcct

SEQ ID NO: 6146031 - DNA, 17 bp, Homo sapiens
ctgccagttacttgggc

SEQ ID NO: 6146032 - DNA, 16 bp, Homo sapiens
ctgccagttctctgtg

SEQ ID NO: 6146033 - DNA, 22 bp, Homo sapiens
ctgccagttctctgtggaagca

SEQ ID NO: 6146034 - DNA, 14 bp, Homo sapiens
ctgccagttgaagt

SEQ ID NO: 6146035 - DNA, 13 bp, Homo sapiens
ctgccagttttgt

SEQ ID NO: 6146036 - DNA, 23 bp, Homo sapiens
ctgccataaaacattaagaaaat

SEQ ID NO: 6146037 - DNA, 21 bp, Homo sapiens
ctgccataaaatctcacgctg

SEQ ID NO: 6146038 - DNA, 15 bp, Homo sapiens
ctgccataaagccat

SEQ ID NO: 6146039 - DNA, 16 bp, Homo sapiens
ctgccataccgctggg

SEQ ID NO: 6146040 - DNA, 22 bp, Homo sapiens
ctgccataccgctggggaacag

SEQ ID NO: 6146041 - DNA, 17 bp, Homo sapiens
ctgccatagccaggagc

SEQ ID NO: 6146042 - DNA, 23 bp, Homo sapiens
ctgccatagggtctgcagcctgc

SEQ ID NO: 6146043 - DNA, 20 bp, Homo sapiens
ctgccatattctgttggcca

SEQ ID NO: 6146044 - DNA, 23 bp, Homo sapiens
ctgccatattctgttggccagtg

SEQ ID NO: 6146045 - DNA, 15 bp, Homo sapiens
ctgccatattgtgta

SEQ ID NO: 6146046 - DNA, 19 bp, Homo sapiens
ctgccatcaccgctgggtg

SEQ ID NO: 6146047 - DNA, 15 bp, Homo sapiens
ctgccatcagaaatt

SEQ ID NO: 6146048 - DNA, 19 bp, Homo sapiens
ctgccatcagcccctgctg

SEQ ID NO: 6146049 - DNA, 21 bp, Homo sapiens
ctgccatcagcccctgctgct

SEQ ID NO: 6146050 - DNA, 22 bp, Homo sapiens
ctgccatcagcccctgctgctc

SEQ ID NO: 6146051 - DNA, 23 bp, Homo sapiens
ctgccatcatgtttacagaggac

SEQ ID NO: 6146052 - DNA, 18 bp, Homo sapiens
ctgccatccaggttcagc

SEQ ID NO: 6146053 - DNA, 13 bp, Homo sapiens
ctgccatccccct

SEQ ID NO: 6146054 - DNA, 17 bp, Homo sapiens
ctgccatcctggcccag

SEQ ID NO: 6146055 - DNA, 18 bp, Homo sapiens
ctgccatcctggcccagg

SEQ ID NO: 6146056 - DNA, 20 bp, Homo sapiens
ctgccatccttgctgcagct

SEQ ID NO: 6146057 - DNA, 14 bp, Homo sapiens
ctgccatctagcca

SEQ ID NO: 6146058 - DNA, 17 bp, Homo sapiens
ctgccatctagccagcc

SEQ ID NO: 6146059 - DNA, 21 bp, Homo sapiens
ctgccatctcacctcctgctg

SEQ ID NO: 6146060 - DNA, 13 bp, Homo sapiens
ctgccatcttcag

SEQ ID NO: 6146061 - DNA, 14 bp, Homo sapiens
ctgccatcttcagg

SEQ ID NO: 6146062 - DNA, 15 bp, Homo sapiens
ctgccatgaactgga

SEQ ID NO: 6146063 - DNA, 12 bp, Homo sapiens
ctgccatgatgt

SEQ ID NO: 6146064 - DNA, 18 bp, Homo sapiens
ctgccatgattttggcca

SEQ ID NO: 6146065 - DNA, 21 bp, Homo sapiens
ctgccatgattttggccactt

SEQ ID NO: 6146066 - DNA, 21 bp, Homo sapiens
ctgccatgcaccaggactggc

SEQ ID NO: 6146067 - DNA, 18 bp, Homo sapiens
ctgccatgcatacatgct

SEQ ID NO: 6146068 - DNA, 16 bp, Homo sapiens
ctgccatgccactgcc

SEQ ID NO: 6146069 - DNA, 17 bp, Homo sapiens
ctgccatgccagcttat

SEQ ID NO: 6146070 - DNA, 17 bp, Homo sapiens
ctgccatgccaggaacc

SEQ ID NO: 6146071 - DNA, 18 bp, Homo sapiens
ctgccatgccaggaacct

SEQ ID NO: 6146072 - DNA, 13 bp, Homo sapiens
ctgccatgcccag

SEQ ID NO: 6146073 - DNA, 15 bp, Homo sapiens
ctgccatgcccagag

SEQ ID NO: 6146074 - DNA, 19 bp, Homo sapiens
ctgccatgcctcaagaaca

SEQ ID NO: 6146075 - DNA, 13 bp, Homo sapiens
ctgccatgctttg

SEQ ID NO: 6146076 - DNA, 17 bp, Homo sapiens
ctgccatggaggcacac

SEQ ID NO: 6146077 - DNA, 20 bp, Homo sapiens
ctgccatggaggcgccttcc

SEQ ID NO: 6146078 - DNA, 23 bp, Homo sapiens
ctgccatggaggcgccttcctgg

SEQ ID NO: 6146079 - DNA, 14 bp, Homo sapiens
ctgccatggcgtgt

SEQ ID NO: 6146080 - DNA, 14 bp, Homo sapiens
ctgccatggctgtg

SEQ ID NO: 6146081 - DNA, 15 bp, Homo sapiens
ctgccatggctgtga

SEQ ID NO: 6146082 - DNA, 21 bp, Homo sapiens
ctgccatgggagagtccaggc

SEQ ID NO: 6146083 - DNA, 23 bp, Homo sapiens
ctgccatgggagagtccaggcct

SEQ ID NO: 6146084 - DNA, 18 bp, Homo sapiens
ctgccatgggccagccta

SEQ ID NO: 6146085 - DNA, 20 bp, Homo sapiens
ctgccatgggccagcctagc

SEQ ID NO: 6146086 - DNA, 19 bp, Homo sapiens
ctgccatgggtgcagaccc

SEQ ID NO: 6146087 - DNA, 22 bp, Homo sapiens
ctgccatgtaaggttgtgcagg

SEQ ID NO: 6146088 - DNA, 17 bp, Homo sapiens
ctgccatgtacctcccc

SEQ ID NO: 6146089 - DNA, 18 bp, Homo sapiens
ctgccatgtacctcccct

SEQ ID NO: 6146090 - DNA, 21 bp, Homo sapiens
ctgccatgtacctcccctgcc

SEQ ID NO: 6146091 - DNA, 22 bp, Homo sapiens
ctgccatgtacctcccctgcct

SEQ ID NO: 6146092 - DNA, 23 bp, Homo sapiens
ctgccatgtacctcccctgcctt

SEQ ID NO: 6146093 - DNA, 20 bp, Homo sapiens
ctgccatgtaggctaagaaa

SEQ ID NO: 6146094 - DNA, 19 bp, Homo sapiens
ctgccatgtagttggggca

SEQ ID NO: 6146095 - DNA, 23 bp, Homo sapiens
ctgccatgtttagtgaatgactt

SEQ ID NO: 6146096 - DNA, 23 bp, Homo sapiens
ctgccattacagaggtattaaaa

SEQ ID NO: 6146097 - DNA, 16 bp, Homo sapiens
ctgccattacccagtg

SEQ ID NO: 6146098 - DNA, 21 bp, Homo sapiens
ctgccattagactgaatttaa

SEQ ID NO: 6146099 - DNA, 15 bp, Homo sapiens
ctgccattattttct

SEQ ID NO: 6146100 - DNA, 20 bp, Homo sapiens
ctgccattctgcatgagctg

SEQ ID NO: 6146101 - DNA, 22 bp, Homo sapiens
ctgccattctgtgcaggctgca

SEQ ID NO: 6146102 - DNA, 17 bp, Homo sapiens
ctgccattggcctcttg

SEQ ID NO: 6146103 - DNA, 18 bp, Homo sapiens
ctgccattggcctcttgt

SEQ ID NO: 6146104 - DNA, 13 bp, Homo sapiens
ctgccatttcatg

SEQ ID NO: 6146105 - DNA, 17 bp, Homo sapiens
ctgccatttccctgaac

SEQ ID NO: 6146106 - DNA, 15 bp, Homo sapiens
ctgccatttctgaga

SEQ ID NO: 6146107 - DNA, 19 bp, Homo sapiens
ctgccatttgcaccctccg

SEQ ID NO: 6146108 - DNA, 21 bp, Homo sapiens
ctgccatttgcaccctccgcc

SEQ ID NO: 6146109 - DNA, 22 bp, Homo sapiens
ctgccattttttaagagacagt

SEQ ID NO: 6146110 - DNA, 12 bp, Homo sapiens
ctgcccaaaatg

SEQ ID NO: 6146111 - DNA, 22 bp, Homo sapiens
ctgcccaaacagctgtatttat

SEQ ID NO: 6146112 - DNA, 18 bp, Homo sapiens
ctgcccaaacccttaact

SEQ ID NO: 6146113 - DNA, 19 bp, Homo sapiens
ctgcccaaactccccttcc

SEQ ID NO: 6146114 - DNA, 13 bp, Homo sapiens
ctgcccaaagcag

SEQ ID NO: 6146115 - DNA, 20 bp, Homo sapiens
ctgcccaaataggaggaaaa

SEQ ID NO: 6146116 - DNA, 13 bp, Homo sapiens
ctgcccaaattat

SEQ ID NO: 6146117 - DNA, 19 bp, Homo sapiens
ctgcccaaattatgtgaaa

SEQ ID NO: 6146118 - DNA, 17 bp, Homo sapiens
ctgcccaacctgctctc

SEQ ID NO: 6146119 - DNA, 22 bp, Homo sapiens
ctgcccaagcagcctggagact

SEQ ID NO: 6146120 - DNA, 14 bp, Homo sapiens
ctgcccaagcccag

SEQ ID NO: 6146121 - DNA, 16 bp, Homo sapiens
ctgcccaagcccaggc

SEQ ID NO: 6146122 - DNA, 21 bp, Homo sapiens
ctgcccaagggcctcccacca

SEQ ID NO: 6146123 - DNA, 22 bp, Homo sapiens
ctgcccaagtgaccagggaagt

SEQ ID NO: 6146124 - DNA, 23 bp, Homo sapiens
ctgcccaagtgaccagggaagtg

SEQ ID NO: 6146125 - DNA, 17 bp, Homo sapiens
ctgcccaagtggctctt

SEQ ID NO: 6146126 - DNA, 21 bp, Homo sapiens
ctgcccaagtggctcttggga

SEQ ID NO: 6146127 - DNA, 23 bp, Homo sapiens
ctgcccaagtggctcttgggaca

SEQ ID NO: 6146128 - DNA, 19 bp, Homo sapiens
ctgcccaagttgctctgta

SEQ ID NO: 6146129 - DNA, 20 bp, Homo sapiens
ctgcccaagttgctctgtat

SEQ ID NO: 6146130 - DNA, 17 bp, Homo sapiens
ctgcccaatcctccctg

SEQ ID NO: 6146131 - DNA, 18 bp, Homo sapiens
ctgcccaatcctccctgg

SEQ ID NO: 6146132 - DNA, 19 bp, Homo sapiens
ctgcccaatcctccctgga

SEQ ID NO: 6146133 - DNA, 20 bp, Homo sapiens
ctgcccaatcctccctggag

SEQ ID NO: 6146134 - DNA, 17 bp, Homo sapiens
ctgcccaatttcacaga

SEQ ID NO: 6146135 - DNA, 19 bp, Homo sapiens
ctgcccaatttcacagagt

SEQ ID NO: 6146136 - DNA, 22 bp, Homo sapiens
ctgcccacaaaaaattgctcct

SEQ ID NO: 6146137 - DNA, 23 bp, Homo sapiens
ctgcccacaaaaaattgctccta

SEQ ID NO: 6146138 - DNA, 21 bp, Homo sapiens
ctgcccacaacgtcccctcaa

SEQ ID NO: 6146139 - DNA, 23 bp, Homo sapiens
ctgcccacaacgtcccctcaagc

SEQ ID NO: 6146140 - DNA, 19 bp, Homo sapiens
ctgcccacacctcctgggg

SEQ ID NO: 6146141 - DNA, 19 bp, Homo sapiens
ctgcccacagtctttccgt

SEQ ID NO: 6146142 - DNA, 20 bp, Homo sapiens
ctgcccacatttgggctcag

SEQ ID NO: 6146143 - DNA, 23 bp, Homo sapiens
ctgcccacatttgggctcagggt

SEQ ID NO: 6146144 - DNA, 14 bp, Homo sapiens
ctgcccaccaaagg

SEQ ID NO: 6146145 - DNA, 13 bp, Homo sapiens
ctgcccaccccat

SEQ ID NO: 6146146 - DNA, 12 bp, Homo sapiens
ctgcccaccccc

SEQ ID NO: 6146147 - DNA, 14 bp, Homo sapiens
ctgcccaccccctc

SEQ ID NO: 6146148 - DNA, 15 bp, Homo sapiens
ctgcccaccccctca

SEQ ID NO: 6146149 - DNA, 19 bp, Homo sapiens
ctgcccaccccctcaagcc

SEQ ID NO: 6146150 - DNA, 16 bp, Homo sapiens
ctgcccaccccctgct

SEQ ID NO: 6146151 - DNA, 18 bp, Homo sapiens
ctgcccaccccctgctgg

SEQ ID NO: 6146152 - DNA, 15 bp, Homo sapiens
ctgcccaccccgcct

SEQ ID NO: 6146153 - DNA, 17 bp, Homo sapiens
ctgcccaccccgcctct

SEQ ID NO: 6146154 - DNA, 19 bp, Homo sapiens
ctgcccaccccgcctctgg

SEQ ID NO: 6146155 - DNA, 22 bp, Homo sapiens
ctgcccaccccgcctctgggct

SEQ ID NO: 6146156 - DNA, 16 bp, Homo sapiens
ctgcccaccctaccag

SEQ ID NO: 6146157 - DNA, 20 bp, Homo sapiens
ctgcccaccctaccagctcc

SEQ ID NO: 6146158 - DNA, 14 bp, Homo sapiens
ctgcccaccctcct

SEQ ID NO: 6146159 - DNA, 14 bp, Homo sapiens
ctgcccaccctggg

SEQ ID NO: 6146160 - DNA, 21 bp, Homo sapiens
ctgcccaccctgggcctcccg

SEQ ID NO: 6146161 - DNA, 23 bp, Homo sapiens
ctgcccaccctgggcctcccgtc

SEQ ID NO: 6146162 - DNA, 13 bp, Homo sapiens
ctgcccaccgacc

SEQ ID NO: 6146163 - DNA, 20 bp, Homo sapiens
ctgcccacctccttccagca

SEQ ID NO: 6146164 - DNA, 15 bp, Homo sapiens
ctgcccacctcggcc

SEQ ID NO: 6146165 - DNA, 18 bp, Homo sapiens
ctgcccacctgccaggct

SEQ ID NO: 6146166 - DNA, 16 bp, Homo sapiens
ctgcccacctgcctgg

SEQ ID NO: 6146167 - DNA, 18 bp, Homo sapiens
ctgcccacctgcctggcc

SEQ ID NO: 6146168 - DNA, 20 bp, Homo sapiens
ctgcccacctgcctggccgg

SEQ ID NO: 6146169 - DNA, 19 bp, Homo sapiens
ctgcccacctggcctctgc

SEQ ID NO: 6146170 - DNA, 16 bp, Homo sapiens
ctgcccacctggggtc

SEQ ID NO: 6146171 - DNA, 18 bp, Homo sapiens
ctgcccacgatcccctcc

SEQ ID NO: 6146172 - DNA, 19 bp, Homo sapiens
ctgcccacgcagacctgca

SEQ ID NO: 6146173 - DNA, 21 bp, Homo sapiens
ctgcccacgcagacctgcagc

SEQ ID NO: 6146174 - DNA, 16 bp, Homo sapiens
ctgcccacgcagagga

SEQ ID NO: 6146175 - DNA, 18 bp, Homo sapiens
ctgcccacgcagaggacg

SEQ ID NO: 6146176 - DNA, 21 bp, Homo sapiens
ctgcccacgcccttggagcct

SEQ ID NO: 6146177 - DNA, 23 bp, Homo sapiens
ctgcccacgcccttggagccttc

SEQ ID NO: 6146178 - DNA, 14 bp, Homo sapiens
ctgcccacggccac

SEQ ID NO: 6146179 - DNA, 23 bp, Homo sapiens
ctgcccacggccacccacccttc

SEQ ID NO: 6146180 - DNA, 23 bp, Homo sapiens
ctgcccactcccatcccttcaac

SEQ ID NO: 6146181 - DNA, 14 bp, Homo sapiens
ctgcccactccctg

SEQ ID NO: 6146182 - DNA, 17 bp, Homo sapiens
ctgcccactcgggtctg

SEQ ID NO: 6146183 - DNA, 16 bp, Homo sapiens
ctgcccactctgggga

SEQ ID NO: 6146184 - DNA, 19 bp, Homo sapiens
ctgcccacttagccgtcca

SEQ ID NO: 6146185 - DNA, 18 bp, Homo sapiens
ctgcccagaaagtggggg

SEQ ID NO: 6146186 - DNA, 23 bp, Homo sapiens
ctgcccagaacccttcctgagac

SEQ ID NO: 6146187 - DNA, 22 bp, Homo sapiens
ctgcccagaattcccagctgtc

SEQ ID NO: 6146188 - DNA, 17 bp, Homo sapiens
ctgcccagacaagattt

SEQ ID NO: 6146189 - DNA, 13 bp, Homo sapiens
ctgcccagacaca

SEQ ID NO: 6146190 - DNA, 17 bp, Homo sapiens
ctgcccagacacatggg

SEQ ID NO: 6146191 - DNA, 20 bp, Homo sapiens
ctgcccagacacatgggctt

SEQ ID NO: 6146192 - DNA, 14 bp, Homo sapiens
ctgcccagactgat

SEQ ID NO: 6146193 - DNA, 18 bp, Homo sapiens
ctgcccagactgatgagc

SEQ ID NO: 6146194 - DNA, 21 bp, Homo sapiens
ctgcccagactgatgagcaca

SEQ ID NO: 6146195 - DNA, 13 bp, Homo sapiens
ctgcccagagctg

SEQ ID NO: 6146196 - DNA, 20 bp, Homo sapiens
ctccagaatttggaaatcct

SEQ ID NO: 6146197 - DNA, 22 bp, Homo sapiens
ctccagaatttggaaatcctag

SEQ ID NO: 6146198 - DNA, 15 bp, Homo sapiens
ctccagacacagaga

SEQ ID NO: 6146199 - DNA, 16 bp, Homo sapiens
ctccagacacagagac

SEQ ID NO: 6146200 - DNA, 17 bp, Homo sapiens
ctccagacacatgtcca

SEQ ID NO: 6146201 - DNA, 15 bp, Homo sapiens
ctccagacagacagg

SEQ ID NO: 6146202 - DNA, 13 bp, Homo sapiens
ctccagacagata

SEQ ID NO: 6146203 - DNA, 14 bp, Homo sapiens
ctccagacaggagg

SEQ ID NO: 6146204 - DNA, 13 bp, Homo sapiens
ctccagacattgt

SEQ ID NO: 6146205 - DNA, 15 bp, Homo sapiens
ctccagacattgtat

SEQ ID NO: 6146206 - DNA, 17 bp, Homo sapiens
ctccagacattgtattt

SEQ ID NO: 6146207 - DNA, 9 bp, Homo sapiens
ctccagacc

SEQ ID NO: 6146208 - DNA, 16 bp, Homo sapiens
ctccagaccaccagcc

SEQ ID NO: 6146209 - DNA, 14 bp, Homo sapiens
ctccagacccagag

SEQ ID NO: 6146210 - DNA, 15 bp, Homo sapiens
ctccagacccagagg

SEQ ID NO: 6146211 - DNA, 16 bp, Homo sapiens
ctccagacccagaggc

SEQ ID NO: 6146212 - DNA, 17 bp, Homo sapiens
ctccagacccagaggcc

SEQ ID NO: 6146213 - DNA, 20 bp, Homo sapiens
ctccagacccagaggccctg

SEQ ID NO: 6146214 - DNA, 21 bp, Homo sapiens
ctccagacccccaccccttcc

SEQ ID NO: 6146215 - DNA, 14 bp, Homo sapiens
ctccagacccccag

SEQ ID NO: 6146216 - DNA, 20 bp, Homo sapiens
ctccagacccctaccctttc

SEQ ID NO: 6146217 - DNA, 15 bp, Homo sapiens
ctccagacccctggc

SEQ ID NO: 6146218 - DNA, 20 bp, Homo sapiens
ctccagacccctggcttttc

SEQ ID NO: 6146219 - DNA, 16 bp, Homo sapiens
ctccagacccctgtgg

SEQ ID NO: 6146220 - DNA, 19 bp, Homo sapiens
ctccagacccctgtggcag

SEQ ID NO: 6146221 - DNA, 16 bp, Homo sapiens
ctccagaccctgcctg

SEQ ID NO: 6146222 - DNA, 18 bp, Homo sapiens
ctccagaccctgcctgag

SEQ ID NO: 6146223 - DNA, 14 bp, Homo sapiens
ctccagacctgatc

SEQ ID NO: 6146224 - DNA, 23 bp, Homo sapiens
ctccagacctgatcctggaggcc

SEQ ID NO: 6146225 - DNA, 17 bp, Homo sapiens
ctccagacctgcccctc

SEQ ID NO: 6146226 - DNA, 19 bp, Homo sapiens
ctccagacgtaggggaggg

SEQ ID NO: 6146227 - DNA, 18 bp, Homo sapiens
ctccagactcagcagagt

SEQ ID NO: 6146228 - DNA, 21 bp, Homo sapiens
ctccagactcgagagggctga

SEQ ID NO: 6146229 - DNA, 15 bp, Homo sapiens
ctccagactctctgt

SEQ ID NO: 6146230 - DNA, 16 bp, Homo sapiens
ctccagactctctgtg

SEQ ID NO: 6146231 - DNA, 18 bp, Homo sapiens
ctccagactctctgtgaa

SEQ ID NO: 6146232 - DNA, 14 bp, Homo sapiens
ctccagactgcgga

SEQ ID NO: 6146233 - DNA, 21 bp, Homo sapiens
ctccagactgcggagcagcct

SEQ ID NO: 6146234 - DNA, 13 bp, Homo sapiens
ctccagagaaagc

SEQ ID NO: 6146235 - DNA, 23 bp, Homo sapiens
ctccagagaaagcacaatttaaa

SEQ ID NO: 6146236 - DNA, 13 bp, Homo sapiens
ctccagagaagcc

SEQ ID NO: 6146237 - DNA, 18 bp, Homo sapiens
ctccagagaagtttcgag

SEQ ID NO: 6146238 - DNA, 16 bp, Homo sapiens
ctccagagacagggaa

SEQ ID NO: 6146239 - DNA, 18 bp, Homo sapiens
ctccagagacagggaaag

SEQ ID NO: 6146240 - DNA, 20 bp, Homo sapiens
ctccagagagaaatcaggcc

SEQ ID NO: 6146241 - DNA, 23 bp, Homo sapiens
ctccagagagaaatcaggcctga

SEQ ID NO: 6146242 - DNA, 20 bp, Homo sapiens
ctccagagatgagtgtctgg

SEQ ID NO: 6146243 - DNA, 13 bp, Homo sapiens
ctccagagcagga

SEQ ID NO: 6146244 - DNA, 16 bp, Homo sapiens
ctccagagccagcctg

SEQ ID NO: 6146245 - DNA, 18 bp, Homo sapiens
ctccagagccagcctggg

SEQ ID NO: 6146246 - DNA, 16 bp, Homo sapiens
ctccagagccccacag

SEQ ID NO: 6146247 - DNA, 19 bp, Homo sapiens
ctccagagctgtcctcctg

SEQ ID NO: 6146248 - DNA, 14 bp, Homo sapiens
ctccagaggacctg

SEQ ID NO: 6146249 - DNA, 15 bp, Homo sapiens
ctccagaggagggga

SEQ ID NO: 6146250 - DNA, 20 bp, Homo sapiens
ctccagagtctgagcccccg

SEQ ID NO: 6146251 - DNA, 17 bp, Homo sapiens
ctccagataactctctt

SEQ ID NO: 6146252 - DNA, 19 bp, Homo sapiens
ctccagataactctctttc

SEQ ID NO: 6146253 - DNA, 13 bp, Homo sapiens
ctccagatagaga

SEQ ID NO: 6146254 - DNA, 21 bp, Homo sapiens
ctccagatgcagggcagtcat

SEQ ID NO: 6146255 - DNA, 19 bp, Homo sapiens
ctccagatgtttccagact

SEQ ID NO: 6146256 - DNA, 18 bp, Homo sapiens
ctccagattattttctat

SEQ ID NO: 6146257 - DNA, 23 bp, Homo sapiens
ctccagattattttctatatttg

SEQ ID NO: 6146258 - DNA, 14 bp, Homo sapiens
ctccagattctgat

SEQ ID NO: 6146259 - DNA, 15 bp, Homo sapiens
ctccagattctgatg

SEQ ID NO: 6146260 - DNA, 23 bp, Homo sapiens
ctccagatttttcggaggcccca

SEQ ID NO: 6146261 - DNA, 16 bp, Homo sapiens
ctccagcaaagctccc

SEQ ID NO: 6146262 - DNA, 18 bp, Homo sapiens
ctccagcaacacagcctg

SEQ ID NO: 6146263 - DNA, 14 bp, Homo sapiens
ctccagcaagacct

SEQ ID NO: 6146264 - DNA, 14 bp, Homo sapiens
ctccagcacagact

SEQ ID NO: 6146265 - DNA, 16 bp, Homo sapiens
ctccagcacagactgt

SEQ ID NO: 6146266 - DNA, 20 bp, Homo sapiens
ctccagcacagactgttccc

SEQ ID NO: 6146267 - DNA, 18 bp, Homo sapiens
ctccagcaccatccgcca

SEQ ID NO: 6146268 - DNA, 21 bp, Homo sapiens
ctccagcacgttttctggctt

SEQ ID NO: 6146269 - DNA, 22 bp, Homo sapiens
ctccagcacgttttctggcttc

SEQ ID NO: 6146270 - DNA, 15 bp, Homo sapiens
ctccagcagcacacc

SEQ ID NO: 6146271 - DNA, 21 bp, Homo sapiens
ctccagcaggtaggggcacag

SEQ ID NO: 6146272 - DNA, 23 bp, Homo sapiens
ctccagcaggtaggggcacagtg

SEQ ID NO: 6146273 - DNA, 17 bp, Homo sapiens
ctccagcagtgctgggc

SEQ ID NO: 6146274 - DNA, 18 bp, Homo sapiens
ctccagcagtgctgggcc

SEQ ID NO: 6146275 - DNA, 22 bp, Homo sapiens
ctccagcagtgctgggcccagc

SEQ ID NO: 6146276 - DNA, 17 bp, Homo sapiens
ctccagcatcccagcct

SEQ ID NO: 6146277 - DNA, 18 bp, Homo sapiens
ctccagcatcccagcctc

SEQ ID NO: 6146278 - DNA, 22 bp, Homo sapiens
ctccagcatcccagcctcagaa

SEQ ID NO: 6146279 - DNA, 16 bp, Homo sapiens
ctccagcatcttttcc

SEQ ID NO: 6146280 - DNA, 19 bp, Homo sapiens
ctccagcattctcagccac

SEQ ID NO: 6146281 - DNA, 13 bp, Homo sapiens
ctccagccaaaga

SEQ ID NO: 6146282 - DNA, 21 bp, Homo sapiens
ctccagccaacccctgtggag

SEQ ID NO: 6146283 - DNA, 21 bp, Homo sapiens
ctccagccaatttcaaagaaa

SEQ ID NO: 6146284 - DNA, 22 bp, Homo sapiens
ctccagccaatttcaaagaaaa

SEQ ID NO: 6146285 - DNA, 19 bp, Homo sapiens
ctccagccaccaaggctgc

SEQ ID NO: 6146286 - DNA, 16 bp, Homo sapiens
ctccagccaccaccca

SEQ ID NO: 6146287 - DNA, 13 bp, Homo sapiens
ctccagccagcaa

SEQ ID NO: 6146288 - DNA, 16 bp, Homo sapiens
ctccagccagcaatga

SEQ ID NO: 6146289 - DNA, 13 bp, Homo sapiens
ctccagccagcgc

SEQ ID NO: 6146290 - DNA, 19 bp, Homo sapiens
ctccagccagcgcctccct

SEQ ID NO: 6146291 - DNA, 23 bp, Homo sapiens
ctccagccagcgcctccctccac

SEQ ID NO: 6146292 - DNA, 21 bp, Homo sapiens
ctccagccatcaagagactga

SEQ ID NO: 6146293 - DNA, 17 bp, Homo sapiens
ctccagcccacacccct

SEQ ID NO: 6146294 - DNA, 15 bp, Homo sapiens
ctccagcccatgctg

SEQ ID NO: 6146295 - DNA, 17 bp, Homo sapiens
ctccagcccatgctggc

SEQ ID NO: 6146296 - DNA, 19 bp, Homo sapiens
ctccagcccatgctggctg

SEQ ID NO: 6146297 - DNA, 20 bp, Homo sapiens
ctccagcccatgctggctgg

SEQ ID NO: 6146298 - DNA, 16 bp, Homo sapiens
ctccagccccgcgacc

SEQ ID NO: 6146299 - DNA, 14 bp, Homo sapiens
ctccagcccctgga

SEQ ID NO: 6146300 - DNA, 20 bp, Homo sapiens
ctccagcccctggatgcagc

SEQ ID NO: 6146301 - DNA, 13 bp, Homo sapiens
ctccagcccctgt

SEQ ID NO: 6146302 - DNA, 19 bp, Homo sapiens
ctccagccccttctcagaa

SEQ ID NO: 6146303 - DNA, 21 bp, Homo sapiens
ctccagcccctttgcctctgt

SEQ ID NO: 6146304 - DNA, 19 bp, Homo sapiens
ctccagcccgagtggtctc

SEQ ID NO: 6146305 - DNA, 22 bp, Homo sapiens
ctccagcccgagtggtctcctc

SEQ ID NO: 6146306 - DNA, 20 bp, Homo sapiens
ctccagcccgggagcctagg

SEQ ID NO: 6146307 - DNA, 21 bp, Homo sapiens
ctccagcccgggagcctagga

SEQ ID NO: 6146308 - DNA, 14 bp, Homo sapiens
ctccagccctgtcc

SEQ ID NO: 6146309 - DNA, 18 bp, Homo sapiens
ctccagccgccggctgtg

SEQ ID NO: 6146310 - DNA, 21 bp, Homo sapiens
ctccagccgccggctgtgcag

SEQ ID NO: 6146311 - DNA, 16 bp, Homo sapiens
ctccagccgctggcaa

SEQ ID NO: 6146312 - DNA, 20 bp, Homo sapiens
ctccagcctcacagatgctg

SEQ ID NO: 6146313 - DNA, 22 bp, Homo sapiens
ctccagcctcacagatgctggc

SEQ ID NO: 6146314 - DNA, 17 bp, Homo sapiens
ctccagcctcagcctcc

SEQ ID NO: 6146315 - DNA, 23 bp, Homo sapiens
ctccagcctcccctcccctgggg

SEQ ID NO: 6146316 - DNA, 24 bp, Homo sapiens
ctccagcctccctgtctccagctg

SEQ ID NO: 6146317 - DNA, 15 bp, Homo sapiens
ctccagcctctcccg

SEQ ID NO: 6146318 - DNA, 24 bp, Homo sapiens
ctccagcctctcccggctgcctgc

SEQ ID NO: 6146319 - DNA, 13 bp, Homo sapiens
ctccagcctctgc

SEQ ID NO: 6146320 - DNA, 14 bp, Homo sapiens
ctccagcctctgcc

SEQ ID NO: 6146321 - DNA, 22 bp, Homo sapiens
ctccagcctctgccgctgccat

SEQ ID NO: 6146322 - DNA, 13 bp, Homo sapiens
ctccagcctctgt

SEQ ID NO: 6146323 - DNA, 11 bp, Homo sapiens
ctccagcctga

SEQ ID NO: 6146324 - DNA, 20 bp, Homo sapiens
ctccagcctgacaacagcct

SEQ ID NO: 6146325 - DNA, 21 bp, Homo sapiens
ctccagcctgacaacagcctg

SEQ ID NO: 6146326 - DNA, 17 bp, Homo sapiens
ctccagcctgagtgaca

SEQ ID NO: 6146327 - DNA, 19 bp, Homo sapiens
ctccagcctgagtgacaga

SEQ ID NO: 6146328 - DNA, 23 bp, Homo sapiens
ctccagcctgcccaagcccaggc

SEQ ID NO: 6146329 - DNA, 14 bp, Homo sapiens
ctccagcctgccct

SEQ ID NO: 6146330 - DNA, 21 bp, Homo sapiens
ctccagcctggacccccagct

SEQ ID NO: 6146331 - DNA, 12 bp, Homo sapiens
ctccagcctggc

SEQ ID NO: 6146332 - DNA, 17 bp, Homo sapiens
ctcccagctttctgtgt

SEQ ID NO: 6146333 - DNA, 18 bp, Homo sapiens
ctcccaggaactgggcca

SEQ ID NO: 6146334 - DNA, 11 bp, Homo sapiens
ctcccaggaag

SEQ ID NO: 6146335 - DNA, 15 bp, Homo sapiens
ctcccaggacaagca

SEQ ID NO: 6146336 - DNA, 16 bp, Homo sapiens
ctcccaggacaagcac

SEQ ID NO: 6146337 - DNA, 23 bp, Homo sapiens
ctcccaggacgcagggagaccct

SEQ ID NO: 6146338 - DNA, 21 bp, Homo sapiens
ctcccaggactctgaccccag

SEQ ID NO: 6146339 - DNA, 20 bp, Homo sapiens
ctcccaggagcctgcccagc

SEQ ID NO: 6146340 - DNA, 18 bp, Homo sapiens
ctcccaggaggtgcttga

SEQ ID NO: 6146341 - DNA, 21 bp, Homo sapiens
ctcccaggatcagcagaagat

SEQ ID NO: 6146342 - DNA, 12 bp, Homo sapiens
ctcccaggatct

SEQ ID NO: 6146343 - DNA, 13 bp, Homo sapiens
ctcccaggatctc

SEQ ID NO: 6146344 - DNA, 17 bp, Homo sapiens
ctcccaggatgacgtgc

SEQ ID NO: 6146345 - DNA, 18 bp, Homo sapiens
ctcccaggcaagcagctg

SEQ ID NO: 6146346 - DNA, 18 bp, Homo sapiens
ctcccaggcaaggctgtg

SEQ ID NO: 6146347 - DNA, 22 bp, Homo sapiens
ctcccaggcaaggctgtggacc

SEQ ID NO: 6146348 - DNA, 15 bp, Homo sapiens
ctcccaggcattccc

SEQ ID NO: 6146349 - DNA, 21 bp, Homo sapiens
ctcccaggccaacagtagcca

SEQ ID NO: 6146350 - DNA, 21 bp, Homo sapiens
ctcccaggccaggctccttcc

SEQ ID NO: 6146351 - DNA, 12 bp, Homo sapiens
ctcccaggcccc

SEQ ID NO: 6146352 - DNA, 16 bp, Homo sapiens
ctcccaggccccaggc

SEQ ID NO: 6146353 - DNA, 20 bp, Homo sapiens
ctcccaggccccaggggaga

SEQ ID NO: 6146354 - DNA, 19 bp, Homo sapiens
ctcccaggccccatgacct

SEQ ID NO: 6146355 - DNA, 15 bp, Homo sapiens
ctcccaggccccctg

SEQ ID NO: 6146356 - DNA, 22 bp, Homo sapiens
ctcccaggctggagtgcagtga

SEQ ID NO: 6146357 - DNA, 20 bp, Homo sapiens
ctcccagggagcaagggcag

SEQ ID NO: 6146358 - DNA, 18 bp, Homo sapiens
ctcccagggagtgagcag

SEQ ID NO: 6146359 - DNA, 20 bp, Homo sapiens
ctcccagggagtgagcagct

SEQ ID NO: 6146360 - DNA, 24 bp, Homo sapiens
ctcccagggagtgagcagctactg

SEQ ID NO: 6146361 - DNA, 11 bp, Homo sapiens
ctcccagggat

SEQ ID NO: 6146362 - DNA, 22 bp, Homo sapiens
ctcccagggatgctctttgtaa

SEQ ID NO: 6146363 - DNA, 23 bp, Homo sapiens
ctcccagggccttaaaagccatc

SEQ ID NO: 6146364 - DNA, 18 bp, Homo sapiens
ctcccagggctacacaga

SEQ ID NO: 6146365 - DNA, 14 bp, Homo sapiens
ctcccagggctctc

SEQ ID NO: 6146366 - DNA, 17 bp, Homo sapiens
ctcccagggctctctgg

SEQ ID NO: 6146367 - DNA, 15 bp, Homo sapiens
ctcccaggggactgt

SEQ ID NO: 6146368 - DNA, 19 bp, Homo sapiens
ctcccaggggactgttcct

SEQ ID NO: 6146369 - DNA, 16 bp, Homo sapiens
ctcccaggggagccag

SEQ ID NO: 6146370 - DNA, 17 bp, Homo sapiens
ctcccaggggagccagc

SEQ ID NO: 6146371 - DNA, 23 bp, Homo sapiens
ctcccaggggagccagctgcttg

SEQ ID NO: 6146372 - DNA, 17 bp, Homo sapiens
ctcccaggggctccctc

SEQ ID NO: 6146373 - DNA, 13 bp, Homo sapiens
ctcccaggggtct

SEQ ID NO: 6146374 - DNA, 17 bp, Homo sapiens
ctcccagggtccctgcc

SEQ ID NO: 6146375 - DNA, 13 bp, Homo sapiens
ctcccagggtcct

SEQ ID NO: 6146376 - DNA, 11 bp, Homo sapiens
ctcccagggtg

SEQ ID NO: 6146377 - DNA, 12 bp, Homo sapiens
ctcccagggtgg

SEQ ID NO: 6146378 - DNA, 21 bp, Homo sapiens
ctcccagggttttaactttgt

SEQ ID NO: 6146379 - DNA, 16 bp, Homo sapiens
ctcccaggtaccagct

SEQ ID NO: 6146380 - DNA, 18 bp, Homo sapiens
ctcccaggtaccagctgc

SEQ ID NO: 6146381 - DNA, 15 bp, Homo sapiens
ctgcctcccacttca

SEQ ID NO: 6146382 - DNA, 16 bp, Homo sapiens
ctgcctcccagccctg

SEQ ID NO: 6146383 - DNA, 17 bp, Homo sapiens
ctgcctcccagccctgc

SEQ ID NO: 6146384 - DNA, 20 bp, Homo sapiens
ctgcctcccagccctgccag

SEQ ID NO: 6146385 - DNA, 21 bp, Homo sapiens
ctgcctcccagccctgccagg

SEQ ID NO: 6146386 - DNA, 17 bp, Homo sapiens
ctgcctcccatgcctgg

SEQ ID NO: 6146387 - DNA, 16 bp, Homo sapiens
ctgcctcccattctga

SEQ ID NO: 6146388 - DNA, 17 bp, Homo sapiens
ctgcctcccattctgca

SEQ ID NO: 6146389 - DNA, 16 bp, Homo sapiens
ctgcctccccaatcca

SEQ ID NO: 6146390 - DNA, 21 bp, Homo sapiens
ctgcctccccggaagtgcctt

SEQ ID NO: 6146391 - DNA, 19 bp, Homo sapiens
ctgcctcccctcctctgct

SEQ ID NO: 6146392 - DNA, 20 bp, Homo sapiens
ctgcctcccctcctctgctt

SEQ ID NO: 6146393 - DNA, 17 bp, Homo sapiens
ctgcctcccctgtgcag

SEQ ID NO: 6146394 - DNA, 11 bp, Homo sapiens
ctgcctccctc

SEQ ID NO: 6146395 - DNA, 18 bp, Homo sapiens
ctgcctccctcaccctga

SEQ ID NO: 6146396 - DNA, 19 bp, Homo sapiens
ctgcctccctcaccctgag

SEQ ID NO: 6146397 - DNA, 15 bp, Homo sapiens
ctgcctccctctctt

SEQ ID NO: 6146398 - DNA, 21 bp, Homo sapiens
ctgcctccctggggaccagga

SEQ ID NO: 6146399 - DNA, 15 bp, Homo sapiens
ctgcctccctgtcca

SEQ ID NO: 6146400 - DNA, 15 bp, Homo sapiens
ctgcctcccttcatg

SEQ ID NO: 6146401 - DNA, 17 bp, Homo sapiens
ctgcctcccttcatgca

SEQ ID NO: 6146402 - DNA, 18 bp, Homo sapiens
ctgcctcccttcatgcat

SEQ ID NO: 6146403 - DNA, 23 bp, Homo sapiens
ctgcctcccttcatgcatggaaa

SEQ ID NO: 6146404 - DNA, 21 bp, Homo sapiens
ctgcctcccttgtggcagcaa

SEQ ID NO: 6146405 - DNA, 18 bp, Homo sapiens
ctgcctccctttcataca

SEQ ID NO: 6146406 - DNA, 15 bp, Homo sapiens
ctgcctccctttctg

SEQ ID NO: 6146407 - DNA, 16 bp, Homo sapiens
ctgcctccctttctgg

SEQ ID NO: 6146408 - DNA, 20 bp, Homo sapiens
ctgcctccctttctgggagg

SEQ ID NO: 6146409 - DNA, 12 bp, Homo sapiens
ctgcctccgagg

SEQ ID NO: 6146410 - DNA, 16 bp, Homo sapiens
ctgcctccgctggctt

SEQ ID NO: 6146411 - DNA, 17 bp, Homo sapiens
ctgcctccgctggcttt

SEQ ID NO: 6146412 - DNA, 22 bp, Homo sapiens
ctgcctccgggcctcggcctgg

SEQ ID NO: 6146413 - DNA, 23 bp, Homo sapiens
ctgcctccgggcctcggcctggc

SEQ ID NO: 6146414 - DNA, 12 bp, Homo sapiens
ctgcctcctagg

SEQ ID NO: 6146415 - DNA, 23 bp, Homo sapiens
ctgcctcctcagctttgcttcat

SEQ ID NO: 6146416 - DNA, 12 bp, Homo sapiens
ctgcctcctcat

SEQ ID NO: 6146417 - DNA, 12 bp, Homo sapiens
ctgcctcctccc

SEQ ID NO: 6146418 - DNA, 13 bp, Homo sapiens
ctgcctcctcctc

SEQ ID NO: 6146419 - DNA, 16 bp, Homo sapiens
ctgcctcctcctcacg

SEQ ID NO: 6146420 - DNA, 15 bp, Homo sapiens
ctgcctcctcgttcc

SEQ ID NO: 6146421 - DNA, 17 bp, Homo sapiens
ctgcctcctcgttcctt

SEQ ID NO: 6146422 - DNA, 14 bp, Homo sapiens
ctgcctcctcttca

SEQ ID NO: 6146423 - DNA, 24 bp, Homo sapiens
ctgcctcctcttcaactgaccagc

SEQ ID NO: 6146424 - DNA, 18 bp, Homo sapiens
ctgcctcctgatgtttgt

SEQ ID NO: 6146425 - DNA, 13 bp, Homo sapiens
ctgcctcctgcca

SEQ ID NO: 6146426 - DNA, 16 bp, Homo sapiens
ctgcctcctgccaccc

SEQ ID NO: 6146427 - DNA, 22 bp, Homo sapiens
ctgcctcctgccggctccttgg

SEQ ID NO: 6146428 - DNA, 13 bp, Homo sapiens
ctgcctcctgcct

SEQ ID NO: 6146429 - DNA, 19 bp, Homo sapiens
ctgcctcctgcctgcccct

SEQ ID NO: 6146430 - DNA, 14 bp, Homo sapiens
ctgcctcctgctct

SEQ ID NO: 6146431 - DNA, 15 bp, Homo sapiens
ctgcctcctgctttg

SEQ ID NO: 6146432 - DNA, 14 bp, Homo sapiens
ctgcctcctggagg

SEQ ID NO: 6146433 - DNA, 18 bp, Homo sapiens
ctgcctcctggctcaggc

SEQ ID NO: 6146434 - DNA, 23 bp, Homo sapiens
ctgcctcctggtttcctttctca

SEQ ID NO: 6146435 - DNA, 21 bp, Homo sapiens
ctgcctcctttgtgaggaagc

SEQ ID NO: 6146436 - DNA, 17 bp, Homo sapiens
ctgcctcgaactggctg

SEQ ID NO: 6146437 - DNA, 20 bp, Homo sapiens
ctgcctcgaactggctgcaa

SEQ ID NO: 6146438 - DNA, 18 bp, Homo sapiens
ctgcctcgagggccgcct

SEQ ID NO: 6146439 - DNA, 16 bp, Homo sapiens
ctgcctcgccttgtgt

SEQ ID NO: 6146440 - DNA, 16 bp, Homo sapiens
ctgcctcggactccat

SEQ ID NO: 6146441 - DNA, 19 bp, Homo sapiens
ctgcctcggactccatggc

SEQ ID NO: 6146442 - DNA, 19 bp, Homo sapiens
ctgcctcgtagagtgacct

SEQ ID NO: 6146443 - DNA, 14 bp, Homo sapiens
ctgcctctaaggcc

SEQ ID NO: 6146444 - DNA, 16 bp, Homo sapiens
ctgcctctaaggccaa

SEQ ID NO: 6146445 - DNA, 18 bp, Homo sapiens
ctgcctctaaggccaagg

SEQ ID NO: 6146446 - DNA, 19 bp, Homo sapiens
ctgcctctacccaaccagg

SEQ ID NO: 6146447 - DNA, 19 bp, Homo sapiens
ctgcctctactgggaaggc

SEQ ID NO: 6146448 - DNA, 22 bp, Homo sapiens
ctgcctctactgggaaggctac

SEQ ID NO: 6146449 - DNA, 15 bp, Homo sapiens
ctgcctctagtcccc

SEQ ID NO: 6146450 - DNA, 22 bp, Homo sapiens
ctgcctctagtccccaaggcct

SEQ ID NO: 6146451 - DNA, 20 bp, Homo sapiens
ctgcctctatccctggccac

SEQ ID NO: 6146452 - DNA, 12 bp, Homo sapiens
ctgcctctatgc

SEQ ID NO: 6146453 - DNA, 15 bp, Homo sapiens
ctgcctctatgccct

SEQ ID NO: 6146454 - DNA, 16 bp, Homo sapiens
ctgcctctatgccctg

SEQ ID NO: 6146455 - DNA, 17 bp, Homo sapiens
ctgcctctatgccctgc

SEQ ID NO: 6146456 - DNA, 18 bp, Homo sapiens
ctgcctctatgccctgca

SEQ ID NO: 6146457 - DNA, 23 bp, Homo sapiens
ctgcctctatgccctgcagagca

SEQ ID NO: 6146458 - DNA, 13 bp, Homo sapiens
ctgcctctcacac

SEQ ID NO: 6146459 - DNA, 16 bp, Homo sapiens
ctgcctctcacagctg

SEQ ID NO: 6146460 - DNA, 22 bp, Homo sapiens
ctgcctctcacagctgagttgt

SEQ ID NO: 6146461 - DNA, 22 bp, Homo sapiens
ctgcctctcatcaactgaatga

SEQ ID NO: 6146462 - DNA, 14 bp, Homo sapiens
ctgcctctccaggc

SEQ ID NO: 6146463 - DNA, 21 bp, Homo sapiens
ctgcctctcccaggcaggggc

SEQ ID NO: 6146464 - DNA, 14 bp, Homo sapiens
ctgcctctccctct

SEQ ID NO: 6146465 - DNA, 18 bp, Homo sapiens
ctgcctctccctggccct

SEQ ID NO: 6146466 - DNA, 16 bp, Homo sapiens
ctgcctctccctgggt

SEQ ID NO: 6146467 - DNA, 21 bp, Homo sapiens
ctgcctctccctgggtctggg

SEQ ID NO: 6146468 - DNA, 18 bp, Homo sapiens
ctgcctctcggtggccag

SEQ ID NO: 6146469 - DNA, 12 bp, Homo sapiens
ctgcctctctgc

SEQ ID NO: 6146470 - DNA, 19 bp, Homo sapiens
ctgcctctctgcaggtccc

SEQ ID NO: 6146471 - DNA, 20 bp, Homo sapiens
ctgcctctctgcaggtccct

SEQ ID NO: 6146472 - DNA, 21 bp, Homo sapiens
ctgcctctctgcaggtcccta

SEQ ID NO: 6146473 - DNA, 15 bp, Homo sapiens
ctgcctctctgctcc

SEQ ID NO: 6146474 - DNA, 19 bp, Homo sapiens
ctgcctctctgctccagag

SEQ ID NO: 6146475 - DNA, 18 bp, Homo sapiens
ctgcctctcttcttcccc

SEQ ID NO: 6146476 - DNA, 13 bp, Homo sapiens
ctgcctctgaaaa

SEQ ID NO: 6146477 - DNA, 17 bp, Homo sapiens
ctgcctctgaaaatatt

SEQ ID NO: 6146478 - DNA, 19 bp, Homo sapiens
ctgcctctgaaaatatttt

SEQ ID NO: 6146479 - DNA, 22 bp, Homo sapiens
ctgcctctgaactgctgctggt

SEQ ID NO: 6146480 - DNA, 17 bp, Homo sapiens
ctgcctctgacacacag

SEQ ID NO: 6146481 - DNA, 18 bp, Homo sapiens
ctgcctctgacacacagc

SEQ ID NO: 6146482 - DNA, 22 bp, Homo sapiens
ctgcctctgacacacagctctg

SEQ ID NO: 6146483 - DNA, 19 bp, Homo sapiens
ctgcctctgacagcagcct

SEQ ID NO: 6146484 - DNA, 16 bp, Homo sapiens
ctgcctctgagccact

SEQ ID NO: 6146485 - DNA, 21 bp, Homo sapiens
ctgcctctgagggaaagccca

SEQ ID NO: 6146486 - DNA, 20 bp, Homo sapiens
ctgcctctgccacactctga

SEQ ID NO: 6146487 - DNA, 16 bp, Homo sapiens
ctgcctctgccacagc

SEQ ID NO: 6146488 - DNA, 20 bp, Homo sapiens
ctgcctctgccatgcccaga

SEQ ID NO: 6146489 - DNA, 13 bp, Homo sapiens
ctgcctctgcctc

SEQ ID NO: 6146490 - DNA, 17 bp, Homo sapiens
ctgcctctgcctgcatt

SEQ ID NO: 6146491 - DNA, 18 bp, Homo sapiens
ctgcctctgcctgcattc

SEQ ID NO: 6146492 - DNA, 14 bp, Homo sapiens
ctgcctctgcctta

SEQ ID NO: 6146493 - DNA, 15 bp, Homo sapiens
ctgcctctgccttag

SEQ ID NO: 6146494 - DNA, 23 bp, Homo sapiens
ctgcctctgccttagaggagccc

SEQ ID NO: 6146495 - DNA, 11 bp, Homo sapiens
ctgcctctgct

SEQ ID NO: 6146496 - DNA, 15 bp, Homo sapiens
ctgcctctgctccct

SEQ ID NO: 6146497 - DNA, 20 bp, Homo sapiens
ctgcctctggaaaactattg

SEQ ID NO: 6146498 - DNA, 13 bp, Homo sapiens
ctgcctctgggag

SEQ ID NO: 6146499 - DNA, 14 bp, Homo sapiens
ctgcctctgggagg

SEQ ID NO: 6146500 - DNA, 15 bp, Homo sapiens
ctgcctctgggcagc

SEQ ID NO: 6146501 - DNA, 22 bp, Homo sapiens
ctgcctctgggtgagtggctga

SEQ ID NO: 6146502 - DNA, 13 bp, Homo sapiens
ctgcctctgtgga

SEQ ID NO: 6146503 - DNA, 13 bp, Homo sapiens
ctgcctcttaact

SEQ ID NO: 6146504 - DNA, 17 bp, Homo sapiens
ctgcctcttaactcctt

SEQ ID NO: 6146505 - DNA, 19 bp, Homo sapiens
ctgcctcttagacttctgc

SEQ ID NO: 6146506 - DNA, 22 bp, Homo sapiens
ctgcctcttccccctgcttcca

SEQ ID NO: 6146507 - DNA, 12 bp, Homo sapiens
ctgcctcttcct

SEQ ID NO: 6146508 - DNA, 13 bp, Homo sapiens
ctgcctcttctct

SEQ ID NO: 6146509 - DNA, 14 bp, Homo sapiens
ctgcctcttctcta

SEQ ID NO: 6146510 - DNA, 22 bp, Homo sapiens
ctgcctcttctcttgacagtct

SEQ ID NO: 6146511 - DNA, 16 bp, Homo sapiens
ctgcctcttctgggag

SEQ ID NO: 6146512 - DNA, 16 bp, Homo sapiens
ctgcctcttggcttct

SEQ ID NO: 6146513 - DNA, 22 bp, Homo sapiens
ctgcctcttggcttctcagccc

SEQ ID NO: 6146514 - DNA, 21 bp, Homo sapiens
ctgcctcttgtttctgtgccc

SEQ ID NO: 6146515 - DNA, 14 bp, Homo sapiens
ctgcctctttccct

SEQ ID NO: 6146516 - DNA, 14 bp, Homo sapiens
ctgcctctttgagt

SEQ ID NO: 6146517 - DNA, 18 bp, Homo sapiens
ctgcctctttgctgcttt

SEQ ID NO: 6146518 - DNA, 14 bp, Homo sapiens
ctgcctgaagagag

SEQ ID NO: 6146519 - DNA, 15 bp, Homo sapiens
ctgcctgaagagagg

SEQ ID NO: 6146520 - DNA, 16 bp, Homo sapiens
ctgcctgaagagagga

SEQ ID NO: 6146521 - DNA, 18 bp, Homo sapiens
ctgcctgaagtcacacag

SEQ ID NO: 6146522 - DNA, 23 bp, Homo sapiens
ctgcctgaagtcacacagtgagt

SEQ ID NO: 6146523 - DNA, 13 bp, Homo sapiens
ctgcctgacagca

SEQ ID NO: 6146524 - DNA, 15 bp, Homo sapiens
ctgcctgacagcatc

SEQ ID NO: 6146525 - DNA, 15 bp, Homo sapiens
ctgcctgacagcctt

SEQ ID NO: 6146526 - DNA, 22 bp, Homo sapiens
ctgcctgacagccttccccagc

SEQ ID NO: 6146527 - DNA, 20 bp, Homo sapiens
ctgcctgacatttggagtgt

SEQ ID NO: 6146528 - DNA, 23 bp, Homo sapiens
ctgcctgacccatcccttttcct

SEQ ID NO: 6146529 - DNA, 23 bp, Homo sapiens
ctgcctgaccccttcactatgac

SEQ ID NO: 6146530 - DNA, 14 bp, Homo sapiens
ctgcctgagattct

SEQ ID NO: 6146531 - DNA, 17 bp, Homo sapiens
ctgcctgagattcttta

SEQ ID NO: 6146532 - DNA, 18 bp, Homo sapiens
ctgcctgagattctttaa

SEQ ID NO: 6146533 - DNA, 21 bp, Homo sapiens
ctgcctgagattctttaagga

SEQ ID NO: 6146534 - DNA, 13 bp, Homo sapiens
ctgcctgagccca

SEQ ID NO: 6146535 - DNA, 12 bp, Homo sapiens
ctgcctgaggag

SEQ ID NO: 6146536 - DNA, 22 bp, Homo sapiens
ctgcctgaggaggaggacacag

SEQ ID NO: 6146537 - DNA, 11 bp, Homo sapiens
ctgcctgaggg

SEQ ID NO: 6146538 - DNA, 14 bp, Homo sapiens
ctgcctgagggcag

SEQ ID NO: 6146539 - DNA, 15 bp, Homo sapiens
ctgcctgagggcagt

SEQ ID NO: 6146540 - DNA, 21 bp, Homo sapiens
ctgcctgagggcccctctgcc

SEQ ID NO: 6146541 - DNA, 18 bp, Homo sapiens
ctgcctgatccctgaacc

SEQ ID NO: 6146542 - DNA, 12 bp, Homo sapiens
ctgcctgcacct

SEQ ID NO: 6146543 - DNA, 14 bp, Homo sapiens
ctgcctgcacctcc

SEQ ID NO: 6146544 - DNA, 14 bp, Homo sapiens
ctgcctgcactccc

SEQ ID NO: 6146545 - DNA, 16 bp, Homo sapiens
ctgcctgcactccctg

SEQ ID NO: 6146546 - DNA, 21 bp, Homo sapiens
ctgcctgcactccctggcctt

SEQ ID NO: 6146547 - DNA, 19 bp, Homo sapiens
ctgcctgcagaggtctgtg

SEQ ID NO: 6146548 - DNA, 21 bp, Homo sapiens
ctgcctgcagaggtctgtgct

SEQ ID NO: 6146549 - DNA, 22 bp, Homo sapiens
ctgcctgcagaggtctgtgctg

SEQ ID NO: 6146550 - DNA, 23 bp, Homo sapiens
ctgcctgcagaggtctgtgctga

SEQ ID NO: 6146551 - DNA, 12 bp, Homo sapiens
ctgcctgcagca

SEQ ID NO: 6146552 - DNA, 18 bp, Homo sapiens
ctgcctgcagcaggcagc

SEQ ID NO: 6146553 - DNA, 12 bp, Homo sapiens
ctgcctgcagcc

SEQ ID NO: 6146554 - DNA, 18 bp, Homo sapiens
ctgcctgcagccagggct

SEQ ID NO: 6146555 - DNA, 19 bp, Homo sapiens
ctgcctgcagccagggctg

SEQ ID NO: 6146556 - DNA, 13 bp, Homo sapiens
ctgcctgcagcct

SEQ ID NO: 6146557 - DNA, 18 bp, Homo sapiens
ctgcctgcagctgagatt

SEQ ID NO: 6146558 - DNA, 20 bp, Homo sapiens
ctgcctgcatgagctggcaa

SEQ ID NO: 6146559 - DNA, 22 bp, Homo sapiens
ctgcctgcatgagctggcaacc

SEQ ID NO: 6146560 - DNA, 16 bp, Homo sapiens
ctcccaggtagctggg

SEQ ID NO: 6146561 - DNA, 16 bp, Homo sapiens
ctcccaggtcccataa

SEQ ID NO: 6146562 - DNA, 20 bp, Homo sapiens
ctcccaggtggattttgtgg

SEQ ID NO: 6146563 - DNA, 21 bp, Homo sapiens
ctcccaggtgttaacattcca

SEQ ID NO: 6146564 - DNA, 21 bp, Homo sapiens
ctcccaggttcccccagcaag

SEQ ID NO: 6146565 - DNA, 22 bp, Homo sapiens
ctcccaggttcccccagcaagc

SEQ ID NO: 6146566 - DNA, 24 bp, Homo sapiens
ctcccaggtttcttctctggagaa

SEQ ID NO: 6146567 - DNA, 17 bp, Homo sapiens
ctcccagtaatttttct

SEQ ID NO: 6146568 - DNA, 13 bp, Homo sapiens
ctcccagtatgtt

SEQ ID NO: 6146569 - DNA, 14 bp, Homo sapiens
ctcccagtcatgtt

SEQ ID NO: 6146570 - DNA, 14 bp, Homo sapiens
ctcccagtccattt

SEQ ID NO: 6146571 - DNA, 15 bp, Homo sapiens
ctcccagtcctccag

SEQ ID NO: 6146572 - DNA, 16 bp, Homo sapiens
ctcccagtcctccaga

SEQ ID NO: 6146573 - DNA, 19 bp, Homo sapiens
ctcccagtcctccagacca

SEQ ID NO: 6146574 - DNA, 20 bp, Homo sapiens
ctcccagtcctgcctgaaca

SEQ ID NO: 6146575 - DNA, 17 bp, Homo sapiens
ctcccagtcgaggctgg

SEQ ID NO: 6146576 - DNA, 18 bp, Homo sapiens
ctcccagtctacccagag

SEQ ID NO: 6146577 - DNA, 17 bp, Homo sapiens
ctcccagtctcatctcc

SEQ ID NO: 6146578 - DNA, 20 bp, Homo sapiens
ctcccagtctcatctcctga

SEQ ID NO: 6146579 - DNA, 20 bp, Homo sapiens
ctcccagtgaactcctgcca

SEQ ID NO: 6146580 - DNA, 22 bp, Homo sapiens
ctcccagtgaactcctgccagg

SEQ ID NO: 6146581 - DNA, 20 bp, Homo sapiens
ctcccagtgagaagggcctg

SEQ ID NO: 6146582 - DNA, 13 bp, Homo sapiens
ctcccagtgggtg

SEQ ID NO: 6146583 - DNA, 18 bp, Homo sapiens
ctcccagttctctaggga

SEQ ID NO: 6146584 - DNA, 23 bp, Homo sapiens
ctcccatatcatataaaatttca

SEQ ID NO: 6146585 - DNA, 14 bp, Homo sapiens
ctcccatcacccgc

SEQ ID NO: 6146586 - DNA, 16 bp, Homo sapiens
ctcccatcacttccct

SEQ ID NO: 6146587 - DNA, 23 bp, Homo sapiens
ctcccatcatgcccggtcccacc

SEQ ID NO: 6146588 - DNA, 23 bp, Homo sapiens
ctcccatcattacccttccctgc

SEQ ID NO: 6146589 - DNA, 14 bp, Homo sapiens
ctcccatccagcgt

SEQ ID NO: 6146590 - DNA, 16 bp, Homo sapiens
ctcccatccagcgtct

SEQ ID NO: 6146591 - DNA, 12 bp, Homo sapiens
ctcccatccccc

SEQ ID NO: 6146592 - DNA, 18 bp, Homo sapiens
ctcccatccccctgccct

SEQ ID NO: 6146593 - DNA, 15 bp, Homo sapiens
ctcccatcccctgga

SEQ ID NO: 6146594 - DNA, 16 bp, Homo sapiens
ctcccatcccctggac

SEQ ID NO: 6146595 - DNA, 13 bp, Homo sapiens
ctcccatcccttc

SEQ ID NO: 6146596 - DNA, 13 bp, Homo sapiens
ctcccatcctcac

SEQ ID NO: 6146597 - DNA, 13 bp, Homo sapiens
ctcccatcctcca

SEQ ID NO: 6146598 - DNA, 15 bp, Homo sapiens
ctcccatcctccagc

SEQ ID NO: 6146599 - DNA, 19 bp, Homo sapiens
ctcccatcctccagccctg

SEQ ID NO: 6146600 - DNA, 21 bp, Homo sapiens
ctcccatcctccccagcgcca

SEQ ID NO: 6146601 - DNA, 11 bp, Homo sapiens
ctcccatcctg

SEQ ID NO: 6146602 - DNA, 15 bp, Homo sapiens
ctcccatcctgatcc

SEQ ID NO: 6146603 - DNA, 15 bp, Homo sapiens
ctcccatcctgtgtg

SEQ ID NO: 6146604 - DNA, 18 bp, Homo sapiens
ctcccatccttccctcat

SEQ ID NO: 6146605 - DNA, 18 bp, Homo sapiens
ctcccatctcacacatga

SEQ ID NO: 6146606 - DNA, 14 bp, Homo sapiens
ctcccatctcctga

SEQ ID NO: 6146607 - DNA, 21 bp, Homo sapiens
ctcccatctccttacctctgg

SEQ ID NO: 6146608 - DNA, 18 bp, Homo sapiens
ctcccatctccttccccc

SEQ ID NO: 6146609 - DNA, 20 bp, Homo sapiens
ctcccatctccttcccccag

SEQ ID NO: 6146610 - DNA, 20 bp, Homo sapiens
ctcccatcttggcctcccag

SEQ ID NO: 6146611 - DNA, 12 bp, Homo sapiens
ctcccatgaagc

SEQ ID NO: 6146612 - DNA, 13 bp, Homo sapiens
ctcccatgaagcc

SEQ ID NO: 6146613 - DNA, 14 bp, Homo sapiens
ctcccatgaagcct

SEQ ID NO: 6146614 - DNA, 15 bp, Homo sapiens
ctcccatgaagcctt

SEQ ID NO: 6146615 - DNA, 19 bp, Homo sapiens
ctcccatgaagccttttga

SEQ ID NO: 6146616 - DNA, 22 bp, Homo sapiens
ctcccatgaagccttttgaaag

SEQ ID NO: 6146617 - DNA, 16 bp, Homo sapiens
ctcccatgaccatact

SEQ ID NO: 6146618 - DNA, 21 bp, Homo sapiens
ctcccatgaccatactgaggg

SEQ ID NO: 6146619 - DNA, 22 bp, Homo sapiens
ctcccatgagggagatgccatg

SEQ ID NO: 6146620 - DNA, 20 bp, Homo sapiens
ctcccatgcacaactctcca

SEQ ID NO: 6146621 - DNA, 15 bp, Homo sapiens
ctcccatgcctggtc

SEQ ID NO: 6146622 - DNA, 15 bp, Homo sapiens
ctcccatggagcccc

SEQ ID NO: 6146623 - DNA, 19 bp, Homo sapiens
ctcccatggagccccagcc

SEQ ID NO: 6146624 - DNA, 13 bp, Homo sapiens
ctcccatggctct

SEQ ID NO: 6146625 - DNA, 22 bp, Homo sapiens
ctcccatgggggcacttgagtt

SEQ ID NO: 6146626 - DNA, 16 bp, Homo sapiens
ctcccatggtccctag

SEQ ID NO: 6146627 - DNA, 17 bp, Homo sapiens
ctcccatgtcactgcag

SEQ ID NO: 6146628 - DNA, 20 bp, Homo sapiens
ctcccatgtgtgatgctgac

SEQ ID NO: 6146629 - DNA, 23 bp, Homo sapiens
ctcccatgtgtgatgctgacacc

SEQ ID NO: 6146630 - DNA, 15 bp, Homo sapiens
ctcccattcaagatt

SEQ ID NO: 6146631 - DNA, 16 bp, Homo sapiens
ctcccattcaccctgt

SEQ ID NO: 6146632 - DNA, 14 bp, Homo sapiens
ctcccattcctgaa

SEQ ID NO: 6146633 - DNA, 16 bp, Homo sapiens
ctcccattcctgaaga

SEQ ID NO: 6146634 - DNA, 17 bp, Homo sapiens
ctcccattcctgaagaa

SEQ ID NO: 6146635 - DNA, 19 bp, Homo sapiens
ctcccattcctgaagaacc

SEQ ID NO: 6146636 - DNA, 16 bp, Homo sapiens
ctcccattgcccagtg

SEQ ID NO: 6146637 - DNA, 18 bp, Homo sapiens
ctcccattgcccagtgag

SEQ ID NO: 6146638 - DNA, 20 bp, Homo sapiens
ctcccattgcccagtgagcc

SEQ ID NO: 6146639 - DNA, 19 bp, Homo sapiens
ctcccattgtccctctgcc

SEQ ID NO: 6146640 - DNA, 12 bp, Homo sapiens
ctcccatttcct

SEQ ID NO: 6146641 - DNA, 18 bp, Homo sapiens
ctcccatttctgttgctg

SEQ ID NO: 6146642 - DNA, 19 bp, Homo sapiens
ctcccatttgcagaccagg

SEQ ID NO: 6146643 - DNA, 16 bp, Homo sapiens
ctccccaaaagaaacc

SEQ ID NO: 6146644 - DNA, 22 bp, Homo sapiens
ctccccaaaagaaaccatgaca

SEQ ID NO: 6146645 - DNA, 18 bp, Homo sapiens
ctccccaaacccatcaga

SEQ ID NO: 6146646 - DNA, 19 bp, Homo sapiens
ctccccaaagccactggaa

SEQ ID NO: 6146647 - DNA, 19 bp, Homo sapiens
ctccccaaaggctttgccc

SEQ ID NO: 6146648 - DNA, 20 bp, Homo sapiens
ctccccaaaggctttgccct

SEQ ID NO: 6146649 - DNA, 21 bp, Homo sapiens
ctccccaaaggctttgccctg

SEQ ID NO: 6146650 - DNA, 16 bp, Homo sapiens
ctccccaaatggctgc

SEQ ID NO: 6146651 - DNA, 11 bp, Homo sapiens
ctccccaaccc

SEQ ID NO: 6146652 - DNA, 20 bp, Homo sapiens
ctccccaacccctctccagg

SEQ ID NO: 6146653 - DNA, 19 bp, Homo sapiens
ctccccaaccctaggttcc

SEQ ID NO: 6146654 - DNA, 14 bp, Homo sapiens
ctccccaacctgca

SEQ ID NO: 6146655 - DNA, 18 bp, Homo sapiens
ctccccaacttgagcctg

SEQ ID NO: 6146656 - DNA, 18 bp, Homo sapiens
ctccccaaggaagagcca

SEQ ID NO: 6146657 - DNA, 17 bp, Homo sapiens
ctccccaaggccccctg

SEQ ID NO: 6146658 - DNA, 13 bp, Homo sapiens
ctccccaaggctg

SEQ ID NO: 6146659 - DNA, 14 bp, Homo sapiens
ctccccaaggctgc

SEQ ID NO: 6146660 - DNA, 14 bp, Homo sapiens
ctccccaatccctg

SEQ ID NO: 6146661 - DNA, 15 bp, Homo sapiens
ctccccaatccctga

SEQ ID NO: 6146662 - DNA, 17 bp, Homo sapiens
ctccccaatgctctcct

SEQ ID NO: 6146663 - DNA, 19 bp, Homo sapiens
ctccccaattatatctccc

SEQ ID NO: 6146664 - DNA, 17 bp, Homo sapiens
ctccccacacacaggcc

SEQ ID NO: 6146665 - DNA, 19 bp, Homo sapiens
ctccccacacacaggcctt

SEQ ID NO: 6146666 - DNA, 12 bp, Homo sapiens
ctccccacaccc

SEQ ID NO: 6146667 - DNA, 16 bp, Homo sapiens
ctccccacaccctgga

SEQ ID NO: 6146668 - DNA, 17 bp, Homo sapiens
ctccccacaccctggag

SEQ ID NO: 6146669 - DNA, 12 bp, Homo sapiens
ctccccacacct

SEQ ID NO: 6146670 - DNA, 14 bp, Homo sapiens
ctccccacactcca

SEQ ID NO: 6146671 - DNA, 17 bp, Homo sapiens
ctccccacagcctctgg

SEQ ID NO: 6146672 - DNA, 20 bp, Homo sapiens
ctccccacagcctctggctc

SEQ ID NO: 6146673 - DNA, 19 bp, Homo sapiens
ctccccacagcgtccctgg

SEQ ID NO: 6146674 - DNA, 20 bp, Homo sapiens
ctccccacagctttgcaccc

SEQ ID NO: 6146675 - DNA, 13 bp, Homo sapiens
ctccccacagtcc

SEQ ID NO: 6146676 - DNA, 21 bp, Homo sapiens
ctccccacagtcctcacagcc

SEQ ID NO: 6146677 - DNA, 14 bp, Homo sapiens
ctccccacagtgcc

SEQ ID NO: 6146678 - DNA, 14 bp, Homo sapiens
ctccccaccagagc

SEQ ID NO: 6146679 - DNA, 16 bp, Homo sapiens
ctccccaccagagctg

SEQ ID NO: 6146680 - DNA, 20 bp, Homo sapiens
ctccccaccagagctgcctc

SEQ ID NO: 6146681 - DNA, 15 bp, Homo sapiens
ctccccaccagtctc

SEQ ID NO: 6146682 - DNA, 16 bp, Homo sapiens
ctccccaccagtctca

SEQ ID NO: 6146683 - DNA, 15 bp, Homo sapiens
ctccccacccaagag

SEQ ID NO: 6146684 - DNA, 12 bp, Homo sapiens
ctccccacccac

SEQ ID NO: 6146685 - DNA, 13 bp, Homo sapiens
ctccccaccccaa

SEQ ID NO: 6146686 - DNA, 17 bp, Homo sapiens
ctccccaccccagtggg

SEQ ID NO: 6146687 - DNA, 18 bp, Homo sapiens
ctccccacccctgccttt

SEQ ID NO: 6146688 - DNA, 19 bp, Homo sapiens
ctccccaccctcctcttgg

SEQ ID NO: 6146689 - DNA, 17 bp, Homo sapiens
ctccccaccctcctggc

SEQ ID NO: 6146690 - DNA, 15 bp, Homo sapiens
ctccccaccctgtcc

SEQ ID NO: 6146691 - DNA, 18 bp, Homo sapiens
ctccccacctacccagct

SEQ ID NO: 6146692 - DNA, 16 bp, Homo sapiens
ctccccacctccaggc

SEQ ID NO: 6146693 - DNA, 14 bp, Homo sapiens
ctccccacctccca

SEQ ID NO: 6146694 - DNA, 12 bp, Homo sapiens
ctccccacctgc

SEQ ID NO: 6146695 - DNA, 13 bp, Homo sapiens
ctccccacctgga

SEQ ID NO: 6146696 - DNA, 18 bp, Homo sapiens
ctccccacctggacacac

SEQ ID NO: 6146697 - DNA, 12 bp, Homo sapiens
ctccccacctgt

SEQ ID NO: 6146698 - DNA, 16 bp, Homo sapiens
ctccccacgagggctg

SEQ ID NO: 6146699 - DNA, 16 bp, Homo sapiens
ctccccacgagtcacc

SEQ ID NO: 6146700 - DNA, 22 bp, Homo sapiens
ctccccacgagtcacctgcaag

SEQ ID NO: 6146701 - DNA, 15 bp, Homo sapiens
ctccccacgccccca

SEQ ID NO: 6146702 - DNA, 21 bp, Homo sapiens
ctccccacggccgctccaggg

SEQ ID NO: 6146703 - DNA, 22 bp, Homo sapiens
ctccccacggccgctccagggg

SEQ ID NO: 6146704 - DNA, 22 bp, Homo sapiens
ctccccacgggaaactcaagga

SEQ ID NO: 6146705 - DNA, 21 bp, Homo sapiens
ctccccacgtggcacctcctc

SEQ ID NO: 6146706 - DNA, 14 bp, Homo sapiens
ctccccactccagc

SEQ ID NO: 6146707 - DNA, 12 bp, Homo sapiens
ctccccactccc

SEQ ID NO: 6146708 - DNA, 12 bp, Homo sapiens
ctccccactcta

SEQ ID NO: 6146709 - DNA, 22 bp, Homo sapiens
ctccccactctgctctgatgca

SEQ ID NO: 6146710 - DNA, 12 bp, Homo sapiens
ctccccactgaa

SEQ ID NO: 6146711 - DNA, 14 bp, Homo sapiens
ctccccagaaacag

SEQ ID NO: 6146712 - DNA, 13 bp, Homo sapiens
ctccccagaactg

SEQ ID NO: 6146713 - DNA, 11 bp, Homo sapiens
ctccccagaat

SEQ ID NO: 6146714 - DNA, 23 bp, Homo sapiens
ctccccagaattcacgcctctcc

SEQ ID NO: 6146715 - DNA, 12 bp, Homo sapiens
ctccccagactc

SEQ ID NO: 6146716 - DNA, 17 bp, Homo sapiens
ctccccagagcactggg

SEQ ID NO: 6146717 - DNA, 17 bp, Homo sapiens
ctccccagagccctgca

SEQ ID NO: 6146718 - DNA, 20 bp, Homo sapiens
ctccccagagccctgcagtc

SEQ ID NO: 6146719 - DNA, 14 bp, Homo sapiens
ctccccagagctgg

SEQ ID NO: 6146720 - DNA, 18 bp, Homo sapiens
ctccccagagctgtgcca

SEQ ID NO: 6146721 - DNA, 23 bp, Homo sapiens
ctccccagagctgtgccagcagg

SEQ ID NO: 6146722 - DNA, 11 bp, Homo sapiens
ctccccagagg

SEQ ID NO: 6146723 - DNA, 20 bp, Homo sapiens
ctccccagagttccccatgc

SEQ ID NO: 6146724 - DNA, 21 bp, Homo sapiens
ctccccagatctgtcctgggg

SEQ ID NO: 6146725 - DNA, 12 bp, Homo sapiens
ctccccagcaag

SEQ ID NO: 6146726 - DNA, 22 bp, Homo sapiens
ctccccagcaagtgagagctgg

SEQ ID NO: 6146727 - DNA, 23 bp, Homo sapiens
ctccccagcaagtgagagctggg

SEQ ID NO: 6146728 - DNA, 19 bp, Homo sapiens
ctccccagcattccagccc

SEQ ID NO: 6146729 - DNA, 13 bp, Homo sapiens
ctccccagccaga

SEQ ID NO: 6146730 - DNA, 16 bp, Homo sapiens
ctccccagccagcctg

SEQ ID NO: 6146731 - DNA, 17 bp, Homo sapiens
ctccccagcccacctgc

SEQ ID NO: 6146732 - DNA, 13 bp, Homo sapiens
ctccccagcccag

SEQ ID NO: 6146733 - DNA, 15 bp, Homo sapiens
ctccccagcccagag

SEQ ID NO: 6146734 - DNA, 17 bp, Homo sapiens
ctccccagcccagagac

SEQ ID NO: 6146735 - DNA, 18 bp, Homo sapiens
ctccccagcccagagaca

SEQ ID NO: 6146736 - DNA, 16 bp, Homo sapiens
ctccccagcccagcac

SEQ ID NO: 6146737 - DNA, 22 bp, Homo sapiens
ctccccagcccagggttccccc

SEQ ID NO: 6146738 - DNA, 15 bp, Homo sapiens
ctccccagccccagc

SEQ ID NO: 6146739 - DNA, 13 bp, Homo sapiens
ctccccagccccc

SEQ ID NO: 6146740 - DNA, 14 bp, Homo sapiens
ctccccagccccca

SEQ ID NO: 6146741 - DNA, 11 bp, Homo sapiens
ctgcctgccaa

SEQ ID NO: 6146742 - DNA, 23 bp, Homo sapiens
ctgcctgccaaagtagtcctggc

SEQ ID NO: 6146743 - DNA, 12 bp, Homo sapiens
ctgcctgccacc

SEQ ID NO: 6146744 - DNA, 20 bp, Homo sapiens
ctgcctgccagctgcactga

SEQ ID NO: 6146745 - DNA, 11 bp, Homo sapiens
ctgcctgccat

SEQ ID NO: 6146746 - DNA, 17 bp, Homo sapiens
ctgcctgccatgtacct

SEQ ID NO: 6146747 - DNA, 20 bp, Homo sapiens
ctgcctgccatgtagttggg

SEQ ID NO: 6146748 - DNA, 17 bp, Homo sapiens
ctgcctgccatgtgtga

SEQ ID NO: 6146749 - DNA, 18 bp, Homo sapiens
ctgcctgccatgtgtgag

SEQ ID NO: 6146750 - DNA, 12 bp, Homo sapiens
ctgcctgcccac

SEQ ID NO: 6146751 - DNA, 16 bp, Homo sapiens
ctgcctgcccacacag

SEQ ID NO: 6146752 - DNA, 13 bp, Homo sapiens
ctgcctgcccacc

SEQ ID NO: 6146753 - DNA, 14 bp, Homo sapiens
ctgcctgcccaccc

SEQ ID NO: 6146754 - DNA, 14 bp, Homo sapiens
ctgcctgcccaggc

SEQ ID NO: 6146755 - DNA, 16 bp, Homo sapiens
ctgcctgcccaggccc

SEQ ID NO: 6146756 - DNA, 20 bp, Homo sapiens
ctgcctgcccaggcccctgc

SEQ ID NO: 6146757 - DNA, 21 bp, Homo sapiens
ctgcctgcccaggcccctgcc

SEQ ID NO: 6146758 - DNA, 17 bp, Homo sapiens
ctgcctgccccacacgg

SEQ ID NO: 6146759 - DNA, 14 bp, Homo sapiens
ctgcctgccccgcc

SEQ ID NO: 6146760 - DNA, 15 bp, Homo sapiens
ctgcctgccccgccc

SEQ ID NO: 6146761 - DNA, 17 bp, Homo sapiens
ctgcctgcccgcacagc

SEQ ID NO: 6146762 - DNA, 18 bp, Homo sapiens
ctgcctgcccgcacagca

SEQ ID NO: 6146763 - DNA, 19 bp, Homo sapiens
ctgcctgcccgcacagcag

SEQ ID NO: 6146764 - DNA, 13 bp, Homo sapiens
ctgcctgccctga

SEQ ID NO: 6146765 - DNA, 14 bp, Homo sapiens
ctgcctgccctggt

SEQ ID NO: 6146766 - DNA, 21 bp, Homo sapiens
ctgcctgccggccgcccagac

SEQ ID NO: 6146767 - DNA, 12 bp, Homo sapiens
ctgcctgcctcc

SEQ ID NO: 6146768 - DNA, 13 bp, Homo sapiens
ctgcctgcctccc

SEQ ID NO: 6146769 - DNA, 15 bp, Homo sapiens
ctgcctgcctcccct

SEQ ID NO: 6146770 - DNA, 14 bp, Homo sapiens
ctgcctgcctccgg

SEQ ID NO: 6146771 - DNA, 17 bp, Homo sapiens
ctgcctgcctccggccc

SEQ ID NO: 6146772 - DNA, 16 bp, Homo sapiens
ctgcctgcctgggaac

SEQ ID NO: 6146773 - DNA, 16 bp, Homo sapiens
ctgcctgcctgtctgt

SEQ ID NO: 6146774 - DNA, 17 bp, Homo sapiens
ctgcctgccttaagtga

SEQ ID NO: 6146775 - DNA, 17 bp, Homo sapiens
ctgcctgccttctcccc

SEQ ID NO: 6146776 - DNA, 17 bp, Homo sapiens
ctgcctgcgaaacccag

SEQ ID NO: 6146777 - DNA, 18 bp, Homo sapiens
ctgcctgcgcccaccccg

SEQ ID NO: 6146778 - DNA, 17 bp, Homo sapiens
ctgcctgcgtcttccgc

SEQ ID NO: 6146779 - DNA, 13 bp, Homo sapiens
ctgcctgctccca

SEQ ID NO: 6146780 - DNA, 14 bp, Homo sapiens
ctgcctgctcccat

SEQ ID NO: 6146781 - DNA, 18 bp, Homo sapiens
ctgcctgctcccatcctg

SEQ ID NO: 6146782 - DNA, 12 bp, Homo sapiens
ctgcctgctcct

SEQ ID NO: 6146783 - DNA, 16 bp, Homo sapiens
ctgcctgctccttggc

SEQ ID NO: 6146784 - DNA, 24 bp, Homo sapiens
ctgcctgctccttggcacccccat

SEQ ID NO: 6146785 - DNA, 18 bp, Homo sapiens
ctgcctgctcgctccctg

SEQ ID NO: 6146786 - DNA, 16 bp, Homo sapiens
ctgcctgctctgcagc

SEQ ID NO: 6146787 - DNA, 15 bp, Homo sapiens
ctgcctgctgaccat

SEQ ID NO: 6146788 - DNA, 17 bp, Homo sapiens
ctgcctgctgggctctt

SEQ ID NO: 6146789 - DNA, 15 bp, Homo sapiens
ctgcctgctgtgctg

SEQ ID NO: 6146790 - DNA, 13 bp, Homo sapiens
ctgcctgctgtgg

SEQ ID NO: 6146791 - DNA, 11 bp, Homo sapiens
ctgcctgcttc

SEQ ID NO: 6146792 - DNA, 14 bp, Homo sapiens
ctgcctgcttggcc

SEQ ID NO: 6146793 - DNA, 22 bp, Homo sapiens
ctgcctgcttttcactgctgca

SEQ ID NO: 6146794 - DNA, 22 bp, Homo sapiens
ctgcctggaaattctggaactg

SEQ ID NO: 6146795 - DNA, 11 bp, Homo sapiens
ctgcctggacc

SEQ ID NO: 6146796 - DNA, 17 bp, Homo sapiens
ctgcctggaccagcctc

SEQ ID NO: 6146797 - DNA, 13 bp, Homo sapiens
ctgcctggacccg

SEQ ID NO: 6146798 - DNA, 18 bp, Homo sapiens
ctgcctggactagaggga

SEQ ID NO: 6146799 - DNA, 12 bp, Homo sapiens
ctgcctggactt

SEQ ID NO: 6146800 - DNA, 12 bp, Homo sapiens
ctgcctggagaa

SEQ ID NO: 6146801 - DNA, 14 bp, Homo sapiens
ctgcctggagaaag

SEQ ID NO: 6146802 - DNA, 17 bp, Homo sapiens
ctgcctggagaaaggat

SEQ ID NO: 6146803 - DNA, 22 bp, Homo sapiens
ctgcctggagacaaggtgctaa

SEQ ID NO: 6146804 - DNA, 23 bp, Homo sapiens
ctgcctggagacaaggtgctaac

SEQ ID NO: 6146805 - DNA, 13 bp, Homo sapiens
ctgcctggagagg

SEQ ID NO: 6146806 - DNA, 16 bp, Homo sapiens
ctgcctggagccccac

SEQ ID NO: 6146807 - DNA, 20 bp, Homo sapiens
ctgcctggaggacctgagcc

SEQ ID NO: 6146808 - DNA, 22 bp, Homo sapiens
ctgcctggaggacctgagcctg

SEQ ID NO: 6146809 - DNA, 23 bp, Homo sapiens
ctgcctggaggcaaaggcctgga

SEQ ID NO: 6146810 - DNA, 22 bp, Homo sapiens
ctgcctggaggctcctctaggc

SEQ ID NO: 6146811 - DNA, 17 bp, Homo sapiens
ctgcctggagtcagtag

SEQ ID NO: 6146812 - DNA, 20 bp, Homo sapiens
ctgcctggagtcagtagcca

SEQ ID NO: 6146813 - DNA, 22 bp, Homo sapiens
ctgcctggagtcagtagccaga

SEQ ID NO: 6146814 - DNA, 19 bp, Homo sapiens
ctgcctggagtgctgtgct

SEQ ID NO: 6146815 - DNA, 19 bp, Homo sapiens
ctgcctggatccagctctg

SEQ ID NO: 6146816 - DNA, 10 bp, Homo sapiens
ctgcctggca

SEQ ID NO: 6146817 - DNA, 12 bp, Homo sapiens
ctgcctggcaac

SEQ ID NO: 6146818 - DNA, 13 bp, Homo sapiens
ctgcctggcaaca

SEQ ID NO: 6146819 - DNA, 16 bp, Homo sapiens
ctgcctggccactgct

SEQ ID NO: 6146820 - DNA, 18 bp, Homo sapiens
ctgcctggccactgctcc

SEQ ID NO: 6146821 - DNA, 15 bp, Homo sapiens
ctgcctggccaggca

SEQ ID NO: 6146822 - DNA, 17 bp, Homo sapiens
ctgcctggccaggccct

SEQ ID NO: 6146823 - DNA, 18 bp, Homo sapiens
ctgcctggccaggccctg

SEQ ID NO: 6146824 - DNA, 12 bp, Homo sapiens
ctgcctggccat

SEQ ID NO: 6146825 - DNA, 16 bp, Homo sapiens
ctgcctggccatgctg

SEQ ID NO: 6146826 - DNA, 19 bp, Homo sapiens
ctgcctggccatgctgtcc

SEQ ID NO: 6146827 - DNA, 12 bp, Homo sapiens
ctgcctggccca

SEQ ID NO: 6146828 - DNA, 12 bp, Homo sapiens
ctgcctggcccc

SEQ ID NO: 6146829 - DNA, 23 bp, Homo sapiens
ctgcctggcccccaacctcaggg

SEQ ID NO: 6146830 - DNA, 15 bp, Homo sapiens
ctgcctggccggcca

SEQ ID NO: 6146831 - DNA, 11 bp, Homo sapiens
ctgcctggcct

SEQ ID NO: 6146832 - DNA, 18 bp, Homo sapiens
ctgcctggcctggctccc

SEQ ID NO: 6146833 - DNA, 19 bp, Homo sapiens
ctgcctggcctggctcccc

SEQ ID NO: 6146834 - DNA, 17 bp, Homo sapiens
ctgcctggcggcagggg

SEQ ID NO: 6146835 - DNA, 15 bp, Homo sapiens
ctgcctggcgggcag

SEQ ID NO: 6146836 - DNA, 20 bp, Homo sapiens
ctgcctggcgggcagcccct

SEQ ID NO: 6146837 - DNA, 23 bp, Homo sapiens
ctgcctggcgggcagcccctgct

SEQ ID NO: 6146838 - DNA, 22 bp, Homo sapiens
ctgcctggcggggttggccctt

SEQ ID NO: 6146839 - DNA, 19 bp, Homo sapiens
ctgcctgggaacacgtgtg

SEQ ID NO: 6146840 - DNA, 13 bp, Homo sapiens
ctgcctgggaagg

SEQ ID NO: 6146841 - DNA, 12 bp, Homo sapiens
ctgcctgggagc

SEQ ID NO: 6146842 - DNA, 16 bp, Homo sapiens
ctgcctgggagccagg

SEQ ID NO: 6146843 - DNA, 12 bp, Homo sapiens
ctgcctgggatg

SEQ ID NO: 6146844 - DNA, 16 bp, Homo sapiens
ctgcctgggcaatggc

SEQ ID NO: 6146845 - DNA, 22 bp, Homo sapiens
ctgcctgggcaatggccagggg

SEQ ID NO: 6146846 - DNA, 11 bp, Homo sapiens
ctgcctgggcc

SEQ ID NO: 6146847 - DNA, 15 bp, Homo sapiens
ctgcctgggccatgc

SEQ ID NO: 6146848 - DNA, 22 bp, Homo sapiens
ctgcctgggccatgcgaggggc

SEQ ID NO: 6146849 - DNA, 20 bp, Homo sapiens
ctgcctgggccgtggcacag

SEQ ID NO: 6146850 - DNA, 23 bp, Homo sapiens
ctgcctgggccgtggcacagctg

SEQ ID NO: 6146851 - DNA, 14 bp, Homo sapiens
ctgcctgggcctcc

SEQ ID NO: 6146852 - DNA, 18 bp, Homo sapiens
ctgcctgggcctcccaaa

SEQ ID NO: 6146853 - DNA, 17 bp, Homo sapiens
ctgcctgggcctgtgca

SEQ ID NO: 6146854 - DNA, 18 bp, Homo sapiens
ctgcctgggcctgtgcag

SEQ ID NO: 6146855 - DNA, 22 bp, Homo sapiens
ctgcctgggcctgtgcagcagc

SEQ ID NO: 6146856 - DNA, 23 bp, Homo sapiens
ctgcctgggcctgtgcagcagcc

SEQ ID NO: 6146857 - DNA, 24 bp, Homo sapiens
ctgcctgggcctgtgcagcagccc

SEQ ID NO: 6146858 - DNA, 17 bp, Homo sapiens
ctgcctgggccttggct

SEQ ID NO: 6146859 - DNA, 19 bp, Homo sapiens
ctgcctgggccttggctgg

SEQ ID NO: 6146860 - DNA, 12 bp, Homo sapiens
ctgcctgggctg

SEQ ID NO: 6146861 - DNA, 17 bp, Homo sapiens
ctgcctgggctgttggc

SEQ ID NO: 6146862 - DNA, 18 bp, Homo sapiens
ctgcctgggctgttggca

SEQ ID NO: 6146863 - DNA, 19 bp, Homo sapiens
ctgcctgggctgttggcac

SEQ ID NO: 6146864 - DNA, 21 bp, Homo sapiens
ctgcctgggctgttggcactc

SEQ ID NO: 6146865 - DNA, 20 bp, Homo sapiens
ctgcctggggattgggaggg

SEQ ID NO: 6146866 - DNA, 17 bp, Homo sapiens
ctgcctgggtaggcccc

SEQ ID NO: 6146867 - DNA, 19 bp, Homo sapiens
ctgcctgggtaggccccac

SEQ ID NO: 6146868 - DNA, 23 bp, Homo sapiens
ctgcctgggtaggccccacaagg

SEQ ID NO: 6146869 - DNA, 13 bp, Homo sapiens
ctgcctgggtggg

SEQ ID NO: 6146870 - DNA, 20 bp, Homo sapiens
ctgcctgggtgggacagcct

SEQ ID NO: 6146871 - DNA, 21 bp, Homo sapiens
ctgcctgggtgggacagcctc

SEQ ID NO: 6146872 - DNA, 15 bp, Homo sapiens
ctgcctggtatgagt

SEQ ID NO: 6146873 - DNA, 16 bp, Homo sapiens
ctgcctggtcctcaca

SEQ ID NO: 6146874 - DNA, 23 bp, Homo sapiens
ctgcctggtcctcacactcaccc

SEQ ID NO: 6146875 - DNA, 19 bp, Homo sapiens
ctgcctggtctcctgcccc

SEQ ID NO: 6146876 - DNA, 20 bp, Homo sapiens
ctgcctggtctgtctggatc

SEQ ID NO: 6146877 - DNA, 21 bp, Homo sapiens
ctgcctggtctgtctggatcc

SEQ ID NO: 6146878 - DNA, 12 bp, Homo sapiens
ctgcctggtggt

SEQ ID NO: 6146879 - DNA, 15 bp, Homo sapiens
ctgcctggtggtcag

SEQ ID NO: 6146880 - DNA, 13 bp, Homo sapiens
ctgcctggttcta

SEQ ID NO: 6146881 - DNA, 19 bp, Homo sapiens
ctgcctgtaacttgagagt

SEQ ID NO: 6146882 - DNA, 13 bp, Homo sapiens
ctgcctgtactac

SEQ ID NO: 6146883 - DNA, 20 bp, Homo sapiens
ctgcctgtagcaatggccag

SEQ ID NO: 6146884 - DNA, 16 bp, Homo sapiens
ctgcctgtagcagtga

SEQ ID NO: 6146885 - DNA, 20 bp, Homo sapiens
ctgcctgtagcccactctgc

SEQ ID NO: 6146886 - DNA, 13 bp, Homo sapiens
ctgcctgtagtta

SEQ ID NO: 6146887 - DNA, 17 bp, Homo sapiens
ctgcctgtagttaggaa

SEQ ID NO: 6146888 - DNA, 19 bp, Homo sapiens
ctgcctgtagttaggaaat

SEQ ID NO: 6146889 - DNA, 20 bp, Homo sapiens
ctgcctgtagttaggaaata

SEQ ID NO: 6146890 - DNA, 21 bp, Homo sapiens
ctgcctgtagttaggaaataa

SEQ ID NO: 6146891 - DNA, 13 bp, Homo sapiens
ctgcctgtatact

SEQ ID NO: 6146892 - DNA, 20 bp, Homo sapiens
ctgcctgtatttgagagact

SEQ ID NO: 6146893 - DNA, 21 bp, Homo sapiens
ctgcctgtatttgagagactg

SEQ ID NO: 6146894 - DNA, 13 bp, Homo sapiens
ctgcctgtatttt

SEQ ID NO: 6146895 - DNA, 22 bp, Homo sapiens
ctgcctgtattttcgggattct

SEQ ID NO: 6146896 - DNA, 12 bp, Homo sapiens
ctgcctgtcccc

SEQ ID NO: 6146897 - DNA, 17 bp, Homo sapiens
ctgcctgtccccatgct

SEQ ID NO: 6146898 - DNA, 16 bp, Homo sapiens
ctgcctgtccctctca

SEQ ID NO: 6146899 - DNA, 23 bp, Homo sapiens
ctgcctgtccctctcaggcatgc

SEQ ID NO: 6146900 - DNA, 13 bp, Homo sapiens
ctgcctgtctcct

SEQ ID NO: 6146901 - DNA, 15 bp, Homo sapiens
ctgcctgtctgaagc

SEQ ID NO: 6146902 - DNA, 17 bp, Homo sapiens
ctgcctgtctgcttgca

SEQ ID NO: 6146903 - DNA, 13 bp, Homo sapiens
ctgcctgtctgtc

SEQ ID NO: 6146904 - DNA, 16 bp, Homo sapiens
ctgcctgtgagccagt

SEQ ID NO: 6146905 - DNA, 18 bp, Homo sapiens
ctgcctgtgagccagtct

SEQ ID NO: 6146906 - DNA, 13 bp, Homo sapiens
ctgcctgtgcatg

SEQ ID NO: 6146907 - DNA, 11 bp, Homo sapiens
ctgcctgtgcc

SEQ ID NO: 6146908 - DNA, 17 bp, Homo sapiens
ctgcctgtgccatgccc

SEQ ID NO: 6146909 - DNA, 22 bp, Homo sapiens
ctgcctgtgccatgcccaaggc

SEQ ID NO: 6146910 - DNA, 21 bp, Homo sapiens
ctgcctgtgcccgcatgtgtg

SEQ ID NO: 6146911 - DNA, 15 bp, Homo sapiens
ctgcctgtgcccgct

SEQ ID NO: 6146912 - DNA, 16 bp, Homo sapiens
ctgcctgtgcccgctg

SEQ ID NO: 6146913 - DNA, 17 bp, Homo sapiens
ctgcctgtgcccgctgc

SEQ ID NO: 6146914 - DNA, 12 bp, Homo sapiens
ctgcctgtgctg

SEQ ID NO: 6146915 - DNA, 13 bp, Homo sapiens
ctgcctgtggcat

SEQ ID NO: 6146916 - DNA, 13 bp, Homo sapiens
ctgcctgtggcct

SEQ ID NO: 6146917 - DNA, 23 bp, Homo sapiens
ctgcctgtggccttgcccgccag

SEQ ID NO: 6146918 - DNA, 12 bp, Homo sapiens
ctgcctgtggcg

SEQ ID NO: 6146919 - DNA, 22 bp, Homo sapiens
ctgcctgtggcgccgtctccag

SEQ ID NO: 6146920 - DNA, 15 bp, Homo sapiens
ctgcctgtgggcttc

SEQ ID NO: 6146921 - DNA, 11 bp, Homo sapiens
ctgcctgtgtg

SEQ ID NO: 6146922 - DNA, 13 bp, Homo sapiens
ctccccagccctg

SEQ ID NO: 6146923 - DNA, 15 bp, Homo sapiens
ctccccagccctggc

SEQ ID NO: 6146924 - DNA, 14 bp, Homo sapiens
ctccccagcccttt

SEQ ID NO: 6146925 - DNA, 16 bp, Homo sapiens
ctccccagcctgcgcc

SEQ ID NO: 6146926 - DNA, 21 bp, Homo sapiens
ctccccagcctgcgcctgctg

SEQ ID NO: 6146927 - DNA, 15 bp, Homo sapiens
ctccccagcctggca

SEQ ID NO: 6146928 - DNA, 14 bp, Homo sapiens
ctccccagcctggg

SEQ ID NO: 6146929 - DNA, 15 bp, Homo sapiens
ctccccagctcctcg

SEQ ID NO: 6146930 - DNA, 17 bp, Homo sapiens
ctccccagctcttctct

SEQ ID NO: 6146931 - DNA, 22 bp, Homo sapiens
ctccccaggaagcccactgcct

SEQ ID NO: 6146932 - DNA, 19 bp, Homo sapiens
ctccccaggaagtggctca

SEQ ID NO: 6146933 - DNA, 21 bp, Homo sapiens
ctccccaggaatttgggaccc

SEQ ID NO: 6146934 - DNA, 17 bp, Homo sapiens
ctccccaggactcaccc

SEQ ID NO: 6146935 - DNA, 18 bp, Homo sapiens
ctccccaggacttggtct

SEQ ID NO: 6146936 - DNA, 19 bp, Homo sapiens
ctccccaggacttggtctt

SEQ ID NO: 6146937 - DNA, 15 bp, Homo sapiens
ctccccaggagctca

SEQ ID NO: 6146938 - DNA, 19 bp, Homo sapiens
ctccccaggcatttgccaa

SEQ ID NO: 6146939 - DNA, 22 bp, Homo sapiens
ctccccaggccaccccgctgat

SEQ ID NO: 6146940 - DNA, 17 bp, Homo sapiens
ctccccaggcctccagc

SEQ ID NO: 6146941 - DNA, 20 bp, Homo sapiens
ctccccaggcctccagcctc

SEQ ID NO: 6146942 - DNA, 22 bp, Homo sapiens
ctccccagggaagcagcagcct

SEQ ID NO: 6146943 - DNA, 13 bp, Homo sapiens
ctccccagggagc

SEQ ID NO: 6146944 - DNA, 11 bp, Homo sapiens
ctccccagggg

SEQ ID NO: 6146945 - DNA, 17 bp, Homo sapiens
ctccccaggtccagctc

SEQ ID NO: 6146946 - DNA, 22 bp, Homo sapiens
ctccccagtacaccccacctct

SEQ ID NO: 6146947 - DNA, 21 bp, Homo sapiens
ctccccagtacaggggtgctg

SEQ ID NO: 6146948 - DNA, 17 bp, Homo sapiens
ctccccagtgcctgcca

SEQ ID NO: 6146949 - DNA, 16 bp, Homo sapiens
ctccccatacacacac

SEQ ID NO: 6146950 - DNA, 19 bp, Homo sapiens
ctccccatacttcctggga

SEQ ID NO: 6146951 - DNA, 18 bp, Homo sapiens
ctccccatatataaatta

SEQ ID NO: 6146952 - DNA, 15 bp, Homo sapiens
ctccccatctgtgtt

SEQ ID NO: 6146953 - DNA, 19 bp, Homo sapiens
ctccccatgatgtttagaa

SEQ ID NO: 6146954 - DNA, 15 bp, Homo sapiens
ctccccatgcaggtg

SEQ ID NO: 6146955 - DNA, 17 bp, Homo sapiens
ctccccatgctgggctc

SEQ ID NO: 6146956 - DNA, 17 bp, Homo sapiens
ctccccatggagccagc

SEQ ID NO: 6146957 - DNA, 21 bp, Homo sapiens
ctccccatggctcctcaccac

SEQ ID NO: 6146958 - DNA, 21 bp, Homo sapiens
ctccccatggtgcagtgaaga

SEQ ID NO: 6146959 - DNA, 21 bp, Homo sapiens
ctccccatgtgcctgcaccag

SEQ ID NO: 6146960 - DNA, 23 bp, Homo sapiens
ctccccatgtgcctgcaccagga

SEQ ID NO: 6146961 - DNA, 19 bp, Homo sapiens
ctccccattcacagagcct

SEQ ID NO: 6146962 - DNA, 17 bp, Homo sapiens
ctccccatttcccatct

SEQ ID NO: 6146963 - DNA, 12 bp, Homo sapiens
ctcccccaaagc

SEQ ID NO: 6146964 - DNA, 16 bp, Homo sapiens
ctcccccaacagctgg

SEQ ID NO: 6146965 - DNA, 13 bp, Homo sapiens
ctcccccaaccaa

SEQ ID NO: 6146966 - DNA, 21 bp, Homo sapiens
ctcccccaaccaaggaaggag

SEQ ID NO: 6146967 - DNA, 12 bp, Homo sapiens
ctcccccaaccc

SEQ ID NO: 6146968 - DNA, 23 bp, Homo sapiens
ctcccccaacccccaccccacac

SEQ ID NO: 6146969 - DNA, 11 bp, Homo sapiens
ctcccccacca

SEQ ID NO: 6146970 - DNA, 19 bp, Homo sapiens
ctcccccaccactcaggcc

SEQ ID NO: 6146971 - DNA, 19 bp, Homo sapiens
ctcccccaccgttgtctca

SEQ ID NO: 6146972 - DNA, 16 bp, Homo sapiens
ctcccccacctgacaa

SEQ ID NO: 6146973 - DNA, 21 bp, Homo sapiens
ctcccccacggccgtccctga

SEQ ID NO: 6146974 - DNA, 13 bp, Homo sapiens
ctcccccacgtct

SEQ ID NO: 6146975 - DNA, 18 bp, Homo sapiens
ctcccccacgtctctctg

SEQ ID NO: 6146976 - DNA, 14 bp, Homo sapiens
ctcccccactccac

SEQ ID NO: 6146977 - DNA, 13 bp, Homo sapiens
ctcccccactttc

SEQ ID NO: 6146978 - DNA, 16 bp, Homo sapiens
ctcccccagacacagc

SEQ ID NO: 6146979 - DNA, 13 bp, Homo sapiens
ctcccccagagcc

SEQ ID NO: 6146980 - DNA, 14 bp, Homo sapiens
ctcccccagagcca

SEQ ID NO: 6146981 - DNA, 12 bp, Homo sapiens
ctcccccagagt

SEQ ID NO: 6146982 - DNA, 18 bp, Homo sapiens
ctcccccagagtgctgtc

SEQ ID NO: 6146983 - DNA, 21 bp, Homo sapiens
ctcccccagagtgctgtcggg

SEQ ID NO: 6146984 - DNA, 12 bp, Homo sapiens
ctcccccagcaa

SEQ ID NO: 6146985 - DNA, 13 bp, Homo sapiens
ctcccccagcaga

SEQ ID NO: 6146986 - DNA, 14 bp, Homo sapiens
ctcccccagccact

SEQ ID NO: 6146987 - DNA, 16 bp, Homo sapiens
ctcccccagccactcc

SEQ ID NO: 6146988 - DNA, 12 bp, Homo sapiens
ctcccccagccc

SEQ ID NO: 6146989 - DNA, 13 bp, Homo sapiens
ctcccccagcccc

SEQ ID NO: 6146990 - DNA, 22 bp, Homo sapiens
ctcccccagccccatcctctgt

SEQ ID NO: 6146991 - DNA, 14 bp, Homo sapiens
ctcccccagctcct

SEQ ID NO: 6146992 - DNA, 16 bp, Homo sapiens
ctcccccagctccttg

SEQ ID NO: 6146993 - DNA, 14 bp, Homo sapiens
ctcccccaggagca

SEQ ID NO: 6146994 - DNA, 11 bp, Homo sapiens
ctcccccaggc

SEQ ID NO: 6146995 - DNA, 12 bp, Homo sapiens
ctcccccaggca

SEQ ID NO: 6146996 - DNA, 16 bp, Homo sapiens
ctcccccaggcctgag

SEQ ID NO: 6146997 - DNA, 18 bp, Homo sapiens
ctcccccaggcctgagct

SEQ ID NO: 6146998 - DNA, 21 bp, Homo sapiens
ctcccccaggcctgagctgct

SEQ ID NO: 6146999 - DNA, 16 bp, Homo sapiens
ctcccccaggctgcgc

SEQ ID NO: 6147000 - DNA, 21 bp, Homo sapiens
ctcccccataaaatgatcctg

SEQ ID NO: 6147001 - DNA, 16 bp, Homo sapiens
ctcccccatagcaccc

SEQ ID NO: 6147002 - DNA, 17 bp, Homo sapiens
ctcccccatagcaccct

SEQ ID NO: 6147003 - DNA, 20 bp, Homo sapiens
ctcccccatccccaccactg

SEQ ID NO: 6147004 - DNA, 12 bp, Homo sapiens
ctcccccatcct

SEQ ID NO: 6147005 - DNA, 15 bp, Homo sapiens
ctcccccatcctccc

SEQ ID NO: 6147006 - DNA, 16 bp, Homo sapiens
ctcccccatctcccac

SEQ ID NO: 6147007 - DNA, 12 bp, Homo sapiens
ctccccccaatc

SEQ ID NO: 6147008 - DNA, 13 bp, Homo sapiens
ctccccccactgc

SEQ ID NO: 6147009 - DNA, 14 bp, Homo sapiens
ctccccccactgca

SEQ ID NO: 6147010 - DNA, 16 bp, Homo sapiens
ctccccccagcccctc

SEQ ID NO: 6147011 - DNA, 19 bp, Homo sapiens
ctccccccagctccctgca

SEQ ID NO: 6147012 - DNA, 20 bp, Homo sapiens
ctccccccagctccctgcac

SEQ ID NO: 6147013 - DNA, 13 bp, Homo sapiens
ctccccccatccc

SEQ ID NO: 6147014 - DNA, 14 bp, Homo sapiens
ctccccccatccca

SEQ ID NO: 6147015 - DNA, 17 bp, Homo sapiens
ctccccccatcccaggg

SEQ ID NO: 6147016 - DNA, 20 bp, Homo sapiens
ctcccccccatgcactgtga

SEQ ID NO: 6147017 - DNA, 18 bp, Homo sapiens
ctcccccccggggctggg

SEQ ID NO: 6147018 - DNA, 18 bp, Homo sapiens
ctccccccgcccacccac

SEQ ID NO: 6147019 - DNA, 17 bp, Homo sapiens
ctccccccgcctgccac

SEQ ID NO: 6147020 - DNA, 16 bp, Homo sapiens
ctcccccgacactgct

SEQ ID NO: 6147021 - DNA, 21 bp, Homo sapiens
ctcccccgcagtccccagccc

SEQ ID NO: 6147022 - DNA, 12 bp, Homo sapiens
ctcccccgccac

SEQ ID NO: 6147023 - DNA, 17 bp, Homo sapiens
ctcccccgggaggggcc

SEQ ID NO: 6147024 - DNA, 20 bp, Homo sapiens
ctcccccgtggtgcctgcac

SEQ ID NO: 6147025 - DNA, 17 bp, Homo sapiens
ctcccccgtttctcctt

SEQ ID NO: 6147026 - DNA, 22 bp, Homo sapiens
ctccccctaaacccctgtccca

SEQ ID NO: 6147027 - DNA, 17 bp, Homo sapiens
ctccccctacccatatc

SEQ ID NO: 6147028 - DNA, 23 bp, Homo sapiens
ctccccctaccgcatggcagctg

SEQ ID NO: 6147029 - DNA, 20 bp, Homo sapiens
ctccccctagcaaggtccag

SEQ ID NO: 6147030 - DNA, 12 bp, Homo sapiens
ctccccctcaga

SEQ ID NO: 6147031 - DNA, 13 bp, Homo sapiens
ctccccctcccca

SEQ ID NO: 6147032 - DNA, 13 bp, Homo sapiens
ctccccctcctag

SEQ ID NO: 6147033 - DNA, 16 bp, Homo sapiens
ctccccctcctagggg

SEQ ID NO: 6147034 - DNA, 14 bp, Homo sapiens
ctccccctcctcca

SEQ ID NO: 6147035 - DNA, 15 bp, Homo sapiens
ctccccctcctccag

SEQ ID NO: 6147036 - DNA, 13 bp, Homo sapiens
ctccccctccttc

SEQ ID NO: 6147037 - DNA, 13 bp, Homo sapiens
ctccccctctgct

SEQ ID NO: 6147038 - DNA, 14 bp, Homo sapiens
ctccccctctgctt

SEQ ID NO: 6147039 - DNA, 15 bp, Homo sapiens
ctccccctctgcttc

SEQ ID NO: 6147040 - DNA, 14 bp, Homo sapiens
ctccccctcttggt

SEQ ID NO: 6147041 - DNA, 23 bp, Homo sapiens
ctccccctgcaacttccgctgag

SEQ ID NO: 6147042 - DNA, 13 bp, Homo sapiens
ctccccctgcagc

SEQ ID NO: 6147043 - DNA, 11 bp, Homo sapiens
ctccccctgcc

SEQ ID NO: 6147044 - DNA, 12 bp, Homo sapiens
ctccccctgcca

SEQ ID NO: 6147045 - DNA, 18 bp, Homo sapiens
ctccccctgccagtgcct

SEQ ID NO: 6147046 - DNA, 13 bp, Homo sapiens
ctccccctgcgcc

SEQ ID NO: 6147047 - DNA, 13 bp, Homo sapiens
ctccccctgctgc

SEQ ID NO: 6147048 - DNA, 14 bp, Homo sapiens
ctccccctgctgct

SEQ ID NO: 6147049 - DNA, 11 bp, Homo sapiens
ctccccctggg

SEQ ID NO: 6147050 - DNA, 23 bp, Homo sapiens
ctccccctgggctctgccccagc

SEQ ID NO: 6147051 - DNA, 13 bp, Homo sapiens
ctccccctgtgtg

SEQ ID NO: 6147052 - DNA, 17 bp, Homo sapiens
ctccccctgtgtggccc

SEQ ID NO: 6147053 - DNA, 18 bp, Homo sapiens
ctcccccttaagccaaca

SEQ ID NO: 6147054 - DNA, 16 bp, Homo sapiens
ctcccccttaccccac

SEQ ID NO: 6147055 - DNA, 17 bp, Homo sapiens
ctcccccttcagctcct

SEQ ID NO: 6147056 - DNA, 18 bp, Homo sapiens
ctcccccttcagctcctg

SEQ ID NO: 6147057 - DNA, 19 bp, Homo sapiens
ctcccccttgcccgccagc

SEQ ID NO: 6147058 - DNA, 17 bp, Homo sapiens
ctcccccttgtcttccc

SEQ ID NO: 6147059 - DNA, 23 bp, Homo sapiens
ctcccccttgtcttcccccctct

SEQ ID NO: 6147060 - DNA, 16 bp, Homo sapiens
ctccccgaaagggaca

SEQ ID NO: 6147061 - DNA, 16 bp, Homo sapiens
ctccccgaggctgccc

SEQ ID NO: 6147062 - DNA, 23 bp, Homo sapiens
ctccccgatccccgacagtggct

SEQ ID NO: 6147063 - DNA, 19 bp, Homo sapiens
ctccccgatggcggggatc

SEQ ID NO: 6147064 - DNA, 14 bp, Homo sapiens
ctccccgcagccct

SEQ ID NO: 6147065 - DNA, 21 bp, Homo sapiens
ctccccgcagccctctccacc

SEQ ID NO: 6147066 - DNA, 22 bp, Homo sapiens
ctccccgcagccctctccaccc

SEQ ID NO: 6147067 - DNA, 21 bp, Homo sapiens
ctccccgcagtcgtcccaggc

SEQ ID NO: 6147068 - DNA, 14 bp, Homo sapiens
ctccccgccccctg

SEQ ID NO: 6147069 - DNA, 16 bp, Homo sapiens
ctccccgccccctgaa

SEQ ID NO: 6147070 - DNA, 19 bp, Homo sapiens
ctccccgccccctgaaaca

SEQ ID NO: 6147071 - DNA, 13 bp, Homo sapiens
ctccccgcccctg

SEQ ID NO: 6147072 - DNA, 14 bp, Homo sapiens
ctccccgcccctgt

SEQ ID NO: 6147073 - DNA, 20 bp, Homo sapiens
ctccccgcccctgtggccct

SEQ ID NO: 6147074 - DNA, 22 bp, Homo sapiens
ctccccgcccctgtggccctgg

SEQ ID NO: 6147075 - DNA, 19 bp, Homo sapiens
ctccccgcccgccctcctc

SEQ ID NO: 6147076 - DNA, 21 bp, Homo sapiens
ctccccgcccgccctcctctg

SEQ ID NO: 6147077 - DNA, 22 bp, Homo sapiens
ctccccgcccgccctcctctgc

SEQ ID NO: 6147078 - DNA, 14 bp, Homo sapiens
ctccccgcctcctc

SEQ ID NO: 6147079 - DNA, 22 bp, Homo sapiens
ctccccgcctcctccctgcctg

SEQ ID NO: 6147080 - DNA, 23 bp, Homo sapiens
ctccccgcctcctccctgcctgg

SEQ ID NO: 6147081 - DNA, 20 bp, Homo sapiens
ctccccgcctgtcctgcctc

SEQ ID NO: 6147082 - DNA, 15 bp, Homo sapiens
ctccccgcctgttcc

SEQ ID NO: 6147083 - DNA, 18 bp, Homo sapiens
ctccccgccttagagcct

SEQ ID NO: 6147084 - DNA, 22 bp, Homo sapiens
ctccccgccttccgccccttcc

SEQ ID NO: 6147085 - DNA, 16 bp, Homo sapiens
ctccccgctcaggggc

SEQ ID NO: 6147086 - DNA, 22 bp, Homo sapiens
ctccccgctcaggggcctggag

SEQ ID NO: 6147087 - DNA, 14 bp, Homo sapiens
ctccccgctctccc

SEQ ID NO: 6147088 - DNA, 14 bp, Homo sapiens
ctccccgctctgga

SEQ ID NO: 6147089 - DNA, 15 bp, Homo sapiens
ctccccgctctggat

SEQ ID NO: 6147090 - DNA, 22 bp, Homo sapiens
ctccccggacaagcccaggaca

SEQ ID NO: 6147091 - DNA, 23 bp, Homo sapiens
ctccccggacaagcccaggacac

SEQ ID NO: 6147092 - DNA, 15 bp, Homo sapiens
ctccccggacatact

SEQ ID NO: 6147093 - DNA, 20 bp, Homo sapiens
ctccccggcaccctctggcc

SEQ ID NO: 6147094 - DNA, 16 bp, Homo sapiens
ctccccggcaggcctg

SEQ ID NO: 6147095 - DNA, 17 bp, Homo sapiens
ctccccggcaggcctga

SEQ ID NO: 6147096 - DNA, 21 bp, Homo sapiens
ctccccggcaggcctgagaat

SEQ ID NO: 6147097 - DNA, 19 bp, Homo sapiens
ctccccggctcaagtgatc

SEQ ID NO: 6147098 - DNA, 19 bp, Homo sapiens
ctccccgggcagcagagag

SEQ ID NO: 6147099 - DNA, 20 bp, Homo sapiens
ctccccgggcagcagagaga

SEQ ID NO: 6147100 - DNA, 19 bp, Homo sapiens
ctccccgggggtccccgga

SEQ ID NO: 6147101 - DNA, 15 bp, Homo sapiens
ctccccgtagccact

SEQ ID NO: 6147102 - DNA, 20 bp, Homo sapiens
ctccccgtagccactctctg

SEQ ID NO: 6147103 - DNA, 22 bp, Homo sapiens
ctgcctgttaagtctgagaagg

SEQ ID NO: 6147104 - DNA, 20 bp, Homo sapiens
ctgcctgttataactctgca

SEQ ID NO: 6147105 - DNA, 22 bp, Homo sapiens
ctgcctgttataactctgcact

SEQ ID NO: 6147106 - DNA, 14 bp, Homo sapiens
ctgcctgttcagct

SEQ ID NO: 6147107 - DNA, 15 bp, Homo sapiens
ctgcctgttcagctc

SEQ ID NO: 6147108 - DNA, 17 bp, Homo sapiens
ctgcctgttcagctcca

SEQ ID NO: 6147109 - DNA, 20 bp, Homo sapiens
ctgcctgttcagctccagct

SEQ ID NO: 6147110 - DNA, 23 bp, Homo sapiens
ctgcctgttcctcccaagaggcc

SEQ ID NO: 6147111 - DNA, 13 bp, Homo sapiens
ctgcctgttcctt

SEQ ID NO: 6147112 - DNA, 17 bp, Homo sapiens
ctgcctgttctccagat

SEQ ID NO: 6147113 - DNA, 18 bp, Homo sapiens
ctgcctgttctccagatg

SEQ ID NO: 6147114 - DNA, 16 bp, Homo sapiens
ctgcctgttctgagga

SEQ ID NO: 6147115 - DNA, 23 bp, Homo sapiens
ctgcctgttgcgtgacactctcc

SEQ ID NO: 6147116 - DNA, 16 bp, Homo sapiens
ctgcctgttggcaggc

SEQ ID NO: 6147117 - DNA, 18 bp, Homo sapiens
ctgcctgttggcaggccc

SEQ ID NO: 6147118 - DNA, 23 bp, Homo sapiens
ctgcctgttgggccaggagcctc

SEQ ID NO: 6147119 - DNA, 13 bp, Homo sapiens
ctgcctgtttccc

SEQ ID NO: 6147120 - DNA, 16 bp, Homo sapiens
ctgcctgtttggggag

SEQ ID NO: 6147121 - DNA, 18 bp, Homo sapiens
ctgcctgtttggggaggg

SEQ ID NO: 6147122 - DNA, 19 bp, Homo sapiens
ctgcctgtttggggagggg

SEQ ID NO: 6147123 - DNA, 21 bp, Homo sapiens
ctgcctgtttggggagggggg

SEQ ID NO: 6147124 - DNA, 22 bp, Homo sapiens
ctgcctgtttggggaggggggc

SEQ ID NO: 6147125 - DNA, 18 bp, Homo sapiens
ctgccttaaaaccaaaga

SEQ ID NO: 6147126 - DNA, 22 bp, Homo sapiens
ctgccttaaaaccaaagagggc

SEQ ID NO: 6147127 - DNA, 15 bp, Homo sapiens
ctgccttaacctggg

SEQ ID NO: 6147128 - DNA, 16 bp, Homo sapiens
ctgccttaagtgagga

SEQ ID NO: 6147129 - DNA, 21 bp, Homo sapiens
ctgccttaatgacattcccct

SEQ ID NO: 6147130 - DNA, 22 bp, Homo sapiens
ctgccttaatgacattcccctc

SEQ ID NO: 6147131 - DNA, 16 bp, Homo sapiens
ctgccttaatttttga

SEQ ID NO: 6147132 - DNA, 20 bp, Homo sapiens
ctgccttaccttcacttaaa

SEQ ID NO: 6147133 - DNA, 22 bp, Homo sapiens
ctgccttactggtttccccagg

SEQ ID NO: 6147134 - DNA, 19 bp, Homo sapiens
ctgccttagagccaggcac

SEQ ID NO: 6147135 - DNA, 16 bp, Homo sapiens
ctgccttagaggagcc

SEQ ID NO: 6147136 - DNA, 23 bp, Homo sapiens
ctgccttagaggagcccacggct

SEQ ID NO: 6147137 - DNA, 12 bp, Homo sapiens
ctgccttagcct

SEQ ID NO: 6147138 - DNA, 13 bp, Homo sapiens
ctgccttagcctc

SEQ ID NO: 6147139 - DNA, 22 bp, Homo sapiens
ctgccttagggtttgcagagtg

SEQ ID NO: 6147140 - DNA, 23 bp, Homo sapiens
ctgccttagtctcagtttgtgtg

SEQ ID NO: 6147141 - DNA, 15 bp, Homo sapiens
ctgccttatattatt

SEQ ID NO: 6147142 - DNA, 20 bp, Homo sapiens
ctgccttatctcatttctca

SEQ ID NO: 6147143 - DNA, 21 bp, Homo sapiens
ctgccttcactgtgctccaac

SEQ ID NO: 6147144 - DNA, 18 bp, Homo sapiens
ctgccttcagccctggcc

SEQ ID NO: 6147145 - DNA, 15 bp, Homo sapiens
ctgccttcagggaga

SEQ ID NO: 6147146 - DNA, 19 bp, Homo sapiens
ctgccttcagtatcaaggc

SEQ ID NO: 6147147 - DNA, 22 bp, Homo sapiens
ctgccttcagtatcaaggctgc

SEQ ID NO: 6147148 - DNA, 18 bp, Homo sapiens
ctgccttcccatgaatct

SEQ ID NO: 6147149 - DNA, 14 bp, Homo sapiens
ctgccttcccccaa

SEQ ID NO: 6147150 - DNA, 12 bp, Homo sapiens
ctgccttcccta

SEQ ID NO: 6147151 - DNA, 15 bp, Homo sapiens
ctgccttccctagct

SEQ ID NO: 6147152 - DNA, 17 bp, Homo sapiens
ctgccttccctagcttt

SEQ ID NO: 6147153 - DNA, 12 bp, Homo sapiens
ctgccttcctca

SEQ ID NO: 6147154 - DNA, 14 bp, Homo sapiens
ctgccttcctcctt

SEQ ID NO: 6147155 - DNA, 20 bp, Homo sapiens
ctgccttcggtacccaccac

SEQ ID NO: 6147156 - DNA, 20 bp, Homo sapiens
ctgccttcgttaactgtgta

SEQ ID NO: 6147157 - DNA, 13 bp, Homo sapiens
ctgccttcgttta

SEQ ID NO: 6147158 - DNA, 19 bp, Homo sapiens
ctgccttctcccctccacg

SEQ ID NO: 6147159 - DNA, 21 bp, Homo sapiens
ctgccttctcctctctgggcc

SEQ ID NO: 6147160 - DNA, 18 bp, Homo sapiens
ctgccttctgacggccct

SEQ ID NO: 6147161 - DNA, 19 bp, Homo sapiens
ctgccttctgacggccctg

SEQ ID NO: 6147162 - DNA, 22 bp, Homo sapiens
ctgccttctgacggccctgcaa

SEQ ID NO: 6147163 - DNA, 15 bp, Homo sapiens
ctgccttctgctgaa

SEQ ID NO: 6147164 - DNA, 20 bp, Homo sapiens
ctgccttctggattcttggc

SEQ ID NO: 6147165 - DNA, 13 bp, Homo sapiens
ctgccttctgtcc

SEQ ID NO: 6147166 - DNA, 18 bp, Homo sapiens
ctgccttctgtctcttgc

SEQ ID NO: 6147167 - DNA, 23 bp, Homo sapiens
ctgccttcttccttgaggggcag

SEQ ID NO: 6147168 - DNA, 19 bp, Homo sapiens
ctgccttcttcggaaagaa

SEQ ID NO: 6147169 - DNA, 24 bp, Homo sapiens
ctgccttcttcggggaactcctgg

SEQ ID NO: 6147170 - DNA, 21 bp, Homo sapiens
ctgccttcttctttttgctgt

SEQ ID NO: 6147171 - DNA, 23 bp, Homo sapiens
ctgccttctttccatcaactccc

SEQ ID NO: 6147172 - DNA, 21 bp, Homo sapiens
ctgccttgaaaaatgacaatt

SEQ ID NO: 6147173 - DNA, 16 bp, Homo sapiens
ctgccttgaagccact

SEQ ID NO: 6147174 - DNA, 22 bp, Homo sapiens
ctgccttgatgaagcctgtgcc

SEQ ID NO: 6147175 - DNA, 20 bp, Homo sapiens
ctgccttgatggagaaggaa

SEQ ID NO: 6147176 - DNA, 12 bp, Homo sapiens
ctgccttgatta

SEQ ID NO: 6147177 - DNA, 18 bp, Homo sapiens
ctgccttgcactgtggtc

SEQ ID NO: 6147178 - DNA, 18 bp, Homo sapiens
ctgccttgcccactcctg

SEQ ID NO: 6147179 - DNA, 22 bp, Homo sapiens
ctgccttgcccactcctgctct

SEQ ID NO: 6147180 - DNA, 20 bp, Homo sapiens
ctgccttgccctcctgggcc

SEQ ID NO: 6147181 - DNA, 18 bp, Homo sapiens
ctgccttgcctcctcagt

SEQ ID NO: 6147182 - DNA, 12 bp, Homo sapiens
ctgccttgcctt

SEQ ID NO: 6147183 - DNA, 13 bp, Homo sapiens
ctgccttgccttt

SEQ ID NO: 6147184 - DNA, 21 bp, Homo sapiens
ctgccttgctgcacctgaggc

SEQ ID NO: 6147185 - DNA, 14 bp, Homo sapiens
ctgccttgctgcct

SEQ ID NO: 6147186 - DNA, 16 bp, Homo sapiens
ctgccttgctgccttc

SEQ ID NO: 6147187 - DNA, 16 bp, Homo sapiens
ctgccttgcttctgta

SEQ ID NO: 6147188 - DNA, 12 bp, Homo sapiens
ctgccttggcct

SEQ ID NO: 6147189 - DNA, 14 bp, Homo sapiens
ctgccttggcctcg

SEQ ID NO: 6147190 - DNA, 17 bp, Homo sapiens
ctgccttggctcagaca

SEQ ID NO: 6147191 - DNA, 22 bp, Homo sapiens
ctgccttggctcagacatgttt

SEQ ID NO: 6147192 - DNA, 20 bp, Homo sapiens
ctgccttgggccttgctgct

SEQ ID NO: 6147193 - DNA, 21 bp, Homo sapiens
ctgccttgggccttgctgctg

SEQ ID NO: 6147194 - DNA, 19 bp, Homo sapiens
ctgccttggggtcaggttg

SEQ ID NO: 6147195 - DNA, 18 bp, Homo sapiens
ctgccttgtttaatgtta

SEQ ID NO: 6147196 - DNA, 22 bp, Homo sapiens
ctgccttgtttatagccacttg

SEQ ID NO: 6147197 - DNA, 14 bp, Homo sapiens
ctgccttgtttgga

SEQ ID NO: 6147198 - DNA, 17 bp, Homo sapiens
ctgcctttaagccaaag

SEQ ID NO: 6147199 - DNA, 18 bp, Homo sapiens
ctgcctttaagccaaaga

SEQ ID NO: 6147200 - DNA, 23 bp, Homo sapiens
ctgcctttaagccaaagaaacaa

SEQ ID NO: 6147201 - DNA, 17 bp, Homo sapiens
ctgcctttagcctggac

SEQ ID NO: 6147202 - DNA, 19 bp, Homo sapiens
ctgcctttatgatgctaag

SEQ ID NO: 6147203 - DNA, 12 bp, Homo sapiens
ctgcctttattg

SEQ ID NO: 6147204 - DNA, 15 bp, Homo sapiens
ctgcctttattgtgt

SEQ ID NO: 6147205 - DNA, 17 bp, Homo sapiens
ctgcctttattgtgttt

SEQ ID NO: 6147206 - DNA, 22 bp, Homo sapiens
ctgcctttattgtgtttgtcat

SEQ ID NO: 6147207 - DNA, 20 bp, Homo sapiens
ctgcctttgaaattccccca

SEQ ID NO: 6147208 - DNA, 23 bp, Homo sapiens
ctgcctttgagcttctcctctgc

SEQ ID NO: 6147209 - DNA, 19 bp, Homo sapiens
ctgcctttgatcacaggag

SEQ ID NO: 6147210 - DNA, 20 bp, Homo sapiens
ctgcctttgcaccacgggac

SEQ ID NO: 6147211 - DNA, 18 bp, Homo sapiens
ctgcctttgccaggtgac

SEQ ID NO: 6147212 - DNA, 20 bp, Homo sapiens
ctgcctttgcctccagaagc

SEQ ID NO: 6147213 - DNA, 16 bp, Homo sapiens
ctgcctttgctgcctt

SEQ ID NO: 6147214 - DNA, 15 bp, Homo sapiens
ctgcctttggaagaa

SEQ ID NO: 6147215 - DNA, 17 bp, Homo sapiens
ctgcctttgggagcagg

SEQ ID NO: 6147216 - DNA, 15 bp, Homo sapiens
ctgcctttgtatgtg

SEQ ID NO: 6147217 - DNA, 18 bp, Homo sapiens
ctgcctttgtatgtggaa

SEQ ID NO: 6147218 - DNA, 21 bp, Homo sapiens
ctgcctttgtccccacacagc

SEQ ID NO: 6147219 - DNA, 20 bp, Homo sapiens
ctgcctttgtggtgggcgct

SEQ ID NO: 6147220 - DNA, 21 bp, Homo sapiens
ctgccttttaagtttgaaact

SEQ ID NO: 6147221 - DNA, 20 bp, Homo sapiens
ctgccttttagttcctgtgc

SEQ ID NO: 6147222 - DNA, 15 bp, Homo sapiens
ctgccttttctagtt

SEQ ID NO: 6147223 - DNA, 18 bp, Homo sapiens
ctgccttttctcattctg

SEQ ID NO: 6147224 - DNA, 21 bp, Homo sapiens
ctgccttttctcattctgtta

SEQ ID NO: 6147225 - DNA, 18 bp, Homo sapiens
ctgccttttgctgctgct

SEQ ID NO: 6147226 - DNA, 13 bp, Homo sapiens
ctgccttttgttc

SEQ ID NO: 6147227 - DNA, 17 bp, Homo sapiens
ctgccttttttcacagc

SEQ ID NO: 6147228 - DNA, 15 bp, Homo sapiens
ctgcgaaacccagcg

SEQ ID NO: 6147229 - DNA, 14 bp, Homo sapiens
ctgcgaactgtgca

SEQ ID NO: 6147230 - DNA, 15 bp, Homo sapiens
ctgcgaactgtgcag

SEQ ID NO: 6147231 - DNA, 20 bp, Homo sapiens
ctgcgaagaccctcttgccc

SEQ ID NO: 6147232 - DNA, 17 bp, Homo sapiens
ctgcgaaggggccctgg

SEQ ID NO: 6147233 - DNA, 19 bp, Homo sapiens
ctgcgaaggggccctggtc

SEQ ID NO: 6147234 - DNA, 22 bp, Homo sapiens
ctgcgaagtcctatggaaaccc

SEQ ID NO: 6147235 - DNA, 18 bp, Homo sapiens
ctgcgaatctagaggagg

SEQ ID NO: 6147236 - DNA, 20 bp, Homo sapiens
ctgcgaatgggatcctgatg

SEQ ID NO: 6147237 - DNA, 14 bp, Homo sapiens
ctgcgaccctgggg

SEQ ID NO: 6147238 - DNA, 16 bp, Homo sapiens
ctgcgacgcttgctct

SEQ ID NO: 6147239 - DNA, 17 bp, Homo sapiens
ctgcgactttctgcctg

SEQ ID NO: 6147240 - DNA, 12 bp, Homo sapiens
ctgcgagaccca

SEQ ID NO: 6147241 - DNA, 22 bp, Homo sapiens
ctgcgagagaccctacagacag

SEQ ID NO: 6147242 - DNA, 17 bp, Homo sapiens
ctgcgagcatttccctc

SEQ ID NO: 6147243 - DNA, 23 bp, Homo sapiens
ctgcgagcatttccctcccggga

SEQ ID NO: 6147244 - DNA, 23 bp, Homo sapiens
ctgcgaggacatcaaagtggtaa

SEQ ID NO: 6147245 - DNA, 16 bp, Homo sapiens
ctgcgagggccggtgc

SEQ ID NO: 6147246 - DNA, 23 bp, Homo sapiens
ctgcgagtagatgaacctgcagc

SEQ ID NO: 6147247 - DNA, 16 bp, Homo sapiens
ctgcgatggtgctgca

SEQ ID NO: 6147248 - DNA, 17 bp, Homo sapiens
ctgcgcaaagggcgggc

SEQ ID NO: 6147249 - DNA, 22 bp, Homo sapiens
ctgcgcaaagggcgggcctgtt

SEQ ID NO: 6147250 - DNA, 17 bp, Homo sapiens
ctgcgcaagtgcctggg

SEQ ID NO: 6147251 - DNA, 15 bp, Homo sapiens
ctgcgcacaggtggg

SEQ ID NO: 6147252 - DNA, 15 bp, Homo sapiens
ctgcgcaccaatgcc

SEQ ID NO: 6147253 - DNA, 16 bp, Homo sapiens
ctgcgcaccaatgccc

SEQ ID NO: 6147254 - DNA, 20 bp, Homo sapiens
ctgcgcaccaatgcccagca

SEQ ID NO: 6147255 - DNA, 12 bp, Homo sapiens
ctgcgcactgtg

SEQ ID NO: 6147256 - DNA, 17 bp, Homo sapiens
ctgcgcagcctccaggg

SEQ ID NO: 6147257 - DNA, 19 bp, Homo sapiens
ctgcgcagcctccagggcc

SEQ ID NO: 6147258 - DNA, 17 bp, Homo sapiens
ctgcgcagggccctctg

SEQ ID NO: 6147259 - DNA, 23 bp, Homo sapiens
ctgcgcagggtggtggtattctg

SEQ ID NO: 6147260 - DNA, 13 bp, Homo sapiens
ctgcgcaggtctc

SEQ ID NO: 6147261 - DNA, 14 bp, Homo sapiens
ctgcgcaggtctct

SEQ ID NO: 6147262 - DNA, 17 bp, Homo sapiens
ctgcgcaggtctcttct

SEQ ID NO: 6147263 - DNA, 23 bp, Homo sapiens
ctgcgcaggtctcttctgggcgt

SEQ ID NO: 6147264 - DNA, 21 bp, Homo sapiens
ctgcgccacggcactccagcc

SEQ ID NO: 6147265 - DNA, 13 bp, Homo sapiens
ctgcgccactgct

SEQ ID NO: 6147266 - DNA, 16 bp, Homo sapiens
ctgcgccacttccttt

SEQ ID NO: 6147267 - DNA, 18 bp, Homo sapiens
ctgcgcccaccccgctct

SEQ ID NO: 6147268 - DNA, 14 bp, Homo sapiens
ctgcgcccagagct

SEQ ID NO: 6147269 - DNA, 20 bp, Homo sapiens
ctgcgcccagagctggcctc

SEQ ID NO: 6147270 - DNA, 19 bp, Homo sapiens
ctgcgcccccagcttctct

SEQ ID NO: 6147271 - DNA, 14 bp, Homo sapiens
ctgcgccccccagt

SEQ ID NO: 6147272 - DNA, 16 bp, Homo sapiens
ctgcgccccgcccaca

SEQ ID NO: 6147273 - DNA, 17 bp, Homo sapiens
ctgcgccccgcccacac

SEQ ID NO: 6147274 - DNA, 16 bp, Homo sapiens
ctgcgccccgcctccc

SEQ ID NO: 6147275 - DNA, 19 bp, Homo sapiens
ctgcgccccgcctgacctg

SEQ ID NO: 6147276 - DNA, 14 bp, Homo sapiens
ctgcgcccctgccc

SEQ ID NO: 6147277 - DNA, 15 bp, Homo sapiens
ctgcgcccctgccca

SEQ ID NO: 6147278 - DNA, 19 bp, Homo sapiens
ctgcgcccctgcccagcac

SEQ ID NO: 6147279 - DNA, 22 bp, Homo sapiens
ctccccgtccctgtcccccagc

SEQ ID NO: 6147280 - DNA, 22 bp, Homo sapiens
ctccccgtgtaaaaagcctcct

SEQ ID NO: 6147281 - DNA, 22 bp, Homo sapiens
ctccccgtgtcctctccctgcc

SEQ ID NO: 6147282 - DNA, 18 bp, Homo sapiens
ctcccctaaagccaggct

SEQ ID NO: 6147283 - DNA, 21 bp, Homo sapiens
ctcccctagagccctctcctc

SEQ ID NO: 6147284 - DNA, 23 bp, Homo sapiens
ctcccctagagccctctcctccc

SEQ ID NO: 6147285 - DNA, 16 bp, Homo sapiens
ctcccctagctcacca

SEQ ID NO: 6147286 - DNA, 18 bp, Homo sapiens
ctcccctatccacccagc

SEQ ID NO: 6147287 - DNA, 17 bp, Homo sapiens
ctcccctatgctggtag

SEQ ID NO: 6147288 - DNA, 19 bp, Homo sapiens
ctcccctatgctggtagat

SEQ ID NO: 6147289 - DNA, 15 bp, Homo sapiens
ctcccctattttaag

SEQ ID NO: 6147290 - DNA, 10 bp, Homo sapiens
ctcccctcaa

SEQ ID NO: 6147291 - DNA, 13 bp, Homo sapiens
ctcccctcaagga

SEQ ID NO: 6147292 - DNA, 15 bp, Homo sapiens
ctcccctcacagcct

SEQ ID NO: 6147293 - DNA, 16 bp, Homo sapiens
ctcccctcacagcctc

SEQ ID NO: 6147294 - DNA, 18 bp, Homo sapiens
ctcccctcacagcctctg

SEQ ID NO: 6147295 - DNA, 19 bp, Homo sapiens
ctcccctcacatcctcctg

SEQ ID NO: 6147296 - DNA, 22 bp, Homo sapiens
ctcccctcacccgctgcccagc

SEQ ID NO: 6147297 - DNA, 15 bp, Homo sapiens
ctcccctcacttttc

SEQ ID NO: 6147298 - DNA, 11 bp, Homo sapiens
ctcccctcaga

SEQ ID NO: 6147299 - DNA, 19 bp, Homo sapiens
ctcccctcagagcccatgg

SEQ ID NO: 6147300 - DNA, 12 bp, Homo sapiens
ctcccctcagcc

SEQ ID NO: 6147301 - DNA, 20 bp, Homo sapiens
ctcccctcagcctgcccacc

SEQ ID NO: 6147302 - DNA, 17 bp, Homo sapiens
ctcccctcagcgcaggc

SEQ ID NO: 6147303 - DNA, 21 bp, Homo sapiens
ctcccctcagcgcaggctgca

SEQ ID NO: 6147304 - DNA, 22 bp, Homo sapiens
ctcccctcagcgcaggctgcag

SEQ ID NO: 6147305 - DNA, 10 bp, Homo sapiens
ctcccctcca

SEQ ID NO: 6147306 - DNA, 13 bp, Homo sapiens
ctcccctccaagt

SEQ ID NO: 6147307 - DNA, 22 bp, Homo sapiens
ctcccctccacgcaaggctgtg

SEQ ID NO: 6147308 - DNA, 13 bp, Homo sapiens
ctcccctccagac

SEQ ID NO: 6147309 - DNA, 14 bp, Homo sapiens
ctcccctccagacc

SEQ ID NO: 6147310 - DNA, 17 bp, Homo sapiens
ctcccctccagacccct

SEQ ID NO: 6147311 - DNA, 12 bp, Homo sapiens
ctcccctccatc

SEQ ID NO: 6147312 - DNA, 14 bp, Homo sapiens
ctcccctccatccc

SEQ ID NO: 6147313 - DNA, 23 bp, Homo sapiens
ctcccctccatccctggccccct

SEQ ID NO: 6147314 - DNA, 12 bp, Homo sapiens
ctcccctcccag

SEQ ID NO: 6147315 - DNA, 14 bp, Homo sapiens
ctcccctcccagtc

SEQ ID NO: 6147316 - DNA, 13 bp, Homo sapiens
ctcccctccccat

SEQ ID NO: 6147317 - DNA, 14 bp, Homo sapiens
ctcccctccccatc

SEQ ID NO: 6147318 - DNA, 17 bp, Homo sapiens
ctcccctccccatctgt

SEQ ID NO: 6147319 - DNA, 21 bp, Homo sapiens
ctcccctccccgccccctgaa

SEQ ID NO: 6147320 - DNA, 18 bp, Homo sapiens
ctcccctccccgcctggc

SEQ ID NO: 6147321 - DNA, 18 bp, Homo sapiens
ctcccctcccctgctgca

SEQ ID NO: 6147322 - DNA, 15 bp, Homo sapiens
ctcccctcccctggg

SEQ ID NO: 6147323 - DNA, 13 bp, Homo sapiens
ctcccctcccgaa

SEQ ID NO: 6147324 - DNA, 20 bp, Homo sapiens
ctcccctccctcttccttcc

SEQ ID NO: 6147325 - DNA, 24 bp, Homo sapiens
ctcccctccggactggtgccctcc

SEQ ID NO: 6147326 - DNA, 11 bp, Homo sapiens
ctcccctcctc

SEQ ID NO: 6147327 - DNA, 12 bp, Homo sapiens
ctcccctcctcc

SEQ ID NO: 6147328 - DNA, 15 bp, Homo sapiens
ctcccctcctcttcc

SEQ ID NO: 6147329 - DNA, 17 bp, Homo sapiens
ctcccctcctcttccct

SEQ ID NO: 6147330 - DNA, 22 bp, Homo sapiens
ctcccctcctggcgagttctct

SEQ ID NO: 6147331 - DNA, 19 bp, Homo sapiens
ctcccctccttgcctcctg

SEQ ID NO: 6147332 - DNA, 22 bp, Homo sapiens
ctcccctccttgcctcctgtgt

SEQ ID NO: 6147333 - DNA, 17 bp, Homo sapiens
ctcccctcgacagctct

SEQ ID NO: 6147334 - DNA, 10 bp, Homo sapiens
ctcccctcta

SEQ ID NO: 6147335 - DNA, 14 bp, Homo sapiens
ctcccctctcagaa

SEQ ID NO: 6147336 - DNA, 22 bp, Homo sapiens
ctcccctctcagaacatactga

SEQ ID NO: 6147337 - DNA, 18 bp, Homo sapiens
ctcccctctcatccccct

SEQ ID NO: 6147338 - DNA, 18 bp, Homo sapiens
ctcccctctcccagggat

SEQ ID NO: 6147339 - DNA, 23 bp, Homo sapiens
ctcccctctcctccccttcctgt

SEQ ID NO: 6147340 - DNA, 22 bp, Homo sapiens
ctcccctctcgccccatccctg

SEQ ID NO: 6147341 - DNA, 23 bp, Homo sapiens
ctcccctctgaaagttgtacatg

SEQ ID NO: 6147342 - DNA, 16 bp, Homo sapiens
ctcccctctgccctgt

SEQ ID NO: 6147343 - DNA, 14 bp, Homo sapiens
ctcccctctgcttc

SEQ ID NO: 6147344 - DNA, 14 bp, Homo sapiens
ctcccctctggaat

SEQ ID NO: 6147345 - DNA, 18 bp, Homo sapiens
ctcccctcttatgtacct

SEQ ID NO: 6147346 - DNA, 14 bp, Homo sapiens
ctcccctcttcctc

SEQ ID NO: 6147347 - DNA, 15 bp, Homo sapiens
ctcccctcttcctct

SEQ ID NO: 6147348 - DNA, 13 bp, Homo sapiens
ctcccctcttctg

SEQ ID NO: 6147349 - DNA, 22 bp, Homo sapiens
ctcccctcttctgagctagttg

SEQ ID NO: 6147350 - DNA, 13 bp, Homo sapiens
ctcccctcttgag

SEQ ID NO: 6147351 - DNA, 13 bp, Homo sapiens
ctcccctcttttg

SEQ ID NO: 6147352 - DNA, 22 bp, Homo sapiens
ctcccctgacctgtgagcccag

SEQ ID NO: 6147353 - DNA, 22 bp, Homo sapiens
ctcccctgaggctggcatcctg

SEQ ID NO: 6147354 - DNA, 12 bp, Homo sapiens
ctcccctgatcc

SEQ ID NO: 6147355 - DNA, 15 bp, Homo sapiens
ctcccctgatccaga

SEQ ID NO: 6147356 - DNA, 22 bp, Homo sapiens
ctcccctgattacaccagcctc

SEQ ID NO: 6147357 - DNA, 19 bp, Homo sapiens
ctcccctgcactgtaaaat

SEQ ID NO: 6147358 - DNA, 13 bp, Homo sapiens
ctcccctgccaca

SEQ ID NO: 6147359 - DNA, 16 bp, Homo sapiens
ctcccctgccacactg

SEQ ID NO: 6147360 - DNA, 12 bp, Homo sapiens
ctcccctgcccc

SEQ ID NO: 6147361 - DNA, 21 bp, Homo sapiens
ctcccctgcccccaggactgg

SEQ ID NO: 6147362 - DNA, 15 bp, Homo sapiens
ctcccctgccccctg

SEQ ID NO: 6147363 - DNA, 17 bp, Homo sapiens
ctcccctgccccctgca

SEQ ID NO: 6147364 - DNA, 20 bp, Homo sapiens
ctcccctgccccctgcagga

SEQ ID NO: 6147365 - DNA, 15 bp, Homo sapiens
ctcccctgccccgtc

SEQ ID NO: 6147366 - DNA, 12 bp, Homo sapiens
ctcccctgccct

SEQ ID NO: 6147367 - DNA, 13 bp, Homo sapiens
ctcccctgccctg

SEQ ID NO: 6147368 - DNA, 16 bp, Homo sapiens
ctcccctgccctgctg

SEQ ID NO: 6147369 - DNA, 12 bp, Homo sapiens
ctcccctgccgc

SEQ ID NO: 6147370 - DNA, 14 bp, Homo sapiens
ctcccctgccggtg

SEQ ID NO: 6147371 - DNA, 22 bp, Homo sapiens
ctcccctgccttaacctgggac

SEQ ID NO: 6147372 - DNA, 23 bp, Homo sapiens
ctcccctgccttaacctgggacc

SEQ ID NO: 6147373 - DNA, 20 bp, Homo sapiens
ctcccctgcgcaggccctcc

SEQ ID NO: 6147374 - DNA, 14 bp, Homo sapiens
ctcccctgctccca

SEQ ID NO: 6147375 - DNA, 16 bp, Homo sapiens
ctcccctgctgaaggt

SEQ ID NO: 6147376 - DNA, 18 bp, Homo sapiens
ctcccctgctgcaggggc

SEQ ID NO: 6147377 - DNA, 13 bp, Homo sapiens
ctcccctgctggg

SEQ ID NO: 6147378 - DNA, 23 bp, Homo sapiens
ctcccctgctgggtgtggcgcag

SEQ ID NO: 6147379 - DNA, 22 bp, Homo sapiens
ctcccctggaactgtctctcat

SEQ ID NO: 6147380 - DNA, 15 bp, Homo sapiens
ctcccctggaagcga

SEQ ID NO: 6147381 - DNA, 17 bp, Homo sapiens
ctcccctggacagaggc

SEQ ID NO: 6147382 - DNA, 12 bp, Homo sapiens
ctcccctggctg

SEQ ID NO: 6147383 - DNA, 13 bp, Homo sapiens
ctcccctgggact

SEQ ID NO: 6147384 - DNA, 18 bp, Homo sapiens
ctcccctgggttaacaaa

SEQ ID NO: 6147385 - DNA, 21 bp, Homo sapiens
ctcccctgggttaacaaatga

SEQ ID NO: 6147386 - DNA, 13 bp, Homo sapiens
ctcccctggtcct

SEQ ID NO: 6147387 - DNA, 14 bp, Homo sapiens
ctcccctggtcctg

SEQ ID NO: 6147388 - DNA, 13 bp, Homo sapiens
ctcccctggtctc

SEQ ID NO: 6147389 - DNA, 20 bp, Homo sapiens
ctcccctgtcttctctcaaa

SEQ ID NO: 6147390 - DNA, 18 bp, Homo sapiens
ctcccctgtgccagccca

SEQ ID NO: 6147391 - DNA, 18 bp, Homo sapiens
ctccccttaaaatgtcta

SEQ ID NO: 6147392 - DNA, 14 bp, Homo sapiens
ctccccttccattt

SEQ ID NO: 6147393 - DNA, 16 bp, Homo sapiens
ctccccttccatttct

SEQ ID NO: 6147394 - DNA, 23 bp, Homo sapiens
ctccccttccccttccttctttg

SEQ ID NO: 6147395 - DNA, 16 bp, Homo sapiens
ctccccttccctgcaa

SEQ ID NO: 6147396 - DNA, 15 bp, Homo sapiens
ctccccttccctggg

SEQ ID NO: 6147397 - DNA, 11 bp, Homo sapiens
ctccccttcct

SEQ ID NO: 6147398 - DNA, 19 bp, Homo sapiens
ctccccttcctcactgccc

SEQ ID NO: 6147399 - DNA, 12 bp, Homo sapiens
ctccccttcctg

SEQ ID NO: 6147400 - DNA, 14 bp, Homo sapiens
ctccccttcctgca

SEQ ID NO: 6147401 - DNA, 16 bp, Homo sapiens
ctccccttcctgcacc

SEQ ID NO: 6147402 - DNA, 18 bp, Homo sapiens
ctccccttcctgcacccg

SEQ ID NO: 6147403 - DNA, 20 bp, Homo sapiens
ctccccttcctgcacccgta

SEQ ID NO: 6147404 - DNA, 20 bp, Homo sapiens
ctccccttcctggacacact

SEQ ID NO: 6147405 - DNA, 14 bp, Homo sapiens
ctccccttcttccc

SEQ ID NO: 6147406 - DNA, 23 bp, Homo sapiens
ctccccttcttgtgtcctggctg

SEQ ID NO: 6147407 - DNA, 14 bp, Homo sapiens
ctccccttgagctg

SEQ ID NO: 6147408 - DNA, 16 bp, Homo sapiens
ctccccttgagctgag

SEQ ID NO: 6147409 - DNA, 16 bp, Homo sapiens
ctccccttgccacatc

SEQ ID NO: 6147410 - DNA, 16 bp, Homo sapiens
ctccccttgccagctg

SEQ ID NO: 6147411 - DNA, 13 bp, Homo sapiens
ctccccttgcctg

SEQ ID NO: 6147412 - DNA, 18 bp, Homo sapiens
ctccccttgcctgtgcca

SEQ ID NO: 6147413 - DNA, 14 bp, Homo sapiens
ctccccttgccttc

SEQ ID NO: 6147414 - DNA, 19 bp, Homo sapiens
ctccccttggacctccagg

SEQ ID NO: 6147415 - DNA, 15 bp, Homo sapiens
ctccccttgggcggc

SEQ ID NO: 6147416 - DNA, 18 bp, Homo sapiens
ctccccttggttctgcac

SEQ ID NO: 6147417 - DNA, 20 bp, Homo sapiens
ctccccttggttctgcactg

SEQ ID NO: 6147418 - DNA, 17 bp, Homo sapiens
ctcccctttctttgcaa

SEQ ID NO: 6147419 - DNA, 21 bp, Homo sapiens
ctccccttttaccactcccag

SEQ ID NO: 6147420 - DNA, 20 bp, Homo sapiens
ctccccttttatgcacttca

SEQ ID NO: 6147421 - DNA, 14 bp, Homo sapiens
ctccccttttctat

SEQ ID NO: 6147422 - DNA, 16 bp, Homo sapiens
ctccccttttctatgt

SEQ ID NO: 6147423 - DNA, 17 bp, Homo sapiens
ctccccttttgcccccg

SEQ ID NO: 6147424 - DNA, 16 bp, Homo sapiens
ctcccctttttttccc

SEQ ID NO: 6147425 - DNA, 17 bp, Homo sapiens
ctcccgaaaaatgtgtg

SEQ ID NO: 6147426 - DNA, 17 bp, Homo sapiens
ctcccgaaagcctttcc

SEQ ID NO: 6147427 - DNA, 18 bp, Homo sapiens
ctcccgaaagcctttcct

SEQ ID NO: 6147428 - DNA, 20 bp, Homo sapiens
ctcccgaaagcctttcctcg

SEQ ID NO: 6147429 - DNA, 18 bp, Homo sapiens
ctcccgaacactgagaaa

SEQ ID NO: 6147430 - DNA, 13 bp, Homo sapiens
ctcccgaatcctg

SEQ ID NO: 6147431 - DNA, 14 bp, Homo sapiens
ctcccgaatcctga

SEQ ID NO: 6147432 - DNA, 16 bp, Homo sapiens
ctcccgacagcccatc

SEQ ID NO: 6147433 - DNA, 18 bp, Homo sapiens
ctcccgaccccatccacc

SEQ ID NO: 6147434 - DNA, 16 bp, Homo sapiens
ctcccgactgaccact

SEQ ID NO: 6147435 - DNA, 18 bp, Homo sapiens
ctcccgagaccgggccct

SEQ ID NO: 6147436 - DNA, 12 bp, Homo sapiens
ctcccgagctcc

SEQ ID NO: 6147437 - DNA, 18 bp, Homo sapiens
ctcccgagctcctcttcc

SEQ ID NO: 6147438 - DNA, 15 bp, Homo sapiens
ctcccgagtagctgg

SEQ ID NO: 6147439 - DNA, 16 bp, Homo sapiens
ctcccgagtagctggg

SEQ ID NO: 6147440 - DNA, 19 bp, Homo sapiens
ctcccgagtagctgggact

SEQ ID NO: 6147441 - DNA, 20 bp, Homo sapiens
ctcccgagtagctgggacta

SEQ ID NO: 6147442 - DNA, 19 bp, Homo sapiens
ctcccgagtagctgggatt

SEQ ID NO: 6147443 - DNA, 16 bp, Homo sapiens
ctcccgagtggggcct

SEQ ID NO: 6147444 - DNA, 17 bp, Homo sapiens
ctcccgcattggtggct

SEQ ID NO: 6147445 - DNA, 16 bp, Homo sapiens
ctcccgccacacgctc

SEQ ID NO: 6147446 - DNA, 18 bp, Homo sapiens
ctcccgccacacgctcac

SEQ ID NO: 6147447 - DNA, 15 bp, Homo sapiens
ctcccgccaccctgt

SEQ ID NO: 6147448 - DNA, 21 bp, Homo sapiens
ctcccgccagactgttagaaa

SEQ ID NO: 6147449 - DNA, 14 bp, Homo sapiens
ctcccgccaggagc

SEQ ID NO: 6147450 - DNA, 13 bp, Homo sapiens
ctcccgccattgg

SEQ ID NO: 6147451 - DNA, 15 bp, Homo sapiens
ctcccgccattggcc

SEQ ID NO: 6147452 - DNA, 21 bp, Homo sapiens
ctcccgcccaaacctttcccc

SEQ ID NO: 6147453 - DNA, 21 bp, Homo sapiens
ctcccgccccccacacttccc

SEQ ID NO: 6147454 - DNA, 20 bp, Homo sapiens
ctcccgccccgggctggccc

SEQ ID NO: 6147455 - DNA, 21 bp, Homo sapiens
ctcccgcccttccatgtgcct

SEQ ID NO: 6147456 - DNA, 16 bp, Homo sapiens
ctcccgccgcctcggg

SEQ ID NO: 6147457 - DNA, 17 bp, Homo sapiens
ctcccgccgcctcgggc

SEQ ID NO: 6147458 - DNA, 20 bp, Homo sapiens
ctcccgccgcctcgggccgc

SEQ ID NO: 6147459 - DNA, 15 bp, Homo sapiens
ctcccgcctcagcct

SEQ ID NO: 6147460 - DNA, 20 bp, Homo sapiens
ctgcgcccctgcccagcacc

SEQ ID NO: 6147461 - DNA, 13 bp, Homo sapiens
ctgcgccctccct

SEQ ID NO: 6147462 - DNA, 23 bp, Homo sapiens
ctgcgccctccctccctccacac

SEQ ID NO: 6147463 - DNA, 14 bp, Homo sapiens
ctgcgccctgtgca

SEQ ID NO: 6147464 - DNA, 17 bp, Homo sapiens
ctgcgcccttaccttcc

SEQ ID NO: 6147465 - DNA, 18 bp, Homo sapiens
ctgcgcccttaccttccc

SEQ ID NO: 6147466 - DNA, 13 bp, Homo sapiens
ctgcgcccttccc

SEQ ID NO: 6147467 - DNA, 19 bp, Homo sapiens
ctgcgccggacagagtggg

SEQ ID NO: 6147468 - DNA, 12 bp, Homo sapiens
ctgcgcctcagg

SEQ ID NO: 6147469 - DNA, 13 bp, Homo sapiens
ctgcgcctccaga

SEQ ID NO: 6147470 - DNA, 14 bp, Homo sapiens
ctgcgcctccagag

SEQ ID NO: 6147471 - DNA, 19 bp, Homo sapiens
ctgcgcctccatccatctg

SEQ ID NO: 6147472 - DNA, 18 bp, Homo sapiens
ctgcgcctcctcctgcat

SEQ ID NO: 6147473 - DNA, 19 bp, Homo sapiens
ctgcgcctcctcctgcatg

SEQ ID NO: 6147474 - DNA, 16 bp, Homo sapiens
ctgcgcctgcacctgc

SEQ ID NO: 6147475 - DNA, 19 bp, Homo sapiens
ctgcgcctgcacctgcgcc

SEQ ID NO: 6147476 - DNA, 13 bp, Homo sapiens
ctgcgcctgcagg

SEQ ID NO: 6147477 - DNA, 16 bp, Homo sapiens
ctgcgcctgcaggcag

SEQ ID NO: 6147478 - DNA, 18 bp, Homo sapiens
ctgcgcctgcaggcagag

SEQ ID NO: 6147479 - DNA, 14 bp, Homo sapiens
ctgcgcctgcccgc

SEQ ID NO: 6147480 - DNA, 15 bp, Homo sapiens
ctgcgcctgcccgcc

SEQ ID NO: 6147481 - DNA, 16 bp, Homo sapiens
ctgcgcctgcgcctcc

SEQ ID NO: 6147482 - DNA, 18 bp, Homo sapiens
ctgcgcctgcgcctcctc

SEQ ID NO: 6147483 - DNA, 12 bp, Homo sapiens
ctgcgcctgctg

SEQ ID NO: 6147484 - DNA, 18 bp, Homo sapiens
ctgcgcctgctgcctgct

SEQ ID NO: 6147485 - DNA, 21 bp, Homo sapiens
ctgcgcctttccttttcgcct

SEQ ID NO: 6147486 - DNA, 16 bp, Homo sapiens
ctgcgctagcagccct

SEQ ID NO: 6147487 - DNA, 20 bp, Homo sapiens
ctgcgctagcagcccttgtg

SEQ ID NO: 6147488 - DNA, 22 bp, Homo sapiens
ctgcgctagcagcccttgtgtg

SEQ ID NO: 6147489 - DNA, 15 bp, Homo sapiens
ctgcgctcctctgca

SEQ ID NO: 6147490 - DNA, 15 bp, Homo sapiens
ctgcgctcggcagga

SEQ ID NO: 6147491 - DNA, 18 bp, Homo sapiens
ctgcgctcggcaggaagg

SEQ ID NO: 6147492 - DNA, 21 bp, Homo sapiens
ctgcgctcggcaggaaggagc

SEQ ID NO: 6147493 - DNA, 23 bp, Homo sapiens
ctgcgctcttgggaccccagaga

SEQ ID NO: 6147494 - DNA, 21 bp, Homo sapiens
ctgcgctgaggcccagcccct

SEQ ID NO: 6147495 - DNA, 20 bp, Homo sapiens
ctgcgctgccccagagcctg

SEQ ID NO: 6147496 - DNA, 19 bp, Homo sapiens
ctgcgctgctttttcaaaa

SEQ ID NO: 6147497 - DNA, 20 bp, Homo sapiens
ctgcgctggacgatagcttg

SEQ ID NO: 6147498 - DNA, 12 bp, Homo sapiens
ctgcgctgtgct

SEQ ID NO: 6147499 - DNA, 15 bp, Homo sapiens
ctgcgctgtgtacaa

SEQ ID NO: 6147500 - DNA, 21 bp, Homo sapiens
ctgcgcttcctgagcagtccc

SEQ ID NO: 6147501 - DNA, 17 bp, Homo sapiens
ctgcgcttctgctggag

SEQ ID NO: 6147502 - DNA, 17 bp, Homo sapiens
ctgcgctttattttctt

SEQ ID NO: 6147503 - DNA, 19 bp, Homo sapiens
ctgcgctttgaacgtgcca

SEQ ID NO: 6147504 - DNA, 22 bp, Homo sapiens
ctgcgctttgaacgtgccagca

SEQ ID NO: 6147505 - DNA, 14 bp, Homo sapiens
ctgcggaaaaggaa

SEQ ID NO: 6147506 - DNA, 15 bp, Homo sapiens
ctgcggaagaactga

SEQ ID NO: 6147507 - DNA, 14 bp, Homo sapiens
ctgcggaagccaaa

SEQ ID NO: 6147508 - DNA, 20 bp, Homo sapiens
ctgcggaagccaaaggcagc

SEQ ID NO: 6147509 - DNA, 16 bp, Homo sapiens
ctgcggaagccacagg

SEQ ID NO: 6147510 - DNA, 20 bp, Homo sapiens
ctgcggaatgaaccacatct

SEQ ID NO: 6147511 - DNA, 17 bp, Homo sapiens
ctgcggacaccgtggcc

SEQ ID NO: 6147512 - DNA, 22 bp, Homo sapiens
ctgcggacaccgtggcctgggc

SEQ ID NO: 6147513 - DNA, 17 bp, Homo sapiens
ctgcggactccatggcc

SEQ ID NO: 6147514 - DNA, 23 bp, Homo sapiens
ctgcggactccatggcccttcct

SEQ ID NO: 6147515 - DNA, 20 bp, Homo sapiens
ctgcggagcacactggctca

SEQ ID NO: 6147516 - DNA, 23 bp, Homo sapiens
ctgcggagccagcgcctgcccga

SEQ ID NO: 6147517 - DNA, 17 bp, Homo sapiens
ctgcggagccggcacct

SEQ ID NO: 6147518 - DNA, 21 bp, Homo sapiens
ctgcggagtgaagaggggcag

SEQ ID NO: 6147519 - DNA, 23 bp, Homo sapiens
ctgcggagtgaagaggggcagcc

SEQ ID NO: 6147520 - DNA, 20 bp, Homo sapiens
ctgcggatactcttggagag

SEQ ID NO: 6147521 - DNA, 23 bp, Homo sapiens
ctgcggcagcccctcccagccta

SEQ ID NO: 6147522 - DNA, 16 bp, Homo sapiens
ctgcggcatccctgtg

SEQ ID NO: 6147523 - DNA, 12 bp, Homo sapiens
ctgcggccagag

SEQ ID NO: 6147524 - DNA, 16 bp, Homo sapiens
ctgcggcgccagcctc

SEQ ID NO: 6147525 - DNA, 20 bp, Homo sapiens
ctgcggctcagccttgcaca

SEQ ID NO: 6147526 - DNA, 14 bp, Homo sapiens
ctgcggctctggaa

SEQ ID NO: 6147527 - DNA, 14 bp, Homo sapiens
ctgcggctgctggc

SEQ ID NO: 6147528 - DNA, 15 bp, Homo sapiens
ctgcggctgtgggcg

SEQ ID NO: 6147529 - DNA, 16 bp, Homo sapiens
ctgcggctgtgggcga

SEQ ID NO: 6147530 - DNA, 15 bp, Homo sapiens
ctgcgggagccagac

SEQ ID NO: 6147531 - DNA, 18 bp, Homo sapiens
ctgcgggagccagactgt

SEQ ID NO: 6147532 - DNA, 17 bp, Homo sapiens
ctgcgggagctctgtat

SEQ ID NO: 6147533 - DNA, 15 bp, Homo sapiens
ctgcgggaggccctg

SEQ ID NO: 6147534 - DNA, 15 bp, Homo sapiens
ctgcgggaggctggg

SEQ ID NO: 6147535 - DNA, 18 bp, Homo sapiens
ctgcgggaggctggggcc

SEQ ID NO: 6147536 - DNA, 18 bp, Homo sapiens
ctgcgggatggtcctggg

SEQ ID NO: 6147537 - DNA, 16 bp, Homo sapiens
ctgcgggccacagggc

SEQ ID NO: 6147538 - DNA, 18 bp, Homo sapiens
ctgcgggccacagggcaa

SEQ ID NO: 6147539 - DNA, 13 bp, Homo sapiens
ctgcgggccaggg

SEQ ID NO: 6147540 - DNA, 15 bp, Homo sapiens
ctgcgggccagggtc

SEQ ID NO: 6147541 - DNA, 14 bp, Homo sapiens
ctgcgggcccctgg

SEQ ID NO: 6147542 - DNA, 23 bp, Homo sapiens
ctgcgggcgcgggcagccaccca

SEQ ID NO: 6147543 - DNA, 16 bp, Homo sapiens
ctgcgggctccctcct

SEQ ID NO: 6147544 - DNA, 15 bp, Homo sapiens
ctgcgggctgagggc

SEQ ID NO: 6147545 - DNA, 21 bp, Homo sapiens
ctgcgggctgagggcatctct

SEQ ID NO: 6147546 - DNA, 14 bp, Homo sapiens
ctgcggggagacag

SEQ ID NO: 6147547 - DNA, 15 bp, Homo sapiens
ctgcggggagacaga

SEQ ID NO: 6147548 - DNA, 15 bp, Homo sapiens
ctgcggggcagcagg

SEQ ID NO: 6147549 - DNA, 15 bp, Homo sapiens
ctgcgggtcctcagc

SEQ ID NO: 6147550 - DNA, 16 bp, Homo sapiens
ctgcgggtctgaagga

SEQ ID NO: 6147551 - DNA, 22 bp, Homo sapiens
ctgcgggtgaacaaagcagcca

SEQ ID NO: 6147552 - DNA, 19 bp, Homo sapiens
ctgcgggtgggtatcccac

SEQ ID NO: 6147553 - DNA, 15 bp, Homo sapiens
ctgcggtacaggagt

SEQ ID NO: 6147554 - DNA, 23 bp, Homo sapiens
ctgcggtacaggagtcagccatg

SEQ ID NO: 6147555 - DNA, 22 bp, Homo sapiens
ctgcggtagatgggagggaggc

SEQ ID NO: 6147556 - DNA, 16 bp, Homo sapiens
ctgcggtcaaggccag

SEQ ID NO: 6147557 - DNA, 15 bp, Homo sapiens
ctgcggtccacccag

SEQ ID NO: 6147558 - DNA, 14 bp, Homo sapiens
ctgcggtgaggcag

SEQ ID NO: 6147559 - DNA, 18 bp, Homo sapiens
ctgcggtgctatctcccc

SEQ ID NO: 6147560 - DNA, 20 bp, Homo sapiens
ctgcggtgctatctccccca

SEQ ID NO: 6147561 - DNA, 23 bp, Homo sapiens
ctgcggtgctatctcccccagcc

SEQ ID NO: 6147562 - DNA, 14 bp, Homo sapiens
ctgcggtgggcagc

SEQ ID NO: 6147563 - DNA, 14 bp, Homo sapiens
ctgcggtgtctgca

SEQ ID NO: 6147564 - DNA, 17 bp, Homo sapiens
ctgcggtgtctgcagct

SEQ ID NO: 6147565 - DNA, 16 bp, Homo sapiens
ctgcgtaaccctcgcc

SEQ ID NO: 6147566 - DNA, 23 bp, Homo sapiens
ctgcgtaaccctcgccctgtccc

SEQ ID NO: 6147567 - DNA, 16 bp, Homo sapiens
ctgcgtactccactgg

SEQ ID NO: 6147568 - DNA, 18 bp, Homo sapiens
ctgcgtagaagatatgga

SEQ ID NO: 6147569 - DNA, 19 bp, Homo sapiens
ctgcgtagagcctggaagg

SEQ ID NO: 6147570 - DNA, 22 bp, Homo sapiens
ctgcgtaggcgttggtgcgtcc

SEQ ID NO: 6147571 - DNA, 20 bp, Homo sapiens
ctgcgtcagaccagtactgg

SEQ ID NO: 6147572 - DNA, 21 bp, Homo sapiens
ctgcgtcagaccagtactggg

SEQ ID NO: 6147573 - DNA, 22 bp, Homo sapiens
ctgcgtcaggcacgtctcctgc

SEQ ID NO: 6147574 - DNA, 15 bp, Homo sapiens
ctgcgtcataaggag

SEQ ID NO: 6147575 - DNA, 13 bp, Homo sapiens
ctgcgtcatggct

SEQ ID NO: 6147576 - DNA, 15 bp, Homo sapiens
ctgcgtcatggctca

SEQ ID NO: 6147577 - DNA, 17 bp, Homo sapiens
ctgcgtcatggctcaag

SEQ ID NO: 6147578 - DNA, 18 bp, Homo sapiens
ctgcgtcatggctcaagg

SEQ ID NO: 6147579 - DNA, 23 bp, Homo sapiens
ctgcgtcatggctcaaggattca

SEQ ID NO: 6147580 - DNA, 14 bp, Homo sapiens
ctgcgtccaccagg

SEQ ID NO: 6147581 - DNA, 16 bp, Homo sapiens
ctgcgtccaccaggcc

SEQ ID NO: 6147582 - DNA, 17 bp, Homo sapiens
ctgcgtccaccaggcct

SEQ ID NO: 6147583 - DNA, 22 bp, Homo sapiens
ctgcgtccaccaggcctcactg

SEQ ID NO: 6147584 - DNA, 23 bp, Homo sapiens
ctgcgtccaccaggcctcactgg

SEQ ID NO: 6147585 - DNA, 18 bp, Homo sapiens
ctgcgtccaccctgagct

SEQ ID NO: 6147586 - DNA, 19 bp, Homo sapiens
ctgcgtcccactgagtctc

SEQ ID NO: 6147587 - DNA, 14 bp, Homo sapiens
ctgcgtcccagcct

SEQ ID NO: 6147588 - DNA, 14 bp, Homo sapiens
ctgcgtcccccagc

SEQ ID NO: 6147589 - DNA, 15 bp, Homo sapiens
ctgcgtcccccagcc

SEQ ID NO: 6147590 - DNA, 17 bp, Homo sapiens
ctgcgtcccccagccct

SEQ ID NO: 6147591 - DNA, 22 bp, Homo sapiens
ctgcgtcccccagccctcaggc

SEQ ID NO: 6147592 - DNA, 15 bp, Homo sapiens
ctgcgtccctgctca

SEQ ID NO: 6147593 - DNA, 19 bp, Homo sapiens
ctgcgtccctgctcagccc

SEQ ID NO: 6147594 - DNA, 13 bp, Homo sapiens
ctgcgtcccttct

SEQ ID NO: 6147595 - DNA, 21 bp, Homo sapiens
ctgcgtcctcatttcccctcc

SEQ ID NO: 6147596 - DNA, 15 bp, Homo sapiens
ctgcgtcctcctcac

SEQ ID NO: 6147597 - DNA, 24 bp, Homo sapiens
ctgcgtcctcctcacctcatgccc

SEQ ID NO: 6147598 - DNA, 18 bp, Homo sapiens
ctgcgtcctgacgccctg

SEQ ID NO: 6147599 - DNA, 19 bp, Homo sapiens
ctgcgtcctgacgccctgc

SEQ ID NO: 6147600 - DNA, 13 bp, Homo sapiens
ctgcgtcctgagg

SEQ ID NO: 6147601 - DNA, 16 bp, Homo sapiens
ctgcgtcgagctggga

SEQ ID NO: 6147602 - DNA, 17 bp, Homo sapiens
ctgcgtcggtcctggtg

SEQ ID NO: 6147603 - DNA, 16 bp, Homo sapiens
ctgcgtctcctcgtcc

SEQ ID NO: 6147604 - DNA, 13 bp, Homo sapiens
ctgcgtctcctgc

SEQ ID NO: 6147605 - DNA, 15 bp, Homo sapiens
ctgcgtctggagggg

SEQ ID NO: 6147606 - DNA, 23 bp, Homo sapiens
ctgcgtcttccgcccctgcctgc

SEQ ID NO: 6147607 - DNA, 20 bp, Homo sapiens
ctgcgtgacatgtgcagtgc

SEQ ID NO: 6147608 - DNA, 23 bp, Homo sapiens
ctgcgtgatggctatgccttgca

SEQ ID NO: 6147609 - DNA, 12 bp, Homo sapiens
ctgcgtgccatc

SEQ ID NO: 6147610 - DNA, 18 bp, Homo sapiens
ctgcgtgccatgagtcca

SEQ ID NO: 6147611 - DNA, 24 bp, Homo sapiens
ctgcgtgccatgagtccatgtcct

SEQ ID NO: 6147612 - DNA, 16 bp, Homo sapiens
ctgcgtgcccctgctg

SEQ ID NO: 6147613 - DNA, 21 bp, Homo sapiens
ctgcgtgctttatttatggct

SEQ ID NO: 6147614 - DNA, 14 bp, Homo sapiens
ctgcgtggcctgag

SEQ ID NO: 6147615 - DNA, 15 bp, Homo sapiens
ctgcgtggcctgagt

SEQ ID NO: 6147616 - DNA, 21 bp, Homo sapiens
ctgcgtggcctgagtcctggt

SEQ ID NO: 6147617 - DNA, 13 bp, Homo sapiens
ctgcgtggcctgg

SEQ ID NO: 6147618 - DNA, 14 bp, Homo sapiens
ctgcgtggcctggg

SEQ ID NO: 6147619 - DNA, 15 bp, Homo sapiens
ctgcgtggctgaccc

SEQ ID NO: 6147620 - DNA, 21 bp, Homo sapiens
ctgcgtgtgggaggctgggga

SEQ ID NO: 6147621 - DNA, 13 bp, Homo sapiens
ctgcgtgtgtata

SEQ ID NO: 6147622 - DNA, 18 bp, Homo sapiens
ctgcgtgttgtttttccc

SEQ ID NO: 6147623 - DNA, 22 bp, Homo sapiens
ctgcgttaattgagcacctact

SEQ ID NO: 6147624 - DNA, 15 bp, Homo sapiens
ctgcgttcagcccct

SEQ ID NO: 6147625 - DNA, 16 bp, Homo sapiens
ctgcgttcagcccctg

SEQ ID NO: 6147626 - DNA, 17 bp, Homo sapiens
ctgcgttcagcccctga

SEQ ID NO: 6147627 - DNA, 15 bp, Homo sapiens
ctgcgttctgcaagc

SEQ ID NO: 6147628 - DNA, 18 bp, Homo sapiens
ctgcgttcttgtgacaga

SEQ ID NO: 6147629 - DNA, 15 bp, Homo sapiens
ctgcgttggagccac

SEQ ID NO: 6147630 - DNA, 17 bp, Homo sapiens
ctgcgttggtccagagc

SEQ ID NO: 6147631 - DNA, 21 bp, Homo sapiens
ctgcgtttggaggcccctggg

SEQ ID NO: 6147632 - DNA, 20 bp, Homo sapiens
ctgcgttttctccgggtcct

SEQ ID NO: 6147633 - DNA, 14 bp, Homo sapiens
ctgctaaaataaac

SEQ ID NO: 6147634 - DNA, 21 bp, Homo sapiens
ctgctaaaatagaatatagca

SEQ ID NO: 6147635 - DNA, 15 bp, Homo sapiens
ctgctaaataaaatt

SEQ ID NO: 6147636 - DNA, 18 bp, Homo sapiens
ctgctaaatactgtacat

SEQ ID NO: 6147637 - DNA, 14 bp, Homo sapiens
ctgctaaatcctca

SEQ ID NO: 6147638 - DNA, 12 bp, Homo sapiens
ctgctaaatctc

SEQ ID NO: 6147639 - DNA, 20 bp, Homo sapiens
ctcccgcctcagcctcctga

SEQ ID NO: 6147640 - DNA, 21 bp, Homo sapiens
ctcccgcctcagcctcctgag

SEQ ID NO: 6147641 - DNA, 19 bp, Homo sapiens
ctcccgcctcagggccagg

SEQ ID NO: 6147642 - DNA, 22 bp, Homo sapiens
ctcccgcctcagggccaggccc

SEQ ID NO: 6147643 - DNA, 22 bp, Homo sapiens
ctcccgcctcccgccaccctgt

SEQ ID NO: 6147644 - DNA, 22 bp, Homo sapiens
ctcccgcctgattggggcctca

SEQ ID NO: 6147645 - DNA, 14 bp, Homo sapiens
ctcccgctcccagg

SEQ ID NO: 6147646 - DNA, 14 bp, Homo sapiens
ctcccgctgcacac

SEQ ID NO: 6147647 - DNA, 22 bp, Homo sapiens
ctcccgctgcacacagacggcc

SEQ ID NO: 6147648 - DNA, 14 bp, Homo sapiens
ctcccgctgctgct

SEQ ID NO: 6147649 - DNA, 13 bp, Homo sapiens
ctcccgcttcctc

SEQ ID NO: 6147650 - DNA, 17 bp, Homo sapiens
ctcccgcttcctccggc

SEQ ID NO: 6147651 - DNA, 19 bp, Homo sapiens
ctcccgcttcctccggctg

SEQ ID NO: 6147652 - DNA, 19 bp, Homo sapiens
ctcccgcttcctggcctcc

SEQ ID NO: 6147653 - DNA, 19 bp, Homo sapiens
ctcccggacctggactagg

SEQ ID NO: 6147654 - DNA, 18 bp, Homo sapiens
ctcccggagcctgtgcag

SEQ ID NO: 6147655 - DNA, 15 bp, Homo sapiens
ctcccggagggccct

SEQ ID NO: 6147656 - DNA, 21 bp, Homo sapiens
ctcccggcatcctgaaagcca

SEQ ID NO: 6147657 - DNA, 19 bp, Homo sapiens
ctcccggcatgggaaagcc

SEQ ID NO: 6147658 - DNA, 15 bp, Homo sapiens
ctcccggcccgcctg

SEQ ID NO: 6147659 - DNA, 16 bp, Homo sapiens
ctcccggccctgcctg

SEQ ID NO: 6147660 - DNA, 21 bp, Homo sapiens
ctcccggcctaggcacctccc

SEQ ID NO: 6147661 - DNA, 12 bp, Homo sapiens
ctcccggcgtgg

SEQ ID NO: 6147662 - DNA, 20 bp, Homo sapiens
ctcccggctatgggggcact

SEQ ID NO: 6147663 - DNA, 14 bp, Homo sapiens
ctcccggctctgag

SEQ ID NO: 6147664 - DNA, 16 bp, Homo sapiens
ctcccggctgccccca

SEQ ID NO: 6147665 - DNA, 14 bp, Homo sapiens
ctcccggctgcctg

SEQ ID NO: 6147666 - DNA, 20 bp, Homo sapiens
ctcccgggaagcatcctccc

SEQ ID NO: 6147667 - DNA, 16 bp, Homo sapiens
ctcccgggactcactg

SEQ ID NO: 6147668 - DNA, 15 bp, Homo sapiens
ctcccgggactctgc

SEQ ID NO: 6147669 - DNA, 18 bp, Homo sapiens
ctcccgggagcacagagg

SEQ ID NO: 6147670 - DNA, 22 bp, Homo sapiens
ctcccgggccaagacagatgga

SEQ ID NO: 6147671 - DNA, 21 bp, Homo sapiens
ctcccgggccacgccccagcc

SEQ ID NO: 6147672 - DNA, 16 bp, Homo sapiens
ctcccgggccctccct

SEQ ID NO: 6147673 - DNA, 19 bp, Homo sapiens
ctcccgggccctcccttgg

SEQ ID NO: 6147674 - DNA, 20 bp, Homo sapiens
ctcccgggccctcccttgga

SEQ ID NO: 6147675 - DNA, 17 bp, Homo sapiens
ctcccggggacgctttt

SEQ ID NO: 6147676 - DNA, 14 bp, Homo sapiens
ctcccggggactca

SEQ ID NO: 6147677 - DNA, 16 bp, Homo sapiens
ctcccggggcagggca

SEQ ID NO: 6147678 - DNA, 17 bp, Homo sapiens
ctcccggggcagggcag

SEQ ID NO: 6147679 - DNA, 18 bp, Homo sapiens
ctcccggggcagggcagc

SEQ ID NO: 6147680 - DNA, 18 bp, Homo sapiens
ctcccggggcccaggact

SEQ ID NO: 6147681 - DNA, 20 bp, Homo sapiens
ctcccggggcctggacaggc

SEQ ID NO: 6147682 - DNA, 15 bp, Homo sapiens
ctcccgggggcccca

SEQ ID NO: 6147683 - DNA, 24 bp, Homo sapiens
ctcccggggtgcccgtgtggcctg

SEQ ID NO: 6147684 - DNA, 17 bp, Homo sapiens
ctcccgggtccttggcc

SEQ ID NO: 6147685 - DNA, 15 bp, Homo sapiens
ctcccgggtcgtgtc

SEQ ID NO: 6147686 - DNA, 21 bp, Homo sapiens
ctcccgggttcacgccattct

SEQ ID NO: 6147687 - DNA, 15 bp, Homo sapiens
ctcccggtgtgcagc

SEQ ID NO: 6147688 - DNA, 18 bp, Homo sapiens
ctcccggtgtgcagcggg

SEQ ID NO: 6147689 - DNA, 21 bp, Homo sapiens
ctcccggttcttccagtggtt

SEQ ID NO: 6147690 - DNA, 20 bp, Homo sapiens
ctcccgtacaaacttggaca

SEQ ID NO: 6147691 - DNA, 17 bp, Homo sapiens
ctcccgtagttttttct

SEQ ID NO: 6147692 - DNA, 14 bp, Homo sapiens
ctcccgtcagggcc

SEQ ID NO: 6147693 - DNA, 19 bp, Homo sapiens
ctcccgtcagggcccaagt

SEQ ID NO: 6147694 - DNA, 22 bp, Homo sapiens
ctcccgtgtaggaacctgcaca

SEQ ID NO: 6147695 - DNA, 18 bp, Homo sapiens
ctcccgtgtgtggttgga

SEQ ID NO: 6147696 - DNA, 20 bp, Homo sapiens
ctcccgttgcgtcaagtcta

SEQ ID NO: 6147697 - DNA, 16 bp, Homo sapiens
ctccctaaaataaaaa

SEQ ID NO: 6147698 - DNA, 20 bp, Homo sapiens
ctccctaaactttggccttt

SEQ ID NO: 6147699 - DNA, 15 bp, Homo sapiens
ctccctaaagccctc

SEQ ID NO: 6147700 - DNA, 19 bp, Homo sapiens
ctccctaaagccctcttca

SEQ ID NO: 6147701 - DNA, 18 bp, Homo sapiens
ctccctaagccagcctgg

SEQ ID NO: 6147702 - DNA, 21 bp, Homo sapiens
ctccctaaggcatgtgtgaaa

SEQ ID NO: 6147703 - DNA, 19 bp, Homo sapiens
ctccctaagtccactctag

SEQ ID NO: 6147704 - DNA, 15 bp, Homo sapiens
ctccctacacacaca

SEQ ID NO: 6147705 - DNA, 13 bp, Homo sapiens
ctccctacactga

SEQ ID NO: 6147706 - DNA, 19 bp, Homo sapiens
ctccctacattccccagag

SEQ ID NO: 6147707 - DNA, 13 bp, Homo sapiens
ctccctaccacct

SEQ ID NO: 6147708 - DNA, 18 bp, Homo sapiens
ctccctaccccagggccc

SEQ ID NO: 6147709 - DNA, 22 bp, Homo sapiens
ctccctacctccctcctcaggg

SEQ ID NO: 6147710 - DNA, 21 bp, Homo sapiens
ctccctacttagacccagtca

SEQ ID NO: 6147711 - DNA, 19 bp, Homo sapiens
ctccctacttccaagaaaa

SEQ ID NO: 6147712 - DNA, 20 bp, Homo sapiens
ctccctagaaacaaagggga

SEQ ID NO: 6147713 - DNA, 23 bp, Homo sapiens
ctccctagaggggcaccttttca

SEQ ID NO: 6147714 - DNA, 16 bp, Homo sapiens
ctccctagatccaggc

SEQ ID NO: 6147715 - DNA, 17 bp, Homo sapiens
ctccctagatccaggct

SEQ ID NO: 6147716 - DNA, 14 bp, Homo sapiens
ctccctagcccttc

SEQ ID NO: 6147717 - DNA, 17 bp, Homo sapiens
ctccctagcccttccag

SEQ ID NO: 6147718 - DNA, 18 bp, Homo sapiens
ctccctagcccttccagc

SEQ ID NO: 6147719 - DNA, 21 bp, Homo sapiens
ctccctagcccttccagcctg

SEQ ID NO: 6147720 - DNA, 23 bp, Homo sapiens
ctccctagcccttccagcctggg

SEQ ID NO: 6147721 - DNA, 20 bp, Homo sapiens
ctccctagcccttctacccc

SEQ ID NO: 6147722 - DNA, 21 bp, Homo sapiens
ctccctagctcttccccatct

SEQ ID NO: 6147723 - DNA, 13 bp, Homo sapiens
ctccctaggccca

SEQ ID NO: 6147724 - DNA, 15 bp, Homo sapiens
ctccctaggcccaag

SEQ ID NO: 6147725 - DNA, 14 bp, Homo sapiens
ctccctaggcctga

SEQ ID NO: 6147726 - DNA, 22 bp, Homo sapiens
ctccctagtgacccggaggcca

SEQ ID NO: 6147727 - DNA, 18 bp, Homo sapiens
ctccctagtggcttcctc

SEQ ID NO: 6147728 - DNA, 20 bp, Homo sapiens
ctccctagttacccacccta

SEQ ID NO: 6147729 - DNA, 17 bp, Homo sapiens
ctccctataatgctgga

SEQ ID NO: 6147730 - DNA, 20 bp, Homo sapiens
ctccctataccgagacccac

SEQ ID NO: 6147731 - DNA, 22 bp, Homo sapiens
ctccctataccgagacccacca

SEQ ID NO: 6147732 - DNA, 22 bp, Homo sapiens
ctccctatatgcacccctggaa

SEQ ID NO: 6147733 - DNA, 14 bp, Homo sapiens
ctccctatgtctgc

SEQ ID NO: 6147734 - DNA, 19 bp, Homo sapiens
ctccctattttttttctgt

SEQ ID NO: 6147735 - DNA, 20 bp, Homo sapiens
ctccctattttttttctgtt

SEQ ID NO: 6147736 - DNA, 15 bp, Homo sapiens
ctccctcaaagcaca

SEQ ID NO: 6147737 - DNA, 14 bp, Homo sapiens
ctccctcaacaagg

SEQ ID NO: 6147738 - DNA, 12 bp, Homo sapiens
ctccctcaactg

SEQ ID NO: 6147739 - DNA, 15 bp, Homo sapiens
ctccctcaactgaag

SEQ ID NO: 6147740 - DNA, 17 bp, Homo sapiens
ctccctcaattccccct

SEQ ID NO: 6147741 - DNA, 22 bp, Homo sapiens
ctccctcacaagcgctcccagc

SEQ ID NO: 6147742 - DNA, 19 bp, Homo sapiens
ctccctcaccccctccttc

SEQ ID NO: 6147743 - DNA, 13 bp, Homo sapiens
ctccctcaccctg

SEQ ID NO: 6147744 - DNA, 20 bp, Homo sapiens
ctccctcactgaaggacctg

SEQ ID NO: 6147745 - DNA, 13 bp, Homo sapiens
ctccctcagaccc

SEQ ID NO: 6147746 - DNA, 15 bp, Homo sapiens
ctccctcagacccag

SEQ ID NO: 6147747 - DNA, 20 bp, Homo sapiens
ctccctcagacccaggggtc

SEQ ID NO: 6147748 - DNA, 13 bp, Homo sapiens
ctccctcagactc

SEQ ID NO: 6147749 - DNA, 16 bp, Homo sapiens
ctccctcagactcaga

SEQ ID NO: 6147750 - DNA, 20 bp, Homo sapiens
ctccctcagactcagaggtc

SEQ ID NO: 6147751 - DNA, 22 bp, Homo sapiens
ctccctcagactcagaggtcca

SEQ ID NO: 6147752 - DNA, 13 bp, Homo sapiens
ctccctcagccac

SEQ ID NO: 6147753 - DNA, 20 bp, Homo sapiens
ctccctcagccacgcctctc

SEQ ID NO: 6147754 - DNA, 23 bp, Homo sapiens
ctccctcagccacgcctctctca

SEQ ID NO: 6147755 - DNA, 17 bp, Homo sapiens
ctccctcagcccccagg

SEQ ID NO: 6147756 - DNA, 22 bp, Homo sapiens
ctccctcagcccccaggatctg

SEQ ID NO: 6147757 - DNA, 15 bp, Homo sapiens
ctccctcagcccctc

SEQ ID NO: 6147758 - DNA, 21 bp, Homo sapiens
ctccctcagccgtcagccatc

SEQ ID NO: 6147759 - DNA, 14 bp, Homo sapiens
ctccctcagcctca

SEQ ID NO: 6147760 - DNA, 17 bp, Homo sapiens
ctccctcagcctcagag

SEQ ID NO: 6147761 - DNA, 18 bp, Homo sapiens
ctccctcagcctcagagg

SEQ ID NO: 6147762 - DNA, 14 bp, Homo sapiens
ctccctcagcctcc

SEQ ID NO: 6147763 - DNA, 10 bp, Homo sapiens
ctccctcagg

SEQ ID NO: 6147764 - DNA, 14 bp, Homo sapiens
ctccctcaggccca

SEQ ID NO: 6147765 - DNA, 17 bp, Homo sapiens
ctccctcaggctctgtg

SEQ ID NO: 6147766 - DNA, 17 bp, Homo sapiens
ctccctcaggggcaggt

SEQ ID NO: 6147767 - DNA, 22 bp, Homo sapiens
ctccctcaggggcaggtggtgg

SEQ ID NO: 6147768 - DNA, 14 bp, Homo sapiens
ctccctcagtgccc

SEQ ID NO: 6147769 - DNA, 14 bp, Homo sapiens
ctccctcatcggcc

SEQ ID NO: 6147770 - DNA, 13 bp, Homo sapiens
ctccctccaagcc

SEQ ID NO: 6147771 - DNA, 15 bp, Homo sapiens
ctccctccaagcctg

SEQ ID NO: 6147772 - DNA, 16 bp, Homo sapiens
ctccctccaagcctgg

SEQ ID NO: 6147773 - DNA, 21 bp, Homo sapiens
ctccctccaagcctggcaccc

SEQ ID NO: 6147774 - DNA, 18 bp, Homo sapiens
ctccctccaattccccct

SEQ ID NO: 6147775 - DNA, 20 bp, Homo sapiens
ctccctccacacctccaccc

SEQ ID NO: 6147776 - DNA, 13 bp, Homo sapiens
ctccctccaccag

SEQ ID NO: 6147777 - DNA, 16 bp, Homo sapiens
ctccctccaccagcct

SEQ ID NO: 6147778 - DNA, 17 bp, Homo sapiens
ctccctccaccagcctg

SEQ ID NO: 6147779 - DNA, 19 bp, Homo sapiens
ctccctccaccagcctgct

SEQ ID NO: 6147780 - DNA, 13 bp, Homo sapiens
ctccctccacccc

SEQ ID NO: 6147781 - DNA, 14 bp, Homo sapiens
ctccctccacccca

SEQ ID NO: 6147782 - DNA, 17 bp, Homo sapiens
ctccctccaccccagga

SEQ ID NO: 6147783 - DNA, 14 bp, Homo sapiens
ctccctccacctac

SEQ ID NO: 6147784 - DNA, 16 bp, Homo sapiens
ctccctccacctcaag

SEQ ID NO: 6147785 - DNA, 15 bp, Homo sapiens
ctccctccactcctc

SEQ ID NO: 6147786 - DNA, 13 bp, Homo sapiens
ctccctccagcac

SEQ ID NO: 6147787 - DNA, 17 bp, Homo sapiens
ctccctccagtaccata

SEQ ID NO: 6147788 - DNA, 12 bp, Homo sapiens
ctccctccatgg

SEQ ID NO: 6147789 - DNA, 16 bp, Homo sapiens
ctccctccatgtggcc

SEQ ID NO: 6147790 - DNA, 12 bp, Homo sapiens
ctccctcccaca

SEQ ID NO: 6147791 - DNA, 12 bp, Homo sapiens
ctccctcccaga

SEQ ID NO: 6147792 - DNA, 22 bp, Homo sapiens
ctccctcccagaaaaactggct

SEQ ID NO: 6147793 - DNA, 23 bp, Homo sapiens
ctccctcccagaaaaactggctc

SEQ ID NO: 6147794 - DNA, 18 bp, Homo sapiens
ctccctcccagagcacct

SEQ ID NO: 6147795 - DNA, 21 bp, Homo sapiens
ctccctcccagagcacctgct

SEQ ID NO: 6147796 - DNA, 21 bp, Homo sapiens
ctccctcccagatccaggaac

SEQ ID NO: 6147797 - DNA, 12 bp, Homo sapiens
ctccctcccagc

SEQ ID NO: 6147798 - DNA, 13 bp, Homo sapiens
ctccctcccagct

SEQ ID NO: 6147799 - DNA, 14 bp, Homo sapiens
ctccctcccagctc

SEQ ID NO: 6147800 - DNA, 17 bp, Homo sapiens
ctccctcccagctgcac

SEQ ID NO: 6147801 - DNA, 20 bp, Homo sapiens
ctccctccccaaatggctgc

SEQ ID NO: 6147802 - DNA, 12 bp, Homo sapiens
ctccctccccac

SEQ ID NO: 6147803 - DNA, 17 bp, Homo sapiens
ctccctccccagctccg

SEQ ID NO: 6147804 - DNA, 17 bp, Homo sapiens
ctccctccccagtgttt

SEQ ID NO: 6147805 - DNA, 20 bp, Homo sapiens
ctccctccccctagcaaggt

SEQ ID NO: 6147806 - DNA, 16 bp, Homo sapiens
ctccctccccgtctca

SEQ ID NO: 6147807 - DNA, 17 bp, Homo sapiens
ctccctcccctctcaga

SEQ ID NO: 6147808 - DNA, 19 bp, Homo sapiens
ctccctcccctctcagaac

SEQ ID NO: 6147809 - DNA, 18 bp, Homo sapiens
ctccctcccctgccattt

SEQ ID NO: 6147810 - DNA, 13 bp, Homo sapiens
ctccctcccgcac

SEQ ID NO: 6147811 - DNA, 20 bp, Homo sapiens
ctccctccctagcccttcca

SEQ ID NO: 6147812 - DNA, 16 bp, Homo sapiens
ctccctccctccacac

SEQ ID NO: 6147813 - DNA, 15 bp, Homo sapiens
ctccctccctcccag

SEQ ID NO: 6147814 - DNA, 18 bp, Homo sapiens
ctccctccctccccagtg

SEQ ID NO: 6147815 - DNA, 16 bp, Homo sapiens
ctccctccctccctgc

SEQ ID NO: 6147816 - DNA, 15 bp, Homo sapiens
ctccctccctctccg

SEQ ID NO: 6147817 - DNA, 14 bp, Homo sapiens
ctccctccctgcag

SEQ ID NO: 6147818 - DNA, 17 bp, Homo sapiens
ctgctaaatctcctatt

SEQ ID NO: 6147819 - DNA, 14 bp, Homo sapiens
ctgctaaatgactt

SEQ ID NO: 6147820 - DNA, 14 bp, Homo sapiens
ctgctaaatgcact

SEQ ID NO: 6147821 - DNA, 17 bp, Homo sapiens
ctgctaaattctatgtt

SEQ ID NO: 6147822 - DNA, 17 bp, Homo sapiens
ctgctaaattgatgttg

SEQ ID NO: 6147823 - DNA, 18 bp, Homo sapiens
ctgctaaattgatgttga

SEQ ID NO: 6147824 - DNA, 18 bp, Homo sapiens
ctgctaacggtgctcagg

SEQ ID NO: 6147825 - DNA, 19 bp, Homo sapiens
ctgctaacggtgctcaggg

SEQ ID NO: 6147826 - DNA, 18 bp, Homo sapiens
ctgctaagctaaagaaac

SEQ ID NO: 6147827 - DNA, 19 bp, Homo sapiens
ctgctaagctaaagaaact

SEQ ID NO: 6147828 - DNA, 17 bp, Homo sapiens
ctgctaaggaacaatgc

SEQ ID NO: 6147829 - DNA, 19 bp, Homo sapiens
ctgctaaggaacaatgccg

SEQ ID NO: 6147830 - DNA, 17 bp, Homo sapiens
ctgctaaggctcctcct

SEQ ID NO: 6147831 - DNA, 14 bp, Homo sapiens
ctgctaaggctgct

SEQ ID NO: 6147832 - DNA, 15 bp, Homo sapiens
ctgctaaggctgctg

SEQ ID NO: 6147833 - DNA, 17 bp, Homo sapiens
ctgctaaggctgctggc

SEQ ID NO: 6147834 - DNA, 19 bp, Homo sapiens
ctgctaaggctgctggctt

SEQ ID NO: 6147835 - DNA, 14 bp, Homo sapiens
ctgctaagtagggg

SEQ ID NO: 6147836 - DNA, 19 bp, Homo sapiens
ctgctaagtggaagacaga

SEQ ID NO: 6147837 - DNA, 15 bp, Homo sapiens
ctgctaataaatgac

SEQ ID NO: 6147838 - DNA, 16 bp, Homo sapiens
ctgctaataaatgacc

SEQ ID NO: 6147839 - DNA, 17 bp, Homo sapiens
ctgctaataaatgacca

SEQ ID NO: 6147840 - DNA, 23 bp, Homo sapiens
ctgctaataaatgaccagtttac

SEQ ID NO: 6147841 - DNA, 21 bp, Homo sapiens
ctgctaatacctcttactttg

SEQ ID NO: 6147842 - DNA, 19 bp, Homo sapiens
ctgctaatattaaaccttt

SEQ ID NO: 6147843 - DNA, 16 bp, Homo sapiens
ctgctaatattttcct

SEQ ID NO: 6147844 - DNA, 20 bp, Homo sapiens
ctgctaatcctgaggctggt

SEQ ID NO: 6147845 - DNA, 14 bp, Homo sapiens
ctgctaatcttcag

SEQ ID NO: 6147846 - DNA, 14 bp, Homo sapiens
ctgctaatgagact

SEQ ID NO: 6147847 - DNA, 20 bp, Homo sapiens
ctgctaatgcaaattaaaac

SEQ ID NO: 6147848 - DNA, 23 bp, Homo sapiens
ctgctaatgcaaattaaaacata

SEQ ID NO: 6147849 - DNA, 15 bp, Homo sapiens
ctgctaatgtaaact

SEQ ID NO: 6147850 - DNA, 22 bp, Homo sapiens
ctgctaattctttgcaaaaatc

SEQ ID NO: 6147851 - DNA, 12 bp, Homo sapiens
ctgctacaaaga

SEQ ID NO: 6147852 - DNA, 14 bp, Homo sapiens
ctgctacaagtgtt

SEQ ID NO: 6147853 - DNA, 15 bp, Homo sapiens
ctgctacaagtgttt

SEQ ID NO: 6147854 - DNA, 16 bp, Homo sapiens
ctgctacaagtgtttt

SEQ ID NO: 6147855 - DNA, 16 bp, Homo sapiens
ctgctacacatacagg

SEQ ID NO: 6147856 - DNA, 12 bp, Homo sapiens
ctgctacacttc

SEQ ID NO: 6147857 - DNA, 16 bp, Homo sapiens
ctgctacacttctgat

SEQ ID NO: 6147858 - DNA, 12 bp, Homo sapiens
ctgctacagcaa

SEQ ID NO: 6147859 - DNA, 12 bp, Homo sapiens
ctgctacaggag

SEQ ID NO: 6147860 - DNA, 13 bp, Homo sapiens
ctgctacaggagg

SEQ ID NO: 6147861 - DNA, 18 bp, Homo sapiens
ctgctacagtagctgtgg

SEQ ID NO: 6147862 - DNA, 19 bp, Homo sapiens
ctgctaccaaggcccagct

SEQ ID NO: 6147863 - DNA, 19 bp, Homo sapiens
ctgctaccatgaagtgaaa

SEQ ID NO: 6147864 - DNA, 18 bp, Homo sapiens
ctgctaccgccctgggct

SEQ ID NO: 6147865 - DNA, 19 bp, Homo sapiens
ctgctaccgccctgggctg

SEQ ID NO: 6147866 - DNA, 20 bp, Homo sapiens
ctgctaccgccctgggctgg

SEQ ID NO: 6147867 - DNA, 12 bp, Homo sapiens
ctgctacctcac

SEQ ID NO: 6147868 - DNA, 13 bp, Homo sapiens
ctgctacctcact

SEQ ID NO: 6147869 - DNA, 19 bp, Homo sapiens
ctgctacctcccttgcctt

SEQ ID NO: 6147870 - DNA, 17 bp, Homo sapiens
ctgctacctctgagaag

SEQ ID NO: 6147871 - DNA, 14 bp, Homo sapiens
ctgctacctgttct

SEQ ID NO: 6147872 - DNA, 21 bp, Homo sapiens
ctgctacctgttcttgggcct

SEQ ID NO: 6147873 - DNA, 14 bp, Homo sapiens
ctgctaccttgccc

SEQ ID NO: 6147874 - DNA, 17 bp, Homo sapiens
ctgctaccttgccccaa

SEQ ID NO: 6147875 - DNA, 19 bp, Homo sapiens
ctgctacctttcaaagctt

SEQ ID NO: 6147876 - DNA, 20 bp, Homo sapiens
ctgctacgttcctattgtca

SEQ ID NO: 6147877 - DNA, 15 bp, Homo sapiens
ctgctactagctctt

SEQ ID NO: 6147878 - DNA, 22 bp, Homo sapiens
ctgctactcataagttggacca

SEQ ID NO: 6147879 - DNA, 17 bp, Homo sapiens
ctgctactcctgtgctc

SEQ ID NO: 6147880 - DNA, 18 bp, Homo sapiens
ctgctactctgttccttc

SEQ ID NO: 6147881 - DNA, 17 bp, Homo sapiens
ctgctactgaggcaggg

SEQ ID NO: 6147882 - DNA, 12 bp, Homo sapiens
ctgctactgcca

SEQ ID NO: 6147883 - DNA, 17 bp, Homo sapiens
ctgctactgccaacctc

SEQ ID NO: 6147884 - DNA, 18 bp, Homo sapiens
ctgctactgcccctctcc

SEQ ID NO: 6147885 - DNA, 20 bp, Homo sapiens
ctgctactgcccctctccga

SEQ ID NO: 6147886 - DNA, 19 bp, Homo sapiens
ctgctacttaaatttgaat

SEQ ID NO: 6147887 - DNA, 13 bp, Homo sapiens
ctgctacttatat

SEQ ID NO: 6147888 - DNA, 20 bp, Homo sapiens
ctgctacttcactgtcatct

SEQ ID NO: 6147889 - DNA, 22 bp, Homo sapiens
ctgctacttccccagctctcag

SEQ ID NO: 6147890 - DNA, 12 bp, Homo sapiens
ctgctagaacct

SEQ ID NO: 6147891 - DNA, 21 bp, Homo sapiens
ctgctagaacttttttaaata

SEQ ID NO: 6147892 - DNA, 22 bp, Homo sapiens
ctgctagaacttttttaaataa

SEQ ID NO: 6147893 - DNA, 16 bp, Homo sapiens
ctgctagagcaacccc

SEQ ID NO: 6147894 - DNA, 22 bp, Homo sapiens
ctgctagagcagacaggcctgg

SEQ ID NO: 6147895 - DNA, 14 bp, Homo sapiens
ctgctagatttcta

SEQ ID NO: 6147896 - DNA, 15 bp, Homo sapiens
ctgctagcacagagg

SEQ ID NO: 6147897 - DNA, 16 bp, Homo sapiens
ctgctagcacagaggc

SEQ ID NO: 6147898 - DNA, 17 bp, Homo sapiens
ctgctagcacagaggcc

SEQ ID NO: 6147899 - DNA, 18 bp, Homo sapiens
ctgctagcacctccccag

SEQ ID NO: 6147900 - DNA, 21 bp, Homo sapiens
ctgctagcacctccccagaca

SEQ ID NO: 6147901 - DNA, 23 bp, Homo sapiens
ctgctagcacctccccagacagg

SEQ ID NO: 6147902 - DNA, 18 bp, Homo sapiens
ctgctagcaggcccccta

SEQ ID NO: 6147903 - DNA, 13 bp, Homo sapiens
ctgctagcggctg

SEQ ID NO: 6147904 - DNA, 20 bp, Homo sapiens
ctgctagctagctcaactag

SEQ ID NO: 6147905 - DNA, 14 bp, Homo sapiens
ctgctagctgtctc

SEQ ID NO: 6147906 - DNA, 17 bp, Homo sapiens
ctgctaggccagagcca

SEQ ID NO: 6147907 - DNA, 21 bp, Homo sapiens
ctgctaggccagagcccactc

SEQ ID NO: 6147908 - DNA, 15 bp, Homo sapiens
ctgctaggcgagtgc

SEQ ID NO: 6147909 - DNA, 18 bp, Homo sapiens
ctgctaggcgagtgccag

SEQ ID NO: 6147910 - DNA, 19 bp, Homo sapiens
ctgctaggcgagtgccagg

SEQ ID NO: 6147911 - DNA, 16 bp, Homo sapiens
ctgctaggcgctgggg

SEQ ID NO: 6147912 - DNA, 13 bp, Homo sapiens
ctgctagggcccc

SEQ ID NO: 6147913 - DNA, 22 bp, Homo sapiens
ctgctagggcccctagaaacca

SEQ ID NO: 6147914 - DNA, 23 bp, Homo sapiens
ctgctaggtagaggcatttgtct

SEQ ID NO: 6147915 - DNA, 20 bp, Homo sapiens
ctgctaggtgggccagcccc

SEQ ID NO: 6147916 - DNA, 22 bp, Homo sapiens
ctgctaggtgggccagcccctc

SEQ ID NO: 6147917 - DNA, 20 bp, Homo sapiens
ctgctagtcgcccctcagag

SEQ ID NO: 6147918 - DNA, 21 bp, Homo sapiens
ctgctagtcgcccctcagagc

SEQ ID NO: 6147919 - DNA, 23 bp, Homo sapiens
ctgctagtcgcccctcagagcat

SEQ ID NO: 6147920 - DNA, 21 bp, Homo sapiens
ctgctagtgctgtaatattgt

SEQ ID NO: 6147921 - DNA, 16 bp, Homo sapiens
ctgctagtgttctgtc

SEQ ID NO: 6147922 - DNA, 18 bp, Homo sapiens
ctgctataaagttaaagt

SEQ ID NO: 6147923 - DNA, 20 bp, Homo sapiens
ctgctataattctatactgt

SEQ ID NO: 6147924 - DNA, 18 bp, Homo sapiens
ctgctatatataaaacgg

SEQ ID NO: 6147925 - DNA, 17 bp, Homo sapiens
ctgctatattaggcctg

SEQ ID NO: 6147926 - DNA, 23 bp, Homo sapiens
ctgctatattttcatgacttttc

SEQ ID NO: 6147927 - DNA, 15 bp, Homo sapiens
ctgctatcagtctct

SEQ ID NO: 6147928 - DNA, 12 bp, Homo sapiens
ctgctatccagc

SEQ ID NO: 6147929 - DNA, 16 bp, Homo sapiens
ctgctatcctgccaaa

SEQ ID NO: 6147930 - DNA, 22 bp, Homo sapiens
ctgctatctactaagtttcctt

SEQ ID NO: 6147931 - DNA, 21 bp, Homo sapiens
ctgctatgaaaggaataaaac

SEQ ID NO: 6147932 - DNA, 14 bp, Homo sapiens
ctgctatgaagact

SEQ ID NO: 6147933 - DNA, 14 bp, Homo sapiens
ctgctatgcatttt

SEQ ID NO: 6147934 - DNA, 16 bp, Homo sapiens
ctgctatgcattttct

SEQ ID NO: 6147935 - DNA, 21 bp, Homo sapiens
ctgctatgcattttcttcaca

SEQ ID NO: 6147936 - DNA, 15 bp, Homo sapiens
ctgctatgccatttc

SEQ ID NO: 6147937 - DNA, 14 bp, Homo sapiens
ctgctatgcttgaa

SEQ ID NO: 6147938 - DNA, 21 bp, Homo sapiens
ctgctatggttttctccaaga

SEQ ID NO: 6147939 - DNA, 14 bp, Homo sapiens
ctgctatgtctgtg

SEQ ID NO: 6147940 - DNA, 15 bp, Homo sapiens
ctgctatgtctgtga

SEQ ID NO: 6147941 - DNA, 21 bp, Homo sapiens
ctgctattaggccagcaagcg

SEQ ID NO: 6147942 - DNA, 18 bp, Homo sapiens
ctgctattctagagcttt

SEQ ID NO: 6147943 - DNA, 22 bp, Homo sapiens
ctgctattgcagaatgaagcca

SEQ ID NO: 6147944 - DNA, 16 bp, Homo sapiens
ctgctatttacactat

SEQ ID NO: 6147945 - DNA, 17 bp, Homo sapiens
ctgctatttacactatt

SEQ ID NO: 6147946 - DNA, 21 bp, Homo sapiens
ctgctatttattttcctaaag

SEQ ID NO: 6147947 - DNA, 16 bp, Homo sapiens
ctgctatttcaggccc

SEQ ID NO: 6147948 - DNA, 19 bp, Homo sapiens
ctgctatttcccaagctgg

SEQ ID NO: 6147949 - DNA, 24 bp, Homo sapiens
ctgctatttcccaagctggagtgc

SEQ ID NO: 6147950 - DNA, 17 bp, Homo sapiens
ctgctatttctcttgct

SEQ ID NO: 6147951 - DNA, 20 bp, Homo sapiens
ctgctattttactgtcttaa

SEQ ID NO: 6147952 - DNA, 21 bp, Homo sapiens
ctgctattttactgtcttaat

SEQ ID NO: 6147953 - DNA, 22 bp, Homo sapiens
ctgctatttttaatttcctgtg

SEQ ID NO: 6147954 - DNA, 14 bp, Homo sapiens
ctgctcaacctctc

SEQ ID NO: 6147955 - DNA, 15 bp, Homo sapiens
ctgctcaacctctct

SEQ ID NO: 6147956 - DNA, 23 bp, Homo sapiens
ctgctcaagaagacatggagact

SEQ ID NO: 6147957 - DNA, 18 bp, Homo sapiens
ctgctcaagccgcaagct

SEQ ID NO: 6147958 - DNA, 19 bp, Homo sapiens
ctgctcaagccgcaagctc

SEQ ID NO: 6147959 - DNA, 20 bp, Homo sapiens
ctgctcaagccgcaagctct

SEQ ID NO: 6147960 - DNA, 23 bp, Homo sapiens
ctgctcaagccgcaagctctcag

SEQ ID NO: 6147961 - DNA, 17 bp, Homo sapiens
ctgctcaaggaccaaga

SEQ ID NO: 6147962 - DNA, 19 bp, Homo sapiens
ctgctcaaggaccaagagc

SEQ ID NO: 6147963 - DNA, 19 bp, Homo sapiens
ctgctcaatgaaaccttcc

SEQ ID NO: 6147964 - DNA, 15 bp, Homo sapiens
ctgctcacaagttct

SEQ ID NO: 6147965 - DNA, 18 bp, Homo sapiens
ctgctcacaggcaggctt

SEQ ID NO: 6147966 - DNA, 13 bp, Homo sapiens
ctgctcacaggga

SEQ ID NO: 6147967 - DNA, 18 bp, Homo sapiens
ctgctcacagggatgctg

SEQ ID NO: 6147968 - DNA, 22 bp, Homo sapiens
ctgctcacatctgaatctcctt

SEQ ID NO: 6147969 - DNA, 13 bp, Homo sapiens
ctgctcacattcc

SEQ ID NO: 6147970 - DNA, 15 bp, Homo sapiens
ctgctcacattccct

SEQ ID NO: 6147971 - DNA, 18 bp, Homo sapiens
ctgctcacattccctctc

SEQ ID NO: 6147972 - DNA, 20 bp, Homo sapiens
ctgctcaccacctgcctcta

SEQ ID NO: 6147973 - DNA, 16 bp, Homo sapiens
ctgctcacccacctct

SEQ ID NO: 6147974 - DNA, 23 bp, Homo sapiens
ctgctcaccgcccatcagggttc

SEQ ID NO: 6147975 - DNA, 20 bp, Homo sapiens
ctgctcacctgtgtgcccag

SEQ ID NO: 6147976 - DNA, 17 bp, Homo sapiens
ctgctcacgtctctgcc

SEQ ID NO: 6147977 - DNA, 22 bp, Homo sapiens
ctgctcacgtctctgccgcctg

SEQ ID NO: 6147978 - DNA, 19 bp, Homo sapiens
ctgctcactacctcctcag

SEQ ID NO: 6147979 - DNA, 22 bp, Homo sapiens
ctgctcactcccgctgagccca

SEQ ID NO: 6147980 - DNA, 12 bp, Homo sapiens
ctgctcacttta

SEQ ID NO: 6147981 - DNA, 18 bp, Homo sapiens
ctgctcactttaaacctg

SEQ ID NO: 6147982 - DNA, 17 bp, Homo sapiens
ctgctcactttccaccc

SEQ ID NO: 6147983 - DNA, 19 bp, Homo sapiens
ctgctcagaacttgctgct

SEQ ID NO: 6147984 - DNA, 13 bp, Homo sapiens
ctgctcagaattc

SEQ ID NO: 6147985 - DNA, 13 bp, Homo sapiens
ctgctcagagcca

SEQ ID NO: 6147986 - DNA, 22 bp, Homo sapiens
ctgctcagagccaagggggcag

SEQ ID NO: 6147987 - DNA, 22 bp, Homo sapiens
ctgctcagagctttaaaagtat

SEQ ID NO: 6147988 - DNA, 16 bp, Homo sapiens
ctgctcagaggccttg

SEQ ID NO: 6147989 - DNA, 18 bp, Homo sapiens
ctgctcagaggccttgct

SEQ ID NO: 6147990 - DNA, 20 bp, Homo sapiens
ctgctcagagtctatcaaca

SEQ ID NO: 6147991 - DNA, 22 bp, Homo sapiens
ctgctcagagtctatcaacatt

SEQ ID NO: 6147992 - DNA, 20 bp, Homo sapiens
ctgctcagatgctggtcatc

SEQ ID NO: 6147993 - DNA, 19 bp, Homo sapiens
ctgctcagattccccccat

SEQ ID NO: 6147994 - DNA, 14 bp, Homo sapiens
ctgctcagcagcca

SEQ ID NO: 6147995 - DNA, 13 bp, Homo sapiens
ctccctccctgct

SEQ ID NO: 6147996 - DNA, 14 bp, Homo sapiens
ctccctcccttcct

SEQ ID NO: 6147997 - DNA, 18 bp, Homo sapiens
ctccctccgactccagat

SEQ ID NO: 6147998 - DNA, 16 bp, Homo sapiens
ctccctccgcccccag

SEQ ID NO: 6147999 - DNA, 20 bp, Homo sapiens
ctccctccgcctcccatccc

SEQ ID NO: 6148000 - DNA, 17 bp, Homo sapiens
ctccctccggcttgacc

SEQ ID NO: 6148001 - DNA, 21 bp, Homo sapiens
ctccctccgtccctctgtcca

SEQ ID NO: 6148002 - DNA, 12 bp, Homo sapiens
ctccctcctcac

SEQ ID NO: 6148003 - DNA, 13 bp, Homo sapiens
ctccctcctcaca

SEQ ID NO: 6148004 - DNA, 14 bp, Homo sapiens
ctccctcctcacac

SEQ ID NO: 6148005 - DNA, 16 bp, Homo sapiens
ctccctcctcacactc

SEQ ID NO: 6148006 - DNA, 18 bp, Homo sapiens
ctccctcctcacactcca

SEQ ID NO: 6148007 - DNA, 15 bp, Homo sapiens
ctccctcctcacctc

SEQ ID NO: 6148008 - DNA, 21 bp, Homo sapiens
ctccctcctcacctctggact

SEQ ID NO: 6148009 - DNA, 16 bp, Homo sapiens
ctccctcctccaggcc

SEQ ID NO: 6148010 - DNA, 14 bp, Homo sapiens
ctccctcctctgcc

SEQ ID NO: 6148011 - DNA, 16 bp, Homo sapiens
ctccctcctctggccc

SEQ ID NO: 6148012 - DNA, 21 bp, Homo sapiens
ctccctcctgatgtttttccc

SEQ ID NO: 6148013 - DNA, 15 bp, Homo sapiens
ctccctcctgcaggc

SEQ ID NO: 6148014 - DNA, 19 bp, Homo sapiens
ctccctcctgccgactcct

SEQ ID NO: 6148015 - DNA, 15 bp, Homo sapiens
ctccctcctgcctgc

SEQ ID NO: 6148016 - DNA, 12 bp, Homo sapiens
ctccctcctgga

SEQ ID NO: 6148017 - DNA, 12 bp, Homo sapiens
ctccctcctggc

SEQ ID NO: 6148018 - DNA, 14 bp, Homo sapiens
ctccctcctggcca

SEQ ID NO: 6148019 - DNA, 14 bp, Homo sapiens
ctccctcctggctc

SEQ ID NO: 6148020 - DNA, 18 bp, Homo sapiens
ctccctcctggctcacag

SEQ ID NO: 6148021 - DNA, 21 bp, Homo sapiens
ctccctcctggctcacagcca

SEQ ID NO: 6148022 - DNA, 11 bp, Homo sapiens
ctccctcctgt

SEQ ID NO: 6148023 - DNA, 19 bp, Homo sapiens
ctccctccttccttcttgc

SEQ ID NO: 6148024 - DNA, 20 bp, Homo sapiens
ctccctccttccttcttgct

SEQ ID NO: 6148025 - DNA, 13 bp, Homo sapiens
ctccctccttggg

SEQ ID NO: 6148026 - DNA, 22 bp, Homo sapiens
ctccctcctttcctttgccctt

SEQ ID NO: 6148027 - DNA, 21 bp, Homo sapiens
ctccctcgaacccacactgca

SEQ ID NO: 6148028 - DNA, 21 bp, Homo sapiens
ctccctcgacagcgcccctgc

SEQ ID NO: 6148029 - DNA, 23 bp, Homo sapiens
ctccctcgacagcgcccctgctg

SEQ ID NO: 6148030 - DNA, 14 bp, Homo sapiens
ctccctcgcatccg

SEQ ID NO: 6148031 - DNA, 14 bp, Homo sapiens
ctccctcgctgtat

SEQ ID NO: 6148032 - DNA, 15 bp, Homo sapiens
ctccctcggccccac

SEQ ID NO: 6148033 - DNA, 20 bp, Homo sapiens
ctccctcggccccacccacc

SEQ ID NO: 6148034 - DNA, 18 bp, Homo sapiens
ctccctcgggctggtgtc

SEQ ID NO: 6148035 - DNA, 20 bp, Homo sapiens
ctccctcgggggctcttccc

SEQ ID NO: 6148036 - DNA, 17 bp, Homo sapiens
ctccctcggtcacctgt

SEQ ID NO: 6148037 - DNA, 19 bp, Homo sapiens
ctccctcggtcacctgtgc

SEQ ID NO: 6148038 - DNA, 19 bp, Homo sapiens
ctccctcgtcttcagctgc

SEQ ID NO: 6148039 - DNA, 13 bp, Homo sapiens
ctccctcgtgggc

SEQ ID NO: 6148040 - DNA, 19 bp, Homo sapiens
ctccctcgtgggcttgtgc

SEQ ID NO: 6148041 - DNA, 17 bp, Homo sapiens
ctccctctactcttcct

SEQ ID NO: 6148042 - DNA, 19 bp, Homo sapiens
ctccctctactcttcctgt

SEQ ID NO: 6148043 - DNA, 19 bp, Homo sapiens
ctccctctactgggagcct

SEQ ID NO: 6148044 - DNA, 20 bp, Homo sapiens
ctccctctactgggagccta

SEQ ID NO: 6148045 - DNA, 20 bp, Homo sapiens
ctccctctagaggctgcctg

SEQ ID NO: 6148046 - DNA, 22 bp, Homo sapiens
ctccctctagaggctgcctggg

SEQ ID NO: 6148047 - DNA, 10 bp, Homo sapiens
ctccctctca

SEQ ID NO: 6148048 - DNA, 21 bp, Homo sapiens
ctccctctcactgtctgagag

SEQ ID NO: 6148049 - DNA, 21 bp, Homo sapiens
ctccctctcatgtccctccag

SEQ ID NO: 6148050 - DNA, 20 bp, Homo sapiens
ctccctctccaagacagcag

SEQ ID NO: 6148051 - DNA, 23 bp, Homo sapiens
ctccctctccaagacagcagcag

SEQ ID NO: 6148052 - DNA, 16 bp, Homo sapiens
ctccctctccagcagg

SEQ ID NO: 6148053 - DNA, 22 bp, Homo sapiens
ctccctctcccccttaccccac

SEQ ID NO: 6148054 - DNA, 15 bp, Homo sapiens
ctccctctccctgtc

SEQ ID NO: 6148055 - DNA, 11 bp, Homo sapiens
ctccctctccg

SEQ ID NO: 6148056 - DNA, 19 bp, Homo sapiens
ctccctctccgactcacac

SEQ ID NO: 6148057 - DNA, 13 bp, Homo sapiens
ctccctctcctcg

SEQ ID NO: 6148058 - DNA, 12 bp, Homo sapiens
ctccctctcctg

SEQ ID NO: 6148059 - DNA, 11 bp, Homo sapiens
ctccctctctc

SEQ ID NO: 6148060 - DNA, 14 bp, Homo sapiens
ctccctctctcctg

SEQ ID NO: 6148061 - DNA, 21 bp, Homo sapiens
ctccctctctcctggactggt

SEQ ID NO: 6148062 - DNA, 21 bp, Homo sapiens
ctccctctctcttctgctcca

SEQ ID NO: 6148063 - DNA, 15 bp, Homo sapiens
ctccctctctgccct

SEQ ID NO: 6148064 - DNA, 12 bp, Homo sapiens
ctccctctctgg

SEQ ID NO: 6148065 - DNA, 22 bp, Homo sapiens
ctccctctcttccgggagctgg

SEQ ID NO: 6148066 - DNA, 21 bp, Homo sapiens
ctccctctgacctgcaggcca

SEQ ID NO: 6148067 - DNA, 13 bp, Homo sapiens
ctccctctgcccc

SEQ ID NO: 6148068 - DNA, 14 bp, Homo sapiens
ctccctctgcccca

SEQ ID NO: 6148069 - DNA, 20 bp, Homo sapiens
ctccctctgccccaagcagc

SEQ ID NO: 6148070 - DNA, 21 bp, Homo sapiens
ctccctctgccccaagcagcc

SEQ ID NO: 6148071 - DNA, 22 bp, Homo sapiens
ctccctctgccccaagcagcca

SEQ ID NO: 6148072 - DNA, 17 bp, Homo sapiens
ctccctctgccggctct

SEQ ID NO: 6148073 - DNA, 13 bp, Homo sapiens
ctccctctgcctc

SEQ ID NO: 6148074 - DNA, 21 bp, Homo sapiens
ctccctctgcctcatcctcct

SEQ ID NO: 6148075 - DNA, 14 bp, Homo sapiens
ctccctctgccttc

SEQ ID NO: 6148076 - DNA, 12 bp, Homo sapiens
ctccctctgctc

SEQ ID NO: 6148077 - DNA, 18 bp, Homo sapiens
ctccctctggccctgcct

SEQ ID NO: 6148078 - DNA, 19 bp, Homo sapiens
ctccctctggccctgcctt

SEQ ID NO: 6148079 - DNA, 20 bp, Homo sapiens
ctccctctgggttccagcag

SEQ ID NO: 6148080 - DNA, 17 bp, Homo sapiens
ctccctctgtccctctc

SEQ ID NO: 6148081 - DNA, 12 bp, Homo sapiens
ctccctctgtct

SEQ ID NO: 6148082 - DNA, 20 bp, Homo sapiens
ctccctctgtcttttctcct

SEQ ID NO: 6148083 - DNA, 12 bp, Homo sapiens
ctccctctgtta

SEQ ID NO: 6148084 - DNA, 22 bp, Homo sapiens
ctccctctgttaggtccatttt

SEQ ID NO: 6148085 - DNA, 23 bp, Homo sapiens
ctccctctgttaggtccattttc

SEQ ID NO: 6148086 - DNA, 18 bp, Homo sapiens
ctccctcttcactgtggc

SEQ ID NO: 6148087 - DNA, 23 bp, Homo sapiens
ctccctcttcactgtggccacag

SEQ ID NO: 6148088 - DNA, 14 bp, Homo sapiens
ctccctcttccaaa

SEQ ID NO: 6148089 - DNA, 15 bp, Homo sapiens
ctccctcttcccagc

SEQ ID NO: 6148090 - DNA, 17 bp, Homo sapiens
ctccctcttcccagcac

SEQ ID NO: 6148091 - DNA, 15 bp, Homo sapiens
ctccctcttccttcc

SEQ ID NO: 6148092 - DNA, 14 bp, Homo sapiens
ctccctcttctcaa

SEQ ID NO: 6148093 - DNA, 15 bp, Homo sapiens
ctccctcttctcaag

SEQ ID NO: 6148094 - DNA, 20 bp, Homo sapiens
ctccctcttctcaagtgcct

SEQ ID NO: 6148095 - DNA, 13 bp, Homo sapiens
ctccctcttcttt

SEQ ID NO: 6148096 - DNA, 14 bp, Homo sapiens
ctccctcttctttc

SEQ ID NO: 6148097 - DNA, 13 bp, Homo sapiens
ctccctcttgtgg

SEQ ID NO: 6148098 - DNA, 14 bp, Homo sapiens
ctccctctttccca

SEQ ID NO: 6148099 - DNA, 20 bp, Homo sapiens
ctccctctttcccaccctcc

SEQ ID NO: 6148100 - DNA, 20 bp, Homo sapiens
ctccctctttccctcccttc

SEQ ID NO: 6148101 - DNA, 16 bp, Homo sapiens
ctccctctttctagcc

SEQ ID NO: 6148102 - DNA, 17 bp, Homo sapiens
ctccctctttctagcct

SEQ ID NO: 6148103 - DNA, 23 bp, Homo sapiens
ctccctctttctagcctggggct

SEQ ID NO: 6148104 - DNA, 19 bp, Homo sapiens
ctccctgaaacactgcttc

SEQ ID NO: 6148105 - DNA, 18 bp, Homo sapiens
ctccctgaacctcagttt

SEQ ID NO: 6148106 - DNA, 17 bp, Homo sapiens
ctccctgaatctgacca

SEQ ID NO: 6148107 - DNA, 21 bp, Homo sapiens
ctccctgaatctgaccacaga

SEQ ID NO: 6148108 - DNA, 22 bp, Homo sapiens
ctccctgaatctgaccacagac

SEQ ID NO: 6148109 - DNA, 23 bp, Homo sapiens
ctccctgaatctgaccacagaca

SEQ ID NO: 6148110 - DNA, 17 bp, Homo sapiens
ctccctgaccaccctgc

SEQ ID NO: 6148111 - DNA, 16 bp, Homo sapiens
ctccctgacccgtcta

SEQ ID NO: 6148112 - DNA, 15 bp, Homo sapiens
ctccctgaccctgca

SEQ ID NO: 6148113 - DNA, 17 bp, Homo sapiens
ctccctgaccctgctcc

SEQ ID NO: 6148114 - DNA, 20 bp, Homo sapiens
ctccctgaccctgctcctag

SEQ ID NO: 6148115 - DNA, 23 bp, Homo sapiens
ctccctgaccctgctcctagcac

SEQ ID NO: 6148116 - DNA, 19 bp, Homo sapiens
ctccctgaccttagcgttc

SEQ ID NO: 6148117 - DNA, 16 bp, Homo sapiens
ctccctgacgtctgcc

SEQ ID NO: 6148118 - DNA, 17 bp, Homo sapiens
ctccctgacgtctgcca

SEQ ID NO: 6148119 - DNA, 22 bp, Homo sapiens
ctccctgacgtctgccaccagc

SEQ ID NO: 6148120 - DNA, 16 bp, Homo sapiens
ctccctgactccctgt

SEQ ID NO: 6148121 - DNA, 18 bp, Homo sapiens
ctccctgactccctgtgg

SEQ ID NO: 6148122 - DNA, 18 bp, Homo sapiens
ctccctgacttctccccc

SEQ ID NO: 6148123 - DNA, 20 bp, Homo sapiens
ctccctgacttctcccccgc

SEQ ID NO: 6148124 - DNA, 14 bp, Homo sapiens
ctccctgagcctgc

SEQ ID NO: 6148125 - DNA, 15 bp, Homo sapiens
ctccctgagcctgca

SEQ ID NO: 6148126 - DNA, 16 bp, Homo sapiens
ctccctgagcctgcat

SEQ ID NO: 6148127 - DNA, 20 bp, Homo sapiens
ctccctgagcctgccccagc

SEQ ID NO: 6148128 - DNA, 21 bp, Homo sapiens
ctccctgagcctgccccagct

SEQ ID NO: 6148129 - DNA, 22 bp, Homo sapiens
ctccctgagcctgccccagctg

SEQ ID NO: 6148130 - DNA, 11 bp, Homo sapiens
ctccctgaggg

SEQ ID NO: 6148131 - DNA, 18 bp, Homo sapiens
ctccctgagtctggacct

SEQ ID NO: 6148132 - DNA, 21 bp, Homo sapiens
ctccctgagtctggacctcca

SEQ ID NO: 6148133 - DNA, 22 bp, Homo sapiens
ctccctgagtctggacctccat

SEQ ID NO: 6148134 - DNA, 16 bp, Homo sapiens
ctccctgatcccagac

SEQ ID NO: 6148135 - DNA, 19 bp, Homo sapiens
ctccctgatttggagccag

SEQ ID NO: 6148136 - DNA, 20 bp, Homo sapiens
ctccctgcaagctccgcctc

SEQ ID NO: 6148137 - DNA, 11 bp, Homo sapiens
ctccctgcaca

SEQ ID NO: 6148138 - DNA, 19 bp, Homo sapiens
ctccctgcacaagccaggg

SEQ ID NO: 6148139 - DNA, 20 bp, Homo sapiens
ctccctgcacaagccagggt

SEQ ID NO: 6148140 - DNA, 17 bp, Homo sapiens
ctccctgcacagcctct

SEQ ID NO: 6148141 - DNA, 12 bp, Homo sapiens
ctccctgcaccg

SEQ ID NO: 6148142 - DNA, 16 bp, Homo sapiens
ctccctgcaccgccgc

SEQ ID NO: 6148143 - DNA, 14 bp, Homo sapiens
ctccctgcacggcc

SEQ ID NO: 6148144 - DNA, 12 bp, Homo sapiens
ctccctgcactt

SEQ ID NO: 6148145 - DNA, 16 bp, Homo sapiens
ctccctgcagactcca

SEQ ID NO: 6148146 - DNA, 20 bp, Homo sapiens
ctccctgcagaggggctgag

SEQ ID NO: 6148147 - DNA, 12 bp, Homo sapiens
ctccctgcagcc

SEQ ID NO: 6148148 - DNA, 14 bp, Homo sapiens
ctccctgcagcctt

SEQ ID NO: 6148149 - DNA, 12 bp, Homo sapiens
ctccctgcaggg

SEQ ID NO: 6148150 - DNA, 15 bp, Homo sapiens
ctccctgcatcctga

SEQ ID NO: 6148151 - DNA, 17 bp, Homo sapiens
ctccctgcatcctgagg

SEQ ID NO: 6148152 - DNA, 11 bp, Homo sapiens
ctccctgccac

SEQ ID NO: 6148153 - DNA, 13 bp, Homo sapiens
ctccctgccatcc

SEQ ID NO: 6148154 - DNA, 23 bp, Homo sapiens
ctccctgccatccccctctcacg

SEQ ID NO: 6148155 - DNA, 20 bp, Homo sapiens
ctccctgccattttttaaga

SEQ ID NO: 6148156 - DNA, 10 bp, Homo sapiens
ctccctgccc

SEQ ID NO: 6148157 - DNA, 17 bp, Homo sapiens
ctccctgcccctccctt

SEQ ID NO: 6148158 - DNA, 21 bp, Homo sapiens
ctccctgcccctcccttcaac

SEQ ID NO: 6148159 - DNA, 20 bp, Homo sapiens
ctccctgccctgtcctccag

SEQ ID NO: 6148160 - DNA, 23 bp, Homo sapiens
ctccctgcctacacacacagcct

SEQ ID NO: 6148161 - DNA, 20 bp, Homo sapiens
ctccctgcctcacatctccc

SEQ ID NO: 6148162 - DNA, 15 bp, Homo sapiens
ctccctgcctccacc

SEQ ID NO: 6148163 - DNA, 19 bp, Homo sapiens
ctccctgcctccacccaca

SEQ ID NO: 6148164 - DNA, 21 bp, Homo sapiens
ctccctgcctccacccacagt

SEQ ID NO: 6148165 - DNA, 14 bp, Homo sapiens
ctccctgcctccag

SEQ ID NO: 6148166 - DNA, 16 bp, Homo sapiens
ctccctgcctccagga

SEQ ID NO: 6148167 - DNA, 13 bp, Homo sapiens
ctccctgcctcct

SEQ ID NO: 6148168 - DNA, 14 bp, Homo sapiens
ctccctgcctcctg

SEQ ID NO: 6148169 - DNA, 16 bp, Homo sapiens
ctccctgcctgctcct

SEQ ID NO: 6148170 - DNA, 19 bp, Homo sapiens
ctccctgcctgctccttgg

SEQ ID NO: 6148171 - DNA, 12 bp, Homo sapiens
ctccctgcctgg

SEQ ID NO: 6148172 - DNA, 22 bp, Homo sapiens
ctccctgcctggatccagctct

SEQ ID NO: 6148173 - DNA, 13 bp, Homo sapiens
ctccctgcctggc

SEQ ID NO: 6148174 - DNA, 18 bp, Homo sapiens
ctccctgcctggccccca

SEQ ID NO: 6148175 - DNA, 15 bp, Homo sapiens
ctgctcagcagccag

SEQ ID NO: 6148176 - DNA, 13 bp, Homo sapiens
ctgctcagcagct

SEQ ID NO: 6148177 - DNA, 14 bp, Homo sapiens
ctgctcagcaggtt

SEQ ID NO: 6148178 - DNA, 11 bp, Homo sapiens
ctgctcagcca

SEQ ID NO: 6148179 - DNA, 13 bp, Homo sapiens
ctgctcagccctg

SEQ ID NO: 6148180 - DNA, 14 bp, Homo sapiens
ctgctcagccctgc

SEQ ID NO: 6148181 - DNA, 16 bp, Homo sapiens
ctgctcagccctggag

SEQ ID NO: 6148182 - DNA, 13 bp, Homo sapiens
ctgctcagcctca

SEQ ID NO: 6148183 - DNA, 17 bp, Homo sapiens
ctgctcagctctggtcc

SEQ ID NO: 6148184 - DNA, 18 bp, Homo sapiens
ctgctcagctctggtcca

SEQ ID NO: 6148185 - DNA, 20 bp, Homo sapiens
ctgctcagctgcgtcatggg

SEQ ID NO: 6148186 - DNA, 13 bp, Homo sapiens
ctgctcagctggc

SEQ ID NO: 6148187 - DNA, 16 bp, Homo sapiens
ctgctcagcttctcct

SEQ ID NO: 6148188 - DNA, 17 bp, Homo sapiens
ctgctcaggaaacgaga

SEQ ID NO: 6148189 - DNA, 11 bp, Homo sapiens
ctgctcaggcc

SEQ ID NO: 6148190 - DNA, 12 bp, Homo sapiens
ctgctcaggcct

SEQ ID NO: 6148191 - DNA, 16 bp, Homo sapiens
ctgctcaggcctcacc

SEQ ID NO: 6148192 - DNA, 21 bp, Homo sapiens
ctgctcaggctccccaagact

SEQ ID NO: 6148193 - DNA, 23 bp, Homo sapiens
ctgctcaggctccccaagacttg

SEQ ID NO: 6148194 - DNA, 16 bp, Homo sapiens
ctgctcaggctgcagc

SEQ ID NO: 6148195 - DNA, 20 bp, Homo sapiens
ctgctcaggctgcagctgga

SEQ ID NO: 6148196 - DNA, 22 bp, Homo sapiens
ctgctcaggctgcagctggaca

SEQ ID NO: 6148197 - DNA, 22 bp, Homo sapiens
ctgctcagggaaaagcagctct

SEQ ID NO: 6148198 - DNA, 23 bp, Homo sapiens
ctgctcagggaaaagcagctctc

SEQ ID NO: 6148199 - DNA, 13 bp, Homo sapiens
ctgctcagggccg

SEQ ID NO: 6148200 - DNA, 19 bp, Homo sapiens
ctgctcagtgcttgggctc

SEQ ID NO: 6148201 - DNA, 15 bp, Homo sapiens
ctgctcataggacct

SEQ ID NO: 6148202 - DNA, 17 bp, Homo sapiens
ctgctcataggacctgc

SEQ ID NO: 6148203 - DNA, 16 bp, Homo sapiens
ctgctcatcacccagt

SEQ ID NO: 6148204 - DNA, 19 bp, Homo sapiens
ctgctcatcacccagtcct

SEQ ID NO: 6148205 - DNA, 21 bp, Homo sapiens
ctgctcatcatattccaaccc

SEQ ID NO: 6148206 - DNA, 13 bp, Homo sapiens
ctgctcatccact

SEQ ID NO: 6148207 - DNA, 18 bp, Homo sapiens
ctgctcatggccctcgga

SEQ ID NO: 6148208 - DNA, 19 bp, Homo sapiens
ctgctcatgggtggctgtg

SEQ ID NO: 6148209 - DNA, 23 bp, Homo sapiens
ctgctcattcctcacgcccttca

SEQ ID NO: 6148210 - DNA, 20 bp, Homo sapiens
ctgctcattgtataagcccc

SEQ ID NO: 6148211 - DNA, 13 bp, Homo sapiens
ctgctcattgtgg

SEQ ID NO: 6148212 - DNA, 22 bp, Homo sapiens
ctgctcattttgacaaagtgcc

SEQ ID NO: 6148213 - DNA, 22 bp, Homo sapiens
ctgctccaacagacaccctcca

SEQ ID NO: 6148214 - DNA, 23 bp, Homo sapiens
ctgctccaaccgggatgggagcc

SEQ ID NO: 6148215 - DNA, 15 bp, Homo sapiens
ctgctccaactccac

SEQ ID NO: 6148216 - DNA, 22 bp, Homo sapiens
ctgctccaagggacaggtgggc

SEQ ID NO: 6148217 - DNA, 20 bp, Homo sapiens
ctgctccaatgactgagcag

SEQ ID NO: 6148218 - DNA, 16 bp, Homo sapiens
ctgctccaatttcccc

SEQ ID NO: 6148219 - DNA, 13 bp, Homo sapiens
ctgctccacagtg

SEQ ID NO: 6148220 - DNA, 16 bp, Homo sapiens
ctgctccacagtgttg

SEQ ID NO: 6148221 - DNA, 13 bp, Homo sapiens
ctgctccaccaca

SEQ ID NO: 6148222 - DNA, 13 bp, Homo sapiens
ctgctccaccagc

SEQ ID NO: 6148223 - DNA, 14 bp, Homo sapiens
ctgctccaccagca

SEQ ID NO: 6148224 - DNA, 18 bp, Homo sapiens
ctgctccaccagcagcat

SEQ ID NO: 6148225 - DNA, 11 bp, Homo sapiens
ctgctccaccc

SEQ ID NO: 6148226 - DNA, 12 bp, Homo sapiens
ctgctccaccct

SEQ ID NO: 6148227 - DNA, 13 bp, Homo sapiens
ctgctccaccctt

SEQ ID NO: 6148228 - DNA, 19 bp, Homo sapiens
ctgctccacccttggcctg

SEQ ID NO: 6148229 - DNA, 12 bp, Homo sapiens
ctgctccacgcg

SEQ ID NO: 6148230 - DNA, 20 bp, Homo sapiens
ctgctccagaatttggaaat

SEQ ID NO: 6148231 - DNA, 21 bp, Homo sapiens
ctgctccagacctgatcctgg

SEQ ID NO: 6148232 - DNA, 12 bp, Homo sapiens
ctgctccagaga

SEQ ID NO: 6148233 - DNA, 20 bp, Homo sapiens
ctgctccagagagaggatgc

SEQ ID NO: 6148234 - DNA, 11 bp, Homo sapiens
ctgctccagat

SEQ ID NO: 6148235 - DNA, 16 bp, Homo sapiens
ctgctccagcagcaca

SEQ ID NO: 6148236 - DNA, 17 bp, Homo sapiens
ctgctccagcctctgcc

SEQ ID NO: 6148237 - DNA, 14 bp, Homo sapiens
ctgctccagctctg

SEQ ID NO: 6148238 - DNA, 19 bp, Homo sapiens
ctgctccagctctggcatg

SEQ ID NO: 6148239 - DNA, 15 bp, Homo sapiens
ctgctccagctgttc

SEQ ID NO: 6148240 - DNA, 19 bp, Homo sapiens
ctgctccagctgttcagct

SEQ ID NO: 6148241 - DNA, 20 bp, Homo sapiens
ctgctccagctgttcagctg

SEQ ID NO: 6148242 - DNA, 12 bp, Homo sapiens
ctgctccaggcc

SEQ ID NO: 6148243 - DNA, 13 bp, Homo sapiens
ctgctccaggcct

SEQ ID NO: 6148244 - DNA, 14 bp, Homo sapiens
ctgctccaggcctg

SEQ ID NO: 6148245 - DNA, 19 bp, Homo sapiens
ctgctccatgactggctgt

SEQ ID NO: 6148246 - DNA, 12 bp, Homo sapiens
ctgctccatgca

SEQ ID NO: 6148247 - DNA, 16 bp, Homo sapiens
ctgctccatgcacagg

SEQ ID NO: 6148248 - DNA, 20 bp, Homo sapiens
ctgctccatgcagactgtta

SEQ ID NO: 6148249 - DNA, 23 bp, Homo sapiens
ctgctccatgcagatctagccag

SEQ ID NO: 6148250 - DNA, 21 bp, Homo sapiens
ctgctccatttataaccccag

SEQ ID NO: 6148251 - DNA, 17 bp, Homo sapiens
ctgctcccaaggggcct

SEQ ID NO: 6148252 - DNA, 20 bp, Homo sapiens
ctgctcccaaggggcctgag

SEQ ID NO: 6148253 - DNA, 21 bp, Homo sapiens
ctgctcccaaggggcctgagc

SEQ ID NO: 6148254 - DNA, 23 bp, Homo sapiens
ctgctcccaaggggcctgagcag

SEQ ID NO: 6148255 - DNA, 16 bp, Homo sapiens
ctgctcccaatgtgcc

SEQ ID NO: 6148256 - DNA, 17 bp, Homo sapiens
ctgctcccacacttgtg

SEQ ID NO: 6148257 - DNA, 21 bp, Homo sapiens
ctgctcccacacttgtgccag

SEQ ID NO: 6148258 - DNA, 22 bp, Homo sapiens
ctgctcccacacttgtgccagc

SEQ ID NO: 6148259 - DNA, 21 bp, Homo sapiens
ctgctcccaccaccagtgaga

SEQ ID NO: 6148260 - DNA, 16 bp, Homo sapiens
ctgctcccaccccaga

SEQ ID NO: 6148261 - DNA, 16 bp, Homo sapiens
ctgctcccacctcctg

SEQ ID NO: 6148262 - DNA, 15 bp, Homo sapiens
ctgctcccacctggc

SEQ ID NO: 6148263 - DNA, 16 bp, Homo sapiens
ctgctcccacctggct

SEQ ID NO: 6148264 - DNA, 19 bp, Homo sapiens
ctgctcccacctggctctg

SEQ ID NO: 6148265 - DNA, 19 bp, Homo sapiens
ctgctcccacgcctgcttc

SEQ ID NO: 6148266 - DNA, 15 bp, Homo sapiens
ctgctcccagcagcc

SEQ ID NO: 6148267 - DNA, 18 bp, Homo sapiens
ctgctcccagcctcttgc

SEQ ID NO: 6148268 - DNA, 19 bp, Homo sapiens
ctgctcccagcctcttgct

SEQ ID NO: 6148269 - DNA, 20 bp, Homo sapiens
ctgctcccagctctctctcc

SEQ ID NO: 6148270 - DNA, 22 bp, Homo sapiens
ctgctcccagctctctctcctg

SEQ ID NO: 6148271 - DNA, 11 bp, Homo sapiens
ctgctcccagg

SEQ ID NO: 6148272 - DNA, 12 bp, Homo sapiens
ctgctcccaggc

SEQ ID NO: 6148273 - DNA, 14 bp, Homo sapiens
ctgctcccaggccc

SEQ ID NO: 6148274 - DNA, 20 bp, Homo sapiens
ctgctcccagggactgacac

SEQ ID NO: 6148275 - DNA, 18 bp, Homo sapiens
ctgctcccagtcctgcct

SEQ ID NO: 6148276 - DNA, 16 bp, Homo sapiens
ctgctcccatcctcac

SEQ ID NO: 6148277 - DNA, 18 bp, Homo sapiens
ctgctcccatcctcaccc

SEQ ID NO: 6148278 - DNA, 14 bp, Homo sapiens
ctgctcccatcctg

SEQ ID NO: 6148279 - DNA, 15 bp, Homo sapiens
ctgctcccattcctc

SEQ ID NO: 6148280 - DNA, 18 bp, Homo sapiens
ctgctcccattcctccct

SEQ ID NO: 6148281 - DNA, 17 bp, Homo sapiens
ctgctccccaacacctg

SEQ ID NO: 6148282 - DNA, 22 bp, Homo sapiens
ctgctccccaacacctgcctct

SEQ ID NO: 6148283 - DNA, 15 bp, Homo sapiens
ctgctccccacccct

SEQ ID NO: 6148284 - DNA, 20 bp, Homo sapiens
ctgctccccacccctaccga

SEQ ID NO: 6148285 - DNA, 20 bp, Homo sapiens
ctgctccccagcagcggaac

SEQ ID NO: 6148286 - DNA, 17 bp, Homo sapiens
ctgctccccagccctgg

SEQ ID NO: 6148287 - DNA, 18 bp, Homo sapiens
ctgctccccagccctggc

SEQ ID NO: 6148288 - DNA, 20 bp, Homo sapiens
ctgctccccagccctggctc

SEQ ID NO: 6148289 - DNA, 17 bp, Homo sapiens
ctgctcccccttttccc

SEQ ID NO: 6148290 - DNA, 18 bp, Homo sapiens
ctgctcccccttttccct

SEQ ID NO: 6148291 - DNA, 18 bp, Homo sapiens
ctgctcccctaaagccag

SEQ ID NO: 6148292 - DNA, 20 bp, Homo sapiens
ctgctcccctaaagccaggc

SEQ ID NO: 6148293 - DNA, 22 bp, Homo sapiens
ctgctcccctgagaccaccccc

SEQ ID NO: 6148294 - DNA, 13 bp, Homo sapiens
ctgctcccctgcc

SEQ ID NO: 6148295 - DNA, 17 bp, Homo sapiens
ctgctcccctgccacgc

SEQ ID NO: 6148296 - DNA, 15 bp, Homo sapiens
ctgctcccggtgtgc

SEQ ID NO: 6148297 - DNA, 21 bp, Homo sapiens
ctgctcccggtgtgcagcggg

SEQ ID NO: 6148298 - DNA, 13 bp, Homo sapiens
ctgctccctaagc

SEQ ID NO: 6148299 - DNA, 17 bp, Homo sapiens
ctgctccctaagccagc

SEQ ID NO: 6148300 - DNA, 20 bp, Homo sapiens
ctgctccctaagccagcctg

SEQ ID NO: 6148301 - DNA, 21 bp, Homo sapiens
ctgctccctaagccagcctgg

SEQ ID NO: 6148302 - DNA, 23 bp, Homo sapiens
ctgctccctaccccagggccctg

SEQ ID NO: 6148303 - DNA, 12 bp, Homo sapiens
ctgctccctcag

SEQ ID NO: 6148304 - DNA, 14 bp, Homo sapiens
ctgctccctccaga

SEQ ID NO: 6148305 - DNA, 22 bp, Homo sapiens
ctgctccctccgggtcttccta

SEQ ID NO: 6148306 - DNA, 20 bp, Homo sapiens
ctgctccctctcccccttac

SEQ ID NO: 6148307 - DNA, 16 bp, Homo sapiens
ctgctccctgaagcca

SEQ ID NO: 6148308 - DNA, 21 bp, Homo sapiens
ctgctccctgaagccagcctt

SEQ ID NO: 6148309 - DNA, 13 bp, Homo sapiens
ctgctccctgagg

SEQ ID NO: 6148310 - DNA, 14 bp, Homo sapiens
ctgctccctgaggg

SEQ ID NO: 6148311 - DNA, 11 bp, Homo sapiens
ctgctccctgc

SEQ ID NO: 6148312 - DNA, 14 bp, Homo sapiens
ctgctccctgcaag

SEQ ID NO: 6148313 - DNA, 23 bp, Homo sapiens
ctgctccctgcaagctccgcctc

SEQ ID NO: 6148314 - DNA, 17 bp, Homo sapiens
ctgctccctgcctcctg

SEQ ID NO: 6148315 - DNA, 18 bp, Homo sapiens
ctgctccctgcctcctgc

SEQ ID NO: 6148316 - DNA, 21 bp, Homo sapiens
ctgctccctgcctcctgccta

SEQ ID NO: 6148317 - DNA, 13 bp, Homo sapiens
ctgctccctgctc

SEQ ID NO: 6148318 - DNA, 16 bp, Homo sapiens
ctgctccctgctccca

SEQ ID NO: 6148319 - DNA, 15 bp, Homo sapiens
ctgctccctggcatt

SEQ ID NO: 6148320 - DNA, 13 bp, Homo sapiens
ctgctccctgtct

SEQ ID NO: 6148321 - DNA, 16 bp, Homo sapiens
ctgctccctgtctgtg

SEQ ID NO: 6148322 - DNA, 23 bp, Homo sapiens
ctgctccctgtctgtgtcccagc

SEQ ID NO: 6148323 - DNA, 15 bp, Homo sapiens
ctgctccgccaggaa

SEQ ID NO: 6148324 - DNA, 14 bp, Homo sapiens
ctgctccgcccgct

SEQ ID NO: 6148325 - DNA, 15 bp, Homo sapiens
ctgctccgcccgctc

SEQ ID NO: 6148326 - DNA, 17 bp, Homo sapiens
ctgctccgctgcctgga

SEQ ID NO: 6148327 - DNA, 18 bp, Homo sapiens
ctgctccgctgcctggaa

SEQ ID NO: 6148328 - DNA, 15 bp, Homo sapiens
ctgctccgctgctcc

SEQ ID NO: 6148329 - DNA, 20 bp, Homo sapiens
ctgctccgtggactgcagtc

SEQ ID NO: 6148330 - DNA, 23 bp, Homo sapiens
ctgctccgtggaggaggttggga

SEQ ID NO: 6148331 - DNA, 19 bp, Homo sapiens
ctgctccgtgtgtctcatg

SEQ ID NO: 6148332 - DNA, 23 bp, Homo sapiens
ctgctcctaaacccccgctccag

SEQ ID NO: 6148333 - DNA, 17 bp, Homo sapiens
ctgctcctagagggagg

SEQ ID NO: 6148334 - DNA, 19 bp, Homo sapiens
ctgctcctagcccagcaga

SEQ ID NO: 6148335 - DNA, 22 bp, Homo sapiens
ctgctcctagcccagcagagag

SEQ ID NO: 6148336 - DNA, 13 bp, Homo sapiens
ctgctcctcaccc

SEQ ID NO: 6148337 - DNA, 22 bp, Homo sapiens
ctgctcctcacccccacccctg

SEQ ID NO: 6148338 - DNA, 13 bp, Homo sapiens
ctgctcctcactg

SEQ ID NO: 6148339 - DNA, 13 bp, Homo sapiens
ctgctcctcatgg

SEQ ID NO: 6148340 - DNA, 14 bp, Homo sapiens
ctgctcctcatggt

SEQ ID NO: 6148341 - DNA, 11 bp, Homo sapiens
ctgctcctcca

SEQ ID NO: 6148342 - DNA, 15 bp, Homo sapiens
ctgctcctccagccc

SEQ ID NO: 6148343 - DNA, 17 bp, Homo sapiens
ctgctcctccagccctt

SEQ ID NO: 6148344 - DNA, 13 bp, Homo sapiens
ctgctcctccagg

SEQ ID NO: 6148345 - DNA, 17 bp, Homo sapiens
ctgctcctccagggcca

SEQ ID NO: 6148346 - DNA, 22 bp, Homo sapiens
ctgctcctccagggccacgtgc

SEQ ID NO: 6148347 - DNA, 13 bp, Homo sapiens
ctgctcctccctc

SEQ ID NO: 6148348 - DNA, 16 bp, Homo sapiens
ctgctcctccctctga

SEQ ID NO: 6148349 - DNA, 14 bp, Homo sapiens
ctgctcctccctgc

SEQ ID NO: 6148350 - DNA, 16 bp, Homo sapiens
ctgctcctccctggct

SEQ ID NO: 6148351 - DNA, 17 bp, Homo sapiens
ctgctcctcgcagttcg

SEQ ID NO: 6148352 - DNA, 17 bp, Homo sapiens
ctgctcctcggccagag

SEQ ID NO: 6148353 - DNA, 23 bp, Homo sapiens
ctgctcctcggccagagctccca

SEQ ID NO: 6148354 - DNA, 16 bp, Homo sapiens
ctgctcctctccaggc

SEQ ID NO: 6148355 - DNA, 21 bp, Homo sapiens
ctccctgcctggcggcagggg

SEQ ID NO: 6148356 - DNA, 15 bp, Homo sapiens
ctccctgcctgtttc

SEQ ID NO: 6148357 - DNA, 17 bp, Homo sapiens
ctccctgcgcccttgag

SEQ ID NO: 6148358 - DNA, 15 bp, Homo sapiens
ctccctgcgcttcct

SEQ ID NO: 6148359 - DNA, 16 bp, Homo sapiens
ctccctgctagcacag

SEQ ID NO: 6148360 - DNA, 22 bp, Homo sapiens
ctccctgctagcacagaggcct

SEQ ID NO: 6148361 - DNA, 16 bp, Homo sapiens
ctccctgctcagtgct

SEQ ID NO: 6148362 - DNA, 13 bp, Homo sapiens
ctccctgctccca

SEQ ID NO: 6148363 - DNA, 15 bp, Homo sapiens
ctccctgctcccagc

SEQ ID NO: 6148364 - DNA, 16 bp, Homo sapiens
ctccctgctcccagct

SEQ ID NO: 6148365 - DNA, 14 bp, Homo sapiens
ctccctgctcctca

SEQ ID NO: 6148366 - DNA, 16 bp, Homo sapiens
ctccctgctcctcatg

SEQ ID NO: 6148367 - DNA, 17 bp, Homo sapiens
ctccctgctcctcatgg

SEQ ID NO: 6148368 - DNA, 17 bp, Homo sapiens
ctccctgctgctcctag

SEQ ID NO: 6148369 - DNA, 16 bp, Homo sapiens
ctccctgctgtcccct

SEQ ID NO: 6148370 - DNA, 18 bp, Homo sapiens
ctccctgctgtcccctct

SEQ ID NO: 6148371 - DNA, 14 bp, Homo sapiens
ctccctgcttcata

SEQ ID NO: 6148372 - DNA, 20 bp, Homo sapiens
ctccctggagaagcaccagc

SEQ ID NO: 6148373 - DNA, 19 bp, Homo sapiens
ctccctggagaagggacat

SEQ ID NO: 6148374 - DNA, 16 bp, Homo sapiens
ctccctggagccctgt

SEQ ID NO: 6148375 - DNA, 21 bp, Homo sapiens
ctccctggaggcacgcaccac

SEQ ID NO: 6148376 - DNA, 12 bp, Homo sapiens
ctccctggagtg

SEQ ID NO: 6148377 - DNA, 22 bp, Homo sapiens
ctccctggagtgtggctgagga

SEQ ID NO: 6148378 - DNA, 20 bp, Homo sapiens
ctccctggatctacctggag

SEQ ID NO: 6148379 - DNA, 13 bp, Homo sapiens
ctccctggatttt

SEQ ID NO: 6148380 - DNA, 17 bp, Homo sapiens
ctccctggcagacacaa

SEQ ID NO: 6148381 - DNA, 21 bp, Homo sapiens
ctccctggcagcacaggaaaa

SEQ ID NO: 6148382 - DNA, 17 bp, Homo sapiens
ctccctggcaggatgct

SEQ ID NO: 6148383 - DNA, 23 bp, Homo sapiens
ctccctggcatgaccatcctgtc

SEQ ID NO: 6148384 - DNA, 20 bp, Homo sapiens
ctccctggcatgtcagagcc

SEQ ID NO: 6148385 - DNA, 15 bp, Homo sapiens
ctccctggcccagcc

SEQ ID NO: 6148386 - DNA, 14 bp, Homo sapiens
ctccctggccccag

SEQ ID NO: 6148387 - DNA, 16 bp, Homo sapiens
ctccctggccccagtg

SEQ ID NO: 6148388 - DNA, 13 bp, Homo sapiens
ctccctggcctgt

SEQ ID NO: 6148389 - DNA, 16 bp, Homo sapiens
ctccctggcctgttct

SEQ ID NO: 6148390 - DNA, 14 bp, Homo sapiens
ctccctggctccca

SEQ ID NO: 6148391 - DNA, 15 bp, Homo sapiens
ctccctggctccctc

SEQ ID NO: 6148392 - DNA, 15 bp, Homo sapiens
ctccctggctctcag

SEQ ID NO: 6148393 - DNA, 17 bp, Homo sapiens
ctccctggctgccctgg

SEQ ID NO: 6148394 - DNA, 19 bp, Homo sapiens
ctccctggctgccctggcc

SEQ ID NO: 6148395 - DNA, 21 bp, Homo sapiens
ctccctggctgccctggccct

SEQ ID NO: 6148396 - DNA, 13 bp, Homo sapiens
ctccctggctgtg

SEQ ID NO: 6148397 - DNA, 16 bp, Homo sapiens
ctccctggctgtgagc

SEQ ID NO: 6148398 - DNA, 19 bp, Homo sapiens
ctccctggctgtgagcagc

SEQ ID NO: 6148399 - DNA, 13 bp, Homo sapiens
ctccctggcttct

SEQ ID NO: 6148400 - DNA, 22 bp, Homo sapiens
ctccctgggacacagacccagg

SEQ ID NO: 6148401 - DNA, 10 bp, Homo sapiens
ctccctgggc

SEQ ID NO: 6148402 - DNA, 18 bp, Homo sapiens
ctccctgggcaccctgca

SEQ ID NO: 6148403 - DNA, 19 bp, Homo sapiens
ctccctgggcaccctgcag

SEQ ID NO: 6148404 - DNA, 20 bp, Homo sapiens
ctccctgggcaccctgcagg

SEQ ID NO: 6148405 - DNA, 14 bp, Homo sapiens
ctccctgggccacc

SEQ ID NO: 6148406 - DNA, 17 bp, Homo sapiens
ctccctgggccacctcc

SEQ ID NO: 6148407 - DNA, 20 bp, Homo sapiens
ctccctgggccacctcctac

SEQ ID NO: 6148408 - DNA, 18 bp, Homo sapiens
ctccctgggcctgtctca

SEQ ID NO: 6148409 - DNA, 19 bp, Homo sapiens
ctccctggggaccaggagc

SEQ ID NO: 6148410 - DNA, 20 bp, Homo sapiens
ctccctggggaccaggagct

SEQ ID NO: 6148411 - DNA, 21 bp, Homo sapiens
ctccctgggggcgggactcct

SEQ ID NO: 6148412 - DNA, 14 bp, Homo sapiens
ctccctgggggtgg

SEQ ID NO: 6148413 - DNA, 14 bp, Homo sapiens
ctccctgggttcag

SEQ ID NO: 6148414 - DNA, 18 bp, Homo sapiens
ctccctggtgcctctgtg

SEQ ID NO: 6148415 - DNA, 19 bp, Homo sapiens
ctccctggtgcctctgtgc

SEQ ID NO: 6148416 - DNA, 18 bp, Homo sapiens
ctccctggttctgatgat

SEQ ID NO: 6148417 - DNA, 17 bp, Homo sapiens
ctccctggttgcctctc

SEQ ID NO: 6148418 - DNA, 20 bp, Homo sapiens
ctccctggttgcctctcttg

SEQ ID NO: 6148419 - DNA, 18 bp, Homo sapiens
ctccctgtagctctgcct

SEQ ID NO: 6148420 - DNA, 22 bp, Homo sapiens
ctccctgtagggtccaaccaga

SEQ ID NO: 6148421 - DNA, 15 bp, Homo sapiens
ctccctgtcacacac

SEQ ID NO: 6148422 - DNA, 19 bp, Homo sapiens
ctccctgtcacacactgga

SEQ ID NO: 6148423 - DNA, 20 bp, Homo sapiens
ctccctgtcacacactggac

SEQ ID NO: 6148424 - DNA, 21 bp, Homo sapiens
ctccctgtcactcagctgaga

SEQ ID NO: 6148425 - DNA, 14 bp, Homo sapiens
ctccctgtcccctg

SEQ ID NO: 6148426 - DNA, 18 bp, Homo sapiens
ctccctgtcccttccttt

SEQ ID NO: 6148427 - DNA, 21 bp, Homo sapiens
ctccctgtcccttcctttctc

SEQ ID NO: 6148428 - DNA, 13 bp, Homo sapiens
ctccctgtcctcc

SEQ ID NO: 6148429 - DNA, 13 bp, Homo sapiens
ctccctgtcgcct

SEQ ID NO: 6148430 - DNA, 13 bp, Homo sapiens
ctccctgtctcca

SEQ ID NO: 6148431 - DNA, 14 bp, Homo sapiens
ctccctgtctccag

SEQ ID NO: 6148432 - DNA, 16 bp, Homo sapiens
ctccctgtctccagct

SEQ ID NO: 6148433 - DNA, 22 bp, Homo sapiens
ctccctgtctccagctgcctgg

SEQ ID NO: 6148434 - DNA, 16 bp, Homo sapiens
ctccctgtctctgcat

SEQ ID NO: 6148435 - DNA, 12 bp, Homo sapiens
ctccctgtctgt

SEQ ID NO: 6148436 - DNA, 14 bp, Homo sapiens
ctccctgtctgtct

SEQ ID NO: 6148437 - DNA, 19 bp, Homo sapiens
ctccctgtctgtgtcccag

SEQ ID NO: 6148438 - DNA, 15 bp, Homo sapiens
ctccctgtgccccca

SEQ ID NO: 6148439 - DNA, 19 bp, Homo sapiens
ctccctgtgcccccagggt

SEQ ID NO: 6148440 - DNA, 18 bp, Homo sapiens
ctccctgtggggcaggag

SEQ ID NO: 6148441 - DNA, 21 bp, Homo sapiens
ctccctgtgggggtggccatc

SEQ ID NO: 6148442 - DNA, 21 bp, Homo sapiens
ctccctgtgtccacctgtggg

SEQ ID NO: 6148443 - DNA, 14 bp, Homo sapiens
ctccctgtgttctg

SEQ ID NO: 6148444 - DNA, 24 bp, Homo sapiens
ctccctgttattttcaagtagctg

SEQ ID NO: 6148445 - DNA, 17 bp, Homo sapiens
ctccctgttatttttct

SEQ ID NO: 6148446 - DNA, 17 bp, Homo sapiens
ctccctgttccccacag

SEQ ID NO: 6148447 - DNA, 18 bp, Homo sapiens
ctccctgttccccacagg

SEQ ID NO: 6148448 - DNA, 19 bp, Homo sapiens
ctccctgttccccagagaa

SEQ ID NO: 6148449 - DNA, 19 bp, Homo sapiens
ctccctgttgaagctctgg

SEQ ID NO: 6148450 - DNA, 19 bp, Homo sapiens
ctccctgttgacgaagtct

SEQ ID NO: 6148451 - DNA, 11 bp, Homo sapiens
ctcccttaccc

SEQ ID NO: 6148452 - DNA, 15 bp, Homo sapiens
ctcccttacccatct

SEQ ID NO: 6148453 - DNA, 20 bp, Homo sapiens
ctcccttaccctcctctgct

SEQ ID NO: 6148454 - DNA, 21 bp, Homo sapiens
ctcccttaccctcctctgctg

SEQ ID NO: 6148455 - DNA, 17 bp, Homo sapiens
ctcccttagctccctgt

SEQ ID NO: 6148456 - DNA, 23 bp, Homo sapiens
ctcccttaggcattatttaatgt

SEQ ID NO: 6148457 - DNA, 15 bp, Homo sapiens
ctcccttatgtccac

SEQ ID NO: 6148458 - DNA, 22 bp, Homo sapiens
ctcccttatgtccaccacttca

SEQ ID NO: 6148459 - DNA, 21 bp, Homo sapiens
ctcccttcaaccattccccat

SEQ ID NO: 6148460 - DNA, 23 bp, Homo sapiens
ctcccttcaaccattccccatgg

SEQ ID NO: 6148461 - DNA, 19 bp, Homo sapiens
ctcccttcacaggggtaca

SEQ ID NO: 6148462 - DNA, 15 bp, Homo sapiens
ctcccttcatccttc

SEQ ID NO: 6148463 - DNA, 14 bp, Homo sapiens
ctcccttccacctc

SEQ ID NO: 6148464 - DNA, 15 bp, Homo sapiens
ctcccttccacctca

SEQ ID NO: 6148465 - DNA, 23 bp, Homo sapiens
ctcccttccatgccccaggatca

SEQ ID NO: 6148466 - DNA, 17 bp, Homo sapiens
ctcccttcccacctctc

SEQ ID NO: 6148467 - DNA, 23 bp, Homo sapiens
ctcccttcccacctctctcactc

SEQ ID NO: 6148468 - DNA, 15 bp, Homo sapiens
ctcccttcccagtgg

SEQ ID NO: 6148469 - DNA, 17 bp, Homo sapiens
ctcccttcccataagct

SEQ ID NO: 6148470 - DNA, 18 bp, Homo sapiens
ctcccttcccctgcctgg

SEQ ID NO: 6148471 - DNA, 19 bp, Homo sapiens
ctcccttccctccatagcc

SEQ ID NO: 6148472 - DNA, 16 bp, Homo sapiens
ctcccttccctccctg

SEQ ID NO: 6148473 - DNA, 15 bp, Homo sapiens
ctcccttccctcctc

SEQ ID NO: 6148474 - DNA, 22 bp, Homo sapiens
ctcccttccgaccctctgggaa

SEQ ID NO: 6148475 - DNA, 17 bp, Homo sapiens
ctcccttccgtccatcc

SEQ ID NO: 6148476 - DNA, 10 bp, Homo sapiens
ctcccttcct

SEQ ID NO: 6148477 - DNA, 13 bp, Homo sapiens
ctcccttcctccc

SEQ ID NO: 6148478 - DNA, 14 bp, Homo sapiens
ctcccttcctcttt

SEQ ID NO: 6148479 - DNA, 18 bp, Homo sapiens
ctcccttccttgggcaga

SEQ ID NO: 6148480 - DNA, 12 bp, Homo sapiens
ctcccttccttt

SEQ ID NO: 6148481 - DNA, 19 bp, Homo sapiens
ctcccttccttttccctgc

SEQ ID NO: 6148482 - DNA, 18 bp, Homo sapiens
ctcccttcgctctgctgg

SEQ ID NO: 6148483 - DNA, 17 bp, Homo sapiens
ctcccttcggtggaaga

SEQ ID NO: 6148484 - DNA, 21 bp, Homo sapiens
ctcccttcggtggaagagctc

SEQ ID NO: 6148485 - DNA, 15 bp, Homo sapiens
ctcccttcgtgtgtg

SEQ ID NO: 6148486 - DNA, 18 bp, Homo sapiens
ctcccttctacctgccac

SEQ ID NO: 6148487 - DNA, 13 bp, Homo sapiens
ctcccttctccct

SEQ ID NO: 6148488 - DNA, 19 bp, Homo sapiens
ctcccttctcgtgtttgct

SEQ ID NO: 6148489 - DNA, 12 bp, Homo sapiens
ctcccttctctc

SEQ ID NO: 6148490 - DNA, 14 bp, Homo sapiens
ctcccttctctctc

SEQ ID NO: 6148491 - DNA, 12 bp, Homo sapiens
ctcccttctgat

SEQ ID NO: 6148492 - DNA, 14 bp, Homo sapiens
ctcccttctgctac

SEQ ID NO: 6148493 - DNA, 21 bp, Homo sapiens
ctcccttcttgggtctgccct

SEQ ID NO: 6148494 - DNA, 15 bp, Homo sapiens
ctcccttctttacct

SEQ ID NO: 6148495 - DNA, 20 bp, Homo sapiens
ctcccttctttccttccttt

SEQ ID NO: 6148496 - DNA, 17 bp, Homo sapiens
ctcccttctttgcttct

SEQ ID NO: 6148497 - DNA, 15 bp, Homo sapiens
ctcccttgacctgct

SEQ ID NO: 6148498 - DNA, 14 bp, Homo sapiens
ctcccttgagctgg

SEQ ID NO: 6148499 - DNA, 15 bp, Homo sapiens
ctcccttgccccagg

SEQ ID NO: 6148500 - DNA, 15 bp, Homo sapiens
ctcccttgccctccc

SEQ ID NO: 6148501 - DNA, 23 bp, Homo sapiens
ctcccttgcctttcgaggcctga

SEQ ID NO: 6148502 - DNA, 16 bp, Homo sapiens
ctcccttgctcagtgc

SEQ ID NO: 6148503 - DNA, 18 bp, Homo sapiens
ctcccttgctcagtgcct

SEQ ID NO: 6148504 - DNA, 21 bp, Homo sapiens
ctcccttgctcagtgcctcct

SEQ ID NO: 6148505 - DNA, 24 bp, Homo sapiens
ctcccttgctcagtgcctcctggc

SEQ ID NO: 6148506 - DNA, 14 bp, Homo sapiens
ctcccttgctgaac

SEQ ID NO: 6148507 - DNA, 20 bp, Homo sapiens
ctcccttgctgaacacacac

SEQ ID NO: 6148508 - DNA, 21 bp, Homo sapiens
ctcccttgctttttgctgtgt

SEQ ID NO: 6148509 - DNA, 17 bp, Homo sapiens
ctcccttggatttttga

SEQ ID NO: 6148510 - DNA, 20 bp, Homo sapiens
ctcccttggccacggcctgg

SEQ ID NO: 6148511 - DNA, 18 bp, Homo sapiens
ctcccttggcccagagac

SEQ ID NO: 6148512 - DNA, 13 bp, Homo sapiens
ctcccttggcttt

SEQ ID NO: 6148513 - DNA, 17 bp, Homo sapiens
ctcccttgggctctgat

SEQ ID NO: 6148514 - DNA, 19 bp, Homo sapiens
ctcccttgggctctgatga

SEQ ID NO: 6148515 - DNA, 17 bp, Homo sapiens
ctcccttggtgccctcg

SEQ ID NO: 6148516 - DNA, 18 bp, Homo sapiens
ctcccttggtgccctcgc

SEQ ID NO: 6148517 - DNA, 20 bp, Homo sapiens
ctcccttggtgccctcgcct

SEQ ID NO: 6148518 - DNA, 20 bp, Homo sapiens
ctcccttggtggcaagagcc

SEQ ID NO: 6148519 - DNA, 21 bp, Homo sapiens
ctcccttggtggcaagagccc

SEQ ID NO: 6148520 - DNA, 21 bp, Homo sapiens
ctcccttggttgttccttttt

SEQ ID NO: 6148521 - DNA, 16 bp, Homo sapiens
ctcccttgtcctgctt

SEQ ID NO: 6148522 - DNA, 16 bp, Homo sapiens
ctcccttgtgttcctt

SEQ ID NO: 6148523 - DNA, 14 bp, Homo sapiens
ctcccttgttctct

SEQ ID NO: 6148524 - DNA, 17 bp, Homo sapiens
ctcccttgttctctaag

SEQ ID NO: 6148525 - DNA, 23 bp, Homo sapiens
ctcccttgtttactctgttacca

SEQ ID NO: 6148526 - DNA, 20 bp, Homo sapiens
ctccctttagtggagccagg

SEQ ID NO: 6148527 - DNA, 19 bp, Homo sapiens
ctccctttagttctgctgt

SEQ ID NO: 6148528 - DNA, 12 bp, Homo sapiens
ctccctttcaac

SEQ ID NO: 6148529 - DNA, 13 bp, Homo sapiens
ctccctttcaaca

SEQ ID NO: 6148530 - DNA, 19 bp, Homo sapiens
ctccctttctatcgttctc

SEQ ID NO: 6148531 - DNA, 17 bp, Homo sapiens
ctccctttctcaggagc

SEQ ID NO: 6148532 - DNA, 12 bp, Homo sapiens
ctccctttctcc

SEQ ID NO: 6148533 - DNA, 20 bp, Homo sapiens
ctccctttctctctcctctc

SEQ ID NO: 6148534 - DNA, 18 bp, Homo sapiens
ctgctcctctccccagca

SEQ ID NO: 6148535 - DNA, 23 bp, Homo sapiens
ctgctcctctccccagcaagtga

SEQ ID NO: 6148536 - DNA, 15 bp, Homo sapiens
ctgctcctctcttgg

SEQ ID NO: 6148537 - DNA, 11 bp, Homo sapiens
ctgctcctctt

SEQ ID NO: 6148538 - DNA, 13 bp, Homo sapiens
ctgctcctcttgt

SEQ ID NO: 6148539 - DNA, 22 bp, Homo sapiens
ctgctcctcttgttcctgaaat

SEQ ID NO: 6148540 - DNA, 14 bp, Homo sapiens
ctgctcctgaacca

SEQ ID NO: 6148541 - DNA, 23 bp, Homo sapiens
ctgctcctgaaccagtcctgctg

SEQ ID NO: 6148542 - DNA, 20 bp, Homo sapiens
ctgctcctgagcccccagct

SEQ ID NO: 6148543 - DNA, 14 bp, Homo sapiens
ctgctcctgcccac

SEQ ID NO: 6148544 - DNA, 12 bp, Homo sapiens
ctgctcctgctt

SEQ ID NO: 6148545 - DNA, 13 bp, Homo sapiens
ctgctcctgcttt

SEQ ID NO: 6148546 - DNA, 14 bp, Homo sapiens
ctgctcctgctttt

SEQ ID NO: 6148547 - DNA, 15 bp, Homo sapiens
ctgctcctgcttttc

SEQ ID NO: 6148548 - DNA, 16 bp, Homo sapiens
ctgctcctgcttttct

SEQ ID NO: 6148549 - DNA, 17 bp, Homo sapiens
ctgctcctgcttttctg

SEQ ID NO: 6148550 - DNA, 18 bp, Homo sapiens
ctgctcctgcttttctgt

SEQ ID NO: 6148551 - DNA, 23 bp, Homo sapiens
ctgctcctgcttttctgtcctgg

SEQ ID NO: 6148552 - DNA, 19 bp, Homo sapiens
ctgctcctggagcctttga

SEQ ID NO: 6148553 - DNA, 20 bp, Homo sapiens
ctgctcctggagcctttgaa

SEQ ID NO: 6148554 - DNA, 19 bp, Homo sapiens
ctgctcctgtggcaggagg

SEQ ID NO: 6148555 - DNA, 20 bp, Homo sapiens
ctgctcctgtttgtctgatg

SEQ ID NO: 6148556 - DNA, 17 bp, Homo sapiens
ctgctccttagctgcca

SEQ ID NO: 6148557 - DNA, 21 bp, Homo sapiens
ctgctccttccatctgcctga

SEQ ID NO: 6148558 - DNA, 12 bp, Homo sapiens
ctgctccttccc

SEQ ID NO: 6148559 - DNA, 13 bp, Homo sapiens
ctgctccttcctg

SEQ ID NO: 6148560 - DNA, 16 bp, Homo sapiens
ctgctccttggcaccc

SEQ ID NO: 6148561 - DNA, 19 bp, Homo sapiens
ctgctccttggcttacctg

SEQ ID NO: 6148562 - DNA, 19 bp, Homo sapiens
ctgctcctttaccctcttg

SEQ ID NO: 6148563 - DNA, 14 bp, Homo sapiens
ctgctcctttcccc

SEQ ID NO: 6148564 - DNA, 15 bp, Homo sapiens
ctgctcctttcccct

SEQ ID NO: 6148565 - DNA, 17 bp, Homo sapiens
ctgctcctttctgccca

SEQ ID NO: 6148566 - DNA, 23 bp, Homo sapiens
ctgctcgaaatggcccctgtctt

SEQ ID NO: 6148567 - DNA, 22 bp, Homo sapiens
ctgctcgccctcctttctgtgc

SEQ ID NO: 6148568 - DNA, 15 bp, Homo sapiens
ctgctcggctactgg

SEQ ID NO: 6148569 - DNA, 16 bp, Homo sapiens
ctgctcgggcccaggc

SEQ ID NO: 6148570 - DNA, 19 bp, Homo sapiens
ctgctcgggcccaggccat

SEQ ID NO: 6148571 - DNA, 22 bp, Homo sapiens
ctgctcgggcccaggccatctt

SEQ ID NO: 6148572 - DNA, 21 bp, Homo sapiens
ctgctcggggtgcacaggagg

SEQ ID NO: 6148573 - DNA, 23 bp, Homo sapiens
ctgctcggggtgcacaggagggg

SEQ ID NO: 6148574 - DNA, 17 bp, Homo sapiens
ctgctcgtggactgtgc

SEQ ID NO: 6148575 - DNA, 18 bp, Homo sapiens
ctgctcgtggactgtgct

SEQ ID NO: 6148576 - DNA, 16 bp, Homo sapiens
ctgctctaaataaaga

SEQ ID NO: 6148577 - DNA, 15 bp, Homo sapiens
ctgctctaagcccag

SEQ ID NO: 6148578 - DNA, 18 bp, Homo sapiens
ctgctctaagcccaggat

SEQ ID NO: 6148579 - DNA, 20 bp, Homo sapiens
ctgctctaagcccaggatct

SEQ ID NO: 6148580 - DNA, 21 bp, Homo sapiens
ctgctctacccatgagcctgc

SEQ ID NO: 6148581 - DNA, 19 bp, Homo sapiens
ctgctctagaaagtataga

SEQ ID NO: 6148582 - DNA, 20 bp, Homo sapiens
ctgctctagatgagctgggc

SEQ ID NO: 6148583 - DNA, 22 bp, Homo sapiens
ctgctctagatgagctgggccg

SEQ ID NO: 6148584 - DNA, 13 bp, Homo sapiens
ctgctctagccag

SEQ ID NO: 6148585 - DNA, 14 bp, Homo sapiens
ctgctctagctggc

SEQ ID NO: 6148586 - DNA, 17 bp, Homo sapiens
ctgctctagctggcagg

SEQ ID NO: 6148587 - DNA, 22 bp, Homo sapiens
ctgctctagggaatctggatta

SEQ ID NO: 6148588 - DNA, 21 bp, Homo sapiens
ctgctctagtgggacagccca

SEQ ID NO: 6148589 - DNA, 23 bp, Homo sapiens
ctgctctagtgggacagcccaga

SEQ ID NO: 6148590 - DNA, 18 bp, Homo sapiens
ctgctctatactgtggcc

SEQ ID NO: 6148591 - DNA, 15 bp, Homo sapiens
ctgctctatgccagg

SEQ ID NO: 6148592 - DNA, 16 bp, Homo sapiens
ctgctctatgccaggc

SEQ ID NO: 6148593 - DNA, 23 bp, Homo sapiens
ctgctctattgtagcatttcttg

SEQ ID NO: 6148594 - DNA, 13 bp, Homo sapiens
ctgctctcagcct

SEQ ID NO: 6148595 - DNA, 17 bp, Homo sapiens
ctgctctcagcctccca

SEQ ID NO: 6148596 - DNA, 17 bp, Homo sapiens
ctgctctcagctccggg

SEQ ID NO: 6148597 - DNA, 13 bp, Homo sapiens
ctgctctcagctt

SEQ ID NO: 6148598 - DNA, 15 bp, Homo sapiens
ctgctctcagcttgt

SEQ ID NO: 6148599 - DNA, 19 bp, Homo sapiens
ctgctctcatccattcctc

SEQ ID NO: 6148600 - DNA, 13 bp, Homo sapiens
ctgctctcatgcc

SEQ ID NO: 6148601 - DNA, 13 bp, Homo sapiens
ctgctctcccagg

SEQ ID NO: 6148602 - DNA, 11 bp, Homo sapiens
ctgctctcctc

SEQ ID NO: 6148603 - DNA, 13 bp, Homo sapiens
ctgctctcctcgg

SEQ ID NO: 6148604 - DNA, 19 bp, Homo sapiens
ctgctctcctcgggccctg

SEQ ID NO: 6148605 - DNA, 20 bp, Homo sapiens
ctgctctcctcgggccctgt

SEQ ID NO: 6148606 - DNA, 24 bp, Homo sapiens
ctgctctcctcgggccctgtggtg

SEQ ID NO: 6148607 - DNA, 14 bp, Homo sapiens
ctgctctcctcttg

SEQ ID NO: 6148608 - DNA, 16 bp, Homo sapiens
ctgctctcctgacagc

SEQ ID NO: 6148609 - DNA, 17 bp, Homo sapiens
ctgctctccttcctgga

SEQ ID NO: 6148610 - DNA, 17 bp, Homo sapiens
ctgctctccttgccctg

SEQ ID NO: 6148611 - DNA, 20 bp, Homo sapiens
ctgctctccttgccctgggc

SEQ ID NO: 6148612 - DNA, 18 bp, Homo sapiens
ctgctctcgaggcagcag

SEQ ID NO: 6148613 - DNA, 14 bp, Homo sapiens
ctgctctctaccca

SEQ ID NO: 6148614 - DNA, 16 bp, Homo sapiens
ctgctctctacccagc

SEQ ID NO: 6148615 - DNA, 15 bp, Homo sapiens
ctgctctctgctcat

SEQ ID NO: 6148616 - DNA, 16 bp, Homo sapiens
ctgctctctgctcatg

SEQ ID NO: 6148617 - DNA, 20 bp, Homo sapiens
ctgctctctgctcatgggtg

SEQ ID NO: 6148618 - DNA, 16 bp, Homo sapiens
ctgctctcttcaggag

SEQ ID NO: 6148619 - DNA, 18 bp, Homo sapiens
ctgctctcttcaggaggc

SEQ ID NO: 6148620 - DNA, 20 bp, Homo sapiens
ctgctctctttttctccagg

SEQ ID NO: 6148621 - DNA, 24 bp, Homo sapiens
ctgctctctttttctccagggtca

SEQ ID NO: 6148622 - DNA, 21 bp, Homo sapiens
ctgctctgaattagtccttgc

SEQ ID NO: 6148623 - DNA, 16 bp, Homo sapiens
ctgctctgaccttcca

SEQ ID NO: 6148624 - DNA, 13 bp, Homo sapiens
ctgctctgagacg

SEQ ID NO: 6148625 - DNA, 14 bp, Homo sapiens
ctgctctgagcatc

SEQ ID NO: 6148626 - DNA, 13 bp, Homo sapiens
ctgctctgagcca

SEQ ID NO: 6148627 - DNA, 16 bp, Homo sapiens
ctgctctgagccacag

SEQ ID NO: 6148628 - DNA, 22 bp, Homo sapiens
ctgctctgaggcttccagagag

SEQ ID NO: 6148629 - DNA, 20 bp, Homo sapiens
ctgctctgatgaagaggagt

SEQ ID NO: 6148630 - DNA, 12 bp, Homo sapiens
ctgctctgcaca

SEQ ID NO: 6148631 - DNA, 14 bp, Homo sapiens
ctgctctgcacggt

SEQ ID NO: 6148632 - DNA, 14 bp, Homo sapiens
ctgctctgcagccc

SEQ ID NO: 6148633 - DNA, 19 bp, Homo sapiens
ctgctctgcagcccacaga

SEQ ID NO: 6148634 - DNA, 20 bp, Homo sapiens
ctgctctgcaggctggggag

SEQ ID NO: 6148635 - DNA, 12 bp, Homo sapiens
ctgctctgcata

SEQ ID NO: 6148636 - DNA, 12 bp, Homo sapiens
ctgctctgccat

SEQ ID NO: 6148637 - DNA, 14 bp, Homo sapiens
ctgctctgcccaga

SEQ ID NO: 6148638 - DNA, 15 bp, Homo sapiens
ctgctctgcccaggc

SEQ ID NO: 6148639 - DNA, 14 bp, Homo sapiens
ctgctctgcccatg

SEQ ID NO: 6148640 - DNA, 16 bp, Homo sapiens
ctgctctgcccatgcc

SEQ ID NO: 6148641 - DNA, 23 bp, Homo sapiens
ctgctctgcccatgcctaaagcc

SEQ ID NO: 6148642 - DNA, 12 bp, Homo sapiens
ctgctctgcccc

SEQ ID NO: 6148643 - DNA, 23 bp, Homo sapiens
ctgctctgcccccaactcccgga

SEQ ID NO: 6148644 - DNA, 17 bp, Homo sapiens
ctgctctgcctggagtg

SEQ ID NO: 6148645 - DNA, 16 bp, Homo sapiens
ctgctctgctcagctg

SEQ ID NO: 6148646 - DNA, 13 bp, Homo sapiens
ctgctctgcttcc

SEQ ID NO: 6148647 - DNA, 14 bp, Homo sapiens
ctgctctgcttcct

SEQ ID NO: 6148648 - DNA, 16 bp, Homo sapiens
ctgctctgcttcctca

SEQ ID NO: 6148649 - DNA, 22 bp, Homo sapiens
ctgctctggaataaagttgcag

SEQ ID NO: 6148650 - DNA, 12 bp, Homo sapiens
ctgctctgggac

SEQ ID NO: 6148651 - DNA, 13 bp, Homo sapiens
ctgctctggtccc

SEQ ID NO: 6148652 - DNA, 21 bp, Homo sapiens
ctgctctggttgtttctgttc

SEQ ID NO: 6148653 - DNA, 22 bp, Homo sapiens
ctgctctggttgtttctgttcc

SEQ ID NO: 6148654 - DNA, 14 bp, Homo sapiens
ctgctctgtacatc

SEQ ID NO: 6148655 - DNA, 16 bp, Homo sapiens
ctgctctgtagccacc

SEQ ID NO: 6148656 - DNA, 18 bp, Homo sapiens
ctgctctgtagccacctc

SEQ ID NO: 6148657 - DNA, 22 bp, Homo sapiens
ctgctctgtccagaggctttaa

SEQ ID NO: 6148658 - DNA, 17 bp, Homo sapiens
ctgctctgtgagcccca

SEQ ID NO: 6148659 - DNA, 21 bp, Homo sapiens
ctgctctgtgagccccacagc

SEQ ID NO: 6148660 - DNA, 15 bp, Homo sapiens
ctgctcttaagaaac

SEQ ID NO: 6148661 - DNA, 18 bp, Homo sapiens
ctgctcttacttccccca

SEQ ID NO: 6148662 - DNA, 19 bp, Homo sapiens
ctgctcttagtgcccgcct

SEQ ID NO: 6148663 - DNA, 17 bp, Homo sapiens
ctgctcttccaaagctc

SEQ ID NO: 6148664 - DNA, 20 bp, Homo sapiens
ctgctcttccatttcttcca

SEQ ID NO: 6148665 - DNA, 11 bp, Homo sapiens
ctgctcttgca

SEQ ID NO: 6148666 - DNA, 19 bp, Homo sapiens
ctgctcttgcagttgctct

SEQ ID NO: 6148667 - DNA, 20 bp, Homo sapiens
ctgctcttgcatctgggcca

SEQ ID NO: 6148668 - DNA, 13 bp, Homo sapiens
ctgctcttgcctg

SEQ ID NO: 6148669 - DNA, 14 bp, Homo sapiens
ctgctcttgcctgc

SEQ ID NO: 6148670 - DNA, 15 bp, Homo sapiens
ctgctcttgcctgca

SEQ ID NO: 6148671 - DNA, 18 bp, Homo sapiens
ctgctcttgcctgcaccc

SEQ ID NO: 6148672 - DNA, 16 bp, Homo sapiens
ctgctcttggctggac

SEQ ID NO: 6148673 - DNA, 17 bp, Homo sapiens
ctgctcttggctggacc

SEQ ID NO: 6148674 - DNA, 19 bp, Homo sapiens
ctgctcttggctggaccca

SEQ ID NO: 6148675 - DNA, 21 bp, Homo sapiens
ctgctcttggctggacccagc

SEQ ID NO: 6148676 - DNA, 23 bp, Homo sapiens
ctgctcttggctggacccagcca

SEQ ID NO: 6148677 - DNA, 15 bp, Homo sapiens
ctgctcttgggcaat

SEQ ID NO: 6148678 - DNA, 14 bp, Homo sapiens
ctgctcttgtttca

SEQ ID NO: 6148679 - DNA, 20 bp, Homo sapiens
ctgctcttgtttcactccac

SEQ ID NO: 6148680 - DNA, 14 bp, Homo sapiens
ctgctcttgtttct

SEQ ID NO: 6148681 - DNA, 12 bp, Homo sapiens
ctgctctttaat

SEQ ID NO: 6148682 - DNA, 16 bp, Homo sapiens
ctgctctttctctgcc

SEQ ID NO: 6148683 - DNA, 18 bp, Homo sapiens
ctgctctttctctgccag

SEQ ID NO: 6148684 - DNA, 20 bp, Homo sapiens
ctgctctttctctgccagtg

SEQ ID NO: 6148685 - DNA, 21 bp, Homo sapiens
ctgctctttctctgccagtga

SEQ ID NO: 6148686 - DNA, 17 bp, Homo sapiens
ctgctctttcttcttcc

SEQ ID NO: 6148687 - DNA, 13 bp, Homo sapiens
ctgctcttttcct

SEQ ID NO: 6148688 - DNA, 22 bp, Homo sapiens
ctgctgaaaaagaaaaaaatga

SEQ ID NO: 6148689 - DNA, 22 bp, Homo sapiens
ctgctgaaaaccatctggcctg

SEQ ID NO: 6148690 - DNA, 23 bp, Homo sapiens
ctgctgaaaaccatctggcctgg

SEQ ID NO: 6148691 - DNA, 16 bp, Homo sapiens
ctgctgaaacacctcc

SEQ ID NO: 6148692 - DNA, 14 bp, Homo sapiens
ctgctgaaactgcc

SEQ ID NO: 6148693 - DNA, 22 bp, Homo sapiens
ctgctgaaagactcgagaacca

SEQ ID NO: 6148694 - DNA, 20 bp, Homo sapiens
ctgctgaaagtcctgctttc

SEQ ID NO: 6148695 - DNA, 19 bp, Homo sapiens
ctgctgaacacagtgtctg

SEQ ID NO: 6148696 - DNA, 21 bp, Homo sapiens
ctgctgaagatgcccctgctc

SEQ ID NO: 6148697 - DNA, 23 bp, Homo sapiens
ctgctgaagatgcccctgctccc

SEQ ID NO: 6148698 - DNA, 12 bp, Homo sapiens
ctgctgaagctg

SEQ ID NO: 6148699 - DNA, 15 bp, Homo sapiens
ctgctgaagctgcct

SEQ ID NO: 6148700 - DNA, 13 bp, Homo sapiens
ctgctgaaggctc

SEQ ID NO: 6148701 - DNA, 16 bp, Homo sapiens
ctgctgaaggctcatt

SEQ ID NO: 6148702 - DNA, 23 bp, Homo sapiens
ctgctgaaggctcgagcatgcct

SEQ ID NO: 6148703 - DNA, 15 bp, Homo sapiens
ctgctgaagggaggg

SEQ ID NO: 6148704 - DNA, 17 bp, Homo sapiens
ctgctgaagggaggggg

SEQ ID NO: 6148705 - DNA, 18 bp, Homo sapiens
ctgctgaagttctgagcc

SEQ ID NO: 6148706 - DNA, 16 bp, Homo sapiens
ctgctgaatgcctcgc

SEQ ID NO: 6148707 - DNA, 14 bp, Homo sapiens
ctgctgaattttca

SEQ ID NO: 6148708 - DNA, 19 bp, Homo sapiens
ctgctgacaggatgtggca

SEQ ID NO: 6148709 - DNA, 21 bp, Homo sapiens
ctgctgacaggatgtggcact

SEQ ID NO: 6148710 - DNA, 12 bp, Homo sapiens
ctgctgacagtg

SEQ ID NO: 6148711 - DNA, 22 bp, Homo sapiens
ctgctgaccaaatggccagttt

SEQ ID NO: 6148712 - DNA, 22 bp, Homo sapiens
ctgctgacccagcctgttttaa

SEQ ID NO: 6148713 - DNA, 17 bp, Homo sapiens
ctccctttgtggacttt

SEQ ID NO: 6148714 - DNA, 17 bp, Homo sapiens
ctccctttttacacttt

SEQ ID NO: 6148715 - DNA, 21 bp, Homo sapiens
ctccctttttatatcccattt

SEQ ID NO: 6148716 - DNA, 16 bp, Homo sapiens
ctccctttttccttgt

SEQ ID NO: 6148717 - DNA, 22 bp, Homo sapiens
ctccctttttccttgtccccac

SEQ ID NO: 6148718 - DNA, 19 bp, Homo sapiens
ctccctttttgaattgtgt

SEQ ID NO: 6148719 - DNA, 21 bp, Homo sapiens
ctccctttttttctctcttcc

SEQ ID NO: 6148720 - DNA, 11 bp, Homo sapiens
ctccgaacccc

SEQ ID NO: 6148721 - DNA, 15 bp, Homo sapiens
ctccgaaggggctct

SEQ ID NO: 6148722 - DNA, 20 bp, Homo sapiens
ctccgacagcgtctccaatt

SEQ ID NO: 6148723 - DNA, 15 bp, Homo sapiens
ctccgacctctctca

SEQ ID NO: 6148724 - DNA, 16 bp, Homo sapiens
ctccgactccccctcc

SEQ ID NO: 6148725 - DNA, 19 bp, Homo sapiens
ctccgactccccctccccg

SEQ ID NO: 6148726 - DNA, 19 bp, Homo sapiens
ctccgactctgcacccgcc

SEQ ID NO: 6148727 - DNA, 20 bp, Homo sapiens
ctccgacttcccctgggcaa

SEQ ID NO: 6148728 - DNA, 23 bp, Homo sapiens
ctccgagaagctctcgagggaag

SEQ ID NO: 6148729 - DNA, 15 bp, Homo sapiens
ctccgagacagtcca

SEQ ID NO: 6148730 - DNA, 17 bp, Homo sapiens
ctccgagaggtgggcca

SEQ ID NO: 6148731 - DNA, 14 bp, Homo sapiens
ctccgagctctggt

SEQ ID NO: 6148732 - DNA, 13 bp, Homo sapiens
ctccgaggctccc

SEQ ID NO: 6148733 - DNA, 14 bp, Homo sapiens
ctccgaggctcccc

SEQ ID NO: 6148734 - DNA, 18 bp, Homo sapiens
ctccgaggctccccgcct

SEQ ID NO: 6148735 - DNA, 14 bp, Homo sapiens
ctccgagggcggcc

SEQ ID NO: 6148736 - DNA, 17 bp, Homo sapiens
ctccgagggcggccagg

SEQ ID NO: 6148737 - DNA, 13 bp, Homo sapiens
ctccgaggggtgg

SEQ ID NO: 6148738 - DNA, 18 bp, Homo sapiens
ctccgaggtggttttaaa

SEQ ID NO: 6148739 - DNA, 21 bp, Homo sapiens
ctccgaggttttgaggcggga

SEQ ID NO: 6148740 - DNA, 23 bp, Homo sapiens
ctccgatttaactgggaacccct

SEQ ID NO: 6148741 - DNA, 17 bp, Homo sapiens
ctccgcacacctctggc

SEQ ID NO: 6148742 - DNA, 22 bp, Homo sapiens
ctccgcacctgaccgctgccca

SEQ ID NO: 6148743 - DNA, 23 bp, Homo sapiens
ctccgcacctgaccgctgcccag

SEQ ID NO: 6148744 - DNA, 12 bp, Homo sapiens
ctccgcaggact

SEQ ID NO: 6148745 - DNA, 22 bp, Homo sapiens
ctccgcaggacttccccggagg

SEQ ID NO: 6148746 - DNA, 15 bp, Homo sapiens
ctccgcaggggtttg

SEQ ID NO: 6148747 - DNA, 15 bp, Homo sapiens
ctccgcagttcctgt

SEQ ID NO: 6148748 - DNA, 16 bp, Homo sapiens
ctccgcatactgagaa

SEQ ID NO: 6148749 - DNA, 14 bp, Homo sapiens
ctccgcatcacctc

SEQ ID NO: 6148750 - DNA, 13 bp, Homo sapiens
ctccgccagaccc

SEQ ID NO: 6148751 - DNA, 22 bp, Homo sapiens
ctccgccagaccccgtggctct

SEQ ID NO: 6148752 - DNA, 13 bp, Homo sapiens
ctccgccagccac

SEQ ID NO: 6148753 - DNA, 20 bp, Homo sapiens
ctccgccagccacaggacca

SEQ ID NO: 6148754 - DNA, 12 bp, Homo sapiens
ctccgccagcct

SEQ ID NO: 6148755 - DNA, 14 bp, Homo sapiens
ctccgccagcctcc

SEQ ID NO: 6148756 - DNA, 20 bp, Homo sapiens
ctccgccagcctcctctgga

SEQ ID NO: 6148757 - DNA, 13 bp, Homo sapiens
ctccgccatccac

SEQ ID NO: 6148758 - DNA, 15 bp, Homo sapiens
ctccgccattgagaa

SEQ ID NO: 6148759 - DNA, 16 bp, Homo sapiens
ctccgccccagacaca

SEQ ID NO: 6148760 - DNA, 21 bp, Homo sapiens
ctccgcccccagcctatgagc

SEQ ID NO: 6148761 - DNA, 15 bp, Homo sapiens
ctccgcccccaggta

SEQ ID NO: 6148762 - DNA, 16 bp, Homo sapiens
ctccgcccccaggtag

SEQ ID NO: 6148763 - DNA, 14 bp, Homo sapiens
ctccgccccccggc

SEQ ID NO: 6148764 - DNA, 21 bp, Homo sapiens
ctccgccccccggcctggccc

SEQ ID NO: 6148765 - DNA, 22 bp, Homo sapiens
ctccgccccccggcctggcccc

SEQ ID NO: 6148766 - DNA, 19 bp, Homo sapiens
ctccgcccctgagcccact

SEQ ID NO: 6148767 - DNA, 20 bp, Homo sapiens
ctccgcccctgagcccactg

SEQ ID NO: 6148768 - DNA, 13 bp, Homo sapiens
ctccgcccctgcc

SEQ ID NO: 6148769 - DNA, 17 bp, Homo sapiens
ctccgccctgccactca

SEQ ID NO: 6148770 - DNA, 20 bp, Homo sapiens
ctccgcccttccctgacact

SEQ ID NO: 6148771 - DNA, 17 bp, Homo sapiens
ctccgccctttttgtcc

SEQ ID NO: 6148772 - DNA, 15 bp, Homo sapiens
ctccgcctccacact

SEQ ID NO: 6148773 - DNA, 16 bp, Homo sapiens
ctccgcctccacactg

SEQ ID NO: 6148774 - DNA, 15 bp, Homo sapiens
ctccgcctctgctgg

SEQ ID NO: 6148775 - DNA, 13 bp, Homo sapiens
ctccgcctgaggc

SEQ ID NO: 6148776 - DNA, 14 bp, Homo sapiens
ctccgcctgaggcc

SEQ ID NO: 6148777 - DNA, 16 bp, Homo sapiens
ctccgcctgaggccag

SEQ ID NO: 6148778 - DNA, 13 bp, Homo sapiens
ctccgcctggcac

SEQ ID NO: 6148779 - DNA, 15 bp, Homo sapiens
ctccgcctgggatct

SEQ ID NO: 6148780 - DNA, 21 bp, Homo sapiens
ctccgccttcactccggtgtg

SEQ ID NO: 6148781 - DNA, 22 bp, Homo sapiens
ctccgccttgctgagacttacg

SEQ ID NO: 6148782 - DNA, 21 bp, Homo sapiens
ctccgcgccctccgacctctc

SEQ ID NO: 6148783 - DNA, 23 bp, Homo sapiens
ctccgcgctgtgtaaatgctcca

SEQ ID NO: 6148784 - DNA, 17 bp, Homo sapiens
ctccgcggaggcccctg

SEQ ID NO: 6148785 - DNA, 20 bp, Homo sapiens
ctccgcggaggcccctgagg

SEQ ID NO: 6148786 - DNA, 13 bp, Homo sapiens
ctccgcggctgga

SEQ ID NO: 6148787 - DNA, 14 bp, Homo sapiens
ctccgcggctggag

SEQ ID NO: 6148788 - DNA, 15 bp, Homo sapiens
ctccgcggctggagc

SEQ ID NO: 6148789 - DNA, 16 bp, Homo sapiens
ctccgcgggagacccc

SEQ ID NO: 6148790 - DNA, 19 bp, Homo sapiens
ctccgcgggagaccccttg

SEQ ID NO: 6148791 - DNA, 17 bp, Homo sapiens
ctccgcgggggacagga

SEQ ID NO: 6148792 - DNA, 16 bp, Homo sapiens
ctccgcgggtgggact

SEQ ID NO: 6148793 - DNA, 18 bp, Homo sapiens
ctccgcgggtgggactct

SEQ ID NO: 6148794 - DNA, 21 bp, Homo sapiens
ctccgctaagacctccccacc

SEQ ID NO: 6148795 - DNA, 20 bp, Homo sapiens
ctccgctaaggcttccggct

SEQ ID NO: 6148796 - DNA, 16 bp, Homo sapiens
ctccgctcccaccgcc

SEQ ID NO: 6148797 - DNA, 18 bp, Homo sapiens
ctccgctcccctttccca

SEQ ID NO: 6148798 - DNA, 13 bp, Homo sapiens
ctccgctgcctgg

SEQ ID NO: 6148799 - DNA, 14 bp, Homo sapiens
ctccgctgggcttc

SEQ ID NO: 6148800 - DNA, 18 bp, Homo sapiens
ctccgctgggcttcattc

SEQ ID NO: 6148801 - DNA, 13 bp, Homo sapiens
ctccgctgtggga

SEQ ID NO: 6148802 - DNA, 17 bp, Homo sapiens
ctccgcttatcctgcta

SEQ ID NO: 6148803 - DNA, 19 bp, Homo sapiens
ctccgcttgtccaagacag

SEQ ID NO: 6148804 - DNA, 19 bp, Homo sapiens
ctccgctttctacccagcg

SEQ ID NO: 6148805 - DNA, 22 bp, Homo sapiens
ctccgctttctacccagcgagc

SEQ ID NO: 6148806 - DNA, 16 bp, Homo sapiens
ctccggaaggacacag

SEQ ID NO: 6148807 - DNA, 21 bp, Homo sapiens
ctccggagcctcatgttctct

SEQ ID NO: 6148808 - DNA, 12 bp, Homo sapiens
ctccggagggga

SEQ ID NO: 6148809 - DNA, 18 bp, Homo sapiens
ctccggaggggacccagc

SEQ ID NO: 6148810 - DNA, 23 bp, Homo sapiens
ctccggaggggacccagctcctc

SEQ ID NO: 6148811 - DNA, 19 bp, Homo sapiens
ctccggagggggtcctcct

SEQ ID NO: 6148812 - DNA, 20 bp, Homo sapiens
ctccggagggggtcctcctc

SEQ ID NO: 6148813 - DNA, 20 bp, Homo sapiens
ctccggattccggccctggc

SEQ ID NO: 6148814 - DNA, 14 bp, Homo sapiens
ctccggcagaggca

SEQ ID NO: 6148815 - DNA, 15 bp, Homo sapiens
ctccggcagaggcag

SEQ ID NO: 6148816 - DNA, 18 bp, Homo sapiens
ctccggcagaggcagggc

SEQ ID NO: 6148817 - DNA, 19 bp, Homo sapiens
ctccggcagaggcagggcc

SEQ ID NO: 6148818 - DNA, 20 bp, Homo sapiens
ctccggccaggtgcctcctg

SEQ ID NO: 6148819 - DNA, 23 bp, Homo sapiens
ctccggccaggtgcctcctgaca

SEQ ID NO: 6148820 - DNA, 17 bp, Homo sapiens
ctccggccatactgcct

SEQ ID NO: 6148821 - DNA, 19 bp, Homo sapiens
ctccggccatactgccttt

SEQ ID NO: 6148822 - DNA, 19 bp, Homo sapiens
ctccggccctccagagccc

SEQ ID NO: 6148823 - DNA, 12 bp, Homo sapiens
ctccggccctgc

SEQ ID NO: 6148824 - DNA, 16 bp, Homo sapiens
ctccggccctgcccca

SEQ ID NO: 6148825 - DNA, 16 bp, Homo sapiens
ctccggcctgcactcc

SEQ ID NO: 6148826 - DNA, 12 bp, Homo sapiens
ctccggcctgct

SEQ ID NO: 6148827 - DNA, 18 bp, Homo sapiens
ctccggcctgggtgacag

SEQ ID NO: 6148828 - DNA, 17 bp, Homo sapiens
ctccggcgtcagcctcc

SEQ ID NO: 6148829 - DNA, 21 bp, Homo sapiens
ctccggcgtcagcctccagcc

SEQ ID NO: 6148830 - DNA, 15 bp, Homo sapiens
ctccggctcccagcc

SEQ ID NO: 6148831 - DNA, 20 bp, Homo sapiens
ctccggctcccagcctcagc

SEQ ID NO: 6148832 - DNA, 13 bp, Homo sapiens
ctccggctgtgct

SEQ ID NO: 6148833 - DNA, 17 bp, Homo sapiens
ctccggctgtgctggga

SEQ ID NO: 6148834 - DNA, 22 bp, Homo sapiens
ctccgggaccattgacctcagc

SEQ ID NO: 6148835 - DNA, 15 bp, Homo sapiens
ctccgggacccccag

SEQ ID NO: 6148836 - DNA, 16 bp, Homo sapiens
ctccgggacccccagg

SEQ ID NO: 6148837 - DNA, 12 bp, Homo sapiens
ctccgggcaaat

SEQ ID NO: 6148838 - DNA, 19 bp, Homo sapiens
ctccgggcaccaggggcca

SEQ ID NO: 6148839 - DNA, 15 bp, Homo sapiens
ctccgggcagagacc

SEQ ID NO: 6148840 - DNA, 14 bp, Homo sapiens
ctccgggcaggcaa

SEQ ID NO: 6148841 - DNA, 12 bp, Homo sapiens
ctccgggcaggg

SEQ ID NO: 6148842 - DNA, 21 bp, Homo sapiens
ctccgggcaggggagccaggg

SEQ ID NO: 6148843 - DNA, 15 bp, Homo sapiens
ctccggggagagcag

SEQ ID NO: 6148844 - DNA, 19 bp, Homo sapiens
ctccggggagagcagaggg

SEQ ID NO: 6148845 - DNA, 20 bp, Homo sapiens
ctccggggccccactggctg

SEQ ID NO: 6148846 - DNA, 16 bp, Homo sapiens
ctccggggctcagccc

SEQ ID NO: 6148847 - DNA, 13 bp, Homo sapiens
ctccggggtctgt

SEQ ID NO: 6148848 - DNA, 15 bp, Homo sapiens
ctccggggtctgtgc

SEQ ID NO: 6148849 - DNA, 17 bp, Homo sapiens
ctccggggtctgtgctg

SEQ ID NO: 6148850 - DNA, 17 bp, Homo sapiens
ctccggggtggccacag

SEQ ID NO: 6148851 - DNA, 21 bp, Homo sapiens
ctccgggtgtggcctcagccc

SEQ ID NO: 6148852 - DNA, 22 bp, Homo sapiens
ctccgggtgtggcctcagccct

SEQ ID NO: 6148853 - DNA, 23 bp, Homo sapiens
ctccggtgtgcctgcagccccgc

SEQ ID NO: 6148854 - DNA, 17 bp, Homo sapiens
ctccgtagctctgctgc

SEQ ID NO: 6148855 - DNA, 19 bp, Homo sapiens
ctccgtagctctgctgctg

SEQ ID NO: 6148856 - DNA, 14 bp, Homo sapiens
ctccgtatttcaga

SEQ ID NO: 6148857 - DNA, 15 bp, Homo sapiens
ctccgtatttcagac

SEQ ID NO: 6148858 - DNA, 13 bp, Homo sapiens
ctccgtcaagctg

SEQ ID NO: 6148859 - DNA, 14 bp, Homo sapiens
ctccgtcaagctgg

SEQ ID NO: 6148860 - DNA, 17 bp, Homo sapiens
ctccgtcaagctggttg

SEQ ID NO: 6148861 - DNA, 17 bp, Homo sapiens
ctccgtcactacctggc

SEQ ID NO: 6148862 - DNA, 19 bp, Homo sapiens
ctccgtcactacctggctg

SEQ ID NO: 6148863 - DNA, 18 bp, Homo sapiens
ctccgtcagcttctccca

SEQ ID NO: 6148864 - DNA, 18 bp, Homo sapiens
ctccgtcatgaatgcctt

SEQ ID NO: 6148865 - DNA, 19 bp, Homo sapiens
ctccgtccacccaggctgc

SEQ ID NO: 6148866 - DNA, 23 bp, Homo sapiens
ctccgtccacccaggctgcactg

SEQ ID NO: 6148867 - DNA, 15 bp, Homo sapiens
ctccgtccagccgcc

SEQ ID NO: 6148868 - DNA, 15 bp, Homo sapiens
ctccgtccccagggt

SEQ ID NO: 6148869 - DNA, 17 bp, Homo sapiens
ctccgtcccccaaacat

SEQ ID NO: 6148870 - DNA, 16 bp, Homo sapiens
ctccgtccctctgtcc

SEQ ID NO: 6148871 - DNA, 16 bp, Homo sapiens
ctccgtcctctcccca

SEQ ID NO: 6148872 - DNA, 20 bp, Homo sapiens
ctccgtcctctccccagcct

SEQ ID NO: 6148873 - DNA, 23 bp, Homo sapiens
ctccgtcgggcccctgcctgcct

SEQ ID NO: 6148874 - DNA, 13 bp, Homo sapiens
ctccgtctgaccc

SEQ ID NO: 6148875 - DNA, 18 bp, Homo sapiens
ctccgtctgaccctctgc

SEQ ID NO: 6148876 - DNA, 15 bp, Homo sapiens
ctccgtgaggctgct

SEQ ID NO: 6148877 - DNA, 17 bp, Homo sapiens
ctccgtgaggctgctgc

SEQ ID NO: 6148878 - DNA, 18 bp, Homo sapiens
ctccgtgaggctgctgcc

SEQ ID NO: 6148879 - DNA, 14 bp, Homo sapiens
ctccgtgcctccac

SEQ ID NO: 6148880 - DNA, 22 bp, Homo sapiens
ctccgtgcctccaccaccactg

SEQ ID NO: 6148881 - DNA, 22 bp, Homo sapiens
ctccgtggaggaggttgggagg

SEQ ID NO: 6148882 - DNA, 23 bp, Homo sapiens
ctccgtgtctcgcgcgactgaga

SEQ ID NO: 6148883 - DNA, 23 bp, Homo sapiens
ctccgtgtggactgtgcctcagg

SEQ ID NO: 6148884 - DNA, 15 bp, Homo sapiens
ctccgttagctcctg

SEQ ID NO: 6148885 - DNA, 17 bp, Homo sapiens
ctccgttagctcctgtg

SEQ ID NO: 6148886 - DNA, 18 bp, Homo sapiens
ctccgttagctcctgtgg

SEQ ID NO: 6148887 - DNA, 21 bp, Homo sapiens
ctccgttagctcctgtggccc

SEQ ID NO: 6148888 - DNA, 22 bp, Homo sapiens
ctccgttagctcctgtggcccc

SEQ ID NO: 6148889 - DNA, 14 bp, Homo sapiens
ctccgttccatctg

SEQ ID NO: 6148890 - DNA, 15 bp, Homo sapiens
ctccgttcccacctc

SEQ ID NO: 6148891 - DNA, 18 bp, Homo sapiens
ctccgttcctcctcagcc

SEQ ID NO: 6148892 - DNA, 15 bp, Homo sapiens
ctgctgacctcactg

SEQ ID NO: 6148893 - DNA, 16 bp, Homo sapiens
ctgctgacctccacag

SEQ ID NO: 6148894 - DNA, 14 bp, Homo sapiens
ctgctgacctgctg

SEQ ID NO: 6148895 - DNA, 15 bp, Homo sapiens
ctgctgacctgctga

SEQ ID NO: 6148896 - DNA, 21 bp, Homo sapiens
ctgctgacctgctgacctgtg

SEQ ID NO: 6148897 - DNA, 18 bp, Homo sapiens
ctgctgactgttttctct

SEQ ID NO: 6148898 - DNA, 21 bp, Homo sapiens
ctgctgactgttttctcttga

SEQ ID NO: 6148899 - DNA, 15 bp, Homo sapiens
ctgctgacttctgag

SEQ ID NO: 6148900 - DNA, 12 bp, Homo sapiens
ctgctgagaacc

SEQ ID NO: 6148901 - DNA, 20 bp, Homo sapiens
ctgctgagactgctgagtga

SEQ ID NO: 6148902 - DNA, 22 bp, Homo sapiens
ctgctgagagacccaaggagga

SEQ ID NO: 6148903 - DNA, 15 bp, Homo sapiens
ctgctgagaggcacc

SEQ ID NO: 6148904 - DNA, 22 bp, Homo sapiens
ctgctgagaggcaccagtccag

SEQ ID NO: 6148905 - DNA, 18 bp, Homo sapiens
ctgctgagagtactgtcc

SEQ ID NO: 6148906 - DNA, 20 bp, Homo sapiens
ctgctgagatacatacagaa

SEQ ID NO: 6148907 - DNA, 14 bp, Homo sapiens
ctgctgagccgcag

SEQ ID NO: 6148908 - DNA, 15 bp, Homo sapiens
ctgctgagccgcaga

SEQ ID NO: 6148909 - DNA, 13 bp, Homo sapiens
ctgctgagctctg

SEQ ID NO: 6148910 - DNA, 22 bp, Homo sapiens
ctgctgagctctgagaggccct

SEQ ID NO: 6148911 - DNA, 23 bp, Homo sapiens
ctgctgagctctgagaggccctg

SEQ ID NO: 6148912 - DNA, 11 bp, Homo sapiens
ctgctgagctg

SEQ ID NO: 6148913 - DNA, 12 bp, Homo sapiens
ctgctgagctgc

SEQ ID NO: 6148914 - DNA, 17 bp, Homo sapiens
ctgctgagctgggccca

SEQ ID NO: 6148915 - DNA, 21 bp, Homo sapiens
ctgctgaggaggggcctgggc

SEQ ID NO: 6148916 - DNA, 21 bp, Homo sapiens
ctgctgaggagtctgaggact

SEQ ID NO: 6148917 - DNA, 15 bp, Homo sapiens
ctgctgaggcccagt

SEQ ID NO: 6148918 - DNA, 20 bp, Homo sapiens
ctgctgaggcccagtgcata

SEQ ID NO: 6148919 - DNA, 13 bp, Homo sapiens
ctgctgaggcctt

SEQ ID NO: 6148920 - DNA, 17 bp, Homo sapiens
ctgctgaggccttctct

SEQ ID NO: 6148921 - DNA, 17 bp, Homo sapiens
ctgctgagggaccagcc

SEQ ID NO: 6148922 - DNA, 18 bp, Homo sapiens
ctgctgagggaccagcca

SEQ ID NO: 6148923 - DNA, 17 bp, Homo sapiens
ctgctgaggtcccgggc

SEQ ID NO: 6148924 - DNA, 17 bp, Homo sapiens
ctgctgagtcctttcca

SEQ ID NO: 6148925 - DNA, 17 bp, Homo sapiens
ctgctgagtcgctctca

SEQ ID NO: 6148926 - DNA, 17 bp, Homo sapiens
ctgctgagtctgttctg

SEQ ID NO: 6148927 - DNA, 13 bp, Homo sapiens
ctgctgagtgaca

SEQ ID NO: 6148928 - DNA, 16 bp, Homo sapiens
ctgctgagtgctgggc

SEQ ID NO: 6148929 - DNA, 17 bp, Homo sapiens
ctgctgagttgcttctt

SEQ ID NO: 6148930 - DNA, 17 bp, Homo sapiens
ctgctgagttggcctgg

SEQ ID NO: 6148931 - DNA, 20 bp, Homo sapiens
ctgctgagttggcctggcca

SEQ ID NO: 6148932 - DNA, 13 bp, Homo sapiens
ctgctgatataat

SEQ ID NO: 6148933 - DNA, 18 bp, Homo sapiens
ctgctgatatcaacagct

SEQ ID NO: 6148934 - DNA, 10 bp, Homo sapiens
ctgctgatca

SEQ ID NO: 6148935 - DNA, 22 bp, Homo sapiens
ctgctgatcaatctgcagtttg

SEQ ID NO: 6148936 - DNA, 16 bp, Homo sapiens
ctgctgatcgccttcc

SEQ ID NO: 6148937 - DNA, 17 bp, Homo sapiens
ctgctgatcgccttccc

SEQ ID NO: 6148938 - DNA, 18 bp, Homo sapiens
ctgctgatcgccttcccc

SEQ ID NO: 6148939 - DNA, 17 bp, Homo sapiens
ctgctgatgcgctggga

SEQ ID NO: 6148940 - DNA, 14 bp, Homo sapiens
ctgctgatgctcat

SEQ ID NO: 6148941 - DNA, 14 bp, Homo sapiens
ctgctgattcttgt

SEQ ID NO: 6148942 - DNA, 18 bp, Homo sapiens
ctgctgattcttgtaaat

SEQ ID NO: 6148943 - DNA, 19 bp, Homo sapiens
ctgctgattcttgtaaatc

SEQ ID NO: 6148944 - DNA, 12 bp, Homo sapiens
ctgctgcaaagt

SEQ ID NO: 6148945 - DNA, 16 bp, Homo sapiens
ctgctgcaaagtgcaa

SEQ ID NO: 6148946 - DNA, 17 bp, Homo sapiens
ctgctgcaacaagctca

SEQ ID NO: 6148947 - DNA, 15 bp, Homo sapiens
ctgctgcaaggcctt

SEQ ID NO: 6148948 - DNA, 23 bp, Homo sapiens
ctgctgcaaggcctttctgtgtg

SEQ ID NO: 6148949 - DNA, 20 bp, Homo sapiens
ctgctgcaaggtggcctctg

SEQ ID NO: 6148950 - DNA, 12 bp, Homo sapiens
ctgctgcacacc

SEQ ID NO: 6148951 - DNA, 13 bp, Homo sapiens
ctgctgcacaggc

SEQ ID NO: 6148952 - DNA, 14 bp, Homo sapiens
ctgctgcacaggcc

SEQ ID NO: 6148953 - DNA, 20 bp, Homo sapiens
ctgctgcacagtagtgttgg

SEQ ID NO: 6148954 - DNA, 15 bp, Homo sapiens
ctgctgcaccaaccc

SEQ ID NO: 6148955 - DNA, 19 bp, Homo sapiens
ctgctgcaccaacccagcc

SEQ ID NO: 6148956 - DNA, 16 bp, Homo sapiens
ctgctgcaccaacctc

SEQ ID NO: 6148957 - DNA, 14 bp, Homo sapiens
ctgctgcaccagag

SEQ ID NO: 6148958 - DNA, 15 bp, Homo sapiens
ctgctgcaccagagt

SEQ ID NO: 6148959 - DNA, 17 bp, Homo sapiens
ctgctgcaccagagtga

SEQ ID NO: 6148960 - DNA, 20 bp, Homo sapiens
ctgctgcacccaactactga

SEQ ID NO: 6148961 - DNA, 22 bp, Homo sapiens
ctgctgcaccctgcgcctccag

SEQ ID NO: 6148962 - DNA, 13 bp, Homo sapiens
ctgctgcactgcc

SEQ ID NO: 6148963 - DNA, 17 bp, Homo sapiens
ctgctgcactgccctcc

SEQ ID NO: 6148964 - DNA, 14 bp, Homo sapiens
ctgctgcagagcag

SEQ ID NO: 6148965 - DNA, 22 bp, Homo sapiens
ctgctgcagaggggcaggccct

SEQ ID NO: 6148966 - DNA, 23 bp, Homo sapiens
ctgctgcagaggggcaggccctg

SEQ ID NO: 6148967 - DNA, 13 bp, Homo sapiens
ctgctgcaggggc

SEQ ID NO: 6148968 - DNA, 12 bp, Homo sapiens
ctgctgcagggt

SEQ ID NO: 6148969 - DNA, 21 bp, Homo sapiens
ctgctgcagggtctttttcta

SEQ ID NO: 6148970 - DNA, 14 bp, Homo sapiens
ctgctgcagttacc

SEQ ID NO: 6148971 - DNA, 18 bp, Homo sapiens
ctgctgcagttaccacag

SEQ ID NO: 6148972 - DNA, 14 bp, Homo sapiens
ctgctgcagttgcc

SEQ ID NO: 6148973 - DNA, 13 bp, Homo sapiens
ctgctgcatcccc

SEQ ID NO: 6148974 - DNA, 19 bp, Homo sapiens
ctgctgcatccccttccag

SEQ ID NO: 6148975 - DNA, 15 bp, Homo sapiens
ctgctgcatcgctgt

SEQ ID NO: 6148976 - DNA, 16 bp, Homo sapiens
ctgctgcatgccctct

SEQ ID NO: 6148977 - DNA, 14 bp, Homo sapiens
ctgctgccacagca

SEQ ID NO: 6148978 - DNA, 16 bp, Homo sapiens
ctgctgccacagcaag

SEQ ID NO: 6148979 - DNA, 18 bp, Homo sapiens
ctgctgccaccaaatctg

SEQ ID NO: 6148980 - DNA, 22 bp, Homo sapiens
ctgctgccaccaaatctgtcta

SEQ ID NO: 6148981 - DNA, 18 bp, Homo sapiens
ctgctgccactctgctgc

SEQ ID NO: 6148982 - DNA, 22 bp, Homo sapiens
ctgctgccactctgctgcctgt

SEQ ID NO: 6148983 - DNA, 13 bp, Homo sapiens
ctgctgccactga

SEQ ID NO: 6148984 - DNA, 22 bp, Homo sapiens
ctgctgccagaattaaagacct

SEQ ID NO: 6148985 - DNA, 23 bp, Homo sapiens
ctgctgccaggcccggcatgagg

SEQ ID NO: 6148986 - DNA, 16 bp, Homo sapiens
ctgctgccatgaactg

SEQ ID NO: 6148987 - DNA, 12 bp, Homo sapiens
ctgctgcccacg

SEQ ID NO: 6148988 - DNA, 19 bp, Homo sapiens
ctgctgcccacggccaccc

SEQ ID NO: 6148989 - DNA, 12 bp, Homo sapiens
ctgctgcccagc

SEQ ID NO: 6148990 - DNA, 19 bp, Homo sapiens
ctgctgcccaggccacagc

SEQ ID NO: 6148991 - DNA, 17 bp, Homo sapiens
ctgctgcccatgtttca

SEQ ID NO: 6148992 - DNA, 15 bp, Homo sapiens
ctgctgccccagctg

SEQ ID NO: 6148993 - DNA, 21 bp, Homo sapiens
ctgctgcccccagaccccatc

SEQ ID NO: 6148994 - DNA, 14 bp, Homo sapiens
ctgctgcccccttc

SEQ ID NO: 6148995 - DNA, 18 bp, Homo sapiens
ctgctgcccccttcccca

SEQ ID NO: 6148996 - DNA, 19 bp, Homo sapiens
ctgctgcccccttccccag

SEQ ID NO: 6148997 - DNA, 21 bp, Homo sapiens
ctgctgcccccttccccagcc

SEQ ID NO: 6148998 - DNA, 19 bp, Homo sapiens
ctgctgccccgcttcccca

SEQ ID NO: 6148999 - DNA, 22 bp, Homo sapiens
ctgctgcccctccctgcctcca

SEQ ID NO: 6149000 - DNA, 13 bp, Homo sapiens
ctgctgcccctgc

SEQ ID NO: 6149001 - DNA, 22 bp, Homo sapiens
ctgctgcccctgcacagcaggc

SEQ ID NO: 6149002 - DNA, 16 bp, Homo sapiens
ctgctgcccgtgagga

SEQ ID NO: 6149003 - DNA, 17 bp, Homo sapiens
ctgctgcccgtgaggag

SEQ ID NO: 6149004 - DNA, 17 bp, Homo sapiens
ctgctgccctccatccc

SEQ ID NO: 6149005 - DNA, 14 bp, Homo sapiens
ctgctgccctccca

SEQ ID NO: 6149006 - DNA, 22 bp, Homo sapiens
ctgctgccctcccacagcctcc

SEQ ID NO: 6149007 - DNA, 16 bp, Homo sapiens
ctgctgccctgctgtg

SEQ ID NO: 6149008 - DNA, 17 bp, Homo sapiens
ctgctgccgccactggc

SEQ ID NO: 6149009 - DNA, 19 bp, Homo sapiens
ctgctgccgccccacccag

SEQ ID NO: 6149010 - DNA, 14 bp, Homo sapiens
ctgctgccgcctcc

SEQ ID NO: 6149011 - DNA, 19 bp, Homo sapiens
ctgctgccgcctcccagcc

SEQ ID NO: 6149012 - DNA, 18 bp, Homo sapiens
ctgctgccggctctgggc

SEQ ID NO: 6149013 - DNA, 19 bp, Homo sapiens
ctgctgccggctctgggcc

SEQ ID NO: 6149014 - DNA, 22 bp, Homo sapiens
ctgctgcctaataaagagactg

SEQ ID NO: 6149015 - DNA, 14 bp, Homo sapiens
ctgctgcctcagct

SEQ ID NO: 6149016 - DNA, 19 bp, Homo sapiens
ctgctgcctcagctcagct

SEQ ID NO: 6149017 - DNA, 16 bp, Homo sapiens
ctgctgcctcaggaat

SEQ ID NO: 6149018 - DNA, 12 bp, Homo sapiens
ctgctgcctcca

SEQ ID NO: 6149019 - DNA, 15 bp, Homo sapiens
ctgctgcctccaagt

SEQ ID NO: 6149020 - DNA, 19 bp, Homo sapiens
ctgctgcctccccaaccct

SEQ ID NO: 6149021 - DNA, 17 bp, Homo sapiens
ctgctgcctccctgggg

SEQ ID NO: 6149022 - DNA, 13 bp, Homo sapiens
ctgctgcctctga

SEQ ID NO: 6149023 - DNA, 17 bp, Homo sapiens
ctgctgcctctttccct

SEQ ID NO: 6149024 - DNA, 15 bp, Homo sapiens
ctgctgcctgccggc

SEQ ID NO: 6149025 - DNA, 14 bp, Homo sapiens
ctgctgcctgctca

SEQ ID NO: 6149026 - DNA, 22 bp, Homo sapiens
ctgctgcctggagtcagtagcc

SEQ ID NO: 6149027 - DNA, 24 bp, Homo sapiens
ctgctgcctggagtcagtagccag

SEQ ID NO: 6149028 - DNA, 12 bp, Homo sapiens
ctgctgcctggc

SEQ ID NO: 6149029 - DNA, 21 bp, Homo sapiens
ctgctgcctgggtaggcccca

SEQ ID NO: 6149030 - DNA, 23 bp, Homo sapiens
ctgctgcctgggtaggccccaca

SEQ ID NO: 6149031 - DNA, 16 bp, Homo sapiens
ctgctgcctgtattct

SEQ ID NO: 6149032 - DNA, 22 bp, Homo sapiens
ctgctgcctgtttggggagggg

SEQ ID NO: 6149033 - DNA, 19 bp, Homo sapiens
ctgctgccttttctggagt

SEQ ID NO: 6149034 - DNA, 20 bp, Homo sapiens
ctgctgccttttctggagtt

SEQ ID NO: 6149035 - DNA, 15 bp, Homo sapiens
ctgctgcgctgcttg

SEQ ID NO: 6149036 - DNA, 17 bp, Homo sapiens
ctgctgcggaggagctg

SEQ ID NO: 6149037 - DNA, 15 bp, Homo sapiens
ctgctgcggctgtgg

SEQ ID NO: 6149038 - DNA, 18 bp, Homo sapiens
ctgctgcggctgtgggcg

SEQ ID NO: 6149039 - DNA, 23 bp, Homo sapiens
ctgctgcgggggagccagttctg

SEQ ID NO: 6149040 - DNA, 20 bp, Homo sapiens
ctgctgcgtcagaccagtac

SEQ ID NO: 6149041 - DNA, 16 bp, Homo sapiens
ctgctgcgtccccact

SEQ ID NO: 6149042 - DNA, 18 bp, Homo sapiens
ctgctgcgtccccactcc

SEQ ID NO: 6149043 - DNA, 18 bp, Homo sapiens
ctgctgcgtgacatgtgc

SEQ ID NO: 6149044 - DNA, 23 bp, Homo sapiens
ctgctgctaaggctctatttcct

SEQ ID NO: 6149045 - DNA, 16 bp, Homo sapiens
ctgctgctacaatgtc

SEQ ID NO: 6149046 - DNA, 13 bp, Homo sapiens
ctgctgctaccag

SEQ ID NO: 6149047 - DNA, 18 bp, Homo sapiens
ctgctgctattgctgtct

SEQ ID NO: 6149048 - DNA, 15 bp, Homo sapiens
ctgctgctcactccc

SEQ ID NO: 6149049 - DNA, 11 bp, Homo sapiens
ctgctgctcat

SEQ ID NO: 6149050 - DNA, 14 bp, Homo sapiens
ctgctgctcatcca

SEQ ID NO: 6149051 - DNA, 12 bp, Homo sapiens
ctgctgctcccc

SEQ ID NO: 6149052 - DNA, 16 bp, Homo sapiens
ctgctgctccccaccc

SEQ ID NO: 6149053 - DNA, 14 bp, Homo sapiens
ctgctgctccctca

SEQ ID NO: 6149054 - DNA, 15 bp, Homo sapiens
ctgctgctccctcag

SEQ ID NO: 6149055 - DNA, 23 bp, Homo sapiens
ctgctgctccctcagactggggc

SEQ ID NO: 6149056 - DNA, 14 bp, Homo sapiens
ctgctgctcctctc

SEQ ID NO: 6149057 - DNA, 19 bp, Homo sapiens
ctgctgctcgggaaggcct

SEQ ID NO: 6149058 - DNA, 21 bp, Homo sapiens
ctgctgctcgggaaggcctga

SEQ ID NO: 6149059 - DNA, 12 bp, Homo sapiens
ctgctgctctca

SEQ ID NO: 6149060 - DNA, 15 bp, Homo sapiens
ctgctgctctcaggc

SEQ ID NO: 6149061 - DNA, 14 bp, Homo sapiens
ctgctgctctccca

SEQ ID NO: 6149062 - DNA, 17 bp, Homo sapiens
ctgctgctctgaccttc

SEQ ID NO: 6149063 - DNA, 23 bp, Homo sapiens
ctgctgctcttggctggacccag

SEQ ID NO: 6149064 - DNA, 13 bp, Homo sapiens
ctgctgctgacat

SEQ ID NO: 6149065 - DNA, 16 bp, Homo sapiens
ctgctgctgacccctg

SEQ ID NO: 6149066 - DNA, 23 bp, Homo sapiens
ctgctgctgacccctgtgtgaca

SEQ ID NO: 6149067 - DNA, 21 bp, Homo sapiens
ctgctgctgagaacctggcct

SEQ ID NO: 6149068 - DNA, 23 bp, Homo sapiens
ctgctgctgagaacctggccttc

SEQ ID NO: 6149069 - DNA, 13 bp, Homo sapiens
ctgctgctgcccg

SEQ ID NO: 6149070 - DNA, 14 bp, Homo sapiens
ctgctgctgcctcc

SEQ ID NO: 6149071 - DNA, 18 bp, Homo sapiens
ctgctgctgcctccctgg

SEQ ID NO: 6149072 - DNA, 19 bp, Homo sapiens
ctccgttcctcctcagcct

SEQ ID NO: 6149073 - DNA, 17 bp, Homo sapiens
ctccgtttatgggcctt

SEQ ID NO: 6149074 - DNA, 21 bp, Homo sapiens
ctccgtttatgggccttgctt

SEQ ID NO: 6149075 - DNA, 22 bp, Homo sapiens
ctccgtttctaccaccgcatcc

SEQ ID NO: 6149076 - DNA, 23 bp, Homo sapiens
ctcctaaacccccgctccagatc

SEQ ID NO: 6149077 - DNA, 15 bp, Homo sapiens
ctcctaaataaacta

SEQ ID NO: 6149078 - DNA, 18 bp, Homo sapiens
ctcctaaataaattattt

SEQ ID NO: 6149079 - DNA, 11 bp, Homo sapiens
ctcctaacaaa

SEQ ID NO: 6149080 - DNA, 17 bp, Homo sapiens
ctcctaacccagcagta

SEQ ID NO: 6149081 - DNA, 20 bp, Homo sapiens
ctcctaactgccagccccct

SEQ ID NO: 6149082 - DNA, 14 bp, Homo sapiens
ctcctaagcacctg

SEQ ID NO: 6149083 - DNA, 16 bp, Homo sapiens
ctcctaagcagctggg

SEQ ID NO: 6149084 - DNA, 20 bp, Homo sapiens
ctcctaagcagctgggacta

SEQ ID NO: 6149085 - DNA, 16 bp, Homo sapiens
ctcctaagctgccagc

SEQ ID NO: 6149086 - DNA, 15 bp, Homo sapiens
ctcctaaggctcccc

SEQ ID NO: 6149087 - DNA, 22 bp, Homo sapiens
ctcctaaggggcccctccttgt

SEQ ID NO: 6149088 - DNA, 15 bp, Homo sapiens
ctcctaagtcccttc

SEQ ID NO: 6149089 - DNA, 17 bp, Homo sapiens
ctcctaagtcccttcct

SEQ ID NO: 6149090 - DNA, 20 bp, Homo sapiens
ctcctaagtcccttcctatt

SEQ ID NO: 6149091 - DNA, 14 bp, Homo sapiens
ctcctaatagcttt

SEQ ID NO: 6149092 - DNA, 21 bp, Homo sapiens
ctcctaatcaagagtctctcc

SEQ ID NO: 6149093 - DNA, 13 bp, Homo sapiens
ctcctaattattg

SEQ ID NO: 6149094 - DNA, 21 bp, Homo sapiens
ctcctaattttaaataatttc

SEQ ID NO: 6149095 - DNA, 16 bp, Homo sapiens
ctcctacacctaactc

SEQ ID NO: 6149096 - DNA, 18 bp, Homo sapiens
ctcctacagcactccacc

SEQ ID NO: 6149097 - DNA, 22 bp, Homo sapiens
ctcctacaggcgctccaggcca

SEQ ID NO: 6149098 - DNA, 15 bp, Homo sapiens
ctcctacatccagct

SEQ ID NO: 6149099 - DNA, 19 bp, Homo sapiens
ctcctacatccagctcctc

SEQ ID NO: 6149100 - DNA, 20 bp, Homo sapiens
ctcctacccaccgcccttgc

SEQ ID NO: 6149101 - DNA, 14 bp, Homo sapiens
ctcctacccctccc

SEQ ID NO: 6149102 - DNA, 19 bp, Homo sapiens
ctcctacccctcccagctg

SEQ ID NO: 6149103 - DNA, 23 bp, Homo sapiens
ctcctacccctgtcctggggctg

SEQ ID NO: 6149104 - DNA, 22 bp, Homo sapiens
ctcctaccccttcctgtcctgc

SEQ ID NO: 6149105 - DNA, 19 bp, Homo sapiens
ctcctaccctcccaccaga

SEQ ID NO: 6149106 - DNA, 22 bp, Homo sapiens
ctcctaccgaaaccttgccttt

SEQ ID NO: 6149107 - DNA, 15 bp, Homo sapiens
ctcctacctcagcct

SEQ ID NO: 6149108 - DNA, 18 bp, Homo sapiens
ctcctacctcagcctaga

SEQ ID NO: 6149109 - DNA, 13 bp, Homo sapiens
ctcctacctgaag

SEQ ID NO: 6149110 - DNA, 21 bp, Homo sapiens
ctcctacctggggactcctca

SEQ ID NO: 6149111 - DNA, 14 bp, Homo sapiens
ctcctacctggggg

SEQ ID NO: 6149112 - DNA, 17 bp, Homo sapiens
ctcctacctggtcaacc

SEQ ID NO: 6149113 - DNA, 14 bp, Homo sapiens
ctcctacctgtctg

SEQ ID NO: 6149114 - DNA, 16 bp, Homo sapiens
ctcctacctgtctgct

SEQ ID NO: 6149115 - DNA, 23 bp, Homo sapiens
ctcctacctgtctgctgccagca

SEQ ID NO: 6149116 - DNA, 13 bp, Homo sapiens
ctcctaccttaat

SEQ ID NO: 6149117 - DNA, 19 bp, Homo sapiens
ctcctacgcagatgctgtc

SEQ ID NO: 6149118 - DNA, 18 bp, Homo sapiens
ctcctacttagggaagaa

SEQ ID NO: 6149119 - DNA, 14 bp, Homo sapiens
ctcctactttacac

SEQ ID NO: 6149120 - DNA, 14 bp, Homo sapiens
ctcctactttgaaa

SEQ ID NO: 6149121 - DNA, 17 bp, Homo sapiens
ctcctacttttcatcct

SEQ ID NO: 6149122 - DNA, 12 bp, Homo sapiens
ctcctagaagaa

SEQ ID NO: 6149123 - DNA, 15 bp, Homo sapiens
ctcctagaagaacca

SEQ ID NO: 6149124 - DNA, 18 bp, Homo sapiens
ctcctagaagtcttaatt

SEQ ID NO: 6149125 - DNA, 13 bp, Homo sapiens
ctcctagacccag

SEQ ID NO: 6149126 - DNA, 17 bp, Homo sapiens
ctcctagacccaggtgg

SEQ ID NO: 6149127 - DNA, 20 bp, Homo sapiens
ctcctagagaacgcagccct

SEQ ID NO: 6149128 - DNA, 17 bp, Homo sapiens
ctcctagagacagaagc

SEQ ID NO: 6149129 - DNA, 23 bp, Homo sapiens
ctcctagagggaggggcctaggc

SEQ ID NO: 6149130 - DNA, 21 bp, Homo sapiens
ctcctagaggtgggcagctgg

SEQ ID NO: 6149131 - DNA, 22 bp, Homo sapiens
ctcctagcaaccaactttacct

SEQ ID NO: 6149132 - DNA, 21 bp, Homo sapiens
ctcctagcacaaggagtgccc

SEQ ID NO: 6149133 - DNA, 18 bp, Homo sapiens
ctcctagcaccctggaga

SEQ ID NO: 6149134 - DNA, 18 bp, Homo sapiens
ctcctagcagacagaaac

SEQ ID NO: 6149135 - DNA, 21 bp, Homo sapiens
ctcctagcagacagaaactgg

SEQ ID NO: 6149136 - DNA, 23 bp, Homo sapiens
ctcctagcagacagaaactggat

SEQ ID NO: 6149137 - DNA, 19 bp, Homo sapiens
ctcctagcccagcagagag

SEQ ID NO: 6149138 - DNA, 18 bp, Homo sapiens
ctcctagcccctctctca

SEQ ID NO: 6149139 - DNA, 14 bp, Homo sapiens
ctcctagccctcct

SEQ ID NO: 6149140 - DNA, 13 bp, Homo sapiens
ctcctagcctctc

SEQ ID NO: 6149141 - DNA, 18 bp, Homo sapiens
ctcctagcctctccgccc

SEQ ID NO: 6149142 - DNA, 20 bp, Homo sapiens
ctcctagcctctccgcccac

SEQ ID NO: 6149143 - DNA, 16 bp, Homo sapiens
ctcctagcctgctctg

SEQ ID NO: 6149144 - DNA, 22 bp, Homo sapiens
ctcctagcctgtgcctctggga

SEQ ID NO: 6149145 - DNA, 13 bp, Homo sapiens
ctcctagctggag

SEQ ID NO: 6149146 - DNA, 19 bp, Homo sapiens
ctcctaggacatgttccct

SEQ ID NO: 6149147 - DNA, 22 bp, Homo sapiens
ctcctaggacatgttcccttct

SEQ ID NO: 6149148 - DNA, 22 bp, Homo sapiens
ctcctaggacccgtctccagct

SEQ ID NO: 6149149 - DNA, 14 bp, Homo sapiens
ctcctaggagaagc

SEQ ID NO: 6149150 - DNA, 20 bp, Homo sapiens
ctcctaggagagccaacctc

SEQ ID NO: 6149151 - DNA, 19 bp, Homo sapiens
ctcctaggcattctggacc

SEQ ID NO: 6149152 - DNA, 20 bp, Homo sapiens
ctcctaggcccttggggtgg

SEQ ID NO: 6149153 - DNA, 19 bp, Homo sapiens
ctcctaggcgctcagaggc

SEQ ID NO: 6149154 - DNA, 21 bp, Homo sapiens
ctcctaggcgctcagaggccg

SEQ ID NO: 6149155 - DNA, 23 bp, Homo sapiens
ctcctaggcgctcagaggccgct

SEQ ID NO: 6149156 - DNA, 18 bp, Homo sapiens
ctcctaggctccctgagg

SEQ ID NO: 6149157 - DNA, 22 bp, Homo sapiens
ctcctaggggaacagaccagtg

SEQ ID NO: 6149158 - DNA, 22 bp, Homo sapiens
ctcctaggggcttggtcctagg

SEQ ID NO: 6149159 - DNA, 17 bp, Homo sapiens
ctcctagggggtgtcag

SEQ ID NO: 6149160 - DNA, 23 bp, Homo sapiens
ctcctaggtagccccctcttccc

SEQ ID NO: 6149161 - DNA, 17 bp, Homo sapiens
ctcctagtatgccctgt

SEQ ID NO: 6149162 - DNA, 19 bp, Homo sapiens
ctcctagtgtttctttgtg

SEQ ID NO: 6149163 - DNA, 23 bp, Homo sapiens
ctcctagtttgacctcacagtga

SEQ ID NO: 6149164 - DNA, 21 bp, Homo sapiens
ctcctataaagggcccacacc

SEQ ID NO: 6149165 - DNA, 16 bp, Homo sapiens
ctcctataatctgtca

SEQ ID NO: 6149166 - DNA, 17 bp, Homo sapiens
ctcctataatctgtcaa

SEQ ID NO: 6149167 - DNA, 12 bp, Homo sapiens
ctcctataccca

SEQ ID NO: 6149168 - DNA, 15 bp, Homo sapiens
ctcctatacccagca

SEQ ID NO: 6149169 - DNA, 16 bp, Homo sapiens
ctcctatacccagcag

SEQ ID NO: 6149170 - DNA, 19 bp, Homo sapiens
ctcctatacccagcagagg

SEQ ID NO: 6149171 - DNA, 14 bp, Homo sapiens
ctcctatatatttc

SEQ ID NO: 6149172 - DNA, 22 bp, Homo sapiens
ctcctatcagaagtttctcagc

SEQ ID NO: 6149173 - DNA, 14 bp, Homo sapiens
ctcctatctccctg

SEQ ID NO: 6149174 - DNA, 15 bp, Homo sapiens
ctcctatctccctgg

SEQ ID NO: 6149175 - DNA, 16 bp, Homo sapiens
ctcctatctccctggc

SEQ ID NO: 6149176 - DNA, 19 bp, Homo sapiens
ctcctatctccctggctca

SEQ ID NO: 6149177 - DNA, 13 bp, Homo sapiens
ctcctatctgtgt

SEQ ID NO: 6149178 - DNA, 17 bp, Homo sapiens
ctcctatcttcatatct

SEQ ID NO: 6149179 - DNA, 15 bp, Homo sapiens
ctcctatcttctcca

SEQ ID NO: 6149180 - DNA, 14 bp, Homo sapiens
ctcctatctttcct

SEQ ID NO: 6149181 - DNA, 17 bp, Homo sapiens
ctcctatgatctcaggt

SEQ ID NO: 6149182 - DNA, 19 bp, Homo sapiens
ctcctatgatctgagtcag

SEQ ID NO: 6149183 - DNA, 23 bp, Homo sapiens
ctcctatgatctgagtcagagcc

SEQ ID NO: 6149184 - DNA, 13 bp, Homo sapiens
ctcctatggtcac

SEQ ID NO: 6149185 - DNA, 17 bp, Homo sapiens
ctcctatgtggcagctg

SEQ ID NO: 6149186 - DNA, 13 bp, Homo sapiens
ctcctatgtgtaa

SEQ ID NO: 6149187 - DNA, 21 bp, Homo sapiens
ctcctatgtgtgcctcctaga

SEQ ID NO: 6149188 - DNA, 13 bp, Homo sapiens
ctcctattttaat

SEQ ID NO: 6149189 - DNA, 19 bp, Homo sapiens
ctcctattttaattggaat

SEQ ID NO: 6149190 - DNA, 17 bp, Homo sapiens
ctcctatttttcagaat

SEQ ID NO: 6149191 - DNA, 18 bp, Homo sapiens
ctcctatttttttaaaat

SEQ ID NO: 6149192 - DNA, 18 bp, Homo sapiens
ctcctcaaaccacttgcc

SEQ ID NO: 6149193 - DNA, 16 bp, Homo sapiens
ctcctcaaacccagtc

SEQ ID NO: 6149194 - DNA, 22 bp, Homo sapiens
ctcctcaaacccagtctcagac

SEQ ID NO: 6149195 - DNA, 16 bp, Homo sapiens
ctcctcaaagcctcaa

SEQ ID NO: 6149196 - DNA, 21 bp, Homo sapiens
ctcctcaacccctcccctcca

SEQ ID NO: 6149197 - DNA, 15 bp, Homo sapiens
ctcctcaagcctgtg

SEQ ID NO: 6149198 - DNA, 17 bp, Homo sapiens
ctcctcaagcctgtggg

SEQ ID NO: 6149199 - DNA, 15 bp, Homo sapiens
ctcctcaagggcaga

SEQ ID NO: 6149200 - DNA, 20 bp, Homo sapiens
ctcctcaatttttgtctcag

SEQ ID NO: 6149201 - DNA, 21 bp, Homo sapiens
ctcctcacaacatggtgtctg

SEQ ID NO: 6149202 - DNA, 15 bp, Homo sapiens
ctcctcacacaccct

SEQ ID NO: 6149203 - DNA, 15 bp, Homo sapiens
ctcctcacacagaat

SEQ ID NO: 6149204 - DNA, 16 bp, Homo sapiens
ctcctcacacttactg

SEQ ID NO: 6149205 - DNA, 14 bp, Homo sapiens
ctcctcacagacct

SEQ ID NO: 6149206 - DNA, 22 bp, Homo sapiens
ctcctcacagacctctgcttgg

SEQ ID NO: 6149207 - DNA, 17 bp, Homo sapiens
ctcctcacccagggccc

SEQ ID NO: 6149208 - DNA, 16 bp, Homo sapiens
ctcctcaccccagtgc

SEQ ID NO: 6149209 - DNA, 18 bp, Homo sapiens
ctcctcaccccagtgcct

SEQ ID NO: 6149210 - DNA, 22 bp, Homo sapiens
ctcctcaccccagtgcctgtct

SEQ ID NO: 6149211 - DNA, 13 bp, Homo sapiens
ctcctcaccccca

SEQ ID NO: 6149212 - DNA, 14 bp, Homo sapiens
ctcctcacccccac

SEQ ID NO: 6149213 - DNA, 18 bp, Homo sapiens
ctcctcacccccacccct

SEQ ID NO: 6149214 - DNA, 20 bp, Homo sapiens
ctcctcacccccacccctgt

SEQ ID NO: 6149215 - DNA, 21 bp, Homo sapiens
ctcctcacccccagctttgct

SEQ ID NO: 6149216 - DNA, 15 bp, Homo sapiens
ctcctcacccttccc

SEQ ID NO: 6149217 - DNA, 12 bp, Homo sapiens
ctcctcacctca

SEQ ID NO: 6149218 - DNA, 14 bp, Homo sapiens
ctcctcacctcatg

SEQ ID NO: 6149219 - DNA, 15 bp, Homo sapiens
ctcctcacctcatgc

SEQ ID NO: 6149220 - DNA, 17 bp, Homo sapiens
ctcctcacctcatgccc

SEQ ID NO: 6149221 - DNA, 14 bp, Homo sapiens
ctcctcacctctgg

SEQ ID NO: 6149222 - DNA, 16 bp, Homo sapiens
ctcctcacctctggac

SEQ ID NO: 6149223 - DNA, 22 bp, Homo sapiens
ctcctcacctctggactggcta

SEQ ID NO: 6149224 - DNA, 15 bp, Homo sapiens
ctcctcacctgtcta

SEQ ID NO: 6149225 - DNA, 15 bp, Homo sapiens
ctcctcactccctag

SEQ ID NO: 6149226 - DNA, 17 bp, Homo sapiens
ctcctcactctgtccct

SEQ ID NO: 6149227 - DNA, 15 bp, Homo sapiens
ctcctcactgccact

SEQ ID NO: 6149228 - DNA, 16 bp, Homo sapiens
ctcctcactgccacta

SEQ ID NO: 6149229 - DNA, 15 bp, Homo sapiens
ctcctcactgcccca

SEQ ID NO: 6149230 - DNA, 19 bp, Homo sapiens
ctcctcactgccccaccag

SEQ ID NO: 6149231 - DNA, 17 bp, Homo sapiens
ctcctcactgcccgcac

SEQ ID NO: 6149232 - DNA, 18 bp, Homo sapiens
ctcctcactgcccgcaca

SEQ ID NO: 6149233 - DNA, 16 bp, Homo sapiens
ctcctcactggaggag

SEQ ID NO: 6149234 - DNA, 20 bp, Homo sapiens
ctcctcactggccatccctc

SEQ ID NO: 6149235 - DNA, 14 bp, Homo sapiens
ctcctcactgtatc

SEQ ID NO: 6149236 - DNA, 19 bp, Homo sapiens
ctcctcactgtatccaggt

SEQ ID NO: 6149237 - DNA, 23 bp, Homo sapiens
ctcctcacttggctgtctgacca

SEQ ID NO: 6149238 - DNA, 15 bp, Homo sapiens
ctcctcagcacccct

SEQ ID NO: 6149239 - DNA, 11 bp, Homo sapiens
ctcctcagcca

SEQ ID NO: 6149240 - DNA, 14 bp, Homo sapiens
ctcctcagccccca

SEQ ID NO: 6149241 - DNA, 19 bp, Homo sapiens
ctcctcagcccccaggcca

SEQ ID NO: 6149242 - DNA, 16 bp, Homo sapiens
ctcctcagccctctct

SEQ ID NO: 6149243 - DNA, 21 bp, Homo sapiens
ctcctcagccctctcttgcca

SEQ ID NO: 6149244 - DNA, 22 bp, Homo sapiens
ctcctcagccctctcttgccaa

SEQ ID NO: 6149245 - DNA, 11 bp, Homo sapiens
ctcctcagcct

SEQ ID NO: 6149246 - DNA, 16 bp, Homo sapiens
ctcctcagcctccctt

SEQ ID NO: 6149247 - DNA, 15 bp, Homo sapiens
ctcctcagcctctgc

SEQ ID NO: 6149248 - DNA, 17 bp, Homo sapiens
ctcctcagcctctgcaa

SEQ ID NO: 6149249 - DNA, 13 bp, Homo sapiens
ctcctcagcctga

SEQ ID NO: 6149250 - DNA, 15 bp, Homo sapiens
ctgctgctgcctggc

SEQ ID NO: 6149251 - DNA, 13 bp, Homo sapiens
ctgctgctgctca

SEQ ID NO: 6149252 - DNA, 14 bp, Homo sapiens
ctgctgctgctcct

SEQ ID NO: 6149253 - DNA, 16 bp, Homo sapiens
ctgctgctgctgccgc

SEQ ID NO: 6149254 - DNA, 16 bp, Homo sapiens
ctgctgctgctgcgcc

SEQ ID NO: 6149255 - DNA, 12 bp, Homo sapiens
ctgctgctggct

SEQ ID NO: 6149256 - DNA, 15 bp, Homo sapiens
ctgctgctggctggt

SEQ ID NO: 6149257 - DNA, 20 bp, Homo sapiens
ctgctgctgtaactgctgag

SEQ ID NO: 6149258 - DNA, 15 bp, Homo sapiens
ctgctgctgtcacct

SEQ ID NO: 6149259 - DNA, 16 bp, Homo sapiens
ctgctgctgtctgggt

SEQ ID NO: 6149260 - DNA, 17 bp, Homo sapiens
ctgctgctgtctgggtg

SEQ ID NO: 6149261 - DNA, 13 bp, Homo sapiens
ctgctgctgtgct

SEQ ID NO: 6149262 - DNA, 15 bp, Homo sapiens
ctgctgcttaaaatg

SEQ ID NO: 6149263 - DNA, 21 bp, Homo sapiens
ctgctgcttaagtgcatgcat

SEQ ID NO: 6149264 - DNA, 17 bp, Homo sapiens
ctgctgcttcatgtttg

SEQ ID NO: 6149265 - DNA, 15 bp, Homo sapiens
ctgctgcttctgctc

SEQ ID NO: 6149266 - DNA, 15 bp, Homo sapiens
ctgctgcttctgggc

SEQ ID NO: 6149267 - DNA, 20 bp, Homo sapiens
ctgctgcttctgggcctgat

SEQ ID NO: 6149268 - DNA, 12 bp, Homo sapiens
ctgctgcttctt

SEQ ID NO: 6149269 - DNA, 13 bp, Homo sapiens
ctgctgcttcttg

SEQ ID NO: 6149270 - DNA, 19 bp, Homo sapiens
ctgctgcttggagtgcccc

SEQ ID NO: 6149271 - DNA, 20 bp, Homo sapiens
ctgctgctttgggctgggat

SEQ ID NO: 6149272 - DNA, 14 bp, Homo sapiens
ctgctggaaaccac

SEQ ID NO: 6149273 - DNA, 22 bp, Homo sapiens
ctgctggaagaactgcatgggg

SEQ ID NO: 6149274 - DNA, 13 bp, Homo sapiens
ctgctggaagccc

SEQ ID NO: 6149275 - DNA, 16 bp, Homo sapiens
ctgctggaagcccagc

SEQ ID NO: 6149276 - DNA, 22 bp, Homo sapiens
ctgctggaagctgtcaggctgg

SEQ ID NO: 6149277 - DNA, 17 bp, Homo sapiens
ctgctggaaggggcagc

SEQ ID NO: 6149278 - DNA, 20 bp, Homo sapiens
ctgctggaaggggcagcagg

SEQ ID NO: 6149279 - DNA, 19 bp, Homo sapiens
ctgctggaccaaggtgcgg

SEQ ID NO: 6149280 - DNA, 19 bp, Homo sapiens
ctgctggagaaaccttcac

SEQ ID NO: 6149281 - DNA, 22 bp, Homo sapiens
ctgctggagaaaccttcactcc

SEQ ID NO: 6149282 - DNA, 23 bp, Homo sapiens
ctgctggagaaaccttcactcca

SEQ ID NO: 6149283 - DNA, 16 bp, Homo sapiens
ctgctggagaaagcca

SEQ ID NO: 6149284 - DNA, 18 bp, Homo sapiens
ctgctggagaggccccag

SEQ ID NO: 6149285 - DNA, 19 bp, Homo sapiens
ctgctggagaggccccagc

SEQ ID NO: 6149286 - DNA, 21 bp, Homo sapiens
ctgctggagaggccccagccg

SEQ ID NO: 6149287 - DNA, 23 bp, Homo sapiens
ctgctggaggaggggaagctggg

SEQ ID NO: 6149288 - DNA, 19 bp, Homo sapiens
ctgctggagtccagtgctt

SEQ ID NO: 6149289 - DNA, 20 bp, Homo sapiens
ctgctggagtctggctttac

SEQ ID NO: 6149290 - DNA, 13 bp, Homo sapiens
ctgctggatgact

SEQ ID NO: 6149291 - DNA, 19 bp, Homo sapiens
ctgctggatgacttgagat

SEQ ID NO: 6149292 - DNA, 16 bp, Homo sapiens
ctgctggatgggactc

SEQ ID NO: 6149293 - DNA, 19 bp, Homo sapiens
ctgctggattcaagtgatc

SEQ ID NO: 6149294 - DNA, 16 bp, Homo sapiens
ctgctggcacccaccg

SEQ ID NO: 6149295 - DNA, 22 bp, Homo sapiens
ctgctggcaggattcttcccgc

SEQ ID NO: 6149296 - DNA, 12 bp, Homo sapiens
ctgctggcaggg

SEQ ID NO: 6149297 - DNA, 13 bp, Homo sapiens
ctgctggcagggc

SEQ ID NO: 6149298 - DNA, 19 bp, Homo sapiens
ctgctggcagggccagggc

SEQ ID NO: 6149299 - DNA, 15 bp, Homo sapiens
ctgctggcatcaggt

SEQ ID NO: 6149300 - DNA, 16 bp, Homo sapiens
ctgctggccaaagtca

SEQ ID NO: 6149301 - DNA, 11 bp, Homo sapiens
ctgctggccat

SEQ ID NO: 6149302 - DNA, 22 bp, Homo sapiens
ctgctggccatgaatctctgcc

SEQ ID NO: 6149303 - DNA, 23 bp, Homo sapiens
ctgctggccatgaatctctgcct

SEQ ID NO: 6149304 - DNA, 16 bp, Homo sapiens
ctgctggcccacagct

SEQ ID NO: 6149305 - DNA, 20 bp, Homo sapiens
ctgctggcccacagctctgc

SEQ ID NO: 6149306 - DNA, 21 bp, Homo sapiens
ctgctggcccacagctctgct

SEQ ID NO: 6149307 - DNA, 15 bp, Homo sapiens
ctgctggcccagcca

SEQ ID NO: 6149308 - DNA, 22 bp, Homo sapiens
ctgctggcccagccaaaccctg

SEQ ID NO: 6149309 - DNA, 21 bp, Homo sapiens
ctgctggccccgcccctgccc

SEQ ID NO: 6149310 - DNA, 14 bp, Homo sapiens
ctgctggcccctca

SEQ ID NO: 6149311 - DNA, 17 bp, Homo sapiens
ctgctggcccctcacct

SEQ ID NO: 6149312 - DNA, 13 bp, Homo sapiens
ctgctggccgcct

SEQ ID NO: 6149313 - DNA, 18 bp, Homo sapiens
ctgctggccgcctcaccc

SEQ ID NO: 6149314 - DNA, 15 bp, Homo sapiens
ctgctggccggagca

SEQ ID NO: 6149315 - DNA, 17 bp, Homo sapiens
ctgctggccgggcacag

SEQ ID NO: 6149316 - DNA, 23 bp, Homo sapiens
ctgctggcctgctcttacttccc

SEQ ID NO: 6149317 - DNA, 16 bp, Homo sapiens
ctgctggcctggatct

SEQ ID NO: 6149318 - DNA, 17 bp, Homo sapiens
ctgctggcctggccctt

SEQ ID NO: 6149319 - DNA, 20 bp, Homo sapiens
ctgctggcctggccggcaac

SEQ ID NO: 6149320 - DNA, 17 bp, Homo sapiens
ctgctggcgcctctgca

SEQ ID NO: 6149321 - DNA, 20 bp, Homo sapiens
ctgctggcgcctctgcaagg

SEQ ID NO: 6149322 - DNA, 13 bp, Homo sapiens
ctgctggctcagg

SEQ ID NO: 6149323 - DNA, 14 bp, Homo sapiens
ctgctggctcagga

SEQ ID NO: 6149324 - DNA, 12 bp, Homo sapiens
ctgctggctccc

SEQ ID NO: 6149325 - DNA, 17 bp, Homo sapiens
ctgctggctcccatctc

SEQ ID NO: 6149326 - DNA, 12 bp, Homo sapiens
ctgctggctctt

SEQ ID NO: 6149327 - DNA, 16 bp, Homo sapiens
ctgctggctgacctgg

SEQ ID NO: 6149328 - DNA, 11 bp, Homo sapiens
ctgctggctgc

SEQ ID NO: 6149329 - DNA, 13 bp, Homo sapiens
ctgctggctgcct

SEQ ID NO: 6149330 - DNA, 14 bp, Homo sapiens
ctgctggctgcggc

SEQ ID NO: 6149331 - DNA, 21 bp, Homo sapiens
ctgctggctggtgcctgagcc

SEQ ID NO: 6149332 - DNA, 22 bp, Homo sapiens
ctgctggctggtgcctgagccc

SEQ ID NO: 6149333 - DNA, 16 bp, Homo sapiens
ctgctggctgtgacaa

SEQ ID NO: 6149334 - DNA, 17 bp, Homo sapiens
ctgctggcttcagggag

SEQ ID NO: 6149335 - DNA, 11 bp, Homo sapiens
ctgctgggaac

SEQ ID NO: 6149336 - DNA, 19 bp, Homo sapiens
ctgctgggaaccccgcagc

SEQ ID NO: 6149337 - DNA, 22 bp, Homo sapiens
ctgctgggaaccccgcagcccg

SEQ ID NO: 6149338 - DNA, 23 bp, Homo sapiens
ctgctgggaacctagcacacctg

SEQ ID NO: 6149339 - DNA, 19 bp, Homo sapiens
ctgctgggaccccagctag

SEQ ID NO: 6149340 - DNA, 21 bp, Homo sapiens
ctgctgggacgatcgcccagg

SEQ ID NO: 6149341 - DNA, 12 bp, Homo sapiens
ctgctgggactc

SEQ ID NO: 6149342 - DNA, 15 bp, Homo sapiens
ctgctgggagcagaa

SEQ ID NO: 6149343 - DNA, 19 bp, Homo sapiens
ctgctgggagcagaacagt

SEQ ID NO: 6149344 - DNA, 22 bp, Homo sapiens
ctgctgggaggttaaaaagaaa

SEQ ID NO: 6149345 - DNA, 19 bp, Homo sapiens
ctgctgggagttctagaac

SEQ ID NO: 6149346 - DNA, 19 bp, Homo sapiens
ctgctgggatggtgggctt

SEQ ID NO: 6149347 - DNA, 23 bp, Homo sapiens
ctgctgggatggtgggcttcagg

SEQ ID NO: 6149348 - DNA, 11 bp, Homo sapiens
ctgctgggcca

SEQ ID NO: 6149349 - DNA, 13 bp, Homo sapiens
ctgctgggccagt

SEQ ID NO: 6149350 - DNA, 14 bp, Homo sapiens
ctgctgggccagtg

SEQ ID NO: 6149351 - DNA, 19 bp, Homo sapiens
ctgctgggccagtggcact

SEQ ID NO: 6149352 - DNA, 21 bp, Homo sapiens
ctgctgggccccatctccaca

SEQ ID NO: 6149353 - DNA, 13 bp, Homo sapiens
ctgctgggcgtct

SEQ ID NO: 6149354 - DNA, 19 bp, Homo sapiens
ctgctgggcgtgtgtgaca

SEQ ID NO: 6149355 - DNA, 16 bp, Homo sapiens
ctgctgggctcccccc

SEQ ID NO: 6149356 - DNA, 21 bp, Homo sapiens
ctgctgggctccccccagtgg

SEQ ID NO: 6149357 - DNA, 14 bp, Homo sapiens
ctgctgggctctcc

SEQ ID NO: 6149358 - DNA, 13 bp, Homo sapiens
ctgctgggctctt

SEQ ID NO: 6149359 - DNA, 14 bp, Homo sapiens
ctgctgggctgagt

SEQ ID NO: 6149360 - DNA, 18 bp, Homo sapiens
ctgctgggctgagtgaca

SEQ ID NO: 6149361 - DNA, 17 bp, Homo sapiens
ctgctgggctggggcct

SEQ ID NO: 6149362 - DNA, 11 bp, Homo sapiens
ctgctgggctt

SEQ ID NO: 6149363 - DNA, 16 bp, Homo sapiens
ctgctgggcttcctgt

SEQ ID NO: 6149364 - DNA, 14 bp, Homo sapiens
ctgctggggaagac

SEQ ID NO: 6149365 - DNA, 21 bp, Homo sapiens
ctgctggggaagacagtggcc

SEQ ID NO: 6149366 - DNA, 22 bp, Homo sapiens
ctgctggggaagacagtggccc

SEQ ID NO: 6149367 - DNA, 16 bp, Homo sapiens
ctgctggggagacaaa

SEQ ID NO: 6149368 - DNA, 13 bp, Homo sapiens
ctgctggggatcc

SEQ ID NO: 6149369 - DNA, 19 bp, Homo sapiens
ctgctggggcagggcccag

SEQ ID NO: 6149370 - DNA, 12 bp, Homo sapiens
ctgctggggcat

SEQ ID NO: 6149371 - DNA, 18 bp, Homo sapiens
ctgctggggcatgtgtgc

SEQ ID NO: 6149372 - DNA, 19 bp, Homo sapiens
ctgctggggcatgtgtgcc

SEQ ID NO: 6149373 - DNA, 22 bp, Homo sapiens
ctgctggggcatgtgtgcctgt

SEQ ID NO: 6149374 - DNA, 17 bp, Homo sapiens
ctgctggggcctcagac

SEQ ID NO: 6149375 - DNA, 14 bp, Homo sapiens
ctgctggggcctgg

SEQ ID NO: 6149376 - DNA, 17 bp, Homo sapiens
ctgctggggcctgggac

SEQ ID NO: 6149377 - DNA, 19 bp, Homo sapiens
ctgctggggcctgggacaa

SEQ ID NO: 6149378 - DNA, 17 bp, Homo sapiens
ctgctggggctgaacat

SEQ ID NO: 6149379 - DNA, 18 bp, Homo sapiens
ctgctggggctgcaagct

SEQ ID NO: 6149380 - DNA, 18 bp, Homo sapiens
ctgctgggggcaactggc

SEQ ID NO: 6149381 - DNA, 17 bp, Homo sapiens
ctgctgggggctcccct

SEQ ID NO: 6149382 - DNA, 23 bp, Homo sapiens
ctgctgggggctccccttgccct

SEQ ID NO: 6149383 - DNA, 12 bp, Homo sapiens
ctgctgggtggc

SEQ ID NO: 6149384 - DNA, 21 bp, Homo sapiens
ctgctgggtggcccatccccc

SEQ ID NO: 6149385 - DNA, 15 bp, Homo sapiens
ctgctgggtgtggcg

SEQ ID NO: 6149386 - DNA, 20 bp, Homo sapiens
ctgctgggtttccacacagc

SEQ ID NO: 6149387 - DNA, 19 bp, Homo sapiens
ctgctgggttttcctccgg

SEQ ID NO: 6149388 - DNA, 17 bp, Homo sapiens
ctgctggtaaaataatg

SEQ ID NO: 6149389 - DNA, 22 bp, Homo sapiens
ctgctggtaatttgtatctgaa

SEQ ID NO: 6149390 - DNA, 15 bp, Homo sapiens
ctgctggtacctgcc

SEQ ID NO: 6149391 - DNA, 21 bp, Homo sapiens
ctgctggtacctgccctctat

SEQ ID NO: 6149392 - DNA, 14 bp, Homo sapiens
ctgctggtatttct

SEQ ID NO: 6149393 - DNA, 17 bp, Homo sapiens
ctgctggtcacttcttc

SEQ ID NO: 6149394 - DNA, 17 bp, Homo sapiens
ctgctggtctctggctc

SEQ ID NO: 6149395 - DNA, 18 bp, Homo sapiens
ctgctggtctctggctct

SEQ ID NO: 6149396 - DNA, 19 bp, Homo sapiens
ctgctggtctctggctcta

SEQ ID NO: 6149397 - DNA, 17 bp, Homo sapiens
ctgctggtcttatcctg

SEQ ID NO: 6149398 - DNA, 22 bp, Homo sapiens
ctgctggtgattttttttttct

SEQ ID NO: 6149399 - DNA, 22 bp, Homo sapiens
ctgctggtgcagagctgaagat

SEQ ID NO: 6149400 - DNA, 13 bp, Homo sapiens
ctgctggtgccag

SEQ ID NO: 6149401 - DNA, 12 bp, Homo sapiens
ctgctggtgccc

SEQ ID NO: 6149402 - DNA, 13 bp, Homo sapiens
ctgctggtgccca

SEQ ID NO: 6149403 - DNA, 15 bp, Homo sapiens
ctgctggtgcccacc

SEQ ID NO: 6149404 - DNA, 16 bp, Homo sapiens
ctgctggtgcccaccc

SEQ ID NO: 6149405 - DNA, 13 bp, Homo sapiens
ctgctggtggggc

SEQ ID NO: 6149406 - DNA, 17 bp, Homo sapiens
ctgctggtggggcagac

SEQ ID NO: 6149407 - DNA, 15 bp, Homo sapiens
ctgctggtgtttatg

SEQ ID NO: 6149408 - DNA, 21 bp, Homo sapiens
ctgctggttaacttgtttggc

SEQ ID NO: 6149409 - DNA, 13 bp, Homo sapiens
ctgctggttcagg

SEQ ID NO: 6149410 - DNA, 18 bp, Homo sapiens
ctgctggttgttgccagg

SEQ ID NO: 6149411 - DNA, 20 bp, Homo sapiens
ctgctggttttggtttccac

SEQ ID NO: 6149412 - DNA, 13 bp, Homo sapiens
ctgctgtaaagca

SEQ ID NO: 6149413 - DNA, 20 bp, Homo sapiens
ctgctgtaaagcaaaatatt

SEQ ID NO: 6149414 - DNA, 20 bp, Homo sapiens
ctgctgtaaatacaggaaga

SEQ ID NO: 6149415 - DNA, 17 bp, Homo sapiens
ctgctgtaaatttggct

SEQ ID NO: 6149416 - DNA, 20 bp, Homo sapiens
ctgctgtaactgctgagcca

SEQ ID NO: 6149417 - DNA, 21 bp, Homo sapiens
ctgctgtaagacggccttgga

SEQ ID NO: 6149418 - DNA, 22 bp, Homo sapiens
ctgctgtacaagatgtagcacc

SEQ ID NO: 6149419 - DNA, 20 bp, Homo sapiens
ctgctgtacccagatgccta

SEQ ID NO: 6149420 - DNA, 23 bp, Homo sapiens
ctgctgtacccagatgcctacaa

SEQ ID NO: 6149421 - DNA, 13 bp, Homo sapiens
ctgctgtactgaa

SEQ ID NO: 6149422 - DNA, 14 bp, Homo sapiens
ctgctgtactgaag

SEQ ID NO: 6149423 - DNA, 21 bp, Homo sapiens
ctgctgtatgaatagctgtgt

SEQ ID NO: 6149424 - DNA, 15 bp, Homo sapiens
ctgctgtatttatag

SEQ ID NO: 6149425 - DNA, 16 bp, Homo sapiens
ctgctgtatttatagt

SEQ ID NO: 6149426 - DNA, 21 bp, Homo sapiens
ctgctgtatttgaggaaactc

SEQ ID NO: 6149427 - DNA, 18 bp, Homo sapiens
ctgctgtcaataaatgac

SEQ ID NO: 6149428 - DNA, 19 bp, Homo sapiens
ctgctgtcaataaatgaca

SEQ ID NO: 6149429 - DNA, 20 bp, Homo sapiens
ctcctcagcgagaggcagca

SEQ ID NO: 6149430 - DNA, 12 bp, Homo sapiens
ctcctcagctcc

SEQ ID NO: 6149431 - DNA, 15 bp, Homo sapiens
ctcctcagctgcatg

SEQ ID NO: 6149432 - DNA, 16 bp, Homo sapiens
ctcctcagctgcatgg

SEQ ID NO: 6149433 - DNA, 16 bp, Homo sapiens
ctcctcagctttgctt

SEQ ID NO: 6149434 - DNA, 16 bp, Homo sapiens
ctcctcaggaacagaa

SEQ ID NO: 6149435 - DNA, 18 bp, Homo sapiens
ctcctcaggaacagaaca

SEQ ID NO: 6149436 - DNA, 13 bp, Homo sapiens
ctcctcaggacaa

SEQ ID NO: 6149437 - DNA, 13 bp, Homo sapiens
ctcctcaggacca

SEQ ID NO: 6149438 - DNA, 14 bp, Homo sapiens
ctcctcaggaccct

SEQ ID NO: 6149439 - DNA, 17 bp, Homo sapiens
ctcctcaggaccctcag

SEQ ID NO: 6149440 - DNA, 11 bp, Homo sapiens
ctcctcagggt

SEQ ID NO: 6149441 - DNA, 20 bp, Homo sapiens
ctcctcagggtccctcagga

SEQ ID NO: 6149442 - DNA, 13 bp, Homo sapiens
ctcctcagggtgg

SEQ ID NO: 6149443 - DNA, 14 bp, Homo sapiens
ctcctcagggtggg

SEQ ID NO: 6149444 - DNA, 16 bp, Homo sapiens
ctcctcagggtggggg

SEQ ID NO: 6149445 - DNA, 19 bp, Homo sapiens
ctcctcagtaaaagtcttc

SEQ ID NO: 6149446 - DNA, 21 bp, Homo sapiens
ctcctcagtatgtgggggctt

SEQ ID NO: 6149447 - DNA, 21 bp, Homo sapiens
ctcctcagtccctcttctggt

SEQ ID NO: 6149448 - DNA, 21 bp, Homo sapiens
ctcctcagtctttgggggatt

SEQ ID NO: 6149449 - DNA, 17 bp, Homo sapiens
ctcctcagtggcttctc

SEQ ID NO: 6149450 - DNA, 13 bp, Homo sapiens
ctcctcatctcca

SEQ ID NO: 6149451 - DNA, 19 bp, Homo sapiens
ctcctcatctgcctggaaa

SEQ ID NO: 6149452 - DNA, 11 bp, Homo sapiens
ctcctcatggg

SEQ ID NO: 6149453 - DNA, 11 bp, Homo sapiens
ctcctcatgta

SEQ ID NO: 6149454 - DNA, 18 bp, Homo sapiens
ctcctcattcacatcgca

SEQ ID NO: 6149455 - DNA, 21 bp, Homo sapiens
ctcctcatttaatatttttca

SEQ ID NO: 6149456 - DNA, 13 bp, Homo sapiens
ctcctccaaatgc

SEQ ID NO: 6149457 - DNA, 17 bp, Homo sapiens
ctcctccaatgtcctga

SEQ ID NO: 6149458 - DNA, 15 bp, Homo sapiens
ctcctccacagtgct

SEQ ID NO: 6149459 - DNA, 16 bp, Homo sapiens
ctcctccacagtgctg

SEQ ID NO: 6149460 - DNA, 20 bp, Homo sapiens
ctcctccacccacccccttt

SEQ ID NO: 6149461 - DNA, 15 bp, Homo sapiens
ctcctccaccgccat

SEQ ID NO: 6149462 - DNA, 19 bp, Homo sapiens
ctcctccaccgccatggct

SEQ ID NO: 6149463 - DNA, 12 bp, Homo sapiens
ctcctccactca

SEQ ID NO: 6149464 - DNA, 13 bp, Homo sapiens
ctcctccactcac

SEQ ID NO: 6149465 - DNA, 16 bp, Homo sapiens
ctcctccactccacct

SEQ ID NO: 6149466 - DNA, 14 bp, Homo sapiens
ctcctccagactcg

SEQ ID NO: 6149467 - DNA, 13 bp, Homo sapiens
ctcctccagagcc

SEQ ID NO: 6149468 - DNA, 13 bp, Homo sapiens
ctcctccagagtc

SEQ ID NO: 6149469 - DNA, 15 bp, Homo sapiens
ctcctccagcccctg

SEQ ID NO: 6149470 - DNA, 13 bp, Homo sapiens
ctcctccagccct

SEQ ID NO: 6149471 - DNA, 15 bp, Homo sapiens
ctcctccagcccttc

SEQ ID NO: 6149472 - DNA, 21 bp, Homo sapiens
ctcctccagcccttcagacga

SEQ ID NO: 6149473 - DNA, 19 bp, Homo sapiens
ctcctccagccgctggcaa

SEQ ID NO: 6149474 - DNA, 14 bp, Homo sapiens
ctcctccagctcct

SEQ ID NO: 6149475 - DNA, 17 bp, Homo sapiens
ctcctccagctcctgcc

SEQ ID NO: 6149476 - DNA, 15 bp, Homo sapiens
ctcctccaggaagcc

SEQ ID NO: 6149477 - DNA, 17 bp, Homo sapiens
ctcctccaggcctgcct

SEQ ID NO: 6149478 - DNA, 14 bp, Homo sapiens
ctcctccagggaag

SEQ ID NO: 6149479 - DNA, 20 bp, Homo sapiens
ctcctccagggccacgtgcc

SEQ ID NO: 6149480 - DNA, 22 bp, Homo sapiens
ctcctccagggccacgtgccag

SEQ ID NO: 6149481 - DNA, 21 bp, Homo sapiens
ctcctccagggtggcagcaac

SEQ ID NO: 6149482 - DNA, 22 bp, Homo sapiens
ctcctccagggtggcagcaaca

SEQ ID NO: 6149483 - DNA, 22 bp, Homo sapiens
ctcctccagtacgtcccgctgc

SEQ ID NO: 6149484 - DNA, 15 bp, Homo sapiens
ctcctccatcacctg

SEQ ID NO: 6149485 - DNA, 19 bp, Homo sapiens
ctcctccatccatgtgttc

SEQ ID NO: 6149486 - DNA, 16 bp, Homo sapiens
ctcctccatgctgtcc

SEQ ID NO: 6149487 - DNA, 15 bp, Homo sapiens
ctcctccattttcct

SEQ ID NO: 6149488 - DNA, 21 bp, Homo sapiens
ctcctcccaacagttttacct

SEQ ID NO: 6149489 - DNA, 20 bp, Homo sapiens
ctcctcccacaatctgggac

SEQ ID NO: 6149490 - DNA, 16 bp, Homo sapiens
ctcctcccaccaccct

SEQ ID NO: 6149491 - DNA, 23 bp, Homo sapiens
ctcctcccaccaccctcccacca

SEQ ID NO: 6149492 - DNA, 12 bp, Homo sapiens
ctcctcccaccc

SEQ ID NO: 6149493 - DNA, 22 bp, Homo sapiens
ctcctcccacccggctgcagag

SEQ ID NO: 6149494 - DNA, 14 bp, Homo sapiens
ctcctcccactgcc

SEQ ID NO: 6149495 - DNA, 15 bp, Homo sapiens
ctcctcccactgccc

SEQ ID NO: 6149496 - DNA, 18 bp, Homo sapiens
ctcctcccactgcccact

SEQ ID NO: 6149497 - DNA, 13 bp, Homo sapiens
ctcctcccactgg

SEQ ID NO: 6149498 - DNA, 14 bp, Homo sapiens
ctcctcccactggg

SEQ ID NO: 6149499 - DNA, 17 bp, Homo sapiens
ctcctcccactgggact

SEQ ID NO: 6149500 - DNA, 16 bp, Homo sapiens
ctcctcccagatggct

SEQ ID NO: 6149501 - DNA, 14 bp, Homo sapiens
ctcctcccagcaca

SEQ ID NO: 6149502 - DNA, 14 bp, Homo sapiens
ctcctcccagcggc

SEQ ID NO: 6149503 - DNA, 13 bp, Homo sapiens
ctcctcccagcgt

SEQ ID NO: 6149504 - DNA, 15 bp, Homo sapiens
ctcctcccagcgtgt

SEQ ID NO: 6149505 - DNA, 16 bp, Homo sapiens
ctcctcccagcgtgtg

SEQ ID NO: 6149506 - DNA, 12 bp, Homo sapiens
ctcctcccagct

SEQ ID NO: 6149507 - DNA, 21 bp, Homo sapiens
ctcctcccagctgtaccggcc

SEQ ID NO: 6149508 - DNA, 11 bp, Homo sapiens
ctcctcccagg

SEQ ID NO: 6149509 - DNA, 17 bp, Homo sapiens
ctcctcccaggcgcccc

SEQ ID NO: 6149510 - DNA, 13 bp, Homo sapiens
ctcctcccagggc

SEQ ID NO: 6149511 - DNA, 21 bp, Homo sapiens
ctcctcccaggtttcttctct

SEQ ID NO: 6149512 - DNA, 16 bp, Homo sapiens
ctcctcccagtgcctt

SEQ ID NO: 6149513 - DNA, 17 bp, Homo sapiens
ctcctcccagtgccttc

SEQ ID NO: 6149514 - DNA, 19 bp, Homo sapiens
ctcctcccagtgccttctg

SEQ ID NO: 6149515 - DNA, 15 bp, Homo sapiens
ctcctcccatggcct

SEQ ID NO: 6149516 - DNA, 15 bp, Homo sapiens
ctcctcccattcccc

SEQ ID NO: 6149517 - DNA, 19 bp, Homo sapiens
ctcctccccaactgtgggg

SEQ ID NO: 6149518 - DNA, 18 bp, Homo sapiens
ctcctccccaccctcctg

SEQ ID NO: 6149519 - DNA, 20 bp, Homo sapiens
ctcctccccaccctcctggc

SEQ ID NO: 6149520 - DNA, 14 bp, Homo sapiens
ctcctccccacctg

SEQ ID NO: 6149521 - DNA, 15 bp, Homo sapiens
ctcctccccacctgt

SEQ ID NO: 6149522 - DNA, 17 bp, Homo sapiens
ctcctccccagctcttc

SEQ ID NO: 6149523 - DNA, 10 bp, Homo sapiens
ctcctccccc

SEQ ID NO: 6149524 - DNA, 13 bp, Homo sapiens
ctcctcccccacc

SEQ ID NO: 6149525 - DNA, 12 bp, Homo sapiens
ctcctcccccag

SEQ ID NO: 6149526 - DNA, 14 bp, Homo sapiens
ctcctcccccagtg

SEQ ID NO: 6149527 - DNA, 21 bp, Homo sapiens
ctcctcccccctcctctgaaa

SEQ ID NO: 6149528 - DNA, 22 bp, Homo sapiens
ctcctcccccctcctctgaaac

SEQ ID NO: 6149529 - DNA, 14 bp, Homo sapiens
ctcctcccccggct

SEQ ID NO: 6149530 - DNA, 20 bp, Homo sapiens
ctcctcccccggctgggcct

SEQ ID NO: 6149531 - DNA, 21 bp, Homo sapiens
ctcctcccccggctgggcctc

SEQ ID NO: 6149532 - DNA, 12 bp, Homo sapiens
ctcctccccctc

SEQ ID NO: 6149533 - DNA, 15 bp, Homo sapiens
ctcctccccctcctc

SEQ ID NO: 6149534 - DNA, 18 bp, Homo sapiens
ctcctccccctcctccat

SEQ ID NO: 6149535 - DNA, 12 bp, Homo sapiens
ctcctccccctt

SEQ ID NO: 6149536 - DNA, 13 bp, Homo sapiens
ctcctccccgatc

SEQ ID NO: 6149537 - DNA, 20 bp, Homo sapiens
ctcctccccgcgccccagtc

SEQ ID NO: 6149538 - DNA, 15 bp, Homo sapiens
ctcctccccggagcc

SEQ ID NO: 6149539 - DNA, 15 bp, Homo sapiens
ctcctcccctactct

SEQ ID NO: 6149540 - DNA, 15 bp, Homo sapiens
ctcctcccctctcct

SEQ ID NO: 6149541 - DNA, 17 bp, Homo sapiens
ctcctcccctgccgcct

SEQ ID NO: 6149542 - DNA, 23 bp, Homo sapiens
ctcctcccctggagggggaatgg

SEQ ID NO: 6149543 - DNA, 15 bp, Homo sapiens
ctcctcccctggcaa

SEQ ID NO: 6149544 - DNA, 21 bp, Homo sapiens
ctcctcccctggcaactgctg

SEQ ID NO: 6149545 - DNA, 13 bp, Homo sapiens
ctcctccccttcc

SEQ ID NO: 6149546 - DNA, 14 bp, Homo sapiens
ctcctccccttcct

SEQ ID NO: 6149547 - DNA, 17 bp, Homo sapiens
ctcctccccttcctgtt

SEQ ID NO: 6149548 - DNA, 19 bp, Homo sapiens
ctcctccccttcctgtttc

SEQ ID NO: 6149549 - DNA, 13 bp, Homo sapiens
ctcctcccgcccc

SEQ ID NO: 6149550 - DNA, 20 bp, Homo sapiens
ctcctcccgccccgcccctc

SEQ ID NO: 6149551 - DNA, 21 bp, Homo sapiens
ctcctcccgccccgcccctcc

SEQ ID NO: 6149552 - DNA, 15 bp, Homo sapiens
ctcctcccggtgccc

SEQ ID NO: 6149553 - DNA, 10 bp, Homo sapiens
ctcctccctc

SEQ ID NO: 6149554 - DNA, 12 bp, Homo sapiens
ctcctccctcag

SEQ ID NO: 6149555 - DNA, 18 bp, Homo sapiens
ctcctccctcagactcag

SEQ ID NO: 6149556 - DNA, 13 bp, Homo sapiens
ctcctccctcagg

SEQ ID NO: 6149557 - DNA, 14 bp, Homo sapiens
ctcctccctccaag

SEQ ID NO: 6149558 - DNA, 18 bp, Homo sapiens
ctcctccctccaagcctg

SEQ ID NO: 6149559 - DNA, 22 bp, Homo sapiens
ctcctccctccaagcctggcac

SEQ ID NO: 6149560 - DNA, 16 bp, Homo sapiens
ctcctccctccagctg

SEQ ID NO: 6149561 - DNA, 17 bp, Homo sapiens
ctcctccctccagctgc

SEQ ID NO: 6149562 - DNA, 20 bp, Homo sapiens
ctcctccctcccagctgcac

SEQ ID NO: 6149563 - DNA, 21 bp, Homo sapiens
ctcctccctcccagctgcact

SEQ ID NO: 6149564 - DNA, 16 bp, Homo sapiens
ctcctccctccctctc

SEQ ID NO: 6149565 - DNA, 14 bp, Homo sapiens
ctcctccctcctgc

SEQ ID NO: 6149566 - DNA, 14 bp, Homo sapiens
ctcctccctctgcc

SEQ ID NO: 6149567 - DNA, 15 bp, Homo sapiens
ctcctccctctgcct

SEQ ID NO: 6149568 - DNA, 13 bp, Homo sapiens
ctcctccctgcat

SEQ ID NO: 6149569 - DNA, 16 bp, Homo sapiens
ctcctccctgcatctg

SEQ ID NO: 6149570 - DNA, 23 bp, Homo sapiens
ctcctccctgcatctgaccagca

SEQ ID NO: 6149571 - DNA, 12 bp, Homo sapiens
ctcctccctgcc

SEQ ID NO: 6149572 - DNA, 13 bp, Homo sapiens
ctcctccctgccc

SEQ ID NO: 6149573 - DNA, 20 bp, Homo sapiens
ctcctccctgccccccaagg

SEQ ID NO: 6149574 - DNA, 12 bp, Homo sapiens
ctcctccctgct

SEQ ID NO: 6149575 - DNA, 18 bp, Homo sapiens
ctcctccctgctcctcat

SEQ ID NO: 6149576 - DNA, 16 bp, Homo sapiens
ctcctccctggagcta

SEQ ID NO: 6149577 - DNA, 21 bp, Homo sapiens
ctcctccctggctgcagcctc

SEQ ID NO: 6149578 - DNA, 18 bp, Homo sapiens
ctcctccctggctgccct

SEQ ID NO: 6149579 - DNA, 22 bp, Homo sapiens
ctcctccctggctgccctggcc

SEQ ID NO: 6149580 - DNA, 12 bp, Homo sapiens
ctcctccctggg

SEQ ID NO: 6149581 - DNA, 13 bp, Homo sapiens
ctcctccctggga

SEQ ID NO: 6149582 - DNA, 13 bp, Homo sapiens
ctcctccctgggc

SEQ ID NO: 6149583 - DNA, 15 bp, Homo sapiens
ctcctccctgggggc

SEQ ID NO: 6149584 - DNA, 21 bp, Homo sapiens
ctcctccctgggggtggggct

SEQ ID NO: 6149585 - DNA, 22 bp, Homo sapiens
ctcctccctgtgcccccagcct

SEQ ID NO: 6149586 - DNA, 15 bp, Homo sapiens
ctcctcccttagctc

SEQ ID NO: 6149587 - DNA, 20 bp, Homo sapiens
ctcctcccttagctccctgt

SEQ ID NO: 6149588 - DNA, 17 bp, Homo sapiens
ctcctcccttccccact

SEQ ID NO: 6149589 - DNA, 21 bp, Homo sapiens
ctcctcccttccttttccctg

SEQ ID NO: 6149590 - DNA, 22 bp, Homo sapiens
ctcctcccttgagaattccctg

SEQ ID NO: 6149591 - DNA, 18 bp, Homo sapiens
ctcctccgagacccagga

SEQ ID NO: 6149592 - DNA, 16 bp, Homo sapiens
ctcctccgcagaaggt

SEQ ID NO: 6149593 - DNA, 14 bp, Homo sapiens
ctcctccgtgagca

SEQ ID NO: 6149594 - DNA, 15 bp, Homo sapiens
ctcctccgtggcaca

SEQ ID NO: 6149595 - DNA, 16 bp, Homo sapiens
ctcctccgtggcacat

SEQ ID NO: 6149596 - DNA, 21 bp, Homo sapiens
ctcctccgtgggcagctcctc

SEQ ID NO: 6149597 - DNA, 12 bp, Homo sapiens
ctcctcctagcc

SEQ ID NO: 6149598 - DNA, 12 bp, Homo sapiens
ctcctcctagct

SEQ ID NO: 6149599 - DNA, 17 bp, Homo sapiens
ctcctcctagctggagt

SEQ ID NO: 6149600 - DNA, 13 bp, Homo sapiens
ctcctcctccctc

SEQ ID NO: 6149601 - DNA, 15 bp, Homo sapiens
ctcctcctccctgca

SEQ ID NO: 6149602 - DNA, 14 bp, Homo sapiens
ctcctcctcctcct

SEQ ID NO: 6149603 - DNA, 15 bp, Homo sapiens
ctcctcctcctgccc

SEQ ID NO: 6149604 - DNA, 13 bp, Homo sapiens
ctcctcctccttt

SEQ ID NO: 6149605 - DNA, 12 bp, Homo sapiens
ctcctcctcgga

SEQ ID NO: 6149606 - DNA, 14 bp, Homo sapiens
ctcctcctctgtgc

SEQ ID NO: 6149607 - DNA, 15 bp, Homo sapiens
ctcctcctctgtgct

SEQ ID NO: 6149608 - DNA, 16 bp, Homo sapiens
ctcctcctcttcacca

SEQ ID NO: 6149609 - DNA, 20 bp, Homo sapiens
ctcctcctcttcaccaggtg

SEQ ID NO: 6149610 - DNA, 13 bp, Homo sapiens
ctcctcctgcatg

SEQ ID NO: 6149611 - DNA, 18 bp, Homo sapiens
ctcctcctgccagctctg

SEQ ID NO: 6149612 - DNA, 21 bp, Homo sapiens
ctcctcctgccagctctgtca

SEQ ID NO: 6149613 - DNA, 22 bp, Homo sapiens
ctgctgtcaataaatgacaccc

SEQ ID NO: 6149614 - DNA, 16 bp, Homo sapiens
ctgctgtcacctctcc

SEQ ID NO: 6149615 - DNA, 14 bp, Homo sapiens
ctgctgtcagacct

SEQ ID NO: 6149616 - DNA, 20 bp, Homo sapiens
ctgctgtcagaccttcttcc

SEQ ID NO: 6149617 - DNA, 12 bp, Homo sapiens
ctgctgtcagcc

SEQ ID NO: 6149618 - DNA, 21 bp, Homo sapiens
ctgctgtcagccaagtcatgg

SEQ ID NO: 6149619 - DNA, 15 bp, Homo sapiens
ctgctgtcataacat

SEQ ID NO: 6149620 - DNA, 17 bp, Homo sapiens
ctgctgtccagacagcc

SEQ ID NO: 6149621 - DNA, 21 bp, Homo sapiens
ctgctgtccagacagcctgta

SEQ ID NO: 6149622 - DNA, 19 bp, Homo sapiens
ctgctgtccagtgcctaca

SEQ ID NO: 6149623 - DNA, 20 bp, Homo sapiens
ctgctgtcccctcttgcccc

SEQ ID NO: 6149624 - DNA, 21 bp, Homo sapiens
ctgctgtcccctcttgcccca

SEQ ID NO: 6149625 - DNA, 11 bp, Homo sapiens
ctgctgtccct

SEQ ID NO: 6149626 - DNA, 16 bp, Homo sapiens
ctgctgtcctctcccc

SEQ ID NO: 6149627 - DNA, 18 bp, Homo sapiens
ctgctgtcctctccccct

SEQ ID NO: 6149628 - DNA, 19 bp, Homo sapiens
ctgctgtcctctccccctt

SEQ ID NO: 6149629 - DNA, 22 bp, Homo sapiens
ctgctgtcctctcccccttcag

SEQ ID NO: 6149630 - DNA, 14 bp, Homo sapiens
ctgctgtcctggtg

SEQ ID NO: 6149631 - DNA, 22 bp, Homo sapiens
ctgctgtcctgtttctgtcaag

SEQ ID NO: 6149632 - DNA, 18 bp, Homo sapiens
ctgctgtcgctctcagtt

SEQ ID NO: 6149633 - DNA, 20 bp, Homo sapiens
ctgctgtctaacctgtgacc

SEQ ID NO: 6149634 - DNA, 19 bp, Homo sapiens
ctgctgtctctctgggctg

SEQ ID NO: 6149635 - DNA, 13 bp, Homo sapiens
ctgctgtctgagt

SEQ ID NO: 6149636 - DNA, 14 bp, Homo sapiens
ctgctgtctgagta

SEQ ID NO: 6149637 - DNA, 13 bp, Homo sapiens
ctgctgtctgggt

SEQ ID NO: 6149638 - DNA, 21 bp, Homo sapiens
ctgctgtctgggtgctactgg

SEQ ID NO: 6149639 - DNA, 15 bp, Homo sapiens
ctgctgtcttccaag

SEQ ID NO: 6149640 - DNA, 19 bp, Homo sapiens
ctgctgtcttctccctcct

SEQ ID NO: 6149641 - DNA, 14 bp, Homo sapiens
ctgctgtcttctgg

SEQ ID NO: 6149642 - DNA, 19 bp, Homo sapiens
ctgctgtgaacatgcctcc

SEQ ID NO: 6149643 - DNA, 19 bp, Homo sapiens
ctgctgtgaagctggaact

SEQ ID NO: 6149644 - DNA, 22 bp, Homo sapiens
ctgctgtgatgccgtcctgctg

SEQ ID NO: 6149645 - DNA, 23 bp, Homo sapiens
ctgctgtgatgccgtcctgctgg

SEQ ID NO: 6149646 - DNA, 22 bp, Homo sapiens
ctgctgtgattccactacacct

SEQ ID NO: 6149647 - DNA, 23 bp, Homo sapiens
ctgctgtgcaccttacattccta

SEQ ID NO: 6149648 - DNA, 13 bp, Homo sapiens
ctgctgtgcccag

SEQ ID NO: 6149649 - DNA, 15 bp, Homo sapiens
ctgctgtgcccagcc

SEQ ID NO: 6149650 - DNA, 21 bp, Homo sapiens
ctgctgtgcccagcctccatg

SEQ ID NO: 6149651 - DNA, 17 bp, Homo sapiens
ctgctgtgccccaccac

SEQ ID NO: 6149652 - DNA, 13 bp, Homo sapiens
ctgctgtgcctgc

SEQ ID NO: 6149653 - DNA, 17 bp, Homo sapiens
ctgctgtgcgtggaaaa

SEQ ID NO: 6149654 - DNA, 12 bp, Homo sapiens
ctgctgtgctct

SEQ ID NO: 6149655 - DNA, 14 bp, Homo sapiens
ctgctgtgctctgg

SEQ ID NO: 6149656 - DNA, 12 bp, Homo sapiens
ctgctgtgctgg

SEQ ID NO: 6149657 - DNA, 13 bp, Homo sapiens
ctgctgtgctgga

SEQ ID NO: 6149658 - DNA, 19 bp, Homo sapiens
ctgctgtgctgtgcccaag

SEQ ID NO: 6149659 - DNA, 15 bp, Homo sapiens
ctgctgtggaaagga

SEQ ID NO: 6149660 - DNA, 13 bp, Homo sapiens
ctgctgtggagcc

SEQ ID NO: 6149661 - DNA, 15 bp, Homo sapiens
ctgctgtggagtgag

SEQ ID NO: 6149662 - DNA, 12 bp, Homo sapiens
ctgctgtggcca

SEQ ID NO: 6149663 - DNA, 16 bp, Homo sapiens
ctgctgtggccaggag

SEQ ID NO: 6149664 - DNA, 18 bp, Homo sapiens
ctgctgtggccaggaggt

SEQ ID NO: 6149665 - DNA, 17 bp, Homo sapiens
ctgctgtggccccctgt

SEQ ID NO: 6149666 - DNA, 12 bp, Homo sapiens
ctgctgtggcct

SEQ ID NO: 6149667 - DNA, 14 bp, Homo sapiens
ctgctgtggcctca

SEQ ID NO: 6149668 - DNA, 16 bp, Homo sapiens
ctgctgtggcctcact

SEQ ID NO: 6149669 - DNA, 21 bp, Homo sapiens
ctgctgtggcctcacttccct

SEQ ID NO: 6149670 - DNA, 22 bp, Homo sapiens
ctgctgtggcctcacttccctg

SEQ ID NO: 6149671 - DNA, 16 bp, Homo sapiens
ctgctgtgggaaaaat

SEQ ID NO: 6149672 - DNA, 12 bp, Homo sapiens
ctgctgtggggc

SEQ ID NO: 6149673 - DNA, 19 bp, Homo sapiens
ctgctgtgggtcagtgtgc

SEQ ID NO: 6149674 - DNA, 21 bp, Homo sapiens
ctgctgtgggtcagtgtgcca

SEQ ID NO: 6149675 - DNA, 10 bp, Homo sapiens
ctgctgtgta

SEQ ID NO: 6149676 - DNA, 12 bp, Homo sapiens
ctgctgtgtagc

SEQ ID NO: 6149677 - DNA, 13 bp, Homo sapiens
ctgctgtgtagct

SEQ ID NO: 6149678 - DNA, 17 bp, Homo sapiens
ctgctgtgtagctctgt

SEQ ID NO: 6149679 - DNA, 20 bp, Homo sapiens
ctgctgtgtagctctgtcca

SEQ ID NO: 6149680 - DNA, 21 bp, Homo sapiens
ctgctgtgtgaattcccaggt

SEQ ID NO: 6149681 - DNA, 15 bp, Homo sapiens
ctgctgttccagtgg

SEQ ID NO: 6149682 - DNA, 14 bp, Homo sapiens
ctgctgttctcagg

SEQ ID NO: 6149683 - DNA, 15 bp, Homo sapiens
ctgctgttctcagga

SEQ ID NO: 6149684 - DNA, 19 bp, Homo sapiens
ctgctgttctcaggacagc

SEQ ID NO: 6149685 - DNA, 19 bp, Homo sapiens
ctgctgttcttcagtcctt

SEQ ID NO: 6149686 - DNA, 19 bp, Homo sapiens
ctgctgttctttaaatgcg

SEQ ID NO: 6149687 - DNA, 17 bp, Homo sapiens
ctgctgttgaacttttt

SEQ ID NO: 6149688 - DNA, 18 bp, Homo sapiens
ctgctgttgattccactg

SEQ ID NO: 6149689 - DNA, 16 bp, Homo sapiens
ctgctgttgccatagc

SEQ ID NO: 6149690 - DNA, 22 bp, Homo sapiens
ctgctgttgctggactgaggac

SEQ ID NO: 6149691 - DNA, 21 bp, Homo sapiens
ctgctgttggtcctctctctg

SEQ ID NO: 6149692 - DNA, 12 bp, Homo sapiens
ctgctgtttaag

SEQ ID NO: 6149693 - DNA, 14 bp, Homo sapiens
ctgctgtttacaac

SEQ ID NO: 6149694 - DNA, 17 bp, Homo sapiens
ctgctgtttagtgaaca

SEQ ID NO: 6149695 - DNA, 12 bp, Homo sapiens
ctgctgttttat

SEQ ID NO: 6149696 - DNA, 16 bp, Homo sapiens
ctgctgttttatgtca

SEQ ID NO: 6149697 - DNA, 23 bp, Homo sapiens
ctgcttaaaaggtataattaaac

SEQ ID NO: 6149698 - DNA, 18 bp, Homo sapiens
ctgcttaaaatgcaagga

SEQ ID NO: 6149699 - DNA, 23 bp, Homo sapiens
ctgcttaaactggaaaggatctg

SEQ ID NO: 6149700 - DNA, 21 bp, Homo sapiens
ctgcttaaagcttccctctca

SEQ ID NO: 6149701 - DNA, 22 bp, Homo sapiens
ctgcttaaagttggtattaata

SEQ ID NO: 6149702 - DNA, 17 bp, Homo sapiens
ctgcttaacttcacata

SEQ ID NO: 6149703 - DNA, 22 bp, Homo sapiens
ctgcttaatcttcaaagccttc

SEQ ID NO: 6149704 - DNA, 23 bp, Homo sapiens
ctgcttaatgtcagtctacaggc

SEQ ID NO: 6149705 - DNA, 13 bp, Homo sapiens
ctgcttaattcaa

SEQ ID NO: 6149706 - DNA, 22 bp, Homo sapiens
ctgcttacaattccctgctgtc

SEQ ID NO: 6149707 - DNA, 13 bp, Homo sapiens
ctgcttaccaaaa

SEQ ID NO: 6149708 - DNA, 17 bp, Homo sapiens
ctgcttaccaaaacata

SEQ ID NO: 6149709 - DNA, 21 bp, Homo sapiens
ctgcttacctactttcttcag

SEQ ID NO: 6149710 - DNA, 13 bp, Homo sapiens
ctgcttacctgac

SEQ ID NO: 6149711 - DNA, 22 bp, Homo sapiens
ctgcttactgtcggtgtcccct

SEQ ID NO: 6149712 - DNA, 23 bp, Homo sapiens
ctgcttagaaataacagaagaaa

SEQ ID NO: 6149713 - DNA, 21 bp, Homo sapiens
ctgcttagaacccttctgctt

SEQ ID NO: 6149714 - DNA, 15 bp, Homo sapiens
ctgcttagaatctga

SEQ ID NO: 6149715 - DNA, 22 bp, Homo sapiens
ctgcttagaatctgatgccttt

SEQ ID NO: 6149716 - DNA, 20 bp, Homo sapiens
ctgcttagctgccttgagct

SEQ ID NO: 6149717 - DNA, 21 bp, Homo sapiens
ctgcttagctgccttgagcta

SEQ ID NO: 6149718 - DNA, 14 bp, Homo sapiens
ctgcttaggaaacc

SEQ ID NO: 6149719 - DNA, 15 bp, Homo sapiens
ctgcttaggagagac

SEQ ID NO: 6149720 - DNA, 16 bp, Homo sapiens
ctgcttaggagagacc

SEQ ID NO: 6149721 - DNA, 20 bp, Homo sapiens
ctgcttaggggaatgttttc

SEQ ID NO: 6149722 - DNA, 17 bp, Homo sapiens
ctgcttaggtctcatgg

SEQ ID NO: 6149723 - DNA, 19 bp, Homo sapiens
ctgcttaggtctcatggac

SEQ ID NO: 6149724 - DNA, 16 bp, Homo sapiens
ctgcttagtgtccctt

SEQ ID NO: 6149725 - DNA, 21 bp, Homo sapiens
ctgcttataaacatttaaaga

SEQ ID NO: 6149726 - DNA, 23 bp, Homo sapiens
ctgcttataaacatttaaagaca

SEQ ID NO: 6149727 - DNA, 20 bp, Homo sapiens
ctgcttatccgttagccgtg

SEQ ID NO: 6149728 - DNA, 13 bp, Homo sapiens
ctgcttatctgaa

SEQ ID NO: 6149729 - DNA, 22 bp, Homo sapiens
ctgcttcaaagattatctgatt

SEQ ID NO: 6149730 - DNA, 14 bp, Homo sapiens
ctgcttcaaatatt

SEQ ID NO: 6149731 - DNA, 19 bp, Homo sapiens
ctgcttcaaatatttccct

SEQ ID NO: 6149732 - DNA, 21 bp, Homo sapiens
ctgcttcaaggatcctgagcc

SEQ ID NO: 6149733 - DNA, 19 bp, Homo sapiens
ctgcttcaaggcttccact

SEQ ID NO: 6149734 - DNA, 13 bp, Homo sapiens
ctgcttcacaccc

SEQ ID NO: 6149735 - DNA, 21 bp, Homo sapiens
ctgcttcacacccctcagcgc

SEQ ID NO: 6149736 - DNA, 21 bp, Homo sapiens
ctgcttcacggactctttgct

SEQ ID NO: 6149737 - DNA, 17 bp, Homo sapiens
ctgcttcactagggaat

SEQ ID NO: 6149738 - DNA, 21 bp, Homo sapiens
ctgcttcactagggaatcctg

SEQ ID NO: 6149739 - DNA, 21 bp, Homo sapiens
ctgcttcagatgtggagccag

SEQ ID NO: 6149740 - DNA, 16 bp, Homo sapiens
ctgcttcagcctccca

SEQ ID NO: 6149741 - DNA, 13 bp, Homo sapiens
ctgcttcatatct

SEQ ID NO: 6149742 - DNA, 14 bp, Homo sapiens
ctgcttcatatctc

SEQ ID NO: 6149743 - DNA, 23 bp, Homo sapiens
ctgcttcatatctctcccttctt

SEQ ID NO: 6149744 - DNA, 19 bp, Homo sapiens
ctgcttcatccaatgtgaa

SEQ ID NO: 6149745 - DNA, 15 bp, Homo sapiens
ctgcttcatgacatt

SEQ ID NO: 6149746 - DNA, 13 bp, Homo sapiens
ctgcttcatgtga

SEQ ID NO: 6149747 - DNA, 15 bp, Homo sapiens
ctgcttcatttttgt

SEQ ID NO: 6149748 - DNA, 24 bp, Homo sapiens
ctgcttccaattttctggaataca

SEQ ID NO: 6149749 - DNA, 23 bp, Homo sapiens
ctgcttccacatgtgccagttgc

SEQ ID NO: 6149750 - DNA, 16 bp, Homo sapiens
ctgcttccacctcacc

SEQ ID NO: 6149751 - DNA, 14 bp, Homo sapiens
ctgcttccagtgag

SEQ ID NO: 6149752 - DNA, 16 bp, Homo sapiens
ctgcttccagtgaggc

SEQ ID NO: 6149753 - DNA, 21 bp, Homo sapiens
ctgcttccagtgaggctctgc

SEQ ID NO: 6149754 - DNA, 22 bp, Homo sapiens
ctgcttcccaaactcccaggac

SEQ ID NO: 6149755 - DNA, 11 bp, Homo sapiens
ctgcttcccac

SEQ ID NO: 6149756 - DNA, 23 bp, Homo sapiens
ctgcttcccacaactactagtgt

SEQ ID NO: 6149757 - DNA, 16 bp, Homo sapiens
ctgcttcccacctccc

SEQ ID NO: 6149758 - DNA, 19 bp, Homo sapiens
ctgcttcccacctccctgc

SEQ ID NO: 6149759 - DNA, 22 bp, Homo sapiens
ctgcttcccacctccctgccca

SEQ ID NO: 6149760 - DNA, 24 bp, Homo sapiens
ctgcttcccacctccctgcccagg

SEQ ID NO: 6149761 - DNA, 16 bp, Homo sapiens
ctgcttcccactgggg

SEQ ID NO: 6149762 - DNA, 12 bp, Homo sapiens
ctgcttcccagg

SEQ ID NO: 6149763 - DNA, 24 bp, Homo sapiens
ctgcttcccatcctaccctcgggc

SEQ ID NO: 6149764 - DNA, 18 bp, Homo sapiens
ctgcttcccatgcctgca

SEQ ID NO: 6149765 - DNA, 20 bp, Homo sapiens
ctgcttccccaggctgccca

SEQ ID NO: 6149766 - DNA, 18 bp, Homo sapiens
ctgcttcccccacttcac

SEQ ID NO: 6149767 - DNA, 13 bp, Homo sapiens
ctgcttcccctcc

SEQ ID NO: 6149768 - DNA, 14 bp, Homo sapiens
ctgcttcccctccc

SEQ ID NO: 6149769 - DNA, 18 bp, Homo sapiens
ctgcttccctctgcctgt

SEQ ID NO: 6149770 - DNA, 22 bp, Homo sapiens
ctgcttccctctgcctgtccct

SEQ ID NO: 6149771 - DNA, 23 bp, Homo sapiens
ctgcttccctctgcctgtccctc

SEQ ID NO: 6149772 - DNA, 15 bp, Homo sapiens
ctgcttccctgaagc

SEQ ID NO: 6149773 - DNA, 19 bp, Homo sapiens
ctgcttccctggggcccca

SEQ ID NO: 6149774 - DNA, 21 bp, Homo sapiens
ctgcttcccttactttgctga

SEQ ID NO: 6149775 - DNA, 20 bp, Homo sapiens
ctgcttccgttcctccccct

SEQ ID NO: 6149776 - DNA, 23 bp, Homo sapiens
ctgcttccgttcctccccctgct

SEQ ID NO: 6149777 - DNA, 21 bp, Homo sapiens
ctgcttcctaggccccagagc

SEQ ID NO: 6149778 - DNA, 22 bp, Homo sapiens
ctgcttcctcagggcccagcag

SEQ ID NO: 6149779 - DNA, 16 bp, Homo sapiens
ctgcttcctcctggaa

SEQ ID NO: 6149780 - DNA, 18 bp, Homo sapiens
ctgcttcctcctggaaat

SEQ ID NO: 6149781 - DNA, 17 bp, Homo sapiens
ctgcttcctgaaagctg

SEQ ID NO: 6149782 - DNA, 18 bp, Homo sapiens
ctgcttcctgaaagctgt

SEQ ID NO: 6149783 - DNA, 14 bp, Homo sapiens
ctgcttcctgaaat

SEQ ID NO: 6149784 - DNA, 22 bp, Homo sapiens
ctgcttcctgaaataaacactg

SEQ ID NO: 6149785 - DNA, 23 bp, Homo sapiens
ctgcttcctgaaataaacactgg

SEQ ID NO: 6149786 - DNA, 12 bp, Homo sapiens
ctgcttcctgct

SEQ ID NO: 6149787 - DNA, 15 bp, Homo sapiens
ctgcttcctggaccg

SEQ ID NO: 6149788 - DNA, 20 bp, Homo sapiens
ctgcttccttctgcacccag

SEQ ID NO: 6149789 - DNA, 17 bp, Homo sapiens
ctgcttcctttcttgat

SEQ ID NO: 6149790 - DNA, 13 bp, Homo sapiens
ctcctcctggaaa

SEQ ID NO: 6149791 - DNA, 14 bp, Homo sapiens
ctcctcctgggcta

SEQ ID NO: 6149792 - DNA, 18 bp, Homo sapiens
ctcctcctgtgtgactgg

SEQ ID NO: 6149793 - DNA, 12 bp, Homo sapiens
ctcctcctgttc

SEQ ID NO: 6149794 - DNA, 15 bp, Homo sapiens
ctcctccttcccagg

SEQ ID NO: 6149795 - DNA, 20 bp, Homo sapiens
ctcctccttcccagggacca

SEQ ID NO: 6149796 - DNA, 15 bp, Homo sapiens
ctcctccttcctagt

SEQ ID NO: 6149797 - DNA, 16 bp, Homo sapiens
ctcctccttgggcagg

SEQ ID NO: 6149798 - DNA, 20 bp, Homo sapiens
ctcctccttgggcagggtct

SEQ ID NO: 6149799 - DNA, 19 bp, Homo sapiens
ctcctccttggtgcctggc

SEQ ID NO: 6149800 - DNA, 13 bp, Homo sapiens
ctcctccttttcc

SEQ ID NO: 6149801 - DNA, 15 bp, Homo sapiens
ctcctcctttttcca

SEQ ID NO: 6149802 - DNA, 17 bp, Homo sapiens
ctcctcgaacccactcc

SEQ ID NO: 6149803 - DNA, 19 bp, Homo sapiens
ctcctcgaagtcccggctt

SEQ ID NO: 6149804 - DNA, 21 bp, Homo sapiens
ctcctcgaagtcccggcttcc

SEQ ID NO: 6149805 - DNA, 16 bp, Homo sapiens
ctcctcgacatcactg

SEQ ID NO: 6149806 - DNA, 20 bp, Homo sapiens
ctcctcgacatcactgttca

SEQ ID NO: 6149807 - DNA, 17 bp, Homo sapiens
ctcctcgagatcccaac

SEQ ID NO: 6149808 - DNA, 15 bp, Homo sapiens
ctcctcgagggcagg

SEQ ID NO: 6149809 - DNA, 18 bp, Homo sapiens
ctcctcgcccccaccagt

SEQ ID NO: 6149810 - DNA, 19 bp, Homo sapiens
ctcctcgctgtgccaccac

SEQ ID NO: 6149811 - DNA, 23 bp, Homo sapiens
ctcctcggaaccgctcacctaga

SEQ ID NO: 6149812 - DNA, 15 bp, Homo sapiens
ctcctcgggccctgt

SEQ ID NO: 6149813 - DNA, 16 bp, Homo sapiens
ctcctcgggccctgtg

SEQ ID NO: 6149814 - DNA, 19 bp, Homo sapiens
ctcctcgggccgaggccca

SEQ ID NO: 6149815 - DNA, 21 bp, Homo sapiens
ctcctcgggccgaggcccagc

SEQ ID NO: 6149816 - DNA, 20 bp, Homo sapiens
ctcctcgggcgcctgcgctc

SEQ ID NO: 6149817 - DNA, 21 bp, Homo sapiens
ctcctcgggcgcctgcgctcc

SEQ ID NO: 6149818 - DNA, 19 bp, Homo sapiens
ctcctcgggtggggcctgc

SEQ ID NO: 6149819 - DNA, 20 bp, Homo sapiens
ctcctcgggtggggcctgcg

SEQ ID NO: 6149820 - DNA, 22 bp, Homo sapiens
ctcctcggtggcatttgctgaa

SEQ ID NO: 6149821 - DNA, 20 bp, Homo sapiens
ctcctcggtgttacttccct

SEQ ID NO: 6149822 - DNA, 15 bp, Homo sapiens
ctcctcgtccatcag

SEQ ID NO: 6149823 - DNA, 21 bp, Homo sapiens
ctcctcgtcccgagggcgcct

SEQ ID NO: 6149824 - DNA, 19 bp, Homo sapiens
ctcctcgtccggcctgcag

SEQ ID NO: 6149825 - DNA, 21 bp, Homo sapiens
ctcctcgtccggcctgcagcc

SEQ ID NO: 6149826 - DNA, 23 bp, Homo sapiens
ctcctcgtccggcctgcagccca

SEQ ID NO: 6149827 - DNA, 13 bp, Homo sapiens
ctcctcgttcctt

SEQ ID NO: 6149828 - DNA, 21 bp, Homo sapiens
ctcctctaacaggggctggtg

SEQ ID NO: 6149829 - DNA, 18 bp, Homo sapiens
ctcctctagccatccctt

SEQ ID NO: 6149830 - DNA, 18 bp, Homo sapiens
ctcctctagctgtggggg

SEQ ID NO: 6149831 - DNA, 14 bp, Homo sapiens
ctcctctatttctt

SEQ ID NO: 6149832 - DNA, 18 bp, Homo sapiens
ctcctctcaactgcctca

SEQ ID NO: 6149833 - DNA, 20 bp, Homo sapiens
ctcctctcacctctccctcg

SEQ ID NO: 6149834 - DNA, 14 bp, Homo sapiens
ctcctctcactccc

SEQ ID NO: 6149835 - DNA, 13 bp, Homo sapiens
ctcctctcagtac

SEQ ID NO: 6149836 - DNA, 16 bp, Homo sapiens
ctcctctccagacaca

SEQ ID NO: 6149837 - DNA, 21 bp, Homo sapiens
ctcctctccagacacagagac

SEQ ID NO: 6149838 - DNA, 12 bp, Homo sapiens
ctcctctccagc

SEQ ID NO: 6149839 - DNA, 13 bp, Homo sapiens
ctcctctccaggc

SEQ ID NO: 6149840 - DNA, 15 bp, Homo sapiens
ctcctctccaggcac

SEQ ID NO: 6149841 - DNA, 14 bp, Homo sapiens
ctcctctccatgca

SEQ ID NO: 6149842 - DNA, 22 bp, Homo sapiens
ctcctctccatgcaagtgctgt

SEQ ID NO: 6149843 - DNA, 23 bp, Homo sapiens
ctcctctccatgcaagtgctgtt

SEQ ID NO: 6149844 - DNA, 21 bp, Homo sapiens
ctcctctccattttagcccag

SEQ ID NO: 6149845 - DNA, 12 bp, Homo sapiens
ctcctctcccat

SEQ ID NO: 6149846 - DNA, 14 bp, Homo sapiens
ctcctctccccagc

SEQ ID NO: 6149847 - DNA, 17 bp, Homo sapiens
ctcctctccccagccca

SEQ ID NO: 6149848 - DNA, 19 bp, Homo sapiens
ctcctctccccagcccaga

SEQ ID NO: 6149849 - DNA, 20 bp, Homo sapiens
ctcctctccccagcccagag

SEQ ID NO: 6149850 - DNA, 23 bp, Homo sapiens
ctcctctccccagcccagagaca

SEQ ID NO: 6149851 - DNA, 15 bp, Homo sapiens
ctcctctcccgcagg

SEQ ID NO: 6149852 - DNA, 15 bp, Homo sapiens
ctcctctccgcgccc

SEQ ID NO: 6149853 - DNA, 20 bp, Homo sapiens
ctcctctcctcctctgtgct

SEQ ID NO: 6149854 - DNA, 14 bp, Homo sapiens
ctcctctcctggag

SEQ ID NO: 6149855 - DNA, 20 bp, Homo sapiens
ctcctctccttgggctcctg

SEQ ID NO: 6149856 - DNA, 22 bp, Homo sapiens
ctcctctccttgggctcctggc

SEQ ID NO: 6149857 - DNA, 23 bp, Homo sapiens
ctcctctccttgggctcctggct

SEQ ID NO: 6149858 - DNA, 14 bp, Homo sapiens
ctcctctctccctg

SEQ ID NO: 6149859 - DNA, 19 bp, Homo sapiens
ctcctctctccctgcctca

SEQ ID NO: 6149860 - DNA, 15 bp, Homo sapiens
ctcctctctctccct

SEQ ID NO: 6149861 - DNA, 16 bp, Homo sapiens
ctcctctctctccctc

SEQ ID NO: 6149862 - DNA, 14 bp, Homo sapiens
ctcctctctctctt

SEQ ID NO: 6149863 - DNA, 13 bp, Homo sapiens
ctcctctctgaag

SEQ ID NO: 6149864 - DNA, 15 bp, Homo sapiens
ctcctctctgcccta

SEQ ID NO: 6149865 - DNA, 12 bp, Homo sapiens
ctcctctctgct

SEQ ID NO: 6149866 - DNA, 16 bp, Homo sapiens
ctcctctctgctgggt

SEQ ID NO: 6149867 - DNA, 12 bp, Homo sapiens
ctcctctctggt

SEQ ID NO: 6149868 - DNA, 11 bp, Homo sapiens
ctcctctgaaa

SEQ ID NO: 6149869 - DNA, 12 bp, Homo sapiens
ctcctctgaaac

SEQ ID NO: 6149870 - DNA, 19 bp, Homo sapiens
ctcctctgaaacagctgcc

SEQ ID NO: 6149871 - DNA, 21 bp, Homo sapiens
ctcctctgaaacagctgcctt

SEQ ID NO: 6149872 - DNA, 22 bp, Homo sapiens
ctcctctgaaacagctgcctta

SEQ ID NO: 6149873 - DNA, 16 bp, Homo sapiens
ctcctctgaccctcct

SEQ ID NO: 6149874 - DNA, 13 bp, Homo sapiens
ctcctctgactca

SEQ ID NO: 6149875 - DNA, 13 bp, Homo sapiens
ctcctctgagcag

SEQ ID NO: 6149876 - DNA, 13 bp, Homo sapiens
ctcctctgagcca

SEQ ID NO: 6149877 - DNA, 13 bp, Homo sapiens
ctcctctgaggaa

SEQ ID NO: 6149878 - DNA, 22 bp, Homo sapiens
ctcctctgaggaagcagttggg

SEQ ID NO: 6149879 - DNA, 22 bp, Homo sapiens
ctcctctgcaaaacgagggggt

SEQ ID NO: 6149880 - DNA, 21 bp, Homo sapiens
ctcctctgcagcctgagctcc

SEQ ID NO: 6149881 - DNA, 15 bp, Homo sapiens
ctcctctgccacctc

SEQ ID NO: 6149882 - DNA, 23 bp, Homo sapiens
ctcctctgccagcaggaataaag

SEQ ID NO: 6149883 - DNA, 18 bp, Homo sapiens
ctcctctgcccccgctga

SEQ ID NO: 6149884 - DNA, 14 bp, Homo sapiens
ctcctctgccccct

SEQ ID NO: 6149885 - DNA, 16 bp, Homo sapiens
ctcctctgccccctcc

SEQ ID NO: 6149886 - DNA, 18 bp, Homo sapiens
ctcctctgccccctcccc

SEQ ID NO: 6149887 - DNA, 22 bp, Homo sapiens
ctcctctgcccgggagctcagg

SEQ ID NO: 6149888 - DNA, 24 bp, Homo sapiens
ctcctctgcccgggagctcaggaa

SEQ ID NO: 6149889 - DNA, 13 bp, Homo sapiens
ctcctctgcctgt

SEQ ID NO: 6149890 - DNA, 14 bp, Homo sapiens
ctcctctgcctgtg

SEQ ID NO: 6149891 - DNA, 18 bp, Homo sapiens
ctcctctgcctgtgcccg

SEQ ID NO: 6149892 - DNA, 13 bp, Homo sapiens
ctcctctgctagg

SEQ ID NO: 6149893 - DNA, 21 bp, Homo sapiens
ctcctctgctatgcattttct

SEQ ID NO: 6149894 - DNA, 14 bp, Homo sapiens
ctcctctgctccaa

SEQ ID NO: 6149895 - DNA, 16 bp, Homo sapiens
ctcctctgctgacctg

SEQ ID NO: 6149896 - DNA, 13 bp, Homo sapiens
ctcctctgctgct

SEQ ID NO: 6149897 - DNA, 14 bp, Homo sapiens
ctcctctgctgctg

SEQ ID NO: 6149898 - DNA, 16 bp, Homo sapiens
ctcctctgctgctggc

SEQ ID NO: 6149899 - DNA, 16 bp, Homo sapiens
ctcctctgctgggact

SEQ ID NO: 6149900 - DNA, 21 bp, Homo sapiens
ctcctctgcttctttgcctcc

SEQ ID NO: 6149901 - DNA, 12 bp, Homo sapiens
ctcctctgcttg

SEQ ID NO: 6149902 - DNA, 22 bp, Homo sapiens
ctcctctgcttgccatccctcc

SEQ ID NO: 6149903 - DNA, 17 bp, Homo sapiens
ctcctctggcaggcttc

SEQ ID NO: 6149904 - DNA, 13 bp, Homo sapiens
ctcctctggccca

SEQ ID NO: 6149905 - DNA, 12 bp, Homo sapiens
ctcctctggctt

SEQ ID NO: 6149906 - DNA, 17 bp, Homo sapiens
ctcctctggctttccca

SEQ ID NO: 6149907 - DNA, 23 bp, Homo sapiens
ctcctctgggcaggacctcagag

SEQ ID NO: 6149908 - DNA, 18 bp, Homo sapiens
ctcctctgggccctgtcg

SEQ ID NO: 6149909 - DNA, 18 bp, Homo sapiens
ctcctctgggcctggggt

SEQ ID NO: 6149910 - DNA, 22 bp, Homo sapiens
ctcctctgggcctggggtgcat

SEQ ID NO: 6149911 - DNA, 13 bp, Homo sapiens
ctcctctgtcagt

SEQ ID NO: 6149912 - DNA, 21 bp, Homo sapiens
ctcctctgtcagtttgtgaag

SEQ ID NO: 6149913 - DNA, 12 bp, Homo sapiens
ctcctctgtcca

SEQ ID NO: 6149914 - DNA, 14 bp, Homo sapiens
ctcctctgtccagg

SEQ ID NO: 6149915 - DNA, 15 bp, Homo sapiens
ctcctctgtccaggg

SEQ ID NO: 6149916 - DNA, 16 bp, Homo sapiens
ctcctctgtccagggc

SEQ ID NO: 6149917 - DNA, 13 bp, Homo sapiens
ctcctctgtccct

SEQ ID NO: 6149918 - DNA, 16 bp, Homo sapiens
ctcctctgtcctgctt

SEQ ID NO: 6149919 - DNA, 20 bp, Homo sapiens
ctcctctgtcctgcttctga

SEQ ID NO: 6149920 - DNA, 15 bp, Homo sapiens
ctcctctgtgctccc

SEQ ID NO: 6149921 - DNA, 22 bp, Homo sapiens
ctcctctgtgctcctgtccctc

SEQ ID NO: 6149922 - DNA, 19 bp, Homo sapiens
ctcctcttaaaaaataaaa

SEQ ID NO: 6149923 - DNA, 23 bp, Homo sapiens
ctcctcttcaactgaccagcctc

SEQ ID NO: 6149924 - DNA, 18 bp, Homo sapiens
ctcctcttcaccaggtgc

SEQ ID NO: 6149925 - DNA, 13 bp, Homo sapiens
ctcctcttcaccc

SEQ ID NO: 6149926 - DNA, 15 bp, Homo sapiens
ctcctcttcacccac

SEQ ID NO: 6149927 - DNA, 15 bp, Homo sapiens
ctcctcttccagagt

SEQ ID NO: 6149928 - DNA, 15 bp, Homo sapiens
ctcctcttcccagag

SEQ ID NO: 6149929 - DNA, 13 bp, Homo sapiens
ctcctcttcccca

SEQ ID NO: 6149930 - DNA, 15 bp, Homo sapiens
ctcctcttccccaga

SEQ ID NO: 6149931 - DNA, 20 bp, Homo sapiens
ctcctcttcccttagcctct

SEQ ID NO: 6149932 - DNA, 18 bp, Homo sapiens
ctcctcttgattcctggt

SEQ ID NO: 6149933 - DNA, 15 bp, Homo sapiens
ctcctcttgccactg

SEQ ID NO: 6149934 - DNA, 12 bp, Homo sapiens
ctcctcttggaa

SEQ ID NO: 6149935 - DNA, 14 bp, Homo sapiens
ctcctcttggaatt

SEQ ID NO: 6149936 - DNA, 15 bp, Homo sapiens
ctcctcttggagctg

SEQ ID NO: 6149937 - DNA, 21 bp, Homo sapiens
ctcctcttggagctgagatga

SEQ ID NO: 6149938 - DNA, 15 bp, Homo sapiens
ctcctcttgggaatc

SEQ ID NO: 6149939 - DNA, 22 bp, Homo sapiens
ctcctcttggtgggtgtggcca

SEQ ID NO: 6149940 - DNA, 11 bp, Homo sapiens
ctcctcttgta

SEQ ID NO: 6149941 - DNA, 21 bp, Homo sapiens
ctcctcttgtaaataaagccc

SEQ ID NO: 6149942 - DNA, 16 bp, Homo sapiens
ctcctcttgttcctga

SEQ ID NO: 6149943 - DNA, 19 bp, Homo sapiens
ctcctctttaaaacaaaac

SEQ ID NO: 6149944 - DNA, 15 bp, Homo sapiens
ctcctctttcctctc

SEQ ID NO: 6149945 - DNA, 22 bp, Homo sapiens
ctcctctttcctctctttgttc

SEQ ID NO: 6149946 - DNA, 16 bp, Homo sapiens
ctcctctttgttttgt

SEQ ID NO: 6149947 - DNA, 21 bp, Homo sapiens
ctcctctttgttttgttttaa

SEQ ID NO: 6149948 - DNA, 19 bp, Homo sapiens
ctcctctttttctgtgtga

SEQ ID NO: 6149949 - DNA, 22 bp, Homo sapiens
ctcctgaaacccaaagccctgg

SEQ ID NO: 6149950 - DNA, 18 bp, Homo sapiens
ctcctgaaacctcttcct

SEQ ID NO: 6149951 - DNA, 19 bp, Homo sapiens
ctcctgaaacctcttccta

SEQ ID NO: 6149952 - DNA, 22 bp, Homo sapiens
ctcctgaaacctcttcctaggc

SEQ ID NO: 6149953 - DNA, 23 bp, Homo sapiens
ctcctgaaatcatatagaaaggc

SEQ ID NO: 6149954 - DNA, 19 bp, Homo sapiens
ctcctgaaatctacaggcc

SEQ ID NO: 6149955 - DNA, 22 bp, Homo sapiens
ctcctgaaatctacaggcctca

SEQ ID NO: 6149956 - DNA, 20 bp, Homo sapiens
ctcctgaaatgccaagtgcc

SEQ ID NO: 6149957 - DNA, 16 bp, Homo sapiens
ctcctgaaccagtcct

SEQ ID NO: 6149958 - DNA, 16 bp, Homo sapiens
ctcctgaagcctctgc

SEQ ID NO: 6149959 - DNA, 21 bp, Homo sapiens
ctcctgaagggaaggcaaagg

SEQ ID NO: 6149960 - DNA, 23 bp, Homo sapiens
ctcctgaagggaaggcaaaggca

SEQ ID NO: 6149961 - DNA, 18 bp, Homo sapiens
ctcctgaaggtctgggtc

SEQ ID NO: 6149962 - DNA, 14 bp, Homo sapiens
ctcctgaatatttt

SEQ ID NO: 6149963 - DNA, 23 bp, Homo sapiens
ctcctgaatccctttcagtttgt

SEQ ID NO: 6149964 - DNA, 20 bp, Homo sapiens
ctcctgaatgaggcggagct

SEQ ID NO: 6149965 - DNA, 23 bp, Homo sapiens
ctcctgaatgaggcggagctcca

SEQ ID NO: 6149966 - DNA, 23 bp, Homo sapiens
ctcctgaattaactatcatcagt

SEQ ID NO: 6149967 - DNA, 16 bp, Homo sapiens
ctcctgacaccccact

SEQ ID NO: 6149968 - DNA, 20 bp, Homo sapiens
ctcctgacaccccacttagc

SEQ ID NO: 6149969 - DNA, 20 bp, Homo sapiens
ctgcttctaccaactggaag

SEQ ID NO: 6149970 - DNA, 20 bp, Homo sapiens
ctgcttctagaaactctggc

SEQ ID NO: 6149971 - DNA, 22 bp, Homo sapiens
ctgcttctagaaactctggctc

SEQ ID NO: 6149972 - DNA, 23 bp, Homo sapiens
ctgcttctagaaactctggctca

SEQ ID NO: 6149973 - DNA, 15 bp, Homo sapiens
ctgcttctcatccca

SEQ ID NO: 6149974 - DNA, 16 bp, Homo sapiens
ctgcttctcatcccaa

SEQ ID NO: 6149975 - DNA, 13 bp, Homo sapiens
ctgcttctccaag

SEQ ID NO: 6149976 - DNA, 17 bp, Homo sapiens
ctgcttctccacctccc

SEQ ID NO: 6149977 - DNA, 20 bp, Homo sapiens
ctgcttctccacctccccca

SEQ ID NO: 6149978 - DNA, 14 bp, Homo sapiens
ctgcttctccagcc

SEQ ID NO: 6149979 - DNA, 16 bp, Homo sapiens
ctgcttctccagcctg

SEQ ID NO: 6149980 - DNA, 18 bp, Homo sapiens
ctgcttctcccacttggc

SEQ ID NO: 6149981 - DNA, 13 bp, Homo sapiens
ctgcttctcccag

SEQ ID NO: 6149982 - DNA, 14 bp, Homo sapiens
ctgcttctcccagg

SEQ ID NO: 6149983 - DNA, 15 bp, Homo sapiens
ctgcttctcccaggc

SEQ ID NO: 6149984 - DNA, 13 bp, Homo sapiens
ctgcttctccccc

SEQ ID NO: 6149985 - DNA, 19 bp, Homo sapiens
ctgcttctccccccatccc

SEQ ID NO: 6149986 - DNA, 21 bp, Homo sapiens
ctgcttctccccccatcccag

SEQ ID NO: 6149987 - DNA, 23 bp, Homo sapiens
ctgcttctccccccatcccaggg

SEQ ID NO: 6149988 - DNA, 12 bp, Homo sapiens
ctgcttctcccg

SEQ ID NO: 6149989 - DNA, 14 bp, Homo sapiens
ctgcttctcccgcc

SEQ ID NO: 6149990 - DNA, 15 bp, Homo sapiens
ctgcttctccctggg

SEQ ID NO: 6149991 - DNA, 16 bp, Homo sapiens
ctgcttctccctgggg

SEQ ID NO: 6149992 - DNA, 18 bp, Homo sapiens
ctgcttctcctcccagcg

SEQ ID NO: 6149993 - DNA, 22 bp, Homo sapiens
ctgcttctcggaggccaggccc

SEQ ID NO: 6149994 - DNA, 22 bp, Homo sapiens
ctgcttctcggggtccagtgca

SEQ ID NO: 6149995 - DNA, 14 bp, Homo sapiens
ctgcttctctcagc

SEQ ID NO: 6149996 - DNA, 21 bp, Homo sapiens
ctgcttctctgacttctgcct

SEQ ID NO: 6149997 - DNA, 18 bp, Homo sapiens
ctgcttctctttatagag

SEQ ID NO: 6149998 - DNA, 13 bp, Homo sapiens
ctgcttctctttt

SEQ ID NO: 6149999 - DNA, 22 bp, Homo sapiens
ctgcttctcttttcctcgcaga

SEQ ID NO: 6150000 - DNA, 19 bp, Homo sapiens
ctgcttctgaatgtgctga

SEQ ID NO: 6150001 - DNA, 14 bp, Homo sapiens
ctgcttctgcacct

SEQ ID NO: 6150002 - DNA, 23 bp, Homo sapiens
ctgcttctgcccacaccgcaggg

SEQ ID NO: 6150003 - DNA, 15 bp, Homo sapiens
ctgcttctgcccacc

SEQ ID NO: 6150004 - DNA, 16 bp, Homo sapiens
ctgcttctgcccaccc

SEQ ID NO: 6150005 - DNA, 11 bp, Homo sapiens
ctgcttctgct

SEQ ID NO: 6150006 - DNA, 20 bp, Homo sapiens
ctgcttctgctccagcccct

SEQ ID NO: 6150007 - DNA, 14 bp, Homo sapiens
ctgcttctgctgcc

SEQ ID NO: 6150008 - DNA, 16 bp, Homo sapiens
ctgcttctgctgccct

SEQ ID NO: 6150009 - DNA, 16 bp, Homo sapiens
ctgcttctgctgcctg

SEQ ID NO: 6150010 - DNA, 18 bp, Homo sapiens
ctgcttctgctgcctgtt

SEQ ID NO: 6150011 - DNA, 15 bp, Homo sapiens
ctgcttctggctcct

SEQ ID NO: 6150012 - DNA, 14 bp, Homo sapiens
ctgcttctgggcct

SEQ ID NO: 6150013 - DNA, 15 bp, Homo sapiens
ctgcttctgggcctg

SEQ ID NO: 6150014 - DNA, 12 bp, Homo sapiens
ctgcttctgggg

SEQ ID NO: 6150015 - DNA, 15 bp, Homo sapiens
ctgcttctgtccagg

SEQ ID NO: 6150016 - DNA, 16 bp, Homo sapiens
ctgcttctgtgcattt

SEQ ID NO: 6150017 - DNA, 14 bp, Homo sapiens
ctgcttctgtgtac

SEQ ID NO: 6150018 - DNA, 22 bp, Homo sapiens
ctgcttctgtgtaccacttctg

SEQ ID NO: 6150019 - DNA, 22 bp, Homo sapiens
ctgcttcttcaagcacctgcag

SEQ ID NO: 6150020 - DNA, 18 bp, Homo sapiens
ctgcttcttccccagggt

SEQ ID NO: 6150021 - DNA, 16 bp, Homo sapiens
ctgcttcttcttccaa

SEQ ID NO: 6150022 - DNA, 15 bp, Homo sapiens
ctgcttcttgcttcc

SEQ ID NO: 6150023 - DNA, 18 bp, Homo sapiens
ctgcttctttccagaaac

SEQ ID NO: 6150024 - DNA, 22 bp, Homo sapiens
ctgcttgaatcaggaggagatt

SEQ ID NO: 6150025 - DNA, 17 bp, Homo sapiens
ctgcttgacaacatctg

SEQ ID NO: 6150026 - DNA, 16 bp, Homo sapiens
ctgcttgactatcaca

SEQ ID NO: 6150027 - DNA, 15 bp, Homo sapiens
ctgcttgagctttct

SEQ ID NO: 6150028 - DNA, 23 bp, Homo sapiens
ctgcttgagctttctgtgcatgt

SEQ ID NO: 6150029 - DNA, 18 bp, Homo sapiens
ctgcttgaggaggggcac

SEQ ID NO: 6150030 - DNA, 20 bp, Homo sapiens
ctgcttgaggaggggcacct

SEQ ID NO: 6150031 - DNA, 20 bp, Homo sapiens
ctgcttgaggcaactcatct

SEQ ID NO: 6150032 - DNA, 22 bp, Homo sapiens
ctgcttgagtggacagcagctg

SEQ ID NO: 6150033 - DNA, 23 bp, Homo sapiens
ctgcttgagtggacagcagctgg

SEQ ID NO: 6150034 - DNA, 20 bp, Homo sapiens
ctgcttgagttcccagatgg

SEQ ID NO: 6150035 - DNA, 16 bp, Homo sapiens
ctgcttgatgaagcaa

SEQ ID NO: 6150036 - DNA, 20 bp, Homo sapiens
ctgcttgatgaagcaaggaa

SEQ ID NO: 6150037 - DNA, 17 bp, Homo sapiens
ctgcttgcacacttccc

SEQ ID NO: 6150038 - DNA, 22 bp, Homo sapiens
ctgcttgcacacttccccatct

SEQ ID NO: 6150039 - DNA, 16 bp, Homo sapiens
ctgcttgcagccagga

SEQ ID NO: 6150040 - DNA, 22 bp, Homo sapiens
ctgcttgcagccaggagaaggt

SEQ ID NO: 6150041 - DNA, 20 bp, Homo sapiens
ctgcttgcaggaggccaaac

SEQ ID NO: 6150042 - DNA, 22 bp, Homo sapiens
ctgcttgccatccctccctcca

SEQ ID NO: 6150043 - DNA, 20 bp, Homo sapiens
ctgcttgcccaagtcacaca

SEQ ID NO: 6150044 - DNA, 16 bp, Homo sapiens
ctgcttgcccgctccc

SEQ ID NO: 6150045 - DNA, 17 bp, Homo sapiens
ctgcttgcccgctccca

SEQ ID NO: 6150046 - DNA, 18 bp, Homo sapiens
ctgcttgcccgctcccac

SEQ ID NO: 6150047 - DNA, 13 bp, Homo sapiens
ctgcttgccctaa

SEQ ID NO: 6150048 - DNA, 20 bp, Homo sapiens
ctgcttgccctaagcagaaa

SEQ ID NO: 6150049 - DNA, 18 bp, Homo sapiens
ctgcttgccgactggctg

SEQ ID NO: 6150050 - DNA, 20 bp, Homo sapiens
ctgcttgccgactggctgtg

SEQ ID NO: 6150051 - DNA, 14 bp, Homo sapiens
ctgcttgcctagcc

SEQ ID NO: 6150052 - DNA, 19 bp, Homo sapiens
ctgcttgcctagccccagg

SEQ ID NO: 6150053 - DNA, 18 bp, Homo sapiens
ctgcttgctaccaatctg

SEQ ID NO: 6150054 - DNA, 14 bp, Homo sapiens
ctgcttgctggaaa

SEQ ID NO: 6150055 - DNA, 17 bp, Homo sapiens
ctgcttgcttttgcctc

SEQ ID NO: 6150056 - DNA, 22 bp, Homo sapiens
ctgcttgcttttgcctctgccc

SEQ ID NO: 6150057 - DNA, 23 bp, Homo sapiens
ctgcttgcttttgcctctgccca

SEQ ID NO: 6150058 - DNA, 20 bp, Homo sapiens
ctgcttggacctcgtgcttt

SEQ ID NO: 6150059 - DNA, 22 bp, Homo sapiens
ctgcttggacctcgtgctttaa

SEQ ID NO: 6150060 - DNA, 17 bp, Homo sapiens
ctgcttggacggattcc

SEQ ID NO: 6150061 - DNA, 15 bp, Homo sapiens
ctgcttggagtgccc

SEQ ID NO: 6150062 - DNA, 18 bp, Homo sapiens
ctgcttggagtgccccaa

SEQ ID NO: 6150063 - DNA, 20 bp, Homo sapiens
ctgcttggagtgccccaagg

SEQ ID NO: 6150064 - DNA, 19 bp, Homo sapiens
ctgcttggatccatacaaa

SEQ ID NO: 6150065 - DNA, 17 bp, Homo sapiens
ctgcttggatgcgagct

SEQ ID NO: 6150066 - DNA, 15 bp, Homo sapiens
ctgcttggattcact

SEQ ID NO: 6150067 - DNA, 12 bp, Homo sapiens
ctgcttggccag

SEQ ID NO: 6150068 - DNA, 20 bp, Homo sapiens
ctgcttggccagatgcgggg

SEQ ID NO: 6150069 - DNA, 15 bp, Homo sapiens
ctgcttggcccaggg

SEQ ID NO: 6150070 - DNA, 23 bp, Homo sapiens
ctgcttggctgtcccctccatct

SEQ ID NO: 6150071 - DNA, 15 bp, Homo sapiens
ctgcttgggcttcat

SEQ ID NO: 6150072 - DNA, 18 bp, Homo sapiens
ctgcttgggcttcatcct

SEQ ID NO: 6150073 - DNA, 19 bp, Homo sapiens
ctgcttggggcctggcgtg

SEQ ID NO: 6150074 - DNA, 14 bp, Homo sapiens
ctgcttgggtggag

SEQ ID NO: 6150075 - DNA, 22 bp, Homo sapiens
ctgcttgggtggagaagccatt

SEQ ID NO: 6150076 - DNA, 18 bp, Homo sapiens
ctgcttggtccttgattt

SEQ ID NO: 6150077 - DNA, 17 bp, Homo sapiens
ctgcttgtactaagcca

SEQ ID NO: 6150078 - DNA, 13 bp, Homo sapiens
ctgcttgtcatcc

SEQ ID NO: 6150079 - DNA, 20 bp, Homo sapiens
ctgcttgtcattctgctaat

SEQ ID NO: 6150080 - DNA, 14 bp, Homo sapiens
ctgcttgtcttaga

SEQ ID NO: 6150081 - DNA, 13 bp, Homo sapiens
ctgcttgtgacct

SEQ ID NO: 6150082 - DNA, 15 bp, Homo sapiens
ctgcttgtgatctca

SEQ ID NO: 6150083 - DNA, 17 bp, Homo sapiens
ctgcttgtgatctcaca

SEQ ID NO: 6150084 - DNA, 19 bp, Homo sapiens
ctgcttgtgcctcccttcc

SEQ ID NO: 6150085 - DNA, 18 bp, Homo sapiens
ctgcttgtgttgggcccc

SEQ ID NO: 6150086 - DNA, 15 bp, Homo sapiens
ctgcttgttgtcaag

SEQ ID NO: 6150087 - DNA, 13 bp, Homo sapiens
ctgcttgtttcct

SEQ ID NO: 6150088 - DNA, 21 bp, Homo sapiens
ctgctttaaagggcctgcctg

SEQ ID NO: 6150089 - DNA, 20 bp, Homo sapiens
ctgctttaacagtggagctg

SEQ ID NO: 6150090 - DNA, 22 bp, Homo sapiens
ctgctttaacagtggagctgaa

SEQ ID NO: 6150091 - DNA, 23 bp, Homo sapiens
ctgctttaacagtggagctgaat

SEQ ID NO: 6150092 - DNA, 20 bp, Homo sapiens
ctgctttacaggatcatgta

SEQ ID NO: 6150093 - DNA, 17 bp, Homo sapiens
ctgctttactgtgtatc

SEQ ID NO: 6150094 - DNA, 14 bp, Homo sapiens
ctgctttagacttg

SEQ ID NO: 6150095 - DNA, 20 bp, Homo sapiens
ctgctttagacttgaaaaga

SEQ ID NO: 6150096 - DNA, 18 bp, Homo sapiens
ctgctttaggattgaagt

SEQ ID NO: 6150097 - DNA, 17 bp, Homo sapiens
ctgctttatcaggggac

SEQ ID NO: 6150098 - DNA, 22 bp, Homo sapiens
ctgctttatccaggggcttcac

SEQ ID NO: 6150099 - DNA, 16 bp, Homo sapiens
ctgctttatcttttca

SEQ ID NO: 6150100 - DNA, 19 bp, Homo sapiens
ctgctttcaacttaaatca

SEQ ID NO: 6150101 - DNA, 22 bp, Homo sapiens
ctgctttcaacttaaatcactg

SEQ ID NO: 6150102 - DNA, 21 bp, Homo sapiens
ctgctttcacttaagtgtctg

SEQ ID NO: 6150103 - DNA, 16 bp, Homo sapiens
ctgctttcagatactg

SEQ ID NO: 6150104 - DNA, 18 bp, Homo sapiens
ctgctttcagtgcctgct

SEQ ID NO: 6150105 - DNA, 21 bp, Homo sapiens
ctgctttcagtgcctgctgtt

SEQ ID NO: 6150106 - DNA, 12 bp, Homo sapiens
ctgctttccaca

SEQ ID NO: 6150107 - DNA, 15 bp, Homo sapiens
ctgctttcccctgtg

SEQ ID NO: 6150108 - DNA, 18 bp, Homo sapiens
ctgctttcgtccatgttt

SEQ ID NO: 6150109 - DNA, 23 bp, Homo sapiens
ctgctttcgtccatgtttctcac

SEQ ID NO: 6150110 - DNA, 12 bp, Homo sapiens
ctgctttctctt

SEQ ID NO: 6150111 - DNA, 13 bp, Homo sapiens
ctgctttctgaat

SEQ ID NO: 6150112 - DNA, 21 bp, Homo sapiens
ctgctttctgatacatctgtc

SEQ ID NO: 6150113 - DNA, 15 bp, Homo sapiens
ctgctttctgcctct

SEQ ID NO: 6150114 - DNA, 18 bp, Homo sapiens
ctgctttctgcctctcct

SEQ ID NO: 6150115 - DNA, 15 bp, Homo sapiens
ctgctttctggtata

SEQ ID NO: 6150116 - DNA, 15 bp, Homo sapiens
ctgctttctgttcca

SEQ ID NO: 6150117 - DNA, 16 bp, Homo sapiens
ctgctttcttctctgc

SEQ ID NO: 6150118 - DNA, 18 bp, Homo sapiens
ctgctttcttctctgcct

SEQ ID NO: 6150119 - DNA, 19 bp, Homo sapiens
ctgctttcttctctgcctc

SEQ ID NO: 6150120 - DNA, 17 bp, Homo sapiens
ctgctttcttgccacac

SEQ ID NO: 6150121 - DNA, 20 bp, Homo sapiens
ctgctttcttgccacacagt

SEQ ID NO: 6150122 - DNA, 13 bp, Homo sapiens
ctgctttgaataa

SEQ ID NO: 6150123 - DNA, 17 bp, Homo sapiens
ctgctttgacgggccag

SEQ ID NO: 6150124 - DNA, 20 bp, Homo sapiens
ctgctttgactgagcagact

SEQ ID NO: 6150125 - DNA, 23 bp, Homo sapiens
ctgctttgactgagcagactggt

SEQ ID NO: 6150126 - DNA, 12 bp, Homo sapiens
ctgctttgcaaa

SEQ ID NO: 6150127 - DNA, 23 bp, Homo sapiens
ctgctttgcaaacatcaacctgg

SEQ ID NO: 6150128 - DNA, 13 bp, Homo sapiens
ctgctttgcaaag

SEQ ID NO: 6150129 - DNA, 23 bp, Homo sapiens
ctgctttgccaagttgctgtcac

SEQ ID NO: 6150130 - DNA, 20 bp, Homo sapiens
ctgctttgcgtgcccggggc

SEQ ID NO: 6150131 - DNA, 21 bp, Homo sapiens
ctgctttgcgtgcccggggca

SEQ ID NO: 6150132 - DNA, 10 bp, Homo sapiens
ctgctttgct

SEQ ID NO: 6150133 - DNA, 12 bp, Homo sapiens
ctgctttgcttc

SEQ ID NO: 6150134 - DNA, 13 bp, Homo sapiens
ctgctttgcttct

SEQ ID NO: 6150135 - DNA, 18 bp, Homo sapiens
ctgctttggatagtctcc

SEQ ID NO: 6150136 - DNA, 20 bp, Homo sapiens
ctgctttggatagtctccta

SEQ ID NO: 6150137 - DNA, 18 bp, Homo sapiens
ctgctttggcctttcctt

SEQ ID NO: 6150138 - DNA, 21 bp, Homo sapiens
ctgctttgggaagactgaggc

SEQ ID NO: 6150139 - DNA, 20 bp, Homo sapiens
ctgctttgggaagccgtgct

SEQ ID NO: 6150140 - DNA, 16 bp, Homo sapiens
ctgctttgggctgccc

SEQ ID NO: 6150141 - DNA, 20 bp, Homo sapiens
ctgctttgggctgccctggt

SEQ ID NO: 6150142 - DNA, 13 bp, Homo sapiens
ctgctttggggat

SEQ ID NO: 6150143 - DNA, 16 bp, Homo sapiens
ctgctttggggatatt

SEQ ID NO: 6150144 - DNA, 15 bp, Homo sapiens
ctgctttgtgcatat

SEQ ID NO: 6150145 - DNA, 20 bp, Homo sapiens
ctgctttgtgcatatgttaa

SEQ ID NO: 6150146 - DNA, 19 bp, Homo sapiens
ctgctttgttaatgaaaat

SEQ ID NO: 6150147 - DNA, 17 bp, Homo sapiens
ctcctgacacccttctc

SEQ ID NO: 6150148 - DNA, 18 bp, Homo sapiens
ctcctgacacccttctcc

SEQ ID NO: 6150149 - DNA, 17 bp, Homo sapiens
ctcctgacactgctgga

SEQ ID NO: 6150150 - DNA, 14 bp, Homo sapiens
ctcctgacagaagg

SEQ ID NO: 6150151 - DNA, 19 bp, Homo sapiens
ctcctgacagaaggtgcca

SEQ ID NO: 6150152 - DNA, 23 bp, Homo sapiens
ctcctgacagcgacagaaaacct

SEQ ID NO: 6150153 - DNA, 15 bp, Homo sapiens
ctcctgaccagggca

SEQ ID NO: 6150154 - DNA, 18 bp, Homo sapiens
ctcctgaccagggcaagg

SEQ ID NO: 6150155 - DNA, 23 bp, Homo sapiens
ctcctgaccagggcaaggcccct

SEQ ID NO: 6150156 - DNA, 16 bp, Homo sapiens
ctcctgaccagttgca

SEQ ID NO: 6150157 - DNA, 23 bp, Homo sapiens
ctcctgacccagccctgaacaaa

SEQ ID NO: 6150158 - DNA, 16 bp, Homo sapiens
ctcctgacccagtccc

SEQ ID NO: 6150159 - DNA, 12 bp, Homo sapiens
ctcctgacccca

SEQ ID NO: 6150160 - DNA, 20 bp, Homo sapiens
ctcctgacccctctcctcaa

SEQ ID NO: 6150161 - DNA, 21 bp, Homo sapiens
ctcctgaccctcccactccca

SEQ ID NO: 6150162 - DNA, 15 bp, Homo sapiens
ctcctgacctcgtga

SEQ ID NO: 6150163 - DNA, 16 bp, Homo sapiens
ctcctgacctgaggct

SEQ ID NO: 6150164 - DNA, 24 bp, Homo sapiens
ctcctgaccttgggtcctgaagtg

SEQ ID NO: 6150165 - DNA, 17 bp, Homo sapiens
ctcctgaccttgtgatc

SEQ ID NO: 6150166 - DNA, 20 bp, Homo sapiens
ctcctgacgtctgaagcttg

SEQ ID NO: 6150167 - DNA, 17 bp, Homo sapiens
ctcctgactcatccgcc

SEQ ID NO: 6150168 - DNA, 16 bp, Homo sapiens
ctcctgactggtgctg

SEQ ID NO: 6150169 - DNA, 20 bp, Homo sapiens
ctcctgacttagcccgtcac

SEQ ID NO: 6150170 - DNA, 22 bp, Homo sapiens
ctcctgacttagcccgtcaccc

SEQ ID NO: 6150171 - DNA, 21 bp, Homo sapiens
ctcctgacttcaggtgatcca

SEQ ID NO: 6150172 - DNA, 18 bp, Homo sapiens
ctcctgagaaaggtgagg

SEQ ID NO: 6150173 - DNA, 11 bp, Homo sapiens
ctcctgagaca

SEQ ID NO: 6150174 - DNA, 15 bp, Homo sapiens
ctcctgagacccctg

SEQ ID NO: 6150175 - DNA, 17 bp, Homo sapiens
ctcctgagacccctggc

SEQ ID NO: 6150176 - DNA, 19 bp, Homo sapiens
ctcctgagacccctggcct

SEQ ID NO: 6150177 - DNA, 20 bp, Homo sapiens
ctcctgagacccctggcctc

SEQ ID NO: 6150178 - DNA, 13 bp, Homo sapiens
ctcctgagccccc

SEQ ID NO: 6150179 - DNA, 17 bp, Homo sapiens
ctcctgagcccccagct

SEQ ID NO: 6150180 - DNA, 21 bp, Homo sapiens
ctcctgagcccccagcttcca

SEQ ID NO: 6150181 - DNA, 23 bp, Homo sapiens
ctcctgagcccccagcttccagc

SEQ ID NO: 6150182 - DNA, 12 bp, Homo sapiens
ctcctgagcctc

SEQ ID NO: 6150183 - DNA, 14 bp, Homo sapiens
ctcctgagcctcac

SEQ ID NO: 6150184 - DNA, 14 bp, Homo sapiens
ctcctgagcctgtg

SEQ ID NO: 6150185 - DNA, 20 bp, Homo sapiens
ctcctgagctaggaagagtc

SEQ ID NO: 6150186 - DNA, 22 bp, Homo sapiens
ctcctgagctcggggggctctg

SEQ ID NO: 6150187 - DNA, 23 bp, Homo sapiens
ctcctgagctcggggggctctgc

SEQ ID NO: 6150188 - DNA, 22 bp, Homo sapiens
ctcctgagcttgatctttttct

SEQ ID NO: 6150189 - DNA, 22 bp, Homo sapiens
ctcctgaggagcagcccacctg

SEQ ID NO: 6150190 - DNA, 19 bp, Homo sapiens
ctcctgaggatcagaaagt

SEQ ID NO: 6150191 - DNA, 20 bp, Homo sapiens
ctcctgaggatcagaaagta

SEQ ID NO: 6150192 - DNA, 19 bp, Homo sapiens
ctcctgaggatgtgtccca

SEQ ID NO: 6150193 - DNA, 19 bp, Homo sapiens
ctcctgagggaggacctgg

SEQ ID NO: 6150194 - DNA, 23 bp, Homo sapiens
ctcctgagggtcctgctggtgac

SEQ ID NO: 6150195 - DNA, 15 bp, Homo sapiens
ctcctgaggtctgga

SEQ ID NO: 6150196 - DNA, 13 bp, Homo sapiens
ctcctgagtagct

SEQ ID NO: 6150197 - DNA, 20 bp, Homo sapiens
ctcctgagtagctgggcctg

SEQ ID NO: 6150198 - DNA, 21 bp, Homo sapiens
ctcctgagtagctgggcctgt

SEQ ID NO: 6150199 - DNA, 15 bp, Homo sapiens
ctcctgagttgtata

SEQ ID NO: 6150200 - DNA, 23 bp, Homo sapiens
ctcctgataaaacaacagctcga

SEQ ID NO: 6150201 - DNA, 13 bp, Homo sapiens
ctcctgatataga

SEQ ID NO: 6150202 - DNA, 16 bp, Homo sapiens
ctcctgatcagaggca

SEQ ID NO: 6150203 - DNA, 19 bp, Homo sapiens
ctcctgatccgcatccaag

SEQ ID NO: 6150204 - DNA, 21 bp, Homo sapiens
ctcctgatgccctcttctcct

SEQ ID NO: 6150205 - DNA, 15 bp, Homo sapiens
ctcctgatggccaag

SEQ ID NO: 6150206 - DNA, 20 bp, Homo sapiens
ctcctgatggccaagagcat

SEQ ID NO: 6150207 - DNA, 17 bp, Homo sapiens
ctcctgatgtttgtatc

SEQ ID NO: 6150208 - DNA, 16 bp, Homo sapiens
ctcctgatgtttttcc

SEQ ID NO: 6150209 - DNA, 18 bp, Homo sapiens
ctcctgattaaggcgtgg

SEQ ID NO: 6150210 - DNA, 23 bp, Homo sapiens
ctcctgattgctctggaagcctg

SEQ ID NO: 6150211 - DNA, 15 bp, Homo sapiens
ctcctgatttgagtt

SEQ ID NO: 6150212 - DNA, 20 bp, Homo sapiens
ctcctgatttgagtttcctt

SEQ ID NO: 6150213 - DNA, 15 bp, Homo sapiens
ctcctgattttgtag

SEQ ID NO: 6150214 - DNA, 21 bp, Homo sapiens
ctcctgcaaatttagtttgtt

SEQ ID NO: 6150215 - DNA, 14 bp, Homo sapiens
ctcctgcacacaga

SEQ ID NO: 6150216 - DNA, 19 bp, Homo sapiens
ctcctgcacttacttgctt

SEQ ID NO: 6150217 - DNA, 22 bp, Homo sapiens
ctcctgcagacacctggactga

SEQ ID NO: 6150218 - DNA, 14 bp, Homo sapiens
ctcctgcagaccac

SEQ ID NO: 6150219 - DNA, 19 bp, Homo sapiens
ctcctgcagcatggtccct

SEQ ID NO: 6150220 - DNA, 15 bp, Homo sapiens
ctcctgcagccccag

SEQ ID NO: 6150221 - DNA, 16 bp, Homo sapiens
ctcctgcaggcagcca

SEQ ID NO: 6150222 - DNA, 19 bp, Homo sapiens
ctcctgcaggctggctgtt

SEQ ID NO: 6150223 - DNA, 22 bp, Homo sapiens
ctcctgcagggagccttctgcc

SEQ ID NO: 6150224 - DNA, 19 bp, Homo sapiens
ctcctgcagtttgggagac

SEQ ID NO: 6150225 - DNA, 17 bp, Homo sapiens
ctcctgcatccctccac

SEQ ID NO: 6150226 - DNA, 21 bp, Homo sapiens
ctcctgccacaacagaataaa

SEQ ID NO: 6150227 - DNA, 18 bp, Homo sapiens
ctcctgccacatggagcc

SEQ ID NO: 6150228 - DNA, 22 bp, Homo sapiens
ctcctgccacatggagccccct

SEQ ID NO: 6150229 - DNA, 13 bp, Homo sapiens
ctcctgccacatt

SEQ ID NO: 6150230 - DNA, 21 bp, Homo sapiens
ctcctgccacattagaacttc

SEQ ID NO: 6150231 - DNA, 16 bp, Homo sapiens
ctcctgccaccccttc

SEQ ID NO: 6150232 - DNA, 18 bp, Homo sapiens
ctcctgccaccccttcct

SEQ ID NO: 6150233 - DNA, 19 bp, Homo sapiens
ctcctgccaccccttcctc

SEQ ID NO: 6150234 - DNA, 20 bp, Homo sapiens
ctcctgccaccccttcctcc

SEQ ID NO: 6150235 - DNA, 16 bp, Homo sapiens
ctcctgccactgacct

SEQ ID NO: 6150236 - DNA, 18 bp, Homo sapiens
ctcctgccactgacctca

SEQ ID NO: 6150237 - DNA, 13 bp, Homo sapiens
ctcctgccagccc

SEQ ID NO: 6150238 - DNA, 17 bp, Homo sapiens
ctcctgccagcccagct

SEQ ID NO: 6150239 - DNA, 19 bp, Homo sapiens
ctcctgccagcccagctgg

SEQ ID NO: 6150240 - DNA, 15 bp, Homo sapiens
ctcctgccagcccgg

SEQ ID NO: 6150241 - DNA, 16 bp, Homo sapiens
ctcctgccagcccggc

SEQ ID NO: 6150242 - DNA, 14 bp, Homo sapiens
ctcctgccagctct

SEQ ID NO: 6150243 - DNA, 15 bp, Homo sapiens
ctcctgccagctctg

SEQ ID NO: 6150244 - DNA, 19 bp, Homo sapiens
ctcctgccattcttctggt

SEQ ID NO: 6150245 - DNA, 14 bp, Homo sapiens
ctcctgcccacctg

SEQ ID NO: 6150246 - DNA, 20 bp, Homo sapiens
ctcctgcccacgcagacctg

SEQ ID NO: 6150247 - DNA, 18 bp, Homo sapiens
ctcctgcccacgtgcagc

SEQ ID NO: 6150248 - DNA, 12 bp, Homo sapiens
ctcctgcccagc

SEQ ID NO: 6150249 - DNA, 16 bp, Homo sapiens
ctcctgcccagccacc

SEQ ID NO: 6150250 - DNA, 13 bp, Homo sapiens
ctcctgcccagct

SEQ ID NO: 6150251 - DNA, 21 bp, Homo sapiens
ctcctgcccagctctgaccct

SEQ ID NO: 6150252 - DNA, 15 bp, Homo sapiens
ctcctgcccaggaga

SEQ ID NO: 6150253 - DNA, 17 bp, Homo sapiens
ctcctgcccaggagagc

SEQ ID NO: 6150254 - DNA, 22 bp, Homo sapiens
ctcctgcccaggagagccagcc

SEQ ID NO: 6150255 - DNA, 17 bp, Homo sapiens
ctcctgcccaggccaca

SEQ ID NO: 6150256 - DNA, 17 bp, Homo sapiens
ctcctgcccagtccccc

SEQ ID NO: 6150257 - DNA, 13 bp, Homo sapiens
ctcctgccccaca

SEQ ID NO: 6150258 - DNA, 17 bp, Homo sapiens
ctcctgccccacactcc

SEQ ID NO: 6150259 - DNA, 20 bp, Homo sapiens
ctcctgcccccacacctggc

SEQ ID NO: 6150260 - DNA, 23 bp, Homo sapiens
ctcctgcccccacacctggccct

SEQ ID NO: 6150261 - DNA, 19 bp, Homo sapiens
ctcctgcccccaccccagg

SEQ ID NO: 6150262 - DNA, 13 bp, Homo sapiens
ctcctgccccctg

SEQ ID NO: 6150263 - DNA, 13 bp, Homo sapiens
ctcctgccccgcc

SEQ ID NO: 6150264 - DNA, 14 bp, Homo sapiens
ctcctgccccgccg

SEQ ID NO: 6150265 - DNA, 15 bp, Homo sapiens
ctcctgccccggccc

SEQ ID NO: 6150266 - DNA, 20 bp, Homo sapiens
ctcctgcccctttcaggcct

SEQ ID NO: 6150267 - DNA, 20 bp, Homo sapiens
ctcctgcccgcagacctctg

SEQ ID NO: 6150268 - DNA, 21 bp, Homo sapiens
ctcctgcccgcagacctctgg

SEQ ID NO: 6150269 - DNA, 23 bp, Homo sapiens
ctcctgcccgcagacctctggat

SEQ ID NO: 6150270 - DNA, 22 bp, Homo sapiens
ctcctgccctccgccccgtccc

SEQ ID NO: 6150271 - DNA, 14 bp, Homo sapiens
ctcctgccctcctc

SEQ ID NO: 6150272 - DNA, 20 bp, Homo sapiens
ctcctgccctcctctcccct

SEQ ID NO: 6150273 - DNA, 23 bp, Homo sapiens
ctcctgccctctgctctgcctgg

SEQ ID NO: 6150274 - DNA, 24 bp, Homo sapiens
ctcctgccctctgctctgcctgga

SEQ ID NO: 6150275 - DNA, 12 bp, Homo sapiens
ctcctgccctgt

SEQ ID NO: 6150276 - DNA, 13 bp, Homo sapiens
ctcctgccctgtg

SEQ ID NO: 6150277 - DNA, 13 bp, Homo sapiens
ctcctgccctgtt

SEQ ID NO: 6150278 - DNA, 15 bp, Homo sapiens
ctcctgccgactcct

SEQ ID NO: 6150279 - DNA, 16 bp, Homo sapiens
ctcctgccgactcctg

SEQ ID NO: 6150280 - DNA, 23 bp, Homo sapiens
ctcctgccgcagacgggcacaga

SEQ ID NO: 6150281 - DNA, 14 bp, Homo sapiens
ctcctgccgggcag

SEQ ID NO: 6150282 - DNA, 22 bp, Homo sapiens
ctcctgcctacattccctggcc

SEQ ID NO: 6150283 - DNA, 20 bp, Homo sapiens
ctcctgcctcaccctcccaa

SEQ ID NO: 6150284 - DNA, 13 bp, Homo sapiens
ctcctgcctcagc

SEQ ID NO: 6150285 - DNA, 19 bp, Homo sapiens
ctcctgcctcagcctcccg

SEQ ID NO: 6150286 - DNA, 19 bp, Homo sapiens
ctcctgcctcagcctcctg

SEQ ID NO: 6150287 - DNA, 19 bp, Homo sapiens
ctcctgcctcagccttcca

SEQ ID NO: 6150288 - DNA, 13 bp, Homo sapiens
ctcctgcctcccg

SEQ ID NO: 6150289 - DNA, 17 bp, Homo sapiens
ctcctgcctccgctggc

SEQ ID NO: 6150290 - DNA, 19 bp, Homo sapiens
ctcctgcctccgctggctt

SEQ ID NO: 6150291 - DNA, 15 bp, Homo sapiens
ctcctgcctcctcag

SEQ ID NO: 6150292 - DNA, 19 bp, Homo sapiens
ctcctgcctcctcagcttt

SEQ ID NO: 6150293 - DNA, 12 bp, Homo sapiens
ctcctgcctcta

SEQ ID NO: 6150294 - DNA, 19 bp, Homo sapiens
ctcctgcctgagtttccag

SEQ ID NO: 6150295 - DNA, 22 bp, Homo sapiens
ctcctgcctgagtttccagcct

SEQ ID NO: 6150296 - DNA, 14 bp, Homo sapiens
ctcctgcctgcccc

SEQ ID NO: 6150297 - DNA, 20 bp, Homo sapiens
ctcctgcctgcccccacacc

SEQ ID NO: 6150298 - DNA, 20 bp, Homo sapiens
ctcctgcctgccctgcctca

SEQ ID NO: 6150299 - DNA, 22 bp, Homo sapiens
ctcctgcctgccctgcctcagc

SEQ ID NO: 6150300 - DNA, 17 bp, Homo sapiens
ctcctgcctgcgcagct

SEQ ID NO: 6150301 - DNA, 11 bp, Homo sapiens
ctcctgcctgt

SEQ ID NO: 6150302 - DNA, 15 bp, Homo sapiens
ctcctgcctgtagca

SEQ ID NO: 6150303 - DNA, 15 bp, Homo sapiens
ctcctgcctgtgttt

SEQ ID NO: 6150304 - DNA, 12 bp, Homo sapiens
ctcctgccttga

SEQ ID NO: 6150305 - DNA, 16 bp, Homo sapiens
ctcctgcctttgcctc

SEQ ID NO: 6150306 - DNA, 17 bp, Homo sapiens
ctcctgcgcaggccatg

SEQ ID NO: 6150307 - DNA, 16 bp, Homo sapiens
ctcctgcgccccgccc

SEQ ID NO: 6150308 - DNA, 17 bp, Homo sapiens
ctcctgcgccccgccca

SEQ ID NO: 6150309 - DNA, 20 bp, Homo sapiens
ctcctgcgccccgcccacac

SEQ ID NO: 6150310 - DNA, 23 bp, Homo sapiens
ctcctgcgccccgcccacaccct

SEQ ID NO: 6150311 - DNA, 18 bp, Homo sapiens
ctcctgcgccctgtgccc

SEQ ID NO: 6150312 - DNA, 14 bp, Homo sapiens
ctcctgcggctcag

SEQ ID NO: 6150313 - DNA, 19 bp, Homo sapiens
ctcctgcggctcagccttg

SEQ ID NO: 6150314 - DNA, 21 bp, Homo sapiens
ctcctgcggctcagccttgca

SEQ ID NO: 6150315 - DNA, 18 bp, Homo sapiens
ctcctgcgggggcgaggc

SEQ ID NO: 6150316 - DNA, 19 bp, Homo sapiens
ctcctgcgtctgtttttaa

SEQ ID NO: 6150317 - DNA, 16 bp, Homo sapiens
ctcctgctcctcagga

SEQ ID NO: 6150318 - DNA, 16 bp, Homo sapiens
ctcctgctcctccctg

SEQ ID NO: 6150319 - DNA, 20 bp, Homo sapiens
ctcctgctcctccctgcccc

SEQ ID NO: 6150320 - DNA, 21 bp, Homo sapiens
ctcctgctcctccctgccccc

SEQ ID NO: 6150321 - DNA, 14 bp, Homo sapiens
ctcctgctctcata

SEQ ID NO: 6150322 - DNA, 18 bp, Homo sapiens
ctcctgctctgcttcctc

SEQ ID NO: 6150323 - DNA, 20 bp, Homo sapiens
ctcctgctctgcttcctcag

SEQ ID NO: 6150324 - DNA, 21 bp, Homo sapiens
ctgctttgttgttctgcctgt

SEQ ID NO: 6150325 - DNA, 22 bp, Homo sapiens
ctgcttttaaaacataggaaag

SEQ ID NO: 6150326 - DNA, 14 bp, Homo sapiens
ctgcttttaccatg

SEQ ID NO: 6150327 - DNA, 21 bp, Homo sapiens
ctgcttttagttcatatatac

SEQ ID NO: 6150328 - DNA, 17 bp, Homo sapiens
ctgcttttatctcagat

SEQ ID NO: 6150329 - DNA, 22 bp, Homo sapiens
ctgcttttattaaatttgttga

SEQ ID NO: 6150330 - DNA, 17 bp, Homo sapiens
ctgcttttcagaatgga

SEQ ID NO: 6150331 - DNA, 19 bp, Homo sapiens
ctgcttttccacaaggaat

SEQ ID NO: 6150332 - DNA, 14 bp, Homo sapiens
ctgcttttccagga

SEQ ID NO: 6150333 - DNA, 19 bp, Homo sapiens
ctgcttttccaggatcctg

SEQ ID NO: 6150334 - DNA, 23 bp, Homo sapiens
ctgcttttccaggatcctgcagg

SEQ ID NO: 6150335 - DNA, 18 bp, Homo sapiens
ctgcttttccattctggg

SEQ ID NO: 6150336 - DNA, 20 bp, Homo sapiens
ctgcttttccattctgggtg

SEQ ID NO: 6150337 - DNA, 18 bp, Homo sapiens
ctgcttttccctttgtga

SEQ ID NO: 6150338 - DNA, 19 bp, Homo sapiens
ctgcttttccctttgtgag

SEQ ID NO: 6150339 - DNA, 17 bp, Homo sapiens
ctgcttttcctctgcct

SEQ ID NO: 6150340 - DNA, 21 bp, Homo sapiens
ctgcttttccttggggcaggc

SEQ ID NO: 6150341 - DNA, 20 bp, Homo sapiens
ctgcttttcggaacactaaa

SEQ ID NO: 6150342 - DNA, 14 bp, Homo sapiens
ctgcttttctgccc

SEQ ID NO: 6150343 - DNA, 15 bp, Homo sapiens
ctgcttttctgccct

SEQ ID NO: 6150344 - DNA, 18 bp, Homo sapiens
ctgcttttctgccctggc

SEQ ID NO: 6150345 - DNA, 12 bp, Homo sapiens
ctgcttttctgt

SEQ ID NO: 6150346 - DNA, 13 bp, Homo sapiens
ctgcttttctgtc

SEQ ID NO: 6150347 - DNA, 13 bp, Homo sapiens
ctgcttttcttaa

SEQ ID NO: 6150348 - DNA, 18 bp, Homo sapiens
ctgcttttgatgatgtct

SEQ ID NO: 6150349 - DNA, 19 bp, Homo sapiens
ctgcttttgatgatgtcta

SEQ ID NO: 6150350 - DNA, 13 bp, Homo sapiens
ctgcttttgatgg

SEQ ID NO: 6150351 - DNA, 18 bp, Homo sapiens
ctgcttttgcaaacagaa

SEQ ID NO: 6150352 - DNA, 19 bp, Homo sapiens
ctgcttttgcataatgcaa

SEQ ID NO: 6150353 - DNA, 14 bp, Homo sapiens
ctgcttttgcatct

SEQ ID NO: 6150354 - DNA, 13 bp, Homo sapiens
ctgcttttggcct

SEQ ID NO: 6150355 - DNA, 15 bp, Homo sapiens
ctgcttttggcctgg

SEQ ID NO: 6150356 - DNA, 20 bp, Homo sapiens
ctgcttttggggctcttgat

SEQ ID NO: 6150357 - DNA, 15 bp, Homo sapiens
ctgcttttggtctgt

SEQ ID NO: 6150358 - DNA, 23 bp, Homo sapiens
ctgcttttgtcactcggctttgg

SEQ ID NO: 6150359 - DNA, 17 bp, Homo sapiens
ctgcttttgtctccctt

SEQ ID NO: 6150360 - DNA, 22 bp, Homo sapiens
ctgctttttaaagaatgctctt

SEQ ID NO: 6150361 - DNA, 22 bp, Homo sapiens
ctgctttttccaactcagaaat

SEQ ID NO: 6150362 - DNA, 19 bp, Homo sapiens
ctgctttttctttcttttt

SEQ ID NO: 6150363 - DNA, 13 bp, Homo sapiens
ctgctttttgaaa

SEQ ID NO: 6150364 - DNA, 15 bp, Homo sapiens
ctgctttttgaaatg

SEQ ID NO: 6150365 - DNA, 18 bp, Homo sapiens
ctgctttttggaaagtca

SEQ ID NO: 6150366 - DNA, 17 bp, Homo sapiens
ctgctttttggcacagt

SEQ ID NO: 6150367 - DNA, 19 bp, Homo sapiens
ctgctttttttcttaaaag

SEQ ID NO: 6150368 - DNA, 17 bp, Homo sapiens
ctgcttttttttttcca

SEQ ID NO: 6150369 - DNA, 18 bp, Homo sapiens
ctgcttttttttttccag

SEQ ID NO: 6150370 - DNA, 23 bp, Homo sapiens
ctgcttttttttttccagcaagt

SEQ ID NO: 6150371 - DNA, 17 bp, Homo sapiens
ctggaaaaaaaatatat

SEQ ID NO: 6150372 - DNA, 14 bp, Homo sapiens
ctggaaaaattaag

SEQ ID NO: 6150373 - DNA, 17 bp, Homo sapiens
ctggaaaacagaacact

SEQ ID NO: 6150374 - DNA, 18 bp, Homo sapiens
ctggaaaacagaacactt

SEQ ID NO: 6150375 - DNA, 19 bp, Homo sapiens
ctggaaaacagaacactta

SEQ ID NO: 6150376 - DNA, 19 bp, Homo sapiens
ctggaaaacagacgggtct

SEQ ID NO: 6150377 - DNA, 16 bp, Homo sapiens
ctggaaaacatagagt

SEQ ID NO: 6150378 - DNA, 19 bp, Homo sapiens
ctggaaaacctgaggccaa

SEQ ID NO: 6150379 - DNA, 23 bp, Homo sapiens
ctggaaaactattgagccttgca

SEQ ID NO: 6150380 - DNA, 17 bp, Homo sapiens
ctggaaaactcaggatt

SEQ ID NO: 6150381 - DNA, 22 bp, Homo sapiens
ctggaaaactgccacaagcaca

SEQ ID NO: 6150382 - DNA, 23 bp, Homo sapiens
ctggaaaactgccacaagcacaa

SEQ ID NO: 6150383 - DNA, 18 bp, Homo sapiens
ctggaaaagaagaaactt

SEQ ID NO: 6150384 - DNA, 23 bp, Homo sapiens
ctggaaaagaagaaactttgcct

SEQ ID NO: 6150385 - DNA, 15 bp, Homo sapiens
ctggaaaagaggagt

SEQ ID NO: 6150386 - DNA, 14 bp, Homo sapiens
ctggaaaagcactt

SEQ ID NO: 6150387 - DNA, 15 bp, Homo sapiens
ctggaaaagcacttt

SEQ ID NO: 6150388 - DNA, 22 bp, Homo sapiens
ctggaaaaggtgaaaatgtttt

SEQ ID NO: 6150389 - DNA, 18 bp, Homo sapiens
ctggaaaagtcacacaga

SEQ ID NO: 6150390 - DNA, 23 bp, Homo sapiens
ctggaaaagtcacacagacacac

SEQ ID NO: 6150391 - DNA, 23 bp, Homo sapiens
ctggaaaagttagtattaaaatc

SEQ ID NO: 6150392 - DNA, 17 bp, Homo sapiens
ctggaaaataatactgc

SEQ ID NO: 6150393 - DNA, 20 bp, Homo sapiens
ctggaaaataatactgctga

SEQ ID NO: 6150394 - DNA, 21 bp, Homo sapiens
ctggaaaatcatattgagaat

SEQ ID NO: 6150395 - DNA, 20 bp, Homo sapiens
ctggaaaatctgtaaaaaag

SEQ ID NO: 6150396 - DNA, 20 bp, Homo sapiens
ctggaaaattcctattgatt

SEQ ID NO: 6150397 - DNA, 17 bp, Homo sapiens
ctggaaacacagtcact

SEQ ID NO: 6150398 - DNA, 18 bp, Homo sapiens
ctggaaacagacagggag

SEQ ID NO: 6150399 - DNA, 14 bp, Homo sapiens
ctggaaacagcatg

SEQ ID NO: 6150400 - DNA, 15 bp, Homo sapiens
ctggaaacagcatga

SEQ ID NO: 6150401 - DNA, 19 bp, Homo sapiens
ctggaaacagcatgaataa

SEQ ID NO: 6150402 - DNA, 23 bp, Homo sapiens
ctggaaacagcatgaataaaaca

SEQ ID NO: 6150403 - DNA, 16 bp, Homo sapiens
ctggaaacccacctct

SEQ ID NO: 6150404 - DNA, 17 bp, Homo sapiens
ctggaaacccacctctc

SEQ ID NO: 6150405 - DNA, 21 bp, Homo sapiens
ctggaaacctgttatgccaaa

SEQ ID NO: 6150406 - DNA, 17 bp, Homo sapiens
ctggaaaccttccaccc

SEQ ID NO: 6150407 - DNA, 23 bp, Homo sapiens
ctggaaagagctgttttggatga

SEQ ID NO: 6150408 - DNA, 15 bp, Homo sapiens
ctggaaagaggagaa

SEQ ID NO: 6150409 - DNA, 18 bp, Homo sapiens
ctggaaagaggagaagga

SEQ ID NO: 6150410 - DNA, 20 bp, Homo sapiens
ctggaaagaggagaaggaga

SEQ ID NO: 6150411 - DNA, 21 bp, Homo sapiens
ctggaaagaggagaaggagag

SEQ ID NO: 6150412 - DNA, 22 bp, Homo sapiens
ctggaaagaggagaaggagagg

SEQ ID NO: 6150413 - DNA, 17 bp, Homo sapiens
ctggaaagcaaacagga

SEQ ID NO: 6150414 - DNA, 16 bp, Homo sapiens
ctggaaagcacaagac

SEQ ID NO: 6150415 - DNA, 17 bp, Homo sapiens
ctggaaagcacaagact

SEQ ID NO: 6150416 - DNA, 23 bp, Homo sapiens
ctggaaagcacaagactggccca

SEQ ID NO: 6150417 - DNA, 21 bp, Homo sapiens
ctggaaagcagagcctcctgg

SEQ ID NO: 6150418 - DNA, 22 bp, Homo sapiens
ctggaaagcagagcctcctggg

SEQ ID NO: 6150419 - DNA, 23 bp, Homo sapiens
ctggaaagcagagcctcctggga

SEQ ID NO: 6150420 - DNA, 22 bp, Homo sapiens
ctggaaagcaggcaagcatgtt

SEQ ID NO: 6150421 - DNA, 13 bp, Homo sapiens
ctggaaaggaaag

SEQ ID NO: 6150422 - DNA, 18 bp, Homo sapiens
ctggaaaggccagcagcc

SEQ ID NO: 6150423 - DNA, 13 bp, Homo sapiens
ctggaaaggctca

SEQ ID NO: 6150424 - DNA, 15 bp, Homo sapiens
ctggaaaggctcagt

SEQ ID NO: 6150425 - DNA, 20 bp, Homo sapiens
ctggaaaggctcagtctcag

SEQ ID NO: 6150426 - DNA, 15 bp, Homo sapiens
ctggaaaggggagag

SEQ ID NO: 6150427 - DNA, 19 bp, Homo sapiens
ctggaaaggggagagcctg

SEQ ID NO: 6150428 - DNA, 20 bp, Homo sapiens
ctggaaaggggggagctggg

SEQ ID NO: 6150429 - DNA, 20 bp, Homo sapiens
ctggaaagttgggcccctga

SEQ ID NO: 6150430 - DNA, 23 bp, Homo sapiens
ctggaaataaagtaggaaagaat

SEQ ID NO: 6150431 - DNA, 22 bp, Homo sapiens
ctggaaatactgatggaagcac

SEQ ID NO: 6150432 - DNA, 21 bp, Homo sapiens
ctggaaatcagggttagtatt

SEQ ID NO: 6150433 - DNA, 18 bp, Homo sapiens
ctggaaatccagctggtt

SEQ ID NO: 6150434 - DNA, 17 bp, Homo sapiens
ctggaaatccctttctg

SEQ ID NO: 6150435 - DNA, 19 bp, Homo sapiens
ctggaaatctgttttgtat

SEQ ID NO: 6150436 - DNA, 23 bp, Homo sapiens
ctggaaatgcatgacttccctcc

SEQ ID NO: 6150437 - DNA, 17 bp, Homo sapiens
ctggaaatgtagcactt

SEQ ID NO: 6150438 - DNA, 20 bp, Homo sapiens
ctggaaatgtagcacttacg

SEQ ID NO: 6150439 - DNA, 22 bp, Homo sapiens
ctggaaatgttctttagatggt

SEQ ID NO: 6150440 - DNA, 15 bp, Homo sapiens
ctggaaattaaaaaa

SEQ ID NO: 6150441 - DNA, 22 bp, Homo sapiens
ctggaaattccaggaaccaaaa

SEQ ID NO: 6150442 - DNA, 16 bp, Homo sapiens
ctggaaattctggaac

SEQ ID NO: 6150443 - DNA, 18 bp, Homo sapiens
ctggaaattcttccctgg

SEQ ID NO: 6150444 - DNA, 20 bp, Homo sapiens
ctggaaattgaggtccatgg

SEQ ID NO: 6150445 - DNA, 14 bp, Homo sapiens
ctggaaatttgtgt

SEQ ID NO: 6150446 - DNA, 12 bp, Homo sapiens
ctggaaattttg

SEQ ID NO: 6150447 - DNA, 23 bp, Homo sapiens
ctggaacaaatcgtttctcagaa

SEQ ID NO: 6150448 - DNA, 15 bp, Homo sapiens
ctggaacaacttgta

SEQ ID NO: 6150449 - DNA, 17 bp, Homo sapiens
ctggaacaacttgtagc

SEQ ID NO: 6150450 - DNA, 21 bp, Homo sapiens
ctggaacaacttgtagcagct

SEQ ID NO: 6150451 - DNA, 13 bp, Homo sapiens
ctggaacaatatt

SEQ ID NO: 6150452 - DNA, 13 bp, Homo sapiens
ctggaacacaggg

SEQ ID NO: 6150453 - DNA, 14 bp, Homo sapiens
ctggaacacagggg

SEQ ID NO: 6150454 - DNA, 17 bp, Homo sapiens
ctggaacacaggggcct

SEQ ID NO: 6150455 - DNA, 16 bp, Homo sapiens
ctggaacacctgatgg

SEQ ID NO: 6150456 - DNA, 20 bp, Homo sapiens
ctggaacactagacaagcca

SEQ ID NO: 6150457 - DNA, 22 bp, Homo sapiens
ctggaacactagacaagccaga

SEQ ID NO: 6150458 - DNA, 16 bp, Homo sapiens
ctggaacactgtactg

SEQ ID NO: 6150459 - DNA, 21 bp, Homo sapiens
ctggaacagattcacactgtc

SEQ ID NO: 6150460 - DNA, 20 bp, Homo sapiens
ctggaacagcccattttatc

SEQ ID NO: 6150461 - DNA, 20 bp, Homo sapiens
ctggaacatcatcaaggcac

SEQ ID NO: 6150462 - DNA, 22 bp, Homo sapiens
ctggaacatcctttgcagggca

SEQ ID NO: 6150463 - DNA, 16 bp, Homo sapiens
ctggaacatttgatat

SEQ ID NO: 6150464 - DNA, 20 bp, Homo sapiens
ctggaacatttgatattttt

SEQ ID NO: 6150465 - DNA, 13 bp, Homo sapiens
ctggaaccagagg

SEQ ID NO: 6150466 - DNA, 21 bp, Homo sapiens
ctggaaccagcaagtcccaga

SEQ ID NO: 6150467 - DNA, 20 bp, Homo sapiens
ctggaaccagggaggagagg

SEQ ID NO: 6150468 - DNA, 16 bp, Homo sapiens
ctggaaccatcagaaa

SEQ ID NO: 6150469 - DNA, 16 bp, Homo sapiens
ctggaaccatcctctg

SEQ ID NO: 6150470 - DNA, 18 bp, Homo sapiens
ctggaaccatcctctgtt

SEQ ID NO: 6150471 - DNA, 16 bp, Homo sapiens
ctggaacccagactca

SEQ ID NO: 6150472 - DNA, 19 bp, Homo sapiens
ctggaacccagactcagac

SEQ ID NO: 6150473 - DNA, 22 bp, Homo sapiens
ctggaacccagactcagacatt

SEQ ID NO: 6150474 - DNA, 14 bp, Homo sapiens
ctggaaccccccag

SEQ ID NO: 6150475 - DNA, 15 bp, Homo sapiens
ctggaaccccccagg

SEQ ID NO: 6150476 - DNA, 17 bp, Homo sapiens
ctggaaccgggaagggt

SEQ ID NO: 6150477 - DNA, 17 bp, Homo sapiens
ctggaacctcagcctgg

SEQ ID NO: 6150478 - DNA, 22 bp, Homo sapiens
ctggaacctcagcctggccaga

SEQ ID NO: 6150479 - DNA, 14 bp, Homo sapiens
ctggaacctccctg

SEQ ID NO: 6150480 - DNA, 18 bp, Homo sapiens
ctggaacctgcaaaaaat

SEQ ID NO: 6150481 - DNA, 14 bp, Homo sapiens
ctggaacctggacc

SEQ ID NO: 6150482 - DNA, 19 bp, Homo sapiens
ctggaacctggaccccagc

SEQ ID NO: 6150483 - DNA, 13 bp, Homo sapiens
ctggaacctggca

SEQ ID NO: 6150484 - DNA, 14 bp, Homo sapiens
ctggaacctggcag

SEQ ID NO: 6150485 - DNA, 15 bp, Homo sapiens
ctggaacctggcagg

SEQ ID NO: 6150486 - DNA, 18 bp, Homo sapiens
ctggaacctggcaggccc

SEQ ID NO: 6150487 - DNA, 14 bp, Homo sapiens
ctggaaccttctag

SEQ ID NO: 6150488 - DNA, 13 bp, Homo sapiens
ctggaacctttcc

SEQ ID NO: 6150489 - DNA, 19 bp, Homo sapiens
ctggaacgctctaggcaga

SEQ ID NO: 6150490 - DNA, 22 bp, Homo sapiens
ctggaacggtgaaggtgacagc

SEQ ID NO: 6150491 - DNA, 19 bp, Homo sapiens
ctggaactcctaaaccttt

SEQ ID NO: 6150492 - DNA, 20 bp, Homo sapiens
ctggaactctatctgggcct

SEQ ID NO: 6150493 - DNA, 17 bp, Homo sapiens
ctggaactcttgacagc

SEQ ID NO: 6150494 - DNA, 22 bp, Homo sapiens
ctggaactgaagtccaaattgt

SEQ ID NO: 6150495 - DNA, 22 bp, Homo sapiens
ctggaactgattgctcccagga

SEQ ID NO: 6150496 - DNA, 23 bp, Homo sapiens
ctggaactgattgctcccaggat

SEQ ID NO: 6150497 - DNA, 19 bp, Homo sapiens
ctggaactgcaactccagc

SEQ ID NO: 6150498 - DNA, 15 bp, Homo sapiens
ctggaactgctgctg

SEQ ID NO: 6150499 - DNA, 12 bp, Homo sapiens
ctcctgctctgg

SEQ ID NO: 6150500 - DNA, 14 bp, Homo sapiens
ctcctgctctggga

SEQ ID NO: 6150501 - DNA, 16 bp, Homo sapiens
ctcctgctctgggacg

SEQ ID NO: 6150502 - DNA, 17 bp, Homo sapiens
ctcctgctctgggacgt

SEQ ID NO: 6150503 - DNA, 21 bp, Homo sapiens
ctcctgctgaccttctgcggc

SEQ ID NO: 6150504 - DNA, 13 bp, Homo sapiens
ctcctgctgagct

SEQ ID NO: 6150505 - DNA, 14 bp, Homo sapiens
ctcctgctgagctg

SEQ ID NO: 6150506 - DNA, 15 bp, Homo sapiens
ctcctgctgagctgc

SEQ ID NO: 6150507 - DNA, 16 bp, Homo sapiens
ctcctgctgagctgcc

SEQ ID NO: 6150508 - DNA, 13 bp, Homo sapiens
ctcctgctgagtg

SEQ ID NO: 6150509 - DNA, 13 bp, Homo sapiens
ctcctgctgcacc

SEQ ID NO: 6150510 - DNA, 19 bp, Homo sapiens
ctcctgctgcaccaaccca

SEQ ID NO: 6150511 - DNA, 12 bp, Homo sapiens
ctcctgctgcag

SEQ ID NO: 6150512 - DNA, 13 bp, Homo sapiens
ctcctgctgccag

SEQ ID NO: 6150513 - DNA, 14 bp, Homo sapiens
ctcctgctgcgtga

SEQ ID NO: 6150514 - DNA, 13 bp, Homo sapiens
ctcctgctgctca

SEQ ID NO: 6150515 - DNA, 14 bp, Homo sapiens
ctcctgctgctcac

SEQ ID NO: 6150516 - DNA, 16 bp, Homo sapiens
ctcctgctgctccctc

SEQ ID NO: 6150517 - DNA, 18 bp, Homo sapiens
ctcctgctgctccctcag

SEQ ID NO: 6150518 - DNA, 22 bp, Homo sapiens
ctcctgctgctccctcagactg

SEQ ID NO: 6150519 - DNA, 12 bp, Homo sapiens
ctcctgctggct

SEQ ID NO: 6150520 - DNA, 15 bp, Homo sapiens
ctcctgctggctctc

SEQ ID NO: 6150521 - DNA, 16 bp, Homo sapiens
ctcctgctggctgagg

SEQ ID NO: 6150522 - DNA, 14 bp, Homo sapiens
ctcctgctgggcgt

SEQ ID NO: 6150523 - DNA, 12 bp, Homo sapiens
ctcctgctggta

SEQ ID NO: 6150524 - DNA, 23 bp, Homo sapiens
ctcctgctgtaaatttggcttct

SEQ ID NO: 6150525 - DNA, 12 bp, Homo sapiens
ctcctgctgtag

SEQ ID NO: 6150526 - DNA, 12 bp, Homo sapiens
ctcctgctgtgc

SEQ ID NO: 6150527 - DNA, 14 bp, Homo sapiens
ctcctgctgtgcct

SEQ ID NO: 6150528 - DNA, 13 bp, Homo sapiens
ctcctgctgtgct

SEQ ID NO: 6150529 - DNA, 14 bp, Homo sapiens
ctcctgcttcccct

SEQ ID NO: 6150530 - DNA, 14 bp, Homo sapiens
ctcctgcttcctct

SEQ ID NO: 6150531 - DNA, 23 bp, Homo sapiens
ctcctgcttcctcttttcctgct

SEQ ID NO: 6150532 - DNA, 19 bp, Homo sapiens
ctcctgcttctctcagcca

SEQ ID NO: 6150533 - DNA, 23 bp, Homo sapiens
ctcctgcttttctgtcctgggca

SEQ ID NO: 6150534 - DNA, 17 bp, Homo sapiens
ctcctggaaaggctcag

SEQ ID NO: 6150535 - DNA, 20 bp, Homo sapiens
ctcctggaaaggctcagtct

SEQ ID NO: 6150536 - DNA, 22 bp, Homo sapiens
ctcctggaaaggctcagtctca

SEQ ID NO: 6150537 - DNA, 11 bp, Homo sapiens
ctcctggaaat

SEQ ID NO: 6150538 - DNA, 21 bp, Homo sapiens
ctcctggaaccggtcacagga

SEQ ID NO: 6150539 - DNA, 18 bp, Homo sapiens
ctcctggaacctggcagg

SEQ ID NO: 6150540 - DNA, 19 bp, Homo sapiens
ctcctggaacctggcaggc

SEQ ID NO: 6150541 - DNA, 22 bp, Homo sapiens
ctcctggaacctggcaggccct

SEQ ID NO: 6150542 - DNA, 17 bp, Homo sapiens
ctcctggaaccttgctg

SEQ ID NO: 6150543 - DNA, 16 bp, Homo sapiens
ctcctggaatggagct

SEQ ID NO: 6150544 - DNA, 20 bp, Homo sapiens
ctcctggacacattggaatg

SEQ ID NO: 6150545 - DNA, 18 bp, Homo sapiens
ctcctggacattttttca

SEQ ID NO: 6150546 - DNA, 18 bp, Homo sapiens
ctcctggacccagcaggg

SEQ ID NO: 6150547 - DNA, 23 bp, Homo sapiens
ctcctggaccttgacagagcagc

SEQ ID NO: 6150548 - DNA, 12 bp, Homo sapiens
ctcctggactcc

SEQ ID NO: 6150549 - DNA, 20 bp, Homo sapiens
ctcctggactccggaggact

SEQ ID NO: 6150550 - DNA, 22 bp, Homo sapiens
ctcctggactccggaggactga

SEQ ID NO: 6150551 - DNA, 24 bp, Homo sapiens
ctcctggactccggaggactgagc

SEQ ID NO: 6150552 - DNA, 15 bp, Homo sapiens
ctcctggactcctgc

SEQ ID NO: 6150553 - DNA, 20 bp, Homo sapiens
ctcctggactggttatcttg

SEQ ID NO: 6150554 - DNA, 18 bp, Homo sapiens
ctcctggagatttcagtt

SEQ ID NO: 6150555 - DNA, 14 bp, Homo sapiens
ctcctggagcaagc

SEQ ID NO: 6150556 - DNA, 19 bp, Homo sapiens
ctcctggagcaagctctgc

SEQ ID NO: 6150557 - DNA, 22 bp, Homo sapiens
ctcctggagcagcagctgaggc

SEQ ID NO: 6150558 - DNA, 17 bp, Homo sapiens
ctcctggagcatcccag

SEQ ID NO: 6150559 - DNA, 12 bp, Homo sapiens
ctcctggagcct

SEQ ID NO: 6150560 - DNA, 19 bp, Homo sapiens
ctcctggagctctgtgggt

SEQ ID NO: 6150561 - DNA, 14 bp, Homo sapiens
ctcctggaggctgg

SEQ ID NO: 6150562 - DNA, 13 bp, Homo sapiens
ctcctggagggcg

SEQ ID NO: 6150563 - DNA, 17 bp, Homo sapiens
ctcctggagggcgccca

SEQ ID NO: 6150564 - DNA, 19 bp, Homo sapiens
ctcctggagggcgcccagc

SEQ ID NO: 6150565 - DNA, 21 bp, Homo sapiens
ctcctggagggcgcccagcag

SEQ ID NO: 6150566 - DNA, 21 bp, Homo sapiens
ctcctggattttaagtagaca

SEQ ID NO: 6150567 - DNA, 11 bp, Homo sapiens
ctcctggcaca

SEQ ID NO: 6150568 - DNA, 24 bp, Homo sapiens
ctcctggcacaacgctctaccctg

SEQ ID NO: 6150569 - DNA, 14 bp, Homo sapiens
ctcctggcacctga

SEQ ID NO: 6150570 - DNA, 10 bp, Homo sapiens
ctcctggcag

SEQ ID NO: 6150571 - DNA, 14 bp, Homo sapiens
ctcctggcagggcc

SEQ ID NO: 6150572 - DNA, 18 bp, Homo sapiens
ctcctggccaagcaggct

SEQ ID NO: 6150573 - DNA, 15 bp, Homo sapiens
ctcctggccagacgc

SEQ ID NO: 6150574 - DNA, 19 bp, Homo sapiens
ctcctggcccactgcatcg

SEQ ID NO: 6150575 - DNA, 14 bp, Homo sapiens
ctcctggcccagcc

SEQ ID NO: 6150576 - DNA, 18 bp, Homo sapiens
ctcctggcccagcctttg

SEQ ID NO: 6150577 - DNA, 18 bp, Homo sapiens
ctcctggcccgccctcac

SEQ ID NO: 6150578 - DNA, 23 bp, Homo sapiens
ctcctggcccgccctcacctctg

SEQ ID NO: 6150579 - DNA, 13 bp, Homo sapiens
ctcctggcctatc

SEQ ID NO: 6150580 - DNA, 18 bp, Homo sapiens
ctcctggcctatccgctg

SEQ ID NO: 6150581 - DNA, 20 bp, Homo sapiens
ctcctggcctcaagccatct

SEQ ID NO: 6150582 - DNA, 17 bp, Homo sapiens
ctcctggcctcaagtga

SEQ ID NO: 6150583 - DNA, 20 bp, Homo sapiens
ctcctggcctggccatctcc

SEQ ID NO: 6150584 - DNA, 23 bp, Homo sapiens
ctcctggcctttcctggttttca

SEQ ID NO: 6150585 - DNA, 19 bp, Homo sapiens
ctcctggctaagcctctgc

SEQ ID NO: 6150586 - DNA, 17 bp, Homo sapiens
ctcctggctcacagcca

SEQ ID NO: 6150587 - DNA, 17 bp, Homo sapiens
ctcctggctcaggccca

SEQ ID NO: 6150588 - DNA, 17 bp, Homo sapiens
ctcctggctgccaggcg

SEQ ID NO: 6150589 - DNA, 14 bp, Homo sapiens
ctcctggctgggcc

SEQ ID NO: 6150590 - DNA, 16 bp, Homo sapiens
ctcctggctgggccat

SEQ ID NO: 6150591 - DNA, 21 bp, Homo sapiens
ctcctggctgggccatccttc

SEQ ID NO: 6150592 - DNA, 15 bp, Homo sapiens
ctcctggctgtgccc

SEQ ID NO: 6150593 - DNA, 18 bp, Homo sapiens
ctcctggctgtgcccagc

SEQ ID NO: 6150594 - DNA, 19 bp, Homo sapiens
ctcctggctgtgcccagca

SEQ ID NO: 6150595 - DNA, 15 bp, Homo sapiens
ctcctggcttcatgt

SEQ ID NO: 6150596 - DNA, 16 bp, Homo sapiens
ctcctgggaaagggag

SEQ ID NO: 6150597 - DNA, 17 bp, Homo sapiens
ctcctgggaagatgagg

SEQ ID NO: 6150598 - DNA, 20 bp, Homo sapiens
ctcctgggaaggccacctcc

SEQ ID NO: 6150599 - DNA, 22 bp, Homo sapiens
ctcctgggaccatggacacatt

SEQ ID NO: 6150600 - DNA, 17 bp, Homo sapiens
ctcctgggacccttggc

SEQ ID NO: 6150601 - DNA, 20 bp, Homo sapiens
ctcctgggacccttggctat

SEQ ID NO: 6150602 - DNA, 13 bp, Homo sapiens
ctcctgggagaga

SEQ ID NO: 6150603 - DNA, 15 bp, Homo sapiens
ctcctgggagagaag

SEQ ID NO: 6150604 - DNA, 19 bp, Homo sapiens
ctcctgggagcccccacca

SEQ ID NO: 6150605 - DNA, 20 bp, Homo sapiens
ctcctgggagcccccaccac

SEQ ID NO: 6150606 - DNA, 23 bp, Homo sapiens
ctcctgggaggccctggcagaag

SEQ ID NO: 6150607 - DNA, 18 bp, Homo sapiens
ctcctgggcaccccaggc

SEQ ID NO: 6150608 - DNA, 20 bp, Homo sapiens
ctcctgggcaccccaggcag

SEQ ID NO: 6150609 - DNA, 16 bp, Homo sapiens
ctcctgggcagccgtt

SEQ ID NO: 6150610 - DNA, 19 bp, Homo sapiens
ctcctgggcagctgcctcc

SEQ ID NO: 6150611 - DNA, 21 bp, Homo sapiens
ctcctgggcatctggccctgc

SEQ ID NO: 6150612 - DNA, 19 bp, Homo sapiens
ctcctgggcattagcaagg

SEQ ID NO: 6150613 - DNA, 17 bp, Homo sapiens
ctcctgggcccaggcag

SEQ ID NO: 6150614 - DNA, 14 bp, Homo sapiens
ctcctgggccccag

SEQ ID NO: 6150615 - DNA, 23 bp, Homo sapiens
ctcctgggccccagaaagcctca

SEQ ID NO: 6150616 - DNA, 22 bp, Homo sapiens
ctcctgggcccctcatctgctc

SEQ ID NO: 6150617 - DNA, 22 bp, Homo sapiens
ctcctgggcccctccctacctc

SEQ ID NO: 6150618 - DNA, 23 bp, Homo sapiens
ctcctgggcccctccctacctca

SEQ ID NO: 6150619 - DNA, 22 bp, Homo sapiens
ctcctgggcccgctttgcctgc

SEQ ID NO: 6150620 - DNA, 12 bp, Homo sapiens
ctcctgggccct

SEQ ID NO: 6150621 - DNA, 14 bp, Homo sapiens
ctcctgggccctct

SEQ ID NO: 6150622 - DNA, 15 bp, Homo sapiens
ctcctgggccctctc

SEQ ID NO: 6150623 - DNA, 18 bp, Homo sapiens
ctcctgggccctgggctg

SEQ ID NO: 6150624 - DNA, 23 bp, Homo sapiens
ctcctgggccgttacatctgtgc

SEQ ID NO: 6150625 - DNA, 15 bp, Homo sapiens
ctcctgggctatatt

SEQ ID NO: 6150626 - DNA, 13 bp, Homo sapiens
ctcctgggctcaa

SEQ ID NO: 6150627 - DNA, 16 bp, Homo sapiens
ctcctgggctccagag

SEQ ID NO: 6150628 - DNA, 19 bp, Homo sapiens
ctcctgggctctgaacaca

SEQ ID NO: 6150629 - DNA, 20 bp, Homo sapiens
ctcctggggagctcctggga

SEQ ID NO: 6150630 - DNA, 17 bp, Homo sapiens
ctcctggggccaggccg

SEQ ID NO: 6150631 - DNA, 22 bp, Homo sapiens
ctcctggggccaggccgggcct

SEQ ID NO: 6150632 - DNA, 16 bp, Homo sapiens
ctcctggggcgtccag

SEQ ID NO: 6150633 - DNA, 16 bp, Homo sapiens
ctcctgggggtggcag

SEQ ID NO: 6150634 - DNA, 19 bp, Homo sapiens
ctcctgggggtggcaggca

SEQ ID NO: 6150635 - DNA, 20 bp, Homo sapiens
ctcctgggggtggcaggcac

SEQ ID NO: 6150636 - DNA, 18 bp, Homo sapiens
ctcctgggggttctttct

SEQ ID NO: 6150637 - DNA, 20 bp, Homo sapiens
ctcctgggggttctttcttc

SEQ ID NO: 6150638 - DNA, 20 bp, Homo sapiens
ctcctgggttcacatgattc

SEQ ID NO: 6150639 - DNA, 15 bp, Homo sapiens
ctcctgggttgagct

SEQ ID NO: 6150640 - DNA, 22 bp, Homo sapiens
ctcctgggttgagctgttgcct

SEQ ID NO: 6150641 - DNA, 13 bp, Homo sapiens
ctcctggtcctgg

SEQ ID NO: 6150642 - DNA, 14 bp, Homo sapiens
ctcctggtcctgga

SEQ ID NO: 6150643 - DNA, 20 bp, Homo sapiens
ctcctggtcctggacacctc

SEQ ID NO: 6150644 - DNA, 24 bp, Homo sapiens
ctcctggtcctggacacctcccag

SEQ ID NO: 6150645 - DNA, 15 bp, Homo sapiens
ctcctggtcttgaga

SEQ ID NO: 6150646 - DNA, 21 bp, Homo sapiens
ctcctggtgaagtgtgacttc

SEQ ID NO: 6150647 - DNA, 22 bp, Homo sapiens
ctcctggtgcaggtctccacct

SEQ ID NO: 6150648 - DNA, 21 bp, Homo sapiens
ctcctggtgcccacagcaggg

SEQ ID NO: 6150649 - DNA, 13 bp, Homo sapiens
ctcctggtgcccc

SEQ ID NO: 6150650 - DNA, 16 bp, Homo sapiens
ctcctggtggccttct

SEQ ID NO: 6150651 - DNA, 21 bp, Homo sapiens
ctcctggtggccttctgctgc

SEQ ID NO: 6150652 - DNA, 15 bp, Homo sapiens
ctcctggtggggcag

SEQ ID NO: 6150653 - DNA, 23 bp, Homo sapiens
ctcctggtggggcagaaaggctg

SEQ ID NO: 6150654 - DNA, 18 bp, Homo sapiens
ctcctggtgtcaccccag

SEQ ID NO: 6150655 - DNA, 20 bp, Homo sapiens
ctcctggtgtcaccccagag

SEQ ID NO: 6150656 - DNA, 15 bp, Homo sapiens
ctcctggtgtgggta

SEQ ID NO: 6150657 - DNA, 18 bp, Homo sapiens
ctcctggtgttctgcagt

SEQ ID NO: 6150658 - DNA, 19 bp, Homo sapiens
ctcctggtgtttttctctc

SEQ ID NO: 6150659 - DNA, 18 bp, Homo sapiens
ctcctggttcaagcgatt

SEQ ID NO: 6150660 - DNA, 22 bp, Homo sapiens
ctcctggttcaagcgattctca

SEQ ID NO: 6150661 - DNA, 15 bp, Homo sapiens
ctcctggttgttcct

SEQ ID NO: 6150662 - DNA, 13 bp, Homo sapiens
ctcctggtttcct

SEQ ID NO: 6150663 - DNA, 16 bp, Homo sapiens
ctcctggtttcctttc

SEQ ID NO: 6150664 - DNA, 21 bp, Homo sapiens
ctcctgtaaatggtgtacata

SEQ ID NO: 6150665 - DNA, 22 bp, Homo sapiens
ctcctgtaacatactggcctgg

SEQ ID NO: 6150666 - DNA, 17 bp, Homo sapiens
ctcctgtaagccaaaga

SEQ ID NO: 6150667 - DNA, 16 bp, Homo sapiens
ctcctgtacctcagtg

SEQ ID NO: 6150668 - DNA, 17 bp, Homo sapiens
ctcctgtagccactggc

SEQ ID NO: 6150669 - DNA, 20 bp, Homo sapiens
ctcctgtagccactggcata

SEQ ID NO: 6150670 - DNA, 20 bp, Homo sapiens
ctcctgtataaccccacctt

SEQ ID NO: 6150671 - DNA, 13 bp, Homo sapiens
ctcctgtcaccta

SEQ ID NO: 6150672 - DNA, 17 bp, Homo sapiens
ctcctgtcactcactga

SEQ ID NO: 6150673 - DNA, 22 bp, Homo sapiens
ctcctgtcactcactgaggcca

SEQ ID NO: 6150674 - DNA, 15 bp, Homo sapiens
ctcctgtcagtgagg

SEQ ID NO: 6150675 - DNA, 19 bp, Homo sapiens
ctcctgtccaaagtaggga

SEQ ID NO: 6150676 - DNA, 15 bp, Homo sapiens
ctcctgtccagcagg

SEQ ID NO: 6150677 - DNA, 19 bp, Homo sapiens
ctggaactgctgctgaccc

SEQ ID NO: 6150678 - DNA, 16 bp, Homo sapiens
ctggaactttagtgaa

SEQ ID NO: 6150679 - DNA, 19 bp, Homo sapiens
ctggaactttagtgaaaca

SEQ ID NO: 6150680 - DNA, 19 bp, Homo sapiens
ctggaagaaactaaaaata

SEQ ID NO: 6150681 - DNA, 19 bp, Homo sapiens
ctggaagaaagccctgtgc

SEQ ID NO: 6150682 - DNA, 16 bp, Homo sapiens
ctggaagaacaggcct

SEQ ID NO: 6150683 - DNA, 18 bp, Homo sapiens
ctggaagaacaggcctct

SEQ ID NO: 6150684 - DNA, 15 bp, Homo sapiens
ctggaagaacatcaa

SEQ ID NO: 6150685 - DNA, 14 bp, Homo sapiens
ctggaagaaccact

SEQ ID NO: 6150686 - DNA, 16 bp, Homo sapiens
ctggaagaacccttct

SEQ ID NO: 6150687 - DNA, 17 bp, Homo sapiens
ctggaagaagaggagga

SEQ ID NO: 6150688 - DNA, 14 bp, Homo sapiens
ctggaagaagcagc

SEQ ID NO: 6150689 - DNA, 15 bp, Homo sapiens
ctggaagacacttca

SEQ ID NO: 6150690 - DNA, 13 bp, Homo sapiens
ctggaagacagag

SEQ ID NO: 6150691 - DNA, 21 bp, Homo sapiens
ctggaagacgcaagggcctga

SEQ ID NO: 6150692 - DNA, 19 bp, Homo sapiens
ctggaagactgctcccggc

SEQ ID NO: 6150693 - DNA, 13 bp, Homo sapiens
ctggaagactgtg

SEQ ID NO: 6150694 - DNA, 18 bp, Homo sapiens
ctggaagactgtgcagaa

SEQ ID NO: 6150695 - DNA, 22 bp, Homo sapiens
ctggaagacttagatctgagcc

SEQ ID NO: 6150696 - DNA, 23 bp, Homo sapiens
ctggaagacttagatctgagccc

SEQ ID NO: 6150697 - DNA, 23 bp, Homo sapiens
ctggaagagccaaagaatattcc

SEQ ID NO: 6150698 - DNA, 21 bp, Homo sapiens
ctggaagagccgagcacctgt

SEQ ID NO: 6150699 - DNA, 17 bp, Homo sapiens
ctggaagagctaggcag

SEQ ID NO: 6150700 - DNA, 14 bp, Homo sapiens
ctggaagaggtggg

SEQ ID NO: 6150701 - DNA, 16 bp, Homo sapiens
ctggaagatagctgtg

SEQ ID NO: 6150702 - DNA, 22 bp, Homo sapiens
ctggaagatataacattcagtt

SEQ ID NO: 6150703 - DNA, 13 bp, Homo sapiens
ctggaagcaaatg

SEQ ID NO: 6150704 - DNA, 15 bp, Homo sapiens
ctggaagcacagaaa

SEQ ID NO: 6150705 - DNA, 22 bp, Homo sapiens
ctggaagcacagaaaactagaa

SEQ ID NO: 6150706 - DNA, 13 bp, Homo sapiens
ctggaagcacagc

SEQ ID NO: 6150707 - DNA, 18 bp, Homo sapiens
ctggaagcacagcttcat

SEQ ID NO: 6150708 - DNA, 12 bp, Homo sapiens
ctggaagcacat

SEQ ID NO: 6150709 - DNA, 15 bp, Homo sapiens
ctggaagcacatgtt

SEQ ID NO: 6150710 - DNA, 19 bp, Homo sapiens
ctggaagcactacagagca

SEQ ID NO: 6150711 - DNA, 15 bp, Homo sapiens
ctggaagcactgctg

SEQ ID NO: 6150712 - DNA, 11 bp, Homo sapiens
ctggaagcaga

SEQ ID NO: 6150713 - DNA, 12 bp, Homo sapiens
ctggaagcagaa

SEQ ID NO: 6150714 - DNA, 15 bp, Homo sapiens
ctggaagcagtgccc

SEQ ID NO: 6150715 - DNA, 16 bp, Homo sapiens
ctggaagcagtgccca

SEQ ID NO: 6150716 - DNA, 16 bp, Homo sapiens
ctggaagccagctttc

SEQ ID NO: 6150717 - DNA, 17 bp, Homo sapiens
ctggaagccagctttcc

SEQ ID NO: 6150718 - DNA, 12 bp, Homo sapiens
ctggaagcccag

SEQ ID NO: 6150719 - DNA, 17 bp, Homo sapiens
ctggaagcccagcccct

SEQ ID NO: 6150720 - DNA, 21 bp, Homo sapiens
ctggaagcccagcccctactg

SEQ ID NO: 6150721 - DNA, 17 bp, Homo sapiens
ctggaagccccccacct

SEQ ID NO: 6150722 - DNA, 21 bp, Homo sapiens
ctggaagcccctgggcccagt

SEQ ID NO: 6150723 - DNA, 13 bp, Homo sapiens
ctggaagcctgct

SEQ ID NO: 6150724 - DNA, 15 bp, Homo sapiens
ctggaagcctgctga

SEQ ID NO: 6150725 - DNA, 16 bp, Homo sapiens
ctggaagcctgctgat

SEQ ID NO: 6150726 - DNA, 16 bp, Homo sapiens
ctggaagcctggactc

SEQ ID NO: 6150727 - DNA, 15 bp, Homo sapiens
ctggaagccttcccc

SEQ ID NO: 6150728 - DNA, 19 bp, Homo sapiens
ctggaagctaatttgcatt

SEQ ID NO: 6150729 - DNA, 21 bp, Homo sapiens
ctggaagctctccgagctctg

SEQ ID NO: 6150730 - DNA, 17 bp, Homo sapiens
ctggaagctgagcaggc

SEQ ID NO: 6150731 - DNA, 15 bp, Homo sapiens
ctggaagctgtcagg

SEQ ID NO: 6150732 - DNA, 12 bp, Homo sapiens
ctggaagctgtg

SEQ ID NO: 6150733 - DNA, 19 bp, Homo sapiens
ctggaagctttgtagaaat

SEQ ID NO: 6150734 - DNA, 22 bp, Homo sapiens
ctggaagctttgtagaaattaa

SEQ ID NO: 6150735 - DNA, 18 bp, Homo sapiens
ctggaagctttgtcccct

SEQ ID NO: 6150736 - DNA, 16 bp, Homo sapiens
ctggaaggaaagcaag

SEQ ID NO: 6150737 - DNA, 22 bp, Homo sapiens
ctggaaggaaagcaaggcagaa

SEQ ID NO: 6150738 - DNA, 18 bp, Homo sapiens
ctggaaggacacagtgat

SEQ ID NO: 6150739 - DNA, 12 bp, Homo sapiens
ctggaaggacct

SEQ ID NO: 6150740 - DNA, 21 bp, Homo sapiens
ctggaaggacctgctcccaca

SEQ ID NO: 6150741 - DNA, 14 bp, Homo sapiens
ctggaaggagcaca

SEQ ID NO: 6150742 - DNA, 20 bp, Homo sapiens
ctggaaggagccagccagga

SEQ ID NO: 6150743 - DNA, 15 bp, Homo sapiens
ctggaaggcagcagg

SEQ ID NO: 6150744 - DNA, 13 bp, Homo sapiens
ctggaaggcaggg

SEQ ID NO: 6150745 - DNA, 17 bp, Homo sapiens
ctggaaggcagggcaga

SEQ ID NO: 6150746 - DNA, 20 bp, Homo sapiens
ctggaaggcagggcagaggg

SEQ ID NO: 6150747 - DNA, 23 bp, Homo sapiens
ctggaaggccccttccctggcag

SEQ ID NO: 6150748 - DNA, 14 bp, Homo sapiens
ctggaagggacagt

SEQ ID NO: 6150749 - DNA, 23 bp, Homo sapiens
ctggaagggaggaaggcctttct

SEQ ID NO: 6150750 - DNA, 18 bp, Homo sapiens
ctggaaggggcagcagga

SEQ ID NO: 6150751 - DNA, 15 bp, Homo sapiens
ctggaaggggcagcc

SEQ ID NO: 6150752 - DNA, 22 bp, Homo sapiens
ctggaaggggcagccctgagtg

SEQ ID NO: 6150753 - DNA, 20 bp, Homo sapiens
ctggaagggtccggcttggc

SEQ ID NO: 6150754 - DNA, 17 bp, Homo sapiens
ctggaagtacttggccc

SEQ ID NO: 6150755 - DNA, 18 bp, Homo sapiens
ctggaagtcaaataaatg

SEQ ID NO: 6150756 - DNA, 20 bp, Homo sapiens
ctggaagtcaaataaatgtt

SEQ ID NO: 6150757 - DNA, 19 bp, Homo sapiens
ctggaagtccaatgtggca

SEQ ID NO: 6150758 - DNA, 20 bp, Homo sapiens
ctggaagtctacctgctgga

SEQ ID NO: 6150759 - DNA, 21 bp, Homo sapiens
ctggaagtctacctgctggac

SEQ ID NO: 6150760 - DNA, 24 bp, Homo sapiens
ctggaagtctacctgctggacagc

SEQ ID NO: 6150761 - DNA, 15 bp, Homo sapiens
ctggaagtgactttg

SEQ ID NO: 6150762 - DNA, 17 bp, Homo sapiens
ctggaagtgtgtgtttc

SEQ ID NO: 6150763 - DNA, 19 bp, Homo sapiens
ctggaagttaaagtgaggc

SEQ ID NO: 6150764 - DNA, 17 bp, Homo sapiens
ctggaagttgtggatat

SEQ ID NO: 6150765 - DNA, 19 bp, Homo sapiens
ctggaagttgtggatatca

SEQ ID NO: 6150766 - DNA, 13 bp, Homo sapiens
ctggaataaacag

SEQ ID NO: 6150767 - DNA, 18 bp, Homo sapiens
ctggaataaagttgcaga

SEQ ID NO: 6150768 - DNA, 23 bp, Homo sapiens
ctggaataaagttgcagatgatt

SEQ ID NO: 6150769 - DNA, 16 bp, Homo sapiens
ctggaataactcttac

SEQ ID NO: 6150770 - DNA, 23 bp, Homo sapiens
ctggaataatcctaaacatatga

SEQ ID NO: 6150771 - DNA, 15 bp, Homo sapiens
ctggaataatttgta

SEQ ID NO: 6150772 - DNA, 16 bp, Homo sapiens
ctggaataatttgtaa

SEQ ID NO: 6150773 - DNA, 21 bp, Homo sapiens
ctggaataatttgtaaatgat

SEQ ID NO: 6150774 - DNA, 15 bp, Homo sapiens
ctggaatacatgaaa

SEQ ID NO: 6150775 - DNA, 18 bp, Homo sapiens
ctggaatacatgaaatat

SEQ ID NO: 6150776 - DNA, 14 bp, Homo sapiens
ctggaatactgaaa

SEQ ID NO: 6150777 - DNA, 15 bp, Homo sapiens
ctggaatactgaaaa

SEQ ID NO: 6150778 - DNA, 20 bp, Homo sapiens
ctggaatactgaaaaagaat

SEQ ID NO: 6150779 - DNA, 20 bp, Homo sapiens
ctggaatagtaaactaaagt

SEQ ID NO: 6150780 - DNA, 16 bp, Homo sapiens
ctggaatagttacttt

SEQ ID NO: 6150781 - DNA, 17 bp, Homo sapiens
ctggaatatctgagaat

SEQ ID NO: 6150782 - DNA, 23 bp, Homo sapiens
ctggaatcaagatgtcagactgg

SEQ ID NO: 6150783 - DNA, 20 bp, Homo sapiens
ctggaatcaaggaatcctga

SEQ ID NO: 6150784 - DNA, 20 bp, Homo sapiens
ctggaatcagagatttttgt

SEQ ID NO: 6150785 - DNA, 22 bp, Homo sapiens
ctggaatcagtatttccttcca

SEQ ID NO: 6150786 - DNA, 20 bp, Homo sapiens
ctggaatccagaaggaagct

SEQ ID NO: 6150787 - DNA, 16 bp, Homo sapiens
ctggaatcccagctcc

SEQ ID NO: 6150788 - DNA, 17 bp, Homo sapiens
ctggaatctacaagcca

SEQ ID NO: 6150789 - DNA, 16 bp, Homo sapiens
ctggaatctactagaa

SEQ ID NO: 6150790 - DNA, 15 bp, Homo sapiens
ctggaatctcatgat

SEQ ID NO: 6150791 - DNA, 14 bp, Homo sapiens
ctggaatctgaggc

SEQ ID NO: 6150792 - DNA, 24 bp, Homo sapiens
ctggaatctggagaccagggagcc

SEQ ID NO: 6150793 - DNA, 19 bp, Homo sapiens
ctggaatctggagagctag

SEQ ID NO: 6150794 - DNA, 20 bp, Homo sapiens
ctggaatcttccatctgcat

SEQ ID NO: 6150795 - DNA, 19 bp, Homo sapiens
ctggaatcttccccaaggg

SEQ ID NO: 6150796 - DNA, 13 bp, Homo sapiens
ctggaatgaggga

SEQ ID NO: 6150797 - DNA, 20 bp, Homo sapiens
ctggaatggaagggttctgg

SEQ ID NO: 6150798 - DNA, 17 bp, Homo sapiens
ctggaatggactgggtg

SEQ ID NO: 6150799 - DNA, 19 bp, Homo sapiens
ctggaatggagctgtataa

SEQ ID NO: 6150800 - DNA, 14 bp, Homo sapiens
ctggaatgggagac

SEQ ID NO: 6150801 - DNA, 16 bp, Homo sapiens
ctggaatggggacctg

SEQ ID NO: 6150802 - DNA, 17 bp, Homo sapiens
ctggaatggggacctgg

SEQ ID NO: 6150803 - DNA, 22 bp, Homo sapiens
ctggaatggtacatgtcttcca

SEQ ID NO: 6150804 - DNA, 16 bp, Homo sapiens
ctggaatggtgttttg

SEQ ID NO: 6150805 - DNA, 15 bp, Homo sapiens
ctggaatgtaatcaa

SEQ ID NO: 6150806 - DNA, 16 bp, Homo sapiens
ctggaatgtgccacag

SEQ ID NO: 6150807 - DNA, 17 bp, Homo sapiens
ctggaatgtgccacaga

SEQ ID NO: 6150808 - DNA, 19 bp, Homo sapiens
ctggaatgtgccacagagg

SEQ ID NO: 6150809 - DNA, 21 bp, Homo sapiens
ctggaatgtgccacagaggcc

SEQ ID NO: 6150810 - DNA, 13 bp, Homo sapiens
ctggaattcaccc

SEQ ID NO: 6150811 - DNA, 22 bp, Homo sapiens
ctggaattcagcaccctgggtg

SEQ ID NO: 6150812 - DNA, 15 bp, Homo sapiens
ctggaattccacagg

SEQ ID NO: 6150813 - DNA, 18 bp, Homo sapiens
ctggaattccacagggac

SEQ ID NO: 6150814 - DNA, 20 bp, Homo sapiens
ctggaattccacagggacca

SEQ ID NO: 6150815 - DNA, 23 bp, Homo sapiens
ctggaattcctaacttttcaatg

SEQ ID NO: 6150816 - DNA, 20 bp, Homo sapiens
ctggaattgatgtttacatg

SEQ ID NO: 6150817 - DNA, 18 bp, Homo sapiens
ctggaattgccagctgac

SEQ ID NO: 6150818 - DNA, 16 bp, Homo sapiens
ctggaattgctgctct

SEQ ID NO: 6150819 - DNA, 15 bp, Homo sapiens
ctggaattgtggcta

SEQ ID NO: 6150820 - DNA, 17 bp, Homo sapiens
ctggaattgttgaatgt

SEQ ID NO: 6150821 - DNA, 23 bp, Homo sapiens
ctggaatttaaggagggacaaga

SEQ ID NO: 6150822 - DNA, 19 bp, Homo sapiens
ctggaatttacctcccctt

SEQ ID NO: 6150823 - DNA, 16 bp, Homo sapiens
ctggaatttgggcaga

SEQ ID NO: 6150824 - DNA, 21 bp, Homo sapiens
ctggaattttttattcttgtg

SEQ ID NO: 6150825 - DNA, 13 bp, Homo sapiens
ctggacaaagaat

SEQ ID NO: 6150826 - DNA, 13 bp, Homo sapiens
ctggacaacccag

SEQ ID NO: 6150827 - DNA, 15 bp, Homo sapiens
ctggacaagaagctg

SEQ ID NO: 6150828 - DNA, 15 bp, Homo sapiens
ctggacaagcagagg

SEQ ID NO: 6150829 - DNA, 15 bp, Homo sapiens
ctggacaagccaact

SEQ ID NO: 6150830 - DNA, 19 bp, Homo sapiens
ctggacacaataggtcttt

SEQ ID NO: 6150831 - DNA, 18 bp, Homo sapiens
ctggacacacactcacca

SEQ ID NO: 6150832 - DNA, 21 bp, Homo sapiens
ctggacacactaaactctggg

SEQ ID NO: 6150833 - DNA, 10 bp, Homo sapiens
ctggacacag

SEQ ID NO: 6150834 - DNA, 21 bp, Homo sapiens
ctggacacagcccaccctctg

SEQ ID NO: 6150835 - DNA, 12 bp, Homo sapiens
ctggacacagct

SEQ ID NO: 6150836 - DNA, 13 bp, Homo sapiens
ctggacacagctc

SEQ ID NO: 6150837 - DNA, 14 bp, Homo sapiens
ctggacacagctct

SEQ ID NO: 6150838 - DNA, 19 bp, Homo sapiens
ctggacacagtcagggcgg

SEQ ID NO: 6150839 - DNA, 17 bp, Homo sapiens
ctggacacccccttggt

SEQ ID NO: 6150840 - DNA, 15 bp, Homo sapiens
ctggacaccctctgc

SEQ ID NO: 6150841 - DNA, 17 bp, Homo sapiens
ctggacaccctctgccg

SEQ ID NO: 6150842 - DNA, 18 bp, Homo sapiens
ctggacaccctctgccga

SEQ ID NO: 6150843 - DNA, 17 bp, Homo sapiens
ctggacaccgggccagt

SEQ ID NO: 6150844 - DNA, 20 bp, Homo sapiens
ctggacacctacagcagcac

SEQ ID NO: 6150845 - DNA, 14 bp, Homo sapiens
ctggacacctccca

SEQ ID NO: 6150846 - DNA, 21 bp, Homo sapiens
ctggacacctcccaggggact

SEQ ID NO: 6150847 - DNA, 20 bp, Homo sapiens
ctggacactagggtcaggcg

SEQ ID NO: 6150848 - DNA, 17 bp, Homo sapiens
ctggacactcagacctg

SEQ ID NO: 6150849 - DNA, 18 bp, Homo sapiens
ctggacactcagacctga

SEQ ID NO: 6150850 - DNA, 12 bp, Homo sapiens
ctggacacttct

SEQ ID NO: 6150851 - DNA, 23 bp, Homo sapiens
ctggacacttctttatactctct

SEQ ID NO: 6150852 - DNA, 12 bp, Homo sapiens
ctggacagacag

SEQ ID NO: 6150853 - DNA, 16 bp, Homo sapiens
ctggacagacccaggt

SEQ ID NO: 6150854 - DNA, 19 bp, Homo sapiens
ctggacagacccaggtctt

SEQ ID NO: 6150855 - DNA, 14 bp, Homo sapiens
ctggacagagactc

SEQ ID NO: 6150856 - DNA, 20 bp, Homo sapiens
ctcctgtccatcagccagga

SEQ ID NO: 6150857 - DNA, 18 bp, Homo sapiens
ctcctgtcccctgctaca

SEQ ID NO: 6150858 - DNA, 13 bp, Homo sapiens
ctcctgtccctac

SEQ ID NO: 6150859 - DNA, 15 bp, Homo sapiens
ctcctgtccctaccc

SEQ ID NO: 6150860 - DNA, 18 bp, Homo sapiens
ctcctgtccctacccact

SEQ ID NO: 6150861 - DNA, 20 bp, Homo sapiens
ctcctgtccctacccactct

SEQ ID NO: 6150862 - DNA, 22 bp, Homo sapiens
ctcctgtccctacccactcttt

SEQ ID NO: 6150863 - DNA, 14 bp, Homo sapiens
ctcctgtccctgta

SEQ ID NO: 6150864 - DNA, 17 bp, Homo sapiens
ctcctgtccctgtagct

SEQ ID NO: 6150865 - DNA, 20 bp, Homo sapiens
ctcctgtccctgtagctcag

SEQ ID NO: 6150866 - DNA, 14 bp, Homo sapiens
ctcctgtccctttt

SEQ ID NO: 6150867 - DNA, 20 bp, Homo sapiens
ctcctgtcccttttccctta

SEQ ID NO: 6150868 - DNA, 10 bp, Homo sapiens
ctcctgtcct

SEQ ID NO: 6150869 - DNA, 13 bp, Homo sapiens
ctcctgtcctccc

SEQ ID NO: 6150870 - DNA, 20 bp, Homo sapiens
ctcctgtcctcccatcccct

SEQ ID NO: 6150871 - DNA, 11 bp, Homo sapiens
ctcctgtcctt

SEQ ID NO: 6150872 - DNA, 18 bp, Homo sapiens
ctcctgtctcagcctcct

SEQ ID NO: 6150873 - DNA, 19 bp, Homo sapiens
ctcctgtctccatgataac

SEQ ID NO: 6150874 - DNA, 17 bp, Homo sapiens
ctcctgtctgccagcca

SEQ ID NO: 6150875 - DNA, 13 bp, Homo sapiens
ctcctgtctggct

SEQ ID NO: 6150876 - DNA, 21 bp, Homo sapiens
ctcctgtctgtcctggaggtg

SEQ ID NO: 6150877 - DNA, 10 bp, Homo sapiens
ctcctgtctt

SEQ ID NO: 6150878 - DNA, 14 bp, Homo sapiens
ctcctgtcttatgg

SEQ ID NO: 6150879 - DNA, 15 bp, Homo sapiens
ctcctgtcttcagag

SEQ ID NO: 6150880 - DNA, 21 bp, Homo sapiens
ctcctgtcttcccagggtagc

SEQ ID NO: 6150881 - DNA, 13 bp, Homo sapiens
ctcctgtcttctg

SEQ ID NO: 6150882 - DNA, 14 bp, Homo sapiens
ctcctgtcttctgc

SEQ ID NO: 6150883 - DNA, 18 bp, Homo sapiens
ctcctgtcttctgctttg

SEQ ID NO: 6150884 - DNA, 17 bp, Homo sapiens
ctcctgtcttctttctc

SEQ ID NO: 6150885 - DNA, 16 bp, Homo sapiens
ctcctgtgatgtccca

SEQ ID NO: 6150886 - DNA, 17 bp, Homo sapiens
ctcctgtgatgtcccag

SEQ ID NO: 6150887 - DNA, 20 bp, Homo sapiens
ctcctgtgccccagctgcca

SEQ ID NO: 6150888 - DNA, 21 bp, Homo sapiens
ctcctgtgccccagctgccag

SEQ ID NO: 6150889 - DNA, 22 bp, Homo sapiens
ctcctgtgccccagctgccagg

SEQ ID NO: 6150890 - DNA, 19 bp, Homo sapiens
ctcctgtgcccctcagaga

SEQ ID NO: 6150891 - DNA, 21 bp, Homo sapiens
ctcctgtgcccctcagagagg

SEQ ID NO: 6150892 - DNA, 13 bp, Homo sapiens
ctcctgtgccctt

SEQ ID NO: 6150893 - DNA, 18 bp, Homo sapiens
ctcctgtgcctggcccca

SEQ ID NO: 6150894 - DNA, 16 bp, Homo sapiens
ctcctgtgctcagccc

SEQ ID NO: 6150895 - DNA, 14 bp, Homo sapiens
ctcctgtgctctgg

SEQ ID NO: 6150896 - DNA, 13 bp, Homo sapiens
ctcctgtgctggg

SEQ ID NO: 6150897 - DNA, 17 bp, Homo sapiens
ctcctgtggcagctgcc

SEQ ID NO: 6150898 - DNA, 18 bp, Homo sapiens
ctcctgtggcagctgccc

SEQ ID NO: 6150899 - DNA, 15 bp, Homo sapiens
ctcctgtggcaggag

SEQ ID NO: 6150900 - DNA, 21 bp, Homo sapiens
ctcctgtggccccaccctggg

SEQ ID NO: 6150901 - DNA, 18 bp, Homo sapiens
ctcctgtggcctgccagt

SEQ ID NO: 6150902 - DNA, 17 bp, Homo sapiens
ctcctgtggcggtgcag

SEQ ID NO: 6150903 - DNA, 13 bp, Homo sapiens
ctcctgtgggagc

SEQ ID NO: 6150904 - DNA, 18 bp, Homo sapiens
ctcctgtgggagcctcgc

SEQ ID NO: 6150905 - DNA, 18 bp, Homo sapiens
ctcctgtggtttgctcca

SEQ ID NO: 6150906 - DNA, 19 bp, Homo sapiens
ctcctgtggtttgctccag

SEQ ID NO: 6150907 - DNA, 11 bp, Homo sapiens
ctcctgtgtaa

SEQ ID NO: 6150908 - DNA, 18 bp, Homo sapiens
ctcctgtgtagctgggat

SEQ ID NO: 6150909 - DNA, 22 bp, Homo sapiens
ctcctgtgtcggtcagaacaac

SEQ ID NO: 6150910 - DNA, 17 bp, Homo sapiens
ctcctgtgtggaagaag

SEQ ID NO: 6150911 - DNA, 11 bp, Homo sapiens
ctcctgtgtgt

SEQ ID NO: 6150912 - DNA, 15 bp, Homo sapiens
ctcctgtgtgtctgc

SEQ ID NO: 6150913 - DNA, 20 bp, Homo sapiens
ctcctgtgtgtctgcagaca

SEQ ID NO: 6150914 - DNA, 14 bp, Homo sapiens
ctcctgtgtgtgcg

SEQ ID NO: 6150915 - DNA, 19 bp, Homo sapiens
ctcctgtgttcaagcgatt

SEQ ID NO: 6150916 - DNA, 21 bp, Homo sapiens
ctcctgttcctgccttctctt

SEQ ID NO: 6150917 - DNA, 15 bp, Homo sapiens
ctcctgttctgccca

SEQ ID NO: 6150918 - DNA, 20 bp, Homo sapiens
ctcctgttgcacccagccct

SEQ ID NO: 6150919 - DNA, 23 bp, Homo sapiens
ctcctgttgcacccagccctggt

SEQ ID NO: 6150920 - DNA, 15 bp, Homo sapiens
ctcctgttgccacac

SEQ ID NO: 6150921 - DNA, 16 bp, Homo sapiens
ctcctgttgccacact

SEQ ID NO: 6150922 - DNA, 16 bp, Homo sapiens
ctcctgttgccatgga

SEQ ID NO: 6150923 - DNA, 14 bp, Homo sapiens
ctcctgttggcctt

SEQ ID NO: 6150924 - DNA, 12 bp, Homo sapiens
ctcctgtttatg

SEQ ID NO: 6150925 - DNA, 18 bp, Homo sapiens
ctcctgtttggaaatggg

SEQ ID NO: 6150926 - DNA, 20 bp, Homo sapiens
ctcctgttttatatattatg

SEQ ID NO: 6150927 - DNA, 17 bp, Homo sapiens
ctccttaaaaactggcc

SEQ ID NO: 6150928 - DNA, 14 bp, Homo sapiens
ctccttaaactgac

SEQ ID NO: 6150929 - DNA, 18 bp, Homo sapiens
ctccttaaccacctagtc

SEQ ID NO: 6150930 - DNA, 21 bp, Homo sapiens
ctccttaatatgatctgtgga

SEQ ID NO: 6150931 - DNA, 23 bp, Homo sapiens
ctccttaatttaattgctttgaa

SEQ ID NO: 6150932 - DNA, 12 bp, Homo sapiens
ctccttacagaa

SEQ ID NO: 6150933 - DNA, 22 bp, Homo sapiens
ctccttacagaagggagtgaaa

SEQ ID NO: 6150934 - DNA, 14 bp, Homo sapiens
ctccttacctctgg

SEQ ID NO: 6150935 - DNA, 17 bp, Homo sapiens
ctccttacctctggaac

SEQ ID NO: 6150936 - DNA, 15 bp, Homo sapiens
ctccttacctggagt

SEQ ID NO: 6150937 - DNA, 14 bp, Homo sapiens
ctccttactctgag

SEQ ID NO: 6150938 - DNA, 17 bp, Homo sapiens
ctccttactctgagccc

SEQ ID NO: 6150939 - DNA, 23 bp, Homo sapiens
ctccttactctgagcccaggccg

SEQ ID NO: 6150940 - DNA, 14 bp, Homo sapiens
ctccttactgtgtt

SEQ ID NO: 6150941 - DNA, 22 bp, Homo sapiens
ctccttagaaaagactgacctt

SEQ ID NO: 6150942 - DNA, 13 bp, Homo sapiens
ctccttagaagtg

SEQ ID NO: 6150943 - DNA, 17 bp, Homo sapiens
ctccttagaagtggaag

SEQ ID NO: 6150944 - DNA, 19 bp, Homo sapiens
ctccttagacactttggaa

SEQ ID NO: 6150945 - DNA, 20 bp, Homo sapiens
ctccttagagacatcaaaat

SEQ ID NO: 6150946 - DNA, 21 bp, Homo sapiens
ctccttagagacatcaaaatc

SEQ ID NO: 6150947 - DNA, 15 bp, Homo sapiens
ctccttagctgccaa

SEQ ID NO: 6150948 - DNA, 17 bp, Homo sapiens
ctccttagctttccctg

SEQ ID NO: 6150949 - DNA, 17 bp, Homo sapiens
ctccttagtcttctcat

SEQ ID NO: 6150950 - DNA, 15 bp, Homo sapiens
ctccttatcccttgg

SEQ ID NO: 6150951 - DNA, 16 bp, Homo sapiens
ctccttatttatcaac

SEQ ID NO: 6150952 - DNA, 21 bp, Homo sapiens
ctccttatttatcaacatctt

SEQ ID NO: 6150953 - DNA, 19 bp, Homo sapiens
ctccttatttggcgtgacc

SEQ ID NO: 6150954 - DNA, 22 bp, Homo sapiens
ctccttcaaaacattctccttt

SEQ ID NO: 6150955 - DNA, 17 bp, Homo sapiens
ctccttcacagatgggt

SEQ ID NO: 6150956 - DNA, 13 bp, Homo sapiens
ctccttcaccacc

SEQ ID NO: 6150957 - DNA, 23 bp, Homo sapiens
ctccttcaccctccgttgacagt

SEQ ID NO: 6150958 - DNA, 14 bp, Homo sapiens
ctccttcacctttg

SEQ ID NO: 6150959 - DNA, 19 bp, Homo sapiens
ctccttcacctttgtcccc

SEQ ID NO: 6150960 - DNA, 17 bp, Homo sapiens
ctccttcactcctgcct

SEQ ID NO: 6150961 - DNA, 23 bp, Homo sapiens
ctccttcactgttccctctggct

SEQ ID NO: 6150962 - DNA, 13 bp, Homo sapiens
ctccttcagacac

SEQ ID NO: 6150963 - DNA, 14 bp, Homo sapiens
ctccttcagacacc

SEQ ID NO: 6150964 - DNA, 17 bp, Homo sapiens
ctccttcagccctcacc

SEQ ID NO: 6150965 - DNA, 20 bp, Homo sapiens
ctccttcagctctggggcag

SEQ ID NO: 6150966 - DNA, 14 bp, Homo sapiens
ctccttcaggggag

SEQ ID NO: 6150967 - DNA, 14 bp, Homo sapiens
ctccttcagtgaca

SEQ ID NO: 6150968 - DNA, 14 bp, Homo sapiens
ctccttcagttctg

SEQ ID NO: 6150969 - DNA, 16 bp, Homo sapiens
ctccttcagttctgct

SEQ ID NO: 6150970 - DNA, 17 bp, Homo sapiens
ctccttcagttctgctt

SEQ ID NO: 6150971 - DNA, 18 bp, Homo sapiens
ctccttcagttctgcttg

SEQ ID NO: 6150972 - DNA, 22 bp, Homo sapiens
ctccttcatatgaaaggtgcca

SEQ ID NO: 6150973 - DNA, 16 bp, Homo sapiens
ctccttcatgtttgga

SEQ ID NO: 6150974 - DNA, 10 bp, Homo sapiens
ctccttccac

SEQ ID NO: 6150975 - DNA, 15 bp, Homo sapiens
ctccttccacatgta

SEQ ID NO: 6150976 - DNA, 14 bp, Homo sapiens
ctccttccagatgc

SEQ ID NO: 6150977 - DNA, 12 bp, Homo sapiens
ctccttccaggc

SEQ ID NO: 6150978 - DNA, 14 bp, Homo sapiens
ctccttccaggccc

SEQ ID NO: 6150979 - DNA, 18 bp, Homo sapiens
ctccttccaggccccagg

SEQ ID NO: 6150980 - DNA, 21 bp, Homo sapiens
ctccttccaggccccaggctg

SEQ ID NO: 6150981 - DNA, 15 bp, Homo sapiens
ctccttccatccttg

SEQ ID NO: 6150982 - DNA, 16 bp, Homo sapiens
ctccttccatccttga

SEQ ID NO: 6150983 - DNA, 14 bp, Homo sapiens
ctccttccatctct

SEQ ID NO: 6150984 - DNA, 10 bp, Homo sapiens
ctccttccca

SEQ ID NO: 6150985 - DNA, 13 bp, Homo sapiens
ctccttcccaaat

SEQ ID NO: 6150986 - DNA, 19 bp, Homo sapiens
ctccttcccaaggcagctg

SEQ ID NO: 6150987 - DNA, 13 bp, Homo sapiens
ctccttcccaagt

SEQ ID NO: 6150988 - DNA, 14 bp, Homo sapiens
ctccttcccaagtg

SEQ ID NO: 6150989 - DNA, 16 bp, Homo sapiens
ctccttcccaccccta

SEQ ID NO: 6150990 - DNA, 17 bp, Homo sapiens
ctccttcccactcttct

SEQ ID NO: 6150991 - DNA, 13 bp, Homo sapiens
ctccttcccactg

SEQ ID NO: 6150992 - DNA, 17 bp, Homo sapiens
ctccttcccactgtcct

SEQ ID NO: 6150993 - DNA, 22 bp, Homo sapiens
ctccttcccactgtcctttctc

SEQ ID NO: 6150994 - DNA, 12 bp, Homo sapiens
ctccttcccagc

SEQ ID NO: 6150995 - DNA, 14 bp, Homo sapiens
ctccttcccagctc

SEQ ID NO: 6150996 - DNA, 18 bp, Homo sapiens
ctccttcccagctgcccc

SEQ ID NO: 6150997 - DNA, 19 bp, Homo sapiens
ctccttcccagctgcccct

SEQ ID NO: 6150998 - DNA, 22 bp, Homo sapiens
ctccttcccagctgcccctccc

SEQ ID NO: 6150999 - DNA, 16 bp, Homo sapiens
ctccttcccatcgctg

SEQ ID NO: 6151000 - DNA, 20 bp, Homo sapiens
ctccttcccatttctctaca

SEQ ID NO: 6151001 - DNA, 10 bp, Homo sapiens
ctccttcccc

SEQ ID NO: 6151002 - DNA, 16 bp, Homo sapiens
ctccttccccacccca

SEQ ID NO: 6151003 - DNA, 15 bp, Homo sapiens
ctccttccccacttc

SEQ ID NO: 6151004 - DNA, 12 bp, Homo sapiens
ctccttccccag

SEQ ID NO: 6151005 - DNA, 19 bp, Homo sapiens
ctccttccccagacccaga

SEQ ID NO: 6151006 - DNA, 23 bp, Homo sapiens
ctccttccccagacccagaggtc

SEQ ID NO: 6151007 - DNA, 18 bp, Homo sapiens
ctccttccccagctcccc

SEQ ID NO: 6151008 - DNA, 22 bp, Homo sapiens
ctccttccccaggatggactct

SEQ ID NO: 6151009 - DNA, 12 bp, Homo sapiens
ctccttccccat

SEQ ID NO: 6151010 - DNA, 15 bp, Homo sapiens
ctccttcccccagcc

SEQ ID NO: 6151011 - DNA, 17 bp, Homo sapiens
ctccttcccccagccca

SEQ ID NO: 6151012 - DNA, 21 bp, Homo sapiens
ctccttcccccagcccaataa

SEQ ID NO: 6151013 - DNA, 23 bp, Homo sapiens
ctccttccccccatctctgagtg

SEQ ID NO: 6151014 - DNA, 14 bp, Homo sapiens
ctccttcccctgca

SEQ ID NO: 6151015 - DNA, 16 bp, Homo sapiens
ctccttcccctgcacc

SEQ ID NO: 6151016 - DNA, 21 bp, Homo sapiens
ctccttccccttgtccctggg

SEQ ID NO: 6151017 - DNA, 21 bp, Homo sapiens
ctccttcccgccgcccgaccc

SEQ ID NO: 6151018 - DNA, 14 bp, Homo sapiens
ctccttccctcctg

SEQ ID NO: 6151019 - DNA, 19 bp, Homo sapiens
ctccttccctctctggaga

SEQ ID NO: 6151020 - DNA, 14 bp, Homo sapiens
ctccttcccttcct

SEQ ID NO: 6151021 - DNA, 14 bp, Homo sapiens
ctccttcccttctc

SEQ ID NO: 6151022 - DNA, 16 bp, Homo sapiens
ctccttcccttctctc

SEQ ID NO: 6151023 - DNA, 16 bp, Homo sapiens
ctccttcccttctctt

SEQ ID NO: 6151024 - DNA, 12 bp, Homo sapiens
ctccttcctaaa

SEQ ID NO: 6151025 - DNA, 10 bp, Homo sapiens
ctccttcctc

SEQ ID NO: 6151026 - DNA, 19 bp, Homo sapiens
ctccttcctcttggctgag

SEQ ID NO: 6151027 - DNA, 22 bp, Homo sapiens
ctccttcctgattgtttacagt

SEQ ID NO: 6151028 - DNA, 21 bp, Homo sapiens
ctccttcctgccacctgctgc

SEQ ID NO: 6151029 - DNA, 21 bp, Homo sapiens
ctccttcctgccccaactcct

SEQ ID NO: 6151030 - DNA, 14 bp, Homo sapiens
ctccttcctggaga

SEQ ID NO: 6151031 - DNA, 12 bp, Homo sapiens
ctccttcctggc

SEQ ID NO: 6151032 - DNA, 17 bp, Homo sapiens
ctccttcctggcctgag

SEQ ID NO: 6151033 - DNA, 18 bp, Homo sapiens
ctccttcctggcctgaga

SEQ ID NO: 6151034 - DNA, 11 bp, Homo sapiens
ctccttcctgt

SEQ ID NO: 6151035 - DNA, 15 bp, Homo sapiens
ctccttcctgtcttc

SEQ ID NO: 6151036 - DNA, 17 bp, Homo sapiens
ctccttcctgtcttcct

SEQ ID NO: 6151037 - DNA, 18 bp, Homo sapiens
ctccttcctgtggcctca

SEQ ID NO: 6151038 - DNA, 16 bp, Homo sapiens
ctggacagagactcag

SEQ ID NO: 6151039 - DNA, 20 bp, Homo sapiens
ctggacagagactcagcgct

SEQ ID NO: 6151040 - DNA, 23 bp, Homo sapiens
ctggacagagactcagcgctcct

SEQ ID NO: 6151041 - DNA, 13 bp, Homo sapiens
ctggacagaggcg

SEQ ID NO: 6151042 - DNA, 14 bp, Homo sapiens
ctggacagagggga

SEQ ID NO: 6151043 - DNA, 20 bp, Homo sapiens
ctggacagaggggactctgg

SEQ ID NO: 6151044 - DNA, 22 bp, Homo sapiens
ctggacagatcaggctagccct

SEQ ID NO: 6151045 - DNA, 23 bp, Homo sapiens
ctggacagatggacgcaggccct

SEQ ID NO: 6151046 - DNA, 22 bp, Homo sapiens
ctggacagatgggtgtcccctg

SEQ ID NO: 6151047 - DNA, 23 bp, Homo sapiens
ctggacagatgggtgtcccctgg

SEQ ID NO: 6151048 - DNA, 13 bp, Homo sapiens
ctggacagccagg

SEQ ID NO: 6151049 - DNA, 22 bp, Homo sapiens
ctggacagccagtgacctttga

SEQ ID NO: 6151050 - DNA, 14 bp, Homo sapiens
ctggacagcctccg

SEQ ID NO: 6151051 - DNA, 16 bp, Homo sapiens
ctggacagcctccgcc

SEQ ID NO: 6151052 - DNA, 13 bp, Homo sapiens
ctggacagcctct

SEQ ID NO: 6151053 - DNA, 22 bp, Homo sapiens
ctggacagcctcttctgtccca

SEQ ID NO: 6151054 - DNA, 19 bp, Homo sapiens
ctggacagcggttgtaaat

SEQ ID NO: 6151055 - DNA, 17 bp, Homo sapiens
ctggacagctgtgcctc

SEQ ID NO: 6151056 - DNA, 18 bp, Homo sapiens
ctggacagctgtgcctcg

SEQ ID NO: 6151057 - DNA, 20 bp, Homo sapiens
ctggacagctgtgcctcgct

SEQ ID NO: 6151058 - DNA, 14 bp, Homo sapiens
ctggacagcttgtg

SEQ ID NO: 6151059 - DNA, 23 bp, Homo sapiens
ctggacaggcatgttctctgagg

SEQ ID NO: 6151060 - DNA, 20 bp, Homo sapiens
ctggacaggcgggctcggag

SEQ ID NO: 6151061 - DNA, 15 bp, Homo sapiens
ctggacaggtctggg

SEQ ID NO: 6151062 - DNA, 18 bp, Homo sapiens
ctggacagtatcccacat

SEQ ID NO: 6151063 - DNA, 20 bp, Homo sapiens
ctggacagtatcccacatcc

SEQ ID NO: 6151064 - DNA, 23 bp, Homo sapiens
ctggacagtcactgccactttgc

SEQ ID NO: 6151065 - DNA, 16 bp, Homo sapiens
ctggacatactgctgg

SEQ ID NO: 6151066 - DNA, 22 bp, Homo sapiens
ctggacatactgctggagtcca

SEQ ID NO: 6151067 - DNA, 18 bp, Homo sapiens
ctggacatagagagggag

SEQ ID NO: 6151068 - DNA, 19 bp, Homo sapiens
ctggacatcacagcagaat

SEQ ID NO: 6151069 - DNA, 23 bp, Homo sapiens
ctggacatcacagcagaatgaag

SEQ ID NO: 6151070 - DNA, 16 bp, Homo sapiens
ctggacatcaccagtc

SEQ ID NO: 6151071 - DNA, 18 bp, Homo sapiens
ctggacatcctcttctgc

SEQ ID NO: 6151072 - DNA, 15 bp, Homo sapiens
ctggacatgaaggaa

SEQ ID NO: 6151073 - DNA, 21 bp, Homo sapiens
ctggacatgagagccccttgg

SEQ ID NO: 6151074 - DNA, 17 bp, Homo sapiens
ctggacatgagatggag

SEQ ID NO: 6151075 - DNA, 13 bp, Homo sapiens
ctggacatgcctg

SEQ ID NO: 6151076 - DNA, 16 bp, Homo sapiens
ctggacatgcctgtcc

SEQ ID NO: 6151077 - DNA, 19 bp, Homo sapiens
ctggacatgcctgtcctga

SEQ ID NO: 6151078 - DNA, 18 bp, Homo sapiens
ctggacattcagaacacc

SEQ ID NO: 6151079 - DNA, 19 bp, Homo sapiens
ctggacattctctttgata

SEQ ID NO: 6151080 - DNA, 20 bp, Homo sapiens
ctggacatttcatataaatg

SEQ ID NO: 6151081 - DNA, 17 bp, Homo sapiens
ctggacatttgtggcag

SEQ ID NO: 6151082 - DNA, 15 bp, Homo sapiens
ctggaccaaagctga

SEQ ID NO: 6151083 - DNA, 23 bp, Homo sapiens
ctggaccaaagggaagtgaggcc

SEQ ID NO: 6151084 - DNA, 15 bp, Homo sapiens
ctggaccaactgctt

SEQ ID NO: 6151085 - DNA, 17 bp, Homo sapiens
ctggaccaactgctttg

SEQ ID NO: 6151086 - DNA, 16 bp, Homo sapiens
ctggaccaaggtgaag

SEQ ID NO: 6151087 - DNA, 20 bp, Homo sapiens
ctggaccaaggtgcggaccg

SEQ ID NO: 6151088 - DNA, 22 bp, Homo sapiens
ctggaccaaggtgcggaccgga

SEQ ID NO: 6151089 - DNA, 21 bp, Homo sapiens
ctggaccaccagccccagcaa

SEQ ID NO: 6151090 - DNA, 20 bp, Homo sapiens
ctggaccacgtctccctggc

SEQ ID NO: 6151091 - DNA, 14 bp, Homo sapiens
ctggaccagccgcc

SEQ ID NO: 6151092 - DNA, 16 bp, Homo sapiens
ctggaccagcctcctg

SEQ ID NO: 6151093 - DNA, 15 bp, Homo sapiens
ctggaccagctggcc

SEQ ID NO: 6151094 - DNA, 15 bp, Homo sapiens
ctggaccaggcccat

SEQ ID NO: 6151095 - DNA, 13 bp, Homo sapiens
ctggaccaggtcc

SEQ ID NO: 6151096 - DNA, 21 bp, Homo sapiens
ctggaccagtggtctcacatg

SEQ ID NO: 6151097 - DNA, 15 bp, Homo sapiens
ctggaccatctctgt

SEQ ID NO: 6151098 - DNA, 12 bp, Homo sapiens
ctggaccatgct

SEQ ID NO: 6151099 - DNA, 22 bp, Homo sapiens
ctggaccattcctgtccctttg

SEQ ID NO: 6151100 - DNA, 12 bp, Homo sapiens
ctggacccagcc

SEQ ID NO: 6151101 - DNA, 14 bp, Homo sapiens
ctggacccagccag

SEQ ID NO: 6151102 - DNA, 20 bp, Homo sapiens
ctggacccagccaggcccag

SEQ ID NO: 6151103 - DNA, 22 bp, Homo sapiens
ctggacccagccaggcccagcc

SEQ ID NO: 6151104 - DNA, 12 bp, Homo sapiens
ctggaccccagc

SEQ ID NO: 6151105 - DNA, 16 bp, Homo sapiens
ctggaccccagcctca

SEQ ID NO: 6151106 - DNA, 22 bp, Homo sapiens
ctggaccccagccttggtgggg

SEQ ID NO: 6151107 - DNA, 15 bp, Homo sapiens
ctggaccccaggcca

SEQ ID NO: 6151108 - DNA, 19 bp, Homo sapiens
ctggacccccctttcacag

SEQ ID NO: 6151109 - DNA, 22 bp, Homo sapiens
ctggacccccctttcacaggca

SEQ ID NO: 6151110 - DNA, 19 bp, Homo sapiens
ctggaccccctgcccgcca

SEQ ID NO: 6151111 - DNA, 14 bp, Homo sapiens
ctggaccccgcctc

SEQ ID NO: 6151112 - DNA, 18 bp, Homo sapiens
ctggaccccgcctcccag

SEQ ID NO: 6151113 - DNA, 19 bp, Homo sapiens
ctggaccccgtttcatttt

SEQ ID NO: 6151114 - DNA, 14 bp, Homo sapiens
ctggacccctggac

SEQ ID NO: 6151115 - DNA, 15 bp, Homo sapiens
ctggacccctggacc

SEQ ID NO: 6151116 - DNA, 18 bp, Homo sapiens
ctggacccctggggtggc

SEQ ID NO: 6151117 - DNA, 19 bp, Homo sapiens
ctggacccctggggtggcc

SEQ ID NO: 6151118 - DNA, 20 bp, Homo sapiens
ctggacccctggggtggcca

SEQ ID NO: 6151119 - DNA, 17 bp, Homo sapiens
ctggaccctgcttcacc

SEQ ID NO: 6151120 - DNA, 13 bp, Homo sapiens
ctggaccctggcc

SEQ ID NO: 6151121 - DNA, 14 bp, Homo sapiens
ctggaccctgttgc

SEQ ID NO: 6151122 - DNA, 15 bp, Homo sapiens
ctggaccctgttgct

SEQ ID NO: 6151123 - DNA, 18 bp, Homo sapiens
ctggaccctgttgctaag

SEQ ID NO: 6151124 - DNA, 23 bp, Homo sapiens
ctggacccttgattcattctgaa

SEQ ID NO: 6151125 - DNA, 17 bp, Homo sapiens
ctggaccgcttcccaga

SEQ ID NO: 6151126 - DNA, 20 bp, Homo sapiens
ctggaccgcttcccagaggc

SEQ ID NO: 6151127 - DNA, 19 bp, Homo sapiens
ctggacctagggtggcctg

SEQ ID NO: 6151128 - DNA, 19 bp, Homo sapiens
ctggacctatgcagggagg

SEQ ID NO: 6151129 - DNA, 18 bp, Homo sapiens
ctggacctcaggagggca

SEQ ID NO: 6151130 - DNA, 21 bp, Homo sapiens
ctggacctcaggagggcaggc

SEQ ID NO: 6151131 - DNA, 23 bp, Homo sapiens
ctggacctcagtttccctctgta

SEQ ID NO: 6151132 - DNA, 19 bp, Homo sapiens
ctggacctcatgttgttga

SEQ ID NO: 6151133 - DNA, 17 bp, Homo sapiens
ctggacctccatccctg

SEQ ID NO: 6151134 - DNA, 20 bp, Homo sapiens
ctggacctccatccctgctc

SEQ ID NO: 6151135 - DNA, 22 bp, Homo sapiens
ctggacctccatccctgctctg

SEQ ID NO: 6151136 - DNA, 20 bp, Homo sapiens
ctggacctccccctcttggt

SEQ ID NO: 6151137 - DNA, 21 bp, Homo sapiens
ctggacctcggtgatgccttc

SEQ ID NO: 6151138 - DNA, 13 bp, Homo sapiens
ctggacctctgac

SEQ ID NO: 6151139 - DNA, 15 bp, Homo sapiens
ctggacctctgacag

SEQ ID NO: 6151140 - DNA, 18 bp, Homo sapiens
ctggacctctgacagcag

SEQ ID NO: 6151141 - DNA, 16 bp, Homo sapiens
ctggacctctgcttcc

SEQ ID NO: 6151142 - DNA, 12 bp, Homo sapiens
ctggacctgcct

SEQ ID NO: 6151143 - DNA, 17 bp, Homo sapiens
ctggacctgcctcctgc

SEQ ID NO: 6151144 - DNA, 20 bp, Homo sapiens
ctggacctgcctcctgcctg

SEQ ID NO: 6151145 - DNA, 22 bp, Homo sapiens
ctggacctggcggcaggaagcc

SEQ ID NO: 6151146 - DNA, 13 bp, Homo sapiens
ctggacctggggg

SEQ ID NO: 6151147 - DNA, 14 bp, Homo sapiens
ctggacctggggtc

SEQ ID NO: 6151148 - DNA, 15 bp, Homo sapiens
ctggacctggggtcc

SEQ ID NO: 6151149 - DNA, 22 bp, Homo sapiens
ctggacctggggtcccccctcc

SEQ ID NO: 6151150 - DNA, 23 bp, Homo sapiens
ctggacctggggtcccccctccc

SEQ ID NO: 6151151 - DNA, 14 bp, Homo sapiens
ctggacctgggtta

SEQ ID NO: 6151152 - DNA, 15 bp, Homo sapiens
ctggacctgtatatt

SEQ ID NO: 6151153 - DNA, 16 bp, Homo sapiens
ctggaccttgaactgg

SEQ ID NO: 6151154 - DNA, 17 bp, Homo sapiens
ctggaccttgaactggg

SEQ ID NO: 6151155 - DNA, 20 bp, Homo sapiens
ctggaccttgaactgggtac

SEQ ID NO: 6151156 - DNA, 16 bp, Homo sapiens
ctggaccttgacagag

SEQ ID NO: 6151157 - DNA, 18 bp, Homo sapiens
ctggaccttgacagagca

SEQ ID NO: 6151158 - DNA, 19 bp, Homo sapiens
ctggaccttgacagagcag

SEQ ID NO: 6151159 - DNA, 22 bp, Homo sapiens
ctggacctttgggttctttctg

SEQ ID NO: 6151160 - DNA, 16 bp, Homo sapiens
ctggaccttttccctt

SEQ ID NO: 6151161 - DNA, 22 bp, Homo sapiens
ctggacgcagccacacagtggc

SEQ ID NO: 6151162 - DNA, 17 bp, Homo sapiens
ctggacgcccagctgag

SEQ ID NO: 6151163 - DNA, 17 bp, Homo sapiens
ctggacgctgccctgca

SEQ ID NO: 6151164 - DNA, 20 bp, Homo sapiens
ctggacgctgtcctgagatg

SEQ ID NO: 6151165 - DNA, 15 bp, Homo sapiens
ctggacggcattcct

SEQ ID NO: 6151166 - DNA, 20 bp, Homo sapiens
ctggacggcattcctgctta

SEQ ID NO: 6151167 - DNA, 22 bp, Homo sapiens
ctggacgggaagggacagctgc

SEQ ID NO: 6151168 - DNA, 23 bp, Homo sapiens
ctggacggggactggggatgtgg

SEQ ID NO: 6151169 - DNA, 14 bp, Homo sapiens
ctggacggggatgg

SEQ ID NO: 6151170 - DNA, 16 bp, Homo sapiens
ctggacggggcgggcc

SEQ ID NO: 6151171 - DNA, 16 bp, Homo sapiens
ctggacgtgaaatact

SEQ ID NO: 6151172 - DNA, 20 bp, Homo sapiens
ctggactagagggacctctc

SEQ ID NO: 6151173 - DNA, 21 bp, Homo sapiens
ctggactagagggacctctcc

SEQ ID NO: 6151174 - DNA, 23 bp, Homo sapiens
ctggactagagggacctctccca

SEQ ID NO: 6151175 - DNA, 16 bp, Homo sapiens
ctggactagcaaagga

SEQ ID NO: 6151176 - DNA, 19 bp, Homo sapiens
ctggactagggcctcggag

SEQ ID NO: 6151177 - DNA, 15 bp, Homo sapiens
ctggactatagctgt

SEQ ID NO: 6151178 - DNA, 20 bp, Homo sapiens
ctggactatattgggactgg

SEQ ID NO: 6151179 - DNA, 16 bp, Homo sapiens
ctggactattgtgcca

SEQ ID NO: 6151180 - DNA, 21 bp, Homo sapiens
ctggactattgtgccaactgc

SEQ ID NO: 6151181 - DNA, 22 bp, Homo sapiens
ctggactcaggatgcccagggc

SEQ ID NO: 6151182 - DNA, 20 bp, Homo sapiens
ctggactccacgatgccttt

SEQ ID NO: 6151183 - DNA, 24 bp, Homo sapiens
ctggactccacggatgcgtgggca

SEQ ID NO: 6151184 - DNA, 21 bp, Homo sapiens
ctggactccagatctgcaccg

SEQ ID NO: 6151185 - DNA, 14 bp, Homo sapiens
ctggactcccctcc

SEQ ID NO: 6151186 - DNA, 15 bp, Homo sapiens
ctggactccggagga

SEQ ID NO: 6151187 - DNA, 23 bp, Homo sapiens
ctggactccggaggactgagccc

SEQ ID NO: 6151188 - DNA, 18 bp, Homo sapiens
ctggactccggccctcct

SEQ ID NO: 6151189 - DNA, 14 bp, Homo sapiens
ctggactcctctgt

SEQ ID NO: 6151190 - DNA, 17 bp, Homo sapiens
ctggactcctctgtcca

SEQ ID NO: 6151191 - DNA, 19 bp, Homo sapiens
ctggactcctgccaccagc

SEQ ID NO: 6151192 - DNA, 18 bp, Homo sapiens
ctggactctaaagaccaa

SEQ ID NO: 6151193 - DNA, 21 bp, Homo sapiens
ctggactctaaagaccaaact

SEQ ID NO: 6151194 - DNA, 14 bp, Homo sapiens
ctggactctcagtc

SEQ ID NO: 6151195 - DNA, 21 bp, Homo sapiens
ctggactctcagtctctgagc

SEQ ID NO: 6151196 - DNA, 21 bp, Homo sapiens
ctggactctccgttaatctct

SEQ ID NO: 6151197 - DNA, 23 bp, Homo sapiens
ctggactctgcatcccagcacct

SEQ ID NO: 6151198 - DNA, 17 bp, Homo sapiens
ctggactctgtggggcc

SEQ ID NO: 6151199 - DNA, 18 bp, Homo sapiens
ctggactctgtggggcca

SEQ ID NO: 6151200 - DNA, 14 bp, Homo sapiens
ctggactcttcaaa

SEQ ID NO: 6151201 - DNA, 22 bp, Homo sapiens
ctggactcttcaaaaactgttt

SEQ ID NO: 6151202 - DNA, 23 bp, Homo sapiens
ctggactcttcaaaaactgtttt

SEQ ID NO: 6151203 - DNA, 10 bp, Homo sapiens
ctggactgac

SEQ ID NO: 6151204 - DNA, 13 bp, Homo sapiens
ctggactgacagc

SEQ ID NO: 6151205 - DNA, 15 bp, Homo sapiens
ctggactgacagcat

SEQ ID NO: 6151206 - DNA, 19 bp, Homo sapiens
ctggactgaccaaagactg

SEQ ID NO: 6151207 - DNA, 21 bp, Homo sapiens
ctggactgaccaaagactgca

SEQ ID NO: 6151208 - DNA, 15 bp, Homo sapiens
ctggactgaccctgc

SEQ ID NO: 6151209 - DNA, 16 bp, Homo sapiens
ctggactgactgcagc

SEQ ID NO: 6151210 - DNA, 20 bp, Homo sapiens
ctggactgagccaaggaggc

SEQ ID NO: 6151211 - DNA, 16 bp, Homo sapiens
ctggactgaggaccac

SEQ ID NO: 6151212 - DNA, 12 bp, Homo sapiens
ctggactgaggc

SEQ ID NO: 6151213 - DNA, 13 bp, Homo sapiens
ctggactgaggcc

SEQ ID NO: 6151214 - DNA, 17 bp, Homo sapiens
ctccttcctgtgggtgg

SEQ ID NO: 6151215 - DNA, 15 bp, Homo sapiens
ctccttcctgtgtgt

SEQ ID NO: 6151216 - DNA, 17 bp, Homo sapiens
ctccttccttcaggact

SEQ ID NO: 6151217 - DNA, 18 bp, Homo sapiens
ctccttccttcaggactc

SEQ ID NO: 6151218 - DNA, 22 bp, Homo sapiens
ctccttccttgctgtcctaggc

SEQ ID NO: 6151219 - DNA, 15 bp, Homo sapiens
ctccttcgtgtctct

SEQ ID NO: 6151220 - DNA, 15 bp, Homo sapiens
ctccttctattttcc

SEQ ID NO: 6151221 - DNA, 11 bp, Homo sapiens
ctccttctccc

SEQ ID NO: 6151222 - DNA, 13 bp, Homo sapiens
ctccttctcccca

SEQ ID NO: 6151223 - DNA, 17 bp, Homo sapiens
ctccttctcccctccag

SEQ ID NO: 6151224 - DNA, 19 bp, Homo sapiens
ctccttctcccctccagac

SEQ ID NO: 6151225 - DNA, 18 bp, Homo sapiens
ctccttctcctgttccat

SEQ ID NO: 6151226 - DNA, 17 bp, Homo sapiens
ctccttctctgccccca

SEQ ID NO: 6151227 - DNA, 20 bp, Homo sapiens
ctccttctctgtctcatgtg

SEQ ID NO: 6151228 - DNA, 21 bp, Homo sapiens
ctccttctctgtctcatgtgt

SEQ ID NO: 6151229 - DNA, 14 bp, Homo sapiens
ctccttctcttctc

SEQ ID NO: 6151230 - DNA, 17 bp, Homo sapiens
ctccttctcttctcttc

SEQ ID NO: 6151231 - DNA, 13 bp, Homo sapiens
ctccttctgagct

SEQ ID NO: 6151232 - DNA, 21 bp, Homo sapiens
ctccttctgcagtcagactga

SEQ ID NO: 6151233 - DNA, 20 bp, Homo sapiens
ctccttctgtcctactctgt

SEQ ID NO: 6151234 - DNA, 13 bp, Homo sapiens
ctccttctgtgtt

SEQ ID NO: 6151235 - DNA, 12 bp, Homo sapiens
ctccttctgttt

SEQ ID NO: 6151236 - DNA, 14 bp, Homo sapiens
ctccttcttccact

SEQ ID NO: 6151237 - DNA, 14 bp, Homo sapiens
ctccttcttccctg

SEQ ID NO: 6151238 - DNA, 16 bp, Homo sapiens
ctccttcttgccctga

SEQ ID NO: 6151239 - DNA, 18 bp, Homo sapiens
ctccttcttgccctgagc

SEQ ID NO: 6151240 - DNA, 12 bp, Homo sapiens
ctccttcttttc

SEQ ID NO: 6151241 - DNA, 19 bp, Homo sapiens
ctccttgaaaccagctcag

SEQ ID NO: 6151242 - DNA, 20 bp, Homo sapiens
ctccttgaatatctttcgat

SEQ ID NO: 6151243 - DNA, 19 bp, Homo sapiens
ctccttgactccttgtggt

SEQ ID NO: 6151244 - DNA, 14 bp, Homo sapiens
ctccttgagatcct

SEQ ID NO: 6151245 - DNA, 16 bp, Homo sapiens
ctccttgagttttcct

SEQ ID NO: 6151246 - DNA, 18 bp, Homo sapiens
ctccttgataacagctac

SEQ ID NO: 6151247 - DNA, 14 bp, Homo sapiens
ctccttgcaaccag

SEQ ID NO: 6151248 - DNA, 15 bp, Homo sapiens
ctccttgcaaccagg

SEQ ID NO: 6151249 - DNA, 20 bp, Homo sapiens
ctccttgcaaccaggcagct

SEQ ID NO: 6151250 - DNA, 16 bp, Homo sapiens
ctccttgcatcaaggg

SEQ ID NO: 6151251 - DNA, 13 bp, Homo sapiens
ctccttgccaccc

SEQ ID NO: 6151252 - DNA, 14 bp, Homo sapiens
ctccttgccacccc

SEQ ID NO: 6151253 - DNA, 16 bp, Homo sapiens
ctccttgccagcccca

SEQ ID NO: 6151254 - DNA, 17 bp, Homo sapiens
ctccttgccagccccac

SEQ ID NO: 6151255 - DNA, 18 bp, Homo sapiens
ctccttgccagccccacc

SEQ ID NO: 6151256 - DNA, 14 bp, Homo sapiens
ctccttgcccagac

SEQ ID NO: 6151257 - DNA, 17 bp, Homo sapiens
ctccttgccccagtcct

SEQ ID NO: 6151258 - DNA, 18 bp, Homo sapiens
ctccttgccccagtcctg

SEQ ID NO: 6151259 - DNA, 18 bp, Homo sapiens
ctccttgcccccagtgcc

SEQ ID NO: 6151260 - DNA, 19 bp, Homo sapiens
ctccttgcccccagtgcct

SEQ ID NO: 6151261 - DNA, 16 bp, Homo sapiens
ctccttgccctgggcc

SEQ ID NO: 6151262 - DNA, 16 bp, Homo sapiens
ctccttgccgctggga

SEQ ID NO: 6151263 - DNA, 15 bp, Homo sapiens
ctccttgcctggtga

SEQ ID NO: 6151264 - DNA, 14 bp, Homo sapiens
ctccttgctctgca

SEQ ID NO: 6151265 - DNA, 17 bp, Homo sapiens
ctccttgctctgcaggc

SEQ ID NO: 6151266 - DNA, 13 bp, Homo sapiens
ctccttgctgacc

SEQ ID NO: 6151267 - DNA, 18 bp, Homo sapiens
ctccttgctgaccccagg

SEQ ID NO: 6151268 - DNA, 21 bp, Homo sapiens
ctccttggatttgcatttttg

SEQ ID NO: 6151269 - DNA, 22 bp, Homo sapiens
ctccttggatttgcatttttgt

SEQ ID NO: 6151270 - DNA, 20 bp, Homo sapiens
ctccttggcacccccatgct

SEQ ID NO: 6151271 - DNA, 15 bp, Homo sapiens
ctccttggctgtctg

SEQ ID NO: 6151272 - DNA, 21 bp, Homo sapiens
ctccttggcttacctgacctc

SEQ ID NO: 6151273 - DNA, 13 bp, Homo sapiens
ctccttgggagga

SEQ ID NO: 6151274 - DNA, 20 bp, Homo sapiens
ctccttgggaggaagcagaa

SEQ ID NO: 6151275 - DNA, 23 bp, Homo sapiens
ctccttgggaggaagcagaataa

SEQ ID NO: 6151276 - DNA, 23 bp, Homo sapiens
ctccttgggatgaagagggtaga

SEQ ID NO: 6151277 - DNA, 21 bp, Homo sapiens
ctccttgggcagggtctctgc

SEQ ID NO: 6151278 - DNA, 23 bp, Homo sapiens
ctccttgggcagggtctctgctc

SEQ ID NO: 6151279 - DNA, 17 bp, Homo sapiens
ctccttgggccctttga

SEQ ID NO: 6151280 - DNA, 18 bp, Homo sapiens
ctccttgggccctttttc

SEQ ID NO: 6151281 - DNA, 14 bp, Homo sapiens
ctccttgggctcct

SEQ ID NO: 6151282 - DNA, 17 bp, Homo sapiens
ctccttggggcagggcc

SEQ ID NO: 6151283 - DNA, 19 bp, Homo sapiens
ctccttggggcagggcctg

SEQ ID NO: 6151284 - DNA, 15 bp, Homo sapiens
ctccttgggtcctgc

SEQ ID NO: 6151285 - DNA, 16 bp, Homo sapiens
ctccttggtgcctctg

SEQ ID NO: 6151286 - DNA, 17 bp, Homo sapiens
ctccttggtgcctctgg

SEQ ID NO: 6151287 - DNA, 22 bp, Homo sapiens
ctccttggtgcctggcctggca

SEQ ID NO: 6151288 - DNA, 17 bp, Homo sapiens
ctccttggtgctaaaga

SEQ ID NO: 6151289 - DNA, 18 bp, Homo sapiens
ctccttggtttctccctc

SEQ ID NO: 6151290 - DNA, 15 bp, Homo sapiens
ctccttggtttgcta

SEQ ID NO: 6151291 - DNA, 17 bp, Homo sapiens
ctccttggtttgctagt

SEQ ID NO: 6151292 - DNA, 22 bp, Homo sapiens
ctccttggtttgctagtatctt

SEQ ID NO: 6151293 - DNA, 22 bp, Homo sapiens
ctccttggttttgcctctttaa

SEQ ID NO: 6151294 - DNA, 21 bp, Homo sapiens
ctccttgtcacagaatctcca

SEQ ID NO: 6151295 - DNA, 18 bp, Homo sapiens
ctccttgtcactgaagat

SEQ ID NO: 6151296 - DNA, 19 bp, Homo sapiens
ctccttgtcagggtctcct

SEQ ID NO: 6151297 - DNA, 23 bp, Homo sapiens
ctccttgtcagggtctccttcct

SEQ ID NO: 6151298 - DNA, 15 bp, Homo sapiens
ctccttgtccaccca

SEQ ID NO: 6151299 - DNA, 21 bp, Homo sapiens
ctccttgtctagtttcccaca

SEQ ID NO: 6151300 - DNA, 20 bp, Homo sapiens
ctccttgtgcaattgtcttt

SEQ ID NO: 6151301 - DNA, 16 bp, Homo sapiens
ctccttgtggcctttt

SEQ ID NO: 6151302 - DNA, 17 bp, Homo sapiens
ctccttgtggtttatgt

SEQ ID NO: 6151303 - DNA, 18 bp, Homo sapiens
ctccttgtggtttatgtc

SEQ ID NO: 6151304 - DNA, 14 bp, Homo sapiens
ctccttgtgttact

SEQ ID NO: 6151305 - DNA, 12 bp, Homo sapiens
ctccttgttcct

SEQ ID NO: 6151306 - DNA, 13 bp, Homo sapiens
ctccttgttccta

SEQ ID NO: 6151307 - DNA, 14 bp, Homo sapiens
ctccttgttcctag

SEQ ID NO: 6151308 - DNA, 19 bp, Homo sapiens
ctcctttaaattctttcct

SEQ ID NO: 6151309 - DNA, 23 bp, Homo sapiens
ctcctttaaattctttcctacct

SEQ ID NO: 6151310 - DNA, 15 bp, Homo sapiens
ctcctttaattgtaa

SEQ ID NO: 6151311 - DNA, 16 bp, Homo sapiens
ctcctttacaaccata

SEQ ID NO: 6151312 - DNA, 11 bp, Homo sapiens
ctcctttacca

SEQ ID NO: 6151313 - DNA, 23 bp, Homo sapiens
ctcctttaccagtcctatttttc

SEQ ID NO: 6151314 - DNA, 14 bp, Homo sapiens
ctcctttaccccac

SEQ ID NO: 6151315 - DNA, 20 bp, Homo sapiens
ctcctttaccctcatctgtc

SEQ ID NO: 6151316 - DNA, 22 bp, Homo sapiens
ctcctttaccgaggacagcctg

SEQ ID NO: 6151317 - DNA, 23 bp, Homo sapiens
ctcctttaccgaggacagcctgc

SEQ ID NO: 6151318 - DNA, 18 bp, Homo sapiens
ctcctttactgcagcctg

SEQ ID NO: 6151319 - DNA, 16 bp, Homo sapiens
ctcctttactttctct

SEQ ID NO: 6151320 - DNA, 20 bp, Homo sapiens
ctcctttagcaggtggtcct

SEQ ID NO: 6151321 - DNA, 21 bp, Homo sapiens
ctcctttaggcaggttacagt

SEQ ID NO: 6151322 - DNA, 22 bp, Homo sapiens
ctcctttatctgtaattgtaat

SEQ ID NO: 6151323 - DNA, 19 bp, Homo sapiens
ctcctttattgctcctgta

SEQ ID NO: 6151324 - DNA, 16 bp, Homo sapiens
ctcctttcacaacctt

SEQ ID NO: 6151325 - DNA, 18 bp, Homo sapiens
ctcctttcatcacactgg

SEQ ID NO: 6151326 - DNA, 10 bp, Homo sapiens
ctcctttcca

SEQ ID NO: 6151327 - DNA, 13 bp, Homo sapiens
ctcctttccactg

SEQ ID NO: 6151328 - DNA, 15 bp, Homo sapiens
ctcctttccatcagc

SEQ ID NO: 6151329 - DNA, 13 bp, Homo sapiens
ctcctttcccaca

SEQ ID NO: 6151330 - DNA, 16 bp, Homo sapiens
ctcctttcccacagtc

SEQ ID NO: 6151331 - DNA, 16 bp, Homo sapiens
ctcctttcccctctca

SEQ ID NO: 6151332 - DNA, 20 bp, Homo sapiens
ctcctttcccctttctcttt

SEQ ID NO: 6151333 - DNA, 15 bp, Homo sapiens
ctcctttcctacagt

SEQ ID NO: 6151334 - DNA, 16 bp, Homo sapiens
ctcctttcctatcttt

SEQ ID NO: 6151335 - DNA, 13 bp, Homo sapiens
ctcctttcctctg

SEQ ID NO: 6151336 - DNA, 21 bp, Homo sapiens
ctcctttcctgcatctttcat

SEQ ID NO: 6151337 - DNA, 16 bp, Homo sapiens
ctcctttccttcccag

SEQ ID NO: 6151338 - DNA, 21 bp, Homo sapiens
ctcctttccttcccaggccct

SEQ ID NO: 6151339 - DNA, 22 bp, Homo sapiens
ctcctttccttcccaggccctt

SEQ ID NO: 6151340 - DNA, 22 bp, Homo sapiens
ctcctttcctttttctttcctt

SEQ ID NO: 6151341 - DNA, 23 bp, Homo sapiens
ctcctttctaaggagcactagaa

SEQ ID NO: 6151342 - DNA, 21 bp, Homo sapiens
ctcctttctccagccagcaat

SEQ ID NO: 6151343 - DNA, 16 bp, Homo sapiens
ctcctttctccctgca

SEQ ID NO: 6151344 - DNA, 17 bp, Homo sapiens
ctcctttctcctgtgaa

SEQ ID NO: 6151345 - DNA, 12 bp, Homo sapiens
ctcctttctctg

SEQ ID NO: 6151346 - DNA, 14 bp, Homo sapiens
ctcctttctctgta

SEQ ID NO: 6151347 - DNA, 14 bp, Homo sapiens
ctcctttctgtgcc

SEQ ID NO: 6151348 - DNA, 17 bp, Homo sapiens
ctcctttctgtgcccta

SEQ ID NO: 6151349 - DNA, 14 bp, Homo sapiens
ctcctttctttcta

SEQ ID NO: 6151350 - DNA, 20 bp, Homo sapiens
ctcctttctttgctgtttgc

SEQ ID NO: 6151351 - DNA, 14 bp, Homo sapiens
ctcctttgaagaag

SEQ ID NO: 6151352 - DNA, 23 bp, Homo sapiens
ctcctttgatattatgtggcttt

SEQ ID NO: 6151353 - DNA, 20 bp, Homo sapiens
ctcctttgcactgagggcca

SEQ ID NO: 6151354 - DNA, 16 bp, Homo sapiens
ctcctttgcaggctca

SEQ ID NO: 6151355 - DNA, 15 bp, Homo sapiens
ctcctttgcctctgc

SEQ ID NO: 6151356 - DNA, 14 bp, Homo sapiens
ctcctttgctcttg

SEQ ID NO: 6151357 - DNA, 18 bp, Homo sapiens
ctcctttggaaggtgaca

SEQ ID NO: 6151358 - DNA, 18 bp, Homo sapiens
ctcctttggcatgtttaa

SEQ ID NO: 6151359 - DNA, 14 bp, Homo sapiens
ctcctttgtacttt

SEQ ID NO: 6151360 - DNA, 17 bp, Homo sapiens
ctcctttgtactttgtg

SEQ ID NO: 6151361 - DNA, 20 bp, Homo sapiens
ctcctttgtactttgtgctt

SEQ ID NO: 6151362 - DNA, 21 bp, Homo sapiens
ctcctttgtcttttttttcat

SEQ ID NO: 6151363 - DNA, 23 bp, Homo sapiens
ctcctttgtgaggaagccgctgg

SEQ ID NO: 6151364 - DNA, 12 bp, Homo sapiens
ctcctttgtgtg

SEQ ID NO: 6151365 - DNA, 17 bp, Homo sapiens
ctcctttgttcccggct

SEQ ID NO: 6151366 - DNA, 18 bp, Homo sapiens
ctccttttatctggtgcc

SEQ ID NO: 6151367 - DNA, 17 bp, Homo sapiens
ctccttttatgctcacc

SEQ ID NO: 6151368 - DNA, 20 bp, Homo sapiens
ctccttttatgctcacctga

SEQ ID NO: 6151369 - DNA, 15 bp, Homo sapiens
ctccttttatgtgta

SEQ ID NO: 6151370 - DNA, 13 bp, Homo sapiens
ctccttttcactt

SEQ ID NO: 6151371 - DNA, 19 bp, Homo sapiens
ctccttttccagagcattc

SEQ ID NO: 6151372 - DNA, 16 bp, Homo sapiens
ctccttttccttacca

SEQ ID NO: 6151373 - DNA, 10 bp, Homo sapiens
ctccttttct

SEQ ID NO: 6151374 - DNA, 15 bp, Homo sapiens
ctccttttctctttg

SEQ ID NO: 6151375 - DNA, 23 bp, Homo sapiens
ctccttttcttttgttactgttc

SEQ ID NO: 6151376 - DNA, 13 bp, Homo sapiens
ctccttttgaact

SEQ ID NO: 6151377 - DNA, 13 bp, Homo sapiens
ctccttttgctgt

SEQ ID NO: 6151378 - DNA, 14 bp, Homo sapiens
ctccttttggcctg

SEQ ID NO: 6151379 - DNA, 17 bp, Homo sapiens
ctccttttgtccccagg

SEQ ID NO: 6151380 - DNA, 21 bp, Homo sapiens
ctccttttgtccccagggccc

SEQ ID NO: 6151381 - DNA, 17 bp, Homo sapiens
ctccttttgtgttccaa

SEQ ID NO: 6151382 - DNA, 18 bp, Homo sapiens
ctcctttttatgttgcca

SEQ ID NO: 6151383 - DNA, 21 bp, Homo sapiens
ctcctttttatttttttgtac

SEQ ID NO: 6151384 - DNA, 16 bp, Homo sapiens
ctcctttttctacctt

SEQ ID NO: 6151385 - DNA, 19 bp, Homo sapiens
ctcctttttctccctctgg

SEQ ID NO: 6151386 - DNA, 21 bp, Homo sapiens
ctcctttttctccctctggat

SEQ ID NO: 6151387 - DNA, 18 bp, Homo sapiens
ctcgaaactgacagtatt

SEQ ID NO: 6151388 - DNA, 13 bp, Homo sapiens
ctcgaaagtgtca

SEQ ID NO: 6151389 - DNA, 18 bp, Homo sapiens
ctcgaaccaaggcagcct

SEQ ID NO: 6151390 - DNA, 23 bp, Homo sapiens
ctcgaaccaaggcagcctccaga

SEQ ID NO: 6151391 - DNA, 13 bp, Homo sapiens
ctcgaactcctga

SEQ ID NO: 6151392 - DNA, 14 bp, Homo sapiens
ctcgaactcctgac

SEQ ID NO: 6151393 - DNA, 14 bp, Homo sapiens
ctcgaactcctggc

SEQ ID NO: 6151394 - DNA, 15 bp, Homo sapiens
ctggactgcacaggc

SEQ ID NO: 6151395 - DNA, 18 bp, Homo sapiens
ctggactgcacaggcagc

SEQ ID NO: 6151396 - DNA, 19 bp, Homo sapiens
ctggactggaggctgggtg

SEQ ID NO: 6151397 - DNA, 17 bp, Homo sapiens
ctggactggaggtgggc

SEQ ID NO: 6151398 - DNA, 22 bp, Homo sapiens
ctggactggaggtgggcatgcc

SEQ ID NO: 6151399 - DNA, 12 bp, Homo sapiens
ctggactggcca

SEQ ID NO: 6151400 - DNA, 13 bp, Homo sapiens
ctggactggccct

SEQ ID NO: 6151401 - DNA, 18 bp, Homo sapiens
ctggactggcccttgccc

SEQ ID NO: 6151402 - DNA, 20 bp, Homo sapiens
ctggactggcgttcacctcc

SEQ ID NO: 6151403 - DNA, 14 bp, Homo sapiens
ctggactgggaggt

SEQ ID NO: 6151404 - DNA, 14 bp, Homo sapiens
ctggactgggtggg

SEQ ID NO: 6151405 - DNA, 22 bp, Homo sapiens
ctggactgggtgggccccacag

SEQ ID NO: 6151406 - DNA, 20 bp, Homo sapiens
ctggactgggttttgtctct

SEQ ID NO: 6151407 - DNA, 21 bp, Homo sapiens
ctggactggtggcccctgcct

SEQ ID NO: 6151408 - DNA, 20 bp, Homo sapiens
ctggactggttatcttgtta

SEQ ID NO: 6151409 - DNA, 19 bp, Homo sapiens
ctggactgtcatagaaatt

SEQ ID NO: 6151410 - DNA, 14 bp, Homo sapiens
ctggactgtcctag

SEQ ID NO: 6151411 - DNA, 20 bp, Homo sapiens
ctggactgtcttctccctgc

SEQ ID NO: 6151412 - DNA, 13 bp, Homo sapiens
ctggactgtgtgc

SEQ ID NO: 6151413 - DNA, 21 bp, Homo sapiens
ctggactgttactgacttgga

SEQ ID NO: 6151414 - DNA, 14 bp, Homo sapiens
ctggactgttccag

SEQ ID NO: 6151415 - DNA, 15 bp, Homo sapiens
ctggactgttccagg

SEQ ID NO: 6151416 - DNA, 19 bp, Homo sapiens
ctggactgttccaggccct

SEQ ID NO: 6151417 - DNA, 22 bp, Homo sapiens
ctggactgttccaggccctcca

SEQ ID NO: 6151418 - DNA, 15 bp, Homo sapiens
ctggactgttctgta

SEQ ID NO: 6151419 - DNA, 16 bp, Homo sapiens
ctggactgtttcatag

SEQ ID NO: 6151420 - DNA, 19 bp, Homo sapiens
ctggactgtttcatagttt

SEQ ID NO: 6151421 - DNA, 18 bp, Homo sapiens
ctggacttaagcatctgg

SEQ ID NO: 6151422 - DNA, 22 bp, Homo sapiens
ctggacttaagcatctggctct

SEQ ID NO: 6151423 - DNA, 23 bp, Homo sapiens
ctggacttcctgtcattttcaca

SEQ ID NO: 6151424 - DNA, 20 bp, Homo sapiens
ctggacttctgtgggcccct

SEQ ID NO: 6151425 - DNA, 13 bp, Homo sapiens
ctggacttcttag

SEQ ID NO: 6151426 - DNA, 13 bp, Homo sapiens
ctggacttgagct

SEQ ID NO: 6151427 - DNA, 20 bp, Homo sapiens
ctggacttgagcttggcagc

SEQ ID NO: 6151428 - DNA, 20 bp, Homo sapiens
ctggactttaaaaaaacaat

SEQ ID NO: 6151429 - DNA, 13 bp, Homo sapiens
ctggactttcctg

SEQ ID NO: 6151430 - DNA, 14 bp, Homo sapiens
ctggactttcctgc

SEQ ID NO: 6151431 - DNA, 16 bp, Homo sapiens
ctggactttcctgcaa

SEQ ID NO: 6151432 - DNA, 13 bp, Homo sapiens
ctggactttctct

SEQ ID NO: 6151433 - DNA, 23 bp, Homo sapiens
ctggactttgcttcccctccagg

SEQ ID NO: 6151434 - DNA, 17 bp, Homo sapiens
ctggacttttgcagctt

SEQ ID NO: 6151435 - DNA, 13 bp, Homo sapiens
ctggagaaaaata

SEQ ID NO: 6151436 - DNA, 14 bp, Homo sapiens
ctggagaaaatgga

SEQ ID NO: 6151437 - DNA, 21 bp, Homo sapiens
ctggagaaaatggacgtgtta

SEQ ID NO: 6151438 - DNA, 12 bp, Homo sapiens
ctggagaaagag

SEQ ID NO: 6151439 - DNA, 17 bp, Homo sapiens
ctggagaaagagctgcc

SEQ ID NO: 6151440 - DNA, 18 bp, Homo sapiens
ctggagaaagagctgcct

SEQ ID NO: 6151441 - DNA, 23 bp, Homo sapiens
ctggagaaagagctgcctggatg

SEQ ID NO: 6151442 - DNA, 12 bp, Homo sapiens
ctggagaaagat

SEQ ID NO: 6151443 - DNA, 19 bp, Homo sapiens
ctggagaaagccacgccct

SEQ ID NO: 6151444 - DNA, 19 bp, Homo sapiens
ctggagaaaggatggcagc

SEQ ID NO: 6151445 - DNA, 20 bp, Homo sapiens
ctggagaacaagaaagggcc

SEQ ID NO: 6151446 - DNA, 14 bp, Homo sapiens
ctggagaagagagg

SEQ ID NO: 6151447 - DNA, 15 bp, Homo sapiens
ctggagaagagagga

SEQ ID NO: 6151448 - DNA, 16 bp, Homo sapiens
ctggagaagagaggag

SEQ ID NO: 6151449 - DNA, 21 bp, Homo sapiens
ctggagaagcagtgagccgca

SEQ ID NO: 6151450 - DNA, 16 bp, Homo sapiens
ctggagaaggcctgga

SEQ ID NO: 6151451 - DNA, 19 bp, Homo sapiens
ctggagaaggcctggaaga

SEQ ID NO: 6151452 - DNA, 20 bp, Homo sapiens
ctggagaagtagtatttgcc

SEQ ID NO: 6151453 - DNA, 22 bp, Homo sapiens
ctggagaagtcttagacttgaa

SEQ ID NO: 6151454 - DNA, 12 bp, Homo sapiens
ctggagaagtgg

SEQ ID NO: 6151455 - DNA, 23 bp, Homo sapiens
ctggagaagtgggtggggacaga

SEQ ID NO: 6151456 - DNA, 17 bp, Homo sapiens
ctggagaataattcttt

SEQ ID NO: 6151457 - DNA, 14 bp, Homo sapiens
ctggagaattgact

SEQ ID NO: 6151458 - DNA, 13 bp, Homo sapiens
ctggagacagccc

SEQ ID NO: 6151459 - DNA, 23 bp, Homo sapiens
ctggagacagccccagagcaggg

SEQ ID NO: 6151460 - DNA, 22 bp, Homo sapiens
ctggagaccaccagggcatctc

SEQ ID NO: 6151461 - DNA, 18 bp, Homo sapiens
ctggagaccagaaacctt

SEQ ID NO: 6151462 - DNA, 22 bp, Homo sapiens
ctggagaccagaacagcatggc

SEQ ID NO: 6151463 - DNA, 17 bp, Homo sapiens
ctggagaccagggagcc

SEQ ID NO: 6151464 - DNA, 19 bp, Homo sapiens
ctggagaccagggagcctt

SEQ ID NO: 6151465 - DNA, 19 bp, Homo sapiens
ctggagacccaccccacct

SEQ ID NO: 6151466 - DNA, 20 bp, Homo sapiens
ctggagacccaccccacctg

SEQ ID NO: 6151467 - DNA, 20 bp, Homo sapiens
ctggagaccccagagtaggg

SEQ ID NO: 6151468 - DNA, 16 bp, Homo sapiens
ctggagaccctgcgcc

SEQ ID NO: 6151469 - DNA, 23 bp, Homo sapiens
ctggagaccctgcgcccctgccc

SEQ ID NO: 6151470 - DNA, 18 bp, Homo sapiens
ctggagaccgaggccaga

SEQ ID NO: 6151471 - DNA, 21 bp, Homo sapiens
ctggagaccgcttcacccctg

SEQ ID NO: 6151472 - DNA, 23 bp, Homo sapiens
ctggagaccgcttcacccctgca

SEQ ID NO: 6151473 - DNA, 20 bp, Homo sapiens
ctggagaccggaattgagag

SEQ ID NO: 6151474 - DNA, 22 bp, Homo sapiens
ctggagaccggaattgagaggt

SEQ ID NO: 6151475 - DNA, 20 bp, Homo sapiens
ctggagacgtggaacctctg

SEQ ID NO: 6151476 - DNA, 17 bp, Homo sapiens
ctggagactatttaagt

SEQ ID NO: 6151477 - DNA, 23 bp, Homo sapiens
ctggagactgtccacttctagct

SEQ ID NO: 6151478 - DNA, 21 bp, Homo sapiens
ctggagacttagggcaccagg

SEQ ID NO: 6151479 - DNA, 18 bp, Homo sapiens
ctggagacttcctctggt

SEQ ID NO: 6151480 - DNA, 22 bp, Homo sapiens
ctggagagaaacaataaagaga

SEQ ID NO: 6151481 - DNA, 16 bp, Homo sapiens
ctggagagaacaggtt

SEQ ID NO: 6151482 - DNA, 12 bp, Homo sapiens
ctggagagaagt

SEQ ID NO: 6151483 - DNA, 16 bp, Homo sapiens
ctggagagaagtggaa

SEQ ID NO: 6151484 - DNA, 20 bp, Homo sapiens
ctggagagcatagggtctgg

SEQ ID NO: 6151485 - DNA, 19 bp, Homo sapiens
ctggagagccagaacctgg

SEQ ID NO: 6151486 - DNA, 17 bp, Homo sapiens
ctggagagcccagagtc

SEQ ID NO: 6151487 - DNA, 11 bp, Homo sapiens
ctggagagcct

SEQ ID NO: 6151488 - DNA, 14 bp, Homo sapiens
ctggagagcctgca

SEQ ID NO: 6151489 - DNA, 22 bp, Homo sapiens
ctggagagctagaacctggaga

SEQ ID NO: 6151490 - DNA, 22 bp, Homo sapiens
ctggagaggacggccctgcctg

SEQ ID NO: 6151491 - DNA, 21 bp, Homo sapiens
ctggagaggagccctgcctct

SEQ ID NO: 6151492 - DNA, 12 bp, Homo sapiens
ctggagaggccc

SEQ ID NO: 6151493 - DNA, 14 bp, Homo sapiens
ctggagaggcctgg

SEQ ID NO: 6151494 - DNA, 16 bp, Homo sapiens
ctggagaggcctgggg

SEQ ID NO: 6151495 - DNA, 21 bp, Homo sapiens
ctggagaggcctggggtggga

SEQ ID NO: 6151496 - DNA, 17 bp, Homo sapiens
ctggagaggctaacctc

SEQ ID NO: 6151497 - DNA, 13 bp, Homo sapiens
ctggagaggggcc

SEQ ID NO: 6151498 - DNA, 13 bp, Homo sapiens
ctggagagggtct

SEQ ID NO: 6151499 - DNA, 23 bp, Homo sapiens
ctggagagggtctcgctgtcact

SEQ ID NO: 6151500 - DNA, 21 bp, Homo sapiens
ctggagaggttataggtcact

SEQ ID NO: 6151501 - DNA, 23 bp, Homo sapiens
ctggagagtctcactcccctcct

SEQ ID NO: 6151502 - DNA, 23 bp, Homo sapiens
ctggagagtgcacatgccccttg

SEQ ID NO: 6151503 - DNA, 17 bp, Homo sapiens
ctggagatagctggggc

SEQ ID NO: 6151504 - DNA, 13 bp, Homo sapiens
ctggagatatgaa

SEQ ID NO: 6151505 - DNA, 23 bp, Homo sapiens
ctggagatattataagggagagc

SEQ ID NO: 6151506 - DNA, 15 bp, Homo sapiens
ctggagatcaccagt

SEQ ID NO: 6151507 - DNA, 20 bp, Homo sapiens
ctggagatcagcatgcctgt

SEQ ID NO: 6151508 - DNA, 16 bp, Homo sapiens
ctggagatcctcctgc

SEQ ID NO: 6151509 - DNA, 15 bp, Homo sapiens
ctggagatgatgatg

SEQ ID NO: 6151510 - DNA, 22 bp, Homo sapiens
ctggagatggaagcttgttgaa

SEQ ID NO: 6151511 - DNA, 23 bp, Homo sapiens
ctggagatggaagcttgttgaaa

SEQ ID NO: 6151512 - DNA, 17 bp, Homo sapiens
ctggagatggctgctgc

SEQ ID NO: 6151513 - DNA, 18 bp, Homo sapiens
ctggagatggctgctgct

SEQ ID NO: 6151514 - DNA, 19 bp, Homo sapiens
ctggagatggctgctgctc

SEQ ID NO: 6151515 - DNA, 15 bp, Homo sapiens
ctggagatggggaga

SEQ ID NO: 6151516 - DNA, 18 bp, Homo sapiens
ctggagatggggagaaac

SEQ ID NO: 6151517 - DNA, 23 bp, Homo sapiens
ctggagattgtgctctgcagcga

SEQ ID NO: 6151518 - DNA, 19 bp, Homo sapiens
ctggagatttcagttactt

SEQ ID NO: 6151519 - DNA, 17 bp, Homo sapiens
ctggagcaagagagagc

SEQ ID NO: 6151520 - DNA, 15 bp, Homo sapiens
ctggagcaagccctg

SEQ ID NO: 6151521 - DNA, 23 bp, Homo sapiens
ctggagcaagccctgacccaata

SEQ ID NO: 6151522 - DNA, 15 bp, Homo sapiens
ctggagcaagctctg

SEQ ID NO: 6151523 - DNA, 19 bp, Homo sapiens
ctggagcaagctctgccct

SEQ ID NO: 6151524 - DNA, 19 bp, Homo sapiens
ctggagcacaaagaccctg

SEQ ID NO: 6151525 - DNA, 22 bp, Homo sapiens
ctggagcacaataaatggctgt

SEQ ID NO: 6151526 - DNA, 14 bp, Homo sapiens
ctggagcaccaggc

SEQ ID NO: 6151527 - DNA, 19 bp, Homo sapiens
ctggagcactgggctcccg

SEQ ID NO: 6151528 - DNA, 23 bp, Homo sapiens
ctggagcactgggctcccgggcc

SEQ ID NO: 6151529 - DNA, 20 bp, Homo sapiens
ctggagcacttgttttaaaa

SEQ ID NO: 6151530 - DNA, 13 bp, Homo sapiens
ctggagcagaagg

SEQ ID NO: 6151531 - DNA, 22 bp, Homo sapiens
ctggagcagaccaccccgcctg

SEQ ID NO: 6151532 - DNA, 22 bp, Homo sapiens
ctggagcagcggattgctctgg

SEQ ID NO: 6151533 - DNA, 21 bp, Homo sapiens
ctggagcaggcccaatgctgc

SEQ ID NO: 6151534 - DNA, 16 bp, Homo sapiens
ctggagcaggccttgc

SEQ ID NO: 6151535 - DNA, 19 bp, Homo sapiens
ctggagcagtttggggcag

SEQ ID NO: 6151536 - DNA, 17 bp, Homo sapiens
ctggagcatctgactca

SEQ ID NO: 6151537 - DNA, 22 bp, Homo sapiens
ctggagcatctgactcacaaga

SEQ ID NO: 6151538 - DNA, 19 bp, Homo sapiens
ctggagcatgagccagctc

SEQ ID NO: 6151539 - DNA, 21 bp, Homo sapiens
ctggagccaaggcagagggga

SEQ ID NO: 6151540 - DNA, 15 bp, Homo sapiens
ctggagccaagtcca

SEQ ID NO: 6151541 - DNA, 16 bp, Homo sapiens
ctggagccaagtccag

SEQ ID NO: 6151542 - DNA, 19 bp, Homo sapiens
ctggagccaagtccagatt

SEQ ID NO: 6151543 - DNA, 22 bp, Homo sapiens
ctggagccaatggtgagggctg

SEQ ID NO: 6151544 - DNA, 13 bp, Homo sapiens
ctggagccacctg

SEQ ID NO: 6151545 - DNA, 16 bp, Homo sapiens
ctggagccacctgtcc

SEQ ID NO: 6151546 - DNA, 21 bp, Homo sapiens
ctggagccagactctggtctt

SEQ ID NO: 6151547 - DNA, 22 bp, Homo sapiens
ctggagccagactctggtcttc

SEQ ID NO: 6151548 - DNA, 17 bp, Homo sapiens
ctggagccagagagaac

SEQ ID NO: 6151549 - DNA, 16 bp, Homo sapiens
ctggagccagcagggc

SEQ ID NO: 6151550 - DNA, 15 bp, Homo sapiens
ctggagccagggcag

SEQ ID NO: 6151551 - DNA, 18 bp, Homo sapiens
ctggagccagggcagagg

SEQ ID NO: 6151552 - DNA, 22 bp, Homo sapiens
ctggagccatcccttcggagcc

SEQ ID NO: 6151553 - DNA, 19 bp, Homo sapiens
ctggagcccacagcgagcc

SEQ ID NO: 6151554 - DNA, 16 bp, Homo sapiens
ctggagcccactgtac

SEQ ID NO: 6151555 - DNA, 17 bp, Homo sapiens
ctggagcccactgtact

SEQ ID NO: 6151556 - DNA, 20 bp, Homo sapiens
ctggagcccactgtacttgc

SEQ ID NO: 6151557 - DNA, 17 bp, Homo sapiens
ctggagcccagaggagg

SEQ ID NO: 6151558 - DNA, 22 bp, Homo sapiens
ctggagcccagcgtcagaagtc

SEQ ID NO: 6151559 - DNA, 12 bp, Homo sapiens
ctggagcccagg

SEQ ID NO: 6151560 - DNA, 13 bp, Homo sapiens
ctggagcccagga

SEQ ID NO: 6151561 - DNA, 15 bp, Homo sapiens
ctggagcccaggagt

SEQ ID NO: 6151562 - DNA, 13 bp, Homo sapiens
ctggagcccccag

SEQ ID NO: 6151563 - DNA, 19 bp, Homo sapiens
ctggagcccccagcagagg

SEQ ID NO: 6151564 - DNA, 20 bp, Homo sapiens
ctggagcccccagcagaggc

SEQ ID NO: 6151565 - DNA, 21 bp, Homo sapiens
ctggagcccccagcagaggca

SEQ ID NO: 6151566 - DNA, 23 bp, Homo sapiens
ctggagcccccagcagaggcagg

SEQ ID NO: 6151567 - DNA, 13 bp, Homo sapiens
ctggagccccgca

SEQ ID NO: 6151568 - DNA, 22 bp, Homo sapiens
ctggagcccctatcctgcaccc

SEQ ID NO: 6151569 - DNA, 16 bp, Homo sapiens
ctggagcccctgggtg

SEQ ID NO: 6151570 - DNA, 15 bp, Homo sapiens
ctcgaactcctggcc

SEQ ID NO: 6151571 - DNA, 16 bp, Homo sapiens
ctcgaactcctggcct

SEQ ID NO: 6151572 - DNA, 17 bp, Homo sapiens
ctcgaactcctgggctc

SEQ ID NO: 6151573 - DNA, 22 bp, Homo sapiens
ctcgaacttgaagcacaagttc

SEQ ID NO: 6151574 - DNA, 20 bp, Homo sapiens
ctcgaagaaaataattctct

SEQ ID NO: 6151575 - DNA, 11 bp, Homo sapiens
ctcgaagccat

SEQ ID NO: 6151576 - DNA, 14 bp, Homo sapiens
ctcgaagcccttcc

SEQ ID NO: 6151577 - DNA, 18 bp, Homo sapiens
ctcgaagcccttccagtg

SEQ ID NO: 6151578 - DNA, 20 bp, Homo sapiens
ctcgaagcgcgccactcgct

SEQ ID NO: 6151579 - DNA, 15 bp, Homo sapiens
ctcgaagctgttctc

SEQ ID NO: 6151580 - DNA, 16 bp, Homo sapiens
ctcgaagctgttctct

SEQ ID NO: 6151581 - DNA, 17 bp, Homo sapiens
ctcgaagctgttctctg

SEQ ID NO: 6151582 - DNA, 21 bp, Homo sapiens
ctcgaagtcttccatcagcag

SEQ ID NO: 6151583 - DNA, 14 bp, Homo sapiens
ctcgaatctgtgtg

SEQ ID NO: 6151584 - DNA, 15 bp, Homo sapiens
ctcgaattctcagac

SEQ ID NO: 6151585 - DNA, 12 bp, Homo sapiens
ctcgaattttgt

SEQ ID NO: 6151586 - DNA, 23 bp, Homo sapiens
ctcgacacgtgggctcccctctt

SEQ ID NO: 6151587 - DNA, 15 bp, Homo sapiens
ctcgacagcgcccct

SEQ ID NO: 6151588 - DNA, 20 bp, Homo sapiens
ctcgacagcgcccctgctgt

SEQ ID NO: 6151589 - DNA, 19 bp, Homo sapiens
ctcgacatgaaaattcaga

SEQ ID NO: 6151590 - DNA, 20 bp, Homo sapiens
ctcgaccacttttcagttca

SEQ ID NO: 6151591 - DNA, 21 bp, Homo sapiens
ctcgacccagaatggagcctg

SEQ ID NO: 6151592 - DNA, 22 bp, Homo sapiens
ctcgaccctgtcccctagggac

SEQ ID NO: 6151593 - DNA, 15 bp, Homo sapiens
ctcgacctccccacc

SEQ ID NO: 6151594 - DNA, 14 bp, Homo sapiens
ctcgacctccctgg

SEQ ID NO: 6151595 - DNA, 15 bp, Homo sapiens
ctcgacctccctggc

SEQ ID NO: 6151596 - DNA, 16 bp, Homo sapiens
ctcgacctccctggct

SEQ ID NO: 6151597 - DNA, 15 bp, Homo sapiens
ctcgacggcacgcac

SEQ ID NO: 6151598 - DNA, 22 bp, Homo sapiens
ctcgacggcacgcacttgcctg

SEQ ID NO: 6151599 - DNA, 14 bp, Homo sapiens
ctcgacgtcccttg

SEQ ID NO: 6151600 - DNA, 15 bp, Homo sapiens
ctcgacgtcccttgg

SEQ ID NO: 6151601 - DNA, 15 bp, Homo sapiens
ctcgactaaaacaag

SEQ ID NO: 6151602 - DNA, 12 bp, Homo sapiens
ctcgactcagca

SEQ ID NO: 6151603 - DNA, 13 bp, Homo sapiens
ctcgactcccccc

SEQ ID NO: 6151604 - DNA, 22 bp, Homo sapiens
ctcgactctgctgctcatggga

SEQ ID NO: 6151605 - DNA, 13 bp, Homo sapiens
ctcgactctgtgc

SEQ ID NO: 6151606 - DNA, 12 bp, Homo sapiens
ctcgactgcttt

SEQ ID NO: 6151607 - DNA, 22 bp, Homo sapiens
ctcgactgtcagtggggcagcc

SEQ ID NO: 6151608 - DNA, 22 bp, Homo sapiens
ctcgacttcaggagctgacaga

SEQ ID NO: 6151609 - DNA, 18 bp, Homo sapiens
ctcgagaccatcctggcc

SEQ ID NO: 6151610 - DNA, 19 bp, Homo sapiens
ctcgagaccatcctggccc

SEQ ID NO: 6151611 - DNA, 22 bp, Homo sapiens
ctcgagaccatcctggcccctc

SEQ ID NO: 6151612 - DNA, 20 bp, Homo sapiens
ctcgagaggccaaagaagga

SEQ ID NO: 6151613 - DNA, 23 bp, Homo sapiens
ctcgagagggctggtccttattt

SEQ ID NO: 6151614 - DNA, 22 bp, Homo sapiens
ctcgagatcccaacactgccag

SEQ ID NO: 6151615 - DNA, 14 bp, Homo sapiens
ctcgagcagagaga

SEQ ID NO: 6151616 - DNA, 22 bp, Homo sapiens
ctcgagcatgcctggatggggc

SEQ ID NO: 6151617 - DNA, 18 bp, Homo sapiens
ctcgagcccacccagcat

SEQ ID NO: 6151618 - DNA, 15 bp, Homo sapiens
ctcgagcccagatgg

SEQ ID NO: 6151619 - DNA, 21 bp, Homo sapiens
ctcgagcgccctgcagaccct

SEQ ID NO: 6151620 - DNA, 23 bp, Homo sapiens
ctcgagcgccctgcagaccctgc

SEQ ID NO: 6151621 - DNA, 16 bp, Homo sapiens
ctcgagctctgtagcc

SEQ ID NO: 6151622 - DNA, 18 bp, Homo sapiens
ctcgaggcaccggcgctg

SEQ ID NO: 6151623 - DNA, 21 bp, Homo sapiens
ctcgaggcaccggcgctgcag

SEQ ID NO: 6151624 - DNA, 22 bp, Homo sapiens
ctcgaggcaccggcgctgcagg

SEQ ID NO: 6151625 - DNA, 11 bp, Homo sapiens
ctcgaggccta

SEQ ID NO: 6151626 - DNA, 12 bp, Homo sapiens
ctcgaggcctgc

SEQ ID NO: 6151627 - DNA, 13 bp, Homo sapiens
ctcgaggcctgca

SEQ ID NO: 6151628 - DNA, 12 bp, Homo sapiens
ctcgaggctctt

SEQ ID NO: 6151629 - DNA, 15 bp, Homo sapiens
ctcgaggctcttcca

SEQ ID NO: 6151630 - DNA, 23 bp, Homo sapiens
ctcgaggctggtggttttcagag

SEQ ID NO: 6151631 - DNA, 18 bp, Homo sapiens
ctcgagggcagggaccac

SEQ ID NO: 6151632 - DNA, 23 bp, Homo sapiens
ctcgagggcagggaccacaccct

SEQ ID NO: 6151633 - DNA, 20 bp, Homo sapiens
ctcgagggccgcctgcctta

SEQ ID NO: 6151634 - DNA, 17 bp, Homo sapiens
ctcgaggggtgggctgg

SEQ ID NO: 6151635 - DNA, 19 bp, Homo sapiens
ctcgaggggtgggctggta

SEQ ID NO: 6151636 - DNA, 21 bp, Homo sapiens
ctcgaggtcgggcagcacaag

SEQ ID NO: 6151637 - DNA, 19 bp, Homo sapiens
ctcgaggtggagggtagcc

SEQ ID NO: 6151638 - DNA, 17 bp, Homo sapiens
ctcgaggtttctcaaag

SEQ ID NO: 6151639 - DNA, 22 bp, Homo sapiens
ctcgagtactgtgggcaattta

SEQ ID NO: 6151640 - DNA, 16 bp, Homo sapiens
ctcgagtcacattctg

SEQ ID NO: 6151641 - DNA, 23 bp, Homo sapiens
ctcgagtccccatgattccctcc

SEQ ID NO: 6151642 - DNA, 13 bp, Homo sapiens
ctcgagtcccccc

SEQ ID NO: 6151643 - DNA, 22 bp, Homo sapiens
ctcgagtccccccacccctccc

SEQ ID NO: 6151644 - DNA, 15 bp, Homo sapiens
ctcgagtgcccctgc

SEQ ID NO: 6151645 - DNA, 22 bp, Homo sapiens
ctcgagtgcccctgcaggggag

SEQ ID NO: 6151646 - DNA, 19 bp, Homo sapiens
ctcgagtggcgagtccaga

SEQ ID NO: 6151647 - DNA, 21 bp, Homo sapiens
ctcgagtggcgagtccagaca

SEQ ID NO: 6151648 - DNA, 16 bp, Homo sapiens
ctcgagtgtttaaatg

SEQ ID NO: 6151649 - DNA, 18 bp, Homo sapiens
ctcgagtgtttaaatgct

SEQ ID NO: 6151650 - DNA, 19 bp, Homo sapiens
ctcgagtgtttaaatgctg

SEQ ID NO: 6151651 - DNA, 20 bp, Homo sapiens
ctcgagttacagacaaagcg

SEQ ID NO: 6151652 - DNA, 22 bp, Homo sapiens
ctcgatcaaaaccttccttccc

SEQ ID NO: 6151653 - DNA, 21 bp, Homo sapiens
ctcgatcatatttccccttgg

SEQ ID NO: 6151654 - DNA, 22 bp, Homo sapiens
ctcgatcatatttccccttgga

SEQ ID NO: 6151655 - DNA, 19 bp, Homo sapiens
ctcgatccaaattgtgctt

SEQ ID NO: 6151656 - DNA, 13 bp, Homo sapiens
ctcgatctcctga

SEQ ID NO: 6151657 - DNA, 14 bp, Homo sapiens
ctcgatctcctgac

SEQ ID NO: 6151658 - DNA, 15 bp, Homo sapiens
ctcgatctcctgacc

SEQ ID NO: 6151659 - DNA, 20 bp, Homo sapiens
ctcgatgcaagtgtttctgt

SEQ ID NO: 6151660 - DNA, 18 bp, Homo sapiens
ctcgatgctgctggcctc

SEQ ID NO: 6151661 - DNA, 19 bp, Homo sapiens
ctcgatgctgctggcctcc

SEQ ID NO: 6151662 - DNA, 23 bp, Homo sapiens
ctcgatgctgctggcctccctcc

SEQ ID NO: 6151663 - DNA, 17 bp, Homo sapiens
ctcgatggacctcagca

SEQ ID NO: 6151664 - DNA, 18 bp, Homo sapiens
ctcgatgtccagctgctg

SEQ ID NO: 6151665 - DNA, 22 bp, Homo sapiens
ctcgatgttcatggaattggtt

SEQ ID NO: 6151666 - DNA, 14 bp, Homo sapiens
ctcgattctttgaa

SEQ ID NO: 6151667 - DNA, 19 bp, Homo sapiens
ctcgattttgtatctgcag

SEQ ID NO: 6151668 - DNA, 18 bp, Homo sapiens
ctcgcacaatgcatgtgc

SEQ ID NO: 6151669 - DNA, 11 bp, Homo sapiens
ctcgcacacag

SEQ ID NO: 6151670 - DNA, 20 bp, Homo sapiens
ctcgcacacagggctcacag

SEQ ID NO: 6151671 - DNA, 19 bp, Homo sapiens
ctcgcacagggcatgcctg

SEQ ID NO: 6151672 - DNA, 21 bp, Homo sapiens
ctcgcacagggcatgcctggc

SEQ ID NO: 6151673 - DNA, 22 bp, Homo sapiens
ctcgcacagggcatgcctggcc

SEQ ID NO: 6151674 - DNA, 23 bp, Homo sapiens
ctcgcacccccctgttctaaggg

SEQ ID NO: 6151675 - DNA, 14 bp, Homo sapiens
ctcgcactgcaaat

SEQ ID NO: 6151676 - DNA, 23 bp, Homo sapiens
ctcgcactgcccagggaagccct

SEQ ID NO: 6151677 - DNA, 20 bp, Homo sapiens
ctcgcacttgcagaggagcc

SEQ ID NO: 6151678 - DNA, 19 bp, Homo sapiens
ctcgcagcacccacagcac

SEQ ID NO: 6151679 - DNA, 20 bp, Homo sapiens
ctcgcagcacccacagcacc

SEQ ID NO: 6151680 - DNA, 19 bp, Homo sapiens
ctcgcagcaggtgcaagag

SEQ ID NO: 6151681 - DNA, 19 bp, Homo sapiens
ctcgcagcctctcagtgcc

SEQ ID NO: 6151682 - DNA, 14 bp, Homo sapiens
ctcgcagcctgaag

SEQ ID NO: 6151683 - DNA, 21 bp, Homo sapiens
ctcgcagcctgaagcctggat

SEQ ID NO: 6151684 - DNA, 14 bp, Homo sapiens
ctcgcagcctggcg

SEQ ID NO: 6151685 - DNA, 15 bp, Homo sapiens
ctcgcagcctggcgg

SEQ ID NO: 6151686 - DNA, 22 bp, Homo sapiens
ctcgcagcctggcggggcagga

SEQ ID NO: 6151687 - DNA, 11 bp, Homo sapiens
ctcgcaggacc

SEQ ID NO: 6151688 - DNA, 12 bp, Homo sapiens
ctcgcaggacca

SEQ ID NO: 6151689 - DNA, 19 bp, Homo sapiens
ctcgcagggaatgcagcag

SEQ ID NO: 6151690 - DNA, 15 bp, Homo sapiens
ctcgcagtcgcagga

SEQ ID NO: 6151691 - DNA, 16 bp, Homo sapiens
ctcgcatcattgcaga

SEQ ID NO: 6151692 - DNA, 17 bp, Homo sapiens
ctcgcatcattgcagat

SEQ ID NO: 6151693 - DNA, 23 bp, Homo sapiens
ctcgcatcctatgcttaataaaa

SEQ ID NO: 6151694 - DNA, 18 bp, Homo sapiens
ctcgcatctatagataac

SEQ ID NO: 6151695 - DNA, 22 bp, Homo sapiens
ctcgccaagcaggacagtgctt

SEQ ID NO: 6151696 - DNA, 12 bp, Homo sapiens
ctcgccaaggcc

SEQ ID NO: 6151697 - DNA, 16 bp, Homo sapiens
ctcgccacgctcagtg

SEQ ID NO: 6151698 - DNA, 19 bp, Homo sapiens
ctcgccacgctcagtgccc

SEQ ID NO: 6151699 - DNA, 23 bp, Homo sapiens
ctcgccagaagactcctaggccc

SEQ ID NO: 6151700 - DNA, 13 bp, Homo sapiens
ctcgccagcttct

SEQ ID NO: 6151701 - DNA, 16 bp, Homo sapiens
ctcgccagcttctcct

SEQ ID NO: 6151702 - DNA, 18 bp, Homo sapiens
ctcgccagcttctcctgc

SEQ ID NO: 6151703 - DNA, 20 bp, Homo sapiens
ctcgccagcttctcctgcgc

SEQ ID NO: 6151704 - DNA, 22 bp, Homo sapiens
ctcgccagcttctcctgcgccc

SEQ ID NO: 6151705 - DNA, 18 bp, Homo sapiens
ctcgccagcttggctcga

SEQ ID NO: 6151706 - DNA, 13 bp, Homo sapiens
ctcgccataaatc

SEQ ID NO: 6151707 - DNA, 12 bp, Homo sapiens
ctcgccatgccg

SEQ ID NO: 6151708 - DNA, 14 bp, Homo sapiens
ctcgcccagacacc

SEQ ID NO: 6151709 - DNA, 16 bp, Homo sapiens
ctcgcccagacaccat

SEQ ID NO: 6151710 - DNA, 12 bp, Homo sapiens
ctcgcccagcag

SEQ ID NO: 6151711 - DNA, 12 bp, Homo sapiens
ctcgcccaggaa

SEQ ID NO: 6151712 - DNA, 14 bp, Homo sapiens
ctcgcccagtccca

SEQ ID NO: 6151713 - DNA, 16 bp, Homo sapiens
ctcgcccagtcccagc

SEQ ID NO: 6151714 - DNA, 19 bp, Homo sapiens
ctcgcccatccccttgagg

SEQ ID NO: 6151715 - DNA, 19 bp, Homo sapiens
ctcgccccaaggttccaga

SEQ ID NO: 6151716 - DNA, 12 bp, Homo sapiens
ctcgccccaccc

SEQ ID NO: 6151717 - DNA, 17 bp, Homo sapiens
ctcgccccaccggcgcg

SEQ ID NO: 6151718 - DNA, 16 bp, Homo sapiens
ctcgccccacctccac

SEQ ID NO: 6151719 - DNA, 23 bp, Homo sapiens
ctcgccccagccaagcctgactt

SEQ ID NO: 6151720 - DNA, 14 bp, Homo sapiens
ctcgccccagcctc

SEQ ID NO: 6151721 - DNA, 13 bp, Homo sapiens
ctcgccccatccc

SEQ ID NO: 6151722 - DNA, 14 bp, Homo sapiens
ctcgcccccacttt

SEQ ID NO: 6151723 - DNA, 20 bp, Homo sapiens
ctcgcccccgcccccaccgg

SEQ ID NO: 6151724 - DNA, 18 bp, Homo sapiens
ctcgcccccgggcccttt

SEQ ID NO: 6151725 - DNA, 18 bp, Homo sapiens
ctcgcccctcccctcagc

SEQ ID NO: 6151726 - DNA, 23 bp, Homo sapiens
ctcgcccctcccctcagcctgcc

SEQ ID NO: 6151727 - DNA, 20 bp, Homo sapiens
ctcgcccctggcagagatgc

SEQ ID NO: 6151728 - DNA, 14 bp, Homo sapiens
ctcgcccgcccact

SEQ ID NO: 6151729 - DNA, 17 bp, Homo sapiens
ctcgccctcctttctgt

SEQ ID NO: 6151730 - DNA, 13 bp, Homo sapiens
ctcgccctgggtc

SEQ ID NO: 6151731 - DNA, 15 bp, Homo sapiens
ctcgccctgggtcta

SEQ ID NO: 6151732 - DNA, 12 bp, Homo sapiens
ctcgccctgtcc

SEQ ID NO: 6151733 - DNA, 13 bp, Homo sapiens
ctcgccctgtgag

SEQ ID NO: 6151734 - DNA, 14 bp, Homo sapiens
ctcgccctgtgccc

SEQ ID NO: 6151735 - DNA, 24 bp, Homo sapiens
ctcgccgagctgtcggagggctgg

SEQ ID NO: 6151736 - DNA, 20 bp, Homo sapiens
ctcgccggaccctctaacct

SEQ ID NO: 6151737 - DNA, 15 bp, Homo sapiens
ctcgccgtctgtgaa

SEQ ID NO: 6151738 - DNA, 21 bp, Homo sapiens
ctcgccgtgtctcagcctctg

SEQ ID NO: 6151739 - DNA, 20 bp, Homo sapiens
ctcgcctaccaatctctgct

SEQ ID NO: 6151740 - DNA, 18 bp, Homo sapiens
ctcgcctaggatttcagc

SEQ ID NO: 6151741 - DNA, 12 bp, Homo sapiens
ctcgcctaggcc

SEQ ID NO: 6151742 - DNA, 14 bp, Homo sapiens
ctcgcctatcttag

SEQ ID NO: 6151743 - DNA, 19 bp, Homo sapiens
ctcgcctcagcctgatcag

SEQ ID NO: 6151744 - DNA, 18 bp, Homo sapiens
ctcgcctcggatcagctg

SEQ ID NO: 6151745 - DNA, 13 bp, Homo sapiens
ctcgcctctccca

SEQ ID NO: 6151746 - DNA, 16 bp, Homo sapiens
ctcgcctctgcccagc

SEQ ID NO: 6151747 - DNA, 17 bp, Homo sapiens
ctcgcctgccctcctct

SEQ ID NO: 6151748 - DNA, 17 bp, Homo sapiens
ctggagcccctgggtgg

SEQ ID NO: 6151749 - DNA, 17 bp, Homo sapiens
ctggagcccctgtgtgg

SEQ ID NO: 6151750 - DNA, 19 bp, Homo sapiens
ctggagcccctgtgtggga

SEQ ID NO: 6151751 - DNA, 16 bp, Homo sapiens
ctggagcccctgtgtt

SEQ ID NO: 6151752 - DNA, 12 bp, Homo sapiens
ctggagcccgcc

SEQ ID NO: 6151753 - DNA, 11 bp, Homo sapiens
ctggagccctg

SEQ ID NO: 6151754 - DNA, 16 bp, Homo sapiens
ctggagccctgttcct

SEQ ID NO: 6151755 - DNA, 21 bp, Homo sapiens
ctggagccctgttcctccctc

SEQ ID NO: 6151756 - DNA, 23 bp, Homo sapiens
ctggagccgcttccccagctcag

SEQ ID NO: 6151757 - DNA, 19 bp, Homo sapiens
ctggagcctcggtggccat

SEQ ID NO: 6151758 - DNA, 21 bp, Homo sapiens
ctggagcctcggtggccatgc

SEQ ID NO: 6151759 - DNA, 16 bp, Homo sapiens
ctggagcctgagtcag

SEQ ID NO: 6151760 - DNA, 23 bp, Homo sapiens
ctggagcctgcaggcaggtgggg

SEQ ID NO: 6151761 - DNA, 22 bp, Homo sapiens
ctggagcctgcggggcagcagg

SEQ ID NO: 6151762 - DNA, 23 bp, Homo sapiens
ctggagcctgcggggcagcaggg

SEQ ID NO: 6151763 - DNA, 12 bp, Homo sapiens
ctggagcctggg

SEQ ID NO: 6151764 - DNA, 23 bp, Homo sapiens
ctggagcctgtgtaacagctcct

SEQ ID NO: 6151765 - DNA, 18 bp, Homo sapiens
ctggagcggagcttgcct

SEQ ID NO: 6151766 - DNA, 17 bp, Homo sapiens
ctggagcggctctcctg

SEQ ID NO: 6151767 - DNA, 22 bp, Homo sapiens
ctggagcgtttgctgtgccagg

SEQ ID NO: 6151768 - DNA, 23 bp, Homo sapiens
ctggagcgtttgctgtgccagga

SEQ ID NO: 6151769 - DNA, 17 bp, Homo sapiens
ctggagctaaggccagc

SEQ ID NO: 6151770 - DNA, 18 bp, Homo sapiens
ctggagctaaggccagct

SEQ ID NO: 6151771 - DNA, 21 bp, Homo sapiens
ctggagctaaggccagctaga

SEQ ID NO: 6151772 - DNA, 19 bp, Homo sapiens
ctggagctagtgtctcctc

SEQ ID NO: 6151773 - DNA, 19 bp, Homo sapiens
ctggagctcaagccgtggc

SEQ ID NO: 6151774 - DNA, 14 bp, Homo sapiens
ctggagctcctccc

SEQ ID NO: 6151775 - DNA, 18 bp, Homo sapiens
ctggagctcctccctcca

SEQ ID NO: 6151776 - DNA, 13 bp, Homo sapiens
ctggagctcctgg

SEQ ID NO: 6151777 - DNA, 16 bp, Homo sapiens
ctggagctcctgggaa

SEQ ID NO: 6151778 - DNA, 12 bp, Homo sapiens
ctggagctctgc

SEQ ID NO: 6151779 - DNA, 13 bp, Homo sapiens
ctggagctctgcc

SEQ ID NO: 6151780 - DNA, 16 bp, Homo sapiens
ctggagctctgcccat

SEQ ID NO: 6151781 - DNA, 23 bp, Homo sapiens
ctggagctctgtgggtctctgga

SEQ ID NO: 6151782 - DNA, 13 bp, Homo sapiens
ctggagctgagct

SEQ ID NO: 6151783 - DNA, 12 bp, Homo sapiens
ctggagctgagg

SEQ ID NO: 6151784 - DNA, 12 bp, Homo sapiens
ctggagctgcca

SEQ ID NO: 6151785 - DNA, 15 bp, Homo sapiens
ctggagctgccagca

SEQ ID NO: 6151786 - DNA, 19 bp, Homo sapiens
ctggagctggcgtctgtct

SEQ ID NO: 6151787 - DNA, 14 bp, Homo sapiens
ctggagctggcttt

SEQ ID NO: 6151788 - DNA, 15 bp, Homo sapiens
ctggagctgggaggt

SEQ ID NO: 6151789 - DNA, 16 bp, Homo sapiens
ctggagctgtccttca

SEQ ID NO: 6151790 - DNA, 16 bp, Homo sapiens
ctggagcttcagccag

SEQ ID NO: 6151791 - DNA, 18 bp, Homo sapiens
ctggagcttcagccaggt

SEQ ID NO: 6151792 - DNA, 19 bp, Homo sapiens
ctggagcttcagccaggtc

SEQ ID NO: 6151793 - DNA, 14 bp, Homo sapiens
ctggagcttctctt

SEQ ID NO: 6151794 - DNA, 22 bp, Homo sapiens
ctggagcttgaaatagtgtctg

SEQ ID NO: 6151795 - DNA, 18 bp, Homo sapiens
ctggaggaaccacatata

SEQ ID NO: 6151796 - DNA, 23 bp, Homo sapiens
ctggaggaacttgctgctgtgcc

SEQ ID NO: 6151797 - DNA, 22 bp, Homo sapiens
ctggaggaagttctccagcttc

SEQ ID NO: 6151798 - DNA, 19 bp, Homo sapiens
ctggaggaatacattttat

SEQ ID NO: 6151799 - DNA, 22 bp, Homo sapiens
ctggaggaatacattttattct

SEQ ID NO: 6151800 - DNA, 20 bp, Homo sapiens
ctggaggactagaacctgga

SEQ ID NO: 6151801 - DNA, 22 bp, Homo sapiens
ctggaggactagaacctggagg

SEQ ID NO: 6151802 - DNA, 24 bp, Homo sapiens
ctggaggactctagaagctcaggt

SEQ ID NO: 6151803 - DNA, 17 bp, Homo sapiens
ctggaggagaaggagga

SEQ ID NO: 6151804 - DNA, 14 bp, Homo sapiens
ctggaggagcacac

SEQ ID NO: 6151805 - DNA, 18 bp, Homo sapiens
ctggaggagcagcttcct

SEQ ID NO: 6151806 - DNA, 12 bp, Homo sapiens
ctggaggagccc

SEQ ID NO: 6151807 - DNA, 13 bp, Homo sapiens
ctggaggagctgg

SEQ ID NO: 6151808 - DNA, 14 bp, Homo sapiens
ctggaggagctggc

SEQ ID NO: 6151809 - DNA, 19 bp, Homo sapiens
ctggaggagctggcctgtg

SEQ ID NO: 6151810 - DNA, 18 bp, Homo sapiens
ctggaggaggcctgtccc

SEQ ID NO: 6151811 - DNA, 16 bp, Homo sapiens
ctggaggaggggaagc

SEQ ID NO: 6151812 - DNA, 19 bp, Homo sapiens
ctggaggaggggaagctgg

SEQ ID NO: 6151813 - DNA, 20 bp, Homo sapiens
ctggaggaggggaagctggg

SEQ ID NO: 6151814 - DNA, 22 bp, Homo sapiens
ctggaggagggtttgggcagag

SEQ ID NO: 6151815 - DNA, 18 bp, Homo sapiens
ctggaggatccctccatc

SEQ ID NO: 6151816 - DNA, 19 bp, Homo sapiens
ctggaggatccctccatcc

SEQ ID NO: 6151817 - DNA, 23 bp, Homo sapiens
ctggaggcaaaggcctggacagc

SEQ ID NO: 6151818 - DNA, 17 bp, Homo sapiens
ctggaggcaagagggag

SEQ ID NO: 6151819 - DNA, 21 bp, Homo sapiens
ctggaggcacgcaccactgct

SEQ ID NO: 6151820 - DNA, 14 bp, Homo sapiens
ctggaggcagacag

SEQ ID NO: 6151821 - DNA, 21 bp, Homo sapiens
ctggaggcagactcgagggcc

SEQ ID NO: 6151822 - DNA, 21 bp, Homo sapiens
ctggaggcagagggcaaggga

SEQ ID NO: 6151823 - DNA, 18 bp, Homo sapiens
ctggaggcaggactcctg

SEQ ID NO: 6151824 - DNA, 22 bp, Homo sapiens
ctggaggcagggccttgcccag

SEQ ID NO: 6151825 - DNA, 23 bp, Homo sapiens
ctggaggcagggccttgcccaga

SEQ ID NO: 6151826 - DNA, 15 bp, Homo sapiens
ctggaggcaggggct

SEQ ID NO: 6151827 - DNA, 19 bp, Homo sapiens
ctggaggcaggggcttcct

SEQ ID NO: 6151828 - DNA, 20 bp, Homo sapiens
ctggaggcagggggtgaggg

SEQ ID NO: 6151829 - DNA, 21 bp, Homo sapiens
ctggaggcattcccagaggtg

SEQ ID NO: 6151830 - DNA, 22 bp, Homo sapiens
ctggaggcattcccagaggtgg

SEQ ID NO: 6151831 - DNA, 13 bp, Homo sapiens
ctggaggcccagg

SEQ ID NO: 6151832 - DNA, 19 bp, Homo sapiens
ctggaggcccaggctggga

SEQ ID NO: 6151833 - DNA, 21 bp, Homo sapiens
ctggaggcccagttcaccctg

SEQ ID NO: 6151834 - DNA, 14 bp, Homo sapiens
ctggaggccccaac

SEQ ID NO: 6151835 - DNA, 13 bp, Homo sapiens
ctggaggcccctg

SEQ ID NO: 6151836 - DNA, 19 bp, Homo sapiens
ctggaggcccctggagcca

SEQ ID NO: 6151837 - DNA, 21 bp, Homo sapiens
ctggaggcccctggagccaga

SEQ ID NO: 6151838 - DNA, 19 bp, Homo sapiens
ctggaggccgaggaccacc

SEQ ID NO: 6151839 - DNA, 23 bp, Homo sapiens
ctggaggccgaggaccaccagca

SEQ ID NO: 6151840 - DNA, 13 bp, Homo sapiens
ctggaggcctcag

SEQ ID NO: 6151841 - DNA, 16 bp, Homo sapiens
ctggaggcctctggcc

SEQ ID NO: 6151842 - DNA, 17 bp, Homo sapiens
ctggaggcctctgggcc

SEQ ID NO: 6151843 - DNA, 18 bp, Homo sapiens
ctggaggcctctgggcct

SEQ ID NO: 6151844 - DNA, 16 bp, Homo sapiens
ctggaggccttccagc

SEQ ID NO: 6151845 - DNA, 18 bp, Homo sapiens
ctggaggccttccagctg

SEQ ID NO: 6151846 - DNA, 21 bp, Homo sapiens
ctggaggccttccagctgctg

SEQ ID NO: 6151847 - DNA, 22 bp, Homo sapiens
ctggaggccttccagctgctgt

SEQ ID NO: 6151848 - DNA, 23 bp, Homo sapiens
ctggaggctcaccttgcagaacc

SEQ ID NO: 6151849 - DNA, 19 bp, Homo sapiens
ctggaggctccaggactcc

SEQ ID NO: 6151850 - DNA, 21 bp, Homo sapiens
ctggaggctcctctaggccct

SEQ ID NO: 6151851 - DNA, 16 bp, Homo sapiens
ctggaggctgcctccc

SEQ ID NO: 6151852 - DNA, 19 bp, Homo sapiens
ctggaggctgcctgctgtg

SEQ ID NO: 6151853 - DNA, 14 bp, Homo sapiens
ctggaggctgcgtc

SEQ ID NO: 6151854 - DNA, 20 bp, Homo sapiens
ctggaggctgcgtcctgagg

SEQ ID NO: 6151855 - DNA, 11 bp, Homo sapiens
ctggaggctgg

SEQ ID NO: 6151856 - DNA, 19 bp, Homo sapiens
ctggaggctggaccaactg

SEQ ID NO: 6151857 - DNA, 20 bp, Homo sapiens
ctggaggctggaccaactgc

SEQ ID NO: 6151858 - DNA, 20 bp, Homo sapiens
ctggagggaaggacagtccc

SEQ ID NO: 6151859 - DNA, 13 bp, Homo sapiens
ctggagggacttt

SEQ ID NO: 6151860 - DNA, 14 bp, Homo sapiens
ctggagggaggctc

SEQ ID NO: 6151861 - DNA, 15 bp, Homo sapiens
ctggagggatgccac

SEQ ID NO: 6151862 - DNA, 15 bp, Homo sapiens
ctggagggatgcccc

SEQ ID NO: 6151863 - DNA, 17 bp, Homo sapiens
ctggagggatgccccca

SEQ ID NO: 6151864 - DNA, 22 bp, Homo sapiens
ctggagggatgcccccaggcag

SEQ ID NO: 6151865 - DNA, 17 bp, Homo sapiens
ctggagggcaagccctg

SEQ ID NO: 6151866 - DNA, 15 bp, Homo sapiens
ctggagggcacttcc

SEQ ID NO: 6151867 - DNA, 15 bp, Homo sapiens
ctggagggcgcccag

SEQ ID NO: 6151868 - DNA, 16 bp, Homo sapiens
ctggagggcgcccagc

SEQ ID NO: 6151869 - DNA, 23 bp, Homo sapiens
ctggagggcgcccagcagcctgc

SEQ ID NO: 6151870 - DNA, 20 bp, Homo sapiens
ctggagggctagaacctaga

SEQ ID NO: 6151871 - DNA, 22 bp, Homo sapiens
ctggagggctagaatctggaga

SEQ ID NO: 6151872 - DNA, 18 bp, Homo sapiens
ctggagggctgggcaggg

SEQ ID NO: 6151873 - DNA, 22 bp, Homo sapiens
ctggagggctgggcagggccct

SEQ ID NO: 6151874 - DNA, 21 bp, Homo sapiens
ctggaggggacgctggtagag

SEQ ID NO: 6151875 - DNA, 18 bp, Homo sapiens
ctggaggggagagctttg

SEQ ID NO: 6151876 - DNA, 18 bp, Homo sapiens
ctggaggggagaggtcag

SEQ ID NO: 6151877 - DNA, 13 bp, Homo sapiens
ctggaggggaggg

SEQ ID NO: 6151878 - DNA, 14 bp, Homo sapiens
ctggaggggcacca

SEQ ID NO: 6151879 - DNA, 20 bp, Homo sapiens
ctggaggggcaccaggtgga

SEQ ID NO: 6151880 - DNA, 18 bp, Homo sapiens
ctggaggggcagtggaga

SEQ ID NO: 6151881 - DNA, 14 bp, Homo sapiens
ctggaggggcatgg

SEQ ID NO: 6151882 - DNA, 18 bp, Homo sapiens
ctggaggggcccatgtgg

SEQ ID NO: 6151883 - DNA, 14 bp, Homo sapiens
ctggaggggcccct

SEQ ID NO: 6151884 - DNA, 23 bp, Homo sapiens
ctggaggggcccctgcttctcca

SEQ ID NO: 6151885 - DNA, 21 bp, Homo sapiens
ctggaggggctagaacctaga

SEQ ID NO: 6151886 - DNA, 14 bp, Homo sapiens
ctggaggggctgtc

SEQ ID NO: 6151887 - DNA, 22 bp, Homo sapiens
ctggagggggaatggcagcagg

SEQ ID NO: 6151888 - DNA, 13 bp, Homo sapiens
ctggaggggtggc

SEQ ID NO: 6151889 - DNA, 14 bp, Homo sapiens
ctggaggggtggcc

SEQ ID NO: 6151890 - DNA, 15 bp, Homo sapiens
ctggaggggtggccc

SEQ ID NO: 6151891 - DNA, 19 bp, Homo sapiens
ctggaggggtggcccagag

SEQ ID NO: 6151892 - DNA, 20 bp, Homo sapiens
ctggaggggtggcccagagc

SEQ ID NO: 6151893 - DNA, 13 bp, Homo sapiens
ctggaggggtggg

SEQ ID NO: 6151894 - DNA, 17 bp, Homo sapiens
ctggaggggtggggagc

SEQ ID NO: 6151895 - DNA, 21 bp, Homo sapiens
ctggaggggtgttgtatggct

SEQ ID NO: 6151896 - DNA, 19 bp, Homo sapiens
ctggaggtaaacaaagact

SEQ ID NO: 6151897 - DNA, 16 bp, Homo sapiens
ctggaggtaaggcctt

SEQ ID NO: 6151898 - DNA, 20 bp, Homo sapiens
ctggaggtactgagacaggg

SEQ ID NO: 6151899 - DNA, 22 bp, Homo sapiens
ctggaggtcacattcaggaaga

SEQ ID NO: 6151900 - DNA, 14 bp, Homo sapiens
ctggaggtcatctg

SEQ ID NO: 6151901 - DNA, 18 bp, Homo sapiens
ctggaggtcccagacatg

SEQ ID NO: 6151902 - DNA, 22 bp, Homo sapiens
ctggaggtcccagacatgctgc

SEQ ID NO: 6151903 - DNA, 23 bp, Homo sapiens
ctggaggtcccagacatgctgcc

SEQ ID NO: 6151904 - DNA, 22 bp, Homo sapiens
ctggaggtcgaagcaatcagca

SEQ ID NO: 6151905 - DNA, 23 bp, Homo sapiens
ctggaggtctccaggggcctgca

SEQ ID NO: 6151906 - DNA, 17 bp, Homo sapiens
ctggaggtctgaaaaga

SEQ ID NO: 6151907 - DNA, 18 bp, Homo sapiens
ctggaggtctgaaaagag

SEQ ID NO: 6151908 - DNA, 17 bp, Homo sapiens
ctggaggtctggctgag

SEQ ID NO: 6151909 - DNA, 21 bp, Homo sapiens
ctggaggtgaggtcaggtgcc

SEQ ID NO: 6151910 - DNA, 21 bp, Homo sapiens
ctggaggtggcgccccctggt

SEQ ID NO: 6151911 - DNA, 23 bp, Homo sapiens
ctggaggtggcgccccctggtgg

SEQ ID NO: 6151912 - DNA, 20 bp, Homo sapiens
ctggaggtgggagacaagga

SEQ ID NO: 6151913 - DNA, 17 bp, Homo sapiens
ctggaggtgggagcagg

SEQ ID NO: 6151914 - DNA, 19 bp, Homo sapiens
ctggaggtgggagcaggag

SEQ ID NO: 6151915 - DNA, 20 bp, Homo sapiens
ctggaggtgggagcaggaga

SEQ ID NO: 6151916 - DNA, 22 bp, Homo sapiens
ctggaggtgggagcaggagatt

SEQ ID NO: 6151917 - DNA, 14 bp, Homo sapiens
ctggaggtgggcat

SEQ ID NO: 6151918 - DNA, 18 bp, Homo sapiens
ctggaggtggggcctgga

SEQ ID NO: 6151919 - DNA, 22 bp, Homo sapiens
ctggaggtggggcctggagcag

SEQ ID NO: 6151920 - DNA, 22 bp, Homo sapiens
ctggaggtgttgtggggatggt

SEQ ID NO: 6151921 - DNA, 16 bp, Homo sapiens
ctggaggttgaagcca

SEQ ID NO: 6151922 - DNA, 19 bp, Homo sapiens
ctggagtaaccggacacct

SEQ ID NO: 6151923 - DNA, 18 bp, Homo sapiens
ctcgcctgccctcctctc

SEQ ID NO: 6151924 - DNA, 21 bp, Homo sapiens
ctcgcctgccctcctctcccg

SEQ ID NO: 6151925 - DNA, 17 bp, Homo sapiens
ctcgcctggaaacagag

SEQ ID NO: 6151926 - DNA, 22 bp, Homo sapiens
ctcgcctggaaacagaggtaaa

SEQ ID NO: 6151927 - DNA, 17 bp, Homo sapiens
ctcgcctggcctgaggt

SEQ ID NO: 6151928 - DNA, 12 bp, Homo sapiens
ctcgcctgggcc

SEQ ID NO: 6151929 - DNA, 14 bp, Homo sapiens
ctcgcctgggccca

SEQ ID NO: 6151930 - DNA, 20 bp, Homo sapiens
ctcgcctgggcccaggctct

SEQ ID NO: 6151931 - DNA, 15 bp, Homo sapiens
ctcgccttcatctcc

SEQ ID NO: 6151932 - DNA, 13 bp, Homo sapiens
ctcgccttccctc

SEQ ID NO: 6151933 - DNA, 20 bp, Homo sapiens
ctcgccttccctcctgcttt

SEQ ID NO: 6151934 - DNA, 23 bp, Homo sapiens
ctcgccttcggcctctcttggaa

SEQ ID NO: 6151935 - DNA, 15 bp, Homo sapiens
ctcgcgacaatgcaa

SEQ ID NO: 6151936 - DNA, 16 bp, Homo sapiens
ctcgcgctcagtaaac

SEQ ID NO: 6151937 - DNA, 16 bp, Homo sapiens
ctcgcgcttgctggcc

SEQ ID NO: 6151938 - DNA, 16 bp, Homo sapiens
ctcgcggccctcagta

SEQ ID NO: 6151939 - DNA, 19 bp, Homo sapiens
ctcgcggcgcagcccctgg

SEQ ID NO: 6151940 - DNA, 16 bp, Homo sapiens
ctcgcgggcagcgggc

SEQ ID NO: 6151941 - DNA, 14 bp, Homo sapiens
ctcgcggggcagca

SEQ ID NO: 6151942 - DNA, 22 bp, Homo sapiens
ctcgctagcagtggcaggcaga

SEQ ID NO: 6151943 - DNA, 21 bp, Homo sapiens
ctcgctattgtcaccagggct

SEQ ID NO: 6151944 - DNA, 18 bp, Homo sapiens
ctcgctcaccgctggccc

SEQ ID NO: 6151945 - DNA, 13 bp, Homo sapiens
ctcgctcagaaga

SEQ ID NO: 6151946 - DNA, 16 bp, Homo sapiens
ctcgctccaactccaa

SEQ ID NO: 6151947 - DNA, 17 bp, Homo sapiens
ctcgctccaactccaac

SEQ ID NO: 6151948 - DNA, 15 bp, Homo sapiens
ctcgctccccactct

SEQ ID NO: 6151949 - DNA, 21 bp, Homo sapiens
ctcgctccccactctgctctg

SEQ ID NO: 6151950 - DNA, 21 bp, Homo sapiens
ctcgctccctgtagctctgcc

SEQ ID NO: 6151951 - DNA, 14 bp, Homo sapiens
ctcgctcccttcaa

SEQ ID NO: 6151952 - DNA, 15 bp, Homo sapiens
ctcgctcctccttcc

SEQ ID NO: 6151953 - DNA, 19 bp, Homo sapiens
ctcgctcctccttcccagg

SEQ ID NO: 6151954 - DNA, 20 bp, Homo sapiens
ctcgctcctccttcccaggg

SEQ ID NO: 6151955 - DNA, 22 bp, Homo sapiens
ctcgctcctccttcccagggac

SEQ ID NO: 6151956 - DNA, 18 bp, Homo sapiens
ctcgctctcgctctcgct

SEQ ID NO: 6151957 - DNA, 13 bp, Homo sapiens
ctcgctctctctc

SEQ ID NO: 6151958 - DNA, 15 bp, Homo sapiens
ctcgctctgtcaccc

SEQ ID NO: 6151959 - DNA, 20 bp, Homo sapiens
ctcgctctgtcgcccaggct

SEQ ID NO: 6151960 - DNA, 22 bp, Homo sapiens
ctcgctgagggcagactggggc

SEQ ID NO: 6151961 - DNA, 17 bp, Homo sapiens
ctcgctgatgctgggct

SEQ ID NO: 6151962 - DNA, 18 bp, Homo sapiens
ctcgctgatgctgggctg

SEQ ID NO: 6151963 - DNA, 20 bp, Homo sapiens
ctcgctgatgctgggctggg

SEQ ID NO: 6151964 - DNA, 18 bp, Homo sapiens
ctcgctgcacaaatactc

SEQ ID NO: 6151965 - DNA, 12 bp, Homo sapiens
ctcgctgccacc

SEQ ID NO: 6151966 - DNA, 13 bp, Homo sapiens
ctcgctgccaccc

SEQ ID NO: 6151967 - DNA, 14 bp, Homo sapiens
ctcgctgccaccca

SEQ ID NO: 6151968 - DNA, 15 bp, Homo sapiens
ctcgctgccacccac

SEQ ID NO: 6151969 - DNA, 12 bp, Homo sapiens
ctcgctgccagc

SEQ ID NO: 6151970 - DNA, 13 bp, Homo sapiens
ctcgctgccagct

SEQ ID NO: 6151971 - DNA, 19 bp, Homo sapiens
ctcgctgccagctctgtat

SEQ ID NO: 6151972 - DNA, 18 bp, Homo sapiens
ctcgctgcgcagcctcca

SEQ ID NO: 6151973 - DNA, 19 bp, Homo sapiens
ctcgctgcgcagcctccag

SEQ ID NO: 6151974 - DNA, 20 bp, Homo sapiens
ctcgctgcgcagcctccagg

SEQ ID NO: 6151975 - DNA, 20 bp, Homo sapiens
ctcgctgcgtcctcatttcc

SEQ ID NO: 6151976 - DNA, 15 bp, Homo sapiens
ctcgctgcgtctcca

SEQ ID NO: 6151977 - DNA, 14 bp, Homo sapiens
ctcgctgctgctac

SEQ ID NO: 6151978 - DNA, 15 bp, Homo sapiens
ctcgctgctgctact

SEQ ID NO: 6151979 - DNA, 15 bp, Homo sapiens
ctcgctggactctca

SEQ ID NO: 6151980 - DNA, 22 bp, Homo sapiens
ctcgctggcccccactggctgt

SEQ ID NO: 6151981 - DNA, 14 bp, Homo sapiens
ctcgctgggctcta

SEQ ID NO: 6151982 - DNA, 16 bp, Homo sapiens
ctcgctgtatgattta

SEQ ID NO: 6151983 - DNA, 15 bp, Homo sapiens
ctcgctgtcactggc

SEQ ID NO: 6151984 - DNA, 17 bp, Homo sapiens
ctcgctgtcactggctg

SEQ ID NO: 6151985 - DNA, 19 bp, Homo sapiens
ctcgctgtcactggctggc

SEQ ID NO: 6151986 - DNA, 20 bp, Homo sapiens
ctcgctgtcactggctggct

SEQ ID NO: 6151987 - DNA, 15 bp, Homo sapiens
ctcgctgtcctgctg

SEQ ID NO: 6151988 - DNA, 17 bp, Homo sapiens
ctcgctgtcctgctgtg

SEQ ID NO: 6151989 - DNA, 20 bp, Homo sapiens
ctcgctgtgattttaagaca

SEQ ID NO: 6151990 - DNA, 12 bp, Homo sapiens
ctcgctgtgcca

SEQ ID NO: 6151991 - DNA, 13 bp, Homo sapiens
ctcgctgtgccac

SEQ ID NO: 6151992 - DNA, 15 bp, Homo sapiens
ctcgctgttgctgaa

SEQ ID NO: 6151993 - DNA, 15 bp, Homo sapiens
ctcgcttcataggca

SEQ ID NO: 6151994 - DNA, 20 bp, Homo sapiens
ctcgcttcataggcagagcc

SEQ ID NO: 6151995 - DNA, 14 bp, Homo sapiens
ctcgcttcccccat

SEQ ID NO: 6151996 - DNA, 19 bp, Homo sapiens
ctcgcttcccccatagcca

SEQ ID NO: 6151997 - DNA, 17 bp, Homo sapiens
ctcgcttcctcagcctc

SEQ ID NO: 6151998 - DNA, 18 bp, Homo sapiens
ctcgcttcctcagcctcc

SEQ ID NO: 6151999 - DNA, 15 bp, Homo sapiens
ctcgcttctcctcca

SEQ ID NO: 6152000 - DNA, 11 bp, Homo sapiens
ctcgcttcttt

SEQ ID NO: 6152001 - DNA, 14 bp, Homo sapiens
ctcgcttgtgcaga

SEQ ID NO: 6152002 - DNA, 22 bp, Homo sapiens
ctcgcttgtgcagaaaacattg

SEQ ID NO: 6152003 - DNA, 21 bp, Homo sapiens
ctcgctttttcatccttcttt

SEQ ID NO: 6152004 - DNA, 22 bp, Homo sapiens
ctcgctttttcatccttctttc

SEQ ID NO: 6152005 - DNA, 20 bp, Homo sapiens
ctcggaaccgctcacctaga

SEQ ID NO: 6152006 - DNA, 23 bp, Homo sapiens
ctcggaacctgtgagctgcacca

SEQ ID NO: 6152007 - DNA, 21 bp, Homo sapiens
ctcggaactgcatgctgctgg

SEQ ID NO: 6152008 - DNA, 18 bp, Homo sapiens
ctcggaagccgtctgact

SEQ ID NO: 6152009 - DNA, 21 bp, Homo sapiens
ctcggaattcataataaattt

SEQ ID NO: 6152010 - DNA, 13 bp, Homo sapiens
ctcggacacagtt

SEQ ID NO: 6152011 - DNA, 13 bp, Homo sapiens
ctcggacaccatc

SEQ ID NO: 6152012 - DNA, 18 bp, Homo sapiens
ctcggacacccagggtct

SEQ ID NO: 6152013 - DNA, 20 bp, Homo sapiens
ctcggacagagcccccctag

SEQ ID NO: 6152014 - DNA, 19 bp, Homo sapiens
ctcggaccccactccggcc

SEQ ID NO: 6152015 - DNA, 16 bp, Homo sapiens
ctcggacttactgcct

SEQ ID NO: 6152016 - DNA, 19 bp, Homo sapiens
ctcggacttactgcctgac

SEQ ID NO: 6152017 - DNA, 19 bp, Homo sapiens
ctcggacttagctgggaga

SEQ ID NO: 6152018 - DNA, 19 bp, Homo sapiens
ctcggacttgaatgctgcc

SEQ ID NO: 6152019 - DNA, 13 bp, Homo sapiens
ctcggagaagagc

SEQ ID NO: 6152020 - DNA, 20 bp, Homo sapiens
ctcggagaagagctgttcac

SEQ ID NO: 6152021 - DNA, 18 bp, Homo sapiens
ctcggagcatcccggagg

SEQ ID NO: 6152022 - DNA, 13 bp, Homo sapiens
ctcggagcatggt

SEQ ID NO: 6152023 - DNA, 19 bp, Homo sapiens
ctcggagccaatgaacagc

SEQ ID NO: 6152024 - DNA, 12 bp, Homo sapiens
ctcggagccccc

SEQ ID NO: 6152025 - DNA, 17 bp, Homo sapiens
ctcggagccccccactc

SEQ ID NO: 6152026 - DNA, 12 bp, Homo sapiens
ctcggagcctgt

SEQ ID NO: 6152027 - DNA, 15 bp, Homo sapiens
ctcggagcctgtgtt

SEQ ID NO: 6152028 - DNA, 13 bp, Homo sapiens
ctcggagctggcc

SEQ ID NO: 6152029 - DNA, 17 bp, Homo sapiens
ctcggagctggcccagg

SEQ ID NO: 6152030 - DNA, 13 bp, Homo sapiens
ctcggagctggct

SEQ ID NO: 6152031 - DNA, 16 bp, Homo sapiens
ctcggagctggctgtg

SEQ ID NO: 6152032 - DNA, 13 bp, Homo sapiens
ctcggaggaagcc

SEQ ID NO: 6152033 - DNA, 15 bp, Homo sapiens
ctcggaggccaggcc

SEQ ID NO: 6152034 - DNA, 15 bp, Homo sapiens
ctcggaggccccaaa

SEQ ID NO: 6152035 - DNA, 22 bp, Homo sapiens
ctcggaggctacccgctgtggc

SEQ ID NO: 6152036 - DNA, 13 bp, Homo sapiens
ctcggaggctgcc

SEQ ID NO: 6152037 - DNA, 15 bp, Homo sapiens
ctcggaggctgcccc

SEQ ID NO: 6152038 - DNA, 17 bp, Homo sapiens
ctcggagggtgccgtgc

SEQ ID NO: 6152039 - DNA, 20 bp, Homo sapiens
ctcggagtatctgggaactg

SEQ ID NO: 6152040 - DNA, 21 bp, Homo sapiens
ctcggagtatctgggaactgt

SEQ ID NO: 6152041 - DNA, 15 bp, Homo sapiens
ctcggagttcttctt

SEQ ID NO: 6152042 - DNA, 16 bp, Homo sapiens
ctcggagttcttcttg

SEQ ID NO: 6152043 - DNA, 18 bp, Homo sapiens
ctcggatagttgctattt

SEQ ID NO: 6152044 - DNA, 22 bp, Homo sapiens
ctcggatagttgctatttttgt

SEQ ID NO: 6152045 - DNA, 20 bp, Homo sapiens
ctcggatcaccgagagtagc

SEQ ID NO: 6152046 - DNA, 14 bp, Homo sapiens
ctcggatcagctga

SEQ ID NO: 6152047 - DNA, 17 bp, Homo sapiens
ctcggatcccactgatt

SEQ ID NO: 6152048 - DNA, 15 bp, Homo sapiens
ctcggatccccttcc

SEQ ID NO: 6152049 - DNA, 23 bp, Homo sapiens
ctcggatccccttcctaccaccc

SEQ ID NO: 6152050 - DNA, 19 bp, Homo sapiens
ctcggatgacaccctggcc

SEQ ID NO: 6152051 - DNA, 21 bp, Homo sapiens
ctcggatgacaccctggcctg

SEQ ID NO: 6152052 - DNA, 22 bp, Homo sapiens
ctcggatggaccaacctgctct

SEQ ID NO: 6152053 - DNA, 24 bp, Homo sapiens
ctcggatggaccaacctgctctgt

SEQ ID NO: 6152054 - DNA, 15 bp, Homo sapiens
ctcggcaccaactaa

SEQ ID NO: 6152055 - DNA, 18 bp, Homo sapiens
ctcggcaccagtgcctca

SEQ ID NO: 6152056 - DNA, 19 bp, Homo sapiens
ctcggcaccagtgcctcag

SEQ ID NO: 6152057 - DNA, 18 bp, Homo sapiens
ctcggcagaactctctgt

SEQ ID NO: 6152058 - DNA, 23 bp, Homo sapiens
ctcggcagcccttccaaactctt

SEQ ID NO: 6152059 - DNA, 17 bp, Homo sapiens
ctcggcagtgtgcagtg

SEQ ID NO: 6152060 - DNA, 19 bp, Homo sapiens
ctcggcattcacacacagc

SEQ ID NO: 6152061 - DNA, 20 bp, Homo sapiens
ctcggcattcacacacagcc

SEQ ID NO: 6152062 - DNA, 23 bp, Homo sapiens
ctcggcattcacacacagcctgg

SEQ ID NO: 6152063 - DNA, 24 bp, Homo sapiens
ctcggcattcacacacagcctggc

SEQ ID NO: 6152064 - DNA, 13 bp, Homo sapiens
ctcggccagagct

SEQ ID NO: 6152065 - DNA, 16 bp, Homo sapiens
ctcggccagagctccc

SEQ ID NO: 6152066 - DNA, 22 bp, Homo sapiens
ctcggccagagctcccaggacg

SEQ ID NO: 6152067 - DNA, 24 bp, Homo sapiens
ctcggccagagctcccaggacgca

SEQ ID NO: 6152068 - DNA, 16 bp, Homo sapiens
ctcggccaggcattgg

SEQ ID NO: 6152069 - DNA, 14 bp, Homo sapiens
ctcggcccagggcc

SEQ ID NO: 6152070 - DNA, 15 bp, Homo sapiens
ctcggcccagggccg

SEQ ID NO: 6152071 - DNA, 19 bp, Homo sapiens
ctcggcccatctgtccatc

SEQ ID NO: 6152072 - DNA, 17 bp, Homo sapiens
ctcggccccctccatcg

SEQ ID NO: 6152073 - DNA, 14 bp, Homo sapiens
ctcggcccctcacc

SEQ ID NO: 6152074 - DNA, 15 bp, Homo sapiens
ctcggcccctcacca

SEQ ID NO: 6152075 - DNA, 15 bp, Homo sapiens
ctcggcccctcccac

SEQ ID NO: 6152076 - DNA, 11 bp, Homo sapiens
ctcggcccctg

SEQ ID NO: 6152077 - DNA, 12 bp, Homo sapiens
ctcggcccctgt

SEQ ID NO: 6152078 - DNA, 23 bp, Homo sapiens
ctcggcccctgtctgttcccagc

SEQ ID NO: 6152079 - DNA, 15 bp, Homo sapiens
ctcggcccggagcag

SEQ ID NO: 6152080 - DNA, 17 bp, Homo sapiens
ctcggcccggagcagca

SEQ ID NO: 6152081 - DNA, 15 bp, Homo sapiens
ctcggccctgaacca

SEQ ID NO: 6152082 - DNA, 20 bp, Homo sapiens
ctcggccctgtagccctggc

SEQ ID NO: 6152083 - DNA, 17 bp, Homo sapiens
ctcggccgcagcggcgt

SEQ ID NO: 6152084 - DNA, 14 bp, Homo sapiens
ctcggcctccaagg

SEQ ID NO: 6152085 - DNA, 16 bp, Homo sapiens
ctcggcctccagactg

SEQ ID NO: 6152086 - DNA, 18 bp, Homo sapiens
ctcggcctccagactgcg

SEQ ID NO: 6152087 - DNA, 15 bp, Homo sapiens
ctcggcctcccaaag

SEQ ID NO: 6152088 - DNA, 19 bp, Homo sapiens
ctcggcctcccacagtgct

SEQ ID NO: 6152089 - DNA, 21 bp, Homo sapiens
ctcggcctccgaggctccccg

SEQ ID NO: 6152090 - DNA, 22 bp, Homo sapiens
ctcggcctcctaaagtgctggg

SEQ ID NO: 6152091 - DNA, 21 bp, Homo sapiens
ctcggcctggctggccaggac

SEQ ID NO: 6152092 - DNA, 23 bp, Homo sapiens
ctcggcctggctggccaggacac

SEQ ID NO: 6152093 - DNA, 13 bp, Homo sapiens
ctcggcctggctt

SEQ ID NO: 6152094 - DNA, 17 bp, Homo sapiens
ctcggcctggcttcacc

SEQ ID NO: 6152095 - DNA, 14 bp, Homo sapiens
ctcggcgcccccac

SEQ ID NO: 6152096 - DNA, 18 bp, Homo sapiens
ctcggcgcccccacccct

SEQ ID NO: 6152097 - DNA, 23 bp, Homo sapiens
ctcggcgtgctccttttctcttt

SEQ ID NO: 6152098 - DNA, 20 bp, Homo sapiens
ctcggctactggttacctgg

SEQ ID NO: 6152099 - DNA, 15 bp, Homo sapiens
ctcggctcactgcaa

SEQ ID NO: 6152100 - DNA, 22 bp, Homo sapiens
ctcggctcactgcaatctctgc

SEQ ID NO: 6152101 - DNA, 15 bp, Homo sapiens
ctcggctcagcctcc

SEQ ID NO: 6152102 - DNA, 19 bp, Homo sapiens
ctggagtacccagcctatc

SEQ ID NO: 6152103 - DNA, 13 bp, Homo sapiens
ctggagtactttt

SEQ ID NO: 6152104 - DNA, 15 bp, Homo sapiens
ctggagtatttggaa

SEQ ID NO: 6152105 - DNA, 20 bp, Homo sapiens
ctggagtcacatcagtgagg

SEQ ID NO: 6152106 - DNA, 22 bp, Homo sapiens
ctggagtcacatcagtgaggag

SEQ ID NO: 6152107 - DNA, 23 bp, Homo sapiens
ctggagtcagatgagcaaggaca

SEQ ID NO: 6152108 - DNA, 14 bp, Homo sapiens
ctggagtcaggtgt

SEQ ID NO: 6152109 - DNA, 13 bp, Homo sapiens
ctggagtccagtg

SEQ ID NO: 6152110 - DNA, 15 bp, Homo sapiens
ctggagtcccacccg

SEQ ID NO: 6152111 - DNA, 14 bp, Homo sapiens
ctggagtcccctgg

SEQ ID NO: 6152112 - DNA, 22 bp, Homo sapiens
ctggagtcccgtccctgcccag

SEQ ID NO: 6152113 - DNA, 20 bp, Homo sapiens
ctggagtcctgttctcagag

SEQ ID NO: 6152114 - DNA, 22 bp, Homo sapiens
ctggagtcctgttctcagagct

SEQ ID NO: 6152115 - DNA, 16 bp, Homo sapiens
ctggagtctatgctta

SEQ ID NO: 6152116 - DNA, 15 bp, Homo sapiens
ctggagtctcagagc

SEQ ID NO: 6152117 - DNA, 17 bp, Homo sapiens
ctggagtctcagagcac

SEQ ID NO: 6152118 - DNA, 15 bp, Homo sapiens
ctggagtctgaagcc

SEQ ID NO: 6152119 - DNA, 17 bp, Homo sapiens
ctggagtctgaagcctg

SEQ ID NO: 6152120 - DNA, 18 bp, Homo sapiens
ctggagtctgaaggagag

SEQ ID NO: 6152121 - DNA, 17 bp, Homo sapiens
ctggagtctggctttac

SEQ ID NO: 6152122 - DNA, 18 bp, Homo sapiens
ctggagtctggctttacc

SEQ ID NO: 6152123 - DNA, 14 bp, Homo sapiens
ctggagtcttgtac

SEQ ID NO: 6152124 - DNA, 16 bp, Homo sapiens
ctggagtgagaggccc

SEQ ID NO: 6152125 - DNA, 22 bp, Homo sapiens
ctggagtgagaggcccccaccc

SEQ ID NO: 6152126 - DNA, 15 bp, Homo sapiens
ctggagtgaggaaaa

SEQ ID NO: 6152127 - DNA, 18 bp, Homo sapiens
ctggagtgaggcttccag

SEQ ID NO: 6152128 - DNA, 18 bp, Homo sapiens
ctggagtgagggcctcag

SEQ ID NO: 6152129 - DNA, 22 bp, Homo sapiens
ctggagtgagggcctcagagcc

SEQ ID NO: 6152130 - DNA, 16 bp, Homo sapiens
ctggagtgatggtgtc

SEQ ID NO: 6152131 - DNA, 16 bp, Homo sapiens
ctggagtgattctaga

SEQ ID NO: 6152132 - DNA, 18 bp, Homo sapiens
ctggagtgattctagagg

SEQ ID NO: 6152133 - DNA, 16 bp, Homo sapiens
ctggagtgcagggagg

SEQ ID NO: 6152134 - DNA, 13 bp, Homo sapiens
ctggagtgcagtt

SEQ ID NO: 6152135 - DNA, 14 bp, Homo sapiens
ctggagtgccatgg

SEQ ID NO: 6152136 - DNA, 19 bp, Homo sapiens
ctggagtgcccccagccca

SEQ ID NO: 6152137 - DNA, 17 bp, Homo sapiens
ctggagtgccctgcagg

SEQ ID NO: 6152138 - DNA, 18 bp, Homo sapiens
ctggagtgcgctcttggt

SEQ ID NO: 6152139 - DNA, 19 bp, Homo sapiens
ctggagtgcgctcttggtc

SEQ ID NO: 6152140 - DNA, 23 bp, Homo sapiens
ctggagtgctgcttgtgcctccc

SEQ ID NO: 6152141 - DNA, 13 bp, Homo sapiens
ctggagtgctggc

SEQ ID NO: 6152142 - DNA, 20 bp, Homo sapiens
ctggagtggatctatttaca

SEQ ID NO: 6152143 - DNA, 21 bp, Homo sapiens
ctggagtggatctatttacat

SEQ ID NO: 6152144 - DNA, 21 bp, Homo sapiens
ctggagtggcatggtcctgtg

SEQ ID NO: 6152145 - DNA, 20 bp, Homo sapiens
ctggagtggctcgccaggcc

SEQ ID NO: 6152146 - DNA, 13 bp, Homo sapiens
ctggagtgggcag

SEQ ID NO: 6152147 - DNA, 20 bp, Homo sapiens
ctggagtggtaacaagagga

SEQ ID NO: 6152148 - DNA, 17 bp, Homo sapiens
ctggagtggtaacagct

SEQ ID NO: 6152149 - DNA, 21 bp, Homo sapiens
ctggagtgtggctgaggaggc

SEQ ID NO: 6152150 - DNA, 22 bp, Homo sapiens
ctggagtgtggctgaggaggcc

SEQ ID NO: 6152151 - DNA, 22 bp, Homo sapiens
ctggagtgtgtcagagcccagg

SEQ ID NO: 6152152 - DNA, 16 bp, Homo sapiens
ctggagttacattaat

SEQ ID NO: 6152153 - DNA, 16 bp, Homo sapiens
ctggagttagggactg

SEQ ID NO: 6152154 - DNA, 23 bp, Homo sapiens
ctggagttattgaagcagagtgg

SEQ ID NO: 6152155 - DNA, 15 bp, Homo sapiens
ctggagttcccaccc

SEQ ID NO: 6152156 - DNA, 17 bp, Homo sapiens
ctggagttccggcctgg

SEQ ID NO: 6152157 - DNA, 22 bp, Homo sapiens
ctggagttccggcctgggcacc

SEQ ID NO: 6152158 - DNA, 23 bp, Homo sapiens
ctggagttccggcctgggcacca

SEQ ID NO: 6152159 - DNA, 19 bp, Homo sapiens
ctggagttccttatccctc

SEQ ID NO: 6152160 - DNA, 20 bp, Homo sapiens
ctggagttccttatccctct

SEQ ID NO: 6152161 - DNA, 16 bp, Homo sapiens
ctggagttctggttcc

SEQ ID NO: 6152162 - DNA, 17 bp, Homo sapiens
ctggagttctggttcct

SEQ ID NO: 6152163 - DNA, 20 bp, Homo sapiens
ctggagttgatctggaaccc

SEQ ID NO: 6152164 - DNA, 14 bp, Homo sapiens
ctggagttgcattg

SEQ ID NO: 6152165 - DNA, 14 bp, Homo sapiens
ctggagttgctgaa

SEQ ID NO: 6152166 - DNA, 15 bp, Homo sapiens
ctggagttgggctgg

SEQ ID NO: 6152167 - DNA, 13 bp, Homo sapiens
ctggagttgtcac

SEQ ID NO: 6152168 - DNA, 18 bp, Homo sapiens
ctggagtttcatgtacaa

SEQ ID NO: 6152169 - DNA, 15 bp, Homo sapiens
ctggataaaaaagaa

SEQ ID NO: 6152170 - DNA, 20 bp, Homo sapiens
ctggataaaaaagaaaacat

SEQ ID NO: 6152171 - DNA, 18 bp, Homo sapiens
ctggataaaccaccctct

SEQ ID NO: 6152172 - DNA, 23 bp, Homo sapiens
ctggataaaccaccctctgggga

SEQ ID NO: 6152173 - DNA, 17 bp, Homo sapiens
ctggataaagccactga

SEQ ID NO: 6152174 - DNA, 13 bp, Homo sapiens
ctggataaattgt

SEQ ID NO: 6152175 - DNA, 18 bp, Homo sapiens
ctggataacttccacagg

SEQ ID NO: 6152176 - DNA, 13 bp, Homo sapiens
ctggataattttg

SEQ ID NO: 6152177 - DNA, 15 bp, Homo sapiens
ctggataattttgca

SEQ ID NO: 6152178 - DNA, 20 bp, Homo sapiens
ctggatacagtataaaaata

SEQ ID NO: 6152179 - DNA, 15 bp, Homo sapiens
ctggatactggacac

SEQ ID NO: 6152180 - DNA, 12 bp, Homo sapiens
ctggatactgta

SEQ ID NO: 6152181 - DNA, 13 bp, Homo sapiens
ctggatactgtac

SEQ ID NO: 6152182 - DNA, 16 bp, Homo sapiens
ctggatagacttggga

SEQ ID NO: 6152183 - DNA, 16 bp, Homo sapiens
ctggatataaattaat

SEQ ID NO: 6152184 - DNA, 20 bp, Homo sapiens
ctggatataaattaattgtg

SEQ ID NO: 6152185 - DNA, 16 bp, Homo sapiens
ctggatatagaaagga

SEQ ID NO: 6152186 - DNA, 18 bp, Homo sapiens
ctggatatagaaaggaga

SEQ ID NO: 6152187 - DNA, 23 bp, Homo sapiens
ctggatatccatgagctgcactg

SEQ ID NO: 6152188 - DNA, 22 bp, Homo sapiens
ctggatatgtccagtcatcctg

SEQ ID NO: 6152189 - DNA, 14 bp, Homo sapiens
ctggatatttcaat

SEQ ID NO: 6152190 - DNA, 19 bp, Homo sapiens
ctggatatttcaatctttt

SEQ ID NO: 6152191 - DNA, 14 bp, Homo sapiens
ctggatatttgcac

SEQ ID NO: 6152192 - DNA, 15 bp, Homo sapiens
ctggatattttcaaa

SEQ ID NO: 6152193 - DNA, 21 bp, Homo sapiens
ctggatcaagttcagccaccg

SEQ ID NO: 6152194 - DNA, 24 bp, Homo sapiens
ctggatcacgacgctgcagagcac

SEQ ID NO: 6152195 - DNA, 16 bp, Homo sapiens
ctggatcagcgtggcc

SEQ ID NO: 6152196 - DNA, 13 bp, Homo sapiens
ctggatcagtaaa

SEQ ID NO: 6152197 - DNA, 13 bp, Homo sapiens
ctggatcagtcct

SEQ ID NO: 6152198 - DNA, 20 bp, Homo sapiens
ctggatcagtcctttgatca

SEQ ID NO: 6152199 - DNA, 16 bp, Homo sapiens
ctggatccagaagcta

SEQ ID NO: 6152200 - DNA, 21 bp, Homo sapiens
ctggatccatcctgctagcac

SEQ ID NO: 6152201 - DNA, 22 bp, Homo sapiens
ctggatccatcttgagccacag

SEQ ID NO: 6152202 - DNA, 14 bp, Homo sapiens
ctggatccatgggg

SEQ ID NO: 6152203 - DNA, 23 bp, Homo sapiens
ctggatccctgcccttctcaaga

SEQ ID NO: 6152204 - DNA, 20 bp, Homo sapiens
ctggatccctttcactatgt

SEQ ID NO: 6152205 - DNA, 19 bp, Homo sapiens
ctggatcctgctgtggcct

SEQ ID NO: 6152206 - DNA, 20 bp, Homo sapiens
ctggatcctgctgtggcctc

SEQ ID NO: 6152207 - DNA, 21 bp, Homo sapiens
ctggatcctgctgtggcctca

SEQ ID NO: 6152208 - DNA, 24 bp, Homo sapiens
ctggatcctgctgtggcctcactt

SEQ ID NO: 6152209 - DNA, 16 bp, Homo sapiens
ctggatccttcccaag

SEQ ID NO: 6152210 - DNA, 15 bp, Homo sapiens
ctggatctacctgga

SEQ ID NO: 6152211 - DNA, 19 bp, Homo sapiens
ctggatctcctgctgcctt

SEQ ID NO: 6152212 - DNA, 17 bp, Homo sapiens
ctggatctgaccctccc

SEQ ID NO: 6152213 - DNA, 19 bp, Homo sapiens
ctggatctgaccctcccag

SEQ ID NO: 6152214 - DNA, 20 bp, Homo sapiens
ctggatctgaccctcccagt

SEQ ID NO: 6152215 - DNA, 13 bp, Homo sapiens
ctggatctgcttg

SEQ ID NO: 6152216 - DNA, 21 bp, Homo sapiens
ctggatctgggaccctttcct

SEQ ID NO: 6152217 - DNA, 14 bp, Homo sapiens
ctggatgaaagagc

SEQ ID NO: 6152218 - DNA, 13 bp, Homo sapiens
ctggatgaaattt

SEQ ID NO: 6152219 - DNA, 19 bp, Homo sapiens
ctggatgagaaacagctca

SEQ ID NO: 6152220 - DNA, 23 bp, Homo sapiens
ctggatgagaaacagctcagcca

SEQ ID NO: 6152221 - DNA, 15 bp, Homo sapiens
ctggatgagctccca

SEQ ID NO: 6152222 - DNA, 14 bp, Homo sapiens
ctggatgatactaa

SEQ ID NO: 6152223 - DNA, 18 bp, Homo sapiens
ctggatgatactaataaa

SEQ ID NO: 6152224 - DNA, 18 bp, Homo sapiens
ctggatgcacagatgcca

SEQ ID NO: 6152225 - DNA, 14 bp, Homo sapiens
ctggatgcacagtg

SEQ ID NO: 6152226 - DNA, 21 bp, Homo sapiens
ctggatgcacagtgcctgatg

SEQ ID NO: 6152227 - DNA, 17 bp, Homo sapiens
ctggatgcagcctcaca

SEQ ID NO: 6152228 - DNA, 15 bp, Homo sapiens
ctggatgcagtggct

SEQ ID NO: 6152229 - DNA, 18 bp, Homo sapiens
ctggatgcagtggctcat

SEQ ID NO: 6152230 - DNA, 22 bp, Homo sapiens
ctggatgcagtggctcatgcct

SEQ ID NO: 6152231 - DNA, 22 bp, Homo sapiens
ctggatgcatttccatttctct

SEQ ID NO: 6152232 - DNA, 14 bp, Homo sapiens
ctggatgcatttct

SEQ ID NO: 6152233 - DNA, 22 bp, Homo sapiens
ctggatgccccctgtggatgct

SEQ ID NO: 6152234 - DNA, 15 bp, Homo sapiens
ctggatgccttcccc

SEQ ID NO: 6152235 - DNA, 16 bp, Homo sapiens
ctggatgctccttcca

SEQ ID NO: 6152236 - DNA, 12 bp, Homo sapiens
ctggatgctgag

SEQ ID NO: 6152237 - DNA, 20 bp, Homo sapiens
ctggatgctgagagacctca

SEQ ID NO: 6152238 - DNA, 21 bp, Homo sapiens
ctggatgctgggttctggggc

SEQ ID NO: 6152239 - DNA, 16 bp, Homo sapiens
ctggatgctgttgagg

SEQ ID NO: 6152240 - DNA, 21 bp, Homo sapiens
ctggatggaaagacaaactgc

SEQ ID NO: 6152241 - DNA, 22 bp, Homo sapiens
ctggatggaacgggcatgggcc

SEQ ID NO: 6152242 - DNA, 11 bp, Homo sapiens
ctggatggaca

SEQ ID NO: 6152243 - DNA, 17 bp, Homo sapiens
ctggatggacagacacc

SEQ ID NO: 6152244 - DNA, 23 bp, Homo sapiens
ctggatggacagacacctccccc

SEQ ID NO: 6152245 - DNA, 18 bp, Homo sapiens
ctggatggagcccaggcg

SEQ ID NO: 6152246 - DNA, 15 bp, Homo sapiens
ctggatggagctgga

SEQ ID NO: 6152247 - DNA, 17 bp, Homo sapiens
ctggatggatctgctcc

SEQ ID NO: 6152248 - DNA, 19 bp, Homo sapiens
ctggatggatctgctccat

SEQ ID NO: 6152249 - DNA, 20 bp, Homo sapiens
ctggatggatctgctccatg

SEQ ID NO: 6152250 - DNA, 23 bp, Homo sapiens
ctggatggatctgctccatgcag

SEQ ID NO: 6152251 - DNA, 18 bp, Homo sapiens
ctggatggcacctcaggc

SEQ ID NO: 6152252 - DNA, 13 bp, Homo sapiens
ctggatggccggg

SEQ ID NO: 6152253 - DNA, 19 bp, Homo sapiens
ctggatggccgggctgctg

SEQ ID NO: 6152254 - DNA, 19 bp, Homo sapiens
ctggatggcctctggggca

SEQ ID NO: 6152255 - DNA, 21 bp, Homo sapiens
ctggatggcggaagctgctac

SEQ ID NO: 6152256 - DNA, 13 bp, Homo sapiens
ctggatgggagga

SEQ ID NO: 6152257 - DNA, 20 bp, Homo sapiens
ctggatgggcattgggctga

SEQ ID NO: 6152258 - DNA, 12 bp, Homo sapiens
ctggatggggca

SEQ ID NO: 6152259 - DNA, 13 bp, Homo sapiens
ctggatggggcag

SEQ ID NO: 6152260 - DNA, 17 bp, Homo sapiens
ctggatggggcagagct

SEQ ID NO: 6152261 - DNA, 16 bp, Homo sapiens
ctggatggggctgcac

SEQ ID NO: 6152262 - DNA, 21 bp, Homo sapiens
ctggatgggggtgcaggcagc

SEQ ID NO: 6152263 - DNA, 22 bp, Homo sapiens
ctggatggtagaataagttgga

SEQ ID NO: 6152264 - DNA, 18 bp, Homo sapiens
ctggatggtgtgccttcc

SEQ ID NO: 6152265 - DNA, 20 bp, Homo sapiens
ctggatggttcccagagggt

SEQ ID NO: 6152266 - DNA, 12 bp, Homo sapiens
ctggatgtaaag

SEQ ID NO: 6152267 - DNA, 14 bp, Homo sapiens
ctggatgtaaatcc

SEQ ID NO: 6152268 - DNA, 15 bp, Homo sapiens
ctggatgtaccacca

SEQ ID NO: 6152269 - DNA, 18 bp, Homo sapiens
ctggatgtccagagctgg

SEQ ID NO: 6152270 - DNA, 17 bp, Homo sapiens
ctggatgtcccctgtcc

SEQ ID NO: 6152271 - DNA, 12 bp, Homo sapiens
ctggatgtctga

SEQ ID NO: 6152272 - DNA, 13 bp, Homo sapiens
ctggatgtctgaa

SEQ ID NO: 6152273 - DNA, 14 bp, Homo sapiens
ctggatgtctggct

SEQ ID NO: 6152274 - DNA, 17 bp, Homo sapiens
ctggatgtgcatctggc

SEQ ID NO: 6152275 - DNA, 19 bp, Homo sapiens
ctggatgtgcatctggcct

SEQ ID NO: 6152276 - DNA, 20 bp, Homo sapiens
ctggatgtgcatctggccta

SEQ ID NO: 6152277 - DNA, 22 bp, Homo sapiens
ctggatgtttctcatgtagaac

SEQ ID NO: 6152278 - DNA, 19 bp, Homo sapiens
ctggattaatgttttgtac

SEQ ID NO: 6152279 - DNA, 16 bp, Homo sapiens
ctggattcacagacca

SEQ ID NO: 6152280 - DNA, 16 bp, Homo sapiens
ctcggctcagtgcaac

SEQ ID NO: 6152281 - DNA, 22 bp, Homo sapiens
ctcggctccccatgtgtcctgg

SEQ ID NO: 6152282 - DNA, 15 bp, Homo sapiens
ctcggctcctgctgc

SEQ ID NO: 6152283 - DNA, 16 bp, Homo sapiens
ctcggctcctgctgca

SEQ ID NO: 6152284 - DNA, 19 bp, Homo sapiens
ctcggctcctgctgcacca

SEQ ID NO: 6152285 - DNA, 12 bp, Homo sapiens
ctcggctcctgg

SEQ ID NO: 6152286 - DNA, 15 bp, Homo sapiens
ctcggctctgcatgt

SEQ ID NO: 6152287 - DNA, 15 bp, Homo sapiens
ctcggctgccagggg

SEQ ID NO: 6152288 - DNA, 23 bp, Homo sapiens
ctcggctggctcccctgcagccc

SEQ ID NO: 6152289 - DNA, 21 bp, Homo sapiens
ctcggctgtctcctgtccccg

SEQ ID NO: 6152290 - DNA, 17 bp, Homo sapiens
ctcggcttggatcctgg

SEQ ID NO: 6152291 - DNA, 20 bp, Homo sapiens
ctcggcttggatcctgggct

SEQ ID NO: 6152292 - DNA, 21 bp, Homo sapiens
ctcggcttggatcctgggctg

SEQ ID NO: 6152293 - DNA, 16 bp, Homo sapiens
ctcggcttgtgggctg

SEQ ID NO: 6152294 - DNA, 18 bp, Homo sapiens
ctcggcttgtgggctggt

SEQ ID NO: 6152295 - DNA, 12 bp, Homo sapiens
ctcgggaacctc

SEQ ID NO: 6152296 - DNA, 16 bp, Homo sapiens
ctcgggaagcagccag

SEQ ID NO: 6152297 - DNA, 13 bp, Homo sapiens
ctcgggaaggcct

SEQ ID NO: 6152298 - DNA, 15 bp, Homo sapiens
ctcgggaagggaggg

SEQ ID NO: 6152299 - DNA, 17 bp, Homo sapiens
ctcgggaagggagggga

SEQ ID NO: 6152300 - DNA, 19 bp, Homo sapiens
ctcgggaagggaggggaag

SEQ ID NO: 6152301 - DNA, 20 bp, Homo sapiens
ctcgggacacctgccctgcc

SEQ ID NO: 6152302 - DNA, 18 bp, Homo sapiens
ctcgggactagctgcctt

SEQ ID NO: 6152303 - DNA, 20 bp, Homo sapiens
ctcgggagcattctgcctgc

SEQ ID NO: 6152304 - DNA, 16 bp, Homo sapiens
ctcgggagctgcacac

SEQ ID NO: 6152305 - DNA, 15 bp, Homo sapiens
ctcgggaggctgaga

SEQ ID NO: 6152306 - DNA, 18 bp, Homo sapiens
ctcgggatgaaaagccat

SEQ ID NO: 6152307 - DNA, 22 bp, Homo sapiens
ctcgggatgccgttctgttcca

SEQ ID NO: 6152308 - DNA, 15 bp, Homo sapiens
ctcgggcaagggccg

SEQ ID NO: 6152309 - DNA, 14 bp, Homo sapiens
ctcgggcccacctg

SEQ ID NO: 6152310 - DNA, 17 bp, Homo sapiens
ctcgggcccacctggcc

SEQ ID NO: 6152311 - DNA, 16 bp, Homo sapiens
ctcgggcccagccccc

SEQ ID NO: 6152312 - DNA, 12 bp, Homo sapiens
ctcgggcccagg

SEQ ID NO: 6152313 - DNA, 13 bp, Homo sapiens
ctcgggcccctga

SEQ ID NO: 6152314 - DNA, 23 bp, Homo sapiens
ctcgggcccctgagcctgtgtcc

SEQ ID NO: 6152315 - DNA, 12 bp, Homo sapiens
ctcgggccctgt

SEQ ID NO: 6152316 - DNA, 22 bp, Homo sapiens
ctcgggccctgtggtgctggga

SEQ ID NO: 6152317 - DNA, 17 bp, Homo sapiens
ctcgggccgcctcctcc

SEQ ID NO: 6152318 - DNA, 14 bp, Homo sapiens
ctcgggccgtaggg

SEQ ID NO: 6152319 - DNA, 20 bp, Homo sapiens
ctcgggccgtaggggctcct

SEQ ID NO: 6152320 - DNA, 19 bp, Homo sapiens
ctcgggcgctgtggctcct

SEQ ID NO: 6152321 - DNA, 22 bp, Homo sapiens
ctcgggctaagtccagctctcc

SEQ ID NO: 6152322 - DNA, 14 bp, Homo sapiens
ctcgggctcctgtg

SEQ ID NO: 6152323 - DNA, 15 bp, Homo sapiens
ctcgggctcctgtgc

SEQ ID NO: 6152324 - DNA, 20 bp, Homo sapiens
ctcgggctgacccttttctg

SEQ ID NO: 6152325 - DNA, 23 bp, Homo sapiens
ctcgggctgagaaccctgcgtgg

SEQ ID NO: 6152326 - DNA, 19 bp, Homo sapiens
ctcgggctggagcctccga

SEQ ID NO: 6152327 - DNA, 12 bp, Homo sapiens
ctcggggaataa

SEQ ID NO: 6152328 - DNA, 13 bp, Homo sapiens
ctcggggacaggt

SEQ ID NO: 6152329 - DNA, 16 bp, Homo sapiens
ctcggggagaggggga

SEQ ID NO: 6152330 - DNA, 17 bp, Homo sapiens
ctcggggagagggggag

SEQ ID NO: 6152331 - DNA, 16 bp, Homo sapiens
ctcggggatgtgtcct

SEQ ID NO: 6152332 - DNA, 18 bp, Homo sapiens
ctcggggcaggaagtccc

SEQ ID NO: 6152333 - DNA, 21 bp, Homo sapiens
ctcggggcaggaagtccctga

SEQ ID NO: 6152334 - DNA, 13 bp, Homo sapiens
ctcggggcagggc

SEQ ID NO: 6152335 - DNA, 14 bp, Homo sapiens
ctcggggcagggca

SEQ ID NO: 6152336 - DNA, 17 bp, Homo sapiens
ctcggggcagggcaggg

SEQ ID NO: 6152337 - DNA, 19 bp, Homo sapiens
ctcggggcctgtgccgcac

SEQ ID NO: 6152338 - DNA, 14 bp, Homo sapiens
ctcggggctgctgt

SEQ ID NO: 6152339 - DNA, 16 bp, Homo sapiens
ctcgggggcctgtggt

SEQ ID NO: 6152340 - DNA, 19 bp, Homo sapiens
ctcgggggctgtctcagac

SEQ ID NO: 6152341 - DNA, 15 bp, Homo sapiens
ctcggggggctctgc

SEQ ID NO: 6152342 - DNA, 17 bp, Homo sapiens
ctcggggggctctgcct

SEQ ID NO: 6152343 - DNA, 22 bp, Homo sapiens
ctcggggggtcacaggcccaga

SEQ ID NO: 6152344 - DNA, 19 bp, Homo sapiens
ctcgggggtccggaagggt

SEQ ID NO: 6152345 - DNA, 20 bp, Homo sapiens
ctcgggggtgctggggccag

SEQ ID NO: 6152346 - DNA, 23 bp, Homo sapiens
ctcgggggtgctggggccagggc

SEQ ID NO: 6152347 - DNA, 13 bp, Homo sapiens
ctcggggtccacc

SEQ ID NO: 6152348 - DNA, 22 bp, Homo sapiens
ctcggggtccaccagtgtgtgg

SEQ ID NO: 6152349 - DNA, 15 bp, Homo sapiens
ctcggggtccagtgc

SEQ ID NO: 6152350 - DNA, 18 bp, Homo sapiens
ctcggggtgcacaggagg

SEQ ID NO: 6152351 - DNA, 14 bp, Homo sapiens
ctcgggtgcatttg

SEQ ID NO: 6152352 - DNA, 13 bp, Homo sapiens
ctcgggtgcccag

SEQ ID NO: 6152353 - DNA, 15 bp, Homo sapiens
ctcgggtgcccagga

SEQ ID NO: 6152354 - DNA, 12 bp, Homo sapiens
ctcgggtgcgtg

SEQ ID NO: 6152355 - DNA, 15 bp, Homo sapiens
ctcgggtgctgccag

SEQ ID NO: 6152356 - DNA, 13 bp, Homo sapiens
ctcgggtggggct

SEQ ID NO: 6152357 - DNA, 16 bp, Homo sapiens
ctcgggtggggctggt

SEQ ID NO: 6152358 - DNA, 16 bp, Homo sapiens
ctcgggttaagaaata

SEQ ID NO: 6152359 - DNA, 18 bp, Homo sapiens
ctcgggttaagaaatacc

SEQ ID NO: 6152360 - DNA, 15 bp, Homo sapiens
ctcggtatctggctt

SEQ ID NO: 6152361 - DNA, 14 bp, Homo sapiens
ctcggtcagcgact

SEQ ID NO: 6152362 - DNA, 19 bp, Homo sapiens
ctcggtcagcgactggatg

SEQ ID NO: 6152363 - DNA, 14 bp, Homo sapiens
ctcggtcaggaggg

SEQ ID NO: 6152364 - DNA, 21 bp, Homo sapiens
ctcggtcgccccgtgtttgcg

SEQ ID NO: 6152365 - DNA, 15 bp, Homo sapiens
ctcggtctcccaaag

SEQ ID NO: 6152366 - DNA, 23 bp, Homo sapiens
ctcggtctcccaaagtgctggga

SEQ ID NO: 6152367 - DNA, 20 bp, Homo sapiens
ctcggtctcccttccgtcca

SEQ ID NO: 6152368 - DNA, 13 bp, Homo sapiens
ctcggtggcattt

SEQ ID NO: 6152369 - DNA, 19 bp, Homo sapiens
ctcggtggcatttgctgaa

SEQ ID NO: 6152370 - DNA, 14 bp, Homo sapiens
ctcggtgggagcca

SEQ ID NO: 6152371 - DNA, 18 bp, Homo sapiens
ctcggtgggccagagctg

SEQ ID NO: 6152372 - DNA, 16 bp, Homo sapiens
ctcggtgtaaaaccat

SEQ ID NO: 6152373 - DNA, 15 bp, Homo sapiens
ctcggtgtccccacc

SEQ ID NO: 6152374 - DNA, 23 bp, Homo sapiens
ctcggttaagtacccgaggcctc

SEQ ID NO: 6152375 - DNA, 21 bp, Homo sapiens
ctcggttcaaggtcactgttt

SEQ ID NO: 6152376 - DNA, 14 bp, Homo sapiens
ctcggttgaaacct

SEQ ID NO: 6152377 - DNA, 13 bp, Homo sapiens
ctcggtttctcca

SEQ ID NO: 6152378 - DNA, 16 bp, Homo sapiens
ctcgtaatagcttctg

SEQ ID NO: 6152379 - DNA, 17 bp, Homo sapiens
ctcgtaatagcttctgt

SEQ ID NO: 6152380 - DNA, 18 bp, Homo sapiens
ctcgtaatagcttctgtg

SEQ ID NO: 6152381 - DNA, 14 bp, Homo sapiens
ctcgtaccagccag

SEQ ID NO: 6152382 - DNA, 16 bp, Homo sapiens
ctcgtactcaggagcc

SEQ ID NO: 6152383 - DNA, 19 bp, Homo sapiens
ctcgtactctctctctttt

SEQ ID NO: 6152384 - DNA, 15 bp, Homo sapiens
ctcgtactttcacat

SEQ ID NO: 6152385 - DNA, 17 bp, Homo sapiens
ctcgtagatgctgccta

SEQ ID NO: 6152386 - DNA, 18 bp, Homo sapiens
ctcgtagatgctgcctag

SEQ ID NO: 6152387 - DNA, 14 bp, Homo sapiens
ctcgtagccatctc

SEQ ID NO: 6152388 - DNA, 18 bp, Homo sapiens
ctcgtatatgtctcaggt

SEQ ID NO: 6152389 - DNA, 20 bp, Homo sapiens
ctcgtatatgtctcaggtcc

SEQ ID NO: 6152390 - DNA, 22 bp, Homo sapiens
ctcgtatccaacccaaggacct

SEQ ID NO: 6152391 - DNA, 12 bp, Homo sapiens
ctcgtatttaat

SEQ ID NO: 6152392 - DNA, 16 bp, Homo sapiens
ctcgtcagccacctgg

SEQ ID NO: 6152393 - DNA, 18 bp, Homo sapiens
ctcgtcaggaggtgcctg

SEQ ID NO: 6152394 - DNA, 20 bp, Homo sapiens
ctcgtcaggctgccagagaa

SEQ ID NO: 6152395 - DNA, 22 bp, Homo sapiens
ctcgtcaggctgccagagaaag

SEQ ID NO: 6152396 - DNA, 18 bp, Homo sapiens
ctcgtcattttctttccc

SEQ ID NO: 6152397 - DNA, 17 bp, Homo sapiens
ctcgtccacaggggcag

SEQ ID NO: 6152398 - DNA, 22 bp, Homo sapiens
ctcgtccaccccccacacacac

SEQ ID NO: 6152399 - DNA, 21 bp, Homo sapiens
ctcgtccacggtcttctgcat

SEQ ID NO: 6152400 - DNA, 21 bp, Homo sapiens
ctcgtcccatccagctaccac

SEQ ID NO: 6152401 - DNA, 15 bp, Homo sapiens
ctcgtccccctccct

SEQ ID NO: 6152402 - DNA, 23 bp, Homo sapiens
ctcgtcccgagggcgcctgggtc

SEQ ID NO: 6152403 - DNA, 16 bp, Homo sapiens
ctcgtccggcctgcag

SEQ ID NO: 6152404 - DNA, 14 bp, Homo sapiens
ctcgtccgtctgtc

SEQ ID NO: 6152405 - DNA, 13 bp, Homo sapiens
ctcgtcctcactg

SEQ ID NO: 6152406 - DNA, 15 bp, Homo sapiens
ctcgtcctccccctg

SEQ ID NO: 6152407 - DNA, 15 bp, Homo sapiens
ctcgtcctgtcccag

SEQ ID NO: 6152408 - DNA, 17 bp, Homo sapiens
ctcgtcctgtcccagag

SEQ ID NO: 6152409 - DNA, 20 bp, Homo sapiens
ctcgtcggggggacagctcc

SEQ ID NO: 6152410 - DNA, 17 bp, Homo sapiens
ctcgtctctttacagaa

SEQ ID NO: 6152411 - DNA, 17 bp, Homo sapiens
ctcgtctcttttaccct

SEQ ID NO: 6152412 - DNA, 22 bp, Homo sapiens
ctcgtctggcaagtcggggcct

SEQ ID NO: 6152413 - DNA, 18 bp, Homo sapiens
ctcgtcttccgtctcccc

SEQ ID NO: 6152414 - DNA, 12 bp, Homo sapiens
ctcgtgacagcc

SEQ ID NO: 6152415 - DNA, 15 bp, Homo sapiens
ctcgtgacagcctct

SEQ ID NO: 6152416 - DNA, 17 bp, Homo sapiens
ctcgtgacccagtggca

SEQ ID NO: 6152417 - DNA, 15 bp, Homo sapiens
ctcgtgacctacagg

SEQ ID NO: 6152418 - DNA, 20 bp, Homo sapiens
ctcgtgaggggcaagctagg

SEQ ID NO: 6152419 - DNA, 15 bp, Homo sapiens
ctcgtgagtcattta

SEQ ID NO: 6152420 - DNA, 22 bp, Homo sapiens
ctcgtgatctgcccttctctgc

SEQ ID NO: 6152421 - DNA, 23 bp, Homo sapiens
ctcgtgatgggcccgcctcggcc

SEQ ID NO: 6152422 - DNA, 18 bp, Homo sapiens
ctcgtgatttgcctgcct

SEQ ID NO: 6152423 - DNA, 20 bp, Homo sapiens
ctcgtgcagagctggggctg

SEQ ID NO: 6152424 - DNA, 17 bp, Homo sapiens
ctcgtgcatccctgaga

SEQ ID NO: 6152425 - DNA, 14 bp, Homo sapiens
ctcgtgccagcagc

SEQ ID NO: 6152426 - DNA, 18 bp, Homo sapiens
ctcgtgccagcagcctcg

SEQ ID NO: 6152427 - DNA, 20 bp, Homo sapiens
ctcgtgccagcagcctcgca

SEQ ID NO: 6152428 - DNA, 19 bp, Homo sapiens
ctcgtgccatgatctgtat

SEQ ID NO: 6152429 - DNA, 21 bp, Homo sapiens
ctcgtgcccagccagggaagg

SEQ ID NO: 6152430 - DNA, 15 bp, Homo sapiens
ctcgtgcccttagag

SEQ ID NO: 6152431 - DNA, 15 bp, Homo sapiens
ctcgtggacacctgc

SEQ ID NO: 6152432 - DNA, 17 bp, Homo sapiens
ctcgtggacacctgccc

SEQ ID NO: 6152433 - DNA, 21 bp, Homo sapiens
ctcgtggacacctgccctgcc

SEQ ID NO: 6152434 - DNA, 19 bp, Homo sapiens
ctcgtggagaatttttact

SEQ ID NO: 6152435 - DNA, 19 bp, Homo sapiens
ctcgtggagctcgcccctc

SEQ ID NO: 6152436 - DNA, 13 bp, Homo sapiens
ctcgtggccagcc

SEQ ID NO: 6152437 - DNA, 16 bp, Homo sapiens
ctcgtggccagcccgg

SEQ ID NO: 6152438 - DNA, 19 bp, Homo sapiens
ctcgtggccagcccggctg

SEQ ID NO: 6152439 - DNA, 11 bp, Homo sapiens
ctcgtggcctt

SEQ ID NO: 6152440 - DNA, 18 bp, Homo sapiens
ctcgtggccttccccagc

SEQ ID NO: 6152441 - DNA, 23 bp, Homo sapiens
ctcgtggccttccccttttgcct

SEQ ID NO: 6152442 - DNA, 16 bp, Homo sapiens
ctcgtggcggggcagc

SEQ ID NO: 6152443 - DNA, 18 bp, Homo sapiens
ctcgtgggctctggctcc

SEQ ID NO: 6152444 - DNA, 15 bp, Homo sapiens
ctcgtgggcttgtgc

SEQ ID NO: 6152445 - DNA, 17 bp, Homo sapiens
ctcgtgggtcccagaga

SEQ ID NO: 6152446 - DNA, 16 bp, Homo sapiens
ctcgtggtaggactgt

SEQ ID NO: 6152447 - DNA, 17 bp, Homo sapiens
ctcgtggtaggactgta

SEQ ID NO: 6152448 - DNA, 21 bp, Homo sapiens
ctcgtggtaggactgtagaaa

SEQ ID NO: 6152449 - DNA, 20 bp, Homo sapiens
ctcgtggttattagcaaggc

SEQ ID NO: 6152450 - DNA, 21 bp, Homo sapiens
ctcgtgtacagctcccttccc

SEQ ID NO: 6152451 - DNA, 20 bp, Homo sapiens
ctcgtgtatcctggggctcc

SEQ ID NO: 6152452 - DNA, 18 bp, Homo sapiens
ctcgtgtcagtaatttat

SEQ ID NO: 6152453 - DNA, 14 bp, Homo sapiens
ctcgtgtcctgcta

SEQ ID NO: 6152454 - DNA, 16 bp, Homo sapiens
ctcgtgtcctgctagc

SEQ ID NO: 6152455 - DNA, 14 bp, Homo sapiens
ctcgtgtgatttcc

SEQ ID NO: 6152456 - DNA, 12 bp, Homo sapiens
ctcgtgtgcatg

SEQ ID NO: 6152457 - DNA, 15 bp, Homo sapiens
ctcgtgtgcccacca

SEQ ID NO: 6152458 - DNA, 17 bp, Homo sapiens
ctcgtgtgcccaccagc

SEQ ID NO: 6152459 - DNA, 16 bp, Homo sapiens
ctcgtgtgtcctcatg

SEQ ID NO: 6152460 - DNA, 13 bp, Homo sapiens
ctggattccagag

SEQ ID NO: 6152461 - DNA, 20 bp, Homo sapiens
ctggattccccatctcaggc

SEQ ID NO: 6152462 - DNA, 14 bp, Homo sapiens
ctggattcctgtca

SEQ ID NO: 6152463 - DNA, 19 bp, Homo sapiens
ctggattctgggaggcaag

SEQ ID NO: 6152464 - DNA, 12 bp, Homo sapiens
ctggattggcca

SEQ ID NO: 6152465 - DNA, 20 bp, Homo sapiens
ctggattggctataacatgt

SEQ ID NO: 6152466 - DNA, 23 bp, Homo sapiens
ctggattggttggcaaactaaag

SEQ ID NO: 6152467 - DNA, 17 bp, Homo sapiens
ctggattgtagaacttg

SEQ ID NO: 6152468 - DNA, 13 bp, Homo sapiens
ctggatttcttcc

SEQ ID NO: 6152469 - DNA, 20 bp, Homo sapiens
ctggatttgggagctctgct

SEQ ID NO: 6152470 - DNA, 23 bp, Homo sapiens
ctggatttgggagctctgcttgc

SEQ ID NO: 6152471 - DNA, 14 bp, Homo sapiens
ctggattttcaaag

SEQ ID NO: 6152472 - DNA, 12 bp, Homo sapiens
ctggattttcag

SEQ ID NO: 6152473 - DNA, 20 bp, Homo sapiens
ctggattttcagcgaacatg

SEQ ID NO: 6152474 - DNA, 17 bp, Homo sapiens
ctggattttctttctat

SEQ ID NO: 6152475 - DNA, 19 bp, Homo sapiens
ctggattttctttctatgt

SEQ ID NO: 6152476 - DNA, 15 bp, Homo sapiens
ctggattttgaatta

SEQ ID NO: 6152477 - DNA, 22 bp, Homo sapiens
ctggatttttacaaataaagat

SEQ ID NO: 6152478 - DNA, 15 bp, Homo sapiens
ctggatttttaccag

SEQ ID NO: 6152479 - DNA, 22 bp, Homo sapiens
ctggatttttttttctttatat

SEQ ID NO: 6152480 - DNA, 22 bp, Homo sapiens
ctggcaaaaatgcaacaaatga

SEQ ID NO: 6152481 - DNA, 23 bp, Homo sapiens
ctggcaaaaatgcaacaaatgaa

SEQ ID NO: 6152482 - DNA, 15 bp, Homo sapiens
ctggcaaaataaaac

SEQ ID NO: 6152483 - DNA, 23 bp, Homo sapiens
ctggcaaaatagttctgcaggtt

SEQ ID NO: 6152484 - DNA, 16 bp, Homo sapiens
ctggcaaacagggcct

SEQ ID NO: 6152485 - DNA, 19 bp, Homo sapiens
ctggcaaaccctcccagaa

SEQ ID NO: 6152486 - DNA, 20 bp, Homo sapiens
ctggcaaagaactcatttga

SEQ ID NO: 6152487 - DNA, 21 bp, Homo sapiens
ctggcaaagatagagaatgcc

SEQ ID NO: 6152488 - DNA, 16 bp, Homo sapiens
ctggcaaagcagaatg

SEQ ID NO: 6152489 - DNA, 19 bp, Homo sapiens
ctggcaaagcagaatgtga

SEQ ID NO: 6152490 - DNA, 19 bp, Homo sapiens
ctggcaaagcttttagaaa

SEQ ID NO: 6152491 - DNA, 13 bp, Homo sapiens
ctggcaaaggacc

SEQ ID NO: 6152492 - DNA, 14 bp, Homo sapiens
ctggcaaaggacca

SEQ ID NO: 6152493 - DNA, 19 bp, Homo sapiens
ctggcaaaggaccagcgtc

SEQ ID NO: 6152494 - DNA, 22 bp, Homo sapiens
ctggcaaaggacccttgagtaa

SEQ ID NO: 6152495 - DNA, 23 bp, Homo sapiens
ctggcaaaggctggctgtgtata

SEQ ID NO: 6152496 - DNA, 15 bp, Homo sapiens
ctggcaaataatact

SEQ ID NO: 6152497 - DNA, 22 bp, Homo sapiens
ctggcaaatgcacacacctcat

SEQ ID NO: 6152498 - DNA, 16 bp, Homo sapiens
ctggcaacacagaggc

SEQ ID NO: 6152499 - DNA, 15 bp, Homo sapiens
ctggcaacagagcga

SEQ ID NO: 6152500 - DNA, 22 bp, Homo sapiens
ctggcaacatagtgagatccca

SEQ ID NO: 6152501 - DNA, 14 bp, Homo sapiens
ctggcaacatcttt

SEQ ID NO: 6152502 - DNA, 17 bp, Homo sapiens
ctggcaagaaaagagtt

SEQ ID NO: 6152503 - DNA, 20 bp, Homo sapiens
ctggcaagaaccagttgttt

SEQ ID NO: 6152504 - DNA, 18 bp, Homo sapiens
ctggcaagagcagatact

SEQ ID NO: 6152505 - DNA, 13 bp, Homo sapiens
ctggcaagattga

SEQ ID NO: 6152506 - DNA, 13 bp, Homo sapiens
ctggcaagcaggg

SEQ ID NO: 6152507 - DNA, 14 bp, Homo sapiens
ctggcaagcaggga

SEQ ID NO: 6152508 - DNA, 17 bp, Homo sapiens
ctggcaagcagggaaag

SEQ ID NO: 6152509 - DNA, 22 bp, Homo sapiens
ctggcaagctagaacctggagg

SEQ ID NO: 6152510 - DNA, 22 bp, Homo sapiens
ctggcaagctgcaaaaggcctg

SEQ ID NO: 6152511 - DNA, 18 bp, Homo sapiens
ctggcaaggacagaggcg

SEQ ID NO: 6152512 - DNA, 19 bp, Homo sapiens
ctggcaaggcattcctcat

SEQ ID NO: 6152513 - DNA, 17 bp, Homo sapiens
ctggcaagtcggggcct

SEQ ID NO: 6152514 - DNA, 12 bp, Homo sapiens
ctggcaataaac

SEQ ID NO: 6152515 - DNA, 19 bp, Homo sapiens
ctggcaatagtgtgttctg

SEQ ID NO: 6152516 - DNA, 18 bp, Homo sapiens
ctggcaatcaatacagct

SEQ ID NO: 6152517 - DNA, 20 bp, Homo sapiens
ctggcaatcccaccaaatca

SEQ ID NO: 6152518 - DNA, 17 bp, Homo sapiens
ctggcaatcttgccctt

SEQ ID NO: 6152519 - DNA, 22 bp, Homo sapiens
ctggcaatgccctacctgcctg

SEQ ID NO: 6152520 - DNA, 20 bp, Homo sapiens
ctggcaattaccagaacaat

SEQ ID NO: 6152521 - DNA, 18 bp, Homo sapiens
ctggcaattgtctattta

SEQ ID NO: 6152522 - DNA, 22 bp, Homo sapiens
ctggcacaaaagacagctggcg

SEQ ID NO: 6152523 - DNA, 22 bp, Homo sapiens
ctggcacaacgctctaccctgc

SEQ ID NO: 6152524 - DNA, 17 bp, Homo sapiens
ctggcacacacccctcc

SEQ ID NO: 6152525 - DNA, 12 bp, Homo sapiens
ctggcacacatc

SEQ ID NO: 6152526 - DNA, 18 bp, Homo sapiens
ctggcacagaaagggcag

SEQ ID NO: 6152527 - DNA, 16 bp, Homo sapiens
ctggcacagaagagga

SEQ ID NO: 6152528 - DNA, 14 bp, Homo sapiens
ctggcacagaccag

SEQ ID NO: 6152529 - DNA, 17 bp, Homo sapiens
ctggcacagcccctgga

SEQ ID NO: 6152530 - DNA, 20 bp, Homo sapiens
ctggcacagcccctggagcc

SEQ ID NO: 6152531 - DNA, 15 bp, Homo sapiens
ctggcacagcctggc

SEQ ID NO: 6152532 - DNA, 15 bp, Homo sapiens
ctggcacaggactga

SEQ ID NO: 6152533 - DNA, 19 bp, Homo sapiens
ctggcacaggccgaggcag

SEQ ID NO: 6152534 - DNA, 20 bp, Homo sapiens
ctggcacagtgtctgggctg

SEQ ID NO: 6152535 - DNA, 21 bp, Homo sapiens
ctggcacagtgtctgggctga

SEQ ID NO: 6152536 - DNA, 20 bp, Homo sapiens
ctggcacagttttctgagaa

SEQ ID NO: 6152537 - DNA, 14 bp, Homo sapiens
ctggcacatcagaa

SEQ ID NO: 6152538 - DNA, 17 bp, Homo sapiens
ctggcacattgcccctc

SEQ ID NO: 6152539 - DNA, 19 bp, Homo sapiens
ctggcacattgcccctctg

SEQ ID NO: 6152540 - DNA, 13 bp, Homo sapiens
ctggcacatttca

SEQ ID NO: 6152541 - DNA, 19 bp, Homo sapiens
ctggcacatttccccagac

SEQ ID NO: 6152542 - DNA, 22 bp, Homo sapiens
ctggcacatttccccagacctg

SEQ ID NO: 6152543 - DNA, 11 bp, Homo sapiens
ctggcaccaca

SEQ ID NO: 6152544 - DNA, 18 bp, Homo sapiens
ctggcaccacactaggga

SEQ ID NO: 6152545 - DNA, 14 bp, Homo sapiens
ctggcaccagatga

SEQ ID NO: 6152546 - DNA, 17 bp, Homo sapiens
ctggcaccatcagcctg

SEQ ID NO: 6152547 - DNA, 14 bp, Homo sapiens
ctggcaccatggtg

SEQ ID NO: 6152548 - DNA, 19 bp, Homo sapiens
ctggcaccatgttggcctc

SEQ ID NO: 6152549 - DNA, 20 bp, Homo sapiens
ctggcaccatgttggcctct

SEQ ID NO: 6152550 - DNA, 13 bp, Homo sapiens
ctggcacccaccg

SEQ ID NO: 6152551 - DNA, 17 bp, Homo sapiens
ctggcacccaccgtctc

SEQ ID NO: 6152552 - DNA, 23 bp, Homo sapiens
ctggcacccaccgtctcggccct

SEQ ID NO: 6152553 - DNA, 19 bp, Homo sapiens
ctggcacccaccgtggagg

SEQ ID NO: 6152554 - DNA, 13 bp, Homo sapiens
ctggcacccactg

SEQ ID NO: 6152555 - DNA, 20 bp, Homo sapiens
ctggcacccggcccctgctg

SEQ ID NO: 6152556 - DNA, 17 bp, Homo sapiens
ctggcaccgccttctct

SEQ ID NO: 6152557 - DNA, 23 bp, Homo sapiens
ctggcacctgagtgtccttgctc

SEQ ID NO: 6152558 - DNA, 17 bp, Homo sapiens
ctggcacgaaatggctg

SEQ ID NO: 6152559 - DNA, 18 bp, Homo sapiens
ctggcacgccctactcca

SEQ ID NO: 6152560 - DNA, 21 bp, Homo sapiens
ctggcacgccctactccactg

SEQ ID NO: 6152561 - DNA, 15 bp, Homo sapiens
ctggcacgtcctcca

SEQ ID NO: 6152562 - DNA, 23 bp, Homo sapiens
ctggcacgtcctccaccggtgcc

SEQ ID NO: 6152563 - DNA, 19 bp, Homo sapiens
ctggcacgtgacaggctcg

SEQ ID NO: 6152564 - DNA, 16 bp, Homo sapiens
ctggcacgtggccagg

SEQ ID NO: 6152565 - DNA, 17 bp, Homo sapiens
ctggcacgtggccagga

SEQ ID NO: 6152566 - DNA, 15 bp, Homo sapiens
ctggcactataatgt

SEQ ID NO: 6152567 - DNA, 16 bp, Homo sapiens
ctggcactataatgta

SEQ ID NO: 6152568 - DNA, 23 bp, Homo sapiens
ctggcactataatgtaagctcta

SEQ ID NO: 6152569 - DNA, 12 bp, Homo sapiens
ctggcactgaca

SEQ ID NO: 6152570 - DNA, 14 bp, Homo sapiens
ctggcactgacagc

SEQ ID NO: 6152571 - DNA, 15 bp, Homo sapiens
ctggcactgacagcc

SEQ ID NO: 6152572 - DNA, 20 bp, Homo sapiens
ctggcactgactgggcatag

SEQ ID NO: 6152573 - DNA, 20 bp, Homo sapiens
ctggcactgcgatcaggaag

SEQ ID NO: 6152574 - DNA, 13 bp, Homo sapiens
ctggcactgctgt

SEQ ID NO: 6152575 - DNA, 14 bp, Homo sapiens
ctggcactgctgtg

SEQ ID NO: 6152576 - DNA, 16 bp, Homo sapiens
ctggcactgctgtgct

SEQ ID NO: 6152577 - DNA, 14 bp, Homo sapiens
ctggcactgcttcc

SEQ ID NO: 6152578 - DNA, 16 bp, Homo sapiens
ctggcactgcttccag

SEQ ID NO: 6152579 - DNA, 20 bp, Homo sapiens
ctggcactgcttccagtgag

SEQ ID NO: 6152580 - DNA, 16 bp, Homo sapiens
ctggcactgtggcact

SEQ ID NO: 6152581 - DNA, 23 bp, Homo sapiens
ctggcactgtggcactgccacca

SEQ ID NO: 6152582 - DNA, 16 bp, Homo sapiens
ctggcacttactggtc

SEQ ID NO: 6152583 - DNA, 23 bp, Homo sapiens
ctggcacttactggtccttacca

SEQ ID NO: 6152584 - DNA, 16 bp, Homo sapiens
ctggcacttccattgg

SEQ ID NO: 6152585 - DNA, 14 bp, Homo sapiens
ctggcacttgcctg

SEQ ID NO: 6152586 - DNA, 16 bp, Homo sapiens
ctggcacttgcctgct

SEQ ID NO: 6152587 - DNA, 22 bp, Homo sapiens
ctggcactttaatgataaaatc

SEQ ID NO: 6152588 - DNA, 12 bp, Homo sapiens
ctggcacttttt

SEQ ID NO: 6152589 - DNA, 21 bp, Homo sapiens
ctggcagaaagcaaatgtgac

SEQ ID NO: 6152590 - DNA, 16 bp, Homo sapiens
ctggcagaactgagct

SEQ ID NO: 6152591 - DNA, 12 bp, Homo sapiens
ctggcagaagca

SEQ ID NO: 6152592 - DNA, 13 bp, Homo sapiens
ctggcagaagcat

SEQ ID NO: 6152593 - DNA, 22 bp, Homo sapiens
ctggcagaagcattgcctggac

SEQ ID NO: 6152594 - DNA, 13 bp, Homo sapiens
ctggcagaaggga

SEQ ID NO: 6152595 - DNA, 16 bp, Homo sapiens
ctggcagaagggagca

SEQ ID NO: 6152596 - DNA, 23 bp, Homo sapiens
ctggcagaatgctagctctgagc

SEQ ID NO: 6152597 - DNA, 23 bp, Homo sapiens
ctggcagactcaaggggctggaa

SEQ ID NO: 6152598 - DNA, 15 bp, Homo sapiens
ctggcagactgtgta

SEQ ID NO: 6152599 - DNA, 12 bp, Homo sapiens
ctggcagagaag

SEQ ID NO: 6152600 - DNA, 13 bp, Homo sapiens
ctggcagagaaga

SEQ ID NO: 6152601 - DNA, 14 bp, Homo sapiens
ctggcagagaagag

SEQ ID NO: 6152602 - DNA, 15 bp, Homo sapiens
ctggcagagaaggat

SEQ ID NO: 6152603 - DNA, 17 bp, Homo sapiens
ctggcagagaaggatgt

SEQ ID NO: 6152604 - DNA, 15 bp, Homo sapiens
ctggcagagaaggct

SEQ ID NO: 6152605 - DNA, 16 bp, Homo sapiens
ctggcagagaaggctt

SEQ ID NO: 6152606 - DNA, 22 bp, Homo sapiens
ctggcagagaaggcttcctcca

SEQ ID NO: 6152607 - DNA, 19 bp, Homo sapiens
ctggcagagagcacagtga

SEQ ID NO: 6152608 - DNA, 20 bp, Homo sapiens
ctggcagagaggtaaagggt

SEQ ID NO: 6152609 - DNA, 22 bp, Homo sapiens
ctggcagagaggtaaagggtgg

SEQ ID NO: 6152610 - DNA, 16 bp, Homo sapiens
ctggcagagcacagcc

SEQ ID NO: 6152611 - DNA, 17 bp, Homo sapiens
ctggcagatgagggctg

SEQ ID NO: 6152612 - DNA, 15 bp, Homo sapiens
ctggcagattcaaat

SEQ ID NO: 6152613 - DNA, 19 bp, Homo sapiens
ctggcagcaaactgctgcc

SEQ ID NO: 6152614 - DNA, 18 bp, Homo sapiens
ctggcagcacagcccagg

SEQ ID NO: 6152615 - DNA, 19 bp, Homo sapiens
ctggcagcacagcccaggg

SEQ ID NO: 6152616 - DNA, 22 bp, Homo sapiens
ctggcagccacacttctcagga

SEQ ID NO: 6152617 - DNA, 23 bp, Homo sapiens
ctggcagccacacttctcaggac

SEQ ID NO: 6152618 - DNA, 15 bp, Homo sapiens
ctggcagccagggag

SEQ ID NO: 6152619 - DNA, 12 bp, Homo sapiens
ctggcagcccag

SEQ ID NO: 6152620 - DNA, 13 bp, Homo sapiens
ctggcagcccaga

SEQ ID NO: 6152621 - DNA, 16 bp, Homo sapiens
ctggcagccccagcac

SEQ ID NO: 6152622 - DNA, 18 bp, Homo sapiens
ctggcagccccagcacca

SEQ ID NO: 6152623 - DNA, 13 bp, Homo sapiens
ctggcagccgtgc

SEQ ID NO: 6152624 - DNA, 17 bp, Homo sapiens
ctggcagccgtgccttc

SEQ ID NO: 6152625 - DNA, 18 bp, Homo sapiens
ctggcagccgtgccttca

SEQ ID NO: 6152626 - DNA, 19 bp, Homo sapiens
ctggcagccgtgccttcag

SEQ ID NO: 6152627 - DNA, 15 bp, Homo sapiens
ctggcagcctcagag

SEQ ID NO: 6152628 - DNA, 16 bp, Homo sapiens
ctggcagcctcagagg

SEQ ID NO: 6152629 - DNA, 15 bp, Homo sapiens
ctggcagcctccagt

SEQ ID NO: 6152630 - DNA, 14 bp, Homo sapiens
ctggcagcctccca

SEQ ID NO: 6152631 - DNA, 13 bp, Homo sapiens
ctggcagctcaga

SEQ ID NO: 6152632 - DNA, 17 bp, Homo sapiens
ctggcagctcagcttcc

SEQ ID NO: 6152633 - DNA, 19 bp, Homo sapiens
ctggcagctcctctccttg

SEQ ID NO: 6152634 - DNA, 23 bp, Homo sapiens
ctggcagctcctctccttgggct

SEQ ID NO: 6152635 - DNA, 14 bp, Homo sapiens
ctggcagctctcca

SEQ ID NO: 6152636 - DNA, 18 bp, Homo sapiens
ctggcagctctccagtca

SEQ ID NO: 6152637 - DNA, 12 bp, Homo sapiens
ctggcagctctg

SEQ ID NO: 6152638 - DNA, 15 bp, Homo sapiens
ctggcagctgagagc

SEQ ID NO: 6152639 - DNA, 23 bp, Homo sapiens
ctcgtgttattttaatctcagaa

SEQ ID NO: 6152640 - DNA, 14 bp, Homo sapiens
ctcgtgttcgctgg

SEQ ID NO: 6152641 - DNA, 20 bp, Homo sapiens
ctcgtgtttgcttaaaatat

SEQ ID NO: 6152642 - DNA, 23 bp, Homo sapiens
ctcgtgtttgcttaaaatatgtg

SEQ ID NO: 6152643 - DNA, 20 bp, Homo sapiens
ctcgttaacacatggcttcc

SEQ ID NO: 6152644 - DNA, 22 bp, Homo sapiens
ctcgttaacacatggcttccta

SEQ ID NO: 6152645 - DNA, 18 bp, Homo sapiens
ctcgttaattttcctttg

SEQ ID NO: 6152646 - DNA, 14 bp, Homo sapiens
ctcgttacctgccg

SEQ ID NO: 6152647 - DNA, 19 bp, Homo sapiens
ctcgttacttcagcccatg

SEQ ID NO: 6152648 - DNA, 23 bp, Homo sapiens
ctcgttagagaatggcctgagac

SEQ ID NO: 6152649 - DNA, 22 bp, Homo sapiens
ctcgttagggaagagaaacagg

SEQ ID NO: 6152650 - DNA, 20 bp, Homo sapiens
ctcgttcaaaacattccaag

SEQ ID NO: 6152651 - DNA, 17 bp, Homo sapiens
ctcgttcccatagattt

SEQ ID NO: 6152652 - DNA, 13 bp, Homo sapiens
ctcgttccggtcc

SEQ ID NO: 6152653 - DNA, 13 bp, Homo sapiens
ctcgttctccttc

SEQ ID NO: 6152654 - DNA, 14 bp, Homo sapiens
ctcgttctccttcc

SEQ ID NO: 6152655 - DNA, 20 bp, Homo sapiens
ctcgttgactggctgtgtgt

SEQ ID NO: 6152656 - DNA, 22 bp, Homo sapiens
ctcgttgccctaattcatcttt

SEQ ID NO: 6152657 - DNA, 22 bp, Homo sapiens
ctcgttgggccgctctgatttc

SEQ ID NO: 6152658 - DNA, 16 bp, Homo sapiens
ctcgttgtcacaccca

SEQ ID NO: 6152659 - DNA, 18 bp, Homo sapiens
ctcgtttacactgcacat

SEQ ID NO: 6152660 - DNA, 17 bp, Homo sapiens
ctcgtttctctcaattt

SEQ ID NO: 6152661 - DNA, 14 bp, Homo sapiens
ctcgtttctgccca

SEQ ID NO: 6152662 - DNA, 13 bp, Homo sapiens
ctcgtttgtgatt

SEQ ID NO: 6152663 - DNA, 14 bp, Homo sapiens
ctcgttttcaaaga

SEQ ID NO: 6152664 - DNA, 16 bp, Homo sapiens
ctcgtttttcagcacc

SEQ ID NO: 6152665 - DNA, 20 bp, Homo sapiens
ctcgtttttcagcaccccca

SEQ ID NO: 6152666 - DNA, 14 bp, Homo sapiens
ctctaaaaatagaa

SEQ ID NO: 6152667 - DNA, 19 bp, Homo sapiens
ctctaaaacagattgcttt

SEQ ID NO: 6152668 - DNA, 18 bp, Homo sapiens
ctctaaaacatagactga

SEQ ID NO: 6152669 - DNA, 23 bp, Homo sapiens
ctctaaaacatagactgaagatt

SEQ ID NO: 6152670 - DNA, 20 bp, Homo sapiens
ctctaaaactatcagcagcg

SEQ ID NO: 6152671 - DNA, 13 bp, Homo sapiens
ctctaaaagatcc

SEQ ID NO: 6152672 - DNA, 13 bp, Homo sapiens
ctctaaaagcacc

SEQ ID NO: 6152673 - DNA, 21 bp, Homo sapiens
ctctaaaatatttatgaagaa

SEQ ID NO: 6152674 - DNA, 19 bp, Homo sapiens
ctctaaaatggacattttc

SEQ ID NO: 6152675 - DNA, 14 bp, Homo sapiens
ctctaaaattctag

SEQ ID NO: 6152676 - DNA, 19 bp, Homo sapiens
ctctaaacccaaataaatg

SEQ ID NO: 6152677 - DNA, 19 bp, Homo sapiens
ctctaaacccacatattga

SEQ ID NO: 6152678 - DNA, 13 bp, Homo sapiens
ctctaaactgcaa

SEQ ID NO: 6152679 - DNA, 22 bp, Homo sapiens
ctctaaactgcaaacagaaatc

SEQ ID NO: 6152680 - DNA, 19 bp, Homo sapiens
ctctaaactggcatctgct

SEQ ID NO: 6152681 - DNA, 22 bp, Homo sapiens
ctctaaactggcatctgctcta

SEQ ID NO: 6152682 - DNA, 11 bp, Homo sapiens
ctctaaactgt

SEQ ID NO: 6152683 - DNA, 16 bp, Homo sapiens
ctctaaagaaacttgg

SEQ ID NO: 6152684 - DNA, 20 bp, Homo sapiens
ctctaaagaaacttggctgg

SEQ ID NO: 6152685 - DNA, 17 bp, Homo sapiens
ctctaaagaccaaactt

SEQ ID NO: 6152686 - DNA, 14 bp, Homo sapiens
ctctaaagagcatc

SEQ ID NO: 6152687 - DNA, 16 bp, Homo sapiens
ctctaaagcaaattta

SEQ ID NO: 6152688 - DNA, 19 bp, Homo sapiens
ctctaaataaagacgacta

SEQ ID NO: 6152689 - DNA, 15 bp, Homo sapiens
ctctaaatatttcat

SEQ ID NO: 6152690 - DNA, 19 bp, Homo sapiens
ctctaaatcttccttgtga

SEQ ID NO: 6152691 - DNA, 23 bp, Homo sapiens
ctctaaattaaagagaaaattga

SEQ ID NO: 6152692 - DNA, 13 bp, Homo sapiens
ctctaaattcttt

SEQ ID NO: 6152693 - DNA, 19 bp, Homo sapiens
ctctaaattctttatttct

SEQ ID NO: 6152694 - DNA, 21 bp, Homo sapiens
ctctaacaatgtattttcttc

SEQ ID NO: 6152695 - DNA, 19 bp, Homo sapiens
ctctaacaccacactgacc

SEQ ID NO: 6152696 - DNA, 22 bp, Homo sapiens
ctctaacaccacactgaccaca

SEQ ID NO: 6152697 - DNA, 14 bp, Homo sapiens
ctctaacagccctc

SEQ ID NO: 6152698 - DNA, 16 bp, Homo sapiens
ctctaacagctcagga

SEQ ID NO: 6152699 - DNA, 18 bp, Homo sapiens
ctctaacagctcaggatc

SEQ ID NO: 6152700 - DNA, 14 bp, Homo sapiens
ctctaacaggcact

SEQ ID NO: 6152701 - DNA, 18 bp, Homo sapiens
ctctaacattactgcctt

SEQ ID NO: 6152702 - DNA, 22 bp, Homo sapiens
ctctaacatttgcaaaatggaa

SEQ ID NO: 6152703 - DNA, 21 bp, Homo sapiens
ctctaaccaaggctgtgttta

SEQ ID NO: 6152704 - DNA, 18 bp, Homo sapiens
ctctaaccattcaaatga

SEQ ID NO: 6152705 - DNA, 23 bp, Homo sapiens
ctctaacccccagtgccacagag

SEQ ID NO: 6152706 - DNA, 15 bp, Homo sapiens
ctctaaccctaggca

SEQ ID NO: 6152707 - DNA, 13 bp, Homo sapiens
ctctaaccctcat

SEQ ID NO: 6152708 - DNA, 19 bp, Homo sapiens
ctctaaccctcattgctgt

SEQ ID NO: 6152709 - DNA, 17 bp, Homo sapiens
ctctaacctcgccctct

SEQ ID NO: 6152710 - DNA, 19 bp, Homo sapiens
ctctaacctcgccctctcc

SEQ ID NO: 6152711 - DNA, 17 bp, Homo sapiens
ctctaacgcctgagccc

SEQ ID NO: 6152712 - DNA, 22 bp, Homo sapiens
ctctaacgcctgagcccaggga

SEQ ID NO: 6152713 - DNA, 15 bp, Homo sapiens
ctctaactccctcct

SEQ ID NO: 6152714 - DNA, 17 bp, Homo sapiens
ctctaactccctcctca

SEQ ID NO: 6152715 - DNA, 18 bp, Homo sapiens
ctctaactgattcagggc

SEQ ID NO: 6152716 - DNA, 18 bp, Homo sapiens
ctctaactggacagcctc

SEQ ID NO: 6152717 - DNA, 20 bp, Homo sapiens
ctctaactgtatatttgtat

SEQ ID NO: 6152718 - DNA, 21 bp, Homo sapiens
ctctaactgtatatttgtatg

SEQ ID NO: 6152719 - DNA, 15 bp, Homo sapiens
ctctaactgtgcaaa

SEQ ID NO: 6152720 - DNA, 15 bp, Homo sapiens
ctctaagaaaagaga

SEQ ID NO: 6152721 - DNA, 18 bp, Homo sapiens
ctctaagaaaagagagga

SEQ ID NO: 6152722 - DNA, 18 bp, Homo sapiens
ctctaagaggctcctaca

SEQ ID NO: 6152723 - DNA, 13 bp, Homo sapiens
ctctaagatgaat

SEQ ID NO: 6152724 - DNA, 16 bp, Homo sapiens
ctctaagcagccagga

SEQ ID NO: 6152725 - DNA, 21 bp, Homo sapiens
ctctaagccacagcttcttca

SEQ ID NO: 6152726 - DNA, 13 bp, Homo sapiens
ctctaagccactc

SEQ ID NO: 6152727 - DNA, 17 bp, Homo sapiens
ctctaagcccaggatct

SEQ ID NO: 6152728 - DNA, 22 bp, Homo sapiens
ctctaagcccaggatctctttc

SEQ ID NO: 6152729 - DNA, 21 bp, Homo sapiens
ctctaagcgtgctgacatcag

SEQ ID NO: 6152730 - DNA, 15 bp, Homo sapiens
ctctaagctggagct

SEQ ID NO: 6152731 - DNA, 20 bp, Homo sapiens
ctctaagctggagctcttgg

SEQ ID NO: 6152732 - DNA, 13 bp, Homo sapiens
ctctaagctgtgt

SEQ ID NO: 6152733 - DNA, 14 bp, Homo sapiens
ctctaagctgtgtg

SEQ ID NO: 6152734 - DNA, 15 bp, Homo sapiens
ctctaaggccaaggc

SEQ ID NO: 6152735 - DNA, 22 bp, Homo sapiens
ctctaaggccaaggcctcagga

SEQ ID NO: 6152736 - DNA, 23 bp, Homo sapiens
ctctaaggccaaggcctcaggag

SEQ ID NO: 6152737 - DNA, 16 bp, Homo sapiens
ctctaaggtactgtgg

SEQ ID NO: 6152738 - DNA, 23 bp, Homo sapiens
ctctaagtatattatatggcagg

SEQ ID NO: 6152739 - DNA, 21 bp, Homo sapiens
ctctaagtcatgtatgtttct

SEQ ID NO: 6152740 - DNA, 18 bp, Homo sapiens
ctctaagtgggcattgcc

SEQ ID NO: 6152741 - DNA, 19 bp, Homo sapiens
ctctaagtgggcattgcca

SEQ ID NO: 6152742 - DNA, 20 bp, Homo sapiens
ctctaagtgggcattgccat

SEQ ID NO: 6152743 - DNA, 22 bp, Homo sapiens
ctctaagttatgactgtgaaat

SEQ ID NO: 6152744 - DNA, 16 bp, Homo sapiens
ctctaagttccactga

SEQ ID NO: 6152745 - DNA, 21 bp, Homo sapiens
ctctaataaagctcctctgct

SEQ ID NO: 6152746 - DNA, 18 bp, Homo sapiens
ctctaataagtttgtgtt

SEQ ID NO: 6152747 - DNA, 20 bp, Homo sapiens
ctctaatagaaaagtctcca

SEQ ID NO: 6152748 - DNA, 23 bp, Homo sapiens
ctctaatagcgaggctctaacca

SEQ ID NO: 6152749 - DNA, 18 bp, Homo sapiens
ctctaatattgcttcttg

SEQ ID NO: 6152750 - DNA, 12 bp, Homo sapiens
ctctaatattgg

SEQ ID NO: 6152751 - DNA, 14 bp, Homo sapiens
ctctaatcagtcct

SEQ ID NO: 6152752 - DNA, 21 bp, Homo sapiens
ctctaatctgagctgcagcct

SEQ ID NO: 6152753 - DNA, 13 bp, Homo sapiens
ctctaatctggat

SEQ ID NO: 6152754 - DNA, 21 bp, Homo sapiens
ctctaatgtaacttcctctta

SEQ ID NO: 6152755 - DNA, 16 bp, Homo sapiens
ctctaatgttgtatca

SEQ ID NO: 6152756 - DNA, 17 bp, Homo sapiens
ctctaatgttgtatcat

SEQ ID NO: 6152757 - DNA, 13 bp, Homo sapiens
ctctaattaaaat

SEQ ID NO: 6152758 - DNA, 20 bp, Homo sapiens
ctctaattagaaatttatat

SEQ ID NO: 6152759 - DNA, 22 bp, Homo sapiens
ctctaattccttaccccagctg

SEQ ID NO: 6152760 - DNA, 17 bp, Homo sapiens
ctctaattcttcctttg

SEQ ID NO: 6152761 - DNA, 14 bp, Homo sapiens
ctctaattgattca

SEQ ID NO: 6152762 - DNA, 15 bp, Homo sapiens
ctctaattgctgcca

SEQ ID NO: 6152763 - DNA, 16 bp, Homo sapiens
ctctaatttattttgt

SEQ ID NO: 6152764 - DNA, 17 bp, Homo sapiens
ctctacaactgagtcct

SEQ ID NO: 6152765 - DNA, 14 bp, Homo sapiens
ctctacaattcctc

SEQ ID NO: 6152766 - DNA, 16 bp, Homo sapiens
ctctacacaacatgta

SEQ ID NO: 6152767 - DNA, 23 bp, Homo sapiens
ctctacacaacatgtatgtggat

SEQ ID NO: 6152768 - DNA, 20 bp, Homo sapiens
ctctacacggactgaggtgc

SEQ ID NO: 6152769 - DNA, 23 bp, Homo sapiens
ctctacacggactgaggtgcctg

SEQ ID NO: 6152770 - DNA, 14 bp, Homo sapiens
ctctacactaaggg

SEQ ID NO: 6152771 - DNA, 18 bp, Homo sapiens
ctctacagagcttccctg

SEQ ID NO: 6152772 - DNA, 19 bp, Homo sapiens
ctctacagaggccatgggc

SEQ ID NO: 6152773 - DNA, 23 bp, Homo sapiens
ctctacagatggcatacctgtgc

SEQ ID NO: 6152774 - DNA, 12 bp, Homo sapiens
ctctacaggcct

SEQ ID NO: 6152775 - DNA, 13 bp, Homo sapiens
ctctacaggcctg

SEQ ID NO: 6152776 - DNA, 17 bp, Homo sapiens
ctctacaggcctgcagc

SEQ ID NO: 6152777 - DNA, 20 bp, Homo sapiens
ctctacaggcctgcagcccc

SEQ ID NO: 6152778 - DNA, 18 bp, Homo sapiens
ctctacatcttctgcctt

SEQ ID NO: 6152779 - DNA, 20 bp, Homo sapiens
ctctacattctgctctgccc

SEQ ID NO: 6152780 - DNA, 16 bp, Homo sapiens
ctctaccaaatagtga

SEQ ID NO: 6152781 - DNA, 21 bp, Homo sapiens
ctctaccagataactgaggag

SEQ ID NO: 6152782 - DNA, 16 bp, Homo sapiens
ctctaccagtctattt

SEQ ID NO: 6152783 - DNA, 17 bp, Homo sapiens
ctctaccagttggcaga

SEQ ID NO: 6152784 - DNA, 17 bp, Homo sapiens
ctctacccaaaccctag

SEQ ID NO: 6152785 - DNA, 18 bp, Homo sapiens
ctctacccaaaccctagg

SEQ ID NO: 6152786 - DNA, 13 bp, Homo sapiens
ctctacccagggc

SEQ ID NO: 6152787 - DNA, 17 bp, Homo sapiens
ctctacccagggcctgc
